United States Patent 9,254,311 (MODIFIED POLYNUCLEOTIDES FOR THE PRODUCTION OF PROTEINS) - sequence listing, part 10

SEQ ID NO: 17868 - DNA, 684 bp, Artificial Sequence
  Description of Artificial Sequence: Synthetic coding sequence
atgtaccagggcgagttcggcctgaacatgaagctgggctacggcaagttcagctggcccaccggcgagagctaccacggccagttctacagagaccactgccacggcctgggcacctacatgtggcccgacggcagcagcttcaccggcaccttctacctgagccacagagagggctacggcaccatgtacatgaagaccagactgttccagggcctgtacaaggccgaccagagattcggccccggcgtggagacctaccccgacggcagccaggacgtgggcctgtggttcagagagcagctgatcaagctgtgcacccagatccccagcggcttcagcctgctgagataccccgagttcagcagcttcatcacccacagccccgccagaatcagcctgagcgaggaggagaagaccgagtggggcctgcaggagggccaggaccccttcttctacgactacaagagattcctgctgaacgacaacctgaccctgccccccgagatgtacgtgtacagcaccaacagcgaccacctgcccatgaccagcagcttcagaaaggagctggacgccagaatcttcctgaacgagatcccccccttcgtggaggacggcgagccctggttcatcatcaacgagacccccctgctggtgaagatccagaagcagacctacaagtag

SEQ ID NO: 17869 - DNA, 1020 bp, Artificial Sequence
  Description of Artificial Sequence: Synthetic coding sequence
atgagagacgtgagcgccgcccccgagaaggaggaggaggaggccgagggccccctgagagcccaggacctgagagagagctacatccagctggtgcagggcgtgcaggagtggcaggacggctgcatgtaccagggcgagttcggcctgaacatgaagctgggctacggcaagttcagctggcccaccggcgagagctaccacggccagttctacagagaccactgccacggcctgggcacctacatgtggcccgacggcagcagcttcaccggcaccttctacctgagccacagagagggctacggcaccatgtacatgaagaccagactgttccagacccactgccacaacgacatcgtgaacctgctgctggactgcggcgccgacgtgaacaagtgcagcgacgagggcctgaccgccctgagcatgtgcttcctgctgcactaccccgcccagagcttcaagcccaacgtggccgagagaaccatccccgagccccaggagccccccaagttccccgtggtgcccatcctgagcagcagcttcatggacaccaacctggagagcctgtactacgaggtgaacgtgcccagccagggcagctacgagctgagacccccccccgcccccctgctgctgcccagagtgagcggcagccacgagggcggccacttccaggacaccggccagtgcggcggcagcatcgaccacagaagcagcagcctgaagggcgacagccccctggtgaagggcagcctgggccacgtggagagcggcctggaggacgtgctgggcaacaccgacagaggcagcctgtgcagcgccgagaccaagttcgagagcaacgtgtgcgtgtgcgacttcagcatcgagctgagccaggccatgctggagagaagcgcccagagccacagcctgctgaagatggccagccccagcccctgcaccagcagcttcgacaagggcaccatgagaagaatggccctgagcatgatcgagagctgcagcctgctgtag

SEQ ID NO: 17870 - DNA, 741 bp, Artificial Sequence
  Description of Artificial Sequence: Synthetic coding sequence
atgtaccagggcgagttcggcctgaacatgaagctgggctacggcaagttcagctggcccaccggcgagagctaccacggccagttctacagagaccactgccacggcctgggcacctacatgtggcccgacggcagcagcttcaccggcaccttctacctgagccacagagagggctacggcaccatgtacatgaagaccagactgttccagggcctgtacaaggccgaccagagattcggccccggcgtggagacctaccccgacggcagccaggacgtgggcctgtggttcagagagcagctgatcaagctgtgcacccagatccccagcggcttcagcctgctgagataccccgagttcagcagcttcatcacccacagccccgccagaatcagcctgagcgaggaggagaagaccgagtggggcctgcaggagggccaggaccccttcttctacgactacaagagattcctgctgaacgacaacctgaccctgccccccgagatgtacgtgtacagcaccaacagcgaccacctgcccatgaccagcagcttcagaaaggagctggacgccagaatcttcctgaacgagatcccccccttcgtggaggacggcgagccctggttcatcatcaacgagacccccctgctggtgaagatccagaagcagacctacaagttcagactgaccgccaccaccaccctgagcaccttcagctggaccgtgggccccacctag

SEQ ID NO: 17871 - DNA, 1326 bp, Artificial Sequence
  Description of Artificial Sequence: Synthetic coding sequence
atggtgcacatcaagaagggcgagctgacccaggaggagaaggagctgctggaggtgatcggcaagggcaccgtgcaggaggccggcaccctgctgagcagcaagaacgtgagagtgaactgcctggacgagaacggcatgacccccctgatgcacgccgcctacaagggcaagctggacatgtgcaagctgctgctgagacacggcgccgacgtgaactgccaccagcacgagcacggctacaccgccctgatgttcgccgccctgagcggcaacaaggacatcacctgggtgatgctggaggccggcgccgagaccgacgtggtgaacagcgtgggcagaaccgccgcccagatggccgccttcgtgggccagcacgactgcgtgaccatcatcaacaacttcttccccagagagagactggactactacaccaagccccagggcctggacaaggagcccaagctgccccccaagctggccggccccctgcacaagatcatcaccaccaccaacctgcaccccgtgaagatcgtgatgctggtgaacgagaaccccctgctgaccgaggaggccgccctgaacaagtgctacagagtgatggacctgatctgcgagaagtgcatgaagcagagagacatgaacgaggtgctggccatgaagatgcactacatcagctgcatcttccagaagtgcatcaacttcctgaaggacggcgagaacaagctggacaccctgatcaagagcctgctgaagggcagagccagcgacggcttccccgtgtaccaggagaagatcatcagagagagcatcagaaagttcccctactgcgaggccaccctgctgcagcagctggtgagaagcatcgcccccgtggagatcggcagcgaccccaccgccttcagcgtgctgacccaggccatcaccggccaggtgggcttcgtggacgtggagttctgcaccacctgcggcgagaagggcgccagcaagagatgcagcgtgtgcaagatggtgatctactgcgaccagacctgccagaagacccactggttcacccacaagaagatctgcaagaacctgaaggacatctacgagaagcagcagctggaggccgccaaggagaagagacaggaggagaaccacggcaagctggacgtgaacagcaactgcgtgaacgaggagcagcccgaggccgaggtgggcatcagccagaaggacagcaaccccgaggacagcggcgagggcaagaaggagagcctggagagcgaggccgagctggagggcctgcaggacgcccccgccggcccccaggtgagcgaggagtag

SEQ ID NO: 17872 - DNA, 1290 bp, Artificial Sequence
  Description of Artificial Sequence: Synthetic coding sequence
atgctgatgagctggagccccgaggagtgcaagggccagggcgagcccctggacgacagacaccccctgtgcgccagactggtggagaagcccagcagaggcagcgaggagcacctgaagagcggccccggccccatcgtgaccagaaccgccagcggccccgccctggccttctggcaggccgtgctggccggcgacgtgggctgcgtgagcagaatcctggccgacagcagcaccggcctggcccccgacagcgtgttcgacaccagcgaccccgagagatggagagacttcagattcaacatcagagccctgagactgtggagcctgacctacgaggaggagctgaccacccccctgcacgtggccgccagcagaggccacaccgaggtgctgagactgctgctgagaagaagagccagacccgacagcgcccccggcggcagaaccgccctgcacgaggcctgcgccgccggccacaccgcctgcgtgcacgtgctgctggtggccggcgccgaccccaacatcgccgaccaggacggcaagagacccctgcacctgtgcagaggccccggcaccctggagtgcgccgagctgctgctgagattcggcgccagagtggacggcagaagcgaggaggaggaggagacccccctgcacgtggccgccagactgggccacgtggagctggccgacctgctgctgagaagaggcgcctgccccgacgccagaaacgccgagggctggacccccctgctggccgcctgcgacgtgagatgccagagcatcaccgacgccgaggccaccaccgccagatgcctgcagctgtgcagcctgctgctgagcgccggcgccgacgccgacgccgccgaccaggacaagcagagacccctgcacctggcctgcagaagaggccacgccgccgtggtggagctgctgctgagctgcggcgtgagcgccaacaccatggactacggcggccacacccccctgcactgcgccctgcagggccccgccgccgccctggcccagagccccgagcacgtggtgagagccctgctgaaccacggcgccgtgagagtgtggcccggcgccctgcccaagaagcaccagagattctacagcagcctgttcgccctggtgagacagcccagaagcctgcagcacctgagcagatgcgccctgagaagccacctggagggcagcctgccccaggccctgcccagactgcccctgccccccagactgctgagatacctgcagctggacttcgagggcgtgctgtactag

SEQ ID NO: 17873 - DNA, 1359 bp, Artificial Sequence
  Description of Artificial Sequence: Synthetic coding sequence
atgccctggggcaagaacagcagcccccactggggccaccacctgggctgcctgcccagcgcccccgcctgcagaatctggagaccccacagcagacccgcctgggagccccccagacccagccccctgctgtgccaggacatggccctgcagaacgccctgtacaccggcgacctggccagactgcaggagctgttccccccccacagcaccgccgacctgctgctggagagcagagccgccgagcccagatggagcagccaccagagaggcctgtggagcctgacctacgaggaggagctgaccacccccctgcacgtggccgccagcagaggccacaccgaggtgctgagactgctgctgagaagaagagccagacccgacagcgcccccggcggcagaaccgccctgcacgaggcctgcgccgccggccacaccgcctgcgtgcacgtgctgctggtggccggcgccgaccccaacatcgccgaccaggacggcaagagacccctgcacctgtgcagaggccccggcaccctggagtgcgccgagctgctgctgagattcggcgccagagtggacggcagaagcgaggaggaggaggagacccccctgcacgtggccgccagactgggccacgtggagctggccgacctgctgctgagaagaggcgcctgccccgacgccagaaacgccgagggctggacccccctgctggccgcctgcgacgtgagatgccagagcatcaccgacgccgaggccaccaccgccagatgcctgcagctgtgcagcctgctgctgagcgccggcgccgacgccgacgccgccgaccaggacaagcagagacccctgcacctggcctgcagaagaggccacgccgccgtggtggagctgctgctgagctgcggcgtgagcgccaacaccatggactacggcggccacacccccctgcactgcgccctgcagggccccgccgccgccctggcccagagccccgagcacgtggtgagagccctgctgaaccacggcgccgtgagagtgtggcccggcgccctgcccaaggtgctggagagatggagcacctgccccagaaccatcgaggtgctgatgaacacctacagcgtggtgcagctgcccgaggaggccgtgggcctggtgacccccgagaccctgcagaagcaccagagattctacagcagcctgttcgccctggtgagacagcccagaagcctgcagcacctgagcagatgcgccctgagaagccacctggagggcagcctgccccaggccctgcccagactgcccctgccccccagactgctgagatacctgcagctggacttcgagggcgtgctgtactag

SEQ ID NO: 17874 - DNA, 1404 bp, Artificial Sequence
  Description of Artificial Sequence: Synthetic coding sequence
atgctgatgagctggagccccgaggagtgcaagggccagggcgagcccctggacgacagacaccccctgtgcgccagactggtggagaagcccagcagaggcagcgaggagcacctgaagagcggccccggccccatcgtgaccagaaccgccagcggccccgccctggccttctggcaggccgtgctggccggcgacgtgggctgcgtgagcagaatcctggccgacagcagcaccggcctggcccccgacagcgtgttcgacaccagcgaccccgagagatggagagacttcagattcaacatcagagccctgagactgtggagcctgacctacgaggaggagctgaccacccccctgcacgtggccgccagcagaggccacaccgaggtgctgagactgctgctgagaagaagagccagacccgacagcgcccccggcggcagaaccgccctgcacgaggcctgcgccgccggccacaccgcctgcgtgcacgtgctgctggtggccggcgccgaccccaacatcgccgaccaggacggcaagagacccctgcacctgtgcagaggccccggcaccctggagtgcgccgagctgctgctgagattcggcgccagagtggacggcagaagcgaggaggaggaggagacccccctgcacgtggccgccagactgggccacgtggagctggccgacctgctgctgagaagaggcgcctgccccgacgccagaaacgccgagggctggacccccctgctggccgcctgcgacgtgagatgccagagcatcaccgacgccgaggccaccaccgccagatgcctgcagctgtgcagcctgctgctgagcgccggcgccgacgccgacgccgccgaccaggacaagcagagacccctgcacctggcctgcagaagaggccacgccgccgtggtggagctgctgctgagctgcggcgtgagcgccaacaccatggactacggcggccacacccccctgcactgcgccctgcagggccccgccgccgccctggcccagagccccgagcacgtggtgagagccctgctgaaccacggcgccgtgagagtgtggcccggcgccctgcccaaggtgctggagagatggagcacctgccccagaaccatcgaggtgctgatgaacacctacagcgtggtgcagctgcccgaggaggccgtgggcctggtgacccccgagaccctgcagaagcaccagagattctacagcagcctgttcgccctggtgagacagcccagaagcctgcagcacctgagcagatgcgccctgagaagccacctggagggcagcctgccccaggccctgcccagactgcccctgccccccagactgctgagatacctgcagctggacttcgagggcgtgctgtactag

SEQ ID NO: 17875 - DNA, 1539 bp, Artificial Sequence
  Description of Artificial Sequence: Synthetic coding sequence
atgagaggccaggtgagcctgggcgcctgggacaccggcgccttctgcctgagcgtgttccccagctgcagcctgagcctgagcctgcccctggcctacaccagcccccccccccacagccccttccccgcccacatgctgatgagctggagccccgaggagtgcaagggccagggcgagcccctggacgacagacaccccctgtgcgccagactggtggagaagcccagcagaggcagcgaggagcacctgaagagcggccccggccccatcgtgaccagaaccgccagcggccccgccctggccttctggcaggccgtgctggccggcgacgtgggctgcgtgagcagaatcctggccgacagcagcaccggcctggcccccgacagcgtgttcgacaccagcgaccccgagagatggagagacttcagattcaacatcagagccctgagactgtggagcctgacctacgaggaggagctgaccacccccctgcacgtggccgccagcagaggccacaccgaggtgctgagactgctgctgagaagaagagccagacccgacagcgcccccggcggcagaaccgccctgcacgaggcctgcgccgccggccacaccgcctgcgtgcacgtgctgctggtggccggcgccgaccccaacatcgccgaccaggacggcaagagacccctgcacctgtgcagaggccccggcaccctggagtgcgccgagctgctgctgagattcggcgccagagtggacggcagaagcgaggaggaggaggagacccccctgcacgtggccgccagactgggccacgtggagctggccgacctgctgctgagaagaggcgcctgccccgacgccagaaacgccgagggctggacccccctgctggccgcctgcgacgtgagatgccagagcatcaccgacgccgaggccaccaccgccagatgcctgcagctgtgcagcctgctgctgagcgccggcgccgacgccgacgccgccgaccaggacaagcagagacccctgcacctggcctgcagaagaggccacgccgccgtggtggagctgctgctgagctgcggcgtgagcgccaacaccatggactacggcggccacacccccctgcactgcgccctgcagggccccgccgccgccctggcccagagccccgagcacgtggtgagagccctgctgaaccacggcgccgtgagagtgtggcccggcgccctgcccaaggtgctggagagatggagcacctgccccagaaccatcgaggtgctgatgaacacctacagcgtggtgcagctgcccgaggaggccgtgggcctggtgacccccgagaccctgcagaagcaccagagattctacagcagcctgttcgccctggtgagacagcccagaagcctgcagcacctgagcagatgcgccctgagaagccacctggagggcagcctgccccaggccctgcccagactgcccctgccccccagactgctgagatacctgcagctggacttcgagggcgtgctgtactag

SEQ ID NO: 17876 - DNA, 1425 bp, Artificial Sequence
  Description of Artificial Sequence: Synthetic coding sequence
atgagaggccaggtgagcctgggcgcctgggacaccggcgccttctgcctgagcgtgttccccagctgcagcctgagcctgagcctgcccctggcctacaccagcccccccccccacagccccttccccgcccacatgctgatgagctggagccccgaggagtgcaagggccagggcgagcccctggacgacagacaccccctgtgcgccagactggtggagaagcccagcagaggcagcgaggagcacctgaagagcggccccggccccatcgtgaccagaaccgccagcggccccgccctggccttctggcaggccgtgctggccggcgacgtgggctgcgtgagcagaatcctggccgacagcagcaccggcctggcccccgacagcgtgttcgacaccagcgaccccgagagatggagagacttcagattcaacatcagagccctgagactgtggagcctgacctacgaggaggagctgaccacccccctgcacgtggccgccagcagaggccacaccgaggtgctgagactgctgctgagaagaagagccagacccgacagcgcccccggcggcagaaccgccctgcacgaggcctgcgccgccggccacaccgcctgcgtgcacgtgctgctggtggccggcgccgaccccaacatcgccgaccaggacggcaagagacccctgcacctgtgcagaggccccggcaccctggagtgcgccgagctgctgctgagattcggcgccagagtggacggcagaagcgaggaggaggaggagacccccctgcacgtggccgccagactgggccacgtggagctggccgacctgctgctgagaagaggcgcctgccccgacgccagaaacgccgagggctggacccccctgctggccgcctgcgacgtgagatgccagagcatcaccgacgccgaggccaccaccgccagatgcctgcagctgtgcagcctgctgctgagcgccggcgccgacgccgacgccgccgaccaggacaagcagagacccctgcacctggcctgcagaagaggccacgccgccgtggtggagctgctgctgagctgcggcgtgagcgccaacaccatggactacggcggccacacccccctgcactgcgccctgcagggccccgccgccgccctggcccagagccccgagcacgtggtgagagccctgctgaaccacggcgccgtgagagtgtggcccggcgccctgcccaagaagcaccagagattctacagcagcctgttcgccctggtgagacagcccagaagcctgcagcacctgagcagatgcgccctgagaagccacctggagggcagcctgccccaggccctgcccagactgcccctgccccccagactgctgagatacctgcagctggacttcgagggcgtgctgtactag

SEQ ID NO: 17877 - DNA, 861 bp, Artificial Sequence
  Description of Artificial Sequence: Synthetic coding sequence
atgagaatcgtgctgcagctggccaagatgaacctgatggacatcaccaagatcttcagcctgctgcagcccgacaaggaggaggaggacaccgacaccgaggagaagcaggccctgaaccaggccgtgtacgacaacgacagctacaccctggaccagctgctgagacaggagagatacaagagattcatcaacagcagaagcggctggggcgtgcccggcacccccctgagactggccgccagctacggccacctgagctgcctgcaggtgctgctggcccacggcgccgacgtggacagcctggacgtgaaggcccagacccccctgttcaccgccgtgagccacggccacctggactgcgtgagagtgctgctggaggccggcgccagccccggcggcagcatctacaacaactgcagccccgtgctgaccgccgccagagacggcgccgtggccatcctgcaggagctgctggaccacggcgccgaggccaacgtgaaggccaagctgcccgtgtgggccagcaacatcgccagctgcagcggccccctgtacctggccgccgtgtacggccacctggactgcttcagactgcaccacaactgcgagcccgagtacatccagctgctgatcgacttcggcgccaacatctacctgcccagcctgagcctggacctgaccagccaggacgacaagggcatcgccctgctgctgcaggccagagccacccccagaagcctgctgagccaggtgagactggtggtgagaagagccctgtgccaggccggccagccccaggccatcaaccagctggacatcccccccatgctgatcagctacctgaagcaccagctgtag

SEQ ID NO: 17878 - DNA, 957 bp, Artificial Sequence
  Description of Artificial Sequence: Synthetic coding sequence
atgagaatcgtgctgcagctggccaagatgaacctgatggacatcaccaagatcttcagcctgctgcagcccgacaaggaggaggaggacaccgacaccgaggagaagcaggccctgaaccaggccgtgtacgacaacgacagctacaccctggaccagctgctgagacaggagagatacaagagattcatcaacagcagaagcggctggggcgtgcccggcacccccctgagactggccgccagctacggccacctgagctgcctgcaggtgctgctggcccacggcgccgacgtggacagcctggacgtgaaggcccagacccccctgttcaccgccgtgagccacggccacctggactgcgtgagagtgctgctggaggccggcgccagccccggcggcagcatctacaacaactgcagccccgtgctgaccgccgccagagacggcgccgtggccatcctgcaggagctgctggaccacggcgccgaggccaacgtgaaggccaagctgcccgtgtgggccagcaacatcgccagctgcagcggccccctgtacctggccgccgtgtacggccacctggactgcttcagactgctgctgctgcacggcgccgaccccgactacaactgcaccgaccagggcctgctggccagagtgcccagacccagaaccctgctggagatctgcctgcaccacaactgcgagcccgagtacatccagctgctgatcgacttcggcgccaacatctacctgcccagcctgagcctggacctgaccagccaggacgacaagggcatcgccctgctgctgcaggccagagccacccccagaagcctgctgagccaggtgagactggtggtgagaagagccctgtgccaggccggccagccccaggccatcaaccagctggacatcccccccatgctgatcagctacctgaagcaccagctgtag

SEQ ID NO: 17879 - DNA, 930 bp, Artificial Sequence
  Description of Artificial Sequence: Synthetic coding sequence
atgaacctgatggacatcaccaagatcttcagcctgctgcagcccgacaaggaggaggaggacaccgacaccgaggagaagcaggccctgaaccaggccgtgtacgacaacgacagctacaccctggaccagctgctgagacaggagagatacaagagattcatcaacagcagaagcggctggggcgtgcccggcacccccctgagactggccgccagctacggccacctgagctgcctgcaggtgctgctggcccacggcgccgacgtggacagcctggacgtgaaggcccagacccccctgttcaccgccgtgagccacggccacctggactgcgtgagagtgctgctggaggccggcgccagccccggcggcagcatctacaacaactgcagccccgtgctgaccgccgccagagacggcgccgtggccatcctgcaggagctgctggaccacggcgccgaggccaacgtgaaggccaagctgcccgtgtgggccagcaacatcgccagctgcagcggccccctgtacctggccgccgtgtacggccacctggactgcttcagactgctgctgctgcacggcgccgaccccgactacaactgcaccgaccagggcctgctggccagagtgcccagacccagaaccctgctggagatctgcctgcaccacaactgcgagcccgagtacatccagctgctgatcgacttcggcgccaacatctacctgcccagcctgagcctggacctgaccagccaggacgacaagggcatcgccctgctgctgcaggccagagccacccccagaagcctgctgagccaggtgagactggtggtgagaagagccctgtgccaggccggccagccccaggccatcaaccagctggacatcccccccatgctgatcagctacctgaagcaccagctgtag

SEQ ID NO: 17880 - DNA, 1764 bp, Artificial Sequence
  Description of Artificial Sequence: Synthetic coding sequence
atggacaactacaccagcgacgaggacatcgacgaggacttcgacacccagctgatcatccagcagagcctgcaggacatctacaagcccggcaccgcccagcacgcccccaaggacgagagcctgcacagcttcctgagcgccgactacaagaagatcgtggagaccatcgagaaggtgggcaaggaggacgccctgagccacctgaccaagtaccacagcgccttcggcgaggccgacgagatcggctggatccccctgcacaaggccgccgtgcagctgaacagaaagatcctggagatcaccctgagcgccagcgaccccagcctgtgggagcagaccacccacaacggcgagacccccctgttcctggccgtgagcagctgcctgctggagaacgccaccttcctgctgctgaacggctgcaaccccaacgccaagaacttcgagggcaacagccccctgctggccgccgtgctgagagactgctacgacatggccgccctgctgatcaactacggcgccgacgtgaacctgagatgcgccaacgagagaaccgccctgcacgaggccgccaagctgggcagagaggacatggtgaagctgatgctggtgagcggcgcccaccccgacccccagagcacctacggcttcacccccctggccctggccgcccagagcggccacaccgagatcatggagatgctgctgagaaagggcaagatcttctgcctggccagcgacagcagcagcatcctgctggaggccgccagcggcggcaaccccgacgccgtggccctgctgctggagtacggcgccgacgccaacatccccaagaacagcggccacctgcccatccacgtggccgccgacagaggccacctgctggccctgaagatcctgatccccgtgaccgacctggccgccatcaagcagagcggcatcagccccgtgcactgcgccgccgccggcgcccacccccagtgcctggagctgctgatccaggccggcttcgacgtgaacttcatgctggaccagagaatcaacaagcactacgacgaccacagaaagagcgccctgtacttcgccgtgagcaacagcgacctgagcagcgtgaagctgctgctgagcgccggcgccctgcccaaccaggaccccgtgaactgcctgcagatcgccctgagaatgggcaactacgagctgatcagcctgctgctgagacacggcgccaacgtgaactacttctgcagagtgaaccccctgcacttccccagcgccctgcagtacaccctgaaggacgaggtgatgctgagaatgctgctgaactacggctacgacaccgagagatgcttcgactgcccccacggcgacaaggtgcaccccagctacaccgtggagggctggaccagcaccgtgatcaaggacaccaagttctgcgaggtgatcaccctgagctggctgcagcacctgagcggcaaggtggtgagagtgatgctggactacgtggaccaggtgagaatctgcagcaagctgaaggccgtgctgcagaagcagggcatctggagcgagatccacttcatcctgaccaaccccagaagcctgaagcacctgtgcagactgaagatcagaaagtgcatgggcagactgcacctgagatgccccgtgttcatgagcttcctgcccctgcccaacagactgaaggcctacgtgctgtacaaggagtacgacctgtacggccagggcatcttcaccggcacctggtag

SEQ ID NO: 17881 - DNA, 1272 bp, Artificial Sequence
  Description of Artificial Sequence: Synthetic coding sequence
atggccgccctgctgatcaactacggcgccgacgtgaacctgagatgcgccaacgagagaaccgccctgcacgaggccgccaagctgggcagagaggacatggtgaagctgatgctggtgagcggcgcccaccccgacccccagagcacctacggcttcacccccctggccctggccgcccagagcggccacaccgagatcatggagatgctgctgagaaagggcgccaacgcccacggccaggccagcgacagcagcagcatcctgctggaggccgccagcggcggcaaccccgacgccgtggccctgctgctggagtacggcgccgacgccaacatccccaagaacagcggccacctgcccatccacgtggccgccgacagaggccacctgctggccctgaagatcctgatccccgtgaccgacctggccgccatcaagcagagcggcatcagccccgtgcactgcgccgccgccggcgcccacccccagtgcctggagctgctgatccaggccggcttcgacgtgaacttcatgctggaccagagaatcaacaagcactacgacgaccacagaaagagcgccctgtacttcgccgtgagcaacagcgacctgagcagcgtgaagctgctgctgagcgccggcgccctgcccaaccaggaccccgtgaactgcctgcagatcgccctgagaatgggcaactacgagctgatcagcctgctgctgagacacggcgccaacgtgaactacttctgcagagtgaaccccctgcacttccccagcgccctgcagtacaccctgaaggacgaggtgatgctgagaatgctgctgaactacggctacgacaccgagagatgcttcgactgcccccacggcgacaaggtgcaccccagctacaccgtggagggctggaccagcaccgtgatcaaggacaccaagttctgcgaggtgatcaccctgagctggctgcagcacctgagcggcaaggtggtgagagtgatgctggactacgtggaccaggtgagaatctgcagcaagctgaaggccgtgctgcagaagcagggcatctggagcgagatccacttcatcctgaccaaccccagaagcctgaagcacctgtgcagactgaagatcagaaagtgcatgggcagactgcacctgagatgccccgtgttcatgagcttcctgcccctgcccaacagactgaaggcctacgtgctgtacaaggagtacgacctgtacggccagggcatcttcaccggcacctggtag

SEQ ID NO: 17882 - DNA, 1764 bp, Artificial Sequence
  Description of Artificial Sequence: Synthetic coding sequence
atggacaactacaccagcgacgaggacatcgacgaggacttcgacacccagctgatcatccagcagagcctgcaggacatctacaagcccggcaccgcccagcacgcccccaaggacgagagcctgcacagcttcctgagcgccgactacaagaagatcgtggagaccatcgagaagggcaaggaggacgccctgagccacctgaccaagtaccacagcgccttcggcgaggccgacgagatcggctggatccccctgcacaaggccgccgtgcagctgaacagaaagatcctggagatcaccctgagcgccagcgaccccagcctgtgggagcagaccacccacaacggcgagacccccctgttcctggccgtgagcagctgcctgctggagaacgccaccttcctgctgctgaacggctgcaaccccaacgccaagaacttcgagggcaacagccccctgctggccgccgtgctgagagactgctacgacatggccgccctgctgatcaactacggcgccgacgtgaacctgagatgcgccaacgagagaaccgccctgcacgaggccgccaagctgggcagagaggacatggtgaagctgatgctggtgagcggcgcccaccccgacccccagagcacctacggcttcacccccctggccctggccgcccagagcggccacaccgagatcatggagatgctgctgagaaagggcgccaacgcccacggccaggccagcgacagcagcagcatcctgctggaggccgccagcggcggcaaccccgacgccgtggccctgctgctggagtacggcgccgacgccaacatccccaagaacagcggccacctgcccatccacgtggccgccgacagaggccacctgctggccctgaagatcctgatccccgtgaccgacctggccgccatcaagcagagcggcatcagccccgtgcactgcgccgccgccggcgcccacccccagtgcctggagctgctgatccaggccggcttcgacgtgaacttcatgctggaccagagaatcaacaagcactacgacgaccacagaaagagcgccctgtacttcgccgtgagcaacagcgacctgagcagcgtgaagctgctgctgagcgccggcgccctgcccaaccaggaccccgtgaactgcctgcagatcgccctgagaatgggcaactacgagctgatcagcctgctgctgagacacggcgccaacgtgaactacttctgcagagtgaaccccctgcacttccccagcgccctgcagtacaccctgaaggacgaggtgatgctgagaatgctgctgaactacggctacgacaccgagagatgcttcgactgcccccacggcgacaaggtgcaccccagctacaccgtggagggctggaccagcaccgtgatcaaggacaccaagttctgcgaggtgatcaccctgagctggctgcagcacctgagcggcaaggtggtgagagtgatgctggactacgtggaccaggtgagaatctgcagcaagctgaaggccgtgctgcagaagcagggcatctggagcgagatccacttcatcctgaccaaccccagaagcctgaagcacctgtgcagactgaagatcagaaagtgcatgggcagactgcacctgagatgccccgtgttcatgagcttcctgcccctgcccaacagactgaaggcctacgtgctgtacaaggagtacgacctgtacggccagggcatcttcaccggcacctggtag

SEQ ID NO: 17883 - DNA, 1767 bp, Artificial Sequence
  Description of Artificial Sequence: Synthetic coding sequence
atggacaccaacgacgaccccgacgaggaccacctgaccagctacgacatccagctgagcatccaggagagcatcgaggccagcaagaccgccctgtgccccgagagattcgtgcccctgagcgcccagaacagaaagctggtggaggccatcaagcagggccacatccccgagctgcaggagtacgtgaagtacaagtacgccatggacgaggccgacgagaagggctggttccccctgcacgaggccgtggtgcagcccatccagcagatcctggagatcgtgctggacgccagctacaagaccctgtgggagttcaagacctgcgacggcgagacccccctgaccctggccgtgaaggccggcctggtggagaacgtgagaaccctgctggagaagggcgtgtggcccaacaccaagaacgacaagggcgagacccccctgctgatcgccgtgaagaagggcagctacgacatggtgagcaccctgatcaagcacaacaccagcctggaccagccctgcgtgaagagatggagcgccatgcacgaggccgccaagcagggcagaaaggacatcgtggccctgctgctgaagcacggcggcaacgtgcacctgagagacggcttcggcgtgacccccctgggcgtggccgccgagtacggccactgcgacgtgctggagcacctgatccacaagggcggcgacgtgctggccctggccgacgacggcgccagcgtgctgttcgaggccgccggcggcggcaaccccgactgcatcagcctgctgctggagtacggcggcagcggcaacgtgcccaacagagccggccacctgcccatccacagagccgcctacgagggccactacctggccctgaagtacctgatccccgtgaccagcaagaacgccatcagaaagagcggcctgacccccatccacagcgccgccgacggccagaacgcccagtgcctggagctgctgatcgagaacggcttcgacgtgaacaccctgctggccgaccacatcagccagagctacgacgacgagagaaagaccgccctgtacttcggcgtgagcaacaacgacgtgcactgcaccgaggtgctgctggccgccggcgccgaccccaacctggaccccctgaactgcctgctggtggccgtgagagccaacaactacgagatcgtgagactgctgctgagccacggcgccaacgtgaactgctacttcatgcacgtgaacgacaccagattccccagcgtgatccagtacgccctgaacgacgaggtgatgctgagactgctgctgaacaacggctaccaggtggagatgtgcttcgactgcatgcacggcgacatcttcggcaacagcttcgtgtggagcgagatccaggaggaggtgctgcccggctggaccagctgcgtgatcaaggacaaccccttctgcgagttcatcaccgtgccctggatgaagcacctggtgggcagagtgaccagagtgctgatcgactacatggactacgtgcccctgtgcgccaagctgaagagcgccctggaggtgcagagagagtggcccgagatcagacagatcctggagaacccctgcagcctgaagcacctgtgcagactgaagatcagaagactgatgggcctgcagaagctgtgccagcccgccagcgtggagaagctgcccctgccccccgccatccagagatacatcctgttcaaggagtacgacctgtacggccaggagctgaagctgacctag

SEQ ID NO: 17884 - DNA, 1767 bp, Artificial Sequence; identical to SEQ ID NO: 17883
  Description of Artificial Sequence: Synthetic coding sequence

SEQ ID NO: 17885 - DNA, 294 bp, Artificial Sequence
  Description of Artificial Sequence: Synthetic coding sequence
atggacaccaacgacgaccccgacgaggaccacctgaccagctacgacatccagctgagcatccaggagagcatcgaggccagcaagaccgccctgtgccccgagagattcgtgcccctgagcgcccagaacagaaagctggtggaggccatcaagcagggccacatccccgagctgcaggagtacgtgaagtacaagtacgccatggacgaggccgacgagaagggctggttccccctgcacgaggccgtggtgcagcccatccagcagatcctggagatcgtgctggactag

SEQ ID NO: 17886 - DNA, 726 bp, Artificial Sequence
  Description of Artificial Sequence: Synthetic coding sequence
atggacaccaacgacgaccccgacgaggaccacctgaccagctacgacatccagctgagcatccaggagagcatcgaggccagcaagaccgccctgtgccccgagagattcgtgcccctgagcgcccagaacagaaagctggtggaggccatcaagcagggccacatccccgagctgcaggagtacgtgaagtacaagtacgccatggacgaggccgacgagaagggctggttccccctgcacgaggccgtggtgcagcccatccagcagatcctggagatcgtgctggacgccagctacaagaccctgtgggagttcaagacctgcgacggcgagacccccctgaccctggccgtgaaggccggcctggtggagaacgtgagaaccctgctggagaagggcgtgtggcccaacaccaagaacgacaagggcgagacccccctgctgatcgccgtgaagaagggcagctacgacatggtgagcaccctgatcaagcacaacaccagcctggaccagccctgcgtgaagagatggagcgccatgcacgaggccgccaagcagggcagaaaggacatcgtggccctgctgctgaagcacggcggcaacgtgcacctgagagacggcttcggcgtgacccccctgggcgtggccgccgagtacggccactgcgacgtgctggagcacctgatccacaagggcggcgacgtgctggccctggccgactag

SEQ ID NO: 17887 - DNA, 1767 bp, Artificial Sequence; identical to SEQ ID NO: 17883
  Description of Artificial Sequence: Synthetic coding sequence

SEQ ID NO: 17888 - DNA, 1767 bp, Artificial Sequence; identical to SEQ ID NO: 17883
  Description of Artificial Sequence: Synthetic coding sequence

SEQ ID NO: 17889 - DNA, 1767 bp, Artificial Sequence; identical to SEQ ID NO: 17883
  Description of Artificial Sequence: Synthetic coding sequence

SEQ ID NO: 17890 - DNA, 750 bp, Artificial Sequence
  Description of Artificial Sequence: Synthetic coding sequence
atgaagcagcccagcaaggccgagtacggccactgcgacgtgctggagcacctgatccacaagggcggcgacgtgctggccctggccgacgacggcgccagcgtgctgttcgaggccgccggcggcggcaaccccgactgcatcagcctgctgctggagtacggcggcagcggcaacgtgcccaacagagccggccacctgcccatccacagagccgcctacgagggccactacctggccctgaagtacctgatccccgtgaccagcaagaacgccatcagaaagagcggcctgacccccatccacagcgccgccgacggccagaacgcccagtgcctggagctgctgatcgagaacggcttcgacgtgaacaccctgctggccgaccacatcagccagagctacgacgacgagagaaagaccgccctgtacttcggcgtgagcaacaacgacgtgcactgcaccgaggtgctgctggccgccggcgccgaccccaacctggaccccctgaactgcctgctggtggccgtgagagccaacaactacgagatcgtgagactgctgctgagccacggcgccaacgtgaactgctacttcatgcacgtgaacgacaccagattccccagcgtgatccagtacgccctgaacgacgaggtgatgctgagactgctgctgaacaacggctaccaggtggagatgtgcttcgactgcatgcacggcgacatcttcggcaacagcttcgtgtgctag

SEQ ID NO: 17891 - DNA, 1362 bp, Artificial Sequence
  Description of Artificial Sequence: Synthetic coding sequence
atggccagagagaccttccccttcaccagcagcatgctgagaagcctgagactgcagcaggagtggctggagtgggaggacagaagaagagccgccgcccagcagtgcagaagcagaagatgccccagcagccccagagccagactgaccagaccccacagaagctgcagagaccccgccgtgcaccaggccctgttcagcggcaacctgcagcaggtgcaggccctgttccaggacgaggaggccgccaacatgatcgtggagaccgtgagcaaccagctggcctggagcgccgagcagggcttctgggtgctgacccccaagaccaagcagaccgcccccctggccatcgccaccgccagaggctacaccgactgcgccagacacctgatcagacagggcgccgagctggacgccagagtgggcggcagagccgccctgcacgaggcctgcgccagagcccagttcgactgcgtgagactgctgctgaccttcggcgccaaggccaacgtgctgaccgaggagggcaccacccccctgcacctgtgcaccatccccgagagcctgcagtgcgccaagctgctgctggaggccggcgccaccgtgaacctggccgccggcgagagccaggagacccccctgcacgtggccgccgccagaggcctggagcagcacgtggccctgtacctggagcacggcgccgacgtgggcctgagaaccagccagggcgagaccgccctgaacaccgcctgcgccggcgccgagggccccggcagctgcagaagacaccaggccgccgccagaagactgctggaggccggcgccgacgccagagccgccggcagaaagagacacacccccctgcacaacgcctgcgccaacggctgcggcggcctggccgagctgctgctgagatacggcgccagagccgaggtgcccaacggcgccggccacacccccatggactgcgccctgcaggccgtgcaggacagccccaactgggagcccgaggtgctgttcgccgccctgctggactacggcgcccagcccgtgagacccgagatgctgaagcactgcgccaacttccccagagccctggaggtgctgctgaacgcctacccctgcgtgcccagctgcgagacctgggtggaggccgtgctgcccgagctgtggaaggagcacgaggccttctacagcagcgccctgtgcatggtgaaccagcccagacagctgcagcacctggccagactggccgtgagagccagactgggcagcagatgcagacagggcgccaccagactgcccctgccccccctgctgagagactacctgctgctgagagtggagggctgcatccagtag

SEQ ID NO: 17892 - DNA, 888 bp, Artificial Sequence
  Description of Artificial Sequence: Synthetic coding sequence
atgagcaagagcaccaagctgtgcggcaagaccagctgccccagaagcaacatcttctgcaacctgctggacaagatcgtgaagagacccagcctgcagttcctgggccagtggggctaccactgctacgagcccagaatctacagaagcctggccaagatcctgagatacgtggacctggacggcttcgacgccctgctgaccgactacatcgccttcgtggagaagagcggctacagattcgaggtgagcttcaacctggacttcaccgagatctgcgtgaacaccatcctgtactgggtgttcgccagaaagggcaaccccgacttcgtggagctgctgctgaagaagaccaaggactacgtgcaggacagaagctgcaacctggccctgatctggagaaccttcacccccgtgtactgccccagccccctgagcggcatcacccccctgttctacgtggcccagaccagacagagcaacatcttcaagatcctgctgcagtacggcatcctggagagagagaagaaccccatcaacatcgtgctgaccatcgtgctgtaccccagcagagtgagagtgatggtggacagagagctggccgacatccacgaggacgccaagacctgcctggtgctgtgcagcagagtgctgagcgtgatcagcgtgaaggagatcaagacccagctgagcctgggcagacaccccatcatcagcaactggttcgactacatccccagcaccagatacaaggacccctgcgagctgctgcacctgtgcagactgaccatcagaaaccagctgctgaccaacaacatgctgcccgacggcatcttcagcctgctgatccccgccagactgcagaactacctgaacctggagatctag

SEQ ID NO: 17893 - DNA, 1314 bp, Artificial Sequence
  Description of Artificial Sequence: Synthetic coding sequence
atggagagacagcccggccccgtgagaggcaagctgcagatcttccagaagaccgagaaggacccccaggccagagccggcagccccgtgcaggagtaccacaccgccctggtggccggcgacctggaccacctgaagcccctgatggaccagttcttccaggacgccaacgtggtgttcgagatcaacaaggacgagatggagtggcaggtgaagagccccgccaccttcggcctgagcggcctgtggaccctggagtacaagagagagctgaccacccccctgtgcatcgccgccgcccacggccacaccgcctgcgtgagacacctgctgggcagaggcgccgaccccgacgccagccccggcggcagaggcgccctgcacgaggcctgcctgggcggccacaccgcctgcgtgagactgctgctgcagcacagagccgaccccgacctgctgagcgccgagggcctggcccccctgcacctgtgcagaaccgccgccagcctgggctgcgcccaggccctgctggagcacggcgccagcgtgcagagagtgggcggcaccggcagagacacccccctgcacgtggccgcccagagaggcctggacgagcacgccagactgtacctgggcagaggcgcccacgtggacgccagaaacggcagaggcgagaccgccctgagcgccgcctgcggcgccgccagaagacccgacgagcacggcagatgcctgagactgtgcgccctgctgctgagaagaggcgccgaggccgacgccagagacgaggacgagagaagccccctgcacaaggcctgcggccacgccagccacagcctggccagactgctgctgagacacggcgccgacgccggcgccctggactacggcggcgccagccccctgggcagagtgctgcagaccgccagctgcgccctgcaggccagcccccagagaaccgtgcaggccctgctgaaccacggcagccccaccgtgtggcccgacgccttccccaaggtgctgaagacctgcgccagcgtgcccgccgtgatcgaggtgctgttcaacagctacccccagctgtgcctgagcgagagctggaaggaggtgatccccgaggaggtgttccagatgcacaagcccttctaccagagcctgttcgccctggccctgacccccagatgcctgcagcacctgtgcagatgcgccctgagaagactgttcggcaagagatgcttcgacctgatccccctgctgcccctgcccaagcccctgcagaactacctgctgctggagccccagggcgtgctgcactag

SEQ ID NO: 17894 - DNA, 1401 bp, Artificial Sequence
  Description of Artificial Sequence: Synthetic coding sequence
atgagcaacagcgactacctgcccgactaccccctgaacagcgacctggtgaagagactgaagagcgccctggacgccaaggacgaggagagagtgagagacctgatctgcaccgagatcacccccgtggacgccgtgatcgagctggccaacgacgactggatgaaggaccccagcgcccagctgcccaccggcatgctgctgggcgacctggaccacctgaagcccctgatggaccagttcttccaggacgccaacgtggtgttcgagatcaacaaggacgagatggagtggcaggtgaagagccccgccaccttcggcctgagcggcctgtggaccctggagtacaagagagagctgaccacccccctgtgcatcgccgccgcccacggccacaccgcctgcgtgagacacctgctgggcagaggcgccgaccccgacgccagccccggcggcagaggcgccctgcacgaggcctgcctgggcggccacaccgcctgcgtgagactgctgctgcagcacagagccgaccccgacctgctgagcgccgagggcctggcccccctgcacctgtgcagaaccgccgccagcctgggctgcgcccaggccctgctggagcacggcgccagcgtgcagagagtgggcggcaccggcagagacacccccctgcacgtggccgcccagagaggcctggacgagcacgccagactgtacctgggcagaggcgcccacgtggacgccagaaacggcagaggcgagaccgccctgagcgccgcctgcggcgccgccagaagacccgacgagcacggcagatgcctgagactgtgcgccctgctgctgagaagaggcgccgaggccgacgccagagacgaggacgagagaagccccctgcacaaggcctgcggccacgccagccacagcctggccagactgctgctgagacacggcgccgacgccggcgccctggactacggcggcgccagccccctgggcagagtgctgcagaccgccagctgcgccctgcaggccagcccccagagaaccgtgcaggccctgctgaaccacggcagccccaccgtgtggcccgacgccttccccaaggtgctgaagacctgcgccagcgtgcccgccgtgatcgaggtgctgttcaacagctacccccagctgtgcctgagcgagagctggaaggaggtgatccccgaggaggtgttccagatgcacaagcccttctaccagagcctgttcgccctggccctgacccccagatgcctgcagcacctgtgcagatgcgccctgagaagactgttcggcaagagatgcttcgacctgatccccctgctgcccctgcccaagcccctgcagaactacctgctgctggagccccagggcgtgctgcactag

SEQ ID NO: 17895 - DNA, 990 bp, Artificial Sequence
  Description of Artificial Sequence: Synthetic coding sequence
atgagcgtgctggaggagaacagacccttcgcccagcagctgagcaacgtgtacttcaccatcctgagcctgttctgcttcaagctgttcgtgaagatcagcctggccatcctgagccacttctacatcgtgaagggcaacagaaaggaggccgccagaatcgccgccgagttctacggcgtgacccagggccagggcagctgggccgacagaagccccctgcacgaggccgccagccagggcagactgctggccctgagaaccctgctgagccagggctacaacgtgaacgccgtgaccctggaccacgtgacccccctgcacgaggcctgcctgggcgaccacgtggcctgcgccagaaccctgctggaggccggcgccaacgtgaacgccatcaccatcgacggcgtgacccccctgttcaacgcctgcagccagggcagccccagctgcgccgagctgctgctggagtacggcgccaaggcccagctggagagctgcctgcccagccccacccacgaggccgccagcaagggccaccacgagtgcctggacatcctgatcagctggggcatcgacgtggaccaggagatcccccacctgggcacccccctgtacgtggcctgcatgagccagcagttccactgcatctggaagctgctgtacgccggcgccgacgtgcagaagggcaagtactgggacacccccctgcacgccgccgcccagcagagcagcaccgagatcgtgaacctgctgctggagttcggcgccgacatcaacgccaagaacaccgagctgctgagacccatcgacgtggccaccagcagcagcatggtggagagaatcctgctgcagcacgaggccacccccagcagcctgtaccagctgtgcagactgtgcatcagaagctacatcggcaagcccagactgcacctgatcccccagctgcagctgcccaccctgctgaagaacttcctgcagtacagatag

SEQ ID NO: 17896 - DNA, 63 bp, Artificial Sequence
  Description of Artificial Sequence: Synthetic coding sequence
atgagcgtgctggaggagaacagacccttcgcccagcagctgagcaacgtgtacttcacctag

SEQ ID NO: 17897 - DNA, 957 bp, Artificial Sequence
  Description of Artificial Sequence: Synthetic coding sequence
atgctgcaccaccactgcagaagaaaccccgagctgcaggaggagctgcagatccaggccgccgtggccgccggcgacgtgcacaccgtgagaaagatgctggagcagggctacagccccaacggcagagacgccaacggctggaccctgctgcacttcagcgccgccagaggcaaggagagatgcgtgagagtgttcctggagcacggcgccgaccccaccgtgaaggacctgatcggcggcttcaccgccctgcactacgccgccatgcacggcagagccagaatcgccagactgatgctggagagcgagtacagaagcgacatcatcaacgccaagagcaacgacggctggacccccctgcacgtggccgcccactacggcagagacagcttcgtgagactgctgctggagttcaaggccgaggtggaccccctgagcgacaagggcaccacccccctgcagctggccatcatcagagagagaagcagctgcgtgaagatcctgctggaccacaacgccaacatcgacatccagaacggcttcctgctgagatacgccgtgatcaagagcaaccacagctactgcagaatgttcctgcagagaggcgccgacaccaacctgggcagactggaggacggccagacccccctgcacctgagcgccctgagagacgacgtgctgtgcgccagaatgctgtacaactacggcgccgacaccaacaccagaaactacgagggccagacccccctggccgtgagcatcagcatcagcggcagcagcagaccctgcctggacttcctgcaggaggtgaccagacagcccagaaacctgcaggacctgtgcagaatcaagatcagacagtgcatcggcctgcagaacctgaagctgctggacgagctgcccatcgccaaggtgatgaaggactacctgaagcacaagttcgacgacatctag

SEQ ID NO: 17898 - DNA, 825 bp, Artificial Sequence
  Description of Artificial Sequence: Synthetic coding sequence
atgctgcaccaccactgcagaagaaaccccgagctgcaggaggagctgcagatccaggccgccgtggccgccggcgacgtgcacaccgtgagaaagatgctggagcagggctacagccccaacggcagagacgccaacggctggaccctgctgcacttcagcgccgccagaggcaaggagagatgcgtgagagtgttcctggagcacggcgccgaccccaccgtgaaggacctgatcggcggcttcaccgccctgcactacgccgccatgcacggcagagccagaatcgccagactgatgctggagagcgagtacagaagcgacatcatcaacgccaagagcaacgacggctggacccccctgcacgtggccgcccactacggcagagacagcttcgtgagactgctgctggagttcaaggccgaggtggaccccctgagcgacaagggcaccacccccctgcagctggccatcatcagagagagaagcagctgcgtgaagatcctgctggaccacaacgccaacatcgacatccagaacggcttcctgctgagatacgccgtgatcaagagcaaccacagctactgcagaatgttcctgcagagaggcgccgacaccaacctgggcagactggaggacggccagacccccctgcacctgagcgccctgagagacgacgtgctgtgcgccagaatgctgtacaactacggcgccgacaccaacaccagaaactacgagggccagacccccctggccgtgagcatcagcatcagcggcagcagcagaccctgcctggacttcctgcaggaggtgaccagcatgtag

SEQ ID NO: 17899 - DNA, 759 bp, Artificial Sequence
  Description of Artificial Sequence: Synthetic coding sequence
atggacggcaagcagggcggcatggacggcagcaagcccgccggccccagagacttccccggcatcagactgctgagcaaccccctgatgggcgacgccgtgagcgactggagccccatgcacgaggccgccatccacggccaccagctgagcctgagaaacctgatcagccagggctgggccgtgaacatcatcaccgccgaccacgtgagccccctgcacgaggcctgcctgggcggccacctgagctgcgtgaagatcctgctgaagcacggcgcccaggtgaacggcgtgaccgccgactggcacacccccctgttcaacgcctgcgtgagcggcagctgggactgcgtgaacctgctgctgcagcacggcgccagcgtgcagcccgagagcgacctggccagccccatccacgaggccgccagaagagcctacggcggcaacatcgaccacaagatcagccacctgggcacccccctgtacctggcctgcgagaaccagcagagagcctgcgtgaagaagctgctggagagcggcgccgacgtgaaccagggcaagggccaggacagccccctgcacgccgtggccagaaccgccagcgaggagctggcctgcctgctgatggacttcggcgccgacacccaggccaagaacgccgagggcaagagacccgtggagctggtgccccccgagagccccctggcccagctgttcctggagagagagggcgccagcctgcccaagcccaagccctag

SEQ ID NO: 17900 - DNA, 789 bp, Artificial Sequence
  Description of Artificial Sequence: Synthetic coding sequence
atggacggcaagcagggcggcatggacggcagcaagcccgccggccccagagacttccccggcatcagactgctgagcaaccccctgatgggcgacgccgtgagcgactggagccccatgcacgaggccgccatccacggccaccagctgagcctgagaaacctgatcagccagggctgggccgtgaacatcatcaccgccgaccacgtgagccccctgcacgaggcctgcctgggcggccacctgagctgcgtgaagatcctgctgaagcacggcgcccaggtgaacggcgtgaccgccgactggcacacccccctgttcaacgcctgcgtgagcggcagctgggactgcgtgaacctgctgctgcagcacggcgccagcgtgcagcccgagagcgacctggccagccccatccacgaggccgccagaagaggccacgtggagtgcgtgaacagcctgatcgcctacggcggcaacatcgaccacaagatcagccacctgggcacccccctgtacctggcctgcgagaaccagcagagagcctgcgtgaagaagctgctggagagcggcgccgacgtgaaccagggcaagggccaggacagccccctgcacgccgtggccagaaccgccagcgaggagctggcctgcctgctgatggacttcggcgccgacacccaggccaagaacgccgagggcaagagacccgtggagctggtgccccccgagagccccctggcccagctgttcctggagagagagggcgccagcctgcccaagcccaagccctag

SEQ ID NO: 17901 - DNA, 885 bp, Artificial Sequence
  Description of Artificial Sequence: Synthetic coding sequence
atggacggcaagcagggcggcatggacggcagcaagcccgccggccccagagacttccccggcatcagactgctgagcaaccccctgatgggcgacgccgtgagcgactggagccccatgcacgaggccgccatccacggccaccagctgagcctgagaaacctgatcagccagggctgggccgtgaacatcatcaccgccgaccacgtgagccccctgcacgaggcctgcctgggcggccacctgagctgcgtgaagatcctgctgaagcacggcgcccaggtgaacggcgtgaccgccgactggcacacccccctgttcaacgcctgcgtgagcggcagctgggactgcgtgaacctgctgctgcagcacggcgccagcgtgcagcccgagagcgacctggccagccccatccacgaggccgccagaagaggccacgtggagtgcgtgaacagcctgatcgcctacggcggcaacatcgaccacaagatcagccacctgggcacccccctgtacctggcctgcgagaaccagcagagagcctgcgtgaagaagctgctggagagcggcgccgacgtgaaccagggcaagggccaggacagccccctgcacgccgtggccagaaccgccagcgaggagctggcctgcctgctgatggacttcggcgccgacacccaggccaagaacgccgagggcaagagacccgtggagctggtgccccccgagagccccctggcccagctgttcctggagagagagggcccccccagcctgatgcagctgtgcagactgagaatcagaaagtgcttcggcatccagcagcaccacaagatcaccaagctggtgctgcccgaggacctgaagcagttcctgctgcacctgtag

SEQ ID NO: 17902 - DNA, 789 bp, Artificial Sequence; identical to SEQ ID NO: 17900
  Description of Artificial Sequence: Synthetic coding sequence

SEQ ID NO: 17903 - DNA, 1971 bp, Artificial Sequence
  Description of Artificial Sequence: Synthetic coding sequence
atgagcgagctgagcgacgaggccagcgagcccgagctgctgaacagaagcctgagcatgtggcacggcctgggcacccaggtgagcggcgaggagctggacgtgcccctggacctgcacaccgccgccagcatcggccagtacgaggtggtgaaggagtgcgtgcagagaagagagctggacctgaacaagaagaacggcggcggctggacccccctgatgtacgccagctacatcggccacgacaccatcgtgcacctgctgctggaggccggcgtgagcgtgaacgtgcccacccccgagggccagacccccctgatgctggccagcagctgcggcaacgagagcatcgcctacttcctgctgcagcagggcgccgagctggagatgaaggacatccagggctggaccgccctgttccactgcaccagcgccggccaccagcacatggtgagattcctgctggacagcggcgccaacgccaacgtgagagagcccatctgcggcttcacccccctgatggaggccgccgccgccggccacgagatcatcgtgcagtacttcctgaaccacggcgtgaaggtggacgccagagaccacagcggcgccaccgccagaatgctggccaagcagtacggccacatgaagatcgtggccctgatggacacctacagccccagcctgcccaagagcctgtacagaagccccgagaagtacgaggacctgagcagcagcgacgagagctgccccgccccccagagacagagaccctgcagaaagaagggcgtgagcatccacgagggccccagagccctggccagaatcaccggcatcggcctgggcggcagagcccccagacccagatacgagcaggccccccccagaggctacgtgaccttcaacagcagcggcgagaaccccctggaggaggagggcctgtgctgcagagacgtgaccagccccatcaacgagagagacgtggagagcagcagcagcagcagcagcagagaggagcacgccttctgcgccaacctgggccccgtgcagagcagcagcagcagcgagggcctggccagagcccagggcctgagcagcgaggccagcgtggagagcaacgaggacagcgaccacgcctgcaagagcagcgccagaaagcaggccaagagctacatgaagaccaagaaccccgacagccagtggccccccagagccgccaccgacagagagggcttcctggccgagagcagcccccagacccagagagccccctacagcggcccccaggacctggccgccctgctggagcagatcggctgcctgaagtacctgcaggtgttcgaggagcaggacgtggacctgagaatcttcctgaccctgaccgagagcgacctgaaggagatcggcatcaccctgttcggccccaagagaaagatgaccagcgccatcgccagatggcacagcagcgccagaccccccggcgacgccctggagctggcctacgccgacagactggaggccgagatgcaggagctggccatccagctgcacaagagatgcgaggaggtggaggccaccagaggccaggtgtgccaggagcaggagctgagagccgtggtggagagctgcctgctggagcaggacagagccagagaggacctgcaggccagactgagagagacctgggccctggccagagacgccgccctggtgctggaccagctgagagcctgccaggccgagctgagcagcagagtgagacaggaccagccccccggcgccgccaccctgggcctggccgtgccccccgccgacagcaagggctggcaggccagcctgcaggccatgagcctgcccgagctgagcggcgccctggaggacagagtgagagagatgggccaggccctgtgcctggtgacccagagcctggagaagctgcaggtgctgaacggcaagaagtggagagagacctag

SEQ ID NO: 17904 - DNA, 1584 bp, Artificial Sequence
  Description of Artificial Sequence: Synthetic coding sequence
atgaaggacatccagggctggaccgccctgttccactgcaccagcgccggccaccagcacatggtgagattcctgctggacagcggcgccaacgccaacgtgagagagcccatctgcggcttcacccccctgatggaggccgccgccgccggccacgagatcatcgtgcagtacttcctgaaccacggcgtgaaggtggacgccagagaccacagcggcgccaccgccagaatgctggccaagcagtacggccacatgaagatcgtggccctgatggacacctacagccccagcctgcccaagagcctgtacagaagccccgagaagtacgaggacctgagcagcagcgacgagagctgccccgccccccagagacagagaccctgcagaaagaagggcgtgagcatccacgagggccccagagccctggccagaatcaccggcatcggcctgggcggcagagcccccagacccagatacgagcaggccccccccagaggctacgtgaccttcaacagcagcggcgagaaccccctggaggaggagggcctgtgctgcagagacgtgaccagccccatcaacgagagagacgtggagagcagcagcagcagcagcagcagagaggagcacgccttctgcgccaacctgggccccgtgcagagcagcagcagcagcgagggcctggccagagcccagggcctgagcagcgaggccagcgtggagagcaacgaggacagcgaccacgcctgcaagagcagcgccagaaagcaggccaagagctacatgaagaccaagaaccccgacagccagtggccccccagagccgccaccgacagagagggcttcctggccgagagcagcccccagacccagagagccccctacagcggcccccaggacctggccgccctgctggagcagatcggctgcctgaagtacctgcaggtgttcgaggagcaggacgtggacctgagaatcttcctgaccctgaccgagagcgacctgaaggagatcggcatcaccctgttcggccccaagagaaagatgaccagcgccatcgccagatggcacagcagcgccagaccccccggcgacgccctggagctggcctacgccgacagactggaggccgagatgcaggagctggccatccagctgcacaagagatgcgaggaggtggaggccaccagaggccaggtgtgccaggagcaggagctgagagccgtggtggagagctgcctgctggagcaggacagagccagagaggacctgcaggccagactgagagagacctgggccctggccagagacgccgccctggtgctggaccagctgagagcctgccaggccgagctgagcagcagagtgagacaggaccagccccccggcgccgccaccctgggcctggccgtgccccccgccgacagcaagggctggcaggccagcctgcaggccatgagcctgcccgagctgagcggcgccctggaggacagagtgagagagatgggccaggccctgtgcctggtgacccagagcctggagaagctgcaggtgctgaacggcaagaagtggagagagacctag

SEQ ID NO: 17905 - DNA, 921 bp, Artificial Sequence
  Description of Artificial Sequence: Synthetic coding sequence
atgctggccaagcagtacggccacatgaagatcgtggccctgatggacacctacagccccagcctgcccaagagcctgtacagaagccccgagaagtacgaggacctgagcagcagcgacgagagctgccccgccccccagagacagagaccctgcagaaagaagggcgtgagcatccacgagggccccagagccctggccagaatcaccggcatcggcctgggcggcagagcccccagacccagatacgagcaggccccccccagaggctacgtgaccttcaacagcagcggcgagaaccccctggaggaggagggcctgtgctgcagagacgtgaccagccccatcaacgagagagacgtggagagcagcagcagcagcagcagcagagaggagcacgccttctgcgccaacctgggccccgtgcagagcagcagcagcagcgagggcctggccagagcccagggcctgagcagcgaggccagcgtggagagcaacgaggacagcgaccacgcctgcaagagcagcgccagaaagcaggccaagagctacatgaagaccaagaaccccgacagccagtggccccccagagccgccaccgacagagagggcttcctggccgagagcagcccccagacccagagagccccctacagcggcccccaggtgagacccctggtgaagctggaggtgaccctgagagacggcaccttctgcgacctgggcggcatgtgctgcgtgtacgacgtgcccggcgccgccagaagaaccgagtggagatggcacccccacggcctgctgggcagcaccggcagccagcccgccccctggctggccgcccccctgcagagattctacagcgtgcccctgcacggcaaggacctgagcccctgcttcccctactggagctggcccccctag

SEQ ID NO: 17906 - DNA, 1275 bp, Artificial Sequence
  Description of Artificial Sequence: Synthetic coding sequence
atgagaatcttcatcgccttcgagggcagcttcgagcccttcgacgtgagcgccgacgagaccgtggaggtggtgaagctgatgatcaaggactacttccacatccccctgagcgaggacaagcagggcagaagatacctggagctgatgtacgccggcgccgccctgaaggacagctggagcctggccgacgtgggcatcagcttctgcagcaccctgaagtgcttcgtgaaggaggaggacaagcccaccctgtacgtgttcaacgccgtgacccaggacaccatgcccgtgatggagagcatcagcctgctggacaagaccgtgagcgacctgagaaccctggtgaccctgagatgcggcctgcccgtgagcgtgtactgcctgagaacccccagaggcctggagatgtacgactgcaacaccctgaaggactaccagaccgacatcggcaccaccctgagactggacgtgtgggacggctggaaggagttcctgatgggctgcctgctgggccagaagctgaaggtgcagagatacctgagcaaggagggccccgtgctgaagtaccagaagagagtggccctgtacatcgccgccttctgcggctacatcgagctgaccgagtgggccctgaagcagggcgccagaccccacgaggccgtgggcgtgcacccctacagagcctggtgccacgaggccctgcacgccgacgtgagcaagtgccccatccacgccgccgccgaggccggccagctgctgatcctgaaggccttcgtgaactacagcgtgctgtgcctggagtgcaagaacgccgccggccagacccccctgaccatcgtgttcaagcacaagcacaaggactgcgtgctgtacctgctgagcaagatgtggagcaccgtgagcttccccaagatcagcgtgcccatgagaatctacatcaagatcaagcagtggatcctgagagcccagagccacagcctgcacaagagccagttctgcggcgccagagtgttcggcgccaaggtgggcgacaccgtgatggtggacggcttcaccaagcccaagatgaccagcaagagctggcacaaggccggcaacagcgacagccagagcatcgtgctgaagctgcccagcctgagcaagcagaccgccagcagcaagcccgtgaaccccctggccatcagccagcccgacaccagaaagcaggccctgaagttccaccccctgaagggcgagagccccaaggccgacaagagcagcggcatcatgtag

SEQ ID NO: 17907 - DNA, 1635 bp, Artificial Sequence
  Description of Artificial Sequence: Synthetic coding sequence
atgagaatcttcatcgccttcgagggcagcttcgagcccttcgacgtgagcgccgacgagaccgtggaggtggtgaagctgatgatcaaggactacttccacatccccctgagcgaggacaagcagggcagaagatacctggagctgatgtacgccggcgccgccctgaaggacagctggagcctggccgacgtgggcatcagcttctgcagcaccctgaagtgcttcgtgaaggaggaggacaagcccaccctgtacgtgttcaacgccgtgacccaggacaccatgcccgtgatggagagcatcagcctgctggacaagaccgtgagcgacctgagaaccctggtgaccctgagatgcggcctgcccgtgagcgtgtactgcctgagaacccccagaggcctggagatgtacgactgcaacaccctgaaggactaccagaccgacatcggcaccaccctgagactggacgtgtgggacggctggaaggagttcctgatgggctgcctgctgggccagaagctgaaggtgcagagatacctgagcaaggagggccccgtgctgaagtaccagaagagagtggccctgtacatcgccgccttctgcggctacatcgagctgaccgagtgggccctgaagcagggcgccagaccccacgaggccgtgggcgtgcacccctacagagcctggtgccacgaggccctgcacgccgacgtgagcaagtgccccatccacgccgccgccgaggccggccagctgctgatcctgaaggccttcgtgaactacagcgtgctgtgcctggagtgcaagaacgccgccggccagacccccctgaccatcgtgttcaagcacaagcacaaggactgcgtgctgtacctgctgagcaagatgtggagcaccgtgagcttccccaagatcagcgtgcccatgagaatctacatcaagatcaagcagtggatcctgagagcccagagccacagcctgcacaagagccagttctgcggcgccagagtgttcggcgccaaggtgggcgacaccgtgatggtggacggcttcaccaagcccaagatgaccagcaagagctggcacaaggccggcaacagcgacagccagagcatcgtgctgaagctgcccagcctgagcaagcagaccgccagcagcaagcccgtgaaccccctggccatcagccagcccgacaccagaaagcaggccctgaagttccaccccctggtgaacgccagcagcttcagcgagctgcagaagcaccagcagcagaaccagaagaagatcaccgccaccgccagaaagaaggagaagctgatcaagaacacctacctgccccaggtgcccctgccccccgtgagcagagtgggctacagccaccccagcttcttctacgccacccccagcgccgacttcctgctgaagagcagcttcagcagcttcctggagcacagcggcaagaccccctgggagaacgccatctactgcctggccgtggccagcgccttcaaggagaagagatggctgcagcagctggagatcgccagagtgctggccaagaagagcatcagcaacctgaccaccagaggcggcctgaccgcctgcgagaacagcctggagaccgtgctgtag

SEQ ID NO: 17908 - DNA, 2181 bp, Artificial Sequence
  Description of Artificial Sequence: Synthetic coding sequence
atgagccccgcccccgacgccgcccccgcccccgccagcatcagcctgttcgacctgagcgccgacgcccccgtgttccagggcctgagcctggtgagccacgcccccggcgaggccctggccagagcccccagaaccagctgcagcggcagcggcgagagagagagccccgagagaaagctgctgcagggccccatggacatcagcgagaagctgttctgcagcacctgcgaccagaccttccagaaccaccaggagcagagagagcactacaagctggactggcacagattcaacctgaagcagagactgaaggacaagcccctgctgagcgccctggacttcgagaagcagagcagcaccggcgacctgagcagcatcagcggcagcgaggacagcgacagcgccagcgaggaggacctgcagaccctggacagagagagagccaccttcgagaagctgagcagaccccccggcttctacccccacagagtgctgttccagaacgcccagggccagttcctgtacgcctacagatgcgtgctgggcccccaccaggacccccccgaggaggccgagctgctgctgcagaacctgcagagcagaggccccagagactgcgtggtgctgatggccgccgccggccacttcgccggcgccatcttccagggcagagaggtggtgacccacaagaccttccacagatacaccgtgagagccaagagaggcaccgcccagggcctgagagacgccagaggcggccccagccacagcgccggcgccaacctgagaagatacaacgaggccaccctgtacaaggacgtgagagacctgctggccggccccagctgggccaaggccctggaggaggccggcaccatcctgctgagagcccccagaagcggcagaagcctgttcttcggcggcaagggcgcccccctgcagagaggcgaccccagactgtgggacatccccctggccaccagaagacccaccttccaggagctgcagagagtgctgcacaagctgaccaccctgcacgtgtacgaggaggaccccagagaggccgtgagactgcacagcccccagacccactggaagaccgtgagagaggagagaaagaagcccaccgaggaggagatcagaaagatctgcagagacgagaaggaggccctgggccagaacgaggagagccccaagcagggcagcggcagcgagggcgaggacggcttccaggtggagctggagctggtggagctgaccgtgggcaccctggacctgtgcgagagcgaggtgctgcccaagagaagaagaagaaagagaaacaagaaggagaagagcagagaccaggaggccggcgcccacagaaccctgctgcagcagacccaggaggaggagcccagcacccagagcagccaggccgtggccgcccccctgggccccctgctggacgaggccaaggcccccggccagcccgagctgtggaacgccctgctggccgcctgcagagccggcgacgtgggcgtgctgaagctgcagctggcccccagccccgccgaccccagagtgctgagcctgctgagcgcccccctgggcagcggcggcttcaccctgctgcacgccgccgccgccgccggcagaggcagcgtggtgagactgctgctggaggccggcgccgaccccaccgtgcaggacagcagagccagacccccctacaccgtggccgccgacaagagcaccagaaacgagttcagaagattcatggagaagaaccccgacgcctacgactacaacaaggcccaggtgcccggccccctgacccccgagatggaggccagacaggccaccagaaagagagagcagaaggccgccagaagacagagagaggagcagcagcagagacagcaggagcaggaggagagagagagagaggagcagagaagattcgccgccctgagcgacagagagaagagagccctggccgccgagagaagactggccgcccagctgggcgcccccaccagccccatccccgacagcgccatcgtgaacaccagaagatgctggagctgcggcgccagcctgcagggcctgacccccttccactacctggacttcagcttctgcagcaccagatgcctgcaggaccacagaagacaggccggcagacccagcagctag

SEQ ID NO: 17909 - DNA, 2181 bp, Artificial Sequence; identical to SEQ ID NO: 17908
  Description of Artificial Sequence: Synthetic coding sequence

SEQ ID NO: 17910 - DNA, 273 bp, Artificial Sequence
  Description of Artificial Sequence: Synthetic coding sequence
atgagccccgcccccgacgccgcccccgcccccgccagcatcagcctgttcgacctgagcgccgacgcccccgtgttccagggcctgagcctggtgagccacgcccccggcgaggccctggccagagcccccagaaccagctgcagcggcagcggcgagagagagagccccgagagaaagctgctgcagggccccatggacatcagcgagaagctgttctgcagcacctgcgaccagaccttccagaaccaccaggagcagagagagcactag

SEQ ID NO: 17911 - DNA, 423 bp, Artificial Sequence
  Description of Artificial Sequence: Synthetic coding sequence
atgagccccgcccccgacgccgcccccgcccccgccagcatcagcctgttcgacctgagcgccgacgcccccgtgttccagggcctgagcctggtgagccacgcccccggcgaggccctggccagagcccccagaaccagctgcagcggcagcggcgagagagagagccccgagagaaagctgctgcagggccccatggacatcagcgagaagctgttctgcagcacctgcgaccagaccttccagaaccaccaggagcagagagagcactacaagctggactggcacagattcaacctgaagcagagactgaaggacaagcccctgctgagcgccctggacttcgagaagcagagcagcaccggcgacctgagcagcatcagcggcagcgaggacagcgacagcgccagcgaggaggactag

SEQ ID NO: 17912 - DNA, 1263 bp, Artificial Sequence
  Description of Artificial Sequence: Synthetic coding sequence
atgagcgccgccggcgccggcgccggcgtggaggccggcttcagcagcgaggagctgctgagcctgagattccccctgcacagagcctgcagagacggcgacctggccaccctgtgcagcctgctgcagcagaccccccacgcccacctggccagcgaggacagcttctacggctggacccccgtgcactgggccgcccacttcggcaagctggagtgcctggtgcagctggtgagagccggcgccaccctgaacgtgagcaccaccagatacgcccagacccccgcccacatcgccgccttcggcggccacccccagtgcctggtgtggctgatccaggccggcgccaacatcaacaagcccgactgcgagggcgagacccccatccacaaggccgccagaagcggcagcctggagtgcatcagcgccctggtggccaacggcgcccacgtggacctgagaaacgccagcggcctgaccgccgccgacatcgcccagacccagggcttccaggagtgcgcccagttcctgctgaacctgcagaactgccacctgaaccacttctacaacaacggcatcctgaacggcggccaccagaacgtgttccccaaccacatcagcgtgggcaccaacagaaagagatgcctggaggacagcgaggacttcggcgtgaagaaggccagaaccgaggcccagagcctggacagcgccgtgcccctgaccaacggcgacaccgaggacgacgccgacaagatgcacgtggacagagagttcgccgtggtgaccgacatgaagaacagcagcagcgtgagcaacaccctgaccaacggctgcgtgatcaacggccacctggacttccccagcaccacccccctgagcggcatggagagcagaaacggccagtgcctgaccggcaccaacggcatcagcagcggcctggcccccggccagcccttccccagcagccagggcagcctgtgcatcagcggcaccgaggagcccgagaagaccctgagagccaaccccgagctgtgcggcagcctgcacctgaacggcagccccagcagctgcatcgccagcagacccagctgggtggaggacatcggcgacaacctgtactacggccactaccacggcttcggcgacaccgccgagagcatccccgagctgaacagcgtggtggagcacagcaagagcgtgaaggtgcaggagagatacgacagcgccgtgctgggcaccatgcacctgcaccacggcagctag

SEQ ID NO: 17913 - DNA, 663 bp, Artificial Sequence
  Description of Artificial Sequence: Synthetic coding sequence
atgagcgccgccggcgccggcgccggcgtggaggccggcttcagcagcgaggagctgctgagcctgagattccccctgcacagagcctgcagagacggcgacctggccaccctgtgcagcctgctgcagcagaccccccacgcccacctggccagcgaggacagcttctacggctggacccccgtgcactgggccgcccacttcggcaagctggagtgcctggtgcagctggtgagagccggcgccaccctgaacgtgagcaccaccagatacgcccagacccccgcccacatcgccgccttcggcggccacccccagtgcctggtgtggctgatccaggccggcgccaacatcaacaagcccgactgcgagggcgagacccccatccacaaggccgccagaagcggcagcctggagtgcatcagcgccctggtggccaacggcgcccacgtggagttcatcagccagagcagcgtgcacagctgcctgcccggcgagctgcagcacggcgtgaccttcgaccccagcgtgctgatccagtgcctgaagcccgagaagtgccagtggcccgacagcagcagacactgcaccaaccccggcttccccagagtgtgccccgtgagcctggagccccccgagctgagcagcgagcccttcctgtag

SEQ ID NO: 17914 - DNA, 1557 bp, Artificial Sequence
  Description of Artificial Sequence: Synthetic coding sequence
atggtgcagctggtgctgcagtacagagactaccagagagccacccagagactggccggcatccccgagctgctgaacaagctgagacaggcccccgacttctacgtggagatgaagtgggagttcaccagctgggtgcccctggtgagcaagatgtgccccagcgacgtgtacagagtgtggaagagaggcgagagcctgagagtggacaccagcctgctgggcttcgagcacatgacctggcagagaggcagaagaagcttcatcttcaagggccaggaggccggcgccctggtgatggaggtggaccacgacagacaggtggtgcacgtggagaccctgggcctgaccctgcaggagcccgagaccctgctggccgccatgagacccagcgaggagcacgtggccagcagactgaccagccccatcgtgagcacccacctggacaccagaaacgtggccttcgagagaaacaagtgcggcatctggggctggagaagcgagaagatggagaccgtgagcggctacgaggccaaggtgtacagcgccaccaacgtggagctggtgaccagaaccagaaccgagcacctgagcgaccaggacaagagcagaagcaaggccggcaagacccccttccagagcttcctgggcatggcccagcagcacagcagccacaccggcgcccccgtgcagcaggccgccagccccaccaaccccaccgccatcagccccgaggagtacttcgaccccaacttcagcctggagagcagaaacatcggcagacccatcgagatgagcagcaaggtgcagagattcaaggccaccctgtggctgagcgaggagcaccccctgagcctgggcgaccaggtgacccccatcatcgacctgatggccatcagcaacgcccacttcgccaagctgagagacttcatcaccctgagactgccccccggcttccccgtgaagatcgagatccccctgttccacgtgctgaacgccagaatcaccttcagcaacctgtgcggctgcgacgagcccctgagcagcgtgtgggtgcccgcccccagcagcgccgtggccgccagcggcaaccccttcccctgcgaggtggaccccaccgtgttcgaggtgcccaacggctacagcgtgctgggcatggagagaaacgagcccctgagagacgaggacgacgacctgctgcagttcgccatccagcagagcctgctggaggccggcaccgaggccgagcaggtgaccgtgtgggaggccctgaccaacaccagacccggcgccagaccccccccccaggccaccgtgtacgaggagcagctgcagctggagagagccctgcaggagagcctgcagctgagcaccgagcccagaggccccggcagcccccccagaaccccccccgcccccggcccccccagcttcgaggagcagctgagactggccctggagctgagcagcagagagcaggaggagagagagagaagaggccagcaggaggaggaggacctgcagagaatcctgcagctgagcctgaccgagcactag

SEQ ID NO: 17915 - DNA, 1557 bp, Artificial Sequence; identical to SEQ ID NO: 17914
  Description of Artificial Sequence: Synthetic coding sequence

SEQ ID NO: 17916 - DNA, 1818 bp, Artificial Sequence
  Description of Artificial Sequence: Synthetic coding sequence
atggccggccccggccccaccttccccctgcacagactggtgtgggccaacagacacagagagctggaggccgccctgcacagccaccagcacgacatcgagcaggaggaccccagaggcagaacccccctggagctggccgtgagcctgggcaacctggagagcgtgagagtgctgctgagacacaacgccaacgtgggcaaggagaacagacagggctgggccgtgctgcaggaggccgtgagcaccggcgaccccgagatggtgcagctggtgctgcagtacagagactaccagagagccacccagagactggccggcatccccgagctgctgaacaagctgagacaggcccccgacttctacgtggagatgaagtgggagttcaccagctgggtgcccctggtgagcaagatgtgccccagcgacgtgtacagagtgtggaagagaggcgagagcctgagagtggacaccagcctgctgggcttcgagcacatgacctggcagagaggcagaagaagcttcatcttcaagggccaggaggccggcgccctggtgatggaggtggaccacgacagacaggtggtgcacgtggagaccctgggcctgaccctgcaggagcccgagaccctgctggccgccatgagacccagcgaggagcacgtggccagcagactgaccagccccatcgtgagcacccacctggacaccagaaacgtggccttcgagagaaacaagtgcggcatctggggctggagaagcgagaagatggagaccgtgagcggctacgaggccaaggtgtacagcgccaccaacgtggagctggtgaccagaaccagaaccgagcacctgagcgaccaggacaagagcagaagcaaggccggcaagacccccttccagagcttcctgggcatggcccagcagcacagcagccacaccggcgcccccgtgcagcaggccgccagccccaccaaccccaccgccatcagccccgaggagtacttcgaccccaacttcagcctggagagcagaaacatcggcagacccatcgagatgagcagcaaggtgcagagattcaaggccaccctgtggctgagcgaggagcaccccctgagcctgggcgaccaggtgacccccatcatcgacctgatggccatcagcaacgcccacttcgccaagctgagagacttcatcaccctgagactgccccccggcttccccgtgaagatcgagatccccctgttccacgtgctgaacgccagaatcaccttcagcaacctgtgcggctgcgacgagcccctgagcagcgtgtgggtgcccgcccccagcagcgccgtggccgccagcggcaaccccttcccctgcgaggtggaccccaccgtgttcgaggtgcccaacggctacagcgtgctgggcatggagagaaacgagcccctgagagacgaggacgacgacctgctgcagttcgccatccagcagagcctgctggaggccggcaccgaggccgagcaggtgaccgtgtgggaggccctgaccaacaccagacccggcgccagaccccccccccaggccaccgtgtacgaggagcagctgcagctggagagagccctgcaggagagcctgcagctgagcaccgagcccagaggccccggcagcccccccagaaccccccccgcccccggcccccccagcttcgaggagcagctgagactggccctggagctgagcagcagagagcaggaggagagagagagaagaggccagcaggaggaggaggacctgcagagaatcctgcagctgagcctgaccgagcactag

SEQ ID NO: 17917 - DNA, 1557 bp, Artificial Sequence; identical to SEQ ID NO: 17914
  Description of Artificial Sequence: Synthetic coding sequence

SEQ ID NO: 17918 - DNA, 768 bp, Artificial Sequence
  Description of Artificial Sequence: Synthetic coding sequence
atgagctgcggcagactgggcagattcaaggccaccctgtggctgagcgaggagcaccccctgagcctgggcgaccaggtgacccccatcatcgacctgatggccatcagcaacgcccacttcgccaagctgagagacttcatcaccctgagactgccccccggcttccccgtgaagatcgagatccccctgttccacgtgctgaacgccagaatcaccttcagcaacctgtgcggctgcgacgagcccctgagcagcgtgtgggtgcccgcccccagcagcgccgtggccgccagcggcaaccccttcccctgcgaggtggaccccaccgtgttcgaggtgcccaacggctacagcgtgctgggcatggagagaaacgagcccctgagagacgaggacgacgacctgctgcagttcgccatccagcagagcctgctggaggccggcaccgaggccgagcaggtgaccgtgtgggaggccctgaccaacaccagacccggcgccagaccccccccccaggccaccgtgtacgaggagcagctgcagctggagagagccctgcaggagagcctgcagctgagcaccgagcccagaggccccggcagcccccccagaaccccccccgcccccggcccccccagcttcgaggagcagctgagactggccctggagctgagcagcagagagcaggaggagagagagagaagaggccagcaggaggaggaggacctgcagagaatcctgcagctgagcctgaccgagcactag

SEQ ID NO: 17919 - DNA, 1011 bp, Artificial Sequence
  Description of Artificial Sequence: Synthetic coding sequence
atgaagcccaagagcagagaggtggagagaagactgaccagccccgtgatcaacaccagcctggacaccaagaacatcgccttcgagagaaccaagagcggcttctggggctggagaaccgacaaggccgaggtggtgaacggctacgaggccaaggtgtacaccgtgaacaacgtgaacgtgatcaccaagatcagaaccgagcacctgaccgaggaggagaagaagagatacaaggacagaaaccccctggagagcctgctgggcaccgtggagcaccagttcggcgcccagggcgacctgaccaccgagtgcgccaccgccaacaaccccaccgccatcacccccgacgagtacttcaacgaggagttcgacctgaaggacagagacatcggcagacccaaggagctgaccatcagaacccagaagttcaaggccatgctgtggatgtgcgaggagttccccctgagcctggtggagcaggtgatccccatcatcgacctgatggccagaaccagcgcccacttcgccagactgagagacttcatcaagctggagttcccccccggcttccccgtgaagatcgccagccacatcaccaacttcgaggtggaccagagcgtgttcgagatccccgagagctactacgtgcaggacaacggcagaaacgtgcacctgcaggacgaggactacgagatcatgcagttcgccatccagcagagcctgctggagagcagcagaagccaggagctgagcggccccgccagcaacggcggcatcagccagaccaacacctacgacgcccagtacgagagagccatccaggagagcctgctgaccagcaccgagggcctgtgccccagcgccctgagcgagaccagcagattcgacaacgacctgcagctggccatggagctgagcgccaaggagctggaggagtgggagctgagactgcaggaggaggaggccgagctgcagcaggtgctgcagctgagcctgaccgacaagtag

SEQ ID NO: 17920 - DNA, 1773 bp, Artificial Sequence
  Description of Artificial Sequence: Synthetic coding sequence
atgagcagcgcctgcgacgccggcgaccactaccccctgcacctgctggtgtggaagaacgactacagacagctggagaaggagctgcagggccagaacgtggaggccgtggaccccagaggcagaaccctgctgcacctggccgtgagcctgggccacctggagagcgccagagtgctgctgagacacaaggccgacgtgaccaaggagaacagacagggctggaccgtgctgcacgaggccgtgagcaccggcgaccccgagatggtgtacaccgtgctgcagcacagagactaccacaacaccagcatggccctggagggcgtgcccgagctgctgcagaagatcctggaggcccccgacttctacgtgcagatgaagtgggagttcaccagctgggtgcccctggtgagcagaatctgccccaacgacgtgtgcagaatctggaagagcggcgccaagctgagagtggacatcaccctgctgggcttcgagaacatgagctggatcagaggcagaagaagcttcatcttcaagggcgaggacaactgggccgagctgatggaggtgaaccacgacgacaaggtggtgaccaccgagagattcgacctgagccaggagatggagagactgaccctggacctgatgaagcccaagagcagagaggtggagagaagactgaccagccccgtgatcaacaccagcctggacaccaagaacatcgccttcgagagaaccaagagcggcttctggggctggagaaccgacaaggccgaggtggtgaacggctacgaggccaaggtgtacaccgtgaacaacgtgaacgtgatcaccaagatcagaaccgagcacctgaccgaggaggagaagaagagatacaaggccgacagaaaccccctggagagcctgctgggcaccgtggagcaccagttcggcgcccagggcgacctgaccaccgagtgcgccaccgccaacaaccccaccgccatcacccccgacgagtacttcaacgaggagttcgacctgaaggacagagacatcggcagacccaaggagctgaccatcagaacccagaagttcaaggccatgctgtggatgtgcgaggagttccccctgagcctggtggagcaggtgatccccatcatcgacctgatggccagaaccagcgcccacttcgccagactgagagacttcatcaagctggagttcccccccggcttccccgtgaagatcgagatccccctgttccacgtgctgaacgccagaatcaccttcggcaacgtgaacggctgcagcaccgccgaggagagcgtgagccagaacgtggagggcacccaggccgacagcgccagccacatcaccaacttcgaggtggaccagagcgtgttcgagatccccgagagctactacgtgcaggacaacggcagaaacgtgcacctgcaggacgaggactacgagatcatgcagttcgccatccagcagagcctgctggagagcagcagaagccaggagctgagcggccccgccagcaacggcggcatcagccagaccaacacctacgacgcccagtacgagagagccatccaggagagcctgctgaccagcaccgagggcctgtgccccagcgccctgagcgagaccagcagattcgacaacgacctgcagctggccatggagctgagcgccaaggagctggaggagtgggagctgagactgcaggaggaggaggccgagctgcagcaggtgctgcagctgagcctgaccgacaagtag

SEQ ID NO: 17921 - DNA, 1881 bp, Artificial Sequence
  Description of Artificial Sequence: Synthetic coding sequence
atgatccccgccaacgccagcgccagaaagggccccgagggcaagtaccccctgcactacctggtgtggcacaacagacacagagagctggagaaggaggtgagagccggccaggtggacatcgagcagctggaccccagaggcagaacccccctgcacctggccaccaccctgggccacctggagtgcgccagagtgctgctggcccacggcgccgacgtgggcagagagaacagaagcggctggaccgtgctgcaggaggccgtgagcaccagagacctggagctggtgcagctggtgctgagatacagagactaccagagagtggtgaagagactggccggcatccccgtgctgctggagaagctgagaaaggcccaggacttctacgtggagatgaagtgggagttcaccagctgggtgcccctggtgagcaagatctgccccagcgacacctacaaggtgtggaagagcggccagaacctgagagtggacaccaccctgctgggcttcgaccacatgacctggcagagaggcaacagaagcttcgtgttcagaggccaggacaccagcgccgtggtgatggagatcgaccacgacagaagagtggtgtacaccgagaccctggccctggccggccaggacagagagctgctgctggccgccgcccagcccaccgaggagcaggtgctgagcagactgaccgcccccgtggtgaccacccagctggacaccaagaacatcagcttcgagagaaacaagaccggcatcctgggctggagaagcgagaagaccgagatggtgaacggctacgaggccaaggtgtacggcgccagcaacgtggagctgatcaccagaaccagaaccgagcacctgagcgagcagcacaagggcaaggtgaagggctgcaagacccccctgcagagcttcctgggcatcgccgagcagcacggcggcccccagaacggcaccctgatcacccagaccctgagccaggccaaccccaccgccatcaccgccgaggagtacttcaaccccaacttcgagctgggcaacagagacatgggcagacccatggagctgaccaccaagacccagaagttcaaggccaagctgtggctgtgcgaggagcaccccctgagcctgtgcgagcaggtggcccccatcatcgacctgatggccgtgagcaacgccctgttcgccaagctgagagacttcatcaccctgagactgccccccggcttccccgtgaagatcgagatccccatcttccacatcctgaacgccagaatcaccttcggcaacctgaacggctgcgacgagcccgtgcccagcgtgagaggcagccccagcagcgagacccccagccccggcagcgacagcagcagcgtgagcagcagcagcagcaccaccagctgcagaggctgcgagatcagccccgccctgttcgaggcccccagaggctacagcatgatgggcggccagagagaggccgccaccagagacgacgacgacgacctgctgcagttcgccatccagcagagcctgctggaggccggcagcgagtacgaccaggtgaccatctgggaggccctgaccaacagcaagcccggcacccaccccatgagctacgagggcagaagacaggacagaagcgccccccccaccccccagagacagcccgccccccccgccagcgtgcccagccccagacccagcagcggccccggcagcggcggccacgtgttcagaagctacgacgagcagctgagactggccatggagctgagcgcccaggagcaggaggagagaagaagaagagccagacaggaggaggaggagctggagagaatcctgagactgagcctgaccgagcagtag

SEQ ID NO: 17922 - DNA, 915 bp, Artificial Sequence
  Description of Artificial Sequence: Synthetic coding sequence
atggcccagcccggcgaccccagaagactgtgcagactggtgcaggagggcagactgagagccctgaaggaggagctgcaggccgccggcggctgccccggccccgccggcgacaccctgctgcactgcgccgccagacacggccacagagacgtgctggcctacctggccgaggcctggggcatggacatcgaggccaccaacagagactacaagagacccctgcacgaggccgccagcatgggccacagagactgcgtgagatacctgctgggcagaggcgccgccgtggactgcctgaagaaggccgactggacccccctgatgatggcctgcaccagaaagaacctgggcgtgatccaggagctggtggagcacggcgccaaccccctgctgaagaacaaggacggctggaacagcttccacatcgccagcagagagggcgaccccctgatcctgcagtacctgctgaccgtgtgccccggcgcctggaagaccgagagcaagatcagaagaacccccctgcacaccgccgccatgcacggccacctggaggccgtgaaggtgctgctgaagagatgccagtacgagcccgactacagagacaactgcggcgtgaccgccctgatggacgccatccagtgcggccacatcgacgtggccagactgctgctggacgagcacggcgcctgcctgagcgccgaggacagcctgggcgcccaggccctgcacagagccgccgtgaccggccaggacgaggccatcagattcctggtgagcgagctgggcgtggacgtggacgtgagagccaccagcacccacctgaccgccctgcactacgccgccaagccctgcatctggcccgtgcaggtgagcacctggcccgtgcccagcttcagctgcagcagagactag

SEQ ID NO: 17923 - DNA, 1086 bp, Artificial Sequence
  Description of Artificial Sequence: Synthetic coding sequence
atggcccagcccggcgaccccagaagactgtgcagactggtgcaggagggcagactgagagccctgaaggaggagctgcaggccgccggcggctgccccggccccgccggcgacaccctgctgcactgcgccgccagacacggccacagagacgtgctggcctacctggccgaggcctggggcatggacatcgaggccaccaacagagactacaagagacccctgcacgaggccgccagcatgggccacagagactgcgtgagatacctgctgggcagaggcgccgccgtggactgcctgaagaaggccgactggacccccctgatgatggcctgcaccagaaagaacctgggcgtgatccaggagctggtggagcacggcgccaaccccctgctgaagaacaaggacggctggaacagcttccacatcgccagcagagagggcgaccccctgatcctgcagtacctgctgaccgtgtgccccggcgcctggaagaccgagagcaagatcagaagaacccccctgcacaccgccgccatgcacggccacctggaggccgtgaaggtgctgctgaagagatgccagtacgagcccgactacagagacaactgcggcgtgaccgccctgatggacgccatccagtgcggccacatcgacgtggccagactgctgctggacgagcacggcgcctgcctgagcgccgaggacagcctgggcgcccaggccctgcacagagccgccgtgaccggccaggacgaggccatcagattcctggtgagcgagctgggcgtggacgtggacgtgagagccaccagcacccacctgaccgccctgcactacgccgccaaggagggccacaccagcaccatccagaccctgctgagcctgggcgccgacatcaacagcaaggacgagaagaacagaagcgccctgcacctggcctgcgccggccagcacctggcctgcgccaagttcctgctgcagagcggcctgaaggacagcgaggacatcaccggcaccctggcccagcagctgcccagaagagccgacgtgctgcagggcagcggccacagcgccatgacctag

SEQ ID NO: 17924 - DNA, 1086 bp, Artificial Sequence; identical to SEQ ID NO: 17923
  Description of Artificial Sequence: Synthetic coding sequence

SEQ ID NO: 17925 - DNA, 618 bp, Artificial Sequence
  Description of Artificial Sequence: Synthetic coding sequence
atgaagaccgcctacgaggaggtgaccaccgagctggaggagttcaaggaggccttcgccggcgccgtgaaggccaacaacagcatgagcaagaagctgatgaagagcgacaagaagatcgccgtgatcagcaccaagctgttcaccgagaagcagagaatgaagtacttcctgagcaccctgcccaccagacccgagcccgagctgccctgcgtggagaacctgaacagcatcgagctgaacagaaagtacatccccaagaccgccatcagaatccccaccagcaacccccagaccagcaacaactgcaagaacttcctgaccgagatggagctggacagagtggagcagatcatcaccggcaccaagaagagcttcgccatgctgagcacctgcagcagactgctgagcttcgtggagagcaccgcccccagaaagcacagaagagccctgcccatcatgagaagcctggtgcccaacagaagaaccaccgtggccagcaccgagagcagaaccaacagacccggcggcgtgagaagccccggcctgcagctggagggcaccagcaccctgcagtgggagcagggccccatcgcccaccccagacacagatgctag

SEQ ID NO: 17926 - DNA, 654 bp, Artificial Sequence
  Description of Artificial Sequence: Synthetic coding sequence
atgaagaccgcctacgaggaggtgaccaccgagctggaggagttcaaggaggccttcgccggcgccgtgaaggccaacaacagcatgagcaagaagctgatgaagagcgacaagaagatcgccgtgatcagcaccaagctgttcaccgagaagcagagaatgaagtacttcctgagcaccctgcccaccagacccgagcccgagctgccctgcgtggagaacctgaacagcatcgagctgaacagaaagtacatccccaagaccgccatcagaatccccaccagcaacccccagaccagcaacaactgcaagaacttcctgaccgagatggagctggacagagtggagcagatcatcaccggcaccaagaagagcttcgccatgctgagcacctgcagcagactgctgagcttcgtggagagcaccgcccccagaaagcacagaagagccctgcccatcatgagaagcctggtgcccaacagaagaaccaccgtggccagcaccgagatgagccagctgctgtacaagggcgtgcccttccagagcagaaccaacagacccggcggcgtgagaagccccggcctgcagctggagggcaccagcaccctgcagtgggagcagggccccatcgcccaccccagacacagatgctag

SEQ ID NO: 17927 - DNA, 2979 bp, Artificial Sequence
  Description of Artificial Sequence: Synthetic coding sequence
atgagaaagctgttcagcttcggcagaagactgggccaggccctgctgagcagcatggaccaggagtacgccggccccggctacgacatcagagactgggagctgagaaagatccacagagccgccatcaagggcgacgccgccgaggtggagagatgcctgaccagaagattcagagacctggacgccagagacagaaaggacagaaccgtgctgcacctggcctgcgcccacggcagagtgcaggtggtgaccctgctgctgcacagaagatgccagatcgacatctgcgacagactgaacagaacccccctgatgaaggccgtgcacagccaggaggaggcctgcgccatcgtgctgctggagtgcggcgccaaccccaacatcgaggacatctacggcaacaccgccctgcactacgccgtgtacaacaagggcaccagcctggccgagagactgctgagccaccacgccaacatcgaggccctgaacaaggagggcaacacccccctgctgttcgccatcaacagcagaagacagcacatggtggagttcctgctgaagaaccaggccaacatccacgccgtggacaacttcaagagaaccgccctgatcctggccgtgcagcacaacctgagcagcatcgtgaccctgctgctgcagcagaacatcagaatcagcagccaggacatgttcggccagaccgccgaggactacgccctgtgcagcgacctgagaagcatcagacagcagatcctggagcacaagaacaagatgctgaagaaccacctgagaaacgacaaccaggagaccgccgccatgaagcccgccaacctgaagaagagaaaggagagagccaaggccgagcacaacctgaaggtggccagcgaggagaagcaggagagactgcagagaagcgagaacaagcagccccaggacagccagagctacggcaagaagaaggacgccatgtacggcaacttcatgctgaagaaggacatcgccatgctgaaggaggagctgtacgccatcaagaacgacagcctgagaaaggagaagaagtacatccaggagatcaagagcatcaccgagatcaacgccaacttcgagaagagcgtgagactgaacgagaagatgatcaccaagaccgtggccagatacagccagcagctgaacgacctgaaggccgagaacgccagactgaacagcgagctggagaaggagaagcacaacaaggagagactggaggccgaggtggagagcctgcacagcagcctggccaccgccatcaacgagtacaacgagatcgtggagagaaaggacctggagctggtgctgtggagagccgacgacgtgagcagacacgagaagatgggcagcaacatcagccagctgaccgacaagaacgagctgctgaccgagcaggtgcacaaggccagagtgaagttcaacaccctgaagggcaagctgagagagaccagagacgccctgagagagaagaccctggccctgggcagcgtgcagctggacctgagacaggcccagcacagaatcaaggagatgaagcagatgcaccccaacggcgaggccaaggagagccagagcatcggcaagcagaacagcctggaggagagaatcagacagcaggagctggagaacctgctgctggagagacagctggaggacgccagaaaggagggcgacaacaaggagatcgtgatcaacatccacagagactgcctggagaacggcaaggaggacctgctggaggagagaaacaaggagctgatgaaggagtacaactacctgaaggagaagctgctgcagtgcgagaaggagaaggccgagagagaggtgatcgtgagagagttccaggaggagctggtggaccacctgaagaccttcagcatcagcgagagccccctggagggcaccagccactgccacatcaacctgaacgagacctggaccagcaagaagaagctgttccaggtggagatccagcccgaggagaagcacgaggagttcagaaagctgttcgagctgatcagcctgctgaactacaccgccgaccagatcagaaagaagaacagagagctggaggaggaggccaccggctacaagaagtgcctggagatgaccatcaacatgctgaacgccttcgccaacgaggacttcagctgccacggcgacctgaacaccgaccagctgaagatggacatcctgttcaagaagctgaagcagaagttcaacgacctggtggccgagaaggaggccgtgagcagcgagtgcgtgaacctggccaaggacaacgaggtgctgcaccaggagctgctgagcatgagaaacgtgcaggagaagtgcgagaagctggagaaggacaagaagatgctggaggaggaggtgctgaacctgaagacccacatggagaaggacatggtggagctgggcaagctgcaggagtacaagagcgagctggacgagagagccgtgcaggagatcgagaagctggaggagatccacctgcagaagcaggccgagtacgagaagcagctggagcagctgaacaaggacaacaccgccagcctgaagaagaaggagctgaccctgaaggacgtggagtgcaagttcagcaagatgaagaccgcctacgaggaggtgaccaccgagctggaggagttcaaggaggccttcgccggcgccgtgaaggccaacaacagcatgagcaagaagctgatgaagagcgacaagaagatcgccgtgatcagcaccaagctgttcaccgagaagcagagaatgaagtacttcctgagcaccctgcccaccagacccgagcccgagctgccctgcgtggagaacctgaacagcatcgagctgaacagaaagtacatccccaagaccgccatcagaatccccaccagcaacccccagaccagcaacaactgcaagaacttcctgaccgaggtgctgctgtgctag

SEQ ID NO: 17928 - DNA, 3036 bp, Artificial Sequence
  Description of Artificial Sequence: Synthetic coding sequence
atgagaaagctgctgagcttcggcagaagactgggccaggccctgctgagcagcatggaccaggagtacgccggcagaggctaccacatcagagactgggagctgagaaagatccacagagccgccatcaagggcgacgccgccgaggtggagcactgcctgaccagaagattcagagacctggacgtgagagacagaaaggacagaaccgtgctgcacctggcctgcgcccacggcagagtgcaggtggtgaccctgctgctggacagaaagtgccagatcaacatctgcgacagactgaacagaacccccctgatgaaggccgtgcactgccaggaggaggcctgcgccatcatcctgctgaagagaggcgccaaccccaacatcaaggacatctacggcaacaccgccctgcactacgccgtgtacaacgagggcaccagcctggccgagagactgctgagccaccacgccaacatcgaggccctgaacaaggagggcaacacccccctgctgttcgccatcaacagcagaagacagcacatggtggagttcctgctgaagaaccaggccaacatccacgccgtggacaacttcaagagaaccgccctgatcctggccgtgcagcacaacctgagcagcatcgtgaccctgctgctgcagcagaacatccacatcagcagccaggacatgttcggccagaccgccgaggactacgccttctgctgcgacctgagaagcatccagcagcagatcctggagcacaagaacaagatgctgaagaaccacctgagaaacgacaaccaggagaccgccgccatgaagcccgagaacctgaagaagagaaagaagagaaagaagctgaagaagagaaaggagggcgccaaggccgagcacaacctgaaggtggccagcgaggagaagcaggagagactggagagaagcgagaacaagcagccccaggacagccagagctacggcaagaagaaggacgagatgttcggcaacttcatgctgaagagagacatcgccatgctgaaggaggagctgtacgccatcaagaacgacagcctgagaaaggagaagaagtacatccaggagatcaagagcatcaccgagatcaacgccaacttcgagaagagcgtgagactgaacgaggagatgatcaccaagaaggtggcccagtacagccagcagctgaacgacctgaaggccgagaacgccagactgaacagcaagctggagaaggagaagcacaacaaggagagactggaggccgaggtggagagcctgcacagcaacctggccaccgccatcaacgagtacaacgagatcctggagagaaaggacctggagctggtgctgtggagagccgacgacgtgagcagacacgagaccatgggcagcaacatcagccagctgaccgacaagaacgagctgctgaccgagcaggtgcacaaggccagagtgaagttcaacaccctgaagggcaagctgagagagaccagagacgccctgagagagaagaccctggccctggagagcgtgcagctggacctgaagcaggcccagcacagaatcaaggagatgaagcagatgcaccccaacggcgaggccaaggagagccagagcatcggcaagcagaacagcagcgaggagagaatcagacagagagagctggagaacctgctgctggagagacagctggaggacgccagaaaggagggcgacaacaaggagatcgtgatcaacatccacagagactgcctggagaacggcaaggaggacctgctggaggagagaaacaaggagctgatgaacgagtacaactacctgaaggagaagctgctgcagtacgagaaggagaaggccgagagagaggtgatcgtgagagagttccaggaggagctggtggaccacctgaagaagttcagcatgagcgagagccccctggagggcaccagccactgccacatcaacctggacgagacctggaccagcaagaagaagctgttccaggtggagatccagcccgaggagaagcacgaggagttcagaaaggtgttcgagctgatcagcctgctgaactacaccgccgaccagatcagaaagaagaacagagagctggaggaggaggccaccggctacaagaagtgcctggagatgaccatcaacatgctgaacgccttcgccaacgaggacttcagctgccacggcgacctgaacaccgaccagctgaagatggacatcctgttcaagaagctgaagcagaagttcgacgacctgatggccgagaaggaggccgtgagcagcaagtgcgtgaacctggccaaggacaacgaggtgctgcaccaggagctgctgagcatgggcaaggtgcaggagaagtgcgagaagctggagaaggacaagaagatgctggaggagaaggtgctgaacctgaagacccacatggagaaggacatggtggagctgggcaaggtgcaggagtacaagagcgagctggacgagagagccatgcaggccatcgagaagctggaggagatccacctgcagaagcaggccgagtacgagaagcagctggagcagctgaacaaggacaacaccgccagcctgaagaagaaggagctgaccctgaaggacgtggagtgcaagttcagcaagatgaagaccgcctacgaggacgtgaccaccgagctggaggagtacaaggaggccttcgccgtggccctgaaggccaacagcagcatgagcgagaagatcaccaagagcgacaagaagatcgccgtgatcagcaccaagctgttcatggagaaggagagaatggagtacttcctgagcaccctgcccatgagacccgaccccgagctgccctgcgtggagaacctgaacagcatcgagctgaacagaaagtacatccccaagatggccatcagaatccccaccagcaacccccagaccagcaacaactgcaagaacagcctgaccgagctgctgctgagatgggccctggcccccatctacttcctgctgtag

SEQ ID NO: 17929 - DNA, 1206 bp, Artificial Sequence
  Description of Artificial Sequence: Synthetic coding sequence
gagaaggagaaggccgagagagaggtgatcgtgagagagttccaggaggagctggtggaccacctgaagaagttcagcatgagcgagagccccctggagggcaccagccactgccacatcaacctggacgagacctggaccagcaagaagaagctgttccaggtggagatccagcccgaggagaagcacgaggagttcagaaaggtgttcgagctgatcagcctgctgaactacaccgccgaccagatcagaaagaagaacagagagctggaggaggaggccaccggctacaagaagtgcctggagatgaccatcaacatgctgaacgccttcgccaacgaggacttcagctgccacggcgacctgaacaccgaccagctgaagatggacatcctgttcaagaagctgaagcagaagttcgacgacctgatggccgagaaggaggccgtgagcagcaagtgcgtgaacctggccaaggacaacgaggtgctgcaccaggagctgctgagcatgggcaaggtgcaggagaagtgcgagaagctggagaaggacaagaagatgctggaggagaaggtgctgaacctgaagacccacatggagaaggacatggtggagctgggcaaggtgcaggagtacaagagcgagctggacgagagagccatgcaggccatcgagaagctggaggagatccacctgcagaagcaggccgagtacgagaagcagctggagcagctgaacaaggacaacaccgccagcctgaagaagaaggagctgaccctgaaggacgtggagtgcaagttcagcaagatgaagaccgcctacgaggacgtgaccaccgagctggaggagtacaaggaggccttcgccgtggccctgaaggccaacagcagcatgagcgagaagatcaccaagagcgacaagaagatcgccgtgatcagcaccaagctgttcatggagaaggagagaatggagtacttcctgagcaccctgcccatgagacccgaccccgagctgccctgcgtggagaacctgaacagcatcgagctgaacagaaagtacatccccaagatggccatcagaatccccaccagcaacccccagaccagcaacaactgcaagaacagcctgaccgagatggagctggactgcgccgagcagatcatcaccgagaccaagaagagcatgctgcccaagtgcatcaactag

SEQ ID NO: 17930 - DNA, 2472 bp, Artificial Sequence
  Description of Artificial Sequence: Synthetic coding sequence
atgaagctgttcggcttcggcagcagaagaggccagaccgcccagggcagcatcgaccacgtgtacaccggcagcggctacagaatcagagacagcgagctgcagaagatccacagagccgccgtgaagggcgacgccgccgaggtggagagatgcctggccagaagaagcggcgacctggacgccctggacaagcagcacagaaccgccctgcacctggcctgcgccagcggccacgtgcaggtggtgaccctgctggtgaacagaaagtgccagatcgacgtgtgcgacaaggagaacagaacccccctgatccaggccgtgcactgccaggaggaggcctgcgccgtgatcctgctggagcacggcgccaaccccaacctgaaggacatctacggcaacaccgccctgcactacgccgtgtacagcgagagcaccagcctggccgagaagctgctgagccacggcgcccacatcgaggccctggacaaggacaacaacacccccctgctgttcgccatcatctgcaagaaggagaagatggtggagttcctgctgaagagaaaggccagcagccacgccgtggacagactgagaagaagcgccctgatgctggccgtgtactacgacagccccggcatcgtgaacatcctgctgaagcagaacatcgacgtgttcgcccaggacatgtgcggcagagacgccgaggactacgccatcagccaccacctgaccaagatccagcagcagatcctggagcacaagaagaagatcctgaagaaggagaagagcgacgtgggcagcagcgacgagagcgccgtgagcatcttccacgagctgagagtggacagcctgcccgccagcgacgacaaggacctgaacgtggccaccaagcagtgcgtgcccgagaaggtgagcgagcccctgcccggcagcagccacgagaagggcaacagaatcgtgaacggccagggcgagggcccccccgccaagcaccccagcctgaagcccagcaccgaggtggaggaccccgccgtgaagggcgccgtgcagagaaagaacgtgcagaccctgagagccgagcaggccctgcccgtggccagcgaggaggagcaggagagacacgagagaagcgagaagaagcagccccaggtgaaggagggcaacaacaccaacaagagcgagaagatccagctgagcgagaacatctgcgacagcaccagcagcgccgccgccggcagactgacccagcagagaaagatcggcaagacctacccccagcagttccccaagaagctgaaggaggagcacgacagatgcaccctgaagcaggagaacgaggagaagaccaacgtgaacatgctgtacaagaagaacagagaggagctggagagaaaggagaagcagtacaagaaggaggtggaggccaagcagctggagcccaccgtgcagagcctggagatgaagagcaagaccgccagaaacacccccaacagagacttccacaaccacgaggagatgaagggcctgatggacgagaactgcatcctgaaggccgacatcgccatcctgagacaggagatctgcaccatgaagaacgacaacctggagaaggagaacaagtacctgaaggacatcaagatcgtgaaggagaccaacgccgccctggagaagtacatcaagctgaacgaggagatgatcaccgagaccgccttcagataccagcaggagctgaacgacctgaaggccgagaacaccagactgaacgccgagctgctgaaggagaaggagagcaagaagagactggaggccgacatcgagagctaccagagcagactggccgccgccatcagcaagcacagcgagagcgtgaagaccgagagaaacctgaagctggccctggagagaaccagagacgtgagcgtgcaggtggagatgagcagcgccatcagcaaggtgaaggacgagaacgagttcctgaccgagcagctgagcgagacccagatcaagttcaacgccctgaaggacaagttcagaaagaccagagacagcctgagaaagaagagcctggccctggagaccgtgcagaacgacctgagccagacccagcagcagacccaggagatgaaggagatgtaccagaacgccgaggccaaggtgaacaacagcaccggcaagtggaactgcgtggaggagagaatctgccacctgcagagagagaacgcctggctggtgcagcagctggacgacgtgcaccagaaggaggaccacaaggagatcgtgaccaacatccagagaggcttcatcgagagcggcaagaaggacctggtgctggaggagaagagcaagaagctgatgaacgagtgcgaccacctgaaggagagcctgttccagtacgagagagagaagaccgagggcgtggtgagcatcaaggaggacaagtacttccagaccagcagaaagaagatctag

SEQ ID NO: 17931 - DNA, 2472 bp, Artificial Sequence
  Description of Artificial Sequence: Synthetic coding sequence
atgaagctgttcggcttcggcagcagaagaggccagaccgcccagggcagcatcgaccacgtgtacaccggcagcggctacagaatcagagacagcgagctgcagaagatccacagagccgccgtgaagggcgacgccgccgaggtggagagatgcctggccagaagaagcggcgacctggacgccctggacaagcagcacagaaccgccctgcacctggcctgcgccagcggccacgtgcaggtggtgaccctgctggtgaacagaaagtgccagatcgacgtgtgcgacaaggagaacagaacccccctgatccaggccgtgcactgccaggaggaggcctgcgccgtgatcctgctggagcacggcgccaaccccaacctgaaggacatctacggcaacaccgccctgcactacgccgtgtacagcgagagcaccagcctggccgagaagctgctgagccacggcgcccacatcgaggccctggacaaggacaacaacacccccctgctgttcgccatcatctgcaagaaggagaagatggtggagttcctgctgaagagaaaggccagcagccacgccgtggacagactgagaagaagcgccctgatgctggccgtgtactacgacagccccggcatcgtgaacatcctgctgaagcagaacatcgacgtgttcgcccaggacatgtgcggcagagacgccgaggactacgccatcagccaccacctgaccaagatccagcagcagatcctggagcacaagaagaagatcctgaagaaggagaagagcgacgtgggcagcagcgacgagagcgccgtgagcatcttccacgagctgagagtggacagcctgcccgccagcgacgacaaggacctgaacgtggccaccaagcagtgcgtgcccgagaaggtgagcgagcccctgcccggcagcagccacgagaagggcaacagaatcgtgaacggccagggcgagggcccccccgccaagcaccccagcctgaagcccagcaccgaggtggaggaccccgccgtgaagggcgccgtgcagagaaagaacgtgcagaccctgagagccgagcaggccctgcccgtggccagcgaggaggagcaggagagacacgagagaagcgagaagaagcagccccaggtgaaggagggcaacaacaccaacaagagcgagaagatccagctgagcgagaacatctgcgacagcaccagcagcgccgccgccggcagactgacccagcagagaaagatcggcaagacctacccccagcagttccccaagaagctgaaggaggagcacgacagatgcaccctgaagcaggagaacgaggagaagaccaacgtgaacatgctgtacaagaagaacagagaggagctggagagaaaggagaagcagtacaagaaggaggtggaggccaagcagctggagcccaccgtgcagagcctggagatgaagagcaagaccgccagaaacacccccaacagagacttccacaaccacgaggagatgaagggcctgatggacgagaactgcatcctgaaggccgacatcgccatcctgagacaggagatctgcaccatgaagaacgacaacctggagaaggagaacaagtacctgaaggacatcaagatcgtgaaggagaccaacgccgccctggagaagtacatcaagctgaacgaggagatgatcaccgagaccgccttcagataccagcaggagctgaactacctgaaggccgagaacaccagactgaacgccgagctgctgaaggagaaggagagcaagaagagactggaggccgacatcgagagctaccagagcagactggccgccgccatcagcaagcacagcgagagcgtgaagaccgagagaaacctgaagctggccctggagagaaccagagacgtgagcgtgcaggtggagatgagcagcgccatcagcaaggtgaaggacgagaacgagttcctgaccgagcagctgagcgagacccagatcaagttcaacgccctgaaggacaagttcagaaagaccagagacagcctgagaaagaagagcctggccctggagaccgtgcagaacgacctgagccagacccagcagcagacccaggagatgaaggagatgtaccagaacgccgaggccaaggtgaacaacagcaccggcaagtggaactgcgtggaggagagaatctgccacctgcagagagagaacgcctggctggtgcagcagctggacgacgtgcaccagaaggaggaccacaaggagatcgtgaccaacatccagagaggcttcatcgagagcggcaagaaggacctggtgctggaggagaagagcaagaagctgatgaacgagtgcgaccacctgaaggagagcctgttccagtacgagagagagaagaccgagggcgtggtgagcatcaaggaggacaagtacttccagaccagcagaaagaccatctag

SEQ ID NO: 17932 - DNA, 2472 bp, Artificial Sequence
  Description of Artificial Sequence: Synthetic coding sequence
atgaagctgttcggcttcggcagcagaagaggccagaccgcccagggcagcatcgaccacgtgtacaccggcagcggctacagaatcagagacagcgagctgcagaagatccacagagccgccgtgaagggcgacgccgccgaggtggagagatgcctggccagaagaagcggcgagctggacgccctggacaagcagcacagaaccgccctgcacctggcctgcgccagcggccacgtgcaggtggtgaccctgctggtgaacagaaagtgccagatcgacgtgtgcgacaaggagaacagaacccccctgatccaggccgtgcactgccaggaggaggcctgcgccgtgatcctgctggagcacggcgccaaccccaacctgaaggacatctacggcaacaccgccctgcactacgccgtgtacagcgagagcaccagcctggccgagaagctgctgagccacggcgcccacatcgaggccctggacaaggacaacaacacccccctgctgttcgccatcatctgcaagaaggagaagatggtggagttcctgctgaagaagaaggccagcagccacgccgtggacagactgagaagaagcgccctgatgctggccgtgtactacgacagccccggcatcgtgaacatcctgctgaagcagaacatcgacgtgttcgcccaggacatgtgcggcagagacgccgaggactacgccatcagccaccacctgaccaagatccagcagcagatcctggagcacaagaagaagatcctgaagaaggagaagagcgacgtgggcagcagcgacgagagcgccgtgagcatcttccacgagctgagagtggacagcctgcccgccagcgacgacaaggacctgaacgtggccaccaagcagtgcgtgcccgagaaggtgagcgagcccctgcccggcagcagccacgagaagggcaacagaatcgtgaacggccagggcgagggcccccccgccaagcaccccagcctgaagcccagcaccgaggtggaggaccccgccgtgaagggcgccgtgcagagaaagaacgtgcagaccctgagagccgagcaggccctgcccgtggccagcgaggaggagcagcagagacacgagagaagcgagaagaagcagccccaggtgaaggagggcaacaacaccaacaagagcgagaagatccagctgagcgagaacatctgcgacagcaccagcagcgccgccgccggcagactgacccagcagagaaagatcggcaagacctacccccagcagttccccaagaagctgaaggaggagcacgacagatgcaccctgaagcaggagaacgaggagaagaccaacgtgaacatgctgtacaagaagaacagagaggagctggagagaaaggagaagcagtacaagaaggaggtggaggccaagcagctggagcccaccgtgcagagcctggagatgaagagcaagaccgccagaaacacccccaactgggacttccacaaccacgaggagatgaagggcctgatggacgagaactgcatcctgaaggccgacatcgccatcctgagacaggagatctgcaccatgaagaacgacaacctggagaaggagaacaagtacctgaaggacatcaagatcgtgaaggagaccaacgccgccctggagaagtacatcaagctgaacgaggagatgatcaccgagaccgccttcagataccagcaggagctgaacgacctgaaggccgagaacaccagactgaacgccgagctgctgaaggagaaggagagcaagaagagactggaggccgacatcgagagctaccagagcagactggccgccgccatcagcaagcacagcgagagcgtgaagaccgagagaaacctgaagctggccctggagagaacccaggacgtgagcgtgcaggtggagatgagcagcgccatcagcaaggtgaaggacgagaacgagttcctgaccgagcagctgagcgagacccagatcaagttcaacgccctgaaggacaagttcagaaagaccagagacagcctgagaaagaagagcctggccctggagaccgtgcagaacaacctgagccagacccagcagcagacccaggagatgaaggagatgtaccagaacgccgaggccaaggtgaacaacagcaccggcaagtggaactgcgtggaggagagaatctgccacctgcagagagagaacgcctggctggtgcagcagctggacgacgtgcaccagaaggaggaccacaaggagatcgtgaccaacatccagagaggcttcatcgagagcggcaagaaggacttcgtgctggaggagaagagcaagaagctgatgaacgagtgcgaccacctgaaggagagcctgttccagtacgagagagagaagaccgaggtggtggtgagcatcaaggaggacaagtacttccagaccagcagaaagaagatctag

SEQ ID NO: 17933 - DNA, 576 bp, Artificial Sequence
  Description of Artificial Sequence: Synthetic coding sequence
atgggcatcctgtacagcgagcccatctgccaggccgcctaccagaacgacttcggccaggtgtggagatgggtgaaggaggacagcagctacgccaacgtgcaggacggcttcaacggcgacacccccctgatctgcgcctgcagaagaggccacgtgagaatcgtgagcttcctgctgagaagaaacgccaacgtgaacctgaagaaccagaaggagagaacctgcctgcactacgccgtgaagaagaagttcaccttcatcgactacctgctgatcatcctgctgatgcccgtgctgctgatcggctacttcctgatggtgagcaagaccaagcagaacgaggccctggtgagaatgctgctggacgccggcgtggaggtgaacgccaccgactgctacggctgcaccgccctgcactacgcctgcgagatgaagaaccagagcctgatccccctgctgctggaggccagagccgaccccaccatcaagaacaagcacggcgagagcagcctggacatcgccagaagactgaagttcagccagatcgagctgatgctgagaaaggccctgtag

SEQ ID NO: 17934 - DNA, 3711 bp, Artificial Sequence
  Description of Artificial Sequence: Synthetic coding sequence
atgcagcccgccgcctgcgccggcgagggcgccggcccccccgcccccagacccccccacccccccggcgacaaggtgagaagaggcagaggcggcgcccccagcctgagcccccagccccccgccccctacctgggcctgcccatccccagcagaggcggcggcggctggagaggcggccagggcggcggcggcggcaccagagagggcggcaccggcagagccggcggcgccggcagcagcggcagcgcccagcccagaccccccgccgcccccagaggccccagcagacccagcggcagaagactgctgctggagcccagagccccccccgcccccagagcccccgacgccatgaagcagctgtgcctgtgcgccgccgccagcttcgccagccaggactggggcaagagcgacgagagactgctgcaggccgtggagaacaacgacgcccccagagtggccgccctgatcgccagaaagggcctggtgcccaccaagctggaccccgagggcaagagcgccttccacctggccgccatgagaggcgccgccagctgcctggaggtgatgatcgcccacggcagcaacgtgatgagcgccgacggcgccggctacaacgccctgcacctggccgccaagtacggccacccccagtgcctgaagcagctgctgcaggccagctgcgtggtggacgtggtggacagcagcggctggaccgccctgcaccacgccgccgccggcggctgcctgagctgcagcgaggtgctgtgcagcttcaaggcccacctgaacccccaggacagaagcggcgccacccccctgatcatcgccgcccagatgtgccacaccgacctgtgcagactgctgctgcagcagggcgccgccgccaacgaccaggacctgcagggcagaaccgccctgatgctggcctgcgagggcgccagccccgagaccgtggaggtgctgctgcagggcggcgcccagcccggcatcaccgacgccctgggccaggacgccgcccactacggcgccctggccggcgacaagctgatcctgcacctgctgcaggaggccgcccagagacccagcccccccagcgccctgaccgaggacgacagcggcgaggccagcagccagaacagcatgagcagccacggcaagcagggcgcccccaagaagagaaaggccccccccccccccgccagcatccccatgcccgacgacagagacgcctacgaggagatcgtgagactgagacaggagagaggcagactgctgcagaagatcagaggcctggagcagcacaaggagagaagacagcaggagagccccgaggccagcagcctgcacatcctggagagacaggtgcaggagctgcagcagctgctggtggagagacaggaggagaaggagagcctgggcagagaggtggagagcctgcagagcagactgagcctgctggagaacgagagagagaacaccagctacgacgtgaccaccctgcaggacgaggagggcgagctgcccgacctgcccggcgccgaggtgctgctgagcagacagctgagccccagcgcccaggagcacctggccagcctgcaggagcaggtggccgtgctgaccagacagaaccaggagctgatggagaaggtgcagatcctggagaacttcgagaaggacgagacccagatggaggtggaggccctggccgaggtgatccccctggccctgtacgacagcctgagagccgagttcgaccagctgagaagacagcacgccgaggccctgcaggccctgagacagcaggagaccagagaggtgcccagagaggagggcgccgcctgcggcgagagcgaggtggccggcgccaccgccaccaagaacggccccacccacatggagctgaacggcagcgtggcccccgagaccaaggtgaacggcgccgagaccatcgacgaggaggccgccggcgacgagaccatggaggccagaaccatggaggccgaggccaccggcgccgaggccaccggcgccgaggccaccggcgccaaggtgaccgagaccaagcccaccggcgccgaggtgagagagatggagaccaccgaggaggaggccaacatggagaccaagcccaccggcgcccaggccaccgacaccgagaccaccggcgtggaggccatgggcgtggaggccaccaagaccaaggccgaggaggccgagatgcaggcctacggcgtgggcgccggccaggccgagccccccgtgaccggcaccaccaacatggaggccaccggcagcagagccaccggcatggagagcaccggcgtgagcgccaccggcgtggagaaccccggcgtggaggccaccgtgcccggcatcagcgccggccccatcctgcaccccggcgccgccgaggccagcgagaagctgcaggtggagctggagaccagaatcagaggcctggaggaggccctgagacagagagagagagaggccgccgccgagctggaggccgccctgggcaagtgcgaggccgccgaggccgaggccggcagactgagagagagagtgagagaggccgagggcagcggcgccagcggcggcggcggcggcgacaccacccagctgagagccgccctggagcaggccagagaggacctgagagacagagacagcagactgagagagctggaggccgccagcgcctgcctggacgaggccagagccagcagactgctggccgaggaggaggccagaggcctgagagccgagctggcccagagagaggaggccagactggagcagagcagagagctggaggtgctgagagagcagctggccaccgccagagccaccggcgagcagcagagaaccgccgccgccgagctgggcagagccagagacgccgccgaggccagagtggccgagctgcccgccgcctgcgaggaggccagacagggcctggccgagctgagagaggccagcgaggccctgagacagagcgtggtgcccgccagcgagcacagaagactgcaggaggaggccctggagctgagaggcagagccgccagcctggagcaggaggtggtggccaccggcaaggaggccgccagactgagagccgagctggagagagagagagtgtgcagcgtggccctgagcgagcacgagagaatcgtgggcaccctgcaggccaacgtggcccagctggagggccagctggaggagctgggcagaagacacgagaagaccagcgccgaggtgttccaggtgcagagagaggccctgttcatgaagagcgagagacacgccgccgaggcccagctggccaccgccgagcagcagctgagaggcctgagaaccgaggccgagagagccagacaggcccagagcagagcccaggaggccctggacaaggccaaggagaaggacaagaagatcaccgagctgagcaaggaggtgttcaacctgaaggaggccctgaaggagcagcccgccgccctggccacccccgaggtggaggccctgagagaccaggtgaaggacctgcagcagcagctgcaggaggccgccagagaccacagcagcgtggtggccctgtacagaagccacctgctgtacgccatccagggccagatggacgaggacgtgcagagaatcctgagccagatcctgcagatgcagagactgcaggcccagggcagatag

SEQ ID NO: 17935 - DNA, 3441 bp, Artificial Sequence
  Description of Artificial Sequence: Synthetic coding sequence
atgaagaccctgagagccagattcaagaagaccgagctgagactgagccccaccgacctgggcagctgccccccctgcggcccctgccccatccccaagcccgccgccagaggcagaagacagagccaggactggggcaagagcgacgagagactgctgcaggccgtggagaacaacgacgcccccagagtggccgccctgatcgccagaaagggcctggtgcccaccaagctggaccccgagggcaagagcgccttccacctggccgccatgagaggcgccgccagctgcctggaggtgatgatcgcccacggcagcaacgtgatgagcgccgacggcgccggctacaacgccctgcacctggccgccaagtacggccacccccagtgcctgaagcagctgctgcaggccagctgcgtggtggacgtggtggacagcagcggctggaccgccctgcaccacgccgccgccggcggctgcctgagctgcagcgaggtgctgtgcagcttcaaggcccacctgaacccccaggacagaagcggcgccacccccctgatcatcgccgcccagatgtgccacaccgacctgtgcagactgctgctgcagcagggcgccgccgccaacgaccaggacctgcagggcagaaccgccctgatgctggcctgcgagggcgccagccccgagaccgtggaggtgctgctgcagggcggcgcccagcccggcatcaccgacgccctgggccaggacgccgcccactacggcgccctggccggcgacaagctgatcctgcacctgctgcaggaggccgcccagagacccagcccccccagcgccctgaccgaggacgacagcggcgaggccagcagccagaacagcatgagcagccacggcaagcagggcgcccccaagaagagaaaggccccccccccccccgccagcatccccatgcccgacgacagagacgcctacgaggagatcgtgagactgagacaggagagaggcagactgctgcagaagatcagaggcctggagcagcacaaggagagaagacagcaggagagccccgaggccagcagcctgcacatcctggagagacaggtgcaggagctgcagcagctgctggtggagagacaggaggagaaggagagcctgggcagagaggtggagagcctgcagagcagactgagcctgctggagaacgagagagagaacaccagctacgacgtgaccaccctgcaggacgaggagggcgagctgcccgacctgcccggcgccgaggtgctgctgagcagacagctgagccccagcgcccaggagcacctggccagcctgcaggagcaggtggccgtgctgaccagacagaaccaggagctgatggagaaggtgcagatcctggagaacttcgagaaggacgagacccagatggaggtggaggccctggccgaggtgatccccctggccctgtacgacagcctgagagccgagttcgaccagctgagaagacagcacgccgaggccctgcaggccctgagacagcaggagaccagagaggtgcccagagaggagggcgccgcctgcggcgagagcgaggtggccggcgccaccgccaccaagaacggccccacccacatggagctgaacggcagcgtggcccccgagaccaaggtgaacggcgccgagaccatcgacgaggaggccgccggcgacgagaccatggaggccagaaccatggaggccgaggccaccggcgccgaggccaccggcgccgaggccaccggcgccaaggtgaccgagaccaagcccaccggcgccgaggtgagagagatggagaccaccgaggaggaggccaacatggagaccaagcccaccggcgcccaggccaccgacaccgagaccaccggcgtggaggccatgggcgtggaggccaccaagaccaaggccgaggaggccgagatgcaggcctacggcgtgggcgccggccaggccgagccccccgtgaccggcaccaccaacatggaggccaccggcagcagagccaccggcatggagagcaccggcgtgagcgccaccggcgtggagaaccccggcgtggaggccaccgtgcccggcatcagcgccggccccatcctgcaccccggcgccgccgaggccagcgagaagctgcaggtggagctggagaccagaatcagaggcctggaggaggccctgagacagagagagagagaggccgccgccgagctggaggccgccctgggcaagtgcgaggccgccgaggccgaggccggcagactgagagagagagtgagagaggccgagggcagcggcgccagcggcggcggcggcggcgacaccacccagctgagagccgccctggagcaggccagagaggacctgagagacagagacagcagactgagagagctggaggccgccagcgcctgcctggacgaggccagagccagcagactgctggccgaggaggaggccagaggcctgagagccgagctggcccagagagaggaggccagactggagcagagcagagagctggaggtgctgagagagcagctggccaccgccagagccaccggcgagcagcagagaaccgccgccgccgagctgggcagagccagagacgccgccgaggccagagtggccgagctgcccgccgcctgcgaggaggccagacagggcctggccgagctgagagaggccagcgaggccctgagacagagcgtggtgcccgccagcgagcacagaagactgcaggaggaggccctggagctgagaggcagagccgccagcctggagcaggaggtggtggccaccggcaaggaggccgccagactgagagccgagctggagagagagagagtgtgcagcgtggccctgagcgagcacgagagaatcgtgggcaccctgcaggccaacgtggcccagctggagggccagctggaggagctgggcagaagacacgagaagaccagcgccgaggtgttccaggtgcagagagaggccctgttcatgaagagcgagagacacgccgccgaggcccagctggccaccgccgagcagcagctgagaggcctgagaaccgaggccgagagagccagacaggcccagagcagagcccaggaggccctggacaaggccaaggagaaggacaagaagatcaccgagctgagcaaggaggtgttcaacctgaaggaggccctgaaggagcagcccgccgccctggccacccccgaggtggaggccctgagagaccaggtgaaggacctgcagcagcagctgcaggaggccgccagagaccacagcagcgtggtggccctgtacagaagccacctgctgtacgccatccagggccagatggacgaggacgtgcagagaatcctgagccagatcctgcagatgcagagactgcaggcccagggcagatag

SEQ ID NO: 17936 - DNA, 3441 bp, Artificial Sequence; identical to SEQ ID NO: 17935
  Description of Artificial Sequence: Synthetic coding sequence

SEQ ID NO: 17937 - DNA, 807 bp, Artificial Sequence
  Description of Artificial Sequence: Synthetic coding sequence
atggaggagaacagcttccagaaggagacccccctggccaacgccgccttctgggccgccagaagaggcaacctggccctgctgaagctgctgctgaacagcggcagagtggacgtggactgcagagacagccacggcaccaccctgctgatggtggccgcctacgccggccacatcgactgcgtgagagagctggtgctgcagggcgccgacatcaacctgcagagagagagcggcaccaccgccctgttcttcgccgcccagcagggccacaacgacgtggtgagattcctgttcggcttcggcgccagcaccgagttcagaaccaaggacggcggcaccgccctgctggccgccagccagtacggccacatgcaggtggtggagaccctgctgaagcacggcgccaacatccacgaccagctgtacgacggcgccaccgccctgttcctggccgcccagggcggctacctggacgtgatcagactgctgctggccagcggcgccaaggtgaaccagcccagacaggacggcaccgcccccctgtggatcgccagccagatgggccacagcgaggtggtgagagtgatgctgctgagaggcgccgacagagacgccgccagaaacgacggcaccaccgccctgctgaaggccgccaacaagggctacaacgacgtgatcaaggagctgctgaagttcagccccaccctgggcatcctgaaggccaacgagctgcccgccgagctgaccaagaacgagagaatcctgagactgctgagaagcaaggagggccccagaaagagctag

SEQ ID NO: 17938 - DNA, 906 bp, Artificial Sequence
  Description of Artificial Sequence: Synthetic coding sequence
atgtgcagaatgagcttcaagaaggagacccccctggccaacgccgccttctgggccgccagaagaggcaacctggccctgctgaagctgctgctgaacagcggcagagtggacgtggactgcagagacagccacggcaccaccctgctgatggtggccgcctacgccggccacatcgactgcgtgagagagctggtgctgcagggcgccgacatcaacctgcagagagagagcggcaccaccgccctgttcttcgccgcccagcagggccacaacgacgtggtgagattcctgttcggcttcggcgccagcaccgagttcagaaccaaggacggcggcaccgccctgctggccgccagccagtacggccacatgcaggtggtggagaccctgctgaagcacggcgccaacatccacgaccagctgtacgacggcgccaccgccctgttcctggccgcccagggcggctacctggacgtgatcagactgctgctggccagcggcgccaaggtgaaccagcccagacaggacggcaccgcccccctgtggatcgccagccagatgggccacagcgaggtggtgagagtgatgctgctgagaggcgccgacagagacgccgccagaaacgacggcaccaccgccctgctgaaggccgccaacaagggctacaacgacgtgatcaaggagctgctgaagttcagccccaccctgggcatcctgaagaacggcaccagcgccctgcacgccgccgtgctgagcggcaacatcaagaccgtggccctgctgctggaggccggcgccgaccccagcctgagaaacaaggccaacgagctgcccgccgagctgaccaagaacgagagaatcctgagactgctgagaagcaaggagggccccagaaagagctag

SEQ ID NO: 17939 - DNA, 906 bp, Artificial Sequence; identical to SEQ ID NO: 17938
  Description of Artificial Sequence: Synthetic coding sequence

SEQ ID NO: 17940 - DNA, 2439 bp, Artificial Sequence
  Description of Artificial Sequence: Synthetic coding sequence
ccctgcaagaccctgctgcagaacgacgtgtgcctgcccaaggccacccaccagaaggagttcgacaccctgagcggcaagctggaggtgtacttctgccccatcggcatgctgaccaacaccaagacccagaagacccccaagcccagcgtgatccccttccagagcaagcacgacttcctgctggagagccccgacaaggacggcctgctgaagcccacctgcggcagaaaggtgagcctgcccaacaaggccctggagctgaaggacagagagaccctgaaggccgagagccccgacaaggacggcctgctgaagcccacctgcgtgagaaaggtgagcctgcccaacaaggccctggagctgaaggacagagagaccctgaaggccgcccagatgttccccagcgagagcaagcagaaggacgacgaggagaacagctgggacttcgagagcttcctggaggccctgctgcagaacgacggctgcctgcccaaggccacccaccagaaggagttcgacaccctgagcggcaagctggaggagagccccgacaaggacggcctgctgaagcccacctgcggcatgaagatcagcctgcccaacaaggccctggagctgaaggacagagagaccttcaaggccgaggacgtgagcagcgtggagagcaccttcagcctgttcggcaagcccaccaccgagaacagccagagcaccaaggtggaggaggacttcaacctgaccaccaaggagggcgccaccaagaccgtgaccggccagcaggagagagacatcggcatcatcgagagagccccccaggaccagaccaacaagatgcccaccagcgagctgggcagaaaggaggacaccaagagcaccagcgacagcgagatcatcagcgtgagcgacacccagaactacgagtgcctgcccgaggccacctaccagaaggagatcaagaccaccaacggcaagatcgaggagagccccgagaagcccagccacttcgagcccgccaccgagatgcagaacagcgtgcccaacaagggcctggagtggaagaacaagcagaccctgagagccgacagcaccaccctgagcaagatcctggacgccctgcccagctgcgagagaggcagagagctgaagaaggacaactgcgagcagatcaccgccaagatggagcagaccaagaacaagttctgcgtgctgcagaaggagctgagcgaggccaaggagatcaagagccagctggagaaccagaaggccaagtgggagcaggagctgtgcagcgtgagactgaccctgaaccaggaggaggagaagagaagaaacgtggacatcctgaaggagaagatcagacccgaggagcagctgagaaagaagctggaggtgaagcagcagctggagcagaccctgagaatccaggacatcgagctgaagagcgtgaccagcaacctgaaccaggtgagccacacccacgagagcgagaacgacctgttccacgagaactgcatgctgaagaaggagatcgccatgctgaagctggaggtggccaccctgaagcaccagcaccaggtgaaggagaacaagtacttcgaggacatcaagatcctgcaggagaagaacgccgagctgcagatgaccctgaagctgaagcagaagaccgtgaccaagagagccagccagtacagagagcagctgaaggtgctgaccgccgagaacaccatgctgaccagcaagctgaaggagaagcaggacaaggagatcctggagaccgagatcgagagccaccaccccagactggccagcgccctgcaggaccacgaccagagcgtgaccagcagaaagaaccaggagctggccttccacagcgccggcgacgcccccctgcagggcatcatgaacgtggacgtgagcaacaccatctacaacaacgaggtgctgcaccagcccctgtacgaggcccagagaaagagcaagagccccaagatcaacctgaactacgccggcgacgacctgagagagaacgccctggtgagcgagcacgcccagagagacagatgcgagacccagtgccagatgaagaaggccgagcacatgtaccagaacgagcaggacaacgtggacaagcacaccgagcagcaggagagcctggagcagaagctgttccagctggagagcaagaacagatggctgagacagcagctggtgtacgcccacaagaaggtgaacaagagcaaggtgaccatcaacatccagttccccgagatgaagatgcagagacacctgaacgagaagaacgaggaggtgttcaactacggcaaccacctgaaggagagaatcgaccagtacgagaaggagaaggccgagagagaggtgagcatcaagaagtacaagtacttcagcaacttcctgaaggagagcggcctgggctag

SEQ ID NO: 17941 - DNA, 2361 bp, Artificial Sequence
  Description of Artificial Sequence: Synthetic coding sequence
aacgcctgggacctgaacagcttcctggagaccctgctgcagaacgacgtgtgcctgcccaaggccacccaccagaaggagttcgacaccctgagcggcaagctggaggagagccccgacaaggacggcctgctgaagcccacctgcggcagaaaggtgagcctgcccaacaaggccctggagctgaaggacagagagaccctgaaggccgagagccccgacaaggacggcctgctgaagcccacctgcgtgagaaaggtgagcctgcccaacaaggccctggagctgaaggacagagagaccctgaaggccgcccagatgttccccagcgagagcaagcagaaggacgacgaggagaacagctgggacttcgagagcttcctggaggccctgctgcagaacgacggctgcctgcccaaggccacccaccagaaggagttcgacaccctgagcggcaagctggaggagagccccgacaaggacggcctgctgaagcccacctgcggcatgaagatcagcctgcccaacaaggccctggagctgaaggacagagagaccttcaaggccgaggacgtgagcagcgtggagagcaccttcagcctgttcggcaagcccaccaccgagaacagccagagcaccaaggtggaggaggacttcaacctgaccaccaaggagggcgccaccaagaccgtgaccggccagcaggagagagacatcggcatcatcgagagagccccccaggaccagaccaacaagatgcccaccagcgagctgggcagaaaggaggacaccaagagcaccagcgacagcgagatcatcagcgtgagcgacacccagaactacgagtgcctgcccgaggccacctaccagaaggagatcaagaccaccaacggcaagatcgaggagagccccgagaagcccagccacttcgagcccgccaccgagatgcagaacagcgtgcccaacaagggcctggagtggaagaacaagcagaccctgagagccgacagcaccaccctgagcaagatcctggacgccctgcccagctgcgagagaggcagagagctgaagaaggacaactgcgagcagatcaccgccaagatggagcagaccaagaacaagttctgcgtgctgcagaaggagctgagcgaggccaaggagatcaagagccagctggagaaccagaaggccaagtgggagcaggagctgtgcagcgtgagactgaccctgaaccaggaggaggagaagagaagaaacgtggacatcctgaaggagaagatcagacccgaggagcagctgagaaagaagctggaggtgaagcagcagctggagcagaccctgagaatccaggacatcgagctgaagagcgtgaccagcaacctgaaccaggtgagccacacccacgagagcgagaacgacctgttccacgagaactgcatgctgaagaaggagatcgccatgctgaagctggaggtggccaccctgaagcaccagcaccaggtgaaggagaacaagtacttcgaggacatcaagatcctgcaggagaagaacgccgagctgcagatgaccctgaagctgaagcagaagaccgtgaccaagagagccagccagtacagagagcagctgaaggtgctgaccgccgagaacaccatgctgaccagcaagctgaaggagaagcaggacaaggagatcctggagaccgagatcgagagccaccaccccagactggccagcgccctgcaggaccacgaccagagcgtgaccagcagaaagaaccaggagctggccttccacagcgccggcgacgcccccctgcagggcatcatgaacgtggacgtgagcaacaccatctacaacaacgaggtgctgcaccagcccctgtacgaggcccagagaaagagcaagagccccaagatcaacctgaactacgccggcgacgacctgagagagaacgccctggtgagcgagcacgcccagagagacagatgcgagacccagtgccagatgaagaaggccgagcacatgtaccagaacgagcaggacaacgtggacaagcacaccgagcagcaggagagcctggagcagaagctgttccagctggagagcaagaacagatggctgagacagcagctggtgtacgcccacaagaaggtgaacaagagcaaggtgaccatcaacatccagttccccgagatgaagatgcagagacacctgaacgagaagaacgaggaggtgttcaactacggcaaccacctgaaggagagaatcgaccagtacgagaaggagaaggccgagagagaggtgagcatcaagaagtacaagtacttcagcaacttcctgaaggagagcggcctgggctag

SEQ ID NO: 17942 - DNA, 4179 bp, Artificial Sequence
  Description of Artificial Sequence: Synthetic coding sequence
atgaagagactgctggccgccgccggcaagggcgtgagaggccccgagccccccaaccccttcagcgagagagtgtacaccgagaaggactacggcaccatctacttcggcgacctgggcaagatccacaccgccgccagcagaggccaggtgcagaagctggagaagatgaccgtgggcaagaagcccgtgaacctgaacaagagagacatgaagaagagaaccgccctgcactgggcctgcgtgaacggccacgccgaggtggtgaccttcctggtggacagaaagtgccagctgaacgtgctggacggcgagggcagaacccccctgatgaaggccctgcagtgcgagagagaggcctgcgccaacatcctgatcgacgccggcgccgacctgaactacgtggacgtgtacggcaacaccgccctgcactacgccgtgtacagcgagaacctgctgatggtggccaccctgctgagctacggcgccgtgatcgaggtgcagaacaaggccagcctgacccccctgctgctggccatccagaagagaagcaagcagaccgtggagttcctgctgaccaagaacgccaacgccaacgccttcaacgagagcaagtgcaccgccctgatgctggccatctgcgagggcagcagcgagatcgtgggcatgctgctgcagcagaacgtggacgtgttcgccgaggacatccacggcatcaccgccgagagatacgccgccgcctgcggcgtgaactacatccaccagcagctgctggagcacatcagaaagctgcccaagaacccccagaacaccaaccccgagggcaccagcaccggcacccccgacgaggccgcccccctggccgagagaacccccgacaccgccgagagcctgctggagaagacccccgacgaggccgccagactggtggagggcaccagcgccaagatccagtgcctgggcaaggccaccagcggcaagttcgagcagagcaccgaggagacccccagaaagatcctgagacccaccaaggagaccagcgagaagttcagctggcccgccaaggagagaagcagaaagatcacctgggaggagaaggagaccagcgtgaagaccgagtgcgtggccggcgtgacccccaacaagaccgaggtgctggagaagggcaccagcaacatgatcgcctgccccaccaaggagaccagcaccaaggccagcaccaacgtggacgtgagcagcgtggagcccatcttcagcctgttcggcaccagaaccatcgagaacagccagtgcaccaaggtggaggaggacttcaacctggccaccaagatcatcagcaagagcgccgcccagaactacacctgcctgcccgacgccacctaccagaaggacatcaagaccatcaaccacaagatcgaggaccagatgttccccagcgagagcaagagagaggaggacgaggagtacagctgggacagcggcagcctgttcgagagcagcgccaagacccaggtgtgcatccccgagagcatgtaccagaaggtgatggagatcaacagagaggtggaggagctgcccgagaagcccagcgccttcaagcccgccgtggagatgcagaagaccgtgcccaacaaggccttcgagctgaagaacgagcagaccctgagagccgcccagatgttccccagcgagagcaagcagaaggacgacgaggagaacagctgggacagcgagagcccctgcgagaccgtgagccagaaggacgtgtacctgcccaaggccacccaccagaaggagttcgacaccctgagcggcaagctggaggagagccccgtgaaggacggcctgctgaagcccacctgcggcagaaaggtgagcctgcccaacaaggccctggagctgaaggacagagagaccttcaaggccgagagccccgacaaggacggcctgctgaagcccacctgcggcagaaaggtgagcctgcccaacaaggccctggagctgaaggacagagagaccctgaaggccgagagccccgacaacgacggcctgctgaagcccacctgcggcagaaaggtgagcctgcccaacaaggccctggagctgaaggacagagagaccttcaaggccgcccagatgttccccagcgagagcaagcagaaggacgacgaggagaacagctgggacttcgagagcttcctggagaccctgctgcagaacgacgtgtgcctgcccaaggccacccaccagaaggagttcgacaccctgagcggcaagctggaggagagccccgacaaggacggcctgctgaagcccacctgcggcatgaagatcagcctgcccaacaaggccctggagctgaaggacagagagaccttcaaggccgaggacgtgagcagcgtggagagcaccttcagcctgttcggcaagcccaccaccgagaacagccagagcaccaaggtggaggaggacttcaacctgaccaccaaggagggcgccaccaagaccgtgaccggccagcaggagagagacatcggcatcatcgagagagccccccaggaccagaccaacaagatgcccaccagcgagctgggcagaaaggaggacaccaagagcaccagcgacagcgagatcatcagcgtgagcgacacccagaactacgagtgcctgcccgaggccacctaccagaaggagatcaagaccaccaacggcaagatcgaggagagccccgagaagcccagccacttcgagcccgccaccgagatgcagaacagcgtgcccaacaagggcctggagtggaagaacaagcagaccctgagagccgacagcaccaccctgagcaagatcctggacgccctgcccagctgcgagagaggcagagagctgaagaaggacaactgcgagcagatcaccgccaagatggagcagaccaagaacaagttctgcgtgctgcagaaggagctgagcgaggccaaggagatcaagagccagctggagaaccagaaggccaagtgggagcaggagctgtgcagcgtgagactgaccctgaaccaggaggaggagaagagaagaaacgtggacatcctgaaggagaagatcagacccgaggagcagctgagaaagaagctggaggtgaagcagcagctggagcagaccctgagaatccaggacatcgagctgaagagcgtgaccagcaacctgaaccaggtgagccacacccacgagagcgagaacgacctgttccacgagaactgcatgctgaagaaggagatcgccatgctgaagctggaggtggccaccctgaagcaccagcaccaggtgaaggagaacaagtacttcgaggacatcaagatcctgcaggagaagaacgccgagctgcagatgaccctgaagctgaagcagaagaccgtgaccaagagagccagccagtacagagagcagctgaaggtgctgaccgccgagaacaccatgctgaccagcaagctgaaggagaagcaggacaaggagatcctggagaccgagatcgagagccaccaccccagactggccagcgccctgcaggaccacgaccagagcgtgaccagcagaaagaaccaggagctggccttccacagcgccggcgacgcccccctgcagggcatcatgaacgtggacgtgagcaacaccatctacaacaacgaggtgctgcaccagcccctgtacgaggcccagagaaagagcaagagccccaagatcaacctgaactacgccggcgacgacctgagagagaacgccctggtgagcgagcacgcccagagagacagatgcgagacccagtgccagatgaagaaggccgagcacatgtaccagaacgagcaggacaacgtggacaagcacaccgagcagcaggagagcctggagcagaagctgttccagctggagagcaagaacagatggctgagacagcagctggtgtacgcccacaagaaggtgaacaagagcaaggtgaccatcaacatccagttccccgagatgaagatgcagagacacctgaacgagaagaacgaggaggtgttcaactacggcaaccacctgaaggagagaatcgaccagtacgagaaggagaaggccgagagagaggtgagcatcaagaagtacaagtacttcagcaacttcctgaaggagagcggcctgggctag

SEQ ID NO: 17943 - DNA, 1860 bp, Artificial Sequence
  Description of Artificial Sequence: Synthetic coding sequence
atgaagagactgctggccgccgccggcaagggcgtgagaggccccgagccccccaaccccttcagcgagagagtgtacaccgagaaggactacggcaccatctacttcggcgacctgggcaagatccacaccgccgccagcagaggccaggtgcagaagctggagaagatgaccgtgggcaagaagcccgtgaacctgaacaagagagacatgaagaagagaaccgccctgcactgggcctgcgtgaacggccacgccgaggtggtgaccttcctggtggacagaaagtgccagctgaacgtgctggacggcgagggcagaacccccctgatgaaggccctgcagtgcgagagagaggcctgcgccaacatcctgatcgacgccggcgccgacctgaactacgtggacgtgtacggcaacaccgccctgcactacgccgtgtacagcgagaacctgctgatggtggccaccctgctgagctacggcgccgtgatcgaggtgcagaacaaggccagcctgacccccctgctgctggccatccagaagagaagcaagcagaccgtggagttcctgctgaccaagaacgccaacgccaacgccttcaacgagagcaagtgcaccgccctgatgctggccatctgcgagggcagcagcgagatcgtgggcatgctgctgcagcagaacgtggacgtgttcgccgaggacatccacggcatcaccgccgagagatacgccgccgcctgcggcgtgaactacatccaccagcagctgctggagcacatcagaaagctgcccaagaacccccagaacaccaaccccgagggcaccagcaccggcacccccgacgaggccgcccccctggccgagagaacccccgacaccgccgagagcctgctggagaagacccccgacgaggccgccagactggtggagggcaccagcgccaagatccagtgcctgggcaaggccaccagcggcaagttcgagcagagcaccgaggagacccccagaaagatcctgagacccaccaaggagaccagcgagaagttcagctggcccgccaaggagagaagcagaaagatcacctgggaggagaaggagaccagcgtgaagaccgagtgcgtggccggcgtgacccccaacaagaccgaggtgctggagaagggcaccagcaacatgatcgcctgccccaccaaggagaccagcaccaaggccagcaccaacgtggacgtgagcagcgtggagcccatcttcagcctgttcggcaccagaaccatcgagaacagccagtgcaccaaggtggaggaggacttcaacctggccaccaagatcatcagcaagagcgccgcccagaactacacctgcctgcccgacgccacctaccagaaggacatcaagaccatcaaccacaagatcgaggaccagatgttccccagcgagagcaagagagaggaggacgaggagtacagctgggacagcggcagcctgttcgagagcagcgccaagacccaggtgtgcatccccgagagcatgtaccagaaggtgatggagatcaacagagaggtggaggagctgcccgagaagcccagcgccttcaagcccgccgtggagatgcagaagaccgtgcccaacaaggccttcgagctgaagaacgagcagaccctgagagccgcccagatgttccccagcgagagcaagcagaaggacgacgaggagaacagctgggacagcgagagcccctgcgagaccgtgagccagaaggacgtgtacctgcccaaggccacccaccagaaggagttcgacaccctgagcggcaagctggaggcctacctgtggaaggagagcttcagcagcaagtag

SEQ ID NO: 17944 - DNA, 5622 bp, Artificial Sequence
  Description of Artificial Sequence: Synthetic coding sequence
atggaggagggcgtgcaggcccccgactgggacagcgacgagaccgtgatcgagggcagcgtgaccgagagcgacctggaggagaaggagctgccctggagaagactgctgttcgaccaggacgccagcctgaagagcgagttcagcctgcaccccgacaccagaggcatgtgcaagggcatgcccagccccgagatccagctgggcttcaagctgagagaggacctgcaggagcagatgaacaagaacaagatgatgcccgtgctgagcgaggacaccatcctgcagagccaggacgagaccgagagaaaccaggccctgctgcagaccagaaagaactgcagcatgttcatcggcagcttcagacagagcggcctgagcctgaaccaccagaacatcgagggccccgaggccgagagccccgaggtgctgccccacatcgagaaggagctgagcgagggcagagacagccccgaggtgagcctgctgagcggcaccgccatcaccgtgagcgacaccgtggccgtgaaggagaccagcctggtggagcccgagaagatcctggccgcccccaacaccttcttcgagcccagaaaggaggtgaccatgaccatgaccagcgaggagaccaaggacgaggagagcagcctggagaccttcgtgagcgccctggagagcctgctgaccagccccgagagcacccaggaggagagactgttcgagctggtgagcgacttcgacagaaaggagctgatgaaccccctgagcgacagcctgagcagcatcagcatccccctgaacagctggagcgcctgccacagagacctgctggaggacgccaaggacgacgccctgcccgccgagctgctggaggccctgaacaccctgagcgaggccaaggtggagaccatctgccacagaaaggagggcggcagcagcctgatcgccagaaacgagtgcctggaggtggagttcaacaccagccagaccaacgaggactgcacccagatcgccgagaccctgcaggaccccaaccccagcggcctgcagaccctggcccaccagaacatcaccagctgcgagcccctgagcaacaagagaaacagcaacagcgtgaccaacagcagcgaccaggagaccgcctgcgtgctgagaagaagcagcagactggagaagctgaaggtgagcagagacgccaagtacagcgaccacatgtacaagatgcccgagaagatcctgcccaagatcctgggctgcgaggacctgaccaacaacaacagcagcgcccagaacttcagaatgcaggaccccgccctgatgatcgacggcaaggagaagaacatgcacagcgccagattcaagaacggcaagcagatcagaaagaacgagcagttcagcggcaagaaggagaagatgaaggtgaacaagatcagcctgcacagcatcaacagaagaaacatcttcggcgagaacctggtgtacaaggccgccctgcacgacgacgccgacctggtgcaccactgcatcaagaagggcggcaacgtgaaccagcccagctacgccggctggaccgccctgcacgaggccagcgtgggcggcttctacagaaccgccagcgagctgctgaagggcggcgccgacgtgaacatcaagggcctgtaccagatcacccccctgcacgacgccgtgatgaacggccactacaaggtggccgagctgctgctgctgaacggcgccgaccccctgttcagaaacgacgacggcaagtgcgccctggacgaggccaaggacctgtgcatgaagagactgctggagagatacatccccaagcaccagaagtgcctgaccagcgcccagagaagcagcatcgaccccctggacatcgaggacgtgtaccagcacaagaagcccaagttcagcagcaagagccacatctggcacgtgtacaacgagaacagcaacagacagaagctggagcacgtgaaggtgaacaagggcagcaaggccagcctgttcatcaacaaggaggacgtgtacgagtactaccagaaggaccccaagaacaccaagttcggcaagagcaagcacaagcagagcaccctggaccagatctacagcaccggcctgagaaagggcaacctgcacaacgtgaaggaccccaacaccaacgtgcccaagggcatcggcagaagaaagacccagcacaagagaacccaggtggacgacgtggactgcaaccccagaaagatcctggccgtgagccccagcagaagaatcaacagactggtgacctaccagcagcacatccccgagacccacaacgacctgcccgaggagctgtgcgagcccagcagcctgaccctgagcagcctgagaaacggcctggacagcagcaccgaggcctgcagcgtgagcaaggagaagcacatccagaacctggacctgagcgacagccaggaggtgcagtgcctggagctggagagcgtggaccagaccgaggccgtgagcttccccggcctgctgctgcacaaggagatcaagctgcccgtggtgaccaccgacaagcagccccacaccctgcaggagcagcaccacgtgctgtacaagagccacgagaacagcaacctggtgcccaaggacgagagattcaacaagtgggagaacagcttcctgagcttcgtgaaggagaacagcgacaacgacgacgacgacgactgcagcaccagcgagaaggccatcaccagcaagaaggtgctgtgcagcaccggcggcaagaagcactacaacttcaaggagaacctgaccaacaagaaggagatgggcttccagcagttcctgctgagcgaggaccacctgagccaggagaacgagctgaaggccgtgagcctgaccaccctgcccgagcaggaggccgtgaacttcagctacagcgacaacgccgtgatcagcgagcacgtggccaactacgagcagtgcatcttcggccccagcttcgaccacagcaacggcaaccccgagcagaacagcctggcctgcatgagaaccctgctgacccacgaggccagcaagctgaccaaccacgtggagctgttcaagaagccccaggactacatccccagagcccccaccttcctgatgaaccagaccgacacccacatcgtggagaagatggccaagaactgcgacaccgagagaaactacatcgacagagaccagaagatcatctacagcaacgagcccctgagcatcgtggcccacagccaggtgatcgagaccaccaaggtggagaagagaagacagaaccacctggagagcgagaccatccacaacatcgacagccacagcaccgacaacatgagcaaggagctggccaacatcagcaagctgagccagagagagaagaaggagatcagccacaagcccggcatgaaggccggcagaatcaacaagagaaacgccagaggcgagagccagctgcacctggccgtgagaagaggcaacctgcccctggtgaaggccctgatcgagagcggcgccgacgtgaacctgaacgacaacgccggctggacccccctgcacgaggccagcaacgagggcagcatcgacatcatcgtggagctgctgaaggccggcgccaaggtgaactgcgagaacatcgacggcatcctgcccctgcacgacgccgtggccaacaaccacctgaaggccgccgagatcctgctgcagaacggcgccaaccccaaccagaaggaccagaagcagaagagcgccctggacgaggccgacgacgagaagatgaaggagctgctgagaagctacggcgccatcgagaccgtgaacagagacgagagcgacgccatcgtgaacgagaagatccccgccgtgagaagcaagagacacaagcagtgcttctgcgacgacggcaagaccatcgacagcagcagcctgagccaccaggagagaagcagagagagcctgagcgtgcaccagaccctgagcgccatcctgcaggacatcgaggagaagcaggagtacctgctggagttcgagatcagaaaccccgaggacgccgagcagtacatcgagaagatgctgaagatcaagaagatcatggacaacgtgctggccaagcagaaggccgagagagacgacctggccaagaagtacagagtgagcatcgagagcttcaagcacggcgccctgagagagcagctggccaacctggccgccagacagaagagcctgctggtggtggccaagaagcagaagaagatcagcctgaagatccagaactgcagaaacgtgaccagcctgccctgcctgagcctgagaaagctgccccccagaagcgagatcagcagcgagaaggacagccaggagctgaccagcctggagaacctggagcacccccagagcggcagcctgagccccgtgagcggcagcatgcaggagacccagctgagcctggagacctggaactacagccagaacaccaacatctgcctgaacagcgaggccgtgagaagaggcgagttcagcggcaacgacatgaacagcaagcagaacggcagcgactgcaccctggacggcttccccaagagcagacacagcgacggcaccgagaagaacaagctgcccagccagcccgtggccttcatcggccagaccgagtacagccagaaggagaacgacctgaccgaggccaccgacaaggaccacgagttctacgtgagcagccccgtgatcggcaagctgaacatcagcgagaccgccagcgtgctggccgagaacgccgcccaccccagcaacatcatctgcgaccaggacctgagcaactacgaccccaagagaggcaacagaaagaccagcagccagcagagccccaccggcgccagcgagagcctggcccaccagggcatcgccgtgctgggcagcgacaccgtgcaccagatgaagccctacctgaagaagagcgtgagcgtggtgccctgcgccgacgacagccagatcagcagcagcagcggcagcggccagcaggacaccatcaagaaggccctgaactacagcaccgcccccaagaagaagtgcatccagatcaaggacctgatcctgctgggcagaatcaaccccggcaacaacatcctggagttcaagacccaggagaccacccacaaggccagcatcctgctgaacggcaagctgaaggtggagagcggccagatctacaagaaccccgtgacctggctgaaggacctgctgggcggcaacagctacgtgacctggaactacgcctggagcaaggtgacctacctgggcaaggagctgctgagatacgtgagcgaggacgcccccatcctgcccgagcccaacagcgtgccccagcagtaccagccctgcctgcccgaggtggcctgcctggacgaccccgtgcaggagcccaacaagagcatgttcgagaagaccaagttcggccagggcaccagcagagagagcatgcagagcagccccagatacctgcagatcaacgagatcctgctgatcagcgaccaggagttcctgccctgccacatcatggaccagcactggaagttctgcgtggagtgcgaggagctgaccccctag

SEQ ID NO: 17945 - DNA, 819 bp, Artificial Sequence
  Description of Artificial Sequence: Synthetic coding sequence
atggtggcctgctaccacggcttccagagcgtggtggccctgctgagccactgccccttcctggacgtgaaccagcaggacaagggcggcgacaccgccctgatgctggccgcccaggccggccacgtgcccctggtgagcctgctgctgaactactacgtgggcctggacctggagagaagagaccagagaggcctgaccgccctgatgaaggccgccatgagaaacagatgcgagtgcgtggccaccctgctgatggccggcgccgacctgaccgccgtggaccccgtgagaggcaagaccgccctggagtgggccgtgctgaccgacagcttcgacaccgtgtggagaatcagacagctgctgagaagaccccaggtggagcagctgagccagcactacaagcccgagtggcccgccctgagcggcctggtggcccaggcccaggcccaggcccaggtggcccccagcctgctggagagactgcaggccaccctgagcctgcccttcgcccccagcccccaggagggcggcgtgctggaccacctggtgaccgccaccaccagcctggccagccccttcgtgaccaccgcctgccacaccctgtgccccgaccacccccccagcctgggcaccagaagcaagagcgtgcccgagctgctggtgcccgccgaggcccagagcttcagaacccccaagagcggccccagcagcctggccatccccggcgcccaggacagagaggaggagaccggcggcggcggccagaacggcaccgaggtgggcgaggacggcatcggccaggccggcaacagatag

SEQ ID NO: 17946 - DNA, 612 bp, Artificial Sequence
  Description of Artificial Sequence: Synthetic coding sequence
atgaaggccgccatgagaaacagatgcgagtgcgtggccaccctgctgatggccggcgccgacctgaccgccgtggaccccgtgagaggcaagaccgccctggagtgggccgtgctgaccgacagcttcgacaccgtgtggagaatcagacagctgctgagaagaccccaggtggagcagctgagccagcactacaagcccgagtggcccgccctgagcggcctggtggcccaggcccaggcccaggcccaggtggcccccagcctgctggagagactgcaggccaccctgagcctgcccttcgcccccagcccccaggagggcggcgtgctggaccacctggtgaccgccaccaccagcctggccagccccttcgtgaccaccgcctgccacaccctgtgccccgaccacccccccagcctgggcaccagaagcaagagcgtgcccgagctgctggtgcccgccgaggcccagagcttcagaacccccaagagcggccccagcagcctggccatccccggcgcccaggacagagaggaggagaccggcggcggcggccagaacggcaccgaggtgggcgaggacggcatcggccaggccggcaacagatag

SEQ ID NO: 17947 - DNA, 1485 bp, Artificial Sequence
  Description of Artificial Sequence: Synthetic coding sequence
atggtgctgctggccggcaccggccccgagggcggcggcgccagatgcatgaccccccccccccccagcccccccagaggcgcccaggtggaggaggaccccgccgactacgaggagttcgaggacttcagcagcctgcccgacaccagaagcatcgccagcgacgacagcttctaccccttcgaggacgaggaggagcacggcgtggagagcgccgagagcgtgcccgagggcgtgcccgagagcgtgcccgagaccgccaccctgctgagagccgcctgcgccaacaacgtgggcctgctgagaaccctggtgagaagaggcgtgagcgtggaggaggcccaggagaccgacagaaacggcagaaccggcctgatcgtggcctgctaccacggcttcgtggacaccgtggtggccctggccgagtgcccccacgtggacgtgaactggcaggacagcgagggcaacaccgccctgatcaccgccgcccaggccggccacgccatcatcaccaactacctgctgaactacttccccggcctggacctggagagaagaaacgccttcggcttcaccgccctgatgaaggccgccatgcagggcagaaccgactgcatcagagccctgatgctggccggcgccgacgtgcacgccagagaccccagaagaggcatgagcccccaggagtgggccacctacaccggcagagtggacgccgtgagactgatgcagagactgctggagagaccctgccccgagcagttctgggagaagtacagacccgagctgccccccccccccgaggccgccagaaagcccgccggcagcaagaactgcctgcagagactgaccgactgcgtgctgagcgtgctgacccccagaagcgtgagaggccccgaggacggcggcgtgctggaccacatggtgagaatgaccaccagcctgtacagccccgccgtggccatcgtgtgccagaccgtgtgccccgagagcccccccagcgtgggcaagagaagactggccgtgcaggagatcctggccgccagagccgccagaggcccccaggcccaggaggaggacgaggtgggcggcgccggccagagaggcagaaccggccaggaggacgccgacagcagagagggcagccccagagccggcctgccccccgccctgggcagcagaggccccgccgcccccgcccccagaaaggccagcctgctgcccctgcagagactgagaagaagaagcgtgagacccggcgtggtggtgcccagagtgagagtgagcaaggcccccgcccccaccttccagcccgagagacccgccagaaagggcagcaccaaggacagcggccacctgcagatccccaagtggagatacaaggaggccaaggaggagaagagaaaggccgaggaggccgagaagaagagacaggccgaggcccagaaggagagaagaaccgccccctggaagaagagaacctag

SEQ ID NO: 17948 - DNA, 1491 bp, Artificial Sequence
  Description of Artificial Sequence: Synthetic coding sequence
atgctgcacaccgagggccacgccctgctgagagccgtgggccagggcaagctgagactggccagactgctgctggagggcggcgcctacgtgaacgagggcgacgcccagggcgagaccgccctgatggccgcctgcagagccagatacgacgacccccagaacaaggccagaatggtgagatacctgctggagcagggcgccgaccccaacatcgccgacagactgggcagaaccgccctgatgcacgcctgcgccggcggcggcggcgccgccgtggccagcctgctgctggcccacggcgccgaccccagcgtgagagaccacgccggcgccagcgccctggtgcacgccctggacagaggcgacagagagaccctggccaccctgctggacgcctgcaaggccaagggcaccgaggtgatcatcatcaccaccgacaccagccccagcggcaccaagaagaccagacagtacctgaacagcccccccagccccggcgtggaggaccccgcccccgccagccccagccccggcttctgcaccagccccagcgagatccagctgcagaccgccggcggcggcggcagaggcatgctgagccccagagcccaggaggaggaggagaagagagacgtgttcgagttccccctgcccaagccccccgacgaccccagccccagcgagcccctgcccaagccccccagacacccccccaagcccctgaagagactgaacagcgagccctggggcctggtggcccccccccagcccgtgccccccaccgagggcagacccggcatcgagagactgaccgccgagttcaacggcctgaccctgaccggcagacccagactgagcagaagacacagcaccgagggccccgaggacccccccccctgggccgagaaggtgaccagcggcggccccctgagcagaagaaacaccgcccccgaggcccaggagagcggcccccccagcggcctgagacagaagctgagcagaatggagcccgtggagctggacacccccggccacctgtgccccgacagccccgagagcagcagactgagcctggagagaagaagatacagcgccagccccctgaccctgccccccgccggcagcgcccccagccccagacagagccaggagagcctgcccggcgccgtgagccccctgagcggcagaagaagaagccccggcctgctggagagaagaggcagcggcaccctgctgctggaccacatcagccagaccagacccggcttcctgccccccctgaacgtgagcccccacccccccatccccgacatcagaccccagcccggcggcagagcccccagcctgcccgcccccccctacgccggcgcccccggcagccccagaaccaagagaaagctggtgagaagacacagcatgcagaccgagcagatcagactgctgggcggcttccagagcctgggcggccccggcgagcccggcagatag

SEQ ID NO: 17949 - DNA, 1608 bp, Artificial Sequence
  Description of Artificial Sequence: Synthetic coding sequence
atgatggacgacgacaccgagctgagaaccgacggcaacagcctgctgaaggccgtgtggctgggcagactgagactgaccagactgctgctggagggcggcgcctacatcaacgagagcaacgacaagggcgagaccgccctgatggtggcctgcatcaccaagcacgtggaccagcagagcatcagcaagagcaagatggtgaagtacctgctggacaacagagccgaccccaacatccaggacaagagcggcaagaccgccctgatccacgcctgcatcagaagagccggcggcgaggtggtgagcctgctgctggagaacggcgccgaccccagcctggaggacagaaccggcgccagcgccctggtgtacgccatcaacgccgacgacaaggacgccctgaagcacctgctggacgcctgcaaggccaagggcaaggaggtgatcatcatcaccaccgacaagagcagcagcggcaccaagaccaccaagcagtacctgaacgtgccccccagccccaaggtggaggacagacacagcccccccctgtgcgccagccccagcgacatcgagctgaaggccctgggcctggacagccccctgaccgagaaggaggacgacttcttcagcctgcaggccggccaccccagcagctgcaacaccagcaaggccgtgaacgagcccggcagccccaccagaaaggtgagcaacctgaagagagccagactgccccagctgaagagactgcagagcgagccctggggcctgatcgcccccagcgtgctggccgccagcaccagacaggacgagacccacggcgccagcaccgacaacgaggtgatcaagagcatcagcgacatcagcttccccaagagaggccccctgagcagaaccaacagcatcgacagcaaggaccccaccctgttccacaccgtgaccgagcaggtgctgaagatccccgtgagcagcgcccccgccagctggaaggccgcctacgagaagggccaggccccccaccccagactggccagaagaggcaccctgcccgtggaccaggagaagtgcggcatgggccccagcggccccagcgccctgaaggagcccgccagcctgaagtggctggagaacgacctgtacgacctggacatccagcccggccccgacccccccaacagcatcagcctggagagcggcaagggccccctggacagaaagaagctgaacagcagccacctgagcctgttccacggcagcagagagagcctggacaccgtgcccagcaccagccccagcagcgccagaagaagacccccccacctgctggagagaagaggcagcggcaccctgctgctggacagaatcagccacaccagacccggcttcctgccccccctgaacgtgaacctgaacccccccatccccgacatcagaagcagcagcaagcccagctgcagcctggccagcggcctgaagagcatggtgcccgtggcccccagcagccccaagagagtggacctgagaagcaagaagaagctgctgagaagacacagcatgcagatcgagcagatgaagcagctgagcgacttcgaggagatcatgacctag

SEQ ID NO: 17950 - DNA, 3006 bp, Artificial Sequence
  Description of Artificial Sequence: Synthetic coding sequence
atgaagagaatcttcagctgcagcagcacccaggtggccgtggagagatggaacagacacgaccagaagctgctggaggccgtgcacagaggcgacgtgggcagagtggccgccctggccagcagaaagagcgccagacccaccaagctggacagcaacggccagagccccttccacctggccgccagcaagggcctgaccgagtgcctgaccatcctgctggccaacggcgccgacatcaacagcaagaacgaggacggcagcaccgccctgcacctggccaccatcagctgccagccccagtgcgtgaaggtgctgctgcagcacggcgccaacgaggacgccgtggacgccgagaacagaagccccctgcactgggccgccagcagcggctgcgccagcagcgtgctgctgctgtgcgaccacgaggccttcctggacgtgctggacaacgacggcagaacccccctgatgatcgccagcctgggcggccacgccgccatctgcagccagctgctgcagagaggcgccagagtgaacgtgaccgacaagaacgacaagagcgccctgatcctggcctgcgagaagggcagcgccgaggtggccgagctgctgctgagccacggcgccgacgccggcgccgtggacagcaccggccacgacgccctgcactacgccctgcacacccaggacaaggccctgtggagacacctgcagcaggccctgagcagaagaagaagaggcggccagagactggtgcagcaccccgacctggccagccaggccagccccagcgagccccaggccggcagcccccccaagagcagctggagagccgagcccgaggaggagcaggaggagaaggaggacgaggacccctgcagcgaggagtggagatggaagtacgaggaggagagaagaaaggtggtgagactggagcaggagctggtgcagaagaccgaggagtgcaagacccaggccgccgcctacctggacctggagaaccagatcagagagcaggcccaggagctgggcgtgctgctgagctgggagcccagagccagcggcaagcagggcagcagcctgagacccggcggcgacggcatggagcagggctgccccaaggacctgctggccgagagcacccaggagctgaagaagcagcagcaggccgccgccaccgtgaaccccgtgctggcccccaagaaggccgaggacagcgcccccggcaagatccagtacgaggtgcacggcagaagccagcccgaggagcagggccccccccagagccccgccagcgagaccatcagaaaggccaccggccagcagctgaccaccaacggcgcccagaccttcggccccgaccacgccgaccagctgcccgccggccagaaggagagcagccaggtgctgggcgtggagcccggcggcaccgtggccgagcccgtgggccccgccgccatgaaccagctgctgctgcagctgagagaggagctggccgccgtgtggagagagaaggacgccgccagaggcgccctgagcagacccgtgatggagggcgccctgggcacccccagagccgaggccgccgccgccgcctgggagaagatggaggccagactggagagagtgctggccagactggagtgggccaaggccggcctgcaggtgaagcccgaggtgcccagccaggagagcagagagggcgccctgaaggccgcccccggcagcatcaagcaggacgaggagaaggagaagagagtgcccggcgccagaggcgagcccctgggcgccctgggcggcgagaaggccctgggcggcctggccaagggccagctggagaaggagatgagcgtgctgagactgagcaacagcaacctgctggaggagctgggcgagctgggcagagagagacagagactgcagagagagctgcagagcctgagccagagactgcagagagagttcgtgcccaagcccgaggcccaggtgcagctgcagcagctgagacagagcgtgggcctgctgaccaacgagctggccatggagaaggaggccaccgagaagctgagaaagctgctggccagccagagcagcggcctgagaggcctgtgggactgcctgcccgccgacctggtgggcgagagaagcgcccagagcaaggccgccgagagcctggaggagctgagagcctgcatcagcaccctggtggacagacacagagaggcccagcaggtgctggccagactgcaggaggagaaccagcagctgagaggcagcctgagcccctgcagagagcccggcaccagcctgaaggcccccgccagcccccaggtggccgccctggagcaggacctgggcaagctggaggaggagctgagagccgtgcaggccaccatgagcggcaagagccaggagatcggcaagctgaagcagctgctgtaccaggccaccgaggaggtggccgagctgagagccagagaggccgccagcctgagacagcacgagaagaccagaggcagcctggtggcccaggcccaggcctggggccaggagctgaaggccctgctggagaagtacaacaccgcctgcagagaggtgggcagactgagagaggccgtggccgaggagagaagaagaagcggcgacctggccgcccaggccgccgagcaggagagacaggccagcgagatgagaggcagaagcgagcagttcgagaagaccgccgagctgctgaaggagaagatggagcacctgatcggcgcctgcagagacaaggaggccaagatcaaggagctgctgaagaagctggagcagctgagcgaggaggtgctggccatcagaggcgagaacgccagactggccctgcagctgcaggacagccagaagaaccacgaggagatcatcagcacctacagaaaccacctgctgaacgccgccagaggctacatggagcacgaggtgtacaacatcctgctgcagatcctgagcatggaggaggagtag

SEQ ID NO: 17951 - DNA, 2733 bp, Artificial Sequence
  Description of Artificial Sequence: Synthetic coding sequence
atgaagagaatcttcagctgccagccccagtgcgtgaaggtgctgctgcagcacggcgccaacgaggacgccgtggacgccgagaacagaagccccctgcactgggccgccagcagcggctgcgccagcagcgtgctgctgctgtgcgaccacgaggccttcctggacgtgctggacaacgacggcagaacccccctgatgatcgccagcctgggcggccacgccgccatctgcagccagctgctgcagagaggcgccagagtgaacgtgaccgacaagaacgacaagagcgccctgatcctggcctgcgagaagggcagcgccgaggtggccgagctgctgctgagccacggcgccgacgccggcgccgtggacagcaccggccacgacgccctgcactacgccctgcacacccaggacaaggccctgtggagacacctgcagcaggccctgagcagaagaagaagaggcggccagagactggtgcagcaccccgacctggccagccaggccagccccagcgagccccaggccggcagcccccccaagagcagctggagagccgagcccgaggaggagcaggaggagaaggaggacgaggacccctgcagcgaggagtggagatggaagtacgaggaggagagaagaaaggtggtgagactggagcaggagctggtgcagaagaccgaggagtgcaagacccaggccgccgcctacctggacctggagaaccagatcagagagcaggcccaggagctgggcgtgctgctgagctgggagcccagagccagcggcaagcagggcagcagcctgagacccggcggcgacggcatggagcagggctgccccaaggacctgctggccgagagcacccaggagctgaagaagcagcagcaggccgccgccaccgtgaaccccgtgctggcccccaagaaggccgaggacagcgcccccggcaagatccagtacgaggtgcacggcagaagccagcccgaggagcagggccccccccagagccccgccagcgagaccatcagaaaggccaccggccagcagctgaccaccaacggcgcccagaccttcggccccgaccacgccgaccagctgcccgccggccagaaggagagcagccaggtgctgggcgtggagcccggcggcaccgtggccgagcccgtgggccccgccgccatgaaccagctgctgctgcagctgagagaggagctggccgccgtgtggagagagaaggacgccgccagaggcgccctgagcagacccgtgatggagggcgccctgggcacccccagagccgaggccgccgccgccgcctgggagaagatggaggccagactggagagagtgctggccagactggagtgggccaaggccggcctgcaggtgaagcccgaggtgcccagccaggagagcagagagggcgccctgaaggccgcccccggcagcatcaagcaggacgaggagaaggagaagagagtgcccggcgccagaggcgagcccctgggcgccctgggcggcgagaaggccctgggcggcctggccaagggccagctggagaaggagatgagcgtgctgagactgagcaacagcaacctgctggaggagctgggcgagctgggcagagagagacagagactgcagagagagctgcagagcctgagccagagactgcagagagagttcgtgcccaagcccgaggcccaggtgcagctgcagcagctgagacagagcgtgggcctgctgaccaacgagctggccatggagaaggaggccaccgagaagctgagaaagctgctggccagccagagcagcggcctgagaggcctgtgggactgcctgcccgccgacctggtgggcgagagaagcgcccagagcaaggccgccgagagcctggaggagctgagagcctgcatcagcaccctggtggacagacacagagaggcccagcaggtgctggccagactgcaggaggagaaccagcagctgagaggcagcctgagcccctgcagagagcccggcaccagcctgaaggcccccgccagcccccaggtggccgccctggagcaggacctgggcaagctggaggaggagctgagagccgtgcaggccaccatgagcggcaagagccaggagatcggcaagctgaagcagctgctgtaccaggccaccgaggaggtggccgagctgagagccagagaggccgccagcctgagacagcacgagaagaccagaggcagcctggtggcccaggcccaggcctggggccaggagctgaaggccctgctggagaagtacaacaccgcctgcagagaggtgggcagactgagagaggccgtggccgaggagagaagaagaagcggcgacctggccgcccaggccgccgagcaggagagacaggccagcgagatgagaggcagaagcgagcagttcgagaagaccgccgagctgctgaaggagaagatggagcacctgatcggcgcctgcagagacaaggaggccaagatcaaggagctgctgaagaagctggagcagctgagcgaggaggtgctggccatcagaggcgagaacgccagactggccctgcagctgcaggacagccagaagaaccacgaggagatcatcagcacctacagaaaccacctgctgaacgccgccagaggctacatggagcacgaggtgtacaacatcctgctgcagatcctgagcatggaggaggagtag

SEQ ID NO: 17952 - DNA, 414 bp, Artificial Sequence
  Description of Artificial Sequence: Synthetic coding sequence
atgaagagaatcttcagctgcagcagcacccaggtggccgtggagagatggaacagacacgaccagaagctgctggaggccgtgcacagaggcgacgtgggcagagtggccgccctggccagcagaaagagcgccagacccaccaagctggacagcaacggccagagccccttccacctggccgccagcaagggcctgaccgagtgcctgaccatcctgctggccaacggcgccgacatcaacagcaagaacgaggacggcagcaccgccctgcacctggccaccatcagctgccagccccagtgcgtgaaggtgctgctgcagccccccctggccgtgccccaggtgtgcagctgctgcgtgaccaccaagcccagctggacctgctggatcatgatggacgtgcacccctag

SEQ ID NO: 17953 - DNA, 489 bp, Artificial Sequence
  Description of Artificial Sequence: Synthetic coding sequence
atggaggacggcaagagagagagatggcccaccctgatggagagactgtgcagcgacggcttcgccttcccccagtaccccatcaagccctaccacctgaagagaatccacagagccgtgctgcacggcaacctggagaagctgaagtacctgctgctgacctactacgacgccaacaagagagacagaaaggagagaaccgccctgcacctggcctgcgccaccggccagcccgagatggtgcacctgctggtgagcagaagatgcgagctgaacctgtgcgacagagaggacagaacccccctgatcaaggccgtgcagctgagacaggaggcctgcgccaccctgctgctgcagaacggcgccaaccccaacatcaccgacttcttcggcagaaccgccctgcactacgccgtgtacaacgaggacaccagcatgatcgagaagctgctgagccacggcaccaacatcgaggagtgcagcaagtag

SEQ ID NO: 17954 - DNA, 384 bp, Artificial Sequence
  Description of Artificial Sequence: Synthetic coding sequence
atgctgctgcagcagcagctggacgacgccagaaacaaggccgacaaccaggagaaggccatcctgaacatccaggccagatgcgacgccagagtgcagaacctgcaggccgagtgcagaaagcacagactgctgctggaggaggacaacaagatgctggtgaacgagctgaaccacagcaaggagaaggagtgccagtacgagaaggagaaggccgagagagaggtggccgtgagacagctgcagcagaagagagacgacgtgctgaacaagggcagcgccaccaaggccctgctggacgccagcagcagacactgcacctacctggagaacggcatgcaggacagcagaaagaagctggaccagatgagaagccaggcctag

SEQ ID NO: 17955 - DNA, 1041 bp, Artificial Sequence
  Description of Artificial Sequence: Synthetic coding sequence
atggaggacggcaagagagagagatggcccaccctgatggagagactgtgcagcgacggcttcgccttcccccagtaccccatcaagccctaccacctgaagagaatccacagagccgtgctgcacggcaacctggagaagctgaagtacctgctgctgacctactacgacgccaacaagagagacagaaaggagagaaccgccctgcacctggcctgcgccaccggccagcccgagatggtgcacctgctggtgagcagaagatgcgagctgaacctgtgcgacagagaggacagaacccccctgatcaaggccgtgcagctgagacaggaggcctgcgccaccctgctgctgcagaacggcgccaaccccaacatcaccgacttcttcggcagaaccgccctgcactacgccgtgtacaacgaggacaccagcatgatcgagaagctgctgagccacggcaccaacatcgaggagtgcagcaagtgcgagtaccagcccctgctgttcgccgtgagcagaagaaaggtgaagatggtggagttcctgctgaagaagaaggccaacgtgaacgccatcgactacctgggcagaagcgccctgatccacgccgtgaccctgggcgagaaggacatcgtgatcctgctgctgcagcacaacatcgacgtgctgagcagagacgccttcagaaagatcgccggcgactacgccatcgaggccaagaacagagtgatcttcgacctgatctacgagtacgagagaaagagatacgaggacctgcccatcaacagcaaccccgtgagcagccagaagccccccaccctgaagggcaccagcgacgaggaggacagcgtgctgggcatcgccagagagaacaaggacggcgagaagagcagaaccgtgagcagcgagaagccccccggcctgaaggccagcagcgccgagaaggacagcgtgctgaacatcgccagaggcaagaaggacggcgagaagaccaagagagtgagcagcagaaagaagcccagcctggaggccacctag

SEQ ID NO: 17956 - DNA, 5826 bp, Artificial Sequence
  Description of Artificial Sequence: Synthetic coding sequence
atggaggacggcaagagagagagatggcccaccctgatggagagactgtgcagcgacggcttcgccttcccccagtaccccatcaagccctaccacctgaagagaatccacagagccgtgctgcacggcaacctggagaagctgaagtacctgctgctgacctactacgacgccaacaagagagacagaaaggagagaaccgccctgcacctggcctgcgccaccggccagcccgagatggtgcacctgctggtgagcagaagatgcgagctgaacctgtgcgacagagaggacagaacccccctgatcaaggccgtgcagctgagacaggaggcctgcgccaccctgctgctgcagaacggcgccaaccccaacatcaccgacttcttcggcagaaccgccctgcactacgccgtgtacaacgaggacaccagcatgatcgagaagctgctgagccacggcaccaacatcgaggagtgcagcaagtgcgagtaccagcccctgctgttcgccgtgagcagaagaaaggtgaagatggtggagttcctgctgaagaagaaggccaacgtgaacgccatcgactacctgggcagaagcgccctgatccacgccgtgaccctgggcgagaaggacatcgtgatcctgctgctgcagcacaacatcgacgtgctgagcagagacgccttcagaaagatcgccggcgactacgccatcgaggccaagaacagagtgatcttcgacctgatctacgagtacgagagaaagagatacgaggacctgcccatcaacagcaaccccgtgagcagccagaagcagcccgccctgaaggccaccagcggcaaggaggacagcatcagcaacatcgccaccgagatcaaggacggccagaagagcggcaccgtgagcagccagaagcagcccgccctgaaggacaccagcgacaaggacgacagcgtgagcaacaccgccaccgagatcaaggacgagcagaagagcggcaccgtgctgcccgccgtggagcagtgcctgaacagaagcctgtacagacccgacgccgtggcccagcccgtgaccgagaacgagttcagcctggagagcgagatcatcagcaagctgtacatccccaagagaaagatcatcagccccagaagcatcaaggacgtgctgccccccgtggaggaggccgtggacagatgcctgtacctgctggacagattcgcccagcccgtgaccaaggacaagttcgccctggagagcgagaacatcagcgagccctacttcaccaacagaagaaccatcagccagcagagcgccgagaacctggacgccgcctgcggcatcgacaagaccgagaacggcaacatgttcgaggaccagaacgtggacaaggagggcaaggccctgcccgccaccggccagaaggccaacgtgagccccgagcagccccccctgttcacccacaccgtgaaggacagagaccacatcagcaccagattcctgggcggcatggacagcctgaccagcagcgaggagagcagcgagagaccccccctgagcaccctgaccctgaaggaggccgaccccagcagcaaggccgccatgagaagaaaggacagccccccccccggcaaggtgagcagccagaagcagcccgccgagaaggccaccagcgacgacaaggacagcgtgagcaacatcgccaccgagatcaaggagggccccatcagcggcaccgtgagcagccagaagcagcccgccgagaaggccaccagcgacgagaaggacagcgtgagcaacatcgccaccgagatcaagaagggccagcagagcggcaccgtgagcccccagaagcagagcgcctggaaggtgatcttcaagaagaaggtgagcctgctgaacatcgccaccagaatcatgggcggcggcaagagcggcaccgtgagcagccagaagcagcccgccagcaaggccaccagcgacaagaccgacagcgccctgaacatcgccaccgagatcaaggacggcctgcagtgcggcaccgtgagcagccagaagcagcccgccctgaaggccaccaccgacgaggaggacagcgtgagcaacatcgccaccgagatcaaggacggcgagaagagcggcaccgtgagcagccagaagcagcccgccctgaaggccaccaccgacgaggaggacagcgtgagcaacatcgccaccgagatcaaggacggcgagaagagcggcaccgtgagcagccagaagcagcccgccctgaaggccaccaccgacgagaaggacagcgtgagcaacatcgccaccgagatcaaggacggcgagaagagcggcaccgtgagcagccagaagccccccgccctgaccgccaccagcgacgaggagggcagcgtgctgagcatcgccagagagaacaaggacggcgagaagagcagaaccgtgagcagcagaaagaagcccgccctgaaggccaccagcgacgagaaggacagcttcagcaacatcaccagaggcaagaaggacggcgagatcagcagaaaggtgagcagccagaagccccccaccctgaagggcaccagcgacgaggaggacagcgtgctgggcatcgccagagagaacaaggacggcgagaagagcagaaccgtgagcagcgagaagccccccggcctgaaggccagcagcgccgagaaggacagcgtgctgaacatcgccagaggcaagaaggacggcgagaagaccaagagagtgagcagcagaaagaagcccagcctggaggccaccagcgacgagaaggacagcttcagcaacatcaccagagagaagaaggacggcgagatcagcagaaaggtgagcagccagaagccccccgccctgaagggcaccagcgacgaggaggacagcgtgctgggcatcgccagagagaacaaggacggcgagaagagcagaaccgtgagcagcgagaagccccccggcctgaaggccaccagcgacgagaaggacagcgtgctgaacatcgccagaggcaagaaggacggcgagaagaccagaaccgtgagcagccagaagccccccaccctgaaggccaccagcgacgaggaggacagcgtgctgagcatcgccagagagaacaaggacggcgagaagagcagaaccgtgagcagcgagaagcccagcggcctgaaggccaccagcgccgagaaggacagcgtgctgaacatcgccagaggcaagaagtacggcgagaagaccaagagagtgagcagcagaaagaagcccgccctgaaggccaccagcgacgagaaggacagcgtgctgtacatcgccagagagaagaaggacggcgagaagagcagaaccgtgagcagccccaagcagcccgccctgaaggccatctgcgacaaggaggacagcgtgcccaacatggccaccgagaagaaggacgagcagatcagcggcaccgtgagctgccagaagcagcccgccctgaaggccaccagcgacaagaaggacagcgtgagcaacatccccaccgagatcaaggacggccagcagagcggcaccgtgagcagccagaagcagcccgcctggaaggccaccagcgtgaagaaggacagcgtgagcaacatcgccaccgagatcaaggacggccagatcagaggcaccggcatcctggagtacaccttcaacgtgatgttcgaccagatcgaggagaagttcaccagcctgaacaagagcgccggcgtgagcccccagaagcagagcgcccagaaggtgatcttcaagaagaaggtgagcctgctgaacatcgccaccagaatcaccggcggctggaagagcggcaccgagtaccccgagaacctgcccaccctgaaggccaccatcgagaacaagaacagcgtgctgaacaccgccaccaagatgaaggacgtgcagaccagcacccccgccgagcaggacctggagatggccagcgagggcgagcagaagagactggaggagtacgagaacaaccagccccaggtgaagaaccagatccacagcagagacgacctggacgacatcatccagagcagccagaccgtgagcgaggacggcgacagcctgtgctgcaactgcaagaacgtgatcctgctgatcgaccagcacgagatgaagtgcaaggactgcgtgcacctgctgaagatcaagaacaccttctgcctgtggaagagactgatcaagctgaaggacaaccactgcgagcagctgagagtgaagatcagaaagctgaagaacaaggccagcgtgctgcagaagagaatcagcgagaaggaggagatcaagagccagctgaagcacgagatcctggagctggagaaggagctgtgcagcctgagattcgccatccagcaggagaagaagaagagaagaaacgtggaggaggtgcaccagaaggtgagagagaagctgagaatcaccgaggagcagtacagaatcgaggccgacgtgaccaagcccatcaagcccgccctgaagagcgccgaggtggagctgaagaccggcggcaacaacagcaaccaggtgagcgagaccgacgagaaggaggacctgctgcacgagaacagactgatgcaggacgagatcgccagactgagactggagaaggacaccatcaagaaccagaacctggagaagaagtacctgaaggacttcgagatcgtgaagagaaagcacgaggacctgcagaaggccctgaagagaaacggcgagaccctggccaagaccatcgcctgctacagcggccagctggccgccctgaccgacgagaacaccaccctgagaagcaagctggagaagcagagagagagcagacagagactggagaccgagatgcagagctaccactgcagactgaacgccgccagatgcgaccacgaccagagccacagcagcaagagagaccaggagctggccttccagggcaccgtggacaagtgcagacacctgcaggagaacctgaacagccacgtgctgatcctgagcctgcagctgagcaaggccgagagcaagagcagagtgctgaagaccgagctgcactacaccggcgaggccctgaaggagaaggccctggtgttcgagcacgtgcagagcgagctgaagcagaagcagagccagatgaaggacatcgagaagatgtacaagagcggctacaacaccatggagaagtgcatcgagaagcaggagagattctgccagctgaagaagcagaacatgctgctgcagcagcagctggacgacgccagaaacaaggccgacaaccaggagaaggccatcctgaacatccaggccagatgcgacgccagagtgcagaacctgcaggccgagtgcagaaagcacagactgctgctggaggaggacaacaagatgctggtgaacgagctgaaccacagcaaggagaaggagtgccagtacgagaaggagaaggccgagagagaggtggccgtgagacagctgcagcagaagagagacgacgtgctgaacaagggcagcgccaccaaggccctgctggacgccagcagcagacactgcacctacctggagaacggcatgcaggacagcagaaagaagctggaccagatgagaagccagttccaggagatccaggaccagctgaccgccaccatcagatgcaccaaggagatggagggcgacacccagaagctggaggtggagcacgtgatgatgagaaagatcatcaagaagcaggacgaccagatcgagagactggagaagatcctgcagcacagcagcctgatgctgcaggtgttcgagagctag

SEQ ID NO: 17957 - DNA, 930 bp, Artificial Sequence
  Description of Artificial Sequence: Synthetic coding sequence
atggaggacggcaagagagagagatggcccaccctgatggagagactgtgcagcgacggcttcgccttcccccagtaccccatcaagccctaccacctgaagagaatccacagagccgtgctgcacggcaacctggagaagctgaagtacctgctgctgacctactacgacgccaacaagagagacagaaaggagagaaccgccctgcacctggcctgcgccaccggccagcccgagatggtgcacctgctggtgagcagaagatgcgagctgaacctgtgcgacagagaggacagaacccccctgatcaaggccgtgcagctgagacaggaggcctgcgccaccctgctgctgcagaacggcgccaaccccaacatcaccgacttcttcggcagaaccgccctgcactacgccgtgtacaacgaggacaccagcatgatcgagaagctgctgagccacggcaccaacatcgaggagtgcagcaagtgcgagtaccagcccctgctgttcgccgtgagcagaagaaaggtgaagatggtggagttcctgctgaagaagaaggccaacgtgaacgccatcgactacctgggcagaagcgccctgatccacgccgtgaccctgggcgagaaggacatcgtgatcctgctgctgcagcacaacatcgacgtgctgagcagagacgccttcagaaagatcgccggcgactacgccatcgaggccaagaacagagtgatcttcgacctgatctacgagtacgagagaaagagatacgaggacctgcccatcaacagcaaccccgtgagcagccagaagcagcccgccctggccaccgagcaggacagcatgagcaagatcaagaagagaaagctgatcgtgatgaagaagaagagcatggtgatccagagattcctggtgaccttctgcaagtag

SEQ ID NO: 17958 - DNA, 5826 bp, Artificial Sequence; identical to SEQ ID NO: 17956
  Description of Artificial Sequence: Synthetic coding sequence

SEQ ID NO: 17959 - DNA, 3627 bp, Artificial Sequence
  Description of Artificial Sequence: Synthetic coding sequence
atgggcggcggcaagagcggcaccgtgagcagccagaagcagcccgccagcaaggccaccagcgacaagaccgacagcgccctgaacatcgccaccgagatcaaggacggcctgcagtgcggcaccgtgagcagccagaagcagcccgccctgaaggccaccaccgacgaggaggacagcgtgagcaacatcgccaccgagatcaaggacggcgagaagagcggcaccgtgagcagccagaagcagcccgccctgaaggccaccaccgacgaggaggacagcgtgagcaacatcgccaccgagatcaaggacggcgagaagagcggcaccgtgagcagccagaagcagcccgccctgaaggccaccaccgacgagaaggacagcgtgagcaacatcgccaccgagatcaaggacggcgagaagagcggcaccgtgagcagccagaagccccccgccctgaccgccaccagcgacgaggagggcagcgtgctgagcatcgccagagagaacaaggacggcgagaagagcagaaccgtgagcagcagaaagaagcccgccctgaaggccaccagcgacgagaaggacagcttcagcaacatcaccagaggcaagaaggacggcgagatcagcagaaaggtgagcagccagaagccccccaccctgaagggcaccagcgacgaggaggacagcgtgctgggcatcgccagagagaacaaggacggcgagaagagcagaaccgtgagcagcgagaagccccccggcctgaaggccagcagcgccgagaaggacagcgtgctgaacatcgccagaggcaagaaggacggcgagaagaccaagagagtgagcagcagaaagaagcccagcctggaggccaccagcgacgagaaggacagcttcagcaacatcaccagagagaagaaggacggcgagatcagcagaaaggtgagcagccagaagccccccgccctgaagggcaccagcgacgaggaggacagcgtgctgggcatcgccagagagaacaaggacggcgagaagagcagaaccgtgagcagcgagaagccccccggcctgaaggccaccagcgacgagaaggacagcgtgctgaacatcgccagaggcaagaaggacggcgagaagaccagaaccgtgagcagccccaagcagcccgccctgaaggccatctgcgacaaggaggacagcgtgcccaacatggccaccgagaagaaggacgagcagatcagcggcaccgtgagctgccagaagcagcccgccctgaaggccaccagcgacaagaaggacagcgtgagcaacatccccaccgagatcaaggacggccagcagagcggcaccgtgagcagccagaagcagcccgcctggaaggccaccagcgtgaagaaggacagcgtgagcaacatcgccaccgagatcaaggacggccagatcagaggcaccgtgagcccccaggtgcccatccccagacacaaggtgggcaacatcaagagctaccccaacaccggcagaagaatccagctggacgccaacaccttcagcgtgagcccccagaagcagagcgcccagaaggtgatcttcaagaagaaggtgagcctgctgaacatcgccaccagaatcaccggcggctggaagagcggcaccgagtaccccgagaacctgcccaccctgaaggccaccatcgagaacaagaacagcgtgctgaacaccgccaccaagatgaaggacgtgcagaccagcacccccgccgagcaggacctggagatggccagcgagggcgagcagaagagactggaggagtacgagaacaaccagccccaggtgaagaaccagatccacagcagagacgacctggacgacatcatccagagcagccagaccgtgagcgaggacggcgacagcctgtgctgcaactgcaagaacgtgatcctgctgatcgaccagcacgagatgaagtgcaaggactgcgtgcacctgctgaagatcaagaacaccttctgcctgtggaagagactgatcaagctgaaggacaaccactgcgagcagctgagagtgaagatcagaaagctgaagaacaaggccagcgtgctgcagaagagaatcagcgagaaggaggagatcaagagccagctgaagcacgagatcctggagctggagaaggagctgtgcagcctgagattcgccatccagcaggagaagaagaagagaagaaacgtggaggaggtgcaccagaaggtgagagagaagctgagaatcaccgaggagcagtacagaatcgaggccgacgtgaccaagcccatcaagcccgccctgaagagcgccgaggtggagctgaagaccggcggcaacaacagcaaccaggtgagcgagaccgacgagaaggaggacctgctgcacgagaacagactgatgcaggacgagatcgccagactgagactggagaaggacaccatcaagaaccagaacctggagaagaagtacctgaaggacttcgagatcgtgaagagaaagcacgaggacctgcagaaggccctgaagagaaacggcgagaccctggccaagaccatcgcctgctacagcggccagctggccgccctgaccgacgagaacaccaccctgagaagcaagctggagaagcagagagagagcagacagagactggagaccgagatgcagagctaccactgcagactgaacgccgccagatgcgaccacgaccagagccacagcagcaagagagaccaggagctggccttccagggcaccgtggacaagtgcagacacctgcaggagaacctgaacagccacgtgctgatcctgagcctgcagctgagcaaggccgagagcaagagcagagtgctgaagaccgagctgcactacaccggcgaggccctgaaggagaaggccctggtgttcgagcacgtgcagagcgagctgaagcagaagcagagccagatgaaggacatcgagaagatgtacaagagcggctacaacaccatggagaagtgcatcgagaagcaggagagattctgccagctgaagaagcagaacatgctgctgcagcagcagctggacgacgccagaaacaaggccgacaaccaggagaaggccatcctgaacatccaggccagatgcgacgccagagtgcagaacctgcaggccgagtgcagaaagcacagactgctgctggaggaggacaacaagatgctggtgaacgagctgaaccacagcaaggagaaggagtgccagtacgagaaggagaaggccgagagagaggtggccgtgagacagctgcagcagaagagagacgacgtgctgaacaagggcagcgccaccaaggccctgctggacgccagcagcagacactgcacctacctggagaacggcatgcaggacagcagaaagaagctggaccagatgagaagccagttccaggagatccaggaccagctgaccgccaccatcagatgcaccaaggagatggagggcgacacccagaagctggaggtggagcacgtgatgatgagaaagatcatcaagaagcaggacgaccagatcgagagactggagaagatcctgcagcacagcagcctgctgctgctgaacttcgagacctag

SEQ ID NO: 17960 - DNA, 1821 bp, Artificial Sequence
  Description of Artificial Sequence: Synthetic coding sequence
agcagcagaaagaagcccgccctgaaggccaccagcgacgagaaggacagcttcagcaacatcaccagagagaagaaggacggcgagaccagcagaaccgtgagcagccagaagccccccgccctgaaggccaccagcgacgaggaggacagcgtgctgagcatcgccagagaggagaaggacggcgagaagagcagaaccgtgagcagcgagcagccccccggcctgaaggccaccagagacgagaaggacagcctgctgaacatcgccagagtgatccaggccggcggccagagcttcagcgtgagcagcagaaagaaggccgccctgaaggccaccagcgacgagaaggacagcttcagcaacatcaccagagagagaaaggacggcgagaccagcagaaccgtgagcagccagaagccccccgccctgaaggccaccagcgacgaggaggacagcgtgctgaacatcgccagagagaagaaggacggcgagaagagcagaaccgtgagcagcagaaagaaggccgccctgaaggccaccagcgacgagaaggacagcttcagcaacatcaccagagagagaaaggacggcgagaccagcagaaccgtgagcagccagaagccccccgccctgaaggccaccagcgacgaggaggacagcgtgctgaacatcgccagagagaagaaggacggcgagaagagcagaaccgtgagcagcgagcagccccccggcctgaaggccaccagagacgagaaggacagcctgctgaacatcgccagaggcaagaagcacggcgagaagaccagaagagtgagcagcagaaagaaggccgccctgaaggccaccagcgacgagaaggacagcttcagcaacatcaccagagagagaaaggacggcgagaccagcagaaccgtgagcagccagaagccccccgccctgaaggccaccggcgacgaggaggacagcgtgctgaacatcgccagagagaagaaggacggcgagaagagcagaaccgtgagcagcgagaagcccagcggcctgaaggccaccagcgacgagaaggacagcgtgctgaacatcgccagaggcaagaagcacggcgagaagaccagaagagtgagcagccacaagcagcccgccctgaaggccaccagcgacaaggagaacagcgtgcccaacatggccaccgagaccaaggacgagcagatcagcggcaccgtgagcagccagaagcagcccgccctgaaggccaccagcgacaagaaggacagcgtgagcaacatccccaccgagatcaaggacggccagcagagcggcaccgtgagcagccagaagcagctggcctggaaggccaccagcgtgaagaaggacagcgtgagcaacatcgccaccgagatcaaggacggccagatcagaggcaccgtgagcagccagagacagcccgccctgaaggccaccggcgacgagaaggacagcgtgagcaacatcgccagagagatcaaggacggcgagaagagcggcaccgtgagcccccagaagcagagcgcccagaaggtgatcttcaagaagaaggtgagcctgctgaacatcgccaccagaatcaccggcggctggaagagcggcaccgagtaccccgagaacctgcccaccctgaaggccaccatcgagaacaagaacagcgtgctgaacaccgccaccaagatgaaggacgtgcagaccagcacccccgagcaggacctggagatggccagcgagggcgagcagaagagactggaggagtacgagaacaaccagccccaggtgtacttcagcttctag

SEQ ID NO: 17961 - DNA, 2400 bp, Artificial Sequence
  Description of Artificial Sequence: Synthetic coding sequence
atggccaccgagaccaaggacgagcagatcagcggcaccgtgagcagccagaagcagcccgccctgaaggccaccagcgacaagaaggacagcgtgagcaacatccccaccgagatcaaggacggccagcagagcggcaccgtgagcagccagaagcagctggcctggaaggccaccagcgtgaagaaggacagcgtgagcaacatcgccaccgagatcaaggacggccagatcagaggcaccgtgagcagccagagacagcccgccctgaaggccaccggcgacgagaaggacagcgtgagcaacatcgccagagagatcaaggacggcgagaagagcggcaccgtgagcccccagaagcagagcgcccagaaggtgatcttcaagaagaaggtgagcctgctgaacatcgccaccagaatcaccggcggctggaagagcggcaccgagtaccccgagaacctgcccaccctgaaggccaccatcgagaacaagaacagcgtgctgaacaccgccaccaagatgaaggacgtgcagaccagcacccccgagcaggacctggagatggccagcgagggcgagcagaagagactggaggagtacgagaacaaccagccccaggtgaagaaccagatccacagcagagacgacctggacgacatcatccagagcagccagaccgtgagcgaggacggcgacagcctgtgctgcaactgcaagaacgtgatcctgctgatcgaccagcacgagatgaagtgcaaggactgcgtgcacctgctgaagatcaagaagaccttctgcctgtgcaagagactgaccgagctgaaggacaaccactgcgagcagctgagagtgaagatcagaaagctgaagaacaaggccagcgtgctgcagaagagactgagcgagaaggaggagatcaagagccagctgaagcacgagaccctggagctggagaaggagctgtgcagcctgagattcgccatccagcaggagaagaagaagagaagaaacgtggaggagctgcaccagaaggtgagagagaagctgagaatcaccgaggagcagtacagaatcgaggccgacgtgaccaagcccatcaagcccgccctgaagagcgccgaggtggagctgaagaccggcggcaacaacagcaaccaggtgagcgagaccgacgagaaggaggacctgctgcacgagaacagactgatgcaggacgagatcgccagactgagactggagaaggacaccatcaagaaccagaacctggagaagaagtacctgaaggacttcgagatcgtgaagagaaagcacgaggacctgcagaaggccctgaagagaaacgaggagaccctggccgagaccatcgcctgctacagcggccagctggccgccctgaccgacgagaacaccaccctgagaagcaagctggagaagcagagagagagcggccagagactggagaccgagatgcagagctacagatgcagactgaacgccgccctgtgcgaccacgaccagagccacagcagcaagagagaccaggagctggccttccagggcaccgtggacaagtgctgccacctgcaggagaacctgaacagccacgtgctgatcctgagcctgcagctgagcaaggccgagagcaagttcagagtgctggagaccgagctgcactacaccggcgaggccctgaaggagaaggccctggtgttcgagcacgtgcagagcgagctgaagcagaagcagagccagatgaaggacatcgagaagatgtacaagagcggctacaacaccatggagaagtgcatcgagaagcaggagagattctgccagctgaagaagcagaacatgctgctgcagcagcagctggacgacgccagaaacaaggccgacaaccaggagaaggccatcctgaacatccaggccagatgcgacgccagagtggagaacctgcaggccgagtgcagaaagcacagactgctgctggaggaggacaacaagatgctggtgaacgagctgaaccacagcaaggagaagaagtgccagtacgagaaggagaaggccgagagagaggtggccgtgagacagctgcagcagaagcaggacgacgtgctgaacaagagaagcgccaccaaggccctgctggacgccagcagcagacactgcatctacctggagaacggcatgcaggacagcagaaagaagctggaccagatgagaagccagttccaggagatccaggaccagctgaccgccaccatcagatgcaccaaggagatggagggcgacgcccagaagctggaggtggagaacgtgatgatgagaaagatcatcaagaagcaggacgagcagatcgagagattcgagaagatcctgcagcacagcagcctggtgtag

SEQ ID NO: 17962 - DNA, 3090 bp, Artificial Sequence
  Description of Artificial Sequence: Synthetic coding sequence
agcagcagaaagaaggccgccctgaaggccaccagcgacgagaaggacagcttcagcaacatcaccagagagagaaaggacggcgagaccagcagaaccgtgagcagccagaagccccccgccctgaaggccaccagcgacgaggaggacagcgtgctgaacatcgccagagagaagaaggacggcgagaagagcagaaccgtgagcagcgagcagccccccggcctgaaggccaccagagacgagaaggacagcctgctgaacatcgccagaggcaagaagcacggcgagaagaccagaagagtgagcagcagaaagaaggccgccctgaaggccaccagcgacgagaaggacagcttcagcaacatcaccagagagagaaaggacggcgagaccagcagaaccgtgagcagccagaagccccccgccctgaaggccaccggcgacgaggaggacagcgtgctgaacatcgccagagagaagaaggacggcgagaagagcagaaccgtgagcagcgagaagcccagcggcctgaaggccaccagcgacgagaaggacagcgtgctgaacatcgccagaggcaagaagcacggcgagaagaccagaagagtgagcagccacaagcagcccgccctgaaggccaccagcgacaaggagaacagcgtgcccaacatggccaccgagaccaaggacgagcagatcagcggcaccgtgagcagccagaagcagcccgccctgaaggccaccagcgacaagaaggacagcgtgagcaacatccccaccgagatcaaggacggccagcagagcggcaccgtgagcagccagaagcagctggcctggaaggccaccagcgtgaagaaggacagcgtgagcaacatcgccaccgagatcaaggacggccagatcagaggcaccgtgagcagccagagacagcccgccctgaaggccaccggcgacgagaaggacagcgtgagcaacatcgccagagagatcaaggacggcgagaagagcggcaccgtgagcccccagaagcagagcgcccagaaggtgatcttcaagaagaaggtgagcctgctgaacatcgccaccagaatcaccggcggctggaagagcggcaccgagtaccccgagaacctgcccaccctgaaggccaccatcgagaacaagaacagcgtgctgaacaccgccaccaagatgaaggacgtgcagaccagcacccccgagcaggacctggagatggccagcgagggcgagcagaagagactggaggagtacgagaacaaccagccccaggtgaagaaccagatccacagcagagacgacctggacgacatcatccagagcagccagaccgtgagcgaggacggcgacagcctgtgctgcaactgcaagaacgtgatcctgctgatcgaccagcacgagatgaagtgcaaggactgcgtgcacctgctgaagatcaagaagaccttctgcctgtgcaagagactgaccgagctgaaggacaaccactgcgagcagctgagagtgaagatcagaaagctgaagaacaaggccagcgtgctgcagaagagactgagcgagaaggaggagatcaagagccagctgaagcacgagaccctggagctggagaaggagctgtgcagcctgagattcgccatccagcaggagaagaagaagagaagaaacgtggaggagctgcaccagaaggtgagagagaagctgagaatcaccgaggagcagtacagaatcgaggccgacgtgaccaagcccatcaagcccgccctgaagagcgccgaggtggagctgaagaccggcggcaacaacagcaaccaggtgagcgagaccgacgagaaggaggacctgctgcacgagaacagactgatgcaggacgagatcgccagactgagactggagaaggacaccatcaagaaccagaacctggagaagaagtacctgaaggacttcgagatcgtgaagagaaagcacgaggacctgcagaaggccctgaagagaaacgaggagaccctggccgagaccatcgcctgctacagcggccagctggccgccctgaccgacgagaacaccaccctgagaagcaagctggagaagcagagagagagcggccagagactggagaccgagatgcagagctacagatgcagactgaacgccgccctgtgcgaccacgaccagagccacagcagcaagagagaccaggagctggccttccagggcaccgtggacaagtgctgccacctgcaggagaacctgaacagccacgtgctgatcctgagcctgcagctgagcaaggccgagagcaagttcagagtgctggagaccgagctgcactacaccggcgaggccctgaaggagaaggccctggtgttcgagcacgtgcagagcgagctgaagcagaagcagagccagatgaaggacatcgagaagatgtacaagagcggctacaacaccatggagaagtgcatcgagaagcaggagagattctgccagctgaagaagcagaacatgctgctgcagcagcagctggacgacgccagaaacaaggccgacaaccaggagaaggccatcctgaacatccaggccagatgcgacgccagagtggagaacctgcaggccgagtgcagaaagcacagactgctgctggaggaggacaacaagatgctggtgaacgagctgaaccacagcaaggagaagaagtgccagtacgagaaggagaaggccgagagagaggtggccgtgagacagctgcagcagaagcaggacgacgtgctgaacaagagaagcgccaccaaggccctgctggacgccagcagcagacactgcatctacctggagaacggcatgcaggacagcagaaagaagctggaccagatgagaagccagttccaggagatccaggaccagctgaccgccaccatcagatgcaccaaggagatggagggcgacgcccagaagctggaggtggagaacgtgatgatgagaaagatcatcaagaagcaggacgagcagatcgagagattcgagaagatcctgcagcacagcagcctggtgagcatcatcttcgagacctag

SEQ ID NO: 17963 - DNA, 5337 bp, Artificial Sequence
  Description of Artificial Sequence: Synthetic coding sequence
atggacgacaaggagcccaagagatggcccaccctgagagacagactgtgcagcgacggcttcctgttcccccagtaccccatcaagccctaccacctgaagggcatccacagagccgtgttctacagagacctggaggagctgaagttcgtgctgctgaccagatacgacatcaacaagagagacagaaaggagagaaccgccctgcacctggcctgcgccaccggccagcccgagatggtgcacctgctggtgagcagaagatgcgagctgaacctgtgcgacagagaggacagaacccccctgatcaaggccgtgcagctgagacaggaggcctgcgccaccctgctgctgcagaacggcgccgaccccaacatcaccgacgtgttcggcagaaccgccctgcactacgccgtgtacaacgaggacaccagcatgatcgagaagctgctgagctacggcgccaacatcgaggagtgcagcgaggacgagtacccccccctgttcctggccgtgagccagagaaaggtgaagatggtggagttcctgctgaagaagaaggccaacatcaacgccgtggactacctgggcagaagcgccctgatccacgccgtgaccctgggcgagaaggacatcgtgatcctgctgctgcagcacaacatcgacgtgttcagcagagacgtgtacggcaagctggccgaggactacgccagcgaggccaagaacagagtgatcttcgagctgatctacgagtacgagagaaagaagcacgaggagctgagcatcaacagcaaccccgtgagcagccagaagcagcccgccctgaaggccaccagcggcaaggaggacagcatcagcaacatcgccaccgagatcaaggacggccagaagagcggcaccgtgagcagccagaagcagcccgccctgaagggcaccagcgacaagaacgacagcgtgagcaacaccgccaccgagatcaaggacgagcagaagagcggcaccgtgagcagccagaagcagcccgccctgaaggacaccagcgacaagaacgacagcgtgagcaacaccgccaccgagatcaaggacgagcagaagagcggcaccgtgctgcccgccgtggagcagtgcctgaacagaagcctgtacagacccgacgccgtggcccagcccgtgaccgaggacgagttcgccctggagagcgagatcatcagcaagctgtacatccccaagagaaagatcatcagccccagaagcatcgaggacgtgctgccccccgtggaggaggccgtggacagatgcctgtacctgctggacagattcgcccaggccgtgaccaaggacaagttcgccctggagagcgagaacatcagcgagccctacttcaccaacagaagaaccatcagccagcagagcgccgagaagctggacgccgcctgcggcatcgacaagaccgagaacggcaccctgttcgaggaccagaacgtggacaaggagggcaaggccctgcccgccaccggccagaaggccaacgtgagccccgagcagccccccctgttcacccacaccgtgaaggacagcgaccacatcagcaccagattcctgggcagcatggacagcctgaccagcagcgaggagagcagcgagagaccccccctgagcaccctgaccctgaaggaggccgaccccagcagcaaggccgccatgagaagaaaggacagccccccccccggcaaggtgagcagccagaagcagcccgccgagaaggccaccagcgacgacaaggacagcgtgagcaacatcgccaccgagatcaaggagggccccatcagcggcaccgtgagcagccagaagcagcccgccgagaaggccaccagcgacgagaaggacagcgtgagcaacatcgccaccgagatcaaggagggccagcagagcggcaccgtgagcccccagaagcagagcgcctggaaggtgatcttcaagaagaaggtgagcctgctgaacatcgccaccagaatcaccggcggcggcaagagcggcaccgtgagcagccagaagcagccccccagcaaggccaccagcgacaagaccgacagcgccctgaacatcgccaccgagatcaaggacggcctgcagtgcggcaccgtgagcagccagaagcagcccgccctgaaggccaccaccgacgaggaggacagcgtgagcaacatcgccaccgagatcaaggacggcgagaagagcggcaccgtgagcagccagaagcagcccgccctgaaggccaccaccgacgaggaggacagcgtgagcatcatcgccaccgagatcaaggacggcgagaagagcggcaccgtgagcagcagaaagaagcccgccctgaaggccaccagcgacgagaaggacagcttcagcaacatcaccagagagaagaaggacggcgagatcagcagaaccgtgaccagcgagaagcccgccggcctgaaggccaccagcgacgaggaggacagcgtgctgaacatcgccagaggcaaggaggacggcgagaagaccagaagagtgagcagcagaaagaagcccgccctgaaggccaccagcgacgagaaggacagcttcagcaacatcaccagagagaagaaggacggcgagaccagcagaaccgtgagcagccagaagccccccgccctgaaggccaccagcgacgaggaggacagcgtgctgaacatcgccagagagaagaaggacggcgagaagagcagaaccgtgagcagcgagaagcccagcggcctgaaggccaccagcgacgagaaggacagcgtgctgaacatcgccagaggcaagaagcacggcgagaagaccagaagagtgagcagccacaagcagcccgccctgaaggccaccagcgacaaggagaacagcgtgcccaacatggccaccgagaccaaggacgagcagatcagcggcaccgtgagcagccagaagcagcccgccctgaaggccaccagcgacaagaaggacagcgtgagcaacatccccaccgagatcaaggacggccagcagagcggcaccgtgagcagccagaagcagctggcctggaaggccaccagcgtgaagaaggacagcgtgagcaacatcgccaccgagatcaaggacggccagatcagaggcaccgtgagcagccagagacagcccgccctgaaggccaccggcgacgagaaggacagcgtgagcaacatcgccagagagatcaaggacggcgagaagagcggcaccgtgagcccccagaagcagagcgcccagaaggtgatcttcaagaagaaggtgagcctgctgaacatcgccaccagaatcaccggcggctggaagagcggcaccgagtaccccgagaacctgcccaccctgaaggccaccatcgagaacaagaacagcgtgctgaacaccgccaccaagatgaaggacgtgcagaccagcacccccgagcaggacctggagatggccagcgagggcgagcagaagagactggaggagtacgagaacaaccagccccaggtgaagaaccagatccacagcagagacgacctggacgacatcatccagagcagccagaccgtgagcgaggacggcgacagcctgtgctgcaactgcaagaacgtgatcctgctgatcgaccagcacgagatgaagtgcaaggactgcgtgcacctgctgaagatcaagaagaccttctgcctgtgcaagagactgaccgagctgaaggacaaccactgcgagcagctgagagtgaagatcagaaagctgaagaacaaggccagcgtgctgcagaagagactgagcgagaaggaggagatcaagagccagctgaagcacgagaccctggagctggagaaggagctgtgcagcctgagattcgccatccagcaggagaagaagaagagaagaaacgtggaggagctgcaccagaaggtgagagagaagctgagaatcaccgaggagcagtacagaatcgaggccgacgtgaccaagcccatcaagcccgccctgaagagcgccgaggtggagctgaagaccggcggcaacaacagcaaccaggtgagcgagaccgacgagaaggaggacctgctgcacgagaacagactgatgcaggacgagatcgccagactgagactggagaaggacaccatcaagaaccagaacctggagaagaagtacctgaaggacttcgagatcgtgaagagaaagcacgaggacctgcagaaggccctgaagagaaacgaggagaccctggccgagaccatcgcctgctacagcggccagctggccgccctgaccgacgagaacaccaccctgagaagcaagctggagaagcagagagagagcggccagagactggagaccgagatgcagagctacagatgcagactgaacgccgccctgtgcgaccacgaccagagccacagcagcaagagagaccaggagctggccttccagggcaccgtggacaagtgctgccacctgcaggagaacctgaacagccacgtgctgatcctgagcctgcagctgagcaaggccgagagcaagttcagagtgctggagaccgagctgcactacaccggcgaggccctgaaggagaaggccctggtgttcgagcacgtgcagagcgagctgaagcagaagcagagccagatgaaggacatcgagaagatgtacaagagcggctacaacaccatggagaagtgcatcgagaagcaggagagattctgccagctgaagaagcagaacatgctgctgcagcagcagctggacgacgccagaaacaaggccgacaaccaggagaaggccatcctgaacatccaggccagatgcgacgccagagtggagaacctgcaggccgagtgcagaaagcacagactgctgctggaggaggacaacaagatgctggtgaacgagctgaaccacagcaaggagaagaagtgccagtacgagaaggagaaggccgagagagaggtggccgtgagacagctgcagcagaagcaggacgacgtgctgaacaagagaagcgccaccaaggccctgctggacgccagcagcagacactgcatctacctggagaacggcatgcaggacagcagaaagaagctggaccagatgagaagccagttccaggagatccaggaccagctgaccgccaccatcagatgcaccaaggagatggagggcgacgcccagaagctggaggtggagaacgtgatgatgagaaagatcatcaagaagcaggacgagcagatcgagagattcgagaagatcctgcagcacagcagcctgatgctgcaggtgttcgagagctag

SEQ ID NO: 17964 - DNA, 552 bp, Artificial Sequence
  Description of Artificial Sequence: Synthetic coding sequence
atggccacccccagaccctgcgccgacggcccctgctgcagccaccccagcgccgtgctgggcgtgcagcagaccctggaggagatggacttcgagagaggcatctggagcgccgccctgaacggcgacctgggcagagtgaagcacctgatccagaaggccgaggaccccagccagcccgacagcgccggctacaccgccctgcactacgccagcagaaacggccactacgccgtgtgccagttcctgctggagagcggcgccaagtgcgacgcccagacccacggcggcgccaccgccctgcacagagccagctactgcggccacaccgagatcgccagactgctgctgagccacggcagcaaccccagagtggtggacgacgacggcatgaccagcctgcacaaggccgccgagagaggccacggcgacatctgcagcctgctgctgcagcacagccccgccctgaaggccatcagagacagaaaggccagactggcctgcgacctgctgccctgcaacagcgacctgagagacctgctgagcagctag

SEQ ID NO: 17965 - DNA, 1107 bp, Artificial Sequence
  Description of Artificial Sequence: Synthetic coding sequence
atgaacgccctgctggagcagaaggagcagcaggagagactgagagaggccgccgccctgggcgacatcagagaggtgcagaagctggtggagagcggcgtggacgtgaacagccagaacgaggtgaacggctggacctgcctgcactgggcctgcaagagaaaccacggccaggtggtgagctacctgctgaagagcggcgccgacaaggagatcctgaccaccaagggcgagatgcccgtgcagctgaccagcagaagagagatcagaaagatcatgggcgtggaggaggaggacgacgacgacgacgacgacgacaacctgccccagctgaagaaggagagcgagctgcccttcgtgcccaactacctggccaaccccgccttccccttcatctacacccccaccgccgaggacagcgcccagatgcagaacggcggccccagcaccccccccgccagcccccccgccgacggcagcccccccctgctgccccccggcgagccccccctgctgggcaccttccccagagaccacaccagcctggccctggtgcagaacggcgacgtgagcgcccccagcgccatcctgagaacccccgagagcaccaagcccggccccgtgtgccagccccccgtgagccagagcagaagcctgttcagcagcgtgcccagcaagccccccatgagcctggagccccagaacggcacctacgccggccccgcccccgccttccagcccttcttcttcaccggcgccttccccttcaacatgcaggagctggtgctgaaggtgagaatccagaaccccagcctgagagagaacgacttcatcgagatcgagctggacagacaggagctgacctaccaggagctgctgagagtgtgctgctgcgagctgggcgtgaaccccgaccaggtggagaagatcagaaagctgcccaacaccctgctgagaaaggacaaggacgtggccagactgcaggacttccaggagctggagctggtgctgatgatcagcgagaacaacttcctgttcagaaacgccgccagcaccctgaccgagagaccctgctacaacagaagagccagcaagctgacctactag

SEQ ID NO: 17966 - DNA, 777 bp, Artificial Sequence
  Description of Artificial Sequence: Synthetic coding sequence
ggcgagaccctggccttccccggccacgtggccgccttcaagggcgacctgggcatgctgaagaagctggtggaggacggcgtgatcaacatcaacgagagagccgacaacggcagcacccccatgcacaaggccgccggccagggccacatcgagtgcctgcagtggctgatcaagatgggcgccgacagcaacatcaccaacaaggccggcgagagacccagcgacgtggccaagagattcgcccacctggccgccgtgaagctgctggaggagctgcagaagtacgacatcgacgacgagaacgagatcgacgagaacgacgtgaagtacttcatcagacacggcgtggagggcagcaccgacgccaaggacgacctgtgcctgagcgacctggacaagaccgacgccagaatgagagcctacaagaagatcgtggagctgagacacctgctggagatcgccgagagcaactacaagcacctgggcggcatcaccgaggaggacctgaagcagaagaaggagcagctggagagcgagaagaccatcaaggagctgcagggccagctggagtacgagagactgagaagagagaagctggagtgccagctggacgagtacagagccgaggtggaccagctgagagagaccctggagaagatccaggtgcccaacttcgtggccatggaggacagcgccagctgcgagagcaacaaggagaagagaagagtgaagaagaaggtgagcagcggcggcgtgttcgtgagaagatactag

SEQ ID NO: 17967 - DNA, 597 bp, Artificial Sequence
  Description of Artificial Sequence: Synthetic coding sequence
atgcccggcgtggccaacagcggccccagcaccagcagcagagagaccgccaacccctgcagcagaaagaaggtgcacttcggcagcatccacgacgccgtgagagccggcgacgtgaagcagctgagcgagatcgtggtgagaggcgccagcatcaacgagctggacgtgctgcacaagttcacccccctgcactgggccgcccacagcggcagcctggagtgcctgcactggctgctgtggcacggcgccgacatcacccacgtgaccaccagaggctggaccgccagccacatcgccgccatcagaggccaggacgcctgcgtgcaggccctgatcatgaacggcgccaacctgaccgcccaggacgacagaggctgcacccccctgcacctggccgccacccacggccacagcttcaccctgcagatcatgctgagaagcggcgtggaccccagcgtgaccgacaagagagagtggagacccgtgcactacgccgccttccacggcagactgggctgcctgcagctgctggtgaagtggggctgcagcatcgaggacgtggactacaacggcaacctgcccgagcccccctag

SEQ ID NO: 17968 - DNA, 1170 bp, Artificial Sequence
  Description of Artificial Sequence: Synthetic coding sequence
atgcccggcgtggccaacagcggccccagcaccagcagcagagagaccgccaacccctgcagcagaaagaaggtgcacttcggcagcatccacgacgccgtgagagccggcgacgtgaagcagctgagcgagatcgtgtgcctgcactggctgctgtggcacggcgccgacatcacccacgtgaccaccagaggctggaccgccagccacatcgccgccatcagaggccaggacgcctgcgtgcaggccctgatcatgaacggcgccaacctgaccgcccaggacgacagaggctgcacccccctgcacctggccgccacccacggccacagcttcaccctgcagatcatgctgagaagcggcgtggaccccagcgtgaccgacaagagagagtggagacccgtgcactacgccgccttccacggcagactgggctgcctgcagctgctggtgaagtggggctgcagcatcgaggacgtggactacaacggcaacctgcccgtgcacctggccgccatggagggccacctgcactgcttcaagttcctggtgagcagaatgagcagcgccacccaggtgctgaaggccttcaacgacaacggcgagaacgtgctggacctggcccagagattcttcaagcagaacatcctgcagttcatccagggcgccgagtacgagggcaaggacctggaggaccaggagaccctggccttccccggccacgtggccgccttcaagggcgacctgggcatgctgaagaagctggtggaggacggcgtgatcaacatcaacgagagagccgacaacggcagcacccccatgcacaaggccgccggccagggccacatcgagtgcctgcagtggctgatcaagatgggcgccgacagcaacatcaccaacaaggccggcgagagacccagcgacgtggccaagagattcgcccacctggccgccgtgaagctgctggaggagctgcagaagtacgacatcgacgacgagaacgagatcgacgagaacgacgtgaagtacttcatcagacacggcgtggagggcagcaccgacgccaaggacgacctgtgcctgagcgacctggacaagaccgacgccagaagacccagcaagaactgcagagccagctggagcatgaacgactacgtggagaagaactag

SEQ ID NO: 17969 - DNA, 1776 bp, Artificial Sequence
  Description of Artificial Sequence: Synthetic coding sequence
agcttccccagaagaagaccctgctgcctgagcagccaggtggccggcgtgggcagactggagagagacagcgagaaggtgcccgccgagggcggcagaagatacggcgacagccagggcgtggccgacgaggacggcggcagaagaaccagccaccacgtgtggagaatcaacggcctgcacggccacagcggcgccgagagcagagagagagtgagcgacgacggcgagagaaagtgcgaggagagcgacagaagaagcagagtggccgccggcagcctgagcgccgacgccggcttcagcagaagcgacctgagaagagtgagcgagaacctgggccactgcagaagcgtgagcagagagagagtgagaggcgacagcggccacagccacagctgcagctgggagagagtgagaggcgacagcaccttctgcagcagcgacgtgaacttcagcgaggtgggcggccaccagaccaccgacagcagaggcaccgccagagaggacagaggcctgagactgagcggcccctgggagggcgtgagcgacatcagagaccccagaaccagcgacttcggcgacagagtgagcgacgacagaagcagaagattcagcggcagctgggagggcggcagcgtggagggcggccacagcgtgggcagcagctgggaggaggtgagcggcgacagaggctacgccgccagcgacagcagcggcgtgagcggcagcgaggacgccagctacagattcagcggcttctgggagagagagagcgaggacgagggcttcagatgcagcttctgggagagagccagagaggacctgggccccagacccagcgacgacggcgaggagggcagatgcagatgcagcggcagctgggtgagagccagcgaggacagaagaagcatcagaggcctggacagcacccccccccagagcagaagatgctgcgccatgcccggcgtggccaacagcggccccagcaccagcagcagagagaccgccaacccctgcagcagaaagaaggtgcacttcggcagcatccacgacgccgtgagagccggcgacgtgaagcagctgagcgagatcgtggtgagaggcgccagcatcaacgagctggacgtgctgcacaagttcacccccctgcactgggccgcccacagcggcagcctggagtgcctgcactggctgctgtggcacggcgccgacatcacccacgtgaccaccagaggctggaccgccagccacatcgccgccatcagaggccaggacgcctgcgtgcaggccctgatcatgaacggcgccaacctgaccgcccaggacgacagaggctgcacccccctgcacctggccgccacccacggccacagcttcaccctgcagatcatgctgagaagcggcgtggaccccagcgtgaccgacaagagagagtggagacccgtgcactacgccgccttccacggcagactgggctgcctgcagctgctggtgaagtggggctgcagcatcgaggacgtggactacaacggcaacctgcccgtgcacctggccgccatggagggccacctgcactgcttcaagttcctggtgagcagaatgagcagcgccacccaggtgctgaaggccttcaacgacaacggcgagaacgtgctggacctggcccagagattcttcaagcagaacatcctgcagttcatccagggcagccccaagcccgccaccgacctgcagggcgagaccggcgccaccgagctggcccccagagagagctag

SEQ ID NO: 17970 - DNA, 1650 bp, Artificial Sequence
  Description of Artificial Sequence: Synthetic coding sequence
atggccctggccgccgccgccgccgccgccgccgccggcgtgagccaggccgccgtgctgggcttcctgcaggagcacggcggcaaggtgagaaacagcgagctgctgagcagattcaagcccctgctggacgccggcgaccccagaggcagagccgccagaagagacagattcaagcagttcgtgaacaacgtggccgtggtgaaggagctggacggcgtgaagttcgtggtgctgagaaagaagcccagaccccccgagcccgagcccgcccccttcggcccccccggcgccgccgcccagcccagcaagcccaccagcaccgtgctgcccagaagcgccagcgcccccggcgccccccccctggtgagagtgcccagacccgtggagccccccggcgacctgggcctgcccaccgagccccaggacacccccggcggccccgccagcgagcccgcccagccccccggcgagagaagcgccgacccccccctgcccgccctggagctggcccaggccaccgagagacccagcgccgacgccgcccccccccccagagcccccagcgaggccgccagcccctgcagcgacccccccgacgccgagcccggccccggcgccgccaagggccccccccagcagaagccctgcatgctgcccgtgagatgcgtgcccgcccccgccaccctgagactgagagccgaggagcccggcctgagaagacagctgagcgaggagcccagccccagaagcagccccctgctgctgagaagactgagcgtggaggagagcggcctgggcctgggcctgggccccggcagaagcccccacctgagaagactgagcagagccggccccagactgctgagccccgacgccgaggagctgcccgccgcccccccccccagcgccgtgcccctggagcccagcgagcacgagtggctggtgagaaccgccggcggcagatggacccaccagctgcacggcctgctgctgagagacagaggcctggccgccaagagagacttcatgagcggcttcaccgccctgcactgggccgccaagagcggcgacggcgagatggccctgcagctggtggaggtggccagaagaagcggcgcccccgtggacgtgaacgccagaagccacggcggctacacccccctgcacctggccgccctgcacggccacgaggacgccgccgtgctgctggtggtgagactgggcgcccaggtgcacgtgagagaccacagcggcagaagagcctaccagtacctgagacccggcagcagctacgccctgagaagactgctgggcgaccccggcctgagaggcaccaccgagcccgacgccaccggcggcggcagcggcagcctggccgccagaagacccgtgcaggtggccgccaccatcctgagcagcaccaccagcgccttcctgggcgtgctggccgacgacctgatgctgcaggacctggccagaggcctgaagaagagcagcagcttcagcaagttcctgagcgccagccccatggcccccagaaagaagaccaagatcagaggcggcctgcccgccttcagcgagatcagcagaagacccacccccggccccctggccggcctggtgcccagcttcccccccaccacctag

SEQ ID NO: 17971 - DNA, 2958 bp, Artificial Sequence
  Description of Artificial Sequence: Synthetic coding sequence
cagccccccctggtgcaggccatcttcagcggcgaccccgaggagatcagaatgctgatccacaagaccgaggacgtgaacaccctggacagcgagaagagaacccccctgcacgtggccgccttcctgggcgacgccgagatcatcgagctgctgatcctgagcggcgccagagtgaacgccaaggacaacatgtggctgacccccctgcacagagccgtggccagcagaagcgaggaggccgtgcaggtgctgatcaagcacagcgccgacgtgaacgccagagacaagaactggcagacccccctgcacgtggccgccgccaacaaggccgtgaagtgcgccgaggtgatcatccccctgctgagcagcgtgaacgtgagcgacagaggcggcagaaccgccctgcaccacgccgccctgaacggccacgtggagatggtgaacctgctgctggccaagggcgccaacatcaacgccttcgacaagaaggacagaagagccctgcactgggccgcctacatgggccacctggacgtggtggccctgctgatcaaccacggcgccgaggtgacctgcaaggacaagaagggctacacccccctgcacgccgccgccagcaacggccagatcaacgtggtgaagcacctgctgaacctgggcgtggagatcgacgagatcaacgtgtacggcaacaccgccctgcacatcgcctgctacaacggccaggacgccgtggtgaacgagctgatcgactacggcgccaacgtgaaccagcccaacaacaacggcttcacccccctgcacttcgccgccgccagcacccacggcgccctgtgcctggagctgctggtgaacaacggcgccgacgtgaacatccagagcaaggacggcaagagccccctgcacatgaccgccgtgcacggcagattcaccagaagccagaccctgatccagaacggcggcgagatcgactgcgtggacaaggacggcaacacccccctgcacgtggccgccagatacggccacgagctgctgatcaacaccctgatcaccagcggcgccgacaccgccaagtgcggcatccacagcatgttccccctgcacctggccgccctgaacgcccacagcgactgctgcagaaagctgctgagcagcggcttcgagatcgacacccccgacaagttcggcagaacctgcctgcacgccgccgccgccggcggcaacgtggagtgcatcaagctgctgcagagcagcggcgccgacttccacaagaaggacaagtgcggcagaacccccctgcactacgccgccgccaactgccacttccactgcatcgagaccctggtgaccaccggcgccaacgtgaacgagaccgacgactggggcagaaccgccctgcactacgccgccgccagcgacatggacagaaacaagaccatcctgggcaacgcccacgacaacagcgaggagctggagagagccagagagctgaaggagaaggaggccaccctgtgcctggagttcctgctgcagaacgacgccaaccccagcatcagagacaaggagggctacaacagcatccactacgccgccgcctacggccacagacagtgcctggagctgctgctggagagaaccaacagcggcttcgaggagagcgacagcggcgccaccaagagccccctgcacctggccgcctacaacggccaccaccaggccctggaggtgctgctgcagagcctggtggacctggacatcagagacgagaagggcagaaccgccctggacctggccgccttcaagggccacaccgagtgcgtggaggccctgatcaaccagggcgccagcatcttcgtgaaggacaacgtgaccaagagaacccccctgcacgccagcgtgatcaacggccacaccctgtgcctgagactgctgctggagatcgccgacaaccccgaggccgtggacgtgaaggacgccaagggccagacccccctgatgctggccgtggcctacggccacatcgacgccgtgagcctgctgctggagaaggaggccaacgtggacaccgtggacatcctgggctgcaccgccctgcacagaggcatcatgaccggccacgaggagtgcgtgcagatgctgctggagcaggaggtgagcatcctgtgcaaggacagcagaggcagaacccccctgcactacgccgccgccagaggccacgccacctggctgagcgagctgctgcagatggccctgagcgaggaggactgctgcttcaaggacaaccagggctacacccccctgcactgggcctgctacaacggcaacgagaactgcatcgaggtgctgctggagcagaagtgcttcagaaagttcatcggcaaccccttcacccccctgcactgcgccatcatcaacgaccacggcaactgcgccagcctgctgctgggcgccatcgacagcagcatcgtgagctgcagagacgacaagggcagaacccccctgcacgccgccgccttcgccgaccacgtggagtgcctgcagctgctgctgagacacagcgcccccgtgaacgccgtggacaacagcggcaagaccgccctgatgatggccgccgagaacggccaggccggcgccgtggacatcctggtgaacagcgcccaggccgacctgaccgtgaaggacaaggacctgaacacccccctgcacctggcctgcagcaagggccacgagaagtgcgccctgctgatcctggacaagatccaggacgagagcctgatcaacgagaagaacaacgccctgcagacccccctgcacgtggccgccagaaacggcctgaaggtggtggtggaggagctgctggccaagggcgcctgcgtgctggccgtggacgagaacgccagcagaagcaacggccccagaagcacccccggcaccgccgtgcagaaggaggagtag

SEQ ID NO: 17972 - DNA, 2760 bp, Artificial Sequence
  Description of Artificial Sequence: Synthetic coding sequence
atgctgatccacaagaccgaggacgtgaacaccctggacagcgagaagagaacccccctgcacgtggccgccttcctgggcgacgccgagatcatcgagctgctgatcctgagcggcgccagagtgaacgccaaggacaacatgtggctgacccccctgcacagagccgtggccagcagaagcgaggaggccgtgcaggtgctgatcaagcacagcgccgacgtgaacgccagagacaagaactggcagacccccctgcacgtggccgccgccaacaaggccgtgaagtgcgccgaggtgatcatccccctgctgagcagcgtgaacgtgagcgacagaggcggcagaaccgccctgcaccacgccgccctgaacggccacgtggagatggtgaacctgctgctggccaagggcgccaacatcaacgccttcgacaagaaggacagaagagccctgcactgggccgcctacatgggccacctggacgtggtggccctgctgatcaaccacggcgccgaggtgacctgcaaggacaagaagggctacacccccctgcacgccgccgccagcaacggccagatcaacgtggtgaagcacctgctgaacctgggcgtggagatcgacgagatcaacgtgtacggcaacaccgccctgcacatcgcctgctacaacggccaggacgccgtggtgaacgagctgatcgactacggcgccaacgtgaaccagcccaacaacaacggcttcacccccctgcacttcgccgccgccagcacccacggcgccctgtgcctggagctgctggtgaacaacggcgccgacgtgaacatccagagcaaggacggcaagagccccctgcacatgaccgccgtgcacggcagattcaccagaagccagaccctgatccagaacggcggcgagatcgactgcgtggacaaggacggcaacacccccctgcacgtggccgccagatacggccacgagctgctgatcaacaccctgatcaccagcggcgccgacaccgccaagtgcggcatccacagcatgttccccctgcacctggccgccctgaacgcccacagcgactgctgcagaaagctgctgagcagcggcttcgagatcgacacccccgacaagttcggcagaacctgcctgcacgccgccgccgccggcggcaacgtggagtgcatcaagctgctgcagagcagcggcgccgacttccacaagaaggacaagtgcggcagaacccccctgcactacgccgccgccaactgccacttccactgcatcgagaccctggtgaccaccggcgccaacgtgaacgagaccgacgactggggcagaaccgccctgcactacgccgccgccagcgacatggacagaaacaagaccatcctgggcaacgcccacgacaacagcgaggagctggagagagccagagagctgaaggagaaggaggccaccctgtgcctggagttcctgctgcagaacgacgccaaccccagcatcagagacaaggagggctacaacagcatccactacgccgccgcctacggccacagacagtgcctggagctgctgctggagagaaccaacagcggcttcgaggagagcgacagcggcgccaccaagagccccctgcacctggccgcctacaacggccaccaccaggccctggaggtgctgctgcagagcctggtggacctggacatcagagacgagaagggcagaaccgccctggacctggccgccttcaagggccacaccgagtgcgtggaggccctgatcaaccagggcgccagcatcttcgtgaaggacaacgtgaccaagagaacccccctgcacgccagcgtgatcaacggccacaccctgtgcctgagactgctgctggagatcgccgacaaccccgaggccgtggacgtgaaggacgccaagggccagacccccctgatgctggccgtggcctacggccacatcgacgccgtgagcctgctgctggagaaggaggccaacgtggacaccgtggacatcctgggctgcaccgccctgcacagaggcatcatgaccggccacgaggagtgcgtgcagatgctgctggagcaggaggtgagcatcctgtgcaaggacagcagaggcagaacccccctgcactacgccgccgccagaggccacgccacctggctgagcgagctgctgcagatggccctgagcgaggaggactgctgcttcaaggacaaccagggctacacccccctgcactgggcctgctacaacggcaacgagaactgcatcgaggtgctgctggagcagaagtgcttcagaaagttcatcggcaaccccttcacccccctgcactgcgccatcatcaacgaccacggcaactgcgccagcctgctgctgggcgccatcgacagcagcatcgtgagctgcagagacgacaagggcagaacccccctgcacgccgccgccttcgccgaccacgtggagtgcctgcagctgctgctgagacacagcgcccccgtgaacgccgtggacaacagcggcaagaccgccctgatgatggccgccgagaacggccaggccggcgccgtggacatcctggtgaacagcgcccaggccgacctgaccgtgaaggacaaggacctgaacacccccctgcacctggcctgcagcaagggccacgagaagtgcgccctgctgatcctggacaagatccaggacgagagcctgatcaacgagaagaacaacgccctgcagacctag

SEQ ID NO: 17973 - DNA, 2760 bp, Artificial Sequence
  Description of Artificial Sequence: Synthetic coding sequence
ctgctgatctacaagaccgagatcatcagcaccctggacagcgagaagagaacccccctgcacgtggccgccttcctgggcgacgccgagatcatcgagctgctgatcctgagcggcgccagagtgaacgccaaggacaacatgtggctgacccccctgcacagagccgtggccagcagaagcgaggaggccgtgcaggtgctgatcaagcacagcgccgacgtgaacgccagagacaagaactggcagacccccctgcacgtggccgccgccaacaaggccgtgaagtgcgccgaggtgatcatccccctgctgagcagcgtgaacgtgagcgacagaggcggcagaaccgccctgcaccacgccgccctgaacggccacgtggagatggtgaacctgctgctggccaagggcgccaacatcaacgccttcgacaagaaggacagaagagccctgcactgggccgcctacatgggccacctggacgtggtggccctgctgatcaaccacggcgccgaggtgacctgcaaggacaagaagggctacacccccctgcacgccgccgccagcaacggccagatcaacgtggtgaagcacctgctgaacctgggcgtggagatcgacgagatcaacgtgtacggcaacaccgccctgcacatcgcctgctacaacggccaggacgccgtggtgaacgagctgatcgactacggcgccaacgtgaaccagcccaacaacaacggcttcacccccctgcacttcgccgccgccagcacccacggcgccctgtgcctggagctgctggtgaacaacggcgccgacgtgaacatccagagcaaggacggcaagagccccctgcacatgaccgccgtgcacggcagattcaccagaagccagaccctgatccagaacggcggcgagatcgactgcgtggacaaggacggcaacacccccctgcacgtggccgccagatacggccacgagctgctgatcaacaccctgatcaccagcggcgccgacaccgccaagtgcggcatccacagcatgttccccctgcacctggccgccctgaacgcccacagcgactgctgcagaaagctgctgagcagcggcttcgagatcgacacccccgacaagttcggcagaacctgcctgcacgccgccgccgccggcggcaacgtggagtgcatcaagctgctgcagagcagcggcgccgacttccacaagaaggacaagtgcggcagaacccccctgcactacgccgccgccaactgccacttccactgcatcgagaccctggtgaccaccggcgccaacgtgaacgagaccgacgactggggcagaaccgccctgcactacgccgccgccagcgacatggacagaaacaagaccatcctgggcaacgcccacgacaacagcgaggagctggagagagccagagagctgaaggagaaggaggccaccctgtgcctggagttcctgctgcagaacgacgccaaccccagcatcagagacaaggagggctacaacagcatccactacgccgccgcctacggccacagacagtgcctggagctgctgctggagagaaccaacagcggcttcgaggagagcgacagcggcgccaccaagagccccctgcacctggccgcctacaacggccaccaccaggccctggaggtgctgctgcagagcctggtggacctggacatcagagacgagaagggcagaaccgccctggacctggccgccttcaagggccacaccgagtgcgtggaggccctgatcaaccagggcgccagcatcttcgtgaaggacaacgtgaccaagagaacccccctgcacgccagcgtgatcaacggccacaccctgtgcctgagactgctgctggagatcgccgacaaccccgaggccgtggacgtgaaggacgccaagggccagacccccctgatgctggccgtggcctacggccacatcgacgccgtgagcctgctgctggagaaggaggccaacgtggacaccgtggacatcctgggctgcaccgccctgcacagaggcatcatgaccggccacgaggagtgcgtgcagatgctgctggagcaggaggtgagcatcctgtgcaaggacagcagaggcagaacccccctgcactacgccgccgccagaggccacgccacctggctgagcgagctgctgcagatggccctgagcgaggaggactgctgcttcaaggacaaccagggctacacccccctgcactgggcctgctacaacggcaacgagaactgcatcgaggtgctgctggagcagaagtgcttcagaaagttcatcggcaaccccttcacccccctgcactgcgccatcatcaacgaccacggcaactgcgccagcctgctgctgggcgccatcgacagcagcatcgtgagctgcagagacgacaagggcagaacccccctgcacgccgccgccttcgccgaccacgtggagtgcctgcagctgctgctgagacacagcgcccccgtgaacgccgtggacaacagcggcaagaccgccctgatgatggccgccgagaacggccaggccggcgccgtggacatcctggtgaacagcgcccaggccgacctgaccgtgaaggacaaggacctgaacacccccctgcacctggcctgcagcaagggccacgagaagtgcgccctgctgatcctggacaagatccaggacgagagcctgatcaacgagaagaacaacgccctgcagacctag

SEQ ID NO: 17974 - DNA, 1740 bp, Artificial Sequence
  Description of Artificial Sequence: Synthetic coding sequence
atggccgtgctgaagctgaccgaccagccccccctggtgcaggccatcttcagcggcgaccccgaggagatcagaatgctgatccacaagaccgaggacgtgaacaccctggacagcgagaagagaacccccctgcacgtggccgccttcctgggcgacgccgagatcatcgagctgctgatcctgagcggcgccagagtgaacgccaaggacaacatgtggctgacccccctgcacagagccgtggccagcagaagcgaggaggccgtgcaggtgctgatcaagcacagcgccgacgtgaacgccagagacaagaactggcagacccccctgcacgtggccgccgccaacaaggccgtgaagtgcgccgaggtgatcatccccctgctgagcagcgtgaacgtgagcgacagaggcggcagaaccgccctgcaccacgccgccctgaacggccacgtggagatggtgaacctgctgctggccaagggcgccaacatcaacgccttcgacaagaaggacagaagagccctgcactgggccgcctacatgggccacctggacgtggtggccctgctgatcaaccacggcgccgaggtgacctgcaaggacaagaagggctacacccccctgcacgccgccgccagcaacggccagatcaacgtggtgaagcacctgctgaacctgggcgtggagatcgacgagatcaacgtgtacggcaacaccgccctgcacatcgcctgctacaacggccaggacgccgtggtgaacgagctgatcgactacggcgccaacgtgaaccagcccaacaacaacggcttcacccccctgcacttcgccgccgccagcacccacggcgccctgtgcctggagctgctggtgaacaacggcgccgacgtgaacatccagagcaaggacggcaagagccccctgcacatgaccgccgtgcacggcagattcaccagaagccagaccctgatccagaacggcggcgagatcgactgcgtggacaaggacggcaacacccccctgcacgtggccgccagatacggccacgagctgctgatcaacaccctgatcaccagcggcgccgacaccgccaagtgcggcatccacagcatgttccccctgcacctggccgccctgaacgcccacagcgactgctgcagaaagctgctgagcagcggcttcgagatcgacacccccgacaagttcggcagaacctgcctgcacgccgccgccgccggcggcaacgtggagtgcatcaagctgctgcagagcagcggcgccgacttccacaagaaggacaagtgcggcagaacccccctgcactacgccgccgccaactgccacttccactgcatcgagaccctggtgaccaccggcgccaacgtgaacgagaccgacgactggggcagaaccgccctgcactacgccgccgccagcgacatggacagaaacaagaccatcctgggcaacgcccacgacaacagcgaggagctggagagagccagagagctgaaggagaaggaggccaccctgtgcctggagttcctgctgcagaacgacgccaaccccagcatcagagacaaggagggctacaacagcatccactacgccgccgcctacggccacagacagtgcctggagctggtgagctgcttcgtgctgttcagcctgacccacacccacacccacacccccaaccacagaggcatcaactgcttcttccccgagctgtag

SEQ ID NO: 17975 - DNA, 1104 bp, Artificial Sequence
  Description of Artificial Sequence: Synthetic coding sequence
atggccgtgctgaagctgaccgaccagccccccctggtgcaggccatcttcagcggcgaccccgaggagatcagaatgctgatccacaagaccgaggacgtgaacaccctggacagcgagaagagaacccccctgcacgtggccgccttcctgggcgacgccgagatcatcgagctgctgatcctgagcggcgccagagtgaacgccaaggacaacatgtggctgacccccctgcacagagccgtggccagcagaagcgaggaggccgtgcaggtgctgatcaagcacagcgccgacgtgaacgccagagacaagaactggcagacccccctgcacgtggccgccgccaacaaggccgtgaagtgcgccgaggtgatcatccccctgctgagcagcgtgaacgtgagcgacagaggcggcagaaccgccctgcaccacgccgccctgaacggccacgtggagatggtgaacctgctgctggccaagggcgccaacatcaacgccttcgacaagaaggacagaagagccctgcactgggccgcctacatgggccacctggacgtggtggccctgctgatcaaccacggcgccgaggtgacctgcaaggacaagaagggctacacccccctgcacgccgccgccagcaacggccagatcaacgtggtgaagcacctgctgaacctgggcgtggagatcgacgagatcaacgtgtacggcaacaccgccctgcacatcgcctgctacaacggccaggacgccgtggtgaacgagctgatcgactacggcgccaacgtgaaccagcccaacaacaacggcttcacccccctgcacttcgccgccgccagcacccacggcgccctgtgcctggagctgctggtgaacaacggcgccgacgtgaacatccagagcaaggacggcaagagccccctgcacatgaccgccgtgcacggcagattcaccagaagccagaccctgatccagaacggcggcgagatcgactgcgtggacaaggacggcaacacccccctgcacgtggccgccagatacggccacgagctgctgatcaacaccctgatcaccagcggcgccgacaccgccaagtag

SEQ ID NO: 17976 - DNA, 2760 bp, Artificial Sequence; identical to SEQ ID NO: 17972
  Description of Artificial Sequence: Synthetic coding sequence

SEQ ID NO: 17977 - DNA, 1524 bp, Artificial Sequence
  Description of Artificial Sequence: Synthetic coding sequence
atgtggctgacccccctgcacagagccgtggccagcagaagcgaggaggccgtgcaggtgctgatcaagcacagcgccgacgtgaacgccagagacaagaactggcagacccccctgcacgtggccgccgccaacaaggccgtgaagtgcgccgaggtgatcatccccctgctgagcagcgtgaacgtgagcgacagaggcggcagaaccgccctgcaccacgccgccctgaacggccacgtggagatggtgaacctgctgctggccaagggcgccaacatcaacgccttcgacaagaaggacagaagagccctgcactgggccgcctacatgggccacctggacgtggtggccctgctgatcaaccacggcgccgaggtgacctgcaaggacaagaagggctacacccccctgcacgccgccgccagcaacggccagatcaacgtggtgaagcacctgctgaacctgggcgtggagatcgacgagatcaacgtgtacggcaacaccgccctgcacatcgcctgctacaacggccaggacgccgtggtgaacgagctgatcgactacggcgccaacgtgaaccagcccaacaacaacggcttcacccccctgcacttcgccgccgccagcacccacggcgccctgtgcctggagctgctggtgaacaacggcgccgacgtgaacatccagagcaaggacggcaagagccccctgcacatgaccgccgtgcacggcagattcaccagaagccagaccctgatccagaacggcggcgagatcgactgcgtggacaaggacggcaacacccccctgcacgtggccgccagatacggccacgagctgctgatcaacaccctgatcaccagcggcgccgacaccgccaagtgcggcatccacagcatgttccccctgcacctggccgccctgaacgcccacagcgactgctgcagaaagctgctgagcagcggcttcgagatcgacacccccgacaagttcggcagaacctgcctgcacgccgccgccgccggcggcaacgtggagtgcatcaagctgctgcagagcagcggcgccgacttccacaagaaggacaagtgcggcagaacccccctgcactacgccgccgccaactgccacttccactgcatcgagaccctggtgaccaccggcgccaacgtgaacgagaccgacgactggggcagaaccgccctgcactacgccgccgccagcgacatggacagaaacaagaccatcctgggcaacgcccacgacaacagcgaggagctggagagagccagagagctgaaggagaaggaggccaccctgtgcctggagttcctgctgcagaacgacgccaaccccagcatcagagacaaggagggctacaacagcatccactacgccgccgcctacggccacagacagtgcctggagctggtgagctgcttcgtgctgttcagcctgacccacacccacacccacacccccaaccacagaggcatcaactgcttcttccccgagctgtag

SEQ ID NO: 17978 - DNA, 801 bp, Artificial Sequence
  Description of Artificial Sequence: Synthetic coding sequence
atggagagcgagggcccccccgagagcgagagcagcgagttcttcagccagcaggaggaggagaacgaggaggaggaggcccaggagcccgaggagaccggccccaagaaccccctgctgcagcccgccctgaccggcgacgtggagggcctgcagaagatcttcgaggaccccgagaacccccaccacgagcaggccatgcagctgctgctggaggaggacatcgtgggcagaaacctgctgtacgccgcctgcatggccggccagagcgacgtgatcagagccctggccaagtacggcgtgaacctgaacgagaagaccaccagaggctacaccctgctgcactgcgccgccgcctggggcagactggagaccctgaaggccctggtggagctggacgtggacatcgaggccctgaacttcagagaggagagagccagagacgtggccgccagatacagccagaccgagtgcgtggagttcctggactgggccgacgccagactgaccctgaagaagtacatcgccaaggtgagcctggccgtgaccgacaccgagaagggcagcggcaagctgctgaaggaggacaagaacaccatcctgagcgcctgcagagccaagaacgagtggctggagacccacaccgaggccagcatcaacgagctgttcgagcagagacagcagctggaggacatcgtgacccccatcttcaccaagatgaccaccccctgccaggtgaagagcgccaagagcgtgaccagccacgaccagaagagaagccaggacgacaccagcaactag

SEQ ID NO: 17979 - DNA, 2331 bp, Artificial Sequence
  Description of Artificial Sequence: Synthetic coding sequence
atggccctggccgacaagagactggagaacctgcagatctacaaggtgctgcagtgcgtgagaaacaaggacaagaagcagatcgagaagctgaccaagctgggctaccccgagctgatcaactacaccgagcccatcaacggcctgagcgccctgcacctggccagcgtgagcaacgacatcgacatggtgagcttcctgctggacctgggcgcccaccccgacgtgcaggacagaatgggctgcacccccaccatgagagccgccgagctgggccacgagctgagcatggagatcctggccaaggccaaggccgacatgaccatcgtggacaacgagggcaagggcgtgctgttctactgcatcctgcccaccaagagacactacagatgcgccctgatcgccctggagcacggcgccgacgtgaacaacagcacctacgagggcaagcccatcttcctgagagcctgcgaggacgcccacgacgtgaaggacgtgtgcctgaccttcctggagaagggcgccaaccccaacgccatcaacagcagcaccggcagaaccgccctgatggaggccagcagagagggcgtggtggagatcgtgagaggcatcctggagagaggcggcgaggtgaacgccttcgacaacgacagacaccacgccgcccacttcgccgccaagggcggcttcttcgacatcctgaagctgctgttcgcctacaacggcgacgtgggcctgatcagcatcaacggcaacacccccctgcactacgccgccatgggcggcttcgccgactgctgcaagtacatcgcccagagaggctgcgacctgaagtggaagaacctggaccacaagacccccagagccgtggccaaggagggcggcttcaaggccgccagcaaggagatcagaagagccgagagaatcgccaacaagctggccagacccggcgccaagaaccccaaccccctgtgggccctgagactgcacgactggagcgtggagagagaggccttcctgagagaggccttcgccgtgctggacagaggcgacggcagcatcagcaagaacgacttcgtgatggtgctggaggagagacaggactacgccagcagcgagcagctggccgccatcgcccacctgcacgagaagaccagaggcggcggcgtgaacatcaacgagttcttcaagggcaccagatacctgaacaagagcttcgtgctgggcagctacggccccaagaagaaggagaagggcatgggcaagaagggcaagaagggcaagttcgtgctgcccctgcccatctgcgtgatccccgagtacgccttccccagaagacaggacggcggccccccctactacatgatcgagacctacaagaacgtgaccgacagcagcagattcaacagagaccacccccccgagcaccccatccaggacgacagcgtgtggtacatcgacgacagcgagaaggtgttcagcaacatcaacatcatcaccaaggccggcgacctggccagcctgaagaaggccttcgagagcggcatccccgtggacatgaaggacaactactacaagacccccctgatgaccgcctgcgccagcggcaacatcgacgtggtgaagttcctgctggagaagggcgccaacgtgaacgccaccgacaacttcctgtggacccccctgcacttcgcctgccacgccggccagcaggacatcgtggagctgctggtggagagcggcgccctgatcgacgccgccagcatcaacaacagcacccccctgaacagagccatcgagagctgcagactggacaccgtgaagtacctgctggacatcggcgccaagttccagctggagaacagaaagggccacagcgccatggacgtggccaaggcctacgccgactacagaatcatcgacctgatcaaggagaagctggacaacctgcccaagcccgccgagaaccagaagctgaagggcaagaccccccccatcctgaagaccgagggccccgagatcaagaaggaggaggagctgctgagcagcatctacggcgtgcccaccaccagcgagggcaagaaggtgcagaagggcaacgtggtgcacctgaacagcctgatcaccagcggctacaccaagaaggtggacatcaccttcatccccagaagaatctggagccccgaggccaccaccgccgagctgatcagaaagagagagctgagaagagagagattcacccacgaggtggacttcgacgacttcatgatgcccttccagaagaacatcaccgagaaggccagagccctggaggccgccctgaagacctag

SEQ ID NO: 17980 - DNA, 2331 bp, Artificial Sequence; identical to SEQ ID NO: 17979
  Description of Artificial Sequence: Synthetic coding sequence

SEQ ID NO: 17981 - DNA, 4290 bp, Artificial Sequence
  Description of Artificial Sequence: Synthetic coding sequence
atgaccaacccctgggaggagaaggtgtgcaagatggcccagaccagcctgctgcagggcaagcagttctactgcagagagtgggtgttccacaagctgcagcactgcctgcaggagaagagcaactgctgcaacagcgccgtgaacgcccccagcctggtgatgaacagcggcaacaacgccagcggcgtgagcggcaagggcgccgcctggggcgtgctgctggtgggcggccccggcagcggcaagaccgccctgtgcaccgagctgctgtggcccagcagccccgccagcctgcagagaggcctgcacagacaggccctggccttccacttctgcaaggcccaggacagcgacaccctgtgcgtgggcggcttcatcagaggcctggtggcccagatctgcagaagcggcctgctgcagggctacgaggacaagctgagagaccccgccgtgcagagcctgctgcagcccggcgagtgcgagagaaaccccgccgaggccttcaagagatgcgtgctgctgcccctgctgggcatgaagcccccccagcagagcctgtacctgctggtggacagcgtggacgagggctgcaacatcaccgagggcgagcagaccagcaccagcctgagcggcaccgtggccgccctgctggccggccaccacgagttcttccccccctggctgctgctgctgtgcagcgccagaaagcagagcaaggccgtgaccaagatgttcaccggcttcagaaagatcagcctggacgacctgagaaaggcctacatcgtgaaggacgtgcagcagtacatcctgcacagactggaccaggaggaggccctgagacagcacctgaccaaggagaccgccgagatgctgaaccagctgcacatcaagagcagcggctgcttcctgtacctggagagagtgctggacggcgtggtggagaacttcatcatgctgagagagatcagagacatccccggcaccctgaacggcctgtacctgtggctgtgccagagactgttcgtgagaaagcagttcgccaaggtgcagcccatcctgaacgtgatcctggccgcctgcagacccctgaccatcaccgagctgtaccacgccgtgtggaccaagaacatgagcctgaccctggaggacttccagagaaagctggacatcctgagcaagctgctggtggacggcctgggcaacaccaagatcctgttccactacagcttcgccgagtggctgctggacgtgaagcactgcacccagaagtacctgtgcaacgccgccgagggccacagaatgctggccatgagctacacctgccaggccaagaacctgacccccctggaggcccaggagttcgccctgcacctgatcaacagcaacctgcagctggagaccgccgagctggccctgtggatgatctggaacggcacccccgtgagagacagcctgagcaccctgatccccaaggagcaggaggtgctgcagctgctggtgaaggccggcgcccacgtgaacagcgaggacgacagaaccagctgcatcgtgagacaggccctggagagagaggacagcatcagaaccctgctggacaacggcgccagcgtgaaccagtgcgacagcaacggcagaaccctgctggccaacgccgcctacagcggcagcctggacgtggtgaacctgctggtgagcagaggcgccgacctggagatcgaggacgcccacggccacacccccctgaccctggccgccagacagggccacaccaaggtggtgaactgcctgatcggctgcggcgccaacatcaaccacaccgaccaggacggctggaccgccctgagaagcgccgcctggggcggccacaccgaggtggtgagcgccctgctgtacgccggcgtgaaggtggactgcgccgacgccgacagcagaaccgccctgagagccgccgcctggggcggccacgaggacatcgtgctgaacctgctgcagcacggcgccgaggtgaacaaggccgacaacgagggcagaaccgccctgatcgccgccgcctacatgggccacagagagatcgtggagcacctgctggaccacggcgccgaggtgaaccacgaggacgtggacggcagaaccgccctgagcgtggccgccctgtgcgtgcccgccagcaagggccacgccagcgtggtgagcctgctgatcgacagaggcgccgaggtggaccactgcgacaaggacggcatgacccccctgctggtggccgcctacgagggccacgtggacgtggtggacctgctgctggagggcggcgccgacgtggaccacaccgacaacaacggcagaacccccctgctggccgccgccagcatgggccacgccagcgtggtgaacaccctgctgttctggggcgccgccgtggacagcatcgacagcgagggcagaaccgtgctgagcatcgccagcgcccagggcaacgtggaggtggtgagaaccctgctggacagaggcctggacgagaaccacagagacgacgccggctggacccccctgcacatggccgccttcgagggccacagactgatctgcgaggccctgatcgagcagggcgccagaaccaacgagatcgacaacgacggcagaatccccttcatcctggccagccaggagggccactacgactgcgtgcagatcctgctggagaacaagagcaacatcgaccagagaggctacgacggcagaaacgccctgagagtggccgccctggagggccacagagacatcgtggagctgctgttcagccacggcgccgacgtgaactgcaaggacgccgacggcagacccaccctgtacatcctggccctggagaaccagctgaccatggccgagtacttcctggagaacggcgccaacgtggaggccagcgacgccgagggcagaaccgccctgcacgtgagctgctggcagggccacatggagatggtgcaggtgctgatcgcctaccacgccgacgtgaacgccgccgacaacgagaagagaagcgccctgcagagcgccgcctggcagggccacgtgaaggtggtgcagctgctgatcgagcacggcgccgtggtggaccacacctgcaaccagggcgccaccgccctgtgcatcgccgcccaggagggccacatcgacgtggtgcaggtgctgctggagcacggcgccgaccccaaccacgccgaccagttcggcagaaccgccatgagagtggccgccaagaacggccacagccagatcatcaagctgctggagaagtacggcgccagcagcctgaacggctgcagccccagccccgtgcacaccatggagcagaagcccctgcagagcctgagcagcaaggtgcagagcctgaccatcaagagcaacagcagcggcagcaccggcggcggcgacatgcagcccagcctgagaggcctgcccaacggccccacccacgccttcagcagccccagcgagagccccgacagcaccgtggacagacagaagagcagcctgagcaacaacagcctgaagagcagcaagaacagcagcctgagaaccaccagcagcaccgccaccgcccagaccgtgcccatcgacagcttccacaacctgagcttcaccgagcagatccagcagcacagcctgcccagaagcagaagcagacagagcatcgtgagccccagcagcaccacccagagcctgggccagagccacaacagccccagcagcgagttcgagtggagccaggtgaagcccagcctgaagagcaccaaggccagcaagggcggcaagagcgagaacagcgccaagagcggcagcgccggcaagaaggccaagcagagcaacagcagccagcccaaggtgctggagtacgagatgacccagttcgacagaagaggccccatcgccaagagcggcaccgccgccccccccaagcagatgcccgccgagagccagtgcaagatcatgatccccagcgcccagcaggagatcggcagaagccagcagcagttcctgatccaccagcagagcggcgagcagaagaagagaaacggcatcatgaccaaccccaactaccacctgcagagcaaccaggtgttcctgggcagagtgagcgtgcccagaaccatgcaggacagaggccaccaggaggtgctggagggctaccccagcagcgagaccgagctgagcctgaagcaggccctgaagctgcagatcgagggcagcgaccccagcttcaactacaagaaggagacccccctgtag

SEQ ID NO: 17982 - DNA, 3753 bp, Artificial Sequence
  Description of Artificial Sequence: Synthetic coding sequence
atgaagcccccccagcagagcctgtacctgctggtggacagcgtggacgagggctgcaacatcaccgagggcgagcagaccagcaccagcctgagcggcaccgtggccgccctgctggccggccaccacgagttcttccccccctggctgctgctgctgtgcagcgccagaaagcagagcaaggccgtgaccaagatgttcaccggcttcagaaagatcagcctggacgacctgagaaaggcctacatcgtgaaggacgtgcagcagtacatcctgcacagactggaccaggaggaggccctgagacagcacctgaccaaggagaccgccgagatgctgaaccagctgcacatcaagagcagcggctgcttcctgtacctggagagagtgctggacggcgtggtggagaacttcatcatgctgagagagatcagagacatccccggcaccctgaacggcctgtacctgtggctgtgccagagactgttcgtgagaaagcagttcgccaaggtgcagcccatcctgaacgtgatcctggccgcctgcagacccctgaccatcaccgagctgtaccacgccgtgtggaccaagaacatgagcctgaccctggaggacttccagagaaagctggacatcctgagcaagctgctggtggacggcctgggcaacaccaagatcctgttccactacagcttcgccgagtggctgctggacgtgaagcactgcacccagaagtacctgtgcaacgccgccgagggccacagaatgctggccatgagctacacctgccaggccaagaacctgacccccctggaggcccaggagttcgccctgcacctgatcaacagcaacctgcagctggagaccgccgagctggccctgtggatgatctggaacggcacccccgtgagagacagcctgagcaccctgatccccaaggagcaggaggtgctgcagctgctggtgaaggccggcgcccacgtgaacagcgaggacgacagaaccagctgcatcgtgagacaggccctggagagagaggacagcatcagaaccctgctggacaacggcgccagcgtgaaccagtgcgacagcaacggcagaaccctgctggccaacgccgcctacagcggcagcctggacgtggtgaacctgctggtgagcagaggcgccgacctggagatcgaggacgcccacggccacacccccctgaccctggccgccagacagggccacaccaaggtggtgaactgcctgatcggctgcggcgccaacatcaaccacaccgaccaggacggctggaccgccctgagaagcgccgcctggggcggccacaccgaggtggtgagcgccctgctgtacgccggcgtgaaggtggactgcgccgacgccgacagcagaaccgccctgagagccgccgcctggggcggccacgaggacatcgtgctgaacctgctgcagcacggcgccgaggtgaacaaggccgacaacgagggcagaaccgccctgatcgccgccgcctacatgggccacagagagatcgtggagcacctgctggaccacggcgccgaggtgaaccacgaggacgtggacggcagaaccgccctgagcgtggccgccctgtgcgtgcccgccagcaagggccacgccagcgtggtgagcctgctgatcgacagaggcgccgaggtggaccactgcgacaaggacggcatgacccccctgctggtggccgcctacgagggccacgtggacgtggtggacctgctgctggagggcggcgccgacgtggaccacaccgacaacaacggcagaacccccctgctggccgccgccagcatgggccacgccagcgtggtgaacaccctgctgttctggggcgccgccgtggacagcatcgacagcgagggcagaaccgtgctgagcatcgccagcgcccagggcaacgtggaggtggtgagaaccctgctggacagaggcctggacgagaaccacagagacgacgccggctggacccccctgcacatggccgccttcgagggccacagactgatctgcgaggccctgatcgagcagggcgccagaaccaacgagatcgacaacgacggcagaatccccttcatcctggccagccaggagggccactacgactgcgtgcagatcctgctggagaacaagagcaacatcgaccagagaggctacgacggcagaaacgccctgagagtggccgccctggagggccacagagacatcgtggagctgctgttcagccacggcgccgacgtgaactgcaaggacgccgacggcagacccaccctgtacatcctggccctggagaaccagctgaccatggccgagtacttcctggagaacggcgccaacgtggaggccagcgacgccgagggcagaaccgccctgcacgtgagctgctggcagggccacatggagatggtgcaggtgctgatcgcctaccacgccgacgtgaacgccgccgacaacgagaagagaagcgccctgcagagcgccgcctggcagggccacgtgaaggtggtgcagctgctgatcgagcacggcgccgtggtggaccacacctgcaaccagggcgccaccgccctgtgcatcgccgcccaggagggccacatcgacgtggtgcaggtgctgctggagcacggcgccgaccccaaccacgccgaccagttcggcagaaccgccatgagagtggccgccaagaacggccacagccagatcatcaagctgctggagaagtacggcgccagcagcctgaacggctgcagccccagccccgtgcacaccatggagcagaagcccctgcagagcctgagcagcaaggtgcagagcctgaccatcaagagcaacagcagcggcagcaccggcggcggcgacatgcagcccagcctgagaggcctgcccaacggccccacccacgccttcagcagccccagcgagagccccgacagcaccgtggacagacagaagagcagcctgagcaacaacagcctgaagagcagcaagaacagcagcctgagaaccaccagcagcaccgccaccgcccagaccgtgcccatcgacagcttccacaacctgagcttcaccgagcagatccagcagcacagcctgcccagaagcagaagcagacagagcatcgtgagccccagcagcaccacccagagcctgggccagagccacaacagccccagcagcgagttcgagtggagccaggtgaagcccagcctgaagagcaccaaggccagcaagggcggcaagagcgagaacagcgccaagagcggcagcgccggcaagaaggccaagcagagcaacagcagccagcccaaggtgctggagtacgagatgacccagttcgacagaagaggccccatcgccaagagcggcaccgccgccccccccaagcagatgcccgccgagagccagtgcaagatcatgatccccagcgcccagcaggagatcggcagaagccagcagcagttcctgatccaccagcagagcggcgagcagaagaagagaaacggcatcatgaccaaccccaactaccacctgcagagcaaccaggtgttcctgggcagagtgagcgtgcccagaaccatgcaggacagaggccaccaggaggtgctggagggctaccccagcagcgagaccgagctgagcctgaagcaggccctgaagctgcagatcgagggcagcgaccccagcttcaactacaagaaggagacccccctgtag

SEQ ID NO: 17983 - DNA, 3231 bp, Artificial Sequence
  Description of Artificial Sequence: Synthetic coding sequence
atgggcatcctgagcatcaccgaccagccccccctggtgcaggccatcttcagcagagacgtggaggaggtgagaagcctgctgagccagaaggagaacatcaacgtgctggaccaggagagaagaacccccctgcacgccgccgcctacgtgggcgacgtgcccatcctgcagctgctgctgatgagcggcgccaacgtgaacgccaaggacaccctgtggctgacccccctgcacagagccgccgccagcagaaacgagaaggtgctgggcctgctgctggcccacagcgccgacgtgaacgccagagacaagctgtggcagacccccctgcacgtggccgccgccaacagagccaccaagtgcgccgaggccctggcccccctgctgagcagcctgaacgtggccgacagaagcggcagaagcgccctgcaccacgccgtgcacagcggccacctggagaccgtgaacctgctgctgaacaagggcgccagcctgaacgtgtgcgacaagaaggagagacagcccctgcactgggccgccttcctgggccacctggaggtgctgaagctgctggtggccagaggcgccgacctgggctgcaaggacagaaagggctacggcctgctgcacaccgccgccgccagcggccagatcgaggtggtgaagtacctgctgagaatgggcgccgagatcgacgagcccaacgccttcggcaacaccgccctgcacatcgcctgctacctgggccaggacgccgtggccatcgagctggtgaacgccggcgccaacgtgaaccagcccaacgacaagggcttcacccccctgcacgtggccgccgtgagcaccaacggcgccctgtgcctggagctgctggtgaacaacggcgccgacgtgaactaccagagcaaggagggcaagagccccctgcacatggccgccatccacggcagattcaccagaagccagatcctgatccagaacggcagcgagatcgactgcgccgacaagttcggcaacacccccctgcacgtggccgccagatacggccacgagctgctgatcagcaccctgatgaccaacggcgccgacaccgccagaagaggcatccacgacatgttccccctgcacctggccgtgctgttcggcttcagcgactgctgcagaaagctgctgagcagcggccagctgtacagcatcgtgagcagcctgagcaacgagcacgtgctgagcgccggcttcgacatcaacacccccgacaacctgggcagaacctgcctgcacgccgccgccagcggcggcaacgtggagtgcctgaacctgctgctgagcagcggcgccgacctgagaagaagagacaagttcggcagaacccccctgcactacgccgccgccaacggcagctaccagtgcgccgtgaccctggtgaccgccggcgccggcgtgaacgaggccgactgcaagggctgcagccccctgcactacgccgccgccagcgacacctacagaagagccgagccccacacccccagcagccacgacgccgaggaggacgagcccctgaaggagagcagaagaaaggaggccttcttctgcctggagttcctgctggacaacggcgccgaccccagcctgagagacagacagggctacaccgccgtgcactacgccgccgcctacggcaacagacagaacctggagctgctgctggagatgagcttcaactgcctggaggacgtggagagcaccatccccgtgagccccctgcacctggccgcctacaacggccactgcgaggccctgaagaccctggccgagaccctggtgaacctggacgtgagagaccacaagggcagaaccgccctgttcctggccaccgagagaggcagcaccgagtgcgtggaggtgctgaccgcccacggcgccagcgccctgatcaaggagagaaagagaaagtggacccccctgcacgccgccgccgccagcggccacaccgacagcctgcacctgctgatcgacagcggcgagagagccgacatcaccgacgtgatggacgcctacggccagacccccctgatgctggccatcatgaacggccacgtggactgcgtgcacctgctgctggagaagggcagcaccgccgacgccgccgacctgagaggcagaaccgccctgcacagaggcgccgtgaccggctgcgaggactgcctggccgccctgctggaccacgacgccttcgtgctgtgcagagacttcaagggcagaacccccatccacctggccagcgcctgcggccacaccgccgtgctgagaaccctgctgcaggccgccctgagcaccgaccccctggacgccggcgtggactacagcggctacagccccatgcactgggccagctacaccggccacgaggactgcctggagctgctgctggagcacagccccttcagctacctggagggcaaccccttcacccccctgcactgcgccgtgatcaacaaccaggacagcaccaccgagatgctgctgggcgccctgggcgccaagatcgtgaacagcagagacgccaagggcagaacccccctgcacgccgccgccttcgccgacaacgtgagcggcctgagaatgctgctgcagcaccaggccgaggtgaacgccaccgaccacaccggcagaaccgccctgatgaccgccgccgagaacggccagaccgccgccgtggagttcctgctgtacagaggcaaggccgacctgaccgtgctggacgagaacaagaacaccgccctgcacctggcctgcagcaagggccacgagaagtgcgccctgatgatcctggccgagacccaggacctgggcctgatcaacgccaccaacagcgccctgcagatgcccctgcacatcgccgccagaaacggcctggccagcgtggtgcaggccctgctgagccacggcgccaccgtgctggccgtggacgaggagggccacacccccgccctggcctgcgcccccaacaaggacgtggccgactgcctggccctgatcctgagcaccatgaagcccttcccccccaaggacgccgtgagccccttcagcttcagcctgctgaagaactgcagcatcgccgccgccaagaccgtgggcggctgcggcgccctgccccacggcgccagctgcccctacagccaggagagacccggcgccatcggcctggacggctgctacagcgagtag

SEQ ID NO: 17984 - DNA, 3231 bp, Artificial Sequence; identical to SEQ ID NO: 17983
  Description of Artificial Sequence: Synthetic coding sequence

SEQ ID NO: 17985 - DNA, 1032 bp, Artificial Sequence
  Description of Artificial Sequence: Synthetic coding sequence
atggccagcgccggcagcaccgccagaagagccggcagcggcagctggcacagcgagagaggcgagggcagaggcgccagaccccagcccacccccagcggcagcatgcagcaggccaacaaggtgagcctgaaggccacctggaccgacgccgagagcaagcagcccagccagcccctgcccgacctggccgaccacctgagcgcccaggccaccgccctggccagacccagaagacccgccagcctgaccccccccagagccgaccccagccccagcaaggagagcgaccagaccgccatcgaccagaccgccatcggcagctactaccagctgttcgccgccgccgtgggcaacgtggagtggctgagattctgcctgaaccagagcctgagagagatccccaccgacgacaagggcttcaccgccatccacttcgccgcccagtggggcaagctggcctgcctgcaggtgctggtggaggagtacaagttccccgtggacctgctgaccaacaacagccagacccccctgcacctggtgatccacagagacaacaccaccgtggccctgccctgcatctactacctgctggagaagggcgccgacctgaacgcccagacctgcaacggcagcacccccctgcacctggccgccagagacggcctgctggactgcgtgaaggtgctggtgcagagcggcgccaacgtgcacgcccaggacgccatgggctacaagcccatcgacttctgcaagatctggaaccacagagcctgcgccagattcctgaaggacgccatgtggaagaaggacaagaaggacttcgccagagagatgaccaagatgaagatgttcaagagccagctgaccctgatggagcacaactacctgatcgagtaccagggccagggctgcagcgtgcacttccccttcgccttcagccccatcacccccgagaccctgctgtggcaggacatcagcctgctgagcgactgcggcttcctgtggagaagaagagagctgagcttctag

SEQ ID NO: 17986 - DNA, 1593 bp, Artificial Sequence
  Description of Artificial Sequence: Synthetic coding sequence
atggccagcgccggcagcaccgccagaagagccggcagcggcagctggcacagcgagagaggcgagggcagaggcgccagaccccagcccacccccagcggcagcatgcagcaggccaacaaggtgagcctgaaggccacctggaccgacgccgagagcaagcagcccagccagcccctgcccgacctggccgaccacctgagcgcccaggccaccgccctggccagacccagaagacccgccagcctgaccccccccagagccgaccccagccccagcaaggagagcgaccagaccgccatcgaccagaccgccatcggcagctactaccagctgttcgccgccgccgtgggcaacgtggagtggctgagattctgcctgaaccagagcctgagagagatccccaccgacgacaagggcttcaccgccatccacttcgccgcccagtggggcaagctggcctgcctgcaggtgctggtggaggagtacaagttccccgtggacctgctgaccaacaacagccagacccccctgcacctggtgatccacagagacaacaccaccgtggccctgccctgcatctactacctgctggagaagggcgccgacctgaacgcccagacctgcaacggcagcacccccctgcacctggccgccagagacggcctgctggactgcgtgaaggtgctggtgcagagcggcgccaacgtgcacgcccaggacgccatgggctacaagcccatcgacttctgcaagatctggaaccacagagcctgcgccagattcctgaaggacgccatgtggaagaaggacaagaaggacttcgccagagagatgaccaagatgaagatgttcaagagccagctgaccctgatggagcacaactacctgatcgagtaccagaaggagcacaagatcctgagagaggccgccatcagaaagtggctgcacggcaagctgcaccccggccacagcctggtgagcaacaccaagcaggccagagccaccgccctgagcaagacccccgagcagagagagagccagagaagcagaagcttccaccccagcgtggacgccagactgcagtgcatcccccagcccaccgagatgcccaagcccatctacagaaagcccaccgtgaagagacccaccatgtggaacgtgagcaacaaccccgccagaccccccaccacccagatcagccacagccagggcatcagactgggcgtgcaccccgaccccacccccgagcacgacttcagcagcttcctggaggtgagacccgacggccacggcggcgccagactgcacaccgtggacggccactgggtggcccccgtgcccagactgcccttcgaggtgctgctgagaatgctgtaccccagagtgtggccctacagaatgaaggtgccccagggcttctaccccatcagcatgagagaggtgcccagaaagagacacctgggcgacaacaccttctggaccgacaccctggccatgaacctgagagacaccttcgacgaggccttcctggccgccgtgagaagccaccagggcctgcccaccctgcccagcccccagaccaacccctag

SEQ ID NO: 17987 - DNA, 1845 bp, Artificial Sequence
  Description of Artificial Sequence: Synthetic coding sequence
atgatgagacaggccaccatggacttcagcacccccagcgtgttcgaccagcagagaggcgacagcagcgaggaggtggacctgaccatggtgtaccaggccgccagcaacggcgacgtgaacgccctgaccgccgtgatcagagaggaccccagcatcctggagtgctgcgacagcgagggctgcacccccctgatgcacgccgtgagcggcagacaggccgacaccgtgaagctgctgctgaagatgggcgccaacatcaacatgcaggacgcctacggcagaaccagcctgtgcctggccacctacctgggctggctggagggctgcgtgagcctgctgagaaacggcgccaagcacaacatccccgacaagaacggcagactgcccctgcacgccgccaccgccgagcccgacatgagactgctgaccgtgctgctgcagcagagcaacatcagcgagatcaaccaccaggacaacgagggcatgacccccctgcactgggccgccttccacaaccagccccagcacacccagatgctgctgaagaagggcgccgaccccaccctggtggacaaggacttcaagaccgccctgcactgggccgtgcagagcggcaacagaatcctgtgcagcatcatcctgagccaccaccagggccccagcatcatcaactacgacgacgagagcggcaagacctgcgtgcacatcgccgccgccgccggcttcagcgacatcatccacgagctggccagagtgcccgagtgcaacctgcaggccctggacgtggacgacagaacccccctgcactgggccgccgccgccggcaaggccgagtgcgtgcagagcctgctggagctgggcatggacagcaacctgagagacatcaacgagagcacccccctggcctacgccctgtactgcggccacaccgcctgcgtgaagctgctgagccaggagagcagaaccgagcccaccagacccccccccagccagagcagcagaccccagaagaaggagagaagattcaacgtgctgaaccagatcttctgcaagaacaagaaggaggagcagagagcccaccagaaggaccccagcagagacagatacagagaggaggacaccagcgaggtgaacgacatcatcaccaccttcgacagcatcgtgggcaccaactgccaggagcagcccggcgaccaggtggccatggtggagttcaagaagaagaccagcgacaacagcaagtacctgctgcccgagaagaagcccctggccagaaagggcctgccccccatcagaacccagagcctgccccccatcaccctgggcaacaacttcctgaccgccagccacagagccaccagccacgccggcctgagcagcgccccccaccacatggcccagagaagccagaagagcagaagcgagcaggacctgctgaacaacagaaccggctgccagatgctgctggacaacccctggaagagcgacagcaaccaggtgttcagctacaaggtgtggaccgtgagcagcagcgacaagctgctggacagactgctgagcgtgagacccggccaccaggaggtgagcgtgcccccccacctgagacacctgcacaaccccagcagcggccagaacttccagcacctgagccccaacagacacaagatcagagacctgcccttcaccagaaacaacctggcccccctgcccgaccagaagttcctgagcggcgagcccctgagaaccaacagagtgctgcccgccatccccagccagagaagacacagcaccgccgccgaggagagcgagcacagcgccaaccccaccagcgacgagaactag

SEQ ID NO: 17988 - DNA, 981 bp, Artificial Sequence
  Description of Artificial Sequence: Synthetic coding sequence
atggacagcaacctgagagacatcaacgagagcacccccctggcctacgccctgtactgcggccacaccgcctgcgtgaagctgctgagccaggagagcagaaccgagcccaccagacccccccccagccagagcagcagaccccagaagaaggagagaagattcaacgtgctgaaccagatcttctgcaagaacaagaaggaggagcagagagcccaccagaaggaccccagcagagacagatacagagaggaggacaccagcgaggtgaacgacatcatcaccaccttcgacagcatcgtgggcaccaactgccaggagcagcccggcgaccaggtggccatggtggagttcaagaagaagaccagcgacaacagcaagtacctgctgcccgagaagaagcccctggccagaaagggcctgccccccatcagaacccagagcctgccccccatcaccctgggcaacaacttcctgaccgccagccacagagccaccagccacgccggcctgagcagcgccccccaccacatggcccagagaagccagaagagcagaagcgagcaggacctgctgaacaacagaaccggctgccagatgctgctggacaacccctggaagagcgacagcaaccaggtgttcagctacaaggtgtggaccgtgagcagcagcgacaagctgctggacagactgctgagcgtgagacccggccaccaggaggtgagcgtgcccccccacctgagacacctgcacaaccccagcagcggccagaacttccagcacctgagccccaacagacacaagatcagagacctgcccttcaccagaaacaacctggcccccctgcccgaccagaagttcctgagcggcgagcccctgagaaccaacagagtgctgcccgccatccccagccagagaagacacagcaccgccgccgaggagagcgagcacagcgccaaccccaccagcgacgagaactag

SEQ ID NO: 17989 - DNA, 1845 bp, Artificial Sequence; identical to SEQ ID NO: 17987
  Description of Artificial Sequence: Synthetic coding sequence

SEQ ID NO: 17990 - DNA, 2382 bp, Artificial Sequence
  Description of Artificial Sequence: Synthetic coding sequence
atggccagagagctgagccaggaggccctgctggacttcctgtgccaggccggcggcagagtgaccaacgccgccctgctgagccacttcaagagcttcctgagagaccccgacgccagccccagccagcaccagcacagaagagagctgttcaagggcttcgtgaacagcgtggccgccgtgagacaggaccccgacggcaccaagtacgtggtgctgaagagaagatacagagacctgctgggcgaggagggcctgcagagacccagagagccccccgccgccgcccccagcgccggcggcgccgccccctgcagccccagaggcgccagaagaggcgagcccccccagcagcagcccagaagaagaagaagagagaaggagcccgaggaggagcccgccggcgccgccgccagagccgccgacgccgcctgcaacggcctgcccggcagcgacagcagaagagcccccggcaagggcggcggcagcaagggcagccccggccagagaccccccgtgcccgccgccgccgccgccggcgcccaggccagagccagctgcgccgccgccaagacccagggcagatgctgctgggagtgcctgcagaacaacctggccgtgctgcccggcgagctgggcgccctgccccacagcgccaccgccgaggagaagcccgccagagccctgcccgcccaggacgacagaggcgccagcagagagagagaggagggcgccctggccgagcccgcccccgtgcccgccgtggcccacagcccccccgccaccgtggaggccgccaccagcagagccagcccccccgccctgctgcccggccccgcccccagaggcgacagacccgagctgctgacccccagcagcctgcactacagcaccctgcagcagcagcagcagagaaccagagagtgggtggccagacacccccaggtgcccgaggccagagaccagggccccatcagagcctggagcgtgctgcccgacaacttcctgcagctgcccctggagcccggcagcaccgagcccaacagcgagccccccgacccctgcctgagcagccacagcctgttccccgtggtgcccgacgagagctgggagagctgggccggcaaccccagcctgaccgtgttcagaagcatcagatgccagctgagcctgcaggacctggacgacttcgtggaccaggagagcgacggcagcgaggagagcagcagcggccccaaggacagccccggcgccagcgaggagggcctgcaggtggtgctgggcacccccgacagaggcaagctgagaaaccccgccggcggcctgagcgtgagcagaaaggagggcagccccagcagaagcccccagggcctgagaaacagaggcgacggccacatcagccagcaggtgcccgccggcgccaacggcctggccggccaccccctgaagcccctgccctggcccgtgcccaagctgagaagaagcctgagaagaagcagcctggccggcagagccaagctgagcagcagcgacgaggagtacctggacgagggcctgctgaagagaagcagaagaccccccagaagcagaaagcccagcaaggccggcaccgcccccagccccagagtggacgccggcctgagcctgaagctggccgaggtgaaggccgtggtggccgagagaggctggagacacagcctgtgggtgcccagcggcgagggcagcgccgccctggccccccacagaaccagcgagcacaagagcagcctggtgcccctggacgccagagagcacgagtggatcgtgaagctggccagcggcagctggatccaggtgtggaccctgttctgggaggacccccagctggccctgcacaaggacttcctgaccggctacaccgccctgcactggatcgccaagcacggcgacctgagagccctgcaggacctggtgagcggcgccaagaaggccggcatcgtgctggacgtgaacgtgagaagcagctgcggctacacccccctgcacctggccgccatccacggccaccagggcgtgatcaagctgctggtgcagagactggccagcagagtgaacgtgagagacagcagcggcaagaagccctggcagtacctgaccagcaacaccagcggcgagatctggcagctgctgggcgcccccagaggcaagcccatcttccccgtgtaccccctggtgggcagcagcagccccaccagaaaggccaagagcaaggagatcagcagaagcgtgaccagaaagaccagcttcgccgccctgctgaagagccagcacaacaagtggaagctggccaaccagtacgagaagttccacagccccagagagagagaggagtacagcgactag

SEQ ID NO: 17991 - DNA, 1578 bp, Artificial Sequence
  Description of Artificial Sequence: Synthetic coding sequence
atggagggccccgccgagtggggccccgaggccgccctgggccccgaggccgtgctgagattcctggccgagagaggcggcagagccctgcacgccgagctggtgcagcacttcagaggcgccctgggcggcgagcccgagcagagagccagagccagagcccacttcaaggagctggtgaacgccgtggccaccgtgagagtggaccccgccgacggcgccaagtacgtgcacctgaagaagagattctgcgagggccccagcgagcccagcggcgacccccccagaatccaggtgaccgccgagcccgaggcccccgacggccccgccggccccgaggccagagacagactgcccgacgccgccgcccccgagagcctgcccggccagggcagagagctgggcgagggcgagccccccgcccccgcccactggccccccctgagcgccggcgccagaagaaagaacagcagaagagacgtgcagcccctgcccagaacccccgcccccggccccagcgaggacctggagctgcccccccacggctgcgaggaggccgacagaggcagcagcctggtgggcgccaccgcccagagacccgccagacagaacctgagagacctggtgatgggcagcagcccccagctgaagagaagcgtgtgccccggcggcagcagccccggcagcagcagcggcggcggcagaggcagaggcggcggcgacagcgacagcgccagcgtggccagcagcagcgccgaggaggagagcagcggcggcggcagcgtgaccctggaccccctggagcacgcctggatgctgagcgccagcgacggcaagtgggacagcctggagggcctgctgacctgcgagcccggcctgctggtgaagagagacttcatcaccggcttcacctgcctgcactgggccgccaagcacggcagacaggagctgctggccatgctggtgaacttcgccaacaagcaccagctgcccgtgaacatcgacgccagaaccagcggcggctacaccgccctgcacctggccgccatgcacggccacgtggaggtggtgaagctgctggtgggcgcctacgacgccgacgtggacatcagagactacagcggcaagaaggccagccagtacctgagcagaagcatcgccgaggagatcaagaacctggtgggcgccctggacgagggcgacggcgagagcgccgccggcagcggcggcggcagatggagactgagcaaggtgctgcccagccacctgatcacctacaagctgagccacgccctggaggacggcggcgaccaccaccaccaccaccacagcgccgagggctgggtgggcggcaaggccaaggaccccggcagaaaggccagcggcagcagcagcggcagaatcaagcccagactgaacaagatcagattcagaacccagatcgtgcacaccacccccagcttcagagaccccgagcagcccctggagggcagaggcgaggagggcgtgggcgaggagagacccgtgaagggccacagccccttcaccctgagacccaagagcaacgtgttcggctag

SEQ ID NO: 17992 - DNA, 948 bp, Artificial Sequence
  Description of Artificial Sequence: Synthetic coding sequence
atggcccagctgggcggcgccgccaacagagcccccaccgccagcctggcccccaccagccagagcctgagatgcgccccccagcccagacccagcagagccgacaccggcagcctgggcagatactggggcaaggccgccgccgccgccagcagagagcaccccttccccggcaccctgatgcacagcgccgccggcagcggcagaagaagaggcgccctgagagagctgctgggcctgcagagagccgcccccgccggctggctgagcgaggagagagccgaggagctgggcggccccagcggccccggcagcagcagactgtgcctggagcccagagagcacgcctggatcctggccgccgccgagggcagatacgaggtgctgagagagctgctggaggccgagcccgagctgctgctgagaggcgaccccatcaccggctacagcgtgctgcactggctggccaagcacggcagacacgaggagctgatcctggtgcacgacttcgccctgagaagaggcctgagactggacgtgagcgcccccggcagcggcggcctgacccccctgcacctggccgccctgcagggccacgacatggtgatcaaggtgctggtgggcgccctgggcgccgacgccaccagaagagaccacagcggccacagagcctgccactacctgagacccgacgccccctggagactgagagagctgagcggcgccgaggagtgggagatggagagcggcagcggctgcaccaacctgaacaacaacagcagcggcaccaccgcctggagagccgccagcgccgtgggcgccaccgccgtggagaccagcagaagagtggccgccagcagaaccaaggccaaggacaccgccggcagcagagtggcccagatgcacagcctgttcagacacctgttccccagcttccaggacagatag

SEQ ID NO: 17993 - DNA, 1026 bp, Artificial Sequence
  Description of Artificial Sequence: Synthetic coding sequence
tgagcctggggcatgagaagagccgccgccggcgccggcggcgccagagccgccggccccaccggcggcgccagcagactgcaccccaacgccggcagaagaagcggcgccagagccggcgcccagggctgcggcggccccagagtgggcagcgccgacagcagagccctgcccgcccagcccctggcctgcgccagaggcagaagccagagactggtgtgcgaccccaaggccgccagcgccctgcccgacctggcccccgacgtgttcgtgctgagagtgagactggaggagaccggcgagatgttcagagtggccaactgcagaggcgacatgaccgtgagagagctgaaggaggagctggacctgatggtgggcatccccttcaacctgcagagactgcagtacctggacgagggcgtgctgatggacgacaccaccctgaagttccacgacgtggtgcccggcggcatcatcagcctgtgcatctggcaccacgacggctggaccgagctggtgctggccgccgtggagggcgaccccagcaagctgagctgcctgggcctgaccgaggacagcttctacagaaccgccaacagcgagcacttcgagggcgagaagtggaagcactggaccagccagagagccttcgtggccctgtacgtggccagccacagaggccacttcgacgccgtgcagtacctgctggagcacggcgccagctgcctgagcagaagccccctgggcagaacccccctgcacgtggccgccgccatgggcagaagcgactgcatcatcctgctgctgcagcacggcgccagcatccacgacagagacgccaagggcgagacccccatcagcatcgcccacagactgaaccacaccctgagcgagagacagatggtgctgctgcacagaatcgccaagagcggcatcagagacctgaacgacctggtgatgaagaacgccctgcagagagtgaagagcggcttcagaagcgagaagatgaccatgaccccccactag

SEQ ID NO: 17994 - DNA, 1038 bp, Artificial Sequence
  Description of Artificial Sequence: Synthetic coding sequence
atgaccagaggcagagcctggggcatgagaagagccgccgccggcgccggcggcgccagagccgccggccccaccggcggcgccagcagactgcaccccaacgccggcagaagaagcggcgccagagccggcgcccagggctgcggcggccccagagtgggcagcgccgacagcagagccctgcccgcccagcccctggcctgcgccagaggcagaagccagagactggtgtgcgaccccaaggccgccagcgccctgcccgacctggcccccgacgtgttcgtgctgagagtgagactggaggagaccggcgagatgttcagagtggccaactgcagaggcgacatgaccgtgagagagctgaaggaggagctggacctgatggtgggcatccccttcaacctgcagagactgcagtacctggacgagggcgtgctgatggacgacaccaccctgaagttccacgacgtggtgcccggcggcatcatcagcctgtgcatctggcaccacgacggctggaccgagctggtgctggccgccgtggagggcgaccccagcaagctgagctgcctgggcctgaccgaggacagcttctacagaaccgccaacagcgagcacttcgagggcgagaagtggaagcactggaccagccagagagccttcgtggccctgtacgtggccagccacagaggccacttcgacgccgtgcagtacctgctggagcacggcgccagctgcctgagcagaagccccctgggcagaacccccctgcacgtggccgccgccatgggcagaagcgactgcatcatcctgctgctgcagcacggcgccagcatccacgacagagacgccaagggcgagacccccatcagcatcgcccacagactgaaccacaccctgagcgagagacagatggtgctgctgcacagaatcgccaagagcggcatcagagacctgaacgacctggtgatgaagaacgccctgcagagagtgaagagcggcttcagaagcgagaagatgaccatgaccccccactag

SEQ ID NO: 17995 - DNA, 2712 bp, Artificial Sequence
  Description of Artificial Sequence: Synthetic coding sequence
atggccacctggagaaagaacagagacaaggacggcttcagcaaccccggctacagagtgagacagaaggacctgggcatgatccacaaggccgccatcgccggcgacgtgaacaaggtgatggagagcatcctgctgagactgaacgacctgaacgacagagacaagaagaacagaaccgccctgctgctggcctgcgcccacggcagacccggcgtggtggccgacctggtggccagaaagtgccagctgaacctgaccgacagcgagaacagaaccgccctgatcaaggccgtgcagtgccaggaggaggtgtgcgccagcatcctgctggagcacggcgccaaccccaacgtgagagacatgtacggcaacaccgccctgcactacgccatcgacaacgagaacatcagcatggccagaaagctgctggcctacggcgccgacatcgaggccagaagccaggacggccacaccagcctgctgctggccgtgaacagaaagaaggagcagatggtggccttcctgctgaagaagaagcccgacctgaccgccatcgacaacttcggcagaaccgccctgatcctggccgccagaaacggcagcaccagcgtggtgtaccagctgctgcagcacaacatcgacgtgttctgccaggacatcagcggctggaccgccgaggactacgccgtggccagcaagttccaggccatcagaggcatgatcagcgagtacaaggccaacaagagatgcaagagcctgcagaacagcaacagcgagcaggacctggagatgaccagcgagggcgagcaggagagactggagggctgcgagagcagccagccccaggtggaggagaagatgaagaagtgcagaaacaagaagatggaggtgagcagaaacgtgcacgccgacgacagcgacaactacaacgacgacgtggacgagctgatccacaagatcaagaacagaaagcccgacaaccaccagagccccggcaaggagaacggcgagttcgacagactggccagaaagaccagcaacgagaagagcaaggtgaagagccagatctacttcaccgacgacctgaacgacatcagcggcagcagcgagaagaccagcgaggacgacgagctgccctacagcgacgacgagaacttcatgctgctgatcgagcagagcggcatggagtgcaaggacttcgtgagcctgagcaagagcaagaacgccaccgccgcctgcggcagaagcatcgaggaccagaagtgctactgcgagagactgaaggtgaagttccagaagatgaagaacaacatcagcgtgctgcagaaggtgctgagcgagaccgacaagaccaagagccagagcgagcaccagaacctgcagggcaagaagaagctgtgcaacctgagattcatcctgcagcagcaggaggaggagagaatcaaggccgaggagctgtacgagaaggacatcgaggagctgaagatcatggaggagcagtacagaacccagaccgaggtgaagaagcagagcaagctgaccctgaagagcctggaggtggagctgaagaccgtgagaagcaacagcaaccagaacttccacacccacgagagagagagagacctgtggcaggagaaccacctgatgagagacgagatcgccagactgagactggagatcgacaccatcaagcaccagaaccaggagaccgagaacaagtacttcaaggacatcgagatcatcaaggagaacaacgaggacctggagaagaccctgaagagaaacgaggaggccctgaccaagaccatcaccagatacagcaaggagctgaacgtgctgatggacgagaacaccatgctgaacagcgagctgcagaaggagaagcagagcatgagcagactggagaccgagatggagagctacagatgcagactggccgccgccctgtgcgaccacgaccagagacagagcagcaagagagacctgcagctggccttccagagcaccgtgaacgagtggtgccacctgcaggaggacaccaacagccacatccagatcctgagccagcagctgagcaaggccgagagcaccagcagcggcctggagaccgagctgcactacgagagagaggccctgaaggagaagaccctgcacatcgagcacatgcagggcgtgctgagcagaacccagagaagactggaggacatcgagcacatgtaccagaacgaccagcccatcctggagaagtacgtgagaaagcagcagagcgtggaggacggcctgttccagctgcagagccagaacctgctgtaccagcagcagtgcaacgacgccagaaagaaggccgacaaccaggagaagaccatcatcaacatccaggtgaagtgcgaggacaccgtggagaagctgcaggccgagtgcagaaagctggaggagaacaacaagggcctgatgaaggagtgcaccctgctgaaggagagacagtgccagtacgagaaggagaaggaggagagagaggtggtgagaagacagctgcagagagaggtggacgacgccctgaacaagcagctgctgctggaggccatgctggagatcagcagcgagagaagaatcaacctggaggacgaggcccagagcctgaagaagaagctgggccagatgagaagccaggtgtgcatgaagctgagcatgagcaccgtgaccctgtag

SEQ ID NO: 17996 - DNA, 1920 bp, Artificial Sequence
  Description of Artificial Sequence: Synthetic coding sequence
atgaccagcgagggcgagcaggagagactggagggctgcgagagcagccagccccaggtggaggagaagatgaagaagtgcagaaacaagaagatggaggtgagcagaaacgtgcacgccgacgacagcgacaactacaacgacgacgtggacgagctgatccacaagatcaagaacagaaagcccgacaaccaccagagccccggcaaggagaacggcgagttcgacagactggccagaaagaccagcaacgagaagagcaaggtgaagagccagatctacttcaccgacgacctgaacgacatcagcggcagcagcgagaagaccagcgaggacgacgagctgccctacagcgacgacgagaacttcatgctgctgatcgagcagagcggcatggagtgcaaggacttcgtgagcctgagcaagagcaagaacgccaccgccgcctgcggcagaagcatcgaggaccagaagtgctactgcgagagactgaaggtgaagttccagaagatgaagaacaacatcagcgtgctgcagaaggtgctgagcgagaccgacaagaccaagagccagagcgagcaccagaacctgcagggcaagaagaagctgtgcaacctgagattcatcctgcagcagcaggaggaggagagaatcaaggccgaggagctgtacgagaaggacatcgaggagctgaagatcatggaggagcagtacagaacccagaccgaggtgaagaagcagagcaagctgaccctgaagagcctggaggtggagctgaagaccgtgagaagcaacagcaaccagaacttccacacccacgagagagagagagacctgtggcaggagaaccacctgatgagagacgagatcgccagactgagactggagatcgacaccatcaagcaccagaaccaggagaccgagaacaagtacttcaaggacatcgagatcatcaaggagaacaacgaggacctggagaagaccctgaagagaaacgaggaggccctgaccaagaccatcaccagatacagcaaggagctgaacgtgctgatggacgagaacaccatgctgaacagcgagctgcagaaggagaagcagagcatgagcagactggagaccgagatggagagctacagatgcagactggccgccgccctgtgcgaccacgaccagagacagagcagcaagagagacctgcagctggccttccagagcaccgtgaacgagtggtgccacctgcaggaggacaccaacagccacatccagatcctgagccagcagctgagcaaggccgagagcaccagcagcggcctggagaccgagctgcactacgagagagaggccctgaaggagaagaccctgcacatcgagcacatgcagggcgtgctgagcagaacccagagaagactggaggacatcgagcacatgtaccagaacgaccagcccatcctggagaagtacgtgagaaagcagcagagcgtggaggacggcctgttccagctgcagagccagaacctgctgtaccagcagcagtgcaacgacgccagaaagaaggccgacaaccaggagaagaccatcatcaacatccaggtgaagtgcgaggacaccgtggagaagctgcaggccgagtgcagaaagctggaggagaacaacaagggcctgatgaaggagtgcaccctgctgaaggagagacagtgccagtacgagaaggagaaggaggagagagaggtggtgagaagacagctgcagagagaggtggacgacgccctgaacaagcagctgctgctggaggccatgctggagatcagcagcgagagaagaatcaacctggaggacgaggcccagagcctgaagaagaagctgggccagatgagaagccaggtgtgcatgaagctgagcatgagcaccgtgaccctgtag

SEQ ID NO: 17997 - DNA, 1143 bp, Artificial Sequence
  Description of Artificial Sequence: Synthetic coding sequence
atgctgaagcccaaggacctgtgccccagagccggcaccagaaccttcctggaggccatgcaggccggcaaggtgcacctggccagattcgtgctggacgccctggacagaagcatcatcgactgcagagccgagcagggcagaacccccctgatggtggccgtgggcctgcccgaccccgccctgagagccagattcgtgagactgctgctggagcagggcgccgccgtgaacctgagagacgagagaggcagaaccgccctgagcctggcctgcgagagaggccacctggacgccgtgcagctgctggtgcagttcagcggcgaccccgaggccgccgacagcgccggcaacagccccgtgatgtgggccgccgcctgcggccacggcgccgtgctggagttcctggtgagaagcttcagaagactgggcctgagactggacagaaccaacagagccggcctgaccgccctgcagctggccgccgccagaggccacggcacctgcgtgcaggccctgaccggcccctggggcagagccgccgccgccgccgccgccagaggcagcaacagcgacagcccccccggcagacccgcccccgccgccagccccgagcacagaagacccagccccagaagactgcccagacccctgctggccagattcgccagagccgccggcggccacggcggcgaggccggcagcgccggcaagaacagcggcagacacagagcccagggcagcgagagacccgagctgggcagaagcatgagcctggccctgggcgccgtgaccgaggaggaggccgccagactgagagccggcgccctgatggccctgcccaacagcccccagagcagcggcaccggcagatggagaagccaggaggtgctggagggcgccccccccaccctggcccaggcccccatcggcctgagcccccaccccgagggcggccccggcagcggcagactgggcctgagaagaagaagcaccgcccccgacatccccagcctggtgggcgaggcccccggccccgagagcggccccgagctggaggccaacgccctgagcgtgagcgtgcccggccccaacccctggcaggccggcaccgaggccgtggtgctgagagcccagagatag

SEQ ID NO: 17998 - DNA, 1200 bp, Artificial Sequence
  Description of Artificial Sequence: Synthetic coding sequence
atggacagccagagacccgagcccagagaggaggaggaggaggagcaggagctgagatggatggagctggacagcgaggaggccctgggcaccagaaccgagggccccagcgtggtgcagggctggggccacctgctgcaggccgtgtggagaggccccgccggcctggtgacccagctgctgagacagggcgccagcgtggaggagagagaccacgccggcagaacccccctgcacctggccgtgctgagaggccacgcccccctggtgagactgctgctgcagagaggcgcccccgtgggcgccgtggacagagccggcagaaccgccctgcacgaggccgcctggcacggccacagcagagtggccgagctgctgctgcagagaggcgccagcgccgccgccagaagcggcaccggcctgacccccctgcactgggccgccgccctgggccacaccctgctggccgccagactgctggaggcccccggccccggccccgccgccgccgaggccgaggacgccagaggctggaccgccgcccactgggccgccgccggcggcagactggccgtgctggagctgctggccgccggcggcgccggcctggacggcgccctgctggtggccgccgccgccggcagaggcgccgccctgagattcctgctggccagaggcgccagagtggacgccagagacggcgccggcgccaccgccctgggcctggccgccgccctgggcagaagccaggacatcgaggtgctgctgggccacggcgccgaccccggcatcagagacagacacggcagaagcgccctgcacagagccgccgccagaggccacctgctggccgtgcagctgctggtgacccagggcgccgaggtggacgccagagacaccctgggcctgacccccctgcaccacgccagcagagagggccacgtggaggtggccggctgcctgctggacagaggcgcccaggtggacgccaccggctggctgagaaagacccccctgcacctggccgccgagagaggccacggccccaccgtgggcctgctgctgagcagaggcgccagccccaccctgagaacccagtgggccgaggtggcccagatgcccgagggcgacctgccccaggccctgcccgagctgggcggcggcgagaaggagtgcgagggcatcgagagcaccggctag

SEQ ID NO: 17999 - DNA, 525 bp, Artificial Sequence
  Description of Artificial Sequence: Synthetic coding sequence
atggacagccagagacccgagcccagagaggaggaggaggaggagcaggagctgagatggatggagctggacagcgaggaggccctgggcaccagaaccgagggccccagcgtggtgcagggctggggccacctgctgcaggccgtgtggagaggccccgccggcctggtgacccagctgctgagacagggcgccagcgtggaggagagaaccctgagatgctgctgggccaccggccagacccaggccagcggcaccggcatggccgccctgagatgcaccggcctgccccccgaggacacctgcctgcccagcagctgctggagccccagaggccccagatggatgagaggcaccccctgggccagccacccctgcatcacccccctgggcaaggccacctggagactgcccgccgcctgctggaccggcgtgcccagatggatgctgcccgccggcagcgagagacccccctacacctggctgcagagcgagggcatgggcctgccctggggcttctgctag

SEQ ID NO: 18000 - DNA, 198 bp, Artificial Sequence
  Description of Artificial Sequence: Synthetic coding sequence
atggacagccagagacccgagcccagagaggaggaggaggaggagcaggagctgagatggatggagctggacagcgaggaggccctgggcaccagaaccgagggccccagcgtggtgcagggctggggccacctgctgcaggccgtgtggagaggccccgccggcctggtgacccagctgctgagacagggccactag

SEQ ID NO: 18001 - DNA, 954 bp, Artificial Sequence
  Description of Artificial Sequence: Synthetic coding sequence
atgccctgggacgccagaagacccggcggcggcgccgacggcggccccgaggccagcggcgccgccagaagcagagcccagaagcagtgcagaaagagcagcttcgccttctaccaggccgtgagagacctgctgcccgtgtggctgctggaggacatgagagccagcgaggccttccactgggacgagagaggcagagccgccgcctacagccccagcgaggccctgctgtacgccctggtgcacgaccaccaggcctacgcccactacctgctggccaccttccccagaagagccctggccccccccagcgccggcttcagatgctgcgccgcccccggcccccacgtggccctggccgtgagatacaacagagtgggcatcctgagaagaatcctgagaaccctgagagacttccccgccgaggagagagccagagtgctggacagaagaggctgcagcagagtggagggcggcggcaccagcctgcacgtggcctgcgagctggccagacccgagtgcctgttcctgctgctgggccacggcgccagccccggcctgagagacggcggcggcctgacccccctggagctgctgctgagacagctgggcagagacgccggcgccacccccagcgccgccggcgcccccgccagcgcccccggcgagcccagacagagaagactgctgctgctggacctgctggccctgtacacccccgtgggcgccgccggcagcgccagacaggagctgctgggcgacagacccagatggcagagactgctgggcgaggacaagttccagtggctggccggcctggccccccccagcctgttcgccagagccatgcaggtgctggtgaccgccatcagccccggcagattccccgaggccctggacgagctgcccctgccccccttcctgcagcccctggacctgaccggcaagggctag

SEQ ID NO: 18002 - DNA, 318 bp, Artificial Sequence
  Description of Artificial Sequence: Synthetic coding sequence
atgccctgggacgccagaagacccggcggcggcgccgacggcggccccgaggccagcggcgccgccagaagcagagcccagaagcagtgcagaaagagcagcttcgccttctaccaggccgtgagagacctgctgcccgtgtggctgctggaggacatgagagccagcgaggccttccactgggacgagagaggcagagccgccgcctacagccccagcgaggccctgctgtacgccctggtgcacgaccaccaggcctacgcccactacctgctggccaccttccccagaagagccctggccccccccagcgcctag

SEQ ID NO: 18003 - DNA, 783 bp, Artificial Sequence
  Description of Artificial Sequence: Synthetic coding sequence
atgccctgggacgccagaagacccggcggcggcgccgacggcggccccgaggccagcggcgccgccagaagcagagcccagaagcagtgcagaaagagcagcttcgccttctaccaggccgtgagagacctgctgcccgtgtggctgctggaggacatgagagccagcgaggccttccactgggacgagagaggcagagccgccgcctacagccccagcgaggccctgctgtacgccctggtgcacgaccaccaggcctacgcccactacctgctggccaccttccccagaagagccctggccccccccagcgccggcttcagatgctgcgccgcccccggcccccacgtggccctggccgtgagatacaacagagtgggcatcctgagaagaatcctgagaaccctgagagacttccccgccgaggagagagccagagtgctggacagaagaggctgcagcagagtggagggcggcggcaccagcctgcacgtggcctgcgagctggccagacccgagtgcctgttcctgctgctgggccacggcgccagccccggcctgagagacggcggcggcctgacccccctggagctgctgctgagacagctgggcagagacgccggcgccacccccagcgccgccggcgcccccgccagcgcccccggcgagcccagacagagaagactgctgctgctggacctgctggccctgtacacccccgtgggcgccgccggcagcgccagacaggagctgctgggcgacagacccagatggcagagatag

SEQ ID NO: 18004 - DNA, 954 bp, Artificial Sequence; identical to SEQ ID NO: 18001
  Description of Artificial Sequence: Synthetic coding sequence

SEQ ID NO: 18005 - DNA, 954 bp, Artificial Sequence; identical to SEQ ID NO: 18001
  Description of Artificial Sequence: Synthetic coding sequence

SEQ ID NO: 18006 - DNA, 2292 bp, Artificial Sequence
  Description of Artificial Sequence: Synthetic coding sequence
atggaggccagcctgaccagaagactgctgttcaaggacagacacttcacctgcagcaagatcatcggcagaagattcgcctgcttcgcccagagactgagccacagaagaaagcagagccagtgcgacctgctgaacgagagcaccggccagctgcccaccacctgcagcagcgccgccagcaacagcatcaactggaactgcagagtgaagatgacccagcagatgcagaacctgcacctgtgccagagcaagaagcacagcgcccccagcagccccaacgccgccaagagactgtacagaaacctgagcgagaagctgaagggcagccacagcagcttcgacgaggcctacttcagaaccagaaccgacagactgagcctgagaaagaccagcgtgaacttccagggcaacgaggccatgttcgaggccgtggagcagcaggacatggacgccgtgcagatcctgctgtaccagtacacccccgaggagctggacctgaacacccccaacagcgagggcctgacccccctggacatcgccatcatgaccaacaacgtgcccatcgccagaatcctgctgagaaccggcgccagagagagcccccacttcgtgagcctggagagcagagccatgcacctgaacaccctggtgcaggaggcccaggagagagtgagcgagctgagcgcccaggtggagaacgagggcttcaccctggacaacaccgagaaggagaagcagctgaaggcctgggagtggagatacagactgtacagaagaatgaagaccggcttcgagcacgccagagcccccgagatgcccaccaacgtgtgcctgatggtgaccagcagcaccagcctgaccgtgagcttccaggagcccctgagcgtgaacgccgccgtggtgaccagatacaaggtggagtggagcatgagcgaggacttcagccccctggccggcgagatcatcatggacaacctgcagaccctgagatgcaccatcaccggcctgaccatgggccagcagtacttcgtgcaggtgagcgcctacaacatgaagggctggggccccgcccagaccaccacccccgcctgcgccagccccagcaactggaaggactacgacgacagagagcccagacacaagggccagagcgaggtgctggagggcctgctgcagcaggtgagagccctgcaccagcactacagctgcagagagagcaccaagctgcagaccaccggcagaaagcagagcgtgagcagaagcctgaagcacctgttccacagcagcaacaagttcgtgaagaccctgaagagaggcctgtacatcgccgtgatcttctactacaaggacaacatcctggtgaccaacgaggaccaggtgcccatcgtggagatcgacgacagccacaccagcagcatcacccaggacttcctgtggttcaccaagctgagctgcatgtgggaggacatcagatggctgagacagagcatccccatcagcagcagcagcagcaccgtgctgcagaccagacagaagatgctggccgccaccgcccagctgcagaacctgctgggcacccacaacctgggcagagtgtactacgagcccatcaaggacagacacggcaacatcctgatcgtgaccatcagagaggtggagatgctgtacagcttcttcaacggcaagtggatgcagatcagcaagctgcagagccagagaaagagcctgagcacccccgaggagcccaccgccctggacatcctgctgatcaccatccaggacatcctgagctaccacaagagaagccaccagagactgttccccggcctgtacctgggctacctgaagctgtgcagcagcgtggaccagatcaaggtgctggtgacccagaagctgcccaacatcctgtgccacgtgaagatcagagagaacaacaacatcagcagagaggagtgggagtggatccagaagctgagcggcagcgagagcatggagagcgtggaccacaccagcgactgccccatgcagctgttcttctacgagctgcagatggccgtgaaggccctgctgcagcagatcaacatccccctgcaccaggccagaaacttcagactgtacacccaggaggtgctggagatgggccacaacgtgagcttcctgctgctgctgcccgccagcgacgacgtgtgcaccgcccccggccagaacaacccctacaccccccacagcggcttcctgaacctgcccctgcagatgttcgagctgggcatcgtggcctgcttcacctag

SEQ ID NO: 18007 - DNA, 831 bp, Artificial Sequence
  Description of Artificial Sequence: Synthetic coding sequence
atggcctggtggaagagctggatcgagcaggagggcgtgaccgtgaagagcagcagccacttcaaccccgaccccgacgccgagaccctgtaccaggccatgaagggcatcggcgtgggcagccagctgctgagccaccaggccgccgccttcgccttccccagcagcgccctgaccagcgtgagcccctggggccagcagggccacctgtgctgcaaccccgccggcaccaacgagcaggccatcatcgacgtgctgaccaagagaagcaacacccagagacagcagatcgccaagagcttcaaggcccagttcggcaaggacctgaccgagaccctgaagagcgagctgagcggcaagttcgagagactgatcgtggccctgatgtaccccccctacagatacgaggccaaggagctgcacgacgccatgaagggcagcagagacgacgtgagcagcttcgtggaccccggcctggccctgcaggacgcccaggacctgtacgccgccggcgagaagatcagaggcaccgacgagatgaagttcatcaccatcctgtgcaccagaagcgccacccacctgctgagagtgaagtgcacccagaacctgcacagctacttcgccgagagactgtactacgccatgaagggcgccggcaccagagacggcaccctgatcagaaacatcgtgagcagaagcgagatcgacctgaacctgatcaagtgccacttcaagaagatgtacggcaagaccctgagcagcatgatcatggaggacaccagcggcgactacaagaacgccctgctgagcctggtgggcagcgacccctag

SEQ ID NO: 18008 - DNA, 984 bp, Artificial Sequence
  Description of Artificial Sequence: Synthetic coding sequence
atggcctggtggaagagctggatcgagcaggagggcgtgaccgtgaagagcagcagccacttcaaccccgaccccgacgccgagaccctgtaccaggccatgaagggcatcggcaccaacgagcaggccatcatcgacgtgctgaccaagagaagcaacacccagagacagcagatcgccaagagcttcaaggcccagttcggcaaggacctgaccgagaccctgaagagcgagctgagcggcaagttcgagagactgatcgtggccctgatgtaccccccctacagatacgaggccaaggagctgcacgacgccatgaagggcctgggcaccaaggagggcgtgatcatcgagatcctggccagcagaaccaagaaccagctgagagagatcatgaaggcctacgaggaggactacggcagcagcctggaggaggacatccaggccgacaccagcggctacctggagagaatcctggtgtgcctgctgcagggcagcagagacgacgtgagcagcttcgtggaccccggcctggccctgcaggacgcccaggacctgtacgccgccggcgagaagatcagaggcaccgacgagatgaagttcatcaccatcctgtgcaccagaagcgccacccacctgctgagagtgttcgaggagtacgagaagatcgccaacaagagcatcgaggacagcatcaagagcgagacccacggcagcctggaggaggccatgctgaccgtggtgaagtgcacccagaacctgcacagctacttcgccgagagactgtactacgccatgaagggcgccggcaccagagacggcaccctgatcagaaacatcgtgagcagaagcgagatcgacctgaacctgatcaagtgccacttcaagaagatgtacggcaagaccctgagcagcatgatcatggaggacaccagcggcgactacaagaacgccctgctgagcctggtgggcagcgacccctag

SEQ ID NO: 18009 - DNA, 798 bp, Artificial Sequence
  Description of Artificial Sequence: Synthetic coding sequence
atggcctggtggaagagctgggacctgaccgagaccctgaagagcgagctgagcggcaagttcgagagactgatcgtggccctgatgtaccccccctacagatacgaggccaaggagctgcacgacgccatgaagggcctgggcaccaaggagggcgtgatcatcgagatcctggccagcagaaccaagaaccagctgagagagatcatgaaggcctacgaggaggactacggcagcagcctggaggaggacatccaggccgacaccagcggctacctggagagaatcctggtgtgcctgctgcagggcagcagagacgacgtgagcagcttcgtggaccccggcctggccctgcaggacgcccaggacctgtacgccgccggcgagaagatcagaggcaccgacgagatgaagttcatcaccatcctgtgcaccagaagcgccacccacctgctgagagtgttcgaggagtacgagaagatcgccaacaagagcatcgaggacagcatcaagagcgagacccacggcagcctggaggaggccatgctgaccgtggtgaagtgcacccagaacctgcacagctacttcgccgagagactgtactacgccatgaagggcgccggcaccagagacggcaccctgatcagaaacatcgtgagcagaagcgagatcgacctgaacctgatcaagtgccacttcaagaagatgtacggcaagaccctgagcagcatgatcatggaggacaccagcggcgactacaagaacgccctgctgagcctggtgggcagcgacccctag

SEQ ID NO: 18010 - DNA, 426 bp, Artificial Sequence
  Description of Artificial Sequence: Synthetic coding sequence
atggcctggtggaagagctggatcgagcaggagggcgtgaccgtgaagagcagcagccacttcaaccccgaccccgacgccgagaccctgtaccaggccatgaagggcatcggcaccaacgagcaggccatcatcgacgtgctgaccaagagaagcaacacccagagacagcagatcgccaagagcttcaaggcccagttcggcaaggacctgaccgagaccctgaagagcgagctgagcggcaagttcgagagactgatcgtggccctgatgtaccccccctacagatacgaggccaaggagctgcacgacgccatgaagggcctgggcaccaaggagggcgtgatcatcgagatcctggccagcagaaccaagaaccagctgagagagatcatgaaggcctacgaggagggccagcagggctag

SEQ ID NO: 18011 - DNA, 831 bp, Artificial Sequence
  Description of Artificial Sequence: Synthetic coding sequence
atggcctggtggaaggcctggatcgagcaggagggcgtgaccgtgaagagcagcagccacttcaaccccgaccccgacgccgagaccctgtacaaggccatgaagggcatcggcgtgggcagccagctgctgagccaccaggccgccgccttcgccttccccagcagcgccctgaccagcgtgagcccctggggccagcagggccacctgtgctgcaaccccgccggcaccaacgagcaggccatcatcgacgtgctgaccaagagaagcaacacccagagacagcagatcgccaagagcttcaaggcccagttcggcaaggacctgaccgagaccctgaagagcgagctgagcggcaagttcgagagactgatcgtggccctgatgtaccccccctacagatacgaggccaaggagctgcacgacgccatgaagggcagcagagacgacgtgagcagcttcgtggaccccgccctggccctgcaggacgcccaggacctgtacgccgccggcgagaacatcagaggcaccgacgagatgaagttcatcaccatcctgtgcaccagaagcgccacccacctgctgagagtgaagtgcacccagaacctgcacagctacttcgccgagagactgtactacgccatgaagggcgccggcaccagagacggcaccctgatcagaaacatcgtgagcagaagcgagatcgacctgaacctgatcaagtgccacttcaagaagatgtacggcaagaccctgagcagcatgatcatggaggacaccagcggcgactacaagaacgccctgctgagcctggtgggcagcgacccctag

SEQ ID NO: 18012 - DNA, 984 bp, Artificial Sequence
  Description of Artificial Sequence: Synthetic coding sequence
atggcctggtggaaggcctggatcgagcaggagggcgtgaccgtgaagagcagcagccacttcaaccccgaccccgacgccgagaccctgtacaaggccatgaagggcatcggcaccaacgagcaggccatcatcgacgtgctgaccaagagaagcaacacccagagacagcagatcgccaagagcttcaaggcccagttcggcaaggacctgaccgagaccctgaagagcgagctgagcggcaagttcgagagactgatcgtggccctgatgtaccccccctacagatacgaggccaaggagctgcacgacgccatgaagggcctgggcaccaaggagggcgtgatcatcgagatcctggccagcagaaccaagaaccagctgagagagatcatgaaggcctacgaggaggactacggcagcagcctggaggaggacatccaggccgacaccagcggctacctggagagaatcctggtgtgcctgctgcagggcagcagagacgacgtgagcagcttcgtggaccccgccctggccctgcaggacgcccaggacctgtacgccgccggcgagaacatcagaggcaccgacgagatgaagttcatcaccatcctgtgcaccagaagcgccacccacctgctgagagtgttcgaggagtacgagaagatcgccaacaagagcatcgaggacagcatcaagagcgagacccacggcagcctggaggaggccatgctgaccgtggtgaagtgcacccagaacctgcacagctacttcgccgagagactgtactacgccatgaagggcgccggcaccagagacggcaccctgatcagaaacatcgtgagcagaagcgagatcgacctgaacctgatcaagtgccacttcaagaagatgtacggcaagaccctgagcagcatgatcatggaggacaccagcggcgactacaagaacgccctgctgagcctggtgggcagcgacccctag

SEQ ID NO: 18013 - DNA, 426 bp, Artificial Sequence
  Description of Artificial Sequence: Synthetic coding sequence
atggcctggtggaaggcctggatcgagcaggagggcgtgaccgtgaagagcagcagccacttcaaccccgaccccgacgccgagaccctgtacaaggccatgaagggcatcggcaccaacgagcaggccatcatcgacgtgctgaccaagagaagcaacacccagagacagcagatcgccaagagcttcaaggcccagttcggcaaggacctgaccgagaccctgaagagcgagctgagcggcaagttcgagagactgatcgtggccctgatgtaccccccctacagatacgaggccaaggagctgcacgacgccatgaagggcctgggcaccaaggagggcgtgatcatcgagatcctggccagcagaaccaagaaccagctgagagagatcatgaaggcctacgaggagggccagcagggctag

SEQ ID NO: 18014 - DNA, 798 bp, Artificial Sequence
  Description of Artificial Sequence: Synthetic coding sequence
atggcctggtggaaggcctgggacctgaccgagaccctgaagagcgagctgagcggcaagttcgagagactgatcgtggccctgatgtaccccccctacagatacgaggccaaggagctgcacgacgccatgaagggcctgggcaccaaggagggcgtgatcatcgagatcctggccagcagaaccaagaaccagctgagagagatcatgaaggcctacgaggaggactacggcagcagcctggaggaggacatccaggccgacaccagcggctacctggagagaatcctggtgtgcctgctgcagggcagcagagacgacgtgagcagcttcgtggaccccgccctggccctgcaggacgcccaggacctgtacgccgccggcgagaacatcagaggcaccgacgagatgaagttcatcaccatcctgtgcaccagaagcgccacccacctgctgagagtgttcgaggagtacgagaagatcgccaacaagagcatcgaggacagcatcaagagcgagacccacggcagcctggaggaggccatgctgaccgtggtgaagtgcacccagaacctgcacagctacttcgccgagagactgtactacgccatgaagggcgccggcaccagagacggcaccctgatcagaaacatcgtgagcagaagcgagatcgacctgaacctgatcaagtgccacttcaagaagatgtacggcaagaccctgagcagcatgatcatggaggacaccagcggcgactacaagaacgccctgctgagcctggtgggcagcgacccctag

SEQ ID NO: 18015 - DNA, 306 bp, Artificial Sequence
  Description of Artificial Sequence: Synthetic coding sequence
tgacacgtgcacctgggcttcatcatcgccttcgagaacgtggtgttcttcttcctgtgccccaacgacagactggtgcccgacgtgcccgccctggccaccaagatcaccgccagagccctgcccggccaggccggcggcggcagacagcccggcgacgccgtgagcgtgagcaagctgagaatctgggccgtgagccagggcagaagcggcagctggatgagaggcctggagttccccggcgacctgcagacctgcaccgccaccctgccctgcagctgcctgctggccagcgtgcagtgctag

SEQ ID NO: 18016 - DNA, 777 bp, Artificial Sequence
  Description of Artificial Sequence: Synthetic coding sequence
atgcccagacccagaagagtgagccagctgctggacctgtgcctgtggtgcttcatgaagaacatcagcagatacctgaccgacatcaagcccctgccccccaacatcaaggacagactgatcaagatcatgagcatgcagggccagatcaccgacagcaacatcagcgagatcctgcaccccgaggtgcagaccctggacctgagaagctgcgacatcagcgacgccgccctgctgcacctgagcaactgcagaaagctgaagaagctgaacctgaacgccagcaagggcaacagagtgagcgtgaccagcgagggcatcaaggccgtggccagcagctgcagctacctgcacgaggccagcctgaagagatgctgcaacctgaccgacgagggcgtggtggccctggccctgaactgccagctgctgaagatcatcgacctgggcggctgcctgagcatcaccgacgtgagcctgcacgccctgggcaagaactgccccttcctgcagtgcgtggacttcagcgccacccaggtgagcgacagcggcgtgatcgccctggtgagcggcccctgcgccaagaagctggaggagatccacatgggccactgcgtgaacctgaccgacggcgccgtggaggccgtgctgacctactgcccccagatcagaatcctgctgttccacggctgccccctgatcaccgaccacagcagagaggtgctggagcagctggtgggccccaacaagctgaagcaggtgacctggaccgtgtactag

SEQ ID NO: 18017 - DNA, 588 bp, Artificial Sequence
  Description of Artificial Sequence: Synthetic coding sequence
atgggcgccgccgtgttcttcggctgcaccttcgtggccttcggccccgccttcgccctgttcctgatcaccgtggccggcgaccccctgagagtgatcatcctggtggccggcagatgcagcgccctgcccaccaccagctgcctgatcagcggcctgagcttcggcatcatcagcggcgtgttcagcgtgatcaacatcctggccgacgccctgggccccggcgtggtgggcatccacggcgacagcccctactacttcctgaccagcgccttcctgaccgccgccatcatcctgctgcacaccttctggggcgtggtgttcttcgacgcctgcgagagaagaagatactgggccctgggcctggtggtgggcagccacctgctgaccagcggcctgaccttcctgaacccctggtacgaggccagcctgctgcccatctacgccgtgaccgtgagcatgggcctgtgggccttcatcaccgccggcggcagcctgagaagcatccagagaagcctgctgtgcagaagacaggaggacagcagagtgatggtgtacagcgccctgagaatcccccccgaggactag

SEQ ID NO: 18018 - DNA, 495 bp, Artificial Sequence
  Description of Artificial Sequence: Synthetic coding sequence
atggaggaggaggccgagaccgaggagcagcagagattcagctaccagcagagactgaaggccgccgtgcactacaccgtgggctgcctgtgcgaggaggtggccctggacaaggagatgcagttcagcaagcagaccatcgccgccatcagcgagctgaccttcagacagtgcgagaacttcgccaaggacctggagatgttcgccagacacgccaagagaaccaccatcaacaccgaggacgtgaagctgctggccagaagaagcaacagcctgcacatgcaggaggccgccggcatcagaaagagcagcctgctgaccttcctggcctggtggttcgagtggaccagccaggccagcgccggccccctgatcggcgaggaggccagagaggtggccagaagacaggagggcgcccccccccagcagagcgccagaagagacagaatgccctgcagaaacttcttctggaagaccttcagcagctgcaagtag

SEQ ID NO: 18019 - DNA, 234 bp, Artificial Sequence
  Description of Artificial Sequence: Synthetic coding sequence
atggaggaggaggccgagaccgaggagcagcagagattcagctaccagcagagactgaaggccgccgtgcactacaccgtgggctgcctgtgcgaggaggtggccctggacaaggagatgcagttcagcaagcagaccatcgccgccatcagcgagctgaccttcagacagtgcgagaacttcgccaaggacctggagatgttcgccagcatctgcagaaagagacaggagtag

SEQ ID NO: 18020 - DNA, 600 bp, Artificial Sequence
  Description of Artificial Sequence: Synthetic coding sequence
atggaggccagccccgccagcggccccagacacctgatggacccccacatcttcaccagcaacttcaacaacggcatcggcagacacaagacctacctgtgctacgaggtggagagactggacaacggcaccagcgtgaagatggaccagcacagaggcttcctgcacaaccaggccaagaacctgctgtgcggcttctacggcagacacgccgagctgagattcctggacctggtgcccagcctgcagctggaccccgcccagatctacagagtgacctggttcatcagctggagcccctgcttcagctggggctgcgccggcgaggtgagagccttcctgcaggagaacacccacgtgagactgagaatcttcgccgccagaatctacgactacgaccccctgtacaaggaggccctgcagatgctgagagacgccggcgcccaggtgagcatcatgacctacgacgagttcaagcactgctgggacaccttcgtggaccaccagggctgccccttccagccctgggacggcctggacgagcacagccaggccctgagcggcagactgagagccatcctgcagaaccagggcaactag

SEQ ID NO: 18021 - DNA, 1161 bp, Artificial Sequence
  Description of Artificial Sequence: Synthetic coding sequence
atgcacgccagaggcccccacggccagctgagccccgccctgcccctggccagcagcgtgctgatgctgctgatgagcaccctgtggctggtgggcgccggccccggcctggtgctggcccccgagctgctgctggacccctggcaggtgcacagactgctgacccacgccctgggccacaccgccctgcccggcctgctgctgagcctgctgctgctgcccaccgtgggctggcagcaggagtgccacctgggcaccctgagattcctgcacgccagcgccctgctggccctggccagcggcctgctggccgtgctgctggccggcctgggcctgagcagcgccgccggcagctgcggctacatgcccgtgcacctggccatgctggccggcgagggccacagacccagaagacccagaggcgccctgcccccctggctgagcccctggctgctgctggccctgacccccctgctgagcagcgagccccccttcctgcagctgctgtgcggcctgctggccggcctggcctacgccgccggcgccttcagatggctggagcccagcgagagaagactgcaggtgctgcaggagggcgtgctgtgcagaaccctggccggctgctggcccctgagactgctggccacccccggcagcctggccgagctgcccgtgacccaccccgccggcgtgagaccccccatccccggccccccctacgtggccagccccgacctgtggagccactgggaggacagcgccctgcccccccccagcctgagacccgtgcagcccacctgggagggcagcagcgaggccggcctggactgggccggcgccagcttcagccccggcacccccatgtgggccgccctggacgagcagatgctgcaggagggcatccaggccagcctgctggacggccccgcccaggagccccagagcgccccctggctgagcaagagcagcgtgagcagcctgagactgcagcagctggagagaatgggcttccccaccgagcaggccgtggtggccctggccgccaccggcagagtggagggcgccgtgagcctgctggtgggcggccaggtgggcaccgagaccctggtgacccacggcaagggcggccccgcccacagcgagggccccggccccccctag

SEQ ID NO: 18022 - DNA, 1161 bp, Artificial Sequence
  Description of Artificial Sequence: Synthetic coding sequence
atgaacccccagatcagaaaccccatggagagaatgtacagagacaccttctacgacaacttcgagaacgagcccatcctgtacggcagaagctacacctggctgtgctacgaggtgaagatcaagagaggcagaagcaacctgctgtgggacaccggcgtgttcagaggccccgtgctgcccaagagacagagcaaccacagacaggaggtgtacttcagattcgagaaccacgccgagatgtgcttcctgagctggttctgcggcaacagactgcccgccaacagaagattccagatcacctggttcgtgagctggaacccctgcctgccctgcgtggtgaaggtgaccaagttcctggccgagcaccccaacgtgaccctgaccatcagcgccgccagactgtactactacagagacagagactggagatgggtgctgctgagactgcacaaggccggcgccagagtgaagatcatggactacgaggacttcgcctactgctgggagaacttcgtgtgcaacgagggccagcccttcatgccctggtacaagttcgacgacaactacgccagcctgcacagaaccctgaaggagatcctgagaaaccccatggaggccatgtacccccacatcttctacttccacttcaagaacctgctgaaggcctgcggcagaaacgagagctggctgtgcttcaccatggaggtgaccaagcaccacagcgccgtgttcagaaagagaggcgtgttcagaaaccaggtggaccccgagacccactgccacgccgagagatgcttcctgagctggttctgcgacgacatcctgagccccaacaccaactacgaggtgacctggtacaccagctggagcccctgccccgagtgcgccggcgaggtggccgagttcctggccagacacagcaacgtgaacctgaccatcttcaccgccagactgtgctacttctgggacaccgactaccaggagggcctgtgcagcctgagccaggagggcgccagcgtgaagatcatgggctacaaggacttcgtgagctgctggaagaacttcgtgtacagcgacgacgagcccttcaagccctggaagggcctgcagaccaacttcagactgctgaagagaagactgagagagatcctgcagtag

SEQ ID NO: 18023 - DNA, 609 bp, Artificial Sequence
  Description of Artificial Sequence: Synthetic coding sequence
atgaacccccagatcagaaaccccatggagagaatgtacagagacaccttctacgacaacttcgagaacgagcccatcctgtacggcagaagctacacctggctgtgctacgaggtgaagatcaagagaggcagaagcaacctgctgtgggacaccggcgtgttcagaggccccgtgctgcccaagagacagagcaaccacagacaggaggtggaccccgagacccactgccacgccgagagatgcttcctgagctggttctgcgacgacatcctgagccccaacaccaactacgaggtgacctggtacaccagctggagcccctgccccgagtgcgccggcgaggtggccgagttcctggccagacacagcaacgtgaacctgaccatcttcaccgccagactgtgctacttctgggacaccgactaccaggagggcctgtgcagcctgagccaggagggcgccagcgtgaagatcatgggctacaaggacttcgtgagctgctggaagaacttcgtgtacagcgacgacgagcccttcaagccctggaagggcctgcagaccaacttcagactgctgaagagaagactgagagagatcctgcagtag

SEQ ID NO: 18024 - DNA, 3210 bp, Artificial Sequence
  Description of Artificial Sequence: Synthetic coding sequence
atggacttcctgagactgtacctgcccggcctgcaccaggccctgagaggcgccctggacagcctgggcaccttcgtgagctacctgctgggcgacgccgtgcccaccgtggagagagaggcccaggccgccgaggagctgggcgtggtggccgtgggcaagaccggcaagatcgtggaggaggaggcccaggaggacctggagggcctgagaggcagccagaacgagggcgccggcagactgagaggccccggcgacgacagaagacacgaggtgggcagcagcgccgtggagcagacctggggctggggcgacggcagcagccacggcagccaggccgagagacaggacagcggcgccggcgagaccgccaaggccgccagatgccaggagcccagcgcccacctggaggccagaaagaagagcaaggccggcagcggcgcctgccaggacagaagcggccaggcccaggagagacaggagagccacgagcaggaggtgaacagagaggagagactgagaagctgggagcaggaggaggaggaggaggaggtgagagccagagagcccggcatggccagaggcgccgagagcgagtggacctggcacggcgagaccgagggcaaggccggcgccgtgggccccaaggccgccggcgacaacagagagatggagcagggcgtgagagaggccgacgccggcgagaccgaggagcccggcgccgagggcgccggcaagggcgaggaggtggtggtggtggagaaggcctgcgagagcaccagagcctggggcacctggggccccggcgccgagcccgaggactggggcatcctgggcagagaggaggccagaaccacccccggcagagaggaggccagagccatcctggacggcgaggaggccagaaccatcagcggcggcgaggaggccgagaccgccagcggcggcgaggaggccgagaccgccagcggcggcgaggaggccggcaccgccagcggcggcgaggaggccggcatcgccagcggcggcgaggccggcaccgccagcggcggcgaggaggccggcaccgccagcggcggcgacgaggcctggaccaccagcggcaaggaggaggccgacctgctgggcgtgagacagaccgagtacggcgccgtgcccggcgagagactgctggaggccaccggcaaggtgtgggtgctggaggaggagggcgacgaggagagagaggccgaggtgagccccttccccaagcagccccaggtgctgggcaccgagagaaccgaggaggccgccgagagccagaccgccggcagagaggccgtgggcggccaggaggccggcgagagcttcgagggccaggtggacctgagaggcaaggaggccgagatgagacaggacctgggcatcagagccgacagagccagaatggaggagctggtgcaggccgaggaggcccaggaggagagaggcagcagcagagaccccgtggccgagctgcccagcgacggcgaggccgagggcaccgccgacctggaggccacccccgaggccagacccgaggaggagctgaccggcgaggagagcgaggccgcccagaccagctgcggcctgctgggcgtggagtggggcggcctgacccacagcgtgaccaagggccagggccccgagctgatgggcggcgcccagacccccaccaagcagcccgaggagagagaggccggcgaggtggagctgatgggcgtgctggccctgagcaaggaggagcaggagagaagcctggaggccggccccagacacgccggcagcgtgaagcccgaggccagcgaggccttccccggcgcctgggagaacagaaccagaaaggacatggagagaggcaacacccaggaggacgccgccgacggcgagcagagagaggaggaggagaccgccggcggccagaccctggccgccgaggccgagggcgacagagagagcgagctgagcgaggtgcccgaggccggcggcgagggcctgaccacccaggacgccggctgcggcaccgaggagggcgaggccagcgtgagcgagaaccaggagctggacggcagcaccggcgccgacgccggcccctgccccagcctgggcgaggcctacgccagagagaccgaggacgaggaggccgaggccgacagaaccagcagaagaggctggagactgcaggccgtggccgtgggcctgcccgacagagaggacgcccagaccggcagcgtggccgccggcatcatgggcggcgacgtggtgccccacatcagcgccgccggcgccggcgaggccctggagggcgtgctgggccagggctgggacagcaaggagaaggaggaggccgccgccggcgagcacgccggcggccaggagttcggcctggagggcagcgccgaggaggaggtgaccggcagaggcagccaggtggaggccttcgagagcagagagggcggcccctggggcggcagagtggaggccgaggagagcgccggcgccgaggacagctgcggcctggaccccgccggcagccagaccgccagagccgagggcatgggcgccatggtggaggccggcggcctgctggagaagtggaccctgctggaggaggaggccgtgggctggcaggagagagagcagagagaggacagcgagggcagatgcggcgactaccaccccgagggcgaggcccccagactgctggacgccgagggcctgatggtgaccggcggcagaagagccgaggccaaggagaccgagcccgagagcctggagcacgtgagaggccaggaggagcagcccacccaccaggcccccgccgaggccgcccccgagagcgtgggcgaggccgagaccgccgaggccatgggcagcgccagaggcggcgccgccaacagctggagcgaggcccccctgcccggcagcctgctggacgtgagcgtgcccagaagcagagtgcacctgagcagaagcagcagccagagaagaagcagacccagcttcagaagaacccccgcctgggagcagcaggaggagccccccgcccccaacccccccgaggaggagctgagcgcccccgagcagagacccctgcagctggaggagcccctggagcccagatgggaggacagactgagacccggcgtgagagaccagcccggccagcacagcaagatccccatcttctag

SEQ ID NO: 18025 - DNA, 3267 bp, Artificial Sequence
  Description of Artificial Sequence: Synthetic coding sequence
atggacttcctgagactgtacctgcccggcctgcaccaggccctgagaggcgccctggacagcctgggcaccttcgtgagctacctgctgggcgacgccgtgcccaccgtggagagagaggcccaggccgccgaggagctgggcgtggtggccgtgggcaagaccggcaagatcgtggaggaggaggcccaggaggacctggagggcctgagaggcagccagaacgagggcgccggcagactgagaggccccggcgacgacagaagacacgaggtgggcagcagcgccgtggagcagacctggggctggggcgacggcagcagccacggcagccaggccgagagacaggacagcggcgccggcgagaccgccaaggccgccagatgccaggagcccagcgcccacctggaggccagaaagaagagcaaggccggcagcggcgcctgccaggacagaagcggccaggcccaggagagacaggagagccacgagcaggaggtgaacagagaggagagactgagaagctgggagcaggaggaggaggaggaggaggtgagagccagagagcccggcatggccagaggcgccgagagcgagtggacctggcacggcgagaccgagggcaaggccggcgccgtgggccccaaggccgccggcgacaacagagagatggagcagggcgtgagagaggccgacgccggcgagaccgaggagcccggcgccgagggcgccggcaagggcgaggaggtggtggtggtggagaaggcctgcgagagcaccagagcctggggcacctggggccccggcgccgagcccgaggactggggcatcctgggcagagaggaggccagaaccacccccggcagagaggaggccagagccatcctggacggcgaggaggccagaaccatcagcggcggcgaggaggccgagaccgccagcggcggcgaggaggccgagaccgccagcggcggcgaggaggccggcaccgccagcggcggcgaggaggccggcatcgccagcggcggcgaggccggcaccgccagcggcggcgaggaggccggcaccgccagcggcggcgacgaggcctggaccaccagcggcaaggaggaggccgacctgctgggcgtgagacagaccgagtacggcgccgtgcccggcgagagactgctggaggccaccggcaaggtgtgggtgctggaggaggagggcgacgaggagagagaggccgaggtgagccccttccccaagcagccccaggtgctgggcaccgagagaaccgaggaggccgccgagagccagaccgccggcagagaggccgtgggcggccaggaggccggcgagagcttcgagggccaggtggacctgagaggcaaggaggccgagatgagacaggacctgggcatcagagccgacagagccagaatggaggagctggtgcaggccgaggaggcccaggaggagagaggcagcagcagagaccccgtggccgagctgcccagcgacggcgaggccgagggcaccgccgacctggaggccacccccgaggccagacccgaggaggagctgaccggcgaggagagcgaggccgcccagaccagctgcggcctgctgggcgtggagtggggcggcctgacccacagcgtgaccaagggccagggccccgagctgatgggcggcgcccagacccccaccaagcagcccgaggagagagaggccggcgaggtggagctgatgggcgtgctggccctgagcaaggaggagcaggagagaagcctggaggccggccccagacacgccggcagcgtgaagcccgaggccagcgaggccttccccggcgcctgggagaacagaaccagaaaggacatggagagaggcaacacccaggaggacgccgccgacggcgagcagagagaggaggaggagaccgccggcggccagaccctggccgccgaggccgagggcgacagagagagcgagctgagcgaggtgcccgaggccggcggcgagggcctgaccacccaggacgccggctgcggcaccgaggagggcgaggccagcgtgagcgagaaccaggagctggacggcagcaccggcgccgacgccggcccctgccccagcctgggcgaggcctacgccagagagaccgaggacgaggaggccgaggccgacagaaccagcagaagaggctggagactgcaggccgtggccgtgggcctgcccgacagagaggacgcccagaccggcagcgtggccgccggcatcatgggcggcgacgtggtgccccacatcagcgccgccggcgccggcgaggccctggagggcgtgctgggccagggctgggacagcaaggagaaggaggaggccgccgccggcgagcacgccggcggccaggagttcggcctggagggcagcgccgaggaggaggtgaccggcagaggcagccaggtggaggccttcgagagcagagagggcggcccctggggcggcagagtggaggccgaggagagcgccggcgccgaggacagctgcggcctggaccccgccggcagccagaccgccagagccgagggcatgggcgccatggtggaggccggcggcctgctggagaagtggaccctgctggaggaggaggccgtgggctggcaggagagagagcagagagaggacagcgagggcagatgcggcgactaccaccccgagggcgaggcccccagactgctggacgccgagggcctgatggtgaccggcggcagaagagccgaggccaaggagaccgagcccgagagcctggagcacgtgagaggccaggaggagcagcccacccaccaggcccccgccgaggccgcccccgagagcgtgggcgaggccgagaccgccgaggccatgggcagcgccagaggcggcgccgccaacagctggagcgaggcccccctgcccggcagcctgctggacgtgagcgtgcccagaagcagagtgcacctgagcagaagcagcagccagagaagaagcagacccagcttcagaagaacccccgcctgggagcagcaggaggagccccccgcccccaacccccccgaggaggagctgagcgcccccgagcagagacccctgcagctggaggagcccctggagcccagccccctgagacacgacggcacccccgtgcccgccagaagaagacccctgggccacggcttcggcctggcccaccccggcatgatgcaggagctgcaggccagactgggcagacccaagccccagtag

SEQ ID NO: 18026 - DNA, 3294 bp, Artificial Sequence
  Description of Artificial Sequence: Synthetic coding sequence
atggacttcctgagactgtacctgcccggcctgcaccaggccctgagaggcgccctggacagcctgggcaccttcgtgagctacctgctgggcgacgccgtgcccaccgtggagagagaggcccaggccgccgaggagctgggcgtggtggccgtgggcaagaccggcaagatcgtggaggaggaggcccaggaggacctggagggcctgagaggcagccagaacgagggcgccggcagactgagaggccccggcgacgacagaagacacgaggtgggcagcagcgccgtggagcagacctggggctggggcgacggcagcagccacggcagccaggccgagagacaggacagcggcgccggcgagaccgccaaggccgccagatgccaggagcccagcgcccacctggaggccagaaagaagagcaaggccggcagcggcgcctgccaggacagaagcggccaggcccaggagagacaggagagccacgagcaggaggtgaacagagaggagagactgagaagctgggagcaggaggaggaggaggaggaggtgagagccagagagcccggcatggccagaggcgccgagagcgagtggacctggcacggcgagaccgagggcaaggccggcgccgtgggccccaaggccgccggcgacaacagagagatggagcagggcgtgagagaggccgacgccggcgagaccgaggagcccggcgccgagggcgccggcaagggcgaggaggtggtggtggtggagaaggcctgcgagagcaccagagcctggggcacctggggccccggcgccgagcccgaggactggggcatcctgggcagagaggaggccagaaccacccccggcagagaggaggccagagccatcctggacggcgaggaggccagaaccatcagcggcggcgaggaggccgagaccgccagcggcggcgaggaggccgagaccgccagcggcggcgaggaggccggcaccgccagcggcggcgaggaggccggcatcgccagcggcggcgaggccggcaccgccagcggcggcgaggaggccggcaccgccagcggcggcgaggaggccggcaccgccagcggcggcgacgaggcctggaccaccagcggcaaggaggaggccgacctgctgggcgtgagacagaccgagtacggcgccgtgcccggcgagagactgctggaggccaccggcaaggtgtgggtgctggaggaggagggcgacgaggagagagaggccgaggtgagccccttccccaagcagccccaggtgctgggcaccgagagaaccgaggaggccgccgagagccagaccgccggcagagaggccgtgggcggccaggaggccggcgagagcttcgagggccaggtggacctgagaggcaaggaggccgagatgagacaggacctgggcatcagagccgacagagccagaatggaggagctggtgcaggccgaggaggcccaggaggagagaggcagcagcagagaccccgtggccgagctgcccagcgacggcgaggccgagggcaccgccgacctggaggccacccccgaggccagacccgaggaggagctgaccggcgaggagagcgaggccgcccagaccagctgcggcctgctgggcgtggagtggggcggcctgacccacagcgtgaccaagggccagggccccgagctgatgggcggcgcccagacccccaccaagcagcccgaggagagagaggccggcgaggtggagctgatgggcgtgctggccctgagcaaggaggagcaggagagaagcctggaggccggccccagacacgccggcagcgtgaagcccgaggccagcgaggccttccccggcgcctgggagaacagaaccagaaaggacatggagagaggcaacacccaggaggacgccgccgacggcgagcagagagaggaggaggagaccgccggcggccagaccctggccgccgaggccgagggcgacagagagagcgagctgagcgaggtgcccgaggccggcggcgagggcctgaccacccaggacgccggctgcggcaccgaggagggcgaggccagcgtgagcgagaaccaggagctggacggcagcaccggcgccgacgccggcccctgccccagcctgggcgaggcctacgccagagagaccgaggacgaggaggccgaggccgacagaaccagcagaagaggctggagactgcaggccgtggccgtgggcctgcccgacagagaggacgcccagaccggcagcgtggccgccggcatcatgggcggcgacgtggtgccccacatcagcgccgccggcgccggcgaggccctggagggcgtgctgggccagggctgggacagcaaggagaaggaggaggccgccgccggcgagcacgccggcggccaggagttcggcctggagggcagcgccgaggaggaggtgaccggcagaggcagccaggtggaggccttcgagagcagagagggcggcccctggggcggcagagtggaggccgaggagagcgccggcgccgaggacagctgcggcctggaccccgccggcagccagaccgccagagccgagggcatgggcgccatggtggaggccggcggcctgctggagaagtggaccctgctggaggaggaggccgtgggctggcaggagagagagcagagagaggacagcgagggcagatgcggcgactaccaccccgagggcgaggcccccagactgctggacgccgagggcctgatggtgaccggcggcagaagagccgaggccaaggagaccgagcccgagagcctggagcacgtgagaggccaggaggagcagcccacccaccaggcccccgccgaggccgcccccgagagcgtgggcgaggccgagaccgccgaggccatgggcagcgccagaggcggcgccgccaacagctggagcgaggcccccctgcccggcagcctgctggacgtgagcgtgcccagaagcagagtgcacctgagcagaagcagcagccagagaagaagcagacccagcttcagaagaacccccgcctgggagcagcaggaggagccccccgcccccaacccccccgaggaggagctgagcgcccccgagcagagacccctgcagctggaggagcccctggagcccagccccctgagacacgacggcacccccgtgcccgccagaagaagacccctgggccacggcttcggcctggcccaccccggcatgatgcaggagctgcaggccagactgggcagacccaagccccagtag

SEQ ID NO: 18027 - DNA, 384 bp, Artificial Sequence
  Description of Artificial Sequence: Synthetic coding sequence
atgagcctgctgagaaacagactgcaggccctgcccgccctgtgcctgtgcgtgctggtgctggcctgcatcggcgcctgccagcccgaggcccaggagggcaccctgagccccccccccaagctgaagatgagcagatggagcctggtgagaggcagaatgaaggagctgctggagaccgtggtgaacagaaccagagacggctggcagtggttctggagccccagcaccttcagaggcttcatgcagacctactacgacgaccacctgagagacctgggccccctgaccaaggcctggttcctggagagcaaggacagcctgctgaagaagacccacagcctgtgccccagactggtgtgcggcgacaaggaccagggctag

SEQ ID NO: 18028 - DNA, 924 bp, Artificial Sequence
  Description of Artificial Sequence: Synthetic coding sequence
atggccggcctgaacgtgagcctgagcttcttcttcgccaccttcaccctgtgcgaggccgccagaagagccagcaaggccctgctgcccgtgggcgcctacgaggtgttcgccagagaggccgtgggcgccgtgcagctgggcgcctgcttcctggagatgagaaccctggtggagctgggcccctgggccggcgacttcggccccgacctgctgctgaccctgctgttcctgctgttcctggcccacggcgtgaccctggacggcgccagcgccaaccccaccgtgagcctgcaggagttcctgatggccgaggagagcctgcccggcaccctgctgaagctggccgcccagggcctgggcatgcaggccgcctgcaccctgaccagactgtgctgggcctgggagctgagcgacctgcacctgctgcagagcctgatggcccagagctgcagcagcgccctgagaaccagcgtgccccacggcgccctggtggaggccgcctgcgccttctgcttccacctgaccctgctgcacctgagacacagcccccccgcctacagcggccccgccgtggccctgctggtgaccgtgaccgcctacaccgccggccccttcaccagcgccttcttcaaccccgccctggccgccagcgtgaccttcgcctgcagcggccacaccctgctggagtacgtgcaggtgtactggctgggccccctgaccggcatggtgctggccgtgctgctgcaccagggcagactgccccacctgttccagagaaacctgttctacggccagaagaacaagtacagagcccccagaggcaagcccgcccccgccagcggcgacacccagacccccgccaagggcagcagcgtgagagagcccggcagaagcggcgtggagggcccccacagcagctag

SEQ ID NO: 18029 - DNA, 1497 bp, Artificial Sequence
  Description of Artificial Sequence: Synthetic coding sequence
atgctgcagtgcagacccgcccaggagttcagcttcggccccagagccctgaaggacgccctggtgagcaccgacgccgccctgcagcagctgtacgtgagcgccttcagccccgccgagagactgttcctggccgaggcctacaacccccagagaaccctgttctgcaccctgctgatcagaaccggcttcgactggctgctgagcagacccgaggcccccgaggacttccagaccttccacgccagcctgcagcacagaaagcccagactggccagaaagcacatctacctgcagcccatcgacctgagcgaggagcccgtgggcagcagcctgctgcaccagctgtgcagctgcaccgaggccttcttcctgggcctgagagtgaagtgcctgcccagcgtggccgccgccagcatcagatgcagcagcagacccagcagagacagcgacagactgcagctgcacaccgacggcatcctgagcttcctgaagaacaacaagcccggcgacgccctgtgcgtgctgggcctgaccctgagcgacctgtacccccacgaggcctggagcttcaccttcagcaagttcctgcccggccacgaggtgggcgtgtgcagcttcgccagattcagcggcgagttccccaagagcggccccagcgcccccgacctggccctggtggaggccgccgccgacggccccgaggcccccctgcaggacagaggctgggccctgtgcttcagcgccctgggcatggtgcagtgctgcaaggtgacctgccacgagctgtgccacctgctgggcctgggcaactgcagatggctgagatgcctgatgcagggcgccctgagcctggacgaggccctgagaagacccctggacctgtgccccatctgcctgagaaagctgcagcacgtgctgggcttcagactgatcgagagataccagagactgtacacctggacccaggccgtggtgggcacctggcccagccaggaggccggcgagcccagcgtgtgggaggacaccccccccgccagcgccgacagcggcatgtgctgcgagagcgacagcgagcccggcaccagcgtgagcgagcccctgacccccgacgccggcagccacaccttcgccagcggccccgaggagggcctgagctacctggccgccagcgaggcccccctgccccccggcggccccgccgaggccatcaaggagcacgagagatggctggccatgtgcatccaggccctgcagagagaggtggccgaggaggacctggtgcaggtggacagagccgtggacgccctggacagatgggagatgttcaccggccagctgcccgccaccagacaggacccccccagcagcagagacagcgtgggcctgagaaaggtgctgggcgacaagttcagcagcctgagaagaaagctgagcgccagaaagctggccagagccgagagcgcccccagaccctgggacggcgaggagagctag

SEQ ID NO: 18030 - DNA, 909 bp, Artificial Sequence
  Description of Artificial Sequence: Synthetic coding sequence
atgcagatcatcagacacagcgagcagaccctgaagaccgccctgatcagcaagaaccccgtgctggtgagccagtacgagaagctgaacgccggcgagcagagactgatgaacgaggccttccagcccgccagcgacctgttcggccccatcaccctgcacagccccagcgactggatcaccagccaccccgaggccccccaggacttcgagcagttcttcagcgacccctacagaaagacccccagccccaacaagagaagcatctacatccagagcatcggcgacatcctgaagttcctgaagaagaagaagcccgaggacgccttctgcgtggtgggcatcaccatgatcgacctgtaccccagagacagctggaacttcgtgttcggccaggccagcctgaccgacggcgtgggcatcttcagcttcgccagatacggcagcgacttctacagcatgcactacaagggcaaggtgaagaagctgaagaagaccagcagcagcgactacagcatcttcgacaactactacatccccgagatcaccagcgtgctgctgctgagaagctgcaagaccctgacccacgagatcggccacatcttcggcctgagacactgccagtggctggcctgcctgatgcagggcagcaaccacctggaggaggccgacagaagacccctgaacctgtgccccatctgcctgcacaagctgcagtgcgccgtgggcttcagcatcgtggagagatacaaggccctggtgagatggatcgacgacgagagcagcgacacccccggcgccacccccgagcacagccacgaggacaacggcaacctgcccaagcccgtggaggccttcaaggagtggaaggagtggatcatcaagtgcctggccgtgctgcagaagtag

SEQ ID NO: 18031 - DNA, 1083 bp, Artificial Sequence
  Description of Artificial Sequence: Synthetic coding sequence
atgcagatcatcagacacagcgagcagaccctgaagaccgccctgatcagcaagaaccccgtgctggtgagccagtacgagaagctgaacgccggcgagcagagactgatgaacgaggccttccagcccgccagcgacctgttcggccccatcaccctgcacagccccagcgactggatcaccagccaccccgaggccccccaggacttcgagcagttcttcagcgacccctacagaaagacccccagccccaacaagagaagcatctacatccagagcatcggcagcctgggcaacaccagaatcatcagcgaggagtacatcaagtggctgaccggctactgcaaggcctacttctacggcctgagagtgaagctgctggagcccgtgcccgtgagcgtgaccagatgcagcttcagagtgaacgagaacacccacaacctgcagatccacgccggcgacatcctgaagttcctgaagaagaagaagcccgaggacgccttctgcgtggtgggcatcaccatgatcgacctgtaccccagagacagctggaacttcgtgttcggccaggccagcctgaccgacggcgtgggcatcttcagcttcgccagatacggcagcgacttctacagcatgcactacaagggcaaggtgaagaagctgaagaagaccagcagcagcgactacagcatcttcgacaactactacatccccgagatcaccagcgtgctgctgctgagaagctgcaagaccctgacccacgagatcggccacatcttcggcctgagacactgccagtggctggcctgcctgatgcagggcagcaaccacctggaggaggccgacagaagacccctgaacctgtgccccatctgcctgcacaagctgcagtgcgccgtgggcttcagcatcgtggagagatacaaggccctggtgagatggatcgacgacgagagcagcgacacccccggcgccacccccgagcacagccacgaggacaacggcaacctgcccaagcccgtggaggccttcaaggagtggaaggagtggatcatcaagtgcctggccgtgctgcagaagtag

SEQ ID NO: 18032 - DNA, 1083 bp, Artificial Sequence; identical to SEQ ID NO: 18031
  Description of Artificial Sequence: Synthetic coding sequence

SEQ ID NO: 18033 - DNA, 1083 bp, Artificial Sequence; identical to SEQ ID NO: 18031
  Description of Artificial Sequence: Synthetic coding sequence

SEQ ID NO: 18034 - DNA, 1083 bp, Artificial Sequence; identical to SEQ ID NO: 18031
  Description of Artificial Sequence: Synthetic coding sequence

SEQ ID NO: 18035 - DNA, 1083 bp, Artificial Sequence; identical to SEQ ID NO: 18031
  Description of Artificial Sequence: Synthetic coding sequence

SEQ ID NO: 18036 - DNA, 2505 bp, Artificial Sequence
  Description of Artificial Sequence: Synthetic coding sequence
atgaccgtggagttcgaggagtgcgtgaaggacagccccagattcagagccaccatcgacgaggtggagaccgacgtggtggagatcgaggccaagctggacaagctggtgaagctgtgcagcggcatggtggaggccggcaaggcctacgtgagcaccagcagactgttcgtgagcggcgtgagagacctgagccagcagtgccagggcgacaccgtgatcagcgagtgcctgcagagattcgccgacagcctgcaggaggtggtgaactaccacatgatcctgttcgaccaggcccagagaagcgtgagacagcagctgcagagcttcgtgaaggaggacgtgagaaagttcaaggagaccaagaagcagttcgacaaggtgagagaggacctggagctgagcctggtgagaaacgcccaggcccccagacacagaccccacgaggtggaggaggccaccggcgccctgaccctgaccagaaagtgcttcagacacctggccctggactacgtgctgcagatcaacgtgctgcaggccaagaagaagttcgagatcctggacagcatgctgagcttcatgcacgcccagagcagcttcttccagcagggctacagcctgctgcaccagctggacccctacatgaagaagctggccgccgagctggaccagctggtgatcgacagcgccgtggagaagagagagatggagagaaagcacgccgccatccagcagagaaccctgctgcaggacttcagctacgacgagagcaaggtggagttcgacgtggacgcccccagcggcgtggtgatggagggctacctgttcaagagagccagcaacgccttcaagacctggaacagaagatggttcagcatccagaacagccagctggtgtaccagaagaagctgaaggacgccctgaccgtggtggtggacgacctgagactgtgcagcgtgaagccctgcgaggacatcgagagaagattctgcttcgaggtgctgagccccaccaagagctgcatgctgcaggccgacagcgagaagctgagacaggcctgggtgcaggccgtgcaggccagcatcgccagcgcctacagagagagccccgacagctgctacagcgagagactggacagaaccgccagccccagcaccagcagcatcgacagcgccaccgacaccagagagagaggcgtgaagggcgagagcgtgctgcagagagtgcagagcgtggccggcaacagccagtgcggcgactgcggccagcccgaccccagatgggccagcatcaacctgggcgtgctgctgtgcatcgagtgcagcggcatccacagaagcctgggcgtgcactgcagcaaggtgagaagcctgaccctggacagctgggagcccgagctgctgaagctgatgtgcgagctgggcaacagcgccgtgaaccagatctacgaggcccagtgcgagggcgccggcagcagaaagcccaccgccagcagcagcagacaggacaaggaggcctggatcaaggacaagtacgtggagaagaagttcctgagaaaggcccccatggcccccgccctggaggcccccagaagatggagagtgcagaagtgcctgagaccccacagcagccccagagcccccaccgccagaagaaaggtgagactggagcccgtgctgccctgcgtggccgccctgagcagcgtgggcaccctggacagaaagttcagaagagacagcctgttctgccccgacgagctggacagcctgttcagctacttcgacgccggcgccgccggcgccggccccagaagcctgagcagcgacagcggcctgggcggcagcagcgacggcagcagcgacgtgctggccttcggcagcggcagcgtggtggacagcgtgaccgaggaggagggcgccgagagcgaggagagcagcggcgaggccgacggcgacaccgaggccgaggcctggggcctggccgacgtgagagagctgcaccccggcctgctggcccacagagccgccagagccagagacctgcccgccctggccgccgccctggcccacggcgccgaggtgaactgggccgacgccgaggacgagggcaagacccccctggtgcaggccgtgctgggcggcagcctgatcgtgtgcgagttcctgctgcagaacggcgccgacgtgaaccagagagacagcagaggcagagcccccctgcaccacgccaccctgctgggcagaaccggccaggtgtgcctgttcctgaagagaggcgccgaccagcacgccctggaccaggagcagagagaccccctggccatcgccgtgcaggccgccaacgccgacatcgtgaccctgctgagactggccagaatggccgaggagatgagagaggccgaggccgcccccggcccccccggcgccctggccggcagccccaccgagctgcagttcagaagatgcatccaggagttcatcagcctgcacctggaggagagctag

SEQ ID NO: 18037 - DNA, 2280 bp, Artificial Sequence
  Description of Artificial Sequence: Synthetic coding sequence
atggtggaggccggcaaggcctacgtgagcaccagcagactgttcgtgagcggcgtgagagacctgagccagcagtgccagggcgacaccgtgatcagcgagtgcctgcagagattcgccgacagcctgcaggaggtggtgaactaccacatgatcctgttcgaccaggcccagagaagcgtgagacagcagctgcagagcttcgtgaaggaggacgtgagaaagttcaaggagaccaagaagcagttcgacaaggtgagagaggacctggagctgagcctggtgagaaacgcccaggcccccagacacagaccccacgaggtggaggaggccaccggcgccctgaccctgaccagaaagtgcttcagacacctggccctggactacgtgctgcagatcaacgtgctgcaggccaagaagaagttcgagatcctggacagcatgctgagcttcatgcacgcccagagcagcttcttccagcagggctacagcctgctgcaccagctggacccctacatgaagaagctggccgccgagctggaccagctggtgatcgacagcgccgtggagaagagagagatggagagaaagcacgccgccatccagcagagaaccctgctgcaggacttcagctacgacgagagcaaggtggagttcgacgtggacgcccccagcggcgtggtgatggagggctacctgttcaagagagccagcaacgccttcaagacctggaacagaagatggttcagcatccagaacagccagctggtgtaccagaagaagctgaaggacgccctgaccgtggtggtggacgacctgagactgtgcagcgtgaagccctgcgaggacatcgagagaagattctgcttcgaggtgctgagccccaccaagagctgcatgctgcaggccgacagcgagaagctgagacaggcctgggtgcaggccgtgcaggccagcatcgccagcgcctacagagagagccccgacagctgctacagcgagagactggacagaaccgccagccccagcaccagcagcatcgacagcgccaccgacaccagagagagaggcgtgaagggcgagagcgtgctgcagagagtgcagagcgtggccggcaacagccagtgcggcgactgcggccagcccgaccccagatgggccagcatcaacctgggcgtgctgctgtgcatcgagtgcagcggcatccacagaagcctgggcgtgcactgcagcaaggtgagaagcctgaccctggacagctgggagcccgagctgctgaagctgatgtgcgagctgggcaacagcgccgtgaaccagatctacgaggcccagtgcgagggcgccggcagcagaaagcccaccgccagcagcagcagacaggacaaggaggcctggatcaaggacaagtacgtggagaagaagttcctgagaaaggcccccatggcccccgccctggaggcccccagaagatggagagtgcagaagtgcctgagaccccacagcagccccagagcccccaccgccagaagaaaggtgagactggagcccgtgctgccctgcgtggccgccctgagcagcgtgggcaccctggacagaaagttcagaagagacagcctgttctgccccgacgagctggacagcctgttcagctacttcgacgccggcgccgccggcgccggccccagaaagggcgccgagagcgaggagagcagcggcgaggccgacggcgacaccgaggccgaggcctggggcctggccgacgtgagagagctgcaccccggcctgctggcccacagagccgccagagccagagacctgcccgccctggccgccgccctggcccacggcgccgaggtgaactgggccgacgccgaggacgagggcaagacccccctggtgcaggccgtgctgggcggcagcctgatcgtgtgcgagttcctgctgcagaacggcgccgacgtgaaccagagagacagcagaggcagagcccccctgcaccacgccaccctgctgggcagaaccggccaggtgtgcctgttcctgaagagaggcgccgaccagcacgccctggaccaggagcagagagaccccctggccatcgccgtgcaggccgccaacgccgacatcgtgaccctgctgagactggccagaatggccgaggagatgagagaggccgaggccgcccccggcccccccggcgccctggccggcagccccaccgagctgcagttcagaagatgcatccaggagttcatcagcctgcacctggaggagagctag

SEQ ID NO: 18038 - DNA, 468 bp, Artificial Sequence
  Description of Artificial Sequence: Synthetic coding sequence
atggtgatggccgccaagaagggccccggccccggcggcggcgtgagcggcggcaaggccgaggccgaggccgccagcgaggtgtggtgcagaagagtgagagagctgggcggctgcagccaggccggcaacagacactgcttcgagtgcgcccagagaggcgtgacctacgtggacatcaccgtgggcagcttcgtgtgcaccacctgcagcggcctgctgagaggcctgaaccccccccacagagtgaagagcatcagcatgaccaccttcaccgagcccgaggtggtgttcctgcagagcagaggcaacgaggtgtgcagaaagatctggctgggcctgttcgacgccagaaccagcctggtgcccgacagcagagacccccagaaggtgaaggagttcctgcaggagaagtacgagaagaagagatggcccgacaccttccccagaagactgtgccagctgtag

SEQ ID NO: 18039 - DNA, 1446 bp, Artificial Sequence
  Description of Artificial Sequence: Synthetic coding sequence
atggtgatggccgccaagaagggccccggccccggcggcggcgtgagcggcggcaaggccgaggccgaggccgccagcgaggtgtggtgcagaagagtgagagagctgggcggctgcagccaggccggcaacagacactgcttcgagtgcgcccagagaggcgtgacctacgtggacatcaccgtgggcagcttcgtgtgcaccacctgcagcggcctgctgagaggcctgaaccccccccacagagtgaagagcatcagcatgaccaccttcaccgagcccgaggtggtgttcctgcagagcagaggcaacgaggtgtgcagaaagatctggctgggcctgttcgacgccagaaccagcctggtgcccgacagcagagacccccagaaggtgaaggagttcctgcaggagaagtacgagaagaagagatggtacgtgccccccgaccaggtgaagggccccacctacaccaagggcagcgccagcacccccgtgcagggcagcatccccgagggcaagcccctgagaaccctgctgggcgaccccgcccccagcctgagcgtggccgccagcaccagcagccagcccgtgagccagagccacgccagaaccagccaggccagaagcacccagccccccccccacagcagcgtgaagaaggccagcaccgacctgctggccgacatcggcggcgaccccttcgccgccccccagatggcccccgccttcgccgccttccccgccttcggcggccagacccccagccagggcggcttcgccaacttcgacgccttcagcagcggccccagcagcagcgtgttcggcagcctgccccccgccggccaggccagcttccaggcccagcccacccccgccggcagcagccagggcacccccttcggcgccacccccctggcccccgccagccagcccaacagcctggccgacgtgggcagcttcctgggccccggcgtgcccgccgccggcgtgcccagcagcctgttcggcatggccggccaggtgccccccctgcagagcgtgaccatgggcggcggcggcggcagcagcaccggcctggccttcggcgccttcaccaaccccttcaccgcccccgccgcccagagccccctgcccagcaccaaccccttccagcccaacggcctggcccccggccccggcttcggcatgagcagcgccggccccggcttcccccaggccgtgccccccaccggcgccttcgccagcagcttccccgcccccctgttccccccccagacccccctggtgcagcagcagaacggcagcagcttcggcgacctgggcagcgccaagctgggccagagacccctgagccagcccgccggcatcagcaccaaccccttcatgaccggccccagcagcagccccttcgccagcaagccccccaccaccaaccccttcctgtag

SEQ ID NO: 18040 - DNA, 1992 bp, Artificial Sequence
  Description of Artificial Sequence: Synthetic coding sequence
gagctgctgagaatcagccccgacctgctggccgccgccgtgatcagcgcccaggaggagcccctgaccaacatccagagagccagcggccccaccggcctgctgtggagcgtgagcctggagttcgaccagcagcagggcagcgtgtgccccagcgagagcgagatctacgaggccggcgccgaggacagaatggccggcgcccccatggccgccgccgtgcagcccgccgaggtgaccgtggaggtgggcgaggacctgcacatgcaccaggtgagagacagagagatgcccgaggccctggagttcaacctgagcgccaaccccgaggccagcaccatcttccagagaaacagccagaccgacgccctggagttcaacagcagcgccaaccccgaggccagcaccatcttccagagaaacagccagaccgacgtggtggagatcagaagaagcaactgcaccaaccacgtgagcaccgagagattcagccagcagtacagcagctgcagcaccatcttcctggacgacagcaccgccatccagcactacctgaccatgaccatcatcagcgtgaccctggagatcccccaccacatcacccagagagacgccgacagaagcctgagcatccccgacgagcagctgcacagcttcgccgtgagcaccgtgcacatcatgaagaagagaaacggcggcggcagcctgaacaactacagcagcagcatcccccccacccccagcaccagccaggaggacccccagttcagcgtgccccccaccgccaacacccccacccccgtgtgcaagctgagcatgagatggagcaacctgttcaccagcgagaagggcagcgaccccgacaaggagagaaaggcccccgagaaccacgccgacaccatcggcagcggcagagccatccccatcaagcagggcatgctgctgaagagaagcggcaagtggctgaagacctggaagaagaagtacgtgaccctgtgcagcaacggcgtgctgacctactacagcagcctgggcgactacatgaagaacatccacaagaaggagatcgacctgagaaccagcaccatcaaggtgcccggcaagtggcccagcctggccaccagcgcctgcgcccccatcagcagcagcaagagcaacggcctgagcaaggacatggacaccggcctgggcgacagcatctgcttcagccccggcatcagcagcaccaccagccccaagctgaaccccccccccagcccccacgccaacaagaagaagcacctgaagaagaagagcaccaacaacttcatgatcgtgagcgccaccggccagacctggcacttcgaggccaccacctacgaggagagagacgcctgggtgcaggccatccagagccagagcgaggccatggccctgcagagcatccagaacatgagaggcaacgcccactgcgtggactgcgagacccagaaccccaagtgggccagcctgaacctgggcgtgctgatgtgcatcgagtgcagcggcatccacagaagcttcggcaccagactgagcagagtgagaagcctggagctggacgactggcccgtggagctgagaaaggtgatgagcagcatcggcaacgagctggccaacagcatctgggagggcagcagccagggccagaccaagcccagcatcaagagcaccagagaggagaaggagtggtggatcagaagcaagtacgaggagaagctgttcctggcccccctgccctgcaccgagctgagcctgggccagcagctgctgagagccaccaccgacgaggacctgcagaccgccatcctgctgctggcccacggcagcagagaggaggtgaacgagacctgcggcgagggcgacggctgcaccgccctgcacctggcctgcagaaagggcaacgtggtgctggagcagctgctgaccggctggaccagctggcccgagatgcccaccggcacccagagatag

SEQ ID NO: 18041 - DNA, 2112 bp, Artificial Sequence
  Description of Artificial Sequence: Synthetic coding sequence
atgttcgaggacgtgttcagcgacagcggcaacaccggcaacttcgacagaggcaagaagagaagactgaccatcatcgagtgcggctgcgacatcaacatgatgatcgacctggccaaggtggccgacctggtgctgatgctgatcgacgccagcttcggcttcgagatggagatgttcgagttcctgaacatctgccaggcccacggcttccccaagatcctgggcgtgctgacccacctggacagcttcaagcacaacaagcagctgaagaagaccaagaagagactgaagcacagattctggaccgaggtgtaccaggacaaggtgggcctgacccacgagctggtgcagagcctgatcagcacctacagcaccatcgacgccaagatggccagcagcagagtgaccctgctgagcaacagcaagcccctgggcagcgaggccatcgacaaccagggcgtgagcctggagttcgaccagcagcagggcagcgtgtgccccagcgagagcgagatctacgaggccggcgccgaggacagaatggccggcgcccccatggccgccgccgtgcagcccgccgaggtgaccgtggaggtgggcgaggacctgcacatgcaccaggtgagagacagagagatgcccgaggtggtggagatcagaagaagcaactgcaccaaccactgcgacctgggcgacaccagcagctaccacaccaaggtgagcaccgtgcacatcatgaagaagagaaacggcggcggcagcctgaacaactacagcagcagcatcccccccacccccagcaccagccaggaggacccccagttcagcgtgccccccaccgccaacacccccacccccgtgtgcaagctgagcatgagatggagcaacctgttcaccagcgagaagggcagcgaccccgacaaggagagaaaggcccccgagaaccacgccgacaccatcggcagcggcagagccatccccatcaagcagggcatgctgctgaagagaagcggcaagtggctgaagacctggaagaagaagtacgtgaccctgtgcagcaacggcgtgctgacctactacagcagcctgggcgactacatgaagaacatccacaagaaggagatcgacctgagaaccagcaccatcaaggtgcccggcaagtggcccagcctggccaccagcgcctgcgcccccatcagcagcagcaagagcaacggcctgagcaaggacatggacaccggcctgggcgacagcatctgcttcagccccggcatcagcagcaccaccagccccaagctgaaccccccccccagcccccacgccaacaagaagaagcacctgaagaagaagagcaccaacaacttcatgatcgtgagcgccaccggccagacctggcacttcgaggccaccacctacgaggagagagacgcctgggtgcaggccatccagagccagatcctggccagcctgcagagctgcaagagcagcaagagcaagagccagctgaccagccagagcgaggccatggccctgcagagcatccagaacatgagaggcaacgcccactgcgtggactgcgagacccagaaccccaagtgggccagcctgaacctgggcgtgctgatgtgcatcgagtgcagcggcatccacagaagcttcggcaccagactgagcagagtgagaagcctggagctggacgactggcccgtggagctgagaaaggtgatgagcagcatcggcaacgagctggccaacagcatctgggagggcagcagccagggccagaccaagcccagcatcaagagcaccagagaggagaaggagtggtggatcagaagcaagtacgaggagaagctgttcctggcccccctgccctgcaccgagctgagcctgggccagcagctgctgagagccaccaccgacgaggacctgcagaccgccatcctgctgctggcccacggcagcagagaggaggtgaacgagacctgcggcgagggcgacggctgcaccgccctgcacctggcctgcagaaagggcaacgtggtgctggagcagctgctgaccggctggaccagctggcccgagatgcccaccggcacccagagatag

SEQ ID NO: 18042 - DNA, 1977 bp, Artificial Sequence
  Description of Artificial Sequence: Synthetic coding sequence
atgggcaacatcctgacctgcagagtgcaccccagcgtgagcctggagttcgaccagcagcagggcagcgtgtgccccagcgagagcgagatctacgaggccggcgccgaggacagaatggccggcgcccccatggccgccgccgtgcagcccgccgaggtgaccgtggaggtgggcgaggacctgcacatgcaccaggtgagagacagagagatgcccgaggccctggagttcaacctgagcgccaaccccgaggccagcaccatcttccagagaaacagccagaccgacgccctggagttcaacagcagcgccaaccccgaggccagcaccatcttccagagaaacagccagaccgacgtggtggagatcagaagaagcaactgcaccaaccacgtgagcaccgagagattcagccagcagtacagcagctgcagcaccatcttcctggacgacagcaccgccatccagcactacctgaccatgaccatcatcagcgtgaccctggagatcccccaccacatcacccagagagacgccgacagaagcctgagcatccccgacgagcagctgcacagcttcgccgtgagcaccgtgcacatcatgaagaagagaaacggcggcggcagcctgaacaactacagcagcagcatcccccccacccccagcaccagccaggaggacccccagttcagcgtgccccccaccgccaacacccccacccccgtgtgcaagctgagcatgagatggagcaacctgttcaccagcgagaagggcagcgaccccgacaaggagagaaaggcccccgagaaccacgccgacaccatcggcagcggcagagccatccccatcaagcagggcatgctgctgaagagaagcggcaagtggctgaagacctggaagaagaagtacgtgaccctgtgcagcaacggcgtgctgacctactacagcagcctgggcgactacatgaagaacatccacaagaaggagatcgacctgagaaccagcaccatcaaggtgcccggcaagtggcccagcctggccaccagcgcctgcgcccccatcagcagcagcaagagcaacggcctgagcaaggacatggacaccggcctgggcgacagcatctgcttcagccccggcatcagcagcaccaccagccccaagctgaaccccccccccagcccccacgccaacaagaagaagcacctgaagaagaagagcaccaacaacttcatgatcgtgagcgccaccggccagacctggcacttcgaggccaccacctacgaggagagagacgcctgggtgcaggccatccagagccagatcctggccagcctgcagagctgcaagagcagcaagagcaagagccagctgaccagccagagcgaggccatggccctgcagagcatccagaacatgagaggcaacgcccactgcgtggactgcgagacccagaaccccaagtgggccagcctgaacctgggcgtgctgatgtgcatcgagtgcagcggcatccacagaagcttcggcaccagactgagcagagtgagaagcctggagctggacgactggcccgtggagctgagaaaggtgatgagcagcatcggcaacgagctggccaacagcatctgggagggcagcagccagggccagaccaagcccagcatcaagagcaccagagaggagaaggagtggtggatcagaagcaagtacgaggagaagctgttcctggcccccctgccctgcaccgagctgagcctgggccagcagctgctgagagccaccaccgacgaggacctgcagaccgccatcctgctgctggcccacggcagcagagaggaggtgaacgagacctgcggcgagggcgacggctgcaccgccctgcacctggcctgcagaaagggcaacgtggtgctggagcagctgctgaccggctggaccagctggcccgagatgcccaccggcacccagagatag

SEQ ID NO: 18043 - DNA, 1320 bp, Artificial Sequence
  Description of Artificial Sequence: Synthetic coding sequence
atgagatggagcaacctgttcaccagcgagaagggcagcgaccccgacaaggagagaaaggcccccgagaaccacgccgacaccatcggcagcggcagagccatccccatcaagcagggcatgctgctgaagagaagcggcaagtggctgaagacctggaagaagaagtacgtgaccctgtgcagcaacggcgtgctgacctactacagcagcctgggcgactacatgaagaacatccacaagaaggagatcgacctgcagaccagcaccatcaaggtgcccggcaagtggcccagcctggccaccagcgcctgcacccccatcagcaccagcaagagcaacggcctgagcaaggacatggacaccggcctgggcgacagcatctgcttcagccccagcatcagcagcaccaccagccccaagctgaaccccccccccagcccccacgccaacaagaagaagcacctgaagaagaagagcaccaacaacttcatgatcgtgagcgccaccggccagacctggcacttcgaggccaccacctacgaggagagagacgcctgggtgcaggccatccagagccagatcctggccagcctgcagagctgcgagagcagcaagagcaagagccagctgaccagccagagcaaggccatggccctgcagagcatccagaacatgagaggcaacgcccactgcgtggactgcgagacccagaaccccaagtgggccagcctgaacctgggcgtgctgatgtgcatcgagtgcagcggcatccacagaagcctgggcaccagactgagcagagtgagaagcctggagctggacgactggcccgtggagctgagaaaggtgatgagcagcatcggcaacgacctggccaacagcatctgggagggcagcagccagggccagaccaagcccagcgagaagagcaccagagaggagaaggagagatggatcagaagcaagtacgaggagaagctgttcctggcccccctgccctgcaccgagctgagcctgggccagcagctgctgagagccaccgccgacgaggacctgcagaccgccatcctgctgctggcccacggcagcagagaggaggtgaacgagacctgcggcgagggcgacggctgcaccgccctgcacctggcctgcagaaagggcaacgtggtgctggcccagctgctgatctggtacggcgtggacgtgatggccagagacgcccacggcaacaccgccctgacctacgccagacaggccagcagccaggagtgcatcaacgtgctgctgcagtacggctgccccgacaagtgcgtgtag

SEQ ID NO: 18044 - DNA, 1992 bp, Artificial Sequence
  Description of Artificial Sequence: Synthetic coding sequence
atgggcaacatcctgacctgcagagtgcaccccagcgtgagcctggagttcgaccagcagcagggcagcgtgtgccccagcgagagcgagatctacgaggccggcgccggcgacagaatggccggcgcccccatggccgccgccgtgcagcccgccgaggtgaccgtggaggtgggcgaggacctgcacatgcaccacgtgagagacagagagatgcccgaggccctggagttcaaccccagcgccaaccccgaggccagcaccatcttccagagaaacagccagaccgacgtggtggagatcagaagaagcaactgcaccaaccacgtgagcaccgtgagattcagccagcagtacagcctgtgcagcaccatcttcctggacgacagcaccgccatccagcactacctgaccatgaccatcatcagcgtgaccctggagatcccccaccacatcacccagagagacgccgacagaagcctgagcatccccgacgagcagctgcacagcttcgccgtgagcaccgtgcacatcatgaagaagagaaacggcggcggcagcctgaacaactacagcagcagcatccccagcacccccagcaccagccaggaggacccccagttcagcgtgccccccaccgccaacacccccacccccgtgtgcaagagaagcatgagatggagcaacctgttcaccagcgagaagggcagcgaccccgacaaggagagaaaggcccccgagaaccacgccgacaccatcggcagcggcagagccatccccatcaagcagggcatgctgctgaagagaagcggcaagtggctgaagacctggaagaagaagtacgtgaccctgtgcagcaacggcgtgctgacctactacagcagcctgggcgactacatgaagaacatccacaagaaggagatcgacctgcagaccagcaccatcaaggtgcccggcaagtggcccagcctggccaccagcgcctgcacccccatcagcaccagcaagagcaacggcctgagcaaggacatggacaccggcctgggcgacagcatctgcttcagccccagcatcagcagcaccaccagccccaagctgaaccccccccccagcccccacgccaacaagaagaagcacctgaagaagaagagcaccaacaacttcatgatcgtgagcgccaccggccagacctggcacttcgaggccaccacctacgaggagagagacgcctgggtgcaggccatccagagccagatcctggccagcctgcagagctgcgagagcagcaagagcaagagccagctgaccagccagagcaaggccatggccctgcagagcatccagaacatgagaggcaacgcccactgcgtggactgcgagacccagaaccccaagtgggccagcctgaacctgggcgtgctgatgtgcatcgagtgcagcggcatccacagaagcctgggcaccagactgagcagagtgagaagcctggagctggacgactggcccgtggagctgagaaaggtgatgagcagcatcggcaacgacctggccaacagcatctgggagggcagcagccagggccagaccaagcccagcgagaagagcaccagagaggagaaggagagatggatcagaagcaagtacgaggagaagctgttcctggcccccctgccctgcaccgagctgagcctgggccagcagctgctgagagccaccgccgacgaggacctgcagaccgccatcctgctgctggcccacggcagcagagaggaggtgaacgagacctgcggcgagggcgacggctgcaccgccctgcacctggcctgcagaaagggcaacgtggtgctggcccagctgctgatctggtacggcgtggacgtgatggccagagacgcccacggcaacaccgccctgacctacgccagacaggccagcagccaggagtgcatcaacgtgctgctgcagtacggctgccccgacaagtgcgtgtag

SEQ ID NO: 18045 - DNA, 2061 bp, Artificial Sequence
  Description of Artificial Sequence: Synthetic coding sequence
atgggcaacatcctgacctgctgcgtgcaccccagcgtgagcctggagttcgaccagcagcagggcagcgtgtgccccagcgagagcgagatctacgaggccggcgccggcgacagaatggccggcgcccccatggccgccgccgtgcagcccgccgaggtgaccgtggaggtgggcgaggacctgcacatgcaccacatcagagaccaggagatgcccgaggccctggagttcagcctgagcgccaaccccgaggccagcaccatcttccagagaaacagccagaccgacgccctggagttcaaccccagcgccaaccccgaggccagcaccatcttccagagaaacagccagaccgacgtggtggagatcagaagaagcaactgcaccaaccacgtgagcaccgagagattcagccagcagtacagcagctgcagcaccatcttcctggacgacagcaccgccagccagcactacctgaccatgaccatcatcagcgtgaccctggagatcccccaccacatcacccagagagacgccgacagaagcctgagcatccccgacgagcagctgcacagcttcgccgtgagcaccgtgcacatcaccaagaacagaaacggcggcggcagcctgaacaactacagcagcagcatccccagcacccccagcaccagccaggaggacccccagttcagcgtgccccccaccgccaacacccccacccccgtgtgcaagagaagcatgagatggagcaacctgttcaccagcgagaagggcagccaccccgacaaggagagaaaggcccccgagaaccacgccgacaccatcggcagcggcagagccatccccatcaagcagggcatgctgctgaagagaagcggcaagtggctgaagacctggaagaagaagtacgtgaccctgtgcagcaacggcgtgctgacctactacagcagcctgggcgactacatgaagaacatccacaagaaggagatcgacctgagaaccagcaccatcaaggtgcccggcaagtggcccagcctggccaccagcgcctgcgcccccatcagcagcagcaagagcaacggcctgagcaaggacatggacaccggcctgggcgacagcatctgcttcagccccagcatcagcagcaccaccagccccaagctgaaccccccccccagcccccacgccaacaagaagaagcacctgaagaagaagagcaccaacaacttcatgatcgtgagcgccaccggccagacctggcacttcgaggccaccacctacgaggagagagacgcctgggtgcaggccatccagagccagatcctggccagcctgcagagctgcgagagcagcaagagcaagagccagctgaccagccagagcgaggccatggccctgcagagcatccagaacatgagaggcaacgcccactgcgtggactacgagacccagaaccccaagtgggccagcctgaacctgggcgtgctgatgtgcatcgagtgcagcggcatccacagaagcctgggcaccagactgagcagagtgagaagcctggagctggacgactggcccgtggagctgagaaaggtgatgagcagcatcggcaacgacctggccaacagcatctgggagggcagcagccagggccagaccaagcccagcgtgaagagcaccagagaggagaaggagagatggatcagaagcaagtacgaggagaagctgttcctggcccccctgccctgcaccgagctgagcctgggccagcacctgctgagagccaccgccgacgaggacctgcagaccgccatcctgctgctggcccacggcagcagagaggaggtgaacgagacctgcggcgagggcgacggctgcaccgccctgcacctggcctgcagaaagggcaacgtggtgctggcccagctgctgatctggtacggcgtggacgtgatggccagagacgcccacggcaacaccgccctgacctacgccagacaggccagcagccaggagtgcatcaacgtgctgctgcagtacggctgccccgacgagtgcgtgtag

SEQ ID NO: 18046 - DNA, 1992 bp, Artificial Sequence
  Description of Artificial Sequence: Synthetic coding sequence
atgggcaacatcctgacctgctgcgtgcaccccagcgtgagcctggagttcgaccagcagcagggcagcgtgtgccccagcgagagcgagatctacgaggccggcgccggcgacagaatggccggcgcccccatggccgccgccgtgcagcccgccgaggtgaccgtggaggtgggcgaggacctgcacatgcaccacatcagagaccaggagatgcccgaggccctggagttcaaccccagcgccaaccccgaggccagcaccatcttccagagaaacagccagaccgacgtggtggagatcagaagaagcaactgcaccaaccacgtgagcaccgagagattcagccagcagtacagcagctgcagcaccatcttcctggacgacagcaccgccagccagcactacctgaccatgaccatcatcagcgtgaccctggagatcccccaccacatcacccagagagacgccgacagaagcctgagcatccccgacgagcagctgcacagcttcgccgtgagcaccgtgcacatcaccaagaacagaaacggcggcggcagcctgaacaactacagcagcagcatccccagcacccccagcaccagccaggaggacccccagttcagcgtgccccccaccgccaacacccccacccccgtgtgcaagagaagcatgagatggagcaacctgttcaccagcgagaagggcagccaccccgacaaggagagaaaggcccccgagaaccacgccgacaccatcggcagcggcagagccatccccatcaagcagggcatgctgctgaagagaagcggcaagtggctgaagacctggaagaagaagtacgtgaccctgtgcagcaacggcgtgctgacctactacagcagcctgggcgactacatgaagaacatccacaagaaggagatcgacctgagaaccagcaccatcaaggtgcccggcaagtggcccagcctggccaccagcgcctgcgcccccatcagcagcagcaagagcaacggcctgagcaaggacatggacaccggcctgggcgacagcatctgcttcagccccagcatcagcagcaccaccagccccaagctgaaccccccccccagcccccacgccaacaagaagaagcacctgaagaagaagagcaccaacaacttcatgatcgtgagcgccaccggccagacctggcacttcgaggccaccacctacgaggagagagacgcctgggtgcaggccatccagagccagatcctggccagcctgcagagctgcgagagcagcaagagcaagagccagctgaccagccagagcgaggccatggccctgcagagcatccagaacatgagaggcaacgcccactgcgtggactacgagacccagaaccccaagtgggccagcctgaacctgggcgtgctgatgtgcatcgagtgcagcggcatccacagaagcctgggcaccagactgagcagagtgagaagcctggagctggacgactggcccgtggagctgagaaaggtgatgagcagcatcggcaacgacctggccaacagcatctgggagggcagcagccagggccagaccaagcccagcgtgaagagcaccagagaggagaaggagagatggatcagaagcaagtacgaggagaagctgttcctggcccccctgccctgcaccgagctgagcctgggccagcacctgctgagagccaccgccgacgaggacctgcagaccgccatcctgctgctggcccacggcagcagagaggaggtgaacgagacctgcggcgagggcgacggctgcaccgccctgcacctggcctgcagaaagggcaacgtggtgctggcccagctgctgatctggtacggcgtggacgtgatggccagagacgcccacggcaacaccgccctgacctacgccagacaggccagcagccaggagtgcatcaacgtgctgctgcagtacggctgccccgacgagtgcgtgtag

SEQ ID NO: 18047 - DNA, 2061 bp, Artificial Sequence
  Description of Artificial Sequence: Synthetic coding sequence
atgggcaacatcctgacctgcagagtgcaccccagcgtgagcctggagttcgaccagcagcagggcagcgtgtgccccagcgagagcgagacctacgaggccggcgccagagacagaatggccggcgcccccatggccgccgccgtgcagcccgccgaggtgaccgtggaggtgggcgaggacctgcacatgcaccacgtgagagacagagagatgcccgaggccctggagttcaacctgagcgccaaccccgagagcagcaccatcttccagagaaacagccagaccgaggccctggagttcaaccccagcgccaaccccgaggccagcaccatcttccagagaaacagccagaccgacgtggtggagatcagaagaagcaactgcaccaaccacgtgagcgccgtgagattcagccagcagtacagcctgtgcagcaccatcttcctggacgacagcaccgccatccagcactacctgaccatgaccatcatcagcgtgaccctggagatcccccaccacatcacccagagagacgccgacagaaccctgagcatccccgacgagcagctgcacagcttcgccgtgagcaccgtgcacatcatgaagaagagaaacggcggcggcagcctgaacaactacagcagcagcatccccagcacccccagcaccagccaggaggacccccagttcagcgtgccccccaccgccaacacccccacccccgtgtgcaagagaagcatgagatggagcaacctgttcaccagcgagaagggcagcgaccccgacaaggagagaaaggcccccgagaaccacgccgacaccatcggcagcggcagagccatccccatcaagcagggcatgctgctgaagagaagcggcaagtggctgaagacctggaagaagaagtacgtgaccctgtgcagcaacggcatgctgacctactacagcagcctgggcgactacatgaagaacatccacaagaaggagatcgacctgcagaccagcaccatcaaggtgcccggcaagtggcccagcctggccaccagcgcctgcacccccatcagcagcagcaagagcaacggcctgagcaaggacatggacaccggcctgggcgacagcatctgcttcagccccagcatcagcagcaccaccagccccaagctgaaccccccccccagcccccacgccaacaagaagaagcacctgaagaagaagagcaccaacaacttcatgatcgtgagcgccaccggccagacctggcacttcgaggccaccacctacgaggagagagacgcctgggtgcaggccatccagagccagatcctggccagcctgcagagctgcgagagcagcaagagcaagagccagctgaccagccagagcgaggccatggccctgcagagcatccagaacatgagaggcaacgcccactgcgtggactgcgagacccagaaccccaagtgggccagcctgaacctgggcgtgctgatgtgcatcgagtgcagcggcatccacagaagcctgggcccccacctgagcagagtgagaagcctggagctggacgactggcccgtggagctgagaaaggtgatgagcagcatcgtgaacgacctggccaacagcatctgggagggcagcagccagggccagaccaagcccagcgagaagagcaccagagaggagaaggagagatggatcagaagcaagtacgaggagaagctgttcctggcccccctgccctgcaccgagctgagcctgggccagcagctgctgagagccaccgccgacgaggacctgcagaccgccatcctgctgctggcccacggcagctgcgaggaggtgaacgagacctgcggcgagggcgacggctgcaccgccctgcacctggcctgcagaaagggcaacgtggtgctggcccagctgctgatctggtacggcgtggacgtgatggccagagacgcccacggcaacaccgccctgacctacgccagacaggccagcagccaggagtgcatcaacgtgctgctgcagtacggctgccccgacgagtgcgtgtag

SEQ ID NO: 18048 - DNA, 1992 bp, Artificial Sequence
  Description of Artificial Sequence: Synthetic coding sequence
atgggcaacatcctgacctgcagagtgcaccccagcgtgagcctggagttcgaccagcagcagggcagcgtgtgccccagcgagagcgagacctacgaggccggcgccagagacagaatggccggcgcccccatggccgccgccgtgcagcccgccgaggtgaccgtggaggtgggcgaggacctgcacatgcaccacgtgagagacagagagatgcccgaggccctggagttcaaccccagcgccaaccccgaggccagcaccatcttccagagaaacagccagaccgacgtggtggagatcagaagaagcaactgcaccaaccacgtgagcgccgtgagattcagccagcagtacagcctgtgcagcaccatcttcctggacgacagcaccgccatccagcactacctgaccatgaccatcatcagcgtgaccctggagatcccccaccacatcacccagagagacgccgacagaaccctgagcatccccgacgagcagctgcacagcttcgccgtgagcaccgtgcacatcatgaagaagagaaacggcggcggcagcctgaacaactacagcagcagcatccccagcacccccagcaccagccaggaggacccccagttcagcgtgccccccaccgccaacacccccacccccgtgtgcaagagaagcatgagatggagcaacctgttcaccagcgagaagggcagcgaccccgacaaggagagaaaggcccccgagaaccacgccgacaccatcggcagcggcagagccatccccatcaagcagggcatgctgctgaagagaagcggcaagtggctgaagacctggaagaagaagtacgtgaccctgtgcagcaacggcatgctgacctactacagcagcctgggcgactacatgaagaacatccacaagaaggagatcgacctgcagaccagcaccatcaaggtgcccggcaagtggcccagcctggccaccagcgcctgcacccccatcagcagcagcaagagcaacggcctgagcaaggacatggacaccggcctgggcgacagcatctgcttcagccccagcatcagcagcaccaccagccccaagctgaaccccccccccagcccccacgccaacaagaagaagcacctgaagaagaagagcaccaacaacttcatgatcgtgagcgccaccggccagacctggcacttcgaggccaccacctacgaggagagagacgcctgggtgcaggccatccagagccagatcctggccagcctgcagagctgcgagagcagcaagagcaagagccagctgaccagccagagcgaggccatggccctgcagagcatccagaacatgagaggcaacgcccactgcgtggactgcgagacccagaaccccaagtgggccagcctgaacctgggcgtgctgatgtgcatcgagtgcagcggcatccacagaagcctgggcccccacctgagcagagtgagaagcctggagctggacgactggcccgtggagctgagaaaggtgatgagcagcatcgtgaacgacctggccaacagcatctgggagggcagcagccagggccagaccaagcccagcgagaagagcaccagagaggagaaggagagatggatcagaagcaagtacgaggagaagctgttcctggcccccctgccctgcaccgagctgagcctgggccagcagctgctgagagccaccgccgacgaggacctgcagaccgccatcctgctgctggcccacggcagctgcgaggaggtgaacgagacctgcggcgagggcgacggctgcaccgccctgcacctggcctgcagaaagggcaacgtggtgctggcccagctgctgatctggtacggcgtggacgtgatggccagagacgcccacggcaacaccgccctgacctacgccagacaggccagcagccaggagtgcatcaacgtgctgctgcagtacggctgccccgacgagtgcgtgtag

SEQ ID NO: 18049 - DNA, 1992 bp, Artificial Sequence
  Description of Artificial Sequence: Synthetic coding sequence
atgggcaacatcctgacctgcagagtgcaccccagcgtgagcctggagttcgaccagcagcagggcagcgtgtgccccagcgagagcgagatctacgaggccggcgccgaggacagaatggccggcgcccccatggccgccgccgtgcagcccgccgaggtgaccgtggaggtgggcgaggacctgcacatgcaccacgtgagagacagagagatgcccgaggccctggagttcaaccccagcgccaaccccgaggccagcaccatcttccagagaaacagccagaccgacgtggtggagatcagaagaagcaactgcaccaaccacgtgagcaccgtgcacttcagccagcagtacagcctgtgcagcaccatcttcctggacgacagcaccgccatccagcactacctgaccatgaccatcatcagcgtgaccctggagatcccccaccacatcacccagagagacgccgacagaagcctgagcatccccgacgagcagctgcacagcttcgccgtgagcaccgtgcacatcaccaagaacagaaacggcggcggcagcctgaacaactacagcagcagcatccccagcacccccagcaccagccaggaggacccccagttcagcgtgccccccaccgccaacacccccacccccgtgtgcaagagaagcatgagatggagcaacctgttcaccagcgagaagggcagcgaccccgacaaggagagaaaggcccccgagaaccacgccgacaccatcggcagcggcagagccatccccatcaagcagggcatgctgctgaagagaagcggcaagtggctgaagacctggaagaagaagtacgtgaccctgtgcagcaacggcgtgctgacctactacagcagcctgggcgactacatgaagtacatccacaagaaggagatcgacctgcagaccagcaccatcaaggtgcccggcaagtggcccagcctggccaccctggcctgcacccccatcagcagcagcaagagcgacggcctgagcaaggacatggacaccggcctgggcgacagcatctgcttcagccccagcatcagcagcaccaccatccccaagctgaaccccccccccagcccccacgccaacaagaagaagcacctgaagaagaagagcaccaacaacttcatgatcgtgagcgccaccggccagacctggcacttcgaggccaccacctacgaggagagagacgcctgggtgcaggccatccagagccagatcctggccagcctgcagagctgcgagagcagcaagagcaagagccagctgaccagccagagcgaggccatggccctgcagagcatccagaacatgagaggcaacgcccactgcgtggactgcgagacccagaaccccaagtgggccagcctgaacctgggcgtgctgatgtgcatcgagtgcagcggcatccacagaagcctgggcaccagactgagcagagtgagaagcctggagctggacgactggcccgtggagctgagaaaggtgatgagcagcatcggcaacgacctggccaacagcatctgggagggcagcagccagggcagaaccaagcccaccgagaagagcaccagagaggagaaggagagatggatcagaagcaagtacgaggagaagctgttcctggcccccctgccctgcaccgagctgagcctgggccagcagctgctgagagccaccgccgacgaggacctgcagaccgccatcctgctgctggcccacggcagcagagaggaggtgaacgagacctgcggcgagggcgacggctgcaccgccctgcacctggcctgcagaaagggcaacgtggtgctggcccagctgctgatctggtacggcgtggacgtgatggccagagacgcccacggcaacaccgccctgacctacgccagacaggccagcagccaggagtgcatcaacgtgctgctgcagtacggctgccccgacgagtgcgtgtag

SEQ ID NO: 18050 - DNA, 1320 bp, Artificial Sequence
  Description of Artificial Sequence: Synthetic coding sequence
atgagatggagcaacctgttcaccagcgagaagggcagcgaccccgacaaggagagaaaggcccccgagaaccacgccgacaccatcggcagcggcagagccatccccatcaagcagggcatgctgctgaagagaagcggcaagtggctgaagacctggaagaagaagtacgtgaccctgtgcagcaacggcgtgctgacctactacagcagcctgggcgactacatgaagaacatccacaagaaggagatcgacctgcagaccagcaccatcaaggtgcccggcaagtggcccagcctggccaccagcgcctgcacccccatcagcagcagcaagagcaacggcctgagcaaggacatggacaccggcctgggcgacagcatctgcttcagccccagcatcagcagcaccaccagccccaagctgaaccccccccccagcccccacgccaacaagaagaagcacctgaagaagaagagcaccaacaacttcatgatcgtgagcgccaccggccagacctggcacttcgaggccaccacctacgaggagagagacgcctgggtgcaggccatccagagccagatcctggccagcctgcagagctgcgagagcagcaagagcaagagccagctgaccagccagagcgaggccatggccctgcagagcatccagaacatgagaggcaacgcccactgcgtggactgcgagacccagaaccccaagtgggccagcctgaacctgggcgtgctgatgtgcatcgagtgcagcggcatccaccacagcctgggcaccagactgagcagagtgagaagcctggagctggacgactggcccgtggagctgagaaaggtgatgagcagcatcggcaacgacctggccaacagcatctgggagggcagcagccagggccagaccaagcccagcgagaagagcaccagagaggagaaggagagatggatcagaagcaagtacgaggagaagctgttcctggcccccctgccctgcaccgagctgagcctgggccagcagctgctgtgggccaccgccgacgaggacctgcagaccgccatcctgctgctggcccacggcagcagagaggaggtgaacgagacctgcggcgagggcgacggctgcaccgccctgcacctggcctgcagaaagggcaacgtggtgctggcccagctgctgatctggtacggcgtggacgtgatggccagagacgcccacggcaacaccgccctgacctacgccagacaggccagcagccaggagtgcatcaacgtgctgctgcagtacggctgccccgacgagtgcgtgtag

SEQ ID NO: 18051 - DNA, 1992 bp, Artificial Sequence
  Description of Artificial Sequence: Synthetic coding sequence
atgggcaacatcctgacctgcagagtgcaccccagcgtgagcctggagttcgaccagcagcagggcagcgtgtgccccagcgagagcgagatctacgaggccggcgccggcgacagaatggccggcgcccccatggccgccgccgtgcagcccgccgaggtgaccgtggaggtgggcgaggacctgcacatgcaccacgtgagagacagagagatgcccgaggccctggagttcaaccccagcgccaaccccgaggccagcaccatcttccagagaaacagccagaccgacgtggtggagatcagaagaagcaactgcaccaaccacgtgagcaccgtgagattcagccagcagtacagcctgtgcagcaccatcttcctggacgacagcaccgccatccagcactacctgaccatgaccatcatcagcgtgaccctggagatcccccaccacatcacccagagagacgccgacagaagcctgagcatccccgacgagcagctgcacagcttcgccgtgagcaccgtgcacatcatgaagaagagaaacggcggcggcagcctgaacaactacagcagcagcatccccagcacccccagcaccagccaggaggacccccagttcagcgtgccccccaccgccaacacccccacccccgtgtgcaagagaagcatgagatggagcaacctgttcaccagcgagaagggcagcgaccccgacaaggagagaaaggcccccgagaaccacgccgacaccatcggcagcggcagagccatccccatcaagcagggcatgctgctgaagagaagcggcaagtggctgaagacctggaagaagaagtacgtgaccctgtgcagcaacggcgtgctgacctactacagcagcctgggcgactacatgaagaacatccacaagaaggagatcgacctgcagaccagcaccatcaaggtgcccggcaagtggcccagcctggccaccagcgcctgcacccccatcagcagcagcaagagcaacggcctgagcaaggacatggacaccggcctgggcgacagcatctgcttcagccccagcatcagcagcaccaccagccccaagctgaaccccccccccagcccccacgccaacaagaagaagcacctgaagaagaagagcaccaacaacttcatgatcgtgagcgccaccggccagacctggcacttcgaggccaccacctacgaggagagagacgcctgggtgcaggccatccagagccagatcctggccagcctgcagagctgcgagagcagcaagagcaagagccagctgaccagccagagcgaggccatggccctgcagagcatccagaacatgagaggcaacgcccactgcgtggactgcgagacccagaaccccaagtgggccagcctgaacctgggcgtgctgatgtgcatcgagtgcagcggcatccaccacagcctgggcaccagactgagcagagtgagaagcctggagctggacgactggcccgtggagctgagaaaggtgatgagcagcatcggcaacgacctggccaacagcatctgggagggcagcagccagggccagaccaagcccagcgagaagagcaccagagaggagaaggagagatggatcagaagcaagtacgaggagaagctgttcctggcccccctgccctgcaccgagctgagcctgggccagcagctgctgtgggccaccgccgacgaggacctgcagaccgccatcctgctgctggcccacggcagcagagaggaggtgaacgagacctgcggcgagggcgacggctgcaccgccctgcacctggcctgcagaaagggcaacgtggtgctggcccagctgctgatctggtacggcgtggacgtgatggccagagacgcccacggcaacaccgccctgacctacgccagacaggccagcagccaggagtgcatcaacgtgctgctgcagtacggctgccccgacgagtgcgtgtag

SEQ ID NO: 18052 - DNA, 1992 bp, Artificial Sequence
  Description of Artificial Sequence: Synthetic coding sequence
gagctgctgagaatcagccccgacctgctggccgccgccgtgatcagcgcccaggaggagcccctgaccaacatccagagagccagcggccccaccggcctgctgtggagcgtgagcctggagttcgaccagcagcagggcagcgtgtgccccagcgagagcgagatctacgaggccggcgccgaggacagaatggccggcgcccccatggccgccgccgtgcagcccgccgaggtgaccgtggaggtgggcgaggacctgcacatgcaccaggtgagagacagagagatgcccgaggccctggagttcaacctgagcgccaaccccgaggccagcaccatcttccagagaaacagccagaccgacgccctggagttcaacagcagcgccaaccccgaggccagcaccatcttccagagaaacagccagaccgacgtggtggagatcagaagaagcaactgcaccaaccacgtgagcaccgagagattcagccagcagtacagcagctgcagcaccatcttcctggacgacagcaccgccatccagcactacctgaccatgaccatcatcagcgtgaccctggagatcccccaccacatcacccagagagacgccgacagaagcctgagcatccccgacgagcagctgcacagcttcgccgtgagcaccgtgcacatcatgaagaagagaaacggcggcggcagcctgaacaactacagcagcagcatcccccccacccccagcaccagccaggaggacccccagttcagcgtgccccccaccgccaacacccccacccccgtgtgcaagagaagcatgagatggagcaacctgttcaccagcgagaagggcagcgaccccgacaaggagagaaaggcccccgagaaccacgccgacaccatcggcagcggcagagccatccccatcaagcagggcatgctgctgaagagaagcggcaagtggctgaagacctggaagaagaagtacgtgaccctgtgcagcaacggcgtgctgacctactacagcagcctgggcgactacatgaagaacatccacaagaaggagatcgacctgagaaccagcaccatcaaggtgcccggcaagtggcccagcctggccaccagcgcctgcgcccccatcagcagcagcaagagcaacggcctgagcaaggacatggacaccggcctgggcgacagcatctgcttcagccccggcatcagcagcaccaccagccccaagctgaaccccccccccagcccccacgccaacaagaagaagcacctgaagaagaagagcaccaacaacttcatgatcgtgagcgccaccggccagacctggcacttcgaggccaccacctacgaggagagagacgcctgggtgcaggccatccagagccagagcgaggccatggccctgcagagcatccagaacatgagaggcaacgcccactgcgtggactgcgagacccagaaccccaagtgggccagcctgaacctgggcgtgctgatgtgcatcgagtgcagcggcatccacagaagcttcggcaccagactgagcagagtgagaagcctggagctggacgactggcccgtggagctgagaaaggtgatgagcagcatcggcaacgagctggccaacagcatctgggagggcagcagccagggccagaccaagcccagcatcaagagcaccagagaggagaaggagtggtggatcagaagcaagtacgaggagaagctgttcctggcccccctgccctgcaccgagctgagcctgggccagcagctgctgagagccaccaccgacgaggacctgcagaccgccatcctgctgctggcccacggcagcagagaggaggtgaacgagacctgcggcgagggcgacggctgcaccgccctgcacctggcctgcagaaagggcaacgtggtgctggagcagctgctgaccggctggaccagctggcccgagatgcccaccggcacccagagatag

SEQ ID NO: 18053 - DNA, 1047 bp, Artificial Sequence
  Description of Artificial Sequence: Synthetic coding sequence
tgagccgaggacagaatggccggcgcccccatggccgccgccgtgcagcccgccgaggtgaccgtggaggtgggcgaggacctgcacatgcaccaggtgagagacagagagatgcccgaggccctggagttcaacctgagcgccaaccccgaggccagcaccatcttccagagaaacagccagaccgacgccctggagttcaacagcagcgccaaccccgaggccagcaccatcttccagagaaacagccagaccgacgtggtggagatcagaagaagcaactgcaccaaccacgtgagcaccgagagattcagccagcagtacagcagctgcagcaccatcttcctggacgacagcaccgccatccagcactacctgaccatgaccatcatcagcgtgaccctggagatcccccaccacatcacccagagagacgccgacagaagcctgagcatccccgacgagcagctgcacagcttcgccgtgagcaccgtgcacatcatgaagaagagaaacggcggcggcagcctgaacaactacagcagcagcatcccccccacccccagcaccagccaggaggacccccagttcagcgtgccccccaccgccaacacccccacccccgtgtgcaagagaagcatgagatggagcaacctgttcaccagcgagaagggcagcgaccccgacaaggagagaaaggcccccgagaaccacgccgacaccatcggcagcggcagagccatccccatcaagcagggcatgctgctgaagagaagcggcaagtggctgaagacctggaagaagaagtacgtgaccctgtgcagcaacggcgtgctgacctactacagcagcctgggcgactacatgaagaacatccacaagaaggagatcgacctgagaaccagcaccatcaaggtgcccggcaagtggcccagcctggccaccagcgcctgcgcccccatcagcagcagcaagagcaacggcctgagcaaggacatggacaccggcctgggcgacagcatctgcttcagccccggcatcagctag

SEQ ID NO: 18054 - DNA, 2112 bp, Artificial Sequence
  Description of Artificial Sequence: Synthetic coding sequence
atgttcgaggacgtgttcagcgacagcggcaacaccggcaacttcgacagaggcaagaagagaagactgaccatcatcgagtgcggctgcgacatcaacatgatgatcgacctggccaaggtggccgacctggtgctgatgctgatcgacgccagcttcggcttcgagatggagatgttcgagttcctgaacatctgccaggcccacggcttccccaagatcctgggcgtgctgacccacctggacagcttcaagcacaacaagcagctgaagaagaccaagaagagactgaagcacagattctggaccgaggtgtaccaggacaaggtgggcctgacccacgagctggtgcagagcctgatcagcacctacagcaccatcgacgccaagatggccagcagcagagtgaccctgctgagcaacagcaagcccctgggcagcgaggccatcgacaaccagggcgtgagcctggagttcgaccagcagcagggcagcgtgtgccccagcgagagcgagatctacgaggccggcgccgaggacagaatggccggcgcccccatggccgccgccgtgcagcccgccgaggtgaccgtggaggtgggcgaggacctgcacatgcaccaggtgagagacagagagatgcccgaggtggtggagatcagaagaagcaactgcaccaaccactgcgacctgggcgacaccagcagctaccacaccaaggtgagcaccgtgcacatcatgaagaagagaaacggcggcggcagcctgaacaactacagcagcagcatcccccccacccccagcaccagccaggaggacccccagttcagcgtgccccccaccgccaacacccccacccccgtgtgcaagagaagcatgagatggagcaacctgttcaccagcgagaagggcagcgaccccgacaaggagagaaaggcccccgagaaccacgccgacaccatcggcagcggcagagccatccccatcaagcagggcatgctgctgaagagaagcggcaagtggctgaagacctggaagaagaagtacgtgaccctgtgcagcaacggcgtgctgacctactacagcagcctgggcgactacatgaagaacatccacaagaaggagatcgacctgagaaccagcaccatcaaggtgcccggcaagtggcccagcctggccaccagcgcctgcgcccccatcagcagcagcaagagcaacggcctgagcaaggacatggacaccggcctgggcgacagcatctgcttcagccccggcatcagcagcaccaccagccccaagctgaaccccccccccagcccccacgccaacaagaagaagcacctgaagaagaagagcaccaacaacttcatgatcgtgagcgccaccggccagacctggcacttcgaggccaccacctacgaggagagagacgcctgggtgcaggccatccagagccagatcctggccagcctgcagagctgcaagagcagcaagagcaagagccagctgaccagccagagcgaggccatggccctgcagagcatccagaacatgagaggcaacgcccactgcgtggactgcgagacccagaaccccaagtgggccagcctgaacctgggcgtgctgatgtgcatcgagtgcagcggcatccacagaagcttcggcaccagactgagcagagtgagaagcctggagctggacgactggcccgtggagctgagaaaggtgatgagcagcatcggcaacgagctggccaacagcatctgggagggcagcagccagggccagaccaagcccagcatcaagagcaccagagaggagaaggagtggtggatcagaagcaagtacgaggagaagctgttcctggcccccctgccctgcaccgagctgagcctgggccagcagctgctgagagccaccaccgacgaggacctgcagaccgccatcctgctgctggcccacggcagcagagaggaggtgaacgagacctgcggcgagggcgacggctgcaccgccctgcacctggcctgcagaaagggcaacgtggtgctggagcagctgctgaccggctggaccagctggcccgagatgcccaccggcacccagagatag

SEQ ID NO: 18055 - DNA, 1977 bp, Artificial Sequence
  Description of Artificial Sequence: Synthetic coding sequence
atgggcaacatcctgacctgcagagtgcaccccagcgtgagcctggagttcgaccagcagcagggcagcgtgtgccccagcgagagcgagatctacgaggccggcgccgaggacagaatggccggcgcccccatggccgccgccgtgcagcccgccgaggtgaccgtggaggtgggcgaggacctgcacatgcaccaggtgagagacagagagatgcccgaggccctggagttcaacctgagcgccaaccccgaggccagcaccatcttccagagaaacagccagaccgacgccctggagttcaacagcagcgccaaccccgaggccagcaccatcttccagagaaacagccagaccgacgtggtggagatcagaagaagcaactgcaccaaccacgtgagcaccgagagattcagccagcagtacagcagctgcagcaccatcttcctggacgacagcaccgccatccagcactacctgaccatgaccatcatcagcgtgaccctggagatcccccaccacatcacccagagagacgccgacagaagcctgagcatccccgacgagcagctgcacagcttcgccgtgagcaccgtgcacatcatgaagaagagaaacggcggcggcagcctgaacaactacagcagcagcatcccccccacccccagcaccagccaggaggacccccagttcagcgtgccccccaccgccaacacccccacccccgtgtgcaagagaagcatgagatggagcaacctgttcaccagcgagaagggcagcgaccccgacaaggagagaaaggcccccgagaaccacgccgacaccatcggcagcggcagagccatccccatcaagcagggcatgctgctgaagagaagcggcaagtggctgaagacctggaagaagaagtacgtgaccctgtgcagcaacggcgtgctgacctactacagcagcctgggcgactacatgaagaacatccacaagaaggagatcgacctgagaaccagcaccatcaaggtgcccggcaagtggcccagcctggccaccagcgcctgcgcccccatcagcagcagcaagagcaacggcctgagcaaggacatggacaccggcctgggcgacagcatctgcttcagccccggcatcagcagcaccaccagccccaagctgaaccccccccccagcccccacgccaacaagaagaagcacctgaagaagaagagcaccaacaacttcatgatcgtgagcgccaccggccagacctggcacttcgaggccaccacctacgaggagagagacgcctgggtgcaggccatccagagccagatcctggccagcctgcagagctgcaagagcagcaagagcaagagccagctgaccagccagagcgaggccatggccctgcagagcatccagaacatgagaggcaacgcccactgcgtggactgcgagacccagaaccccaagtgggccagcctgaacctgggcgtgctgatgtgcatcgagtgcagcggcatccacagaagcttcggcaccagactgagcagagtgagaagcctggagctggacgactggcccgtggagctgagaaaggtgatgagcagcatcggcaacgagctggccaacagcatctgggagggcagcagccagggccagaccaagcccagcatcaagagcaccagagaggagaaggagtggtggatcagaagcaagtacgaggagaagctgttcctggcccccctgccctgcaccgagctgagcctgggccagcagctgctgagagccaccaccgacgaggacctgcagaccgccatcctgctgctggcccacggcagcagagaggaggtgaacgagacctgcggcgagggcgacggctgcaccgccctgcacctggcctgcagaaagggcaacgtggtgctggagcagctgctgaccggctggaccagctggcccgagatgcccaccggcacccagagatag

SEQ ID NO: 18056 - DNA, 4635 bp, Artificial Sequence
  Description of Artificial Sequence: Synthetic coding sequence
atggccgccccccaggacctggacatcgccgtgtggctggccaccgtgcacctggagcagtacgccgacaccttcagaagacacggcctggccaccgccggcgccgccagaggcctgggccacgaggagctgaagcagctgggcatcagcgccaccggccacagaaagagaatcctgagactgctgcagaccggcaccgaggagggcagcctggaccccaagagcgacagcgccatggagcccagccccagccccgccccccaggcccagccccccaagcccgtgcccaagcccagaaccgtgttcggcggcctgagcggccccgccaccacccagagacccggcctgagccccgccctgggcggccccggcgtgagcagaagccccgagcccagccccagacccccccccctgcccaccagcagcagcgagcagagcagcgccctgaacaccgtggagatgatgcccaacagcatctacttcggcctggacagcagaggcagagcccaggccgcccaggacaaggcccccgacagcagccagatcagcgcccccacccccgccctgagacccaccaccggcaccgtgcacatcatggaccccggctgcctgtactacggcgtgcagcccgtgggcacccccggcgcccccgacagaagagagagcagaggcgtgtgccagggcagagccgagcacagactgagcagacaggacctggaggccagagaggacgccggctacgccagcctggagctgcccggcgacagcaccctgctgagccccaccctggagaccgaggagaccagcgacgacctgatcagcccctacgccagcttcagcttcaccgccgacagactgacccccctgctgagcggctggctggacaagctgagcccccagggcaactacgtgttccagagaagattcgtgcagttcaacggcagaagcctgatgtacttcggcagcgacaaggaccccttccccaagggcgtgatccccctgaccgccatcgagatgaccagaagcagcaaggacaacaagttccaggtgatcaccggccagagagtgttcgtgttcagaaccgagagcgaggcccagagagacatgtggtgcagcaccctgcagagctgcctgaaggagcagagactgctgggccaccccagacccccccagccccccagacccctgagaaccggcatgctggagctgagaggccacaaggccaaggtgttcgccgccctgagccccggcgagctggccctgtacaagagcgagcaggccttcagcctgggcatcggcatctgcttcatcgagctgcagggctgcagcgtgagagagaccaagagcagaagcttcgacctgctgaccccccacagatgcttcagcttcaccgccgagagcggcggcgccagacagagctgggccgccgccctgcaggaggccgtgaccgagaccctgagcgactacgaggtggccgagaagatctggagcaacagagccaacagacagtgcgccgactgcggcagcagcagacccgactgggccgccgtgaacctgggcgtggtgatctgcaagcagtgcgccggccagcacagagccctgggcagcggcatcagcaaggtgcagagcctgaagctggacaccagcgtgtggagcaacgagatcgtgcagctgttcatcgtgctgggcaacgacagagccaacagattctgggccggcaccctgccccccggcgagggcctgcaccccgacgccacccccggccccagaggcgagttcatcagcagaaagtacagactgggcctgttcagaaagccccacccccagtaccccgaccacagccagctgctgcaggccctgtgcgccgccgtggccagacccaacctgctgaagaacatgacccagctgctgtgcgtggaggccttcgagggcgaggagccctggttcccccccgcccccgacggcagctgccccggcctgctgcccagcgaccccagccccggcgtgtacaacgaggtggtggtgagagccacctacagcggcttcctgtactgcagccccgtgagcaacaaggccggccccagcccccccagaagaggcagagacgccccccccagactgtggtgcgtgctgggcgccgccctggagatgttcgccagcgagaacagccccgagcccctgagcctgatccagccccaggacatcgtgtgcctgggcgtgagccccccccccaccgaccccggcgacagattccccttcagcttcgagctgatcctggccggcggcagaatccagcacttcggcaccgacggcgccgacagcctggaggcctggaccagcgccgtgggcaagtggttcagccccctgagctgccaccagctgctgggccccggcctgctgagactgggcagactgtggctgagaagccccagccacaccgcccccgcccccggcctgtggctgagcggcttcggcctgctgagaggcgaccacctgttcctgtgcagcgcccccggccccggcccccccgcccccgaggacatggtgcacctgagaagactgcaggagatcagcgtggtgagcgccgccgacacccccgacaagaaggagcacctggtgctggtggagaccggcagaaccctgtacctgcagggcgagggcagactggacttcaccgcctggaacgccgccatcggcggcgccgccggcggcggcggcaccggcctgcaggagcagcagatgagcagaggcgacatccccatcatcgtggacgcctgcatcagcttcgtgacccagcacggcctgagactggagggcgtgtacagaaagggcggcgccagagccagaagcctgagactgctggccgagttcagaagagacgccagaagcgtgaagctgagacccggcgagcacttcgtggaggacgtgaccgacaccctgaagagattcttcagagagctggacgaccccgtgaccagcgccagactgctgcccagatggagagaggccgccgagctgccccagaagaaccagagactggagaagtacaaggacgtgatcggctgcctgcccagagtgaacagaagaaccctggccaccctgatcggccacctgtacagagtgcagaagtgcgccgccctgaaccagatgtgcaccagaaacctggccctgctgttcgcccccagcgtgttccagaccgacggcagaggcgagcacgaggtgagagtgctgcaggagctgatcgacggctacatcagcgtgttcgacatcgacagcgaccaggtggcccagatcgacctggaggtgagcctgatcaccacctggaaggacgtgcagctgagccaggccggcgacctgatcatggaggtgtacatcgagcagcagctgcccgacaactgcgtgaccctgaaggtgagccccaccctgaccgccgaggagctgaccaaccaggtgctggagatgagaggcaccgccgccggcatggacctgtgggtgaccttcgagatcagagagcacggcgagctggagagacccctgcaccccaaggagaaggtgctggagcaggccctgcagtggtgccagctgcccgagccctgcagcgccagcctgctgctgaagaaggtgcccctggcccaggccggctgcctgttcaccggcatcagaagagagagccccagagtgggcctgctgagatgcagagaggagccccccagactgctgggcagcagattccaggagagattcttcctgctgagaggcagatgcctgctgctgctgaaggagaagaagagcagcaagcccgagagagagtggcccctggagggcgccaaggtgtacctgggcatcagaaagaagctgaagccccccaccccctggggcttcaccctgatcctggagaagatgcacctgtacctgagctgcaccgacgaggacgagatgtgggactggaccaccagcatcctgaaggcccagcacgacgaccagcagcccgtggtgctgagaagacacagcagcagcgacctggccagacagaagttcggcaccatgcccctgctgcccatcagaggcgacgacagcggcgccaccctgctgagcgccaaccagaccctgagaagactgcacaacagaagaaccctgagcatgttcttccccatgaagagcagccagggcagcgtggaggagcaggaggagctggaggagcccgtgtacgaggagcccgtgtacgaggaggtgggcgccttccccgagctgatccaggacaccagcaccagcttcagcaccaccagagagtggaccgtgaagcccgagaaccccctgaccagccagaagagcctggaccagcccttcctgagcaagagcagcaccctgggccaggaggagagaccccccgagcccccccccggcccccccagcaagagcagcccccaggccagaggcagcctggaggagcagctgctgcaggagctgagcagcctgatcctgagaaagggcgagaccaccgccggcctgggcagccccagccagcccagcagcccccagagccccagccccaccggcctgcccacccagacccccggcttccccacccagcccccctgcaccagcagcccccccagcagccagcccctgacctag

SEQ ID NO: 18057 - DNA, 1422 bp, Artificial Sequence
  Description of Artificial Sequence: Synthetic coding sequence
atggccgccccccaggacctggacatcgccgtgtggctggccaccgtgcacctggagcagtacgccgacaccttcagaagacacggcctggccaccgccggcgccgccagaggcctgggccacgaggagctgaagcagctgggcatcagcgccaccggccacagaaagagaatcctgagactgctgcagaccggcaccgaggagggcagcctggaccccaagagcgacagcgccatggagcccagccccagccccgccccccaggcccagccccccaagcccgtgcccaagcccagaaccgtgttcggcggcctgagcggccccgccaccacccagagacccggcctgagccccgccctgggcggccccggcgtgagcagaagccccgagcccagccccagacccccccccctgcccaccagcagcagcgagcagagcagcgccctgaacaccgtggagatgatgcccaacagcatctacttcggcctggacagcagaggcagagcccaggccgcccaggacaaggcccccgacagcagccagatcagcgcccccacccccgccctgagacccaccaccggcaccgtgcacatcatggaccccggctgcctgtactacggcgtgcagcccgtgggcacccccggcgcccccgacagaagagagagcagaggcgtgtgccagggcagagccgagcacagactgagcagacaggacctggaggccagagaggacgccggctacgccagcctggagctgcccggcgacagcaccctgctgagccccaccctggagaccgaggagaccagcgacgacctgatcagcccctacgccagcttcagcttcaccgccgacagactgacccccctgctgagcggctggctggacaagctgagcccccagggcaactacgtgttccagagaagattcgtgcagttcaacggcagaagcctgatgtacttcggcagcgacaaggaccccttccccaagggcgtgatccccctgaccgccatcgagatgaccagaagcagcaaggacaacaagttccaggtgatcaccggccagagagtgttcgtgttcagaaccgagagcgaggcccagagagacatgtggtgcagcaccctgcagagctgcctgaaggagcagagactgctgggccaccccagacccccccagccccccagacccctgagaaccggcatgctggagctgagaggccacaaggccaaggtgttcgccgccctgagccccggcgagctggccctgtacaagagcgagcaggccttcagcctgggcatcggcatctgcttcatcgagctgcagggctgcagcgtgagagagaccaagagcagaagcttcgacctgctgaccccccacagatgcttcagcttcaccgccgagagcggcggcgccagacagagctag

SEQ ID NO: 18058 - DNA, 4128 bp, Artificial Sequence
  Description of Artificial Sequence: Synthetic coding sequence
atggagcccagccccagccccgccccccaggcccagccccccaagcccgtgcccaagcccagaaccgtgttcggcggcctgagcggccccgccaccacccagagacccggcctgagccccgccctgggcggccccggcgtgagcagaagccccgagcccagccccagacccccccccctgcccaccagcagcagcgagcagagcagcgccctgaacaccgtggagatgatgcccaacagcatctacttcggcctggacagcagaggcagagcccaggccgcccaggacaaggcccccgacagcagccagatcagcgcccccacccccgccctgagacccaccaccggcaccgtgcacatcatggaccccggctgcctgtactacggcgtgcagcccgtgggcacccccggcgcccccgacagaagagagagcagaggcgtgtgccagggcagagccgagcacagactgagcagacaggacctggaggccagagaggacgccggctacgccagcctggagctgcccggcgacagcaccctgctgagccccaccctggagaccgaggagaccagcgacgacctgatcagcccctacgccagcttcagcttcaccgccgacagactgacccccctgctgagcggctggctggacaagctgagcccccagggcaactacgtgttccagagaagattcgtgcagttcaacggcagaagcctgatgtacttcggcagcgacaaggaccccttccccaagggcgtgatccccctgaccgccatcgagatgaccagaagcagcaaggacaacaagttccaggtgatcaccggccagagagtgttcgtgttcagaaccgagagcgaggcccagagagacatgtggtgcagcaccctgcagagctgcctgaaggagcagagactgctgggccaccccagacccccccagccccccagacccctgagaaccggcatgctggagctgagaggccacaaggccaaggtgttcgccgccctgagccccggcgagctggccctgtacaagagcgagcaggccttcagcctgggcatcggcatctgcttcatcgagctgcagggctgcagcgtgagagagaccaagagcagaagcttcgacctgctgaccccccacagatgcttcagcttcaccgccgagagcggcggcgccagacagagctgggccgccgccctgcaggaggccgtgaccgagaccctgagcgactacgaggtggccgagaagatctggagcaacagagccaacagacagtgcgccgactgcggcagcagcagacccgactgggccgccgtgaacctgggcgtggtgatctgcaagcagtgcgccggccagcacagagccctgggcagcggcatcagcaaggtgcagagcctgaagctggacaccagcgtgtggagcaacgagatcgtgcagctgttcatcgtgctgggcaacgacagagccaacagattctgggccggcaccctgccccccggcgagggcctgcaccccgacgccacccccggccccagaggcgagttcatcagcagaaagtacagactgggcctgttcagaaagccccacccccagtaccccgaccacagccagctgctgcaggccctgtgcgccgccgtggccagacccaacctgctgaagaacatgacccagctgctgtgcgtggaggccttcgaggaccccagccccggcgtgtacaacgaggtggtggtgagagccacctacagcggcttcctgtactgcagccccgtgagcaacaaggccggccccagcccccccagaagaggcagagacgccccccccagactgtggtgcgtgctgggcgccgccctggagatgttcgccagcgagaacagccccgagcccctgagcctgatccagccccaggacatcgtgtgcctgggcgtgagccccccccccaccgaccccggcgacagattccccttcagcttcgagctgatcctggccggcggcagaatccagcacttcggcaccgacggcgccgacagcctggaggcctggaccagcgccgtgggcaagtggttcagccccctgagctgccaccagctgctgggccccggcctgctgagactgggcagactgtggctgagaagccccagccacaccgcccccgcccccggcctgtggctgagcggcttcggcctgctgagaggcgaccacctgttcctgtgcagcgcccccggccccggcccccccgcccccgaggacatggtgcacctgagaagactgcaggagatcagcgtggtgagcgccgccgacacccccgacaagaaggagcacctggtgctggtggagaccggcagaaccctgtacctgcagggcgagggcagactggacttcaccgcctggaacgccgccatcggcggcgccgccggcggcggcggcaccggcctgcaggagcagcagatgagcagaggcgacatccccatcatcgtggacgcctgcatcagcttcgtgacccagcacgagctgccccagaagaaccagagactggagaagtacaaggacgtgatcggctgcctgcccagagtgaacagaagaaccctggccaccctgatcggccacctgtacagagtgcagaagtgcgccgccctgaaccagatgtgcaccagaaacctggccctgctgttcgcccccagcgtgttccagaccgacggcagaggcgagcacgaggtgagagtgctgcaggagctgatcgacggctacatcagcgtgttcgacatcgacagcgaccaggtggcccagatcgacctggaggtgagcctgatcaccacctggaaggacgtgcagctgagccaggccggcgacctgatcatggaggtgtacatcgagcagcagctgcccgacaactgcgtgaccctgaaggtgagccccaccctgaccgccgaggagctgaccaaccaggtgctggagatgagaggcaccgccgccggcatggacctgtgggtgaccttcgagatcagagagcacggcgagctggagagacccctgcaccccaaggagaaggtgctggagcaggccctgcagtggtgccagctgcccgagccctgcagcgccagcctgctgctgaagaaggtgcccctggcccaggccggctgcctgttcaccggcatcagaagagagagccccagagtgggcctgctgagatgcagagaggagccccccagactgctgggcagcagattccaggagagattcttcctgctgagaggcagatgcctgctgctgctgaaggagaagaagagcagcaagcccgagagagagtggcccctggagggcgccaaggtgtacctgggcatcagaaagaagctgaagccccccaccccctggggcttcaccctgatcctggagaagatgcacctgtacctgagctgcaccgacgaggacgagatgtgggactggaccaccagcatcctgaaggcccagcacgacgaccagcagcccgtggtgctgagaagacacagcagcagcgacctggccagacagaagttcggcaccatgcccctgctgcccatcagaggcgacgacagcggcgccaccctgctgagcgccaaccagaccctgagaagactgcacaacagaagaaccctgagcatgttcttccccatgaagagcagccagggcagcgtggaggagcaggaggagctggaggagcccgtgtacgaggagcccgtgtacgaggaggtgggcgccttccccgagctgatccaggacaccagcaccagcttcagcaccaccagagagtggaccgtgaagcccgagaaccccctgaccagccagaagagcctggaccagcccttcctgagcaagagcagcaccctgggccaggaggagagaccccccgagcccccccccggcccccccagcaagagcagcccccaggccagaggcagcctggaggagcagctgctgcaggagctgagcagcctgatcctgagaaagggcgagaccaccgccggcctgggcagccccagccagcccagcagcccccagagccccagccccaccggcctgcccacccagacccccggcttccccacccagcccccctgcaccagcagcccccccagcagccagcccctgacctag

SEQ ID NO: 18059 - DNA, 3582 bp, Artificial Sequence
  Description of Artificial Sequence: Synthetic coding sequence
atgaccagaagcagcaaggacaacaagttccaggtgatcaccggccagagagtgttcgtgttcagaaccgagagcgaggcccagagagacatgtggtgcagcaccctgcagagctgcctgaaggagcagagactgctgggccaccccagacccccccagccccccagacccctgagaaccggcatgctggagctgagaggccacaaggccaaggtgttcgccgccctgagccccggcgagctggccctgtacaagagcgagcaggccttcagcctgggcatcggcatctgcttcatcgagctgcagggctgcagcgtgagagagaccaagagcagaagcttcgacctgctgaccccccacagatgcttcagcttcaccgccgagagcggcggcgccagacagagctgggccgccgccctgcaggaggccgtgaccgagaccctgagcgactacgaggtggccgagaagatctggagcaacagagccaacagacagtgcgccgactgcggcagcagcagacccgactgggccgccgtgaacctgggcgtggtgatctgcaagcagtgcgccggccagcacagagccctgggcagcggcatcagcaaggtgcagagcctgaagctggacaccagcgtgtggagcaacgagatcgtgcagctgttcatcgtgctgggcaacgacagagccaacagattctgggccggcaccctgccccccggcgagggcctgcaccccgacgccacccccggccccagaggcgagttcatcagcagaaagtacagactgggcctgttcagaaagccccacccccagtaccccgaccacagccagctgctgcaggccctgtgcgccgccgtggccagacccaacctgctgaagaacatgacccagctgctgtgcgtggaggccttcgagggcgaggagccctggttcccccccgcccccgacggcagctgccccggcctgctgcccagcgaccccagccccggcgtgtacaacgaggtggtggtgagagccacctacagcggcttcctgtactgcagccccgtgagcaacaaggccggccccagcccccccagaagaggcagagacgccccccccagactgtggtgcgtgctgggcgccgccctggagatgttcgccagcgagaacagccccgagcccctgagcctgatccagccccaggacatcgtgtgcctgggcgtgagccccccccccaccgaccccggcgacagattccccttcagcttcgagctgatcctggccggcggcagaatccagcacttcggcaccgacggcgccgacagcctggaggcctggaccagcgccgtgggcaagtggttcagccccctgagctgccaccagctgctgggccccggcctgctgagactgggcagactgtggctgagaagccccagccacaccgcccccgcccccggcctgtggctgagcggcttcggcctgctgagaggcgaccacctgttcctgtgcagcgcccccggccccggcccccccgcccccgaggacatggtgcacctgagaagactgcaggagatcagcgtggtgagcgccgccgacacccccgacaagaaggagcacctggtgctggtggagaccggcagaaccctgtacctgcagggcgagggcagactggacttcaccgcctggaacgccgccatcggcggcgccgccggcggcggcggcaccggcctgcaggagcagcagatgagcagaggcgacatccccatcatcgtggacgcctgcatcagcttcgtgacccagcacggcctgagactggagggcgtgtacagaaagggcggcgccagagccagaagcctgagactgctggccgagttcagaagagacgccagaagcgtgaagctgagacccggcgagcacttcgtggaggacgtgaccgacaccctgaagagattcttcagagagctggacgaccccgtgaccagcgccagactgctgcccagatggagagaggccgccgagctgccccagaagaaccagagactggagaagtacaaggacgtgatcggctgcctgcccagagtgaacagaagaaccctggccaccctgatcggccacctgtacagagtgcagaagtgcgccgccctgaaccagatgtgcaccagaaacctggccctgctgttcgcccccagcgtgttccagaccgacggcagaggcgagcacgaggtgagagtgctgcaggagctgatcgacggctacatcagcgtgttcgacatcgacagcgaccaggtggcccagatcgacctggaggtgagcctgatcaccacctggaaggacgtgcagctgagccaggccggcgacctgatcatggaggtgtacatcgagcagcagctgcccgacaactgcgtgaccctgaaggtgagccccaccctgaccgccgaggagctgaccaaccaggtgctggagatgagaggcaccgccgccggcatggacctgtgggtgaccttcgagatcagagagcacggcgagctggagagacccctgcaccccaaggagaaggtgctggagcaggccctgcagtggtgccagctgcccgagccctgcagcgccagcctgctgctgaagaaggtgcccctggcccaggccggctgcctgttcaccggcatcagaagagagagccccagagtgggcctgctgagatgcagagaggagccccccagactgctgggcagcagattccaggagagattcttcctgctgagaggcagatgcctgctgctgctgaaggagaagaagagcagcaagcccgagagagagtggcccctggagggcgccaaggtgtacctgggcatcagaaagaagctgaagccccccaccccctggggcttcaccctgatcctggagaagatgcacctgtacctgagctgcaccgacgaggacgagatgtgggactggaccaccagcatcctgaaggcccagcacgacgaccagcagcccgtggtgctgagaagacacagcagcagcgacctggccagacagaagttcggcaccatgcccctgctgcccatcagaggcgacgacagcggcgccaccctgctgagcgccaaccagaccctgcccatgaagagcagccagggcagcgtggaggagcaggaggagctggaggagcccgtgtacgaggagcccgtgtacgaggaggtgggcgccttccccgagctgatccaggacaccagcaccagcttcagcaccaccagagagtggaccgtgaagcccgagaaccccctgaccagccagaagagcctggaccagcccttcctgagcaagagcagcaccctgggccaggaggagagaccccccgagcccccccccggcccccccagcaagagcagcccccaggccagaggcagcctggaggagcagctgctgcaggagctgagcagcctgatcctgagaaagggcgagaccaccgccggcctgggcagccccagccagcccagcagcccccagagccccagccccaccggcctgcccacccagacccccggcttccccacccagcccccctgcaccagcagcccccccagcagccagcccctgacctag

SEQ ID NO: 18060 - DNA, 1116 bp, Artificial Sequence
  Description of Artificial Sequence: Synthetic coding sequence
atgctgatggccagcaccaccagcgccgtgcccggccaccccagcctgcccagcctgcccagcaacagcagccaggagagacccctggacaccagagaccccctgctggccagagccgagctggccctgctgagcatcgtgttcgtggccgtggccctgagcaacggcctggtgctggccgccctggccagaagaggcagaagaggccactgggcccccatccacgtgttcatcggccacctgtgcctggccgacctggccgtggccctgttccaggtgctgccccagctggcctggaaggccaccgacagattcagaggccccgacgccctgtgcagagccgtgaagtacctgcagatggtgggcatgtacgccagcagctacatgatcctggccatgaccctggacagacacagagccatctgcagacccatgctggcctacagacacggcagcggcgcccactggaacagacccgtgctggtggcctgggccttcagcctgctgctgagcctgccccagctgttcatcttcgcccagagaaacgtggagggcggcagcggcgtgaccgactgctgggcctgcttcgccgagccctggggcagaagaacctacgtgacctggatcgccctgatggtgttcgtggcccccaccctgggcatcgccgcctgccaggtgctgatcttcagagagatccacgccagcctggtgcccggccccagcgagagacccggcggcagaagaagaggcagaagaaccggcagccccggcgagggcgcccacgtgagcgccgccgtggccaagaccgtgagaatgaccctggtgatcgtggtggtgtacgtgctgtgctgggcccccttcttcctggtgcagctgtgggccgcctgggaccccgaggcccccctggagggcgcccccttcgtgctgctgatgctgctggccagcctgaacagctgcaccaacccctggatctacgccagcttcagcagcagcgtgagcagcgagctgagaagcctgctgtgctgcgccagaggcagaaccccccccagcctgggcccccaggacgagagctgcaccaccgccagcagcagcctggccaaggacaccagcagctag

SEQ ID NO: 18061 - DNA, 444 bp, Artificial Sequence
  Description of Artificial Sequence: Synthetic coding sequence
atgggcacccccgccagcgtggtgagcgagccccccccctggcaggcccccatcgaggccagaggcagaaagcaggccagcgccaacatcttccaggacgccgagctgctgcagatccaggccctgttccagagaagcggcgaccagctggccgaggagagagcccagatcatctgggagtgcgccggcgaccacagagtggccgaggccctgaagagactgagaagaaagagaccccccagacagaagcccctgggccacagcctgcaccactgcagcagactgagaatcctggagccccacagcgccctggccaacccccagagcgccaccgagaccgccagcagcgagcagtacctgcacagcagaaagaagagcgccagaatcagaagaaactggagaaagagcggccccaccagctacctgcaccagatcagacactag

SEQ ID NO: 18062 - DNA, 1305 bp, Artificial Sequence
  Description of Artificial Sequence: Synthetic coding sequence
atggccgccagcgacaccgagagagacggcctggcccccgagaagaccagccccgacagagacaagaagaaggagcagagcgaggtgagcgtgagccccagagccagcaagcaccactacagcagaagcagaagcagaagcagagagagaaagagaaagagcgacaacgagggcagaaagcacagaagcagaagcagaagcaaggagggcagaagacacgagagcaaggacaagagcagcaagaagcacaagagcgaggagcacaacgacaaggagcacagcagcgacaagggcagagagagactgaacagcagcgagaacggcgaggacagacacaagagaaaggagagaaagagcagcagaggcagaagccacagcagaagcagaagcagagagagaagacacagaagcagaagcagagagagaaagaagagcagaagcagaagcagagagagaaagaagagcagaagcagaagcagagagagaaagaagagcagaagcagaagcagagagagaaagagaagaatcagaagcagaagcagaagcagaagcagacacagacacagaaccagaagcagaagcagaaccagaagcagaagcagagacagaaagaagagaatcgagaagcccagaagattcagcagaagcctgagcagaacccccagccccccccccttcagaggcagaaacaccgccatggacgcccaggaggccctggccagaagactggagagagccaagaagctgcaggagcagagagagaaggagatggtggagaagcagaagcagcaggagatcgccgccgccgccgccaccggcggcagcgtgctgaacgtggccgccctgctggccagcggcacccaggtgaccccccagatcgccatggccgcccagatggccgccctgcaggccaaggccctggccgagaccggcatcgccgtgcccagctactacaaccccgccgccgtgaaccccatgaagttcgccgagcaggagaagaagagaaagatgctgtggcagggcaagaaggagggcgacaagagccagagcgccgagatctgggagaagctgaacttcggcaacaaggaccagaacgtgaagttcagaaagctgatgggcatcaagagcgaggacgaggccggctgcagcagcgtggacgaggagagctacaagaccctgaagcagcaggaggaggtgttcagaaacctggacgcccagtacgagatggccagaagccagacccacacccagagaggcatgggcctgggcttcaccagcagcatgagaggcatggacgccgtgtag

SEQ ID NO: 18063 - DNA, 1161 bp, Artificial Sequence
  Description of Artificial Sequence: Synthetic coding sequence
atgaaggaggagaacaccggcgccggcgccgaggccaagagaaccaacttcttcctgaagcagggcagaagacacgagagcaaggacaagagcagcaagaagcacaagagcgaggagcacaacgacaaggagcacagcagcgacaagggcagagagagactgaacagcagcgagaacggcgaggacagacacaagagaaaggagagaaagagcagcagaggcagaagccacagcagaagcagaagcagagagagaagacacagaagcagaagcagagagagaaagaagagcagaagcagaagcagagagagaaagaagagcagaagcagaagcagagagagaaagaagagcagaagcagaagcagagagagaaagagaagaatcagaagcagaagcagaagcagaagcagacacagacacagaaccagaagcagaagcagaaccagaagcagaagcagagacagaaagaagagaatcgagaagcccagaagattcagcagaagcctgagcagaacccccagccccccccccttcagaggcagaaacaccgccatggacgcccaggaggccctggccagaagactggagagagccaagaagctgcaggagcagagagagaaggagatggtggagaagcagaagcagcaggagatcgccgccgccgccgccaccggcggcagcgtgctgaacgtggccgccctgctggccagcggcacccaggtgaccccccagatcgccatggccgcccagatggccgccctgcaggccaaggccctggccgagaccggcatcgccgtgcccagctactacaaccccgccgccgtgaaccccatgaagttcgccgagcaggagaagaagagaaagatgctgtggcagggcaagaaggagggcgacaagagccagagcgccgagatctgggagaagctgaacttcggcaacaaggaccagaacgtgaagttcagaaagctgatgggcatcaagagcgaggacgaggccggctgcagcagcgtggacgaggagagctacaagaccctgaagcagcaggaggaggtgttcagaaacctggacgcccagtacgagatggccagaagccagacccacacccagagaggcatgggcctgggcttcaccagcagcatgagaggcatggacgccgtgtag

SEQ ID NO: 18064 - DNA, 1110 bp, Artificial Sequence
  Description of Artificial Sequence: Synthetic coding sequence
atggccgccagcgacaccgagagagacggcctggcccccgagaagaccagccccgacagagacaagaagaaggagcagagcgaggtgagcgtgagccccagagccagcaagcaccactacagcagaagcagaagcagaagcagagagagaaagagaaagagcgacaacgagggcagaaagcacagaagcagaagcagaagcaaggagggcagaagacacgagagcaaggacaagagcagcaagaagcacaagagcgaggagcacaacgacaaggagcacagcagcgacaagggcagagagagactgaacagcagcgagaacggcgaggacagacacaagagaaaggagagaaagagcagcagaggcagaagccacagcagaagcagaagcagagagagaagacacagaagcagaagcagagagagaaagaagagcagaagcagaagcagagagagaaagaagagcagaagcagaagcagagagagaaagaagagcagaagcagaagcagagagagaaagagaagaatcagaagcagaagcagaagcagaagcagacacagacacagaaccagaagcagaagcagaaccagaagcagaagcagagacagaaagaagagaatcgagaagcccagaagattcagcagaagcctgagcagaacccccagccccccccccttcagaggcagaaacaccgccatggacgcccaggaggccctggccagaagactggagagagccaagaagctgcaggagcagagagagaaggagatggtggagaagcagaagcagcaggagatcgccgccgccgccgccgccaccggcggcagcgtgctgaacgtggccgccctgctggccagcggcacccaggtgaccccccagatcgccatggccgcccagatggccgccctgcaggccaaggccctggccgagaccggcatcgccgtgcccagctactacaaccccgccgccgtgaaccccatgaagttcgccgagcaggagaagaagagaaagatgctgtggcagggcaagaaggagggcttcatccccaactacctggagatcatgggcaagatcgagttctggaagcagggccagaacgtgaagttctag

SEQ ID NO: 18065 - DNA, 333 bp, Artificial Sequence
  Description of Artificial Sequence: Synthetic coding sequence
ggcgccagaagccccggcagcacccaccagggcagcctggccagcggcgtgctgcccatcaagtgcagccacgtggagttcggcatgtggaagggcggcagaagccaccccttcctgccccacagcagcagatgcgccggcagcggcggccagctggacagcatcctgccccaccagagccccgcctggggcccctggggctgcaaggacctgagcagcggcttccccagcttcctgaccagcagcatcctgtggaagagcgccgtggtgagagagccccacatcagcccccaccaggcccccccctacaagaccagcgactgcatcacctag

SEQ ID NO: 18066 - DNA, 1104 bp, Artificial Sequence
  Description of Artificial Sequence: Synthetic coding sequence
atgggcaagagcatcccccagtacctgggccagctggacatcagaaagagcgtggtgagcctggccaccggcgccggcgccatctacctgctgtacaaggccatcaaggccggcatcaagtgcaagccccccctgtgcagcaacagccccatctgcatcgccagagagtgccccggccccggcgagagagccctgccccaggaggcccccgcccccgaggccagcgccgtgggcggccccaagggcctggccgtggagagagagagacacggcagagacagcggcgagctgagaagactgctgaacagcctggagtgcaagcaggacgagtacgccaagagcatgatcctgcacagcatcaccagatgcgtgtacctgctggaggccgaggccagcgcctgcaccaccgacgacatcgtgctgctgggctacatgctggacgacaaggacaacagcgtgaagacccaggccctgaacaccctgaaggccttcagcggcatcagaaagttcagactgaagatccaggagcacagcatcaaggtgctggagctgatcagcaccatctgggacaccgagctgcacatcgccggcctgagactgctgaacaacctgcccctgcccgactacgtgcacccccagctgagaagagtgatgcccgccctgatggagatcctgcagagcgactacatcctggcccaggtgcaggccgtgagactgctgagctacctggcccagaagaacgacctgctgtacgacatcctgaactgccaggtgcacagcaacttcctgaacctgttccagcccacccagagcggcagcctgctgtacgaggtgctggtgttcgccgagagactgagcgagggcagaaacgccccccactaccacgtggtgaagtggcactacaacgagcagagcctgcacgagagcctgttcggcgaggagagcagactggccgacagactgctggccctggtgatccaccccgaggaggacgtgcagatccaggcctgcaaggtgatcgtgagcctgcagtacccccaggacctgagagccagacccagcagctgccagcccagcagaagctacttcaagaacaccgagtag

SEQ ID NO: 18067 - DNA, 1023 bp, Artificial Sequence
  Description of Artificial Sequence: Synthetic coding sequence
atgggcaagagcatcccccagtacctgggccagctggacatcagaaagagcgtggtgagcctggccaccggcgccggcgccatctacctgctgtacaaggccatcaaggccggcatcaagtgcaagccccccctgtgcagcaacagccccatctgcatcgccagactggccgtggagagagagagacacggcagagacagcggcgagctgagaagactgctgaacagcctggagtgcaagcaggacgagtacgccaagagcatgatcctgcacagcatcaccagatgcgtgtacctgctggaggccgaggccagcgcctgcaccaccgacgacatcgtgctgctgggctacatgctggacgacaaggacaacagcgtgaagacccaggccctgaacaccctgaaggccttcagcggcatcagaaagttcagactgaagatccaggagcacagcatcaaggtgctggagctgatcagcaccatctgggacaccgagctgcacatcgccggcctgagactgctgaacaacctgcccctgcccgactacgtgcacccccagctgagaagagtgatgcccgccctgatggagatcctgcagagcgactacatcctggcccaggtgcaggccgtgagactgctgagctacctggcccagaagaacgacctgctgtacgacatcctgaactgccaggtgcacagcaacttcctgaacctgttccagcccacccagagcggcagcctgctgtacgaggtgctggtgttcgccgagagactgagcgagggcagaaacgccccccactaccacgtggtgaagtggcactacaacgagcagagcctgcacgagagcctgttcggcgaggagagcagactggccgacagactgctggccctggtgatccaccccgaggaggacgtgcagatccaggcctgcaaggtgatcgtgagcctgcagtacccccaggacctgagagccagacccagcagctgccagcccagcagaagctacttcaagaacaccgagtag

SEQ ID NO: 18068 - DNA, 993 bp, Artificial Sequence
  Description of Artificial Sequence: Synthetic coding sequence
atgggcaagagcatcccccagtacctgggccagctggacatcagaaagagcgtggtgagcctggccaccggcgccggcgccatctacctgctgtacaaggccatcaaggccggcatcaagtgcaagccccccctgtgcagcaacagccccatctgcatcgccagactggccgtggagagagagagacacggcagagacagcggcgagctgagaagactgctgaacagcctggagtgcaagcaggacgagtacgccaagagcatgatcctgcacagcatcaccagatgcgtgtacctgctggaggccgaggccagcgcctgcaccaccgacgacatcgtgctgctgggctacatgctggacgacaaggacaacagcgtgaagacccaggccctgaacaccctgaaggccttcagcggcatcagaaagttcagactgaagatccaggagcacagcatcaaggtgctggagctgatcagcaccatctgggacaccgagctgcacatcgccggcctgagactgctgaacaacctgcccctgcccgactacgtgcacccccagctgagaagagtgatgcccgccctgatggagatcctgcagagcgactacatcctggcccaggtgcaggccgtgagactgctgagctacctggcccagaagaacgacctgctgtacgacatcctgaactgccagcccacccagagcggcagcctgctgtacgaggtgctggtgttcgccgagagactgagcgagggcagaaacgccccccactaccacgtggtgaagtggcactacaacgagcagagcctgcacgagagcctgttcggcgaggagagcagactggccgacagactgctggccctggtgatccaccccgaggaggacgtgcagatccaggcctgcaaggtgatcgtgagcctgcagtacccccaggacctgagagccagacccagcagctgccagcccagcagaagctacttcaagaacaccgagtag

SEQ ID NO: 18069 - DNA, 672 bp, Artificial Sequence
  Description of Artificial Sequence: Synthetic coding sequence
atgctgagccccaacgacaagatgctgggcaagctggaccccttctaccagcccagcgtgagcaagcagaagaccagcgccgagatcatcagcgaggccagaaacgccctgagaaccgtgagaacccagagacccttcaccccccaggaggcccagagaaagctgttcggccccgccagcagcagaaccagcgagaacagaccccccagcagcttcagcctgcacgccagcagcttcgagagcagcgacagcagacccatcagcggcaccagactgagccccctggagctgaagcccaaggtgcccgccagccccaccagagaggaggacagctgcttcagcttccccaagccccccgtggaccccgccaagatcagaagagtgagcaacgccagagccagactgttcagagccgccagccagagagccctgctgcccgacagaagcctgccccccagcgacagcaagaagaccgtggagagcaaggagaccgtgatgatgggcgacagcatggtgaagatcaacggcatctacctgaccaagagcaacgccatctgccacctgaagagccaccccctgcagctgaccgacgacggcggcttcagcgagatcaaggagcaggagatgttcaagggcaccaccagcctgcccagccacctgaagaacggctag

SEQ ID NO: 18070 - DNA, 2109 bp, Artificial Sequence
  Description of Artificial Sequence: Synthetic coding sequence
atgatgggcgacagcatggtgaagatcaacggcatctacctgaccaagagcaacgccatctgccacctgaagagccaccccctgcagctgaccgacgacggcggcttcagcgagatcaaggagcaggagatgttcaagggcaccaccagcctgcccagccacctgaagaacggcggcgaccagggcaagagacacgccagagccagcagctgccccagcagcagcgacctgagcagactgcagaccaaggccgtgcccaaggccgacctgcaggaggaggacgccgagatcgaggtggacgaggtgttctggaacaccagaatcgtgcccatcctgagagagctggagaaggaggagaacatcgagaccgtgtgcgccgcctgcacccagctgcaccacgccctggaggagggcaacatgctgggcaacaagttcaagggcagaagcatcctgctgaagaccctgtgcaagctggtggacgtgggcagcgacagcctgagcctgaagctggccaagatcatcctggccctgaaggtgagcagaaagaacctgctgaacgtgtgcaagctgatcttcaagatcagcagaaacgagaagaacgacagcctgatccagaacgacagcatcctggagagcctgctggaggtgctgagaagcgaggacctgcagaccaacatggaggccttcctgtactgcatgggcagcatcaagttcatcagcggcaacctgggcttcctgaacgagatgatcagcaagggcgccgtggagatcctgatcaacctgatcaagcagatcaacgagaacatcaagaagtgcggcaccttcctgcccaacagcggccacctgctggtgcaggtgaccgccaccctgagaaacctggtggacagcagcctggtgagaagcaagttcctgaacatcagcgccctgccccagctgtgcaccgccatggagcagtacaagggcgacaaggacgtgtgcaccaacatcgccagaatcttcagcaagctgaccagctacagagactgctgcaccgccctggccagctacagcagatgctacgccctgttcctgaacctgatcaacaagtaccagaagaagcaggacctggtggtgagagtggtgttcatcctgggcaacctgaccgccaagaacaaccaggccagagagcagttcagcaaggagaagggcagcatccagaccctgctgagcctgttccagaccttccaccagctggacctgcacagccagaagcccgtgggccagagaggcgagcagcacagagcccagagaccccccagcgaggccgaggacgtgctgatcaagctgaccagagtgctggccaacatcgccatccaccccggcgtgggccccgtgctggccgccaaccccggcatcgtgggcctgctgctgaccaccctggagtacaagagcctggacgactgcgaggagctggtgatcaacgccaccgccaccatcaacaacctgagctactaccaggtgaagaacagcatcatccaggacaagaagctgtacatcgccgagctgctgctgaagctgctggtgagcaacaacatggacggcatcctggaggccgtgagagtgttcggcaacctgagccaggaccacgacgtgtgcgacttcatcgtgcagaacaacgtgcacagattcatgatggccctgctggacgcccagcaccaggacatctgcttcagcgcctgcggcgtgctgctgaacctgaccgtggacaaggacaagagagtgatcctgaaggagggcggcggcatcaagaagctggtggactgcctgagagacctgggccccaccgactggcagctggcctgcctggtgtgcaagaccctgtggaacttcagcgagaacatcaccaacgccagcagctgcttcggcaacgaggacaccaacaccctgctgctgctgctgagcagcttcctggacgaggagctggccctggacggcagcttcgaccccgacctgaagaactaccacaagctgcactgggagaccgagttcaagcccgtggcccagcagctgctgaacagaatccagagacaccacaccttcctggagcccctgcccatccccagcttctag

SEQ ID NO: 18071 - DNA, 2604 bp, Artificial Sequence
  Description of Artificial Sequence: Synthetic coding sequence
atgctgagccccaacgacaagatgctgggcaagctggaccccttctaccagcccagcgtgagcaagcagaagaccagcgccgagatcatcagcgaggccagaaacgccctgagaaccgtgagaacccagagacccttcaccccccaggaggcccagagaaagctgttcggccccgccagcagcagaaccagcgagaacagaccccccagcagcttcagcctgcacgccagcagcttcgagagcagcgacagcagacccatcagcggcaccagactgagccccctggagctgaagcccaaggtgcccgccagccccaccagagaggaggacagctgcttcagcttccccaagccccccgtggaccccgccaagatcagaagagtgagcaacgccagagccagactgttcagagccgccagccagagagccctgctgcccgacagaagcctgccccccagcgacagcaagaagaccgtggagagcaaggagaccgtgatgatgggcgacagcatggtgaagatcaacggcatctacctgaccaagagcaacgccatctgccacctgaagagccaccccctgcagctgaccgacgacggcggcttcagcgagatcaaggagcaggagatgttcaagggcaccaccagcctgcccagccacctgaagaacggcggcgaccagggcaagagacacgccagagccagcagctgccccagcagcagcgacctgagcagactgcagaccaaggccgtgcccaaggccgacctgcaggaggaggacgccgagatcgaggtggacgaggtgttctggaacaccagaatcgtgcccatcctgagagagctggagaaggaggagaacatcgagaccgtgtgcgccgcctgcacccagctgcaccacgccctggaggagggcaacatgctgggcaacaagttcaagggcagaagcatcctgctgaagaccctgtgcaagctggtggacgtgggcagcgacagcctgagcctgaagctggccaagatcatcctggccctgaaggtgagcagaaagaacctgctgaacgtgtgcaagctgatcttcaagatcagcagaaacgagaagaacgacagcctgatccagaacgacagcatcctggagagcctgctggaggtgctgagaagcgaggacctgcagaccaacatggaggccttcctgtactgcatgggcagcatcaagttcatcagcggcaacctgggcttcctgaacgagatgatcagcaagggcgccgtggagatcctgatcaacctgatcaagcagatcaacgagaacatcaagaagtgcggcaccttcctgcccaacagcggccacctgctggtgcaggtgaccgccaccctgagaaacctggtggacagcagcctggtgagaagcaagttcctgaacatcagcgccctgccccagctgtgcaccgccatggagcagtacaagggcgacaaggacgtgtgcaccaacatcgccagaatcttcagcaagctgaccagctacagagactgctgcaccgccctggccagctacagcagatgctacgccctgttcctgaacctgatcaacaagtaccagaagaagcaggacctggtggtgagagtggtgttcatcctgggcaacctgaccgccaagaacaaccaggccagagagcagttcagcaaggagaagggcagcatccagaccctgctgagcctgttccagaccttccaccagctggacctgcacagccagaagcccgtgggccagagaggcgagcagcacagagcccagagaccccccagcgaggccgaggacgtgctgatcaagctgaccagagtgctggccaacatcgccatccaccccggcgtgggccccgtgctggccgccaaccccggcatcgtgggcctgctgctgaccaccctggagtacaagagcctggacgactgcgaggagctggtgatcaacgccaccgccaccatcaacaacctgagctactaccaggtgaagaacagcatcatccaggacaagaagctgtacatcgccgagctgctgctgaagctgctggtgagcaacaacatggacggcatcctggaggccgtgagagtgttcggcaacctgagccaggaccacgacgtgtgcgacttcatcgtgcagaacaacgtgcacagattcatgatggccctgctggacgcccagcaccaggacatctgcttcagcgcctgcggcgtgctgctgaacctgaccgtggacaaggacaagagagtgatcctgaaggagggcggcggcatcaagaagctggtggactgcctgagagacctgggccccaccgactggcagctggcctgcctggtgtgcaagaccctgtggaacttcagcgagaacatcaccaacgccagcagctgcttcggcaacgaggacaccaacaccctgctgctgctgctgagcagcttcctggacgaggagctggccctggacggcagcttcgaccccgacctgaagaactaccacaagctgcactgggagaccgagttcaagcccgtggcccagcagctgctgaacagaatccagagacaccacaccttcctggagcccctgcccatccccagcttctag

SEQ ID NO: 18072 - DNA, 2619 bp, Artificial Sequence
  Description of Artificial Sequence: Synthetic coding sequence
atgggcaagaagatcaagaaggaggtggagcccccccccaaggacgtgttcgaccccctgatgatcgagagcaagaaggccgccaccgtggtgctgatgctgaacagccccgaggaggagatcctggccaaggcctgcgaggccatctacaagttcgccctgaagggcgaggagaacaagaccaccctgctggagctgggcgccgtggagcccctgaccaagctgctgacccacgaggacaagatcgtgagaagaaacgccaccatgatcttcggcatcctggccagcaacaacgacgtgaagaagctgctgagagagctggacgtgatgaacagcgtgatcgcccagctggcccccgaggaggaggtggtgatccacgagttcgccagcctgtgcctggccaacatgagcgccgagtacaccagcaaggtgcagatcttcgagcacggcggcctggagcccctgatcagactgctgagcagccccgaccccgacgtgaagaagaacagcatggagtgcatctacaacctggtgcaggacttccagtgcagagccaagctgcaggagctgaacgccatcccccccatcctggacctgctgaagagcgagtaccccgtgatccagctgctggccctgaagaccctgggcgtgatcgccaacgacaaggagagcagaaccatgctgagagacaaccagggcctggaccacctgatcaagatcctggagaccaaggagctgaacgacctgcacatcgaggccctggccgtgatcgccaactgcctggaggacatggacaccatggtgcagatccagcagaccggcggcctgaagaagctgctgagcttcgccgagaacagcaccatccccgacatccagaagaacgccgccaaggccatcaccaaggccgcctacgaccccgagaacagaaagctgttccacgagcaggaggtggagaagtgcctggtggccctgctgggcagcgagaacgacggcaccaagatcgccgccagccaggccatcagcgccatgtgcgagaacagcggcagcaaggacttcttcaacaaccagggcatcccccagctgatccagctgctgaagagcgacaacgaggaggtgagagaggccgccgccctggccctggccaacctgaccacctgcaaccccgccaacgccaacgccgccgccgaggccgacggcatcgaccccctgatcaacctgctgagcagcaagagagacggcgccatcgccaacgccgccaccgtgctgaccaacatggccatgcaggagcccctgagactgaacatccagaaccacgacatcatgcacgccatcatcagccccctgagaagcgccaacaccgtggtgcagagcaaggccgccctggccgtgaccgccaccgcctgcgacgtggaggccagaaccgagctgagaaacagcggcggcctggagcccctggtggagctgctgagaagcaagaacgacgaggtgagaaagcacgccagctgggccgtgatggtgtgcgccggcgacgagctgaccgccaacgagctgtgcagactgggcgccctggacatcctggaggaggtgaacgtgagcggcaccagaaagaacaagttcagcgaggccgcctacaacaagctgctgaacaacaacctgagcctgaagtacagccagaccggctacctgagcagcagcaacatcatcaacgacggcttctacgactacggcagaatcaaccccggcaccaagctgctgcccctgaaggagctgtgcctgcaggagcccagcgacctgagagccgtgctgctgatcaacagcaagagctacgtgagcccccccagcagcatggaggacaagagcgacgtgggctacggcagaagcatcagcagcagcagcagcctgagaagaagcagcaaggagaagaacaagaagaacagctaccacttcagcgccggcttcggcagccccatcgaggacaagagcgagcccgccagcggcagaaacaccgtgctgagcaagagcgccaccaaggagaagggctggagaaagagcaagggcaagaaggaggaggagaaggtgaaggaggaggaggaggtgatggtggtgcccaagttcgtgggcgagggcagcagcgacaaggagtggtgcccccccagcgaccccgacttcagcatgtacgtgtacgaggtgaccaagagcatcctgcccatcaccaacatcaaggagcagatcgaggacctggccaagtacgtggccgagaagatgggcggcaagatccccaaggagaagctgcccgacttcagctgggagctgcacatcagcgagctgaagttccagctgaagagcaacgtgatccccatcggccacgtgaagaagggcatcttctaccacagagccctgctgttcaaggccctggccgacagaatcggcatcggctgcagcctggtgagaggcgagtacggcagagcctggaacgaggtgatgctgcagaacgacagcagaaagggcgtgatcggcggcctgcccgcccccgagatgtacgtgatcgacctgatgttccaccccggcggcctgatgaagctgagaagcagagaggccgacctgtacagattcatctag

SEQ ID NO: 18073 - DNA, 1830 bp, Artificial Sequence
  Description of Artificial Sequence: Synthetic coding sequence
atggacaccatggtgcagatccagcagaccggcggcctgaagaagctgctgagcttcgccgagaacagcaccatccccgacatccagaagaacgccgccaaggccatcaccaaggccgcctacgaccccgagaacagaaagctgttccacgagcaggaggtggagaagtgcctggtggccctgctgggcagcgagaacgacggcaccaagatcgccgccagccaggccatcagcgccatgtgcgagaacagcggcagcaaggacttcttcaacaaccagggcatcccccagctgatccagctgctgaagagcgacaacgaggaggtgagagaggccgccgccctggccctggccaacctgaccacctgcaaccccgccaacgccaacgccgccgccgaggccgacggcatcgaccccctgatcaacctgctgagcagcaagagagacggcgccatcgccaacgccgccaccgtgctgaccaacatggccatgcaggagcccctgagactgaacatccagaaccacgacatcatgcacgccatcatcagccccctgagaagcgccaacaccgtggtgcagagcaaggccgccctggccgtgaccgccaccgcctgcgacgtggaggccagaaccgagctgagaaacagcggcggcctggagcccctggtggagctgctgagaagcaagaacgacgaggtgagaaagcacgccagctgggccgtgatggtgtgcgccggcgacgagctgaccgccaacgagctgtgcagactgggcgccctggacatcctggaggaggtgaacgtgagcggcaccagaaagaacaagttcagcgaggccgcctacaacaagctgctgaacaacaacctgagcctgaagtacagccagaccggctacctgagcagcagcaacatcatcaacgacggcttctacgactacggcagaatcaaccccggcaccaagctgctgcccctgaaggagctgtgcctgcaggagcccagcgacctgagagccgtgctgctgatcaacagcaagagctacgtgagcccccccagcagcatggaggacaagagcgacgtgggctacggcagaagcatcagcagcagcagcagcctgagaagaagcagcaaggagaagaacaagaagaacagctaccacttcagcgccggcttcggcagccccatcgaggacaagagcgagcccgccagcggcagaaacaccgtgctgagcaagagcgccaccaaggagaagggctggagaaagagcaagggcaagaaggaggaggagaaggtgaaggaggaggaggaggtgatggtggtgcccaagttcgtgggcgagggcagcagcgacaaggagtggtgcccccccagcgaccccgacttcagcatgtacgtgtacgaggtgaccaagagcatcctgcccatcaccaacatcaaggagcagatcgaggacctggccaagtacgtggccgagaagatgggcggcaagatccccaaggagaagctgcccgacttcagctgggagctgcacatcagcgagctgaagttccagctgaagagcaacgtgatccccatcggccacgtgaagaagggcatcttctaccacagagccctgctgttcaaggccctggccgacagaatcggcatcggctgcagcctggtgagaggcgagtacggcagagcctggaacgaggtgatgctgcagaacgacagcagaaagggcgtgatcggcggcctgcccgcccccgagatgtacgtgatcgacctgatgttccaccccggcggcctgatgaagctgagaagcagagaggccgacctgtacagattcatctag

SEQ ID NO: 18074 - DNA, 2067 bp, Artificial Sequence
  Description of Artificial Sequence: Synthetic coding sequence
atgggcaagaagatcaagaaggaggtggagcccccccccaaggacgtgttcgaccccctgatgatcgagagcaagaaggccgccaccgtggtgctgatgctgaacagccccgaggaggagatcctggccaaggcctgcgaggccatctacaagttcgccctgaagggcgaggagaacaagaccaccctgctggagctgggcgccgtggagcccctgaccaagctgctgacccacgaggacaagatcgtgagaagaaacgccaccatgatcttcggcatcctggccagcaacaacgacgtgaagaagctgctgagagagctggacgtgatgaacagcgtgatcgcccagctggcccccgaggaggaggtggtgatccacgagttcgccagcctgtgcctggccaacatgagcgccgagtacaccagcaaggtgcagatcttcgagcacggcggcctggagcccctgatcagactgctgagcagccccgaccccgacgtgaagaagaacagcatggagtgcatctacaacctggtgcaggacttccagtgcagagccaagctgcaggagctgaacgccatcccccccatcctggacctgctgaagagcgagtaccccgtgatccagctgctggccctgaagaccctgggcgtgatcgccaacgacaaggagagcagaaccatgctgagagacaaccagggcctggaccacctgatcaagatcctggagaccaaggagctgaacgacctgcacatcgaggccctggccgtgatcgccaactgcctggaggacatggacaccatggtgcagatccagcagaccggcggcctgaagaagctgctgagcttcgccgagaacagcaccatccccgacatccagaagaacgccgccaaggccatcaccaaggccgcctacgaccccgagaacagaaagctgttccacgagcaggaggtggagaagtgcctggtggccctgctgggcagcgagaacgacggcaccaagatcgccgccagccaggccatcagcgccatgtgcgagaacagcggcagcaaggacttcttcaacaaccagggcatcccccagctgatccagctgctgaagagcgacaacgaggaggtgagagaggccgccgccctggccctggccaacctgaccacctgcaaccccgccaacgccaacgccgccgccgaggccgacggcatcgaccccctgatcaacctgctgagcagcaagagagacggcgccatcgccaacgccgccaccgtgctgaccaacatggccatgcaggagcccctgagactgaacatccagaaccacgacatcatgcacgccatcatcagccccctgagaagcgccaacaccgtggtgcagagcaaggccgccctggccgtgaccgccaccgcctgcgacgtggaggccagaaccgagctgagaaacagcggcggcctggagcccctggtggagctgctgagaagcaagaacgacgaggtgagaaagcacgccagctgggccgtgatggtgtgcgccggcgacgagctgaccgccaacgagctgtgcagactgggcgccctggacatcctggaggaggtgaacgtgagcggcaccagaaagaacaagttcagcgaggccgcctacaacaagctgctgaacaacaacctgagcctgaagtacagccagaccggctacctgagcagcagcaacatcatcaacgacggcttctacgactacggcagaatcaaccccggcaccaagctgctgcccctgaaggagctgtgcctgcaggagcccagcgacctgagagccgtgctgctgatcaacagcaagagctacgtgagcccccccagcagcatggaggacaagagcgacgtgggctacggcagaagcatcagcagcagcagcagcctgagaagaagcagcaaggagaagaacaagaagaacagctaccacttcagcgccggcttcggcagccccatcgaggacaagagcgagcccgccagcggcagaaacaccgtgctgagcaagagcgccaccaaggagaagggctggagcagcctgcccaccagcagatag

SEQ ID NO: 18075 - DNA, 2598 bp, Artificial Sequence
  Description of Artificial Sequence: Synthetic coding sequence
atgggcaagaagatcaagaaggaggtggagcccccccccaaggacgtgttcgaccccctgatgatcgagagcaagaaggccgccaccgtggtgctgatgctgaacagccccgaggaggagatcctggccaaggcctgcgaggccatctacaagttcgccctgaagggcgaggagaacaagaccaccctgctggagctgggcgccgtggagcccctgaccaagctgctgacccacgaggacaagatcgtgagaagaaacgccaccatgatcttcggcatcctggccagcaacaacgacgtgaagaagctgctgagagagctggacgtgatgaacagcgtgatcgcccagctggcccccgaggaggaggtggtgatccacgagttcgccagcctgtgcctggccaacatgagcgccgagtacaccagcaaggtgcagatcttcgagcacggcggcctggagcccctgatcagactgctgagcagccccgaccccgacgtgaagaagaacagcatggagtgcatctacaacctggtgcaggacttccagtgcagagccaagctgcaggagctgaacgccatcccccccatcctggacctgctgaagagcgagtaccccgtgatccagctgctggccctgaagaccctgggcgtgatcgccaacgacaaggagagcagaaccatgctgagagacaaccagggcctggaccacctgatcaagatcctggagaccaaggagctgaacgacctgcacatcgaggccctggccgtgatcgccaactgcctggaggacatggacaccatggtgcagatccagcagaccggcggcctgaagaagctgctgagcttcgccgagaacagcaccatccccgacatccagaagaacgccgccaaggccatcaccaaggccgcctacgaccccgagaacagaaagctgttccacgagcaggaggtggagaagtgcctggtggccctgctgggcagcgagaacgacggcaccaagatcgccgccagccaggccatcagcgccatgtgcgagaacagcggcagcaaggacttcttcaacaaccagggcatcccccagctgatccagctgctgaagagcgacaacgaggaggtgagagaggccgccgccctggccctggccaacctgaccacctgcaaccccgccaacgccaacgccgccgccgaggccgacggcatcgaccccctgatcaacctgctgagcagcaagagagacggcgccatcgccaacgccgccaccgtgctgaccaacatggccatgcaggagcccctgagactgaacatccagaaccacgacatcatgcacgccatcatcagccccctgagaagcgccaacaccgtggtgcagagcaaggccgccctggccgtgaccgccaccgcctgcgacgtggaggccagaaccgagctgagaaacagcggcggcctggagcccctggtggagctgctgagaagcaagaacgacgaggtgagaaagcacgccagctgggccgtgatggtgtgcgccggcgacgagctgaccgccaacgagctgtgcagactgggcgccctggacatcctggaggaggtgaacgtgagcggcaccagaaagaacaagttcagcgaggccgcctacaacaagctgctgaacaacaacctgagcctgaagtacagccagaccggctacctgagcagcagcaacatcatcaacgacggcttctacgactacggcagaatcaaccccggcaccaagctgctgcccctgaaggagctgtgcctgcaggagcccagcgacctgagagccgtgctgctgatcaacagcaagagctacgtgagcccccccagcagcatggaggacaagagcgacgtgggctacggcagaagcatcagcagcagcagcagcctgagaagaagcagcaaggagaagaacaacgccggcttcggcagccccatcgaggacaagagcgagcccgccagcggcagaaacaccgtgctgagcaagagcgccaccaaggagaagggctggagaaagagcaagggcaagaaggaggaggagaaggtgaaggaggaggaggaggtgatggtggtgcccaagttcgtgggcgagggcagcagcgacaaggagtggtgcccccccagcgaccccgacttcagcatgtacgtgtacgaggtgaccaagagcatcctgcccatcaccaacatcaaggagcagatcgaggacctggccaagtacgtggccgagaagatgggcggcaagatccccaaggagaagctgcccgacttcagctgggagctgcacatcagcgagctgaagttccagctgaagagcaacgtgatccccatcggccacgtgaagaagggcatcttctaccacagagccctgctgttcaaggccctggccgacagaatcggcatcggctgcagcctggtgagaggcgagtacggcagagcctggaacgaggtgatgctgcagaacgacagcagaaagggcgtgatcggcggcctgcccgcccccgagatgtacgtgatcgacctgatgttccaccccggcggcctgatgaagctgagaagcagagaggccgacctgtacagattcatctag

SEQ ID NO: 18076 - DNA, 1059 bp, Artificial Sequence
  Description of Artificial Sequence: Synthetic coding sequence
atgaaggagaacagcatcgccctgaacatcctgggcaagatcaccagagacgacgaccccgagagcgagatcaagatgaagatcgccatgctgctgaagcagctggacctgcacctgctgaaccacagcctgaagcacatcagcctggagatcagcctgagccccatgaccgtgaagaaggacatcgagctgctgaagagattcagcggcaagggcaaccagaccgtgctggagagcatcgagtacaccagcgactacgagttcagcaacggctgcagagcccccccctggagacagatcagaggcgagatctgctacgtgctggtgaagccccacgacggcgagaccctgtgcatcacctgcagcgccggcggcgtgttcctgaacggcggcaagaccgacgacgagggcgacgtgaactacgagagaaagggcagcatctacaagaacctggtgaccttcctgagagagaagagccccaagttcagcgagaacatgagcaagctgggcatcagcttcagcgaggaccagcagaaggagaaggaccagctgggcaaggcccccaagaaggaggaggccgccgccctgagaaaggacatcagcggcagcgacaagagaagcctggagaagaaccagatcaacttctggagaaaccagatgaccaagagatgggagcccagcctgaactggaagaccaccgtgaactacaagggcaagggcagcgccaaggagatccaggaggacaagcacaccggcaagctggagaagcccagacccagcgtgagccacggcagagcccagctgctgagaaagagcgccgagaagatcgaggagaccgtgagcgacagcagcagcgagagcgaggaggacgaggagccccccgaccacagacaggaggccagcgccgacctgcccagcgagtactggcagatccagaagctggtgaagtacctgaagcagaaggagaccagccagaacggcagaaacaagagatggatcagaaagcagaacaccagagtgatcagaagcatgatcttcgacgtgggcaagaccagctag

SEQ ID NO: 18077 - DNA, 3135 bp, Artificial Sequence
  Description of Artificial Sequence: Synthetic coding sequence
atgggcgtggccctgagaaagctgacccagtggaccgccgccggccacggcaccggcatcctggagatcacccccctgaacgaggccatcctgaaggagatcatcgtgttcgtggagagcttcatctacaagcacccccaggaggccaagttcgtgttcgtggagcccctggagtggaacaccagcctggcccccagcgccttcgagagcggctacgtggtgagcgagaccaccgtgaagagcgaggaggtggacaagaacggccagcccctgctgttcctgagcgtgccccagatcaagatcagaagcttcggccagctgagcagactgctgctgatcgccaagaccggcaagctgaaggaggcccaggcctgcgtggaggccaacagagaccccatcgtgaagatcctgggcagcgactacaacaccatgaaggagaacagcatcgccctgaacatcctgggcaagatcaccagagacgacgaccccgagagcgagatcaagatgaagatcgccatgctgctgaagcagctggacctgcacctgctgaaccacagcctgaagcacatcagcctggagatcagcctgagccccatgaccgtgaagaaggacatcgagctgctgaagagattcagcggcaagggcaaccagaccgtgctggagagcatcgagtacaccagcgactacgagttcagcaacggctgcagagcccccccctggagacagatcagaggcgagatctgctacgtgctggtgaagccccacgacggcgagaccctgtgcatcacctgcagcgccggcggcgtgttcctgaacggcggcaagaccgacgacgagggcgacgtgaactacgagagaaagggcagcatctacaagaacctggtgaccttcctgagagagaagagccccaagttcagcgagaacatgagcaagctgggcatcagcttcagcgaggaccagcagaaggagaaggaccagctgggcaaggcccccaagaaggaggaggccgccgccctgagaaaggacatcagcggcagcgacaagagaagcctggagaagaaccagatcaacttctggagaaaccagatgaccaagagatgggagcccagcctgaactggaagaccaccgtgaactacaagggcaagggcagcgccaaggagatccaggaggacaagcacaccggcaagctggagaagcccagacccagcgtgagccacggcagagcccagctgctgagaaagagcgccgagaagatcgaggagaccgtgagcgacagcagcagcgagagcgaggaggacgaggagccccccgaccacagacaggaggccagcgccgacctgcccagcgagtactggcagatccagaagctggtgaagtacctgaagggcggcaaccagaccgccaccgtgatcgccctgtgcagcatgagagacttcagcctggcccaggagacctgccagctggccatcagagacgtgggcggcctggaggtgctgatcaacctgctggagaccgacgaggtgaagtgcaagatcggcagcctgaagatcctgaaggagatcagccacaacccccagatcagacagaacatcgtggacctgggcggcctgcccatcatggtgaacatcctggacagcccccacaagagcctgaagtgcctggccgccgagaccatcgccaacgtggccaagttcaagagagccagaagagtggtgagacagcacggcggcatcaccaagctggtggccctgctggactgcgcccacgacagcaccaagcccgcccagagcagcctgtacgaggccagagacgtggaggtggccagatgcggcgccctggccctgtggagctgcagcaagagccacaccaacaaggaggccatcagaaaggccggcggcatccccctgctggccagactgctgaagaccagccacgagaacatgctgatccccgtggtgggcaccctgcaggagtgcgccagcgaggagaactacagagccgccatcaaggccgagagaatcatcgagaacctggtgaagaacctgaacagcgagaacgagcagctgcaggagcactgcgccatggccatctaccagtgcgccgaggacaaggagaccagagacctggtgagactgcacggcggcctgaagcccctggccagcctgctgaacaacaccgacaacaaggagagactggccgccgtgaccggcgccatctggaagtgcagcatcagcaaggagaacgtgaccaagttcagagagtacaaggccatcgagaccctggtgggcctgctgaccgaccagcccgaggaggtgctggtgaacgtggtgggcgccctgggcgagtgctgccaggagagagagaacagagtgatcgtgagaaagtgcggcggcatccagcccctggtgaacctgctggtgggcatcaaccaggccctgctggtgaacgtgaccaaggccgtgggcgcctgcgccgtggagcccgagagcatgatgatcatcgacagactggacggcgtgagactgctgtggagcctgctgaagaacccccaccccgacgtgaaggccagcgccgcctgggccctgtgcccctgcatcaagaacgccaaggacgccggcgagatggtgagaagcttcgtgggcggcctggagctgatcgtgaacctgctgaagagcgacaacaaggaggtgctggccagcgtgtgcgccgccatcaccaacatcgccaaggaccaggagaacctggccgtgatcaccgaccacggcgtggtgcccctgctgagcaagctggccaacaccaacaacaacaagctgagacaccacctggccgaggccatcagcagatgctgcatgtggggcagaaacagagtggccttcggcgagcacaaggccgtggcccccctggtgagatacctgaagagcaacgacaccaacgtgcacagagccaccgcccaggccctgtaccagctgagcgaggacgccgacaactgcatcaccatgcacgagaacggcgccgtgaagctgctgctggacatggtgggcagccccgaccaggacctgcaggaggccgccgccggctgcatcagcaacatcagaagactggccctggccaccgagaaggccagatacacctag

SEQ ID NO: 18078 - DNA, 1170 bp, Artificial Sequence
  Description of Artificial Sequence: Synthetic coding sequence
ctgagcagactgctgctgatcgccaagaccggcaagctgaaggaggcccaggcctgcgtggaggccaacagagaccccatcgtgaagatcctgggcagcgactacaacaccatgaaggagaacagcatcgccctgaacatcctgggcaagatcaccagagacgacgaccccgagagcgagatcaagatgaagatcgccatgctgctgaagcagctggacctgcacctgctgaaccacagcctgaagcacatcagcctggagatcagcctgagccccatgaccgtgaagaaggacatcgagctgctgaagagattcagcggcaagggcaaccagaccgtgctggagagcatcgagtacaccagcgactacgagttcagcaacggctgcagagcccccccctggagacagatcagaggcgagatctgctacgtgctggtgaagccccacgacggcgagaccctgtgcatcacctgcagcgccggcggcgtgttcctgaacggcggcaagaccgacgacgagggcgacgtgaactacgagagaaagggcagcatctacaagaacctggtgaccttcctgagagagaagagccccaagttcagcgagaacatgagcaagctgggcatcagcttcagcgaggaccagcagaaggagaaggaccagctgggcaaggcccccaagaaggaggaggccgccgccctgagaaaggacatcagcggcagcgacaagagaagcctggagaagaaccagatcaacttctggagaaaccagatgaccaagagatgggagcccagcctgaactggaagaccaccgtgaactacaagggcaagggcagcgccaaggagatccaggaggacaagcacaccggcaagctggagaagcccagacccagcgtgagccacggcagagcccagctgctgagaaagagcgccgagaagatcgaggagaccgtgagcgacagcagcagcgagagcgaggaggacgaggagccccccgaccacagacaggaggccagcgccgacctgcccagcgagtactggcagatccagaagctggtgaagtacctgaagcagaaggagaccagccagaacggcagaaacaagagatggatcagaaagcagaacaccagagtgatcagaagcatgatcttcgacgtgggcaagaccagctag

SEQ ID NO: 18079 - DNA, 621 bp, Artificial Sequence
  Description of Artificial Sequence: Synthetic coding sequence
atgagcaagctgggcatcagcttcagcgaggaccagcagaaggagaaggaccagctgggcaaggcccccaagaaggaggaggccgccgccctgagaaaggacatcagcggcagcgacaagagaagcctggagaagaaccagatcaacttctggagaaaccagatgaccaagagatgggagcccagcctgaactggaagaccaccgtgaactacaagggcaagggcagcgccaaggagatccaggaggacaagcacaccggcaagctggagaagcccagacccagcgtgagccacggcagagcccagctgctgagaaagagcgccgagaagatcgaggagaccgtgagcgacagcagcagcgagagcgaggaggacgaggagccccccgaccacagacaggaggccagcgccgacctgcccagcgagtactggcagatccagaagctggtgaagtacctgaagggcggcaaccagaccgccaccgtgatcgccctgtgcagcatgagagacttcagcctggcccaggagacctgccagctggccatcagagacgtgggcggcctggaggtgctgatcatctgcctgaagcccatgaagagcaacgtgagactggtgcactag

SEQ ID NO: 18080 - DNA, 2118 bp, Artificial Sequence
  Description of Artificial Sequence: Synthetic coding sequence
atgagcaagctgggcatcagcttcagcgaggaccagcagaaggagaaggaccagctgggcaaggcccccaagaaggaggaggccgccgccctgagaaaggacatcagcggcagcgacaagagaagcctggagaagaaccagatcaacttctggagaaaccagatgaccaagagatgggagcccagcctgaactggaagaccaccgtgaactacaagggcaagggcagcgccaaggagatccaggaggacaagcacaccggcaagctggagaagcccagacccagcgtgagccacggcagagcccagctgctgagaaagagcgccgagaagatcgaggagaccgtgagcgacagcagcagcgagagcgaggaggacgaggagccccccgaccacagacaggaggccagcgccgacctgcccagcgagtactggcagatccagaagctggtgaagtacctgaagggcggcaaccagaccgccaccgtgatcgccctgtgcagcatgagagacttcagcctggcccaggagacctgccagctggccatcagagacgtgggcggcctggaggtgctgatcaacctgctggagaccgacgaggtgaagtgcaagatcggcagcctgaagatcctgaaggagatcagccacaacccccagatcagacagaacatcgtggacctgggcggcctgcccatcatggtgaacatcctggacagcccccacaagagcctgaagtgcctggccgccgagaccatcgccaacgtggccaagttcaagagagccagaagagtggtgagacagcacggcggcatcaccaagctggtggccctgctggactgcgcccacgacagcaccaagcccgcccagagcagcctgtacgaggccagagacgtggaggtggccagatgcggcgccctggccctgtggagctgcagcaagagccacaccaacaaggaggccatcagaaaggccggcggcatccccctgctggccagactgctgaagaccagccacgagaacatgctgatccccgtggtgggcaccctgcaggagtgcgccagcgaggagaactacagagccgccatcaaggccgagagaatcatcgagaacctggtgaagaacctgaacagcgagaacgagcagctgcaggagcactgcgccatggccatctaccagtgcgccgaggacaaggagaccagagacctggtgagactgcacggcggcctgaagcccctggccagcctgctgaacaacaccgacaacaaggagagactggccgccgtgaccggcgccatctggaagtgcagcatcagcaaggagaacgtgaccaagttcagagagtacaaggccatcgagaccctggtgggcctgctgaccgaccagcccgaggaggtgctggtgaacgtggtgggcgccctgggcgagtgctgccaggagagagagaacagagtgatcgtgagaaagtgcggcggcatccagcccctggtgaacctgctggtgggcatcaaccaggccctgctggtgaacgtgaccaaggccgtgggcgcctgcgccgtggagcccgagagcatgatgatcatcgacagactggacggcgtgagactgctgtggagcctgctgaagaacccccaccccgacgtgaaggccagcgccgcctgggccctgtgcccctgcatcaagaacgccaaggacgccggcgagatggtgagaagcttcgtgggcggcctggagctgatcgtgaacctgctgaagagcgacaacaaggaggtgctggccagcgtgtgcgccgccatcaccaacatcgccaaggaccaggagaacctggccgtgatcaccgaccacggcgtggtgcccctgctgagcaagctggccaacaccaacaacaacaagctgagacaccacctggccgaggccatcagcagatgctgcatgtggggcagaaacagagtggccttcggcgagcacaaggccgtggcccccctggtgagatacctgaagagcaacgacaccaacgtgcacagagccaccgcccaggccctgtaccagctgagcgaggacgccgacaactgcatcaccatgcacgagaacggcgccgtgaagaagaacatcttcatcagctag

SEQ ID NO: 18081 - DNA, 1839 bp, Artificial Sequence
  Description of Artificial Sequence: Synthetic coding sequence
atgagagacttcagcctggcccaggagacctgccagctggccatcagagacgtgggcggcctggaggtgctgatcaacctgctggagaccgacgaggtgaagtgcaagatcggcagcctgaagatcctgaaggagatcagccacaacccccagatcagacagaacatcgtggacctgggcggcctgcccatcatggtgaacatcctggacagcccccacaagagcctgaagtgcctggccgccgagaccatcgccaacgtggccaagttcaagagagccagaagagtggtgagacagcacggcggcatcaccaagctggtggccctgctggactgcgcccacgacagcaccaagcccgcccagagcagcctgtacgaggccagagacgtggaggtggccagatgcggcgccctggccctgtggagctgcagcaagagccacaccaacaaggaggccatcagaaaggccggcggcatccccctgctggccagactgctgaagaccagccacgagaacatgctgatccccgtggtgggcaccctgcaggagtgcgccagcgaggagaactacagagccgccatcaaggccgagagaatcatcgagaacctggtgaagaacctgaacagcgagaacgagcagctgcaggagcactgcgccatggccatctaccagtgcgccgaggacaaggagaccagagacctggtgagactgcacggcggcctgaagcccctggccagcctgctgaacaacaccgacaacaaggagagactggccgccgtgaccggcgccatctggaagtgcagcatcagcaaggagaacgtgaccaagttcagagagtacaaggccatcgagaccctggtgggcctgctgaccgaccagcccgaggaggtgctggtgaacgtggtgggcgccctgggcgagtgctgccaggagagagagaacagagtgatcgtgagaaagtgcggcggcatccagcccctggtgaacctgctggtgggcatcaaccaggccctgctggtgaacgtgaccaaggccgtgggcgcctgcgccgtggagcccgagagcatgatgatcatcgacagactggacggcgtgagactgctgtggagcctgctgaagaacccccaccccgacgtgaaggccagcgccgcctgggccctgtgcccctgcatcaagaacgccaaggacgccggcgagatggtgagaagcttcgtgggcggcctggagctgatcgtgaacctgctgaagagcgacaacaaggaggtgctggccagcgtgtgcgccgccatcaccaacatcgccaaggaccaggagaacctggccgtgatcaccgaccacggcgtggtgcccctgctgagcaagctggccaacaccaacaacaacaagctgagacaccacctggccgaggccatcagcagatgctgcatgtggggcagaaacagagtggccttcggcgagcacaaggccgtggcccccctggtgagatacctgaagagcaacgacaccaacgtgcacagagccaccgcccaggccctgtaccagctgagcgaggacgccgacaactgcatcaccatgcacgagaacggcgccgtgaagaccgagagcagacacgtggccagactggagtgcagcgacaacgacctgggcagcctgcagccccccccccccggcttcaagagattcagctgcctgagcctgctgagcagctgggactacagcttctactggatctggctgggccccctgaccagaatcagcagaaagctgcagctggtggtgtaccccatcagcgccggctggctgctgctgcagagaagacaggacaccctggagatctag

SEQ ID NO: 18082 - DNA, 2808 bp, Artificial Sequence
  Description of Artificial Sequence: Synthetic coding sequence
atggccgccgccaagcccaccctgaccgacagcctgagcttctgcctggcccagctggccgccgccgccggcgaggccctgggcggcgagaaggaccccgccaccaacgagacccccctgagcagagccctgctggccctgagaaccagacacatcaaggccgccggcggcatcgagagattcagagccagaggcggcctgagacccctgctggccctgctgagaagagccgccgccgccggcagcgcccccagccaggccggccccggcagcgcccccagcagcgccgccagcggcgccagcagccccgcccccgccagcggccccgcccccagcgccgtgagcagcagcagccccaccccccccgtgagactgagaaagaccctggacctggccctgagcatcctggccgactgctgcaccgagggcgcctgcagaaccgaggtgagaagactgggcggcatcctgcccctggtgaccatcctgcagtgcatgaagaccgacagcatccagaacagaaccgccagagccctgggcaacctggccatggagcccgagagctgcggcgacatccactgcgccggcgccgtgcccctgctggtggagagcctgaccgcctgccaggacagccagtgcctgcagagcgtggtgagagccctgagaaacctggccgacagcccccagcacagactggccctggcccagcagggcgccgtgagacccctggccgagctgctggccaccgcccccgacgccgccctgaccctggccctggtgagagccctgctggagctgagcagaggctgcagcagagcctgcgccgagcagctgagcctgggcggcggcctgggccccctggtgagcctggccagccaccccaagagagccgtgagagagggcaccatcctgatcctggccaacctgtgcgcccagggcctgatcagacccgccctgggcaacgccggcggcgtggaggtgctggtggacgagctgagacagagaagagaccccaacggcgccagccccaccagccagcagcccctggtgagagccgtgtgcctgctgtgcagagaggccatcaacagagccagactgagagacgccggcggcctggacctgctgatgggcctgctgagagaccccagagccagcgcctggcaccccagaatcgtggccgccctggtgggcttcctgtacgacaccggcgccctgggcagactgcaggccctgggcctggtgcccctgctggccggccagctgtgcggcgaggccggcgaggaggaggaggagggcagagaggccgccagctgggacttccccgaggagagaacccccgagagagcccagggcggcagcttcagaagcctgagaagctggctgatcagcgagggctacgccaccggccccgacgacatcagccccgactggagccccgagcagtgcccccccgagcccatggagcccgccagccccgcccccacccccaccagcctgagagcccccagaacccagagaacccccggcagaagccccgccgccgccatcgaggagccctggggcagagagggccccgccctgctgctgctgagcagattcagccaggcccccgaccccagcggcgccctggtgaccggccccgccctgtacggcctgctgacctacgtgaccggcgcccccggcccccccagccccagagccctgagaatcctgagcagactgacctgcaaccccgcctgcctggaggccttcgtgagaagctacggcgccgccctgctgagagcctggctggtgctgggcgtggcccccgacgactggcccgcccccagagccagacccaccctgcacagcagacacagagagctgggcgagagactgctgcagaacctgaccgtgcaggccgagagccccttcggcgtgggcgccctgacccacctgctgctgagcggcagccccgaggacagagtggcctgcgccctgaccctgcccttcatctgcagaaagcccagcctgtggagaagactgctgctggagcagggcggcctgagactgctgctggccgccctgaccagacccgccccccaccccctgttcctgttcttcgccgccgacagcctgagctgcctgcaggacctggtgagccccaccgtgagccccgccgtgccccaggccgtgcccatggacctggacagccccagcccctgcctgtacgagcccctgctgggccccgcccccgtgcccgcccccgacctgcacttcctgctggacagcggcctgcagctgcccgcccagagagccgccagcgccaccgccagccccttcttcagagccctgctgagcggcagcttcgccgaggcccagatggacctggtgcccctgagaggcctgagccccggcgccgcctggcccgtgctgcaccacctgcacggctgcagaggctgcggcgccgccctgggccccgtgcccccccccggccagcccctgctgggcagcgaggccgaggaggccctggaggccgccggcagattcctgctgcccggcctggaggaggagctggaggaggccgtgggcagaatccacctgggcccccagggcggccccgagagcgtgggcgaggtgttcagactgggcagacccagactggccgcccactgcgccagatggaccctgggcagcgagcagtgccccagaaagagaggcctggccctggtgggcctggtggaggccgccggcgaggaggccggccccctgaccgaggccctgctggccgtggtgatgggcatcgagctgggcgccagagtgcccgcctag

SEQ ID NO: 18083 - DNA, 3093 bp, Artificial Sequence
  Description of Artificial Sequence: Synthetic coding sequence
atggtgaccctgggcgccggcgtgagactgttcaccggcgtgtaccccgtggtgctgaaccagatcagagccaccagcgaggccagcgccatcaccagaaccaccatgcccgcccccgagctgaccagcaccagcagagccgaggacaccagagacaccggcgtgcagctgagaaagagaaagatcccccaggccagacacagcagaaagagacagagaaccttcagcttcagaagcctgggcagcgccgccagaagcggcgccgagagcgaggccagagccaagatggccgccgccaagcccaccctgaccgacagcctgagcttctgcctggcccagctggccgccgccgccggcgaggccctgggcggcgagaaggaccccgccaccaacgagacccccctgagcagagccctgctggccctgagaaccagacacatcaaggccgccggcggcatcgagagattcagagccagaggcggcctgagacccctgctggccctgctgagaagagccgccgccgccggcagcgcccccagccaggccggccccggcagcgcccccagcagcgccgccagcggcgccagcagccccgcccccgccagcggccccgcccccagcgccgtgagcagcagcagccccaccccccccgtgagactgagaaagaccctggacctggccctgagcatcctggccgactgctgcaccgagggcgcctgcagaaccgaggtgagaagactgggcggcatcctgcccctggtgaccatcctgcagtgcatgaagaccgacagcatccagaacagaaccgccagagccctgggcaacctggccatggagcccgagagctgcggcgacatccactgcgccggcgccgtgcccctgctggtggagagcctgaccgcctgccaggacagccagtgcctgcagagcgtggtgagagccctgagaaacctggccgacagcccccagcacagactggccctggcccagcagggcgccgtgagacccctggccgagctgctggccaccgcccccgacgccgccctgaccctggccctggtgagagccctgctggagctgagcagaggctgcagcagagcctgcgccgagcagctgagcctgggcggcggcctgggccccctggtgagcctggccagccaccccaagagagccgtgagagagggcaccatcctgatcctggccaacctgtgcgcccagggcctgatcagacccgccctgggcaacgccggcggcgtggaggtgctggtggacgagctgagacagagaagagaccccaacggcgccagccccaccagccagcagcccctggtgagagccgtgtgcctgctgtgcagagaggccatcaacagagccagactgagagacgccggcggcctggacctgctgatgggcctgctgagagaccccagagccagcgcctggcaccccagaatcgtggccgccctggtgggcttcctgtacgacaccggcgccctgggcagactgcaggccctgggcctggtgcccctgctggccggccagctgtgcggcgaggccggcgaggaggaggaggagggcagagaggccgccagctgggacttccccgaggagagaacccccgagagagcccagggcggcagcttcagaagcctgagaagctggctgatcagcgagggctacgccaccggccccgacgacatcagccccgactggagccccgagcagtgcccccccgagcccatggagcccgccagccccgcccccacccccaccagcctgagagcccccagaacccagagaacccccggcagaagccccgccgccgccatcgaggagccctggggcagagagggccccgccctgctgctgctgagcagattcagccaggcccccgaccccagcggcgccctggtgaccggccccgccctgtacggcctgctgacctacgtgaccggcgcccccggcccccccagccccagagccctgagaatcctgagcagactgacctgcaaccccgcctgcctggaggccttcgtgagaagctacggcgccgccctgctgagagcctggctggtgctgggcgtggcccccgacgactggcccgcccccagagccagacccaccctgcacagcagacacagagagctgggcgagagactgctgcagaacctgaccgtgcaggccgagagccccttcggcgtgggcgccctgacccacctgctgctgagcggcagccccgaggacagagtggcctgcgccctgaccctgcccttcatctgcagaaagcccagcctgtggagaagactgctgctggagcagggcggcctgagactgctgctggccgccctgaccagacccgccccccaccccctgttcctgttcttcgccgccgacagcctgagctgcctgcaggacctggtgagccccaccgtgagccccgccgtgccccaggccgtgcccatggacctggacagccccagcccctgcctgtacgagcccctgctgggccccgcccccgtgcccgcccccgacctgcacttcctgctggacagcggcctgcagctgcccgcccagagagccgccagcgccaccgccagccccttcttcagagccctgctgagcggcagcttcgccgaggcccagatggacctggtgcccctgagaggcctgagccccggcgccgcctggcccgtgctgcaccacctgcacggctgcagaggctgcggcgccgccctgggccccgtgcccccccccggccagcccctgctgggcagcgaggccgaggaggccctggaggccgccggcagattcctgctgcccggcctggaggaggagctggaggaggccgtgggcagaatccacctgggcccccagggcggccccgagagcgtgggcgaggtgttcagactgggcagacccagactggccgcccactgcgccagatggaccctgggcagcgagcagtgccccagaaagagaggcctggccctggtgggcctggtggaggccgccggcgaggaggccggccccctgaccgaggccctgctggccgtggtgatgggcatcgagctgggcgccagagtgcccgcctag

SEQ ID NO: 18084 - DNA, 1740 bp, Artificial Sequence
  Description of Artificial Sequence: Synthetic coding sequence
atgaagaccgacagcatccagaacagaaccgccagagccctgggcaacctggccatggagcccgagagctgcggcgacatccactgcgccggcgccgtgcccctgctggtggagagcctgaccgcctgccaggacagccagtgcctgcagagcgtggccctgggcctggtgcccctgctggccggccagctgtgcggcgaggccggcgaggaggaggaggagggcagagaggccgccagctgggacttccccgaggagagaacccccgagagagcccagggcggcagcttcagaagcctgagaagctggctgatcagcgagggctacgccaccggccccgacgacatcagccccgactggagccccgagcagtgcccccccgagcccatggagcccgccagccccgcccccacccccaccagcctgagagcccccagaacccagagaacccccggcagaagccccgccgccgccatcgaggagccctggggcagagagggccccgccctgctgctgctgagcagattcagccaggcccccgaccccagcggcgccctggtgaccggccccgccctgtacggcctgctgacctacgtgaccggcgcccccggcccccccagccccagagccctgagaatcctgagcagactgacctgcaaccccgcctgcctggaggccttcgtgagaagctacggcgccgccctgctgagagcctggctggtgctgggcgtggcccccgacgactggcccgcccccagagccagacccaccctgcacagcagacacagagagctgggcgagagactgctgcagaacctgaccgtgcaggccgagagccccttcggcgtgggcgccctgacccacctgctgctgagcggcagccccgaggacagagtggcctgcgccctgaccctgcccttcatctgcagaaagcccagcctgtggagaagactgctgctggagcagggcggcctgagactgctgctggccgccctgaccagacccgccccccaccccctgttcctgttcttcgccgccgacagcctgagctgcctgcaggacctggtgagccccaccgtgagccccgccgtgccccaggccgtgcccatggacctggacagccccagcccctgcctgtacgagcccctgctgggccccgcccccgtgcccgcccccgacctgcacttcctgctggacagcggcctgcagctgcccgcccagagagccgccagcgccaccgccagccccttcttcagagccctgctgagcggcagcttcgccgaggcccagatggacctggtgcccctgagaggcctgagccccggcgccgcctggcccgtgctgcaccacctgcacggctgcagaggctgcggcgccgccctgggccccgtgcccccccccggccagcccctgctgggcagcgaggccgaggaggccctggaggccgccggcagattcctgctgcccggcctggaggaggagctggaggaggccgtgggcagaatccacctgggcccccagggcggccccgagagcgtgggcgaggtgttcagactgggcagacccagactggccgcccactgcgccagatggaccctgggcagcgagcagtgccccagaaagagaggcctggccctggtgggcctggtggaggccgccggcgaggaggccggccccctgaccgaggccctgctggccgtggtgatgggcatcgagctgggcgccagagtgcccgcctag

SEQ ID NO: 18085 - DNA, 2178 bp, Artificial Sequence
  Description of Artificial Sequence: Synthetic coding sequence
atggccgccgccaagcccaccctgaccgacagcctgagcttctgcctggcccagctggccgccgccgccggcgaggccctgggcggcgagaaggaccccgccaccaacgagacccccctgagcagagccctgctggccctgagaaccagacacatcaaggccgccggcggcatcgagagattcagagccagaggcggcctgagacccctgctggccctgctgagaagagccgccgccgccggcagcgcccccagccaggccggccccggcagcgcccccagcagcgccgccagcggcgccagcagccccgcccccgccagcggccccgcccccagcgccgtgagcagcagcagccccaccccccccgtgagactgagaaagaccctggacctggccctgagcatcctggccgactgctgcaccgagggcgcctgcagaaccgaggtgagaagactgggcggcatcctgcccctggtgaccatcctgcagtgcatgaagaccgacagcatccagaacagaaccgccagagccctgggcaacctggccatggagcccgagagctgcggcgacatccactgcgccggcgccgtgcccctgctggtggagagcctgaccgcctgccaggacagccagtgcctgcagagcgtggtgagagccctgagaaacctggccgacagcccccagcacagactggccctggcccagcagggcgccgtgagacccctggccgagctgctggccaccgcccccgacgccgccctgaccctggccctggtgagagccctgctggagctgagcagaggctgcagcagagcctgcgccgagcagctgagcctgggcggcggcctgggccccctggtgagcctggccagccaccccaagagagccgtgagagagggcaccatcctgatcctggccaacctgtgcgcccagggcctgatcagacccgccctgggcaacgccggcggcgtggaggtgctggtggacgagctgagacagagaagagaccccaacggcgccagccccaccagccagcagcccctggtgagagccgtgtgcctgctgtgcagagaggccatcaacagagccagactgagagacgccggcggcctggacctgctgatgggcctgctgagagaccccagagccagcgcctggcaccccagaatcgtggccgccctggtgggcttcctgtacgacaccggcgccctgggcagactgcaggccctgggcctggtgcccctgctggccggccagctgtgcggcgaggccggcgaggaggaggaggagggcagagaggccgccagctgggacttccccgaggagagaacccccgagagagcccagggcggcagcttcagaagcctgagaagctggctgatcagcgagggctacgccaccggccccgacgacatcagccccgactggagccccgagcagtgcccccccgagcccatggagcccgccagccccgcccccacccccaccagcctgagagcccccagaacccagagaacccccggcagaagccccgccgccgccatcgaggagccctggggcagagagggccccgccctgctgctgctgagcagattcagccaggcccccgaccccagcggcgccctggtgaccggccccgccctgtacggcctgctgacctacgtgaccggcgcccccggcccccccagccccagagccctgagaatcctgagcagactgacctgcaaccccgcctgcctggaggccttcgtgagaagctacggcgccgccctgctgagagcctggctggtgctgggcgtggcccccgacgactggcccgcccccagagccagacccaccctgcacagcagacacagagagctgggcgagttcccctacccccccgtgagcctgcccccctgcgagagccccagcagccccatggccagcatgggccccgagccccacctgcccacccacctgagcagccccgccagaccccccgacaacctgagccccgagtggggcggcgagcagggcgtgcccgtgcccccctgggcccacagacagagcagcgccgtgagcagcgccctggccctgggccccagataccccaacagcagatgcagccccgcccccagaatctgggccggcctgtgcttcttccccggcagcgccatcggcagcgccctgagctag

SEQ ID NO: 18086 - DNA, 2904 bp, Artificial Sequence
  Description of Artificial Sequence: Synthetic coding sequence
atgcacagaccccacgtgcccggctgcgccgccatcaagttcagaagcctgggcagcgccgccagaagcggcgccgagagcgaggccagagccaagatggccgccgccaagcccaccctgaccgacagcctgagcttctgcctggcccagctggccgccgccgccggcgaggccctgggcggcgagaaggaccccgccaccaacgagacccccctgagcagagccctgctggccctgagaaccagacacatcaaggccgccggcggcatcgagagattcagagccagaggcggcctgagacccctgctggccctgctgagaagagccgccgccgccggcagcgcccccagccaggccggccccggcagcgcccccagcagcgccgccagcggcgccagcagccccgcccccgccagcggccccgcccccagcgccgtgagcagcagcagccccaccccccccgtgagactgagaaagaccctggacctggccctgagcatcctggccgactgctgcaccgagggcgcctgcagaaccgaggtgagaagactgggcggcatcctgcccctggtgaccatcctgcagtgcatgaagaccgacagcatccagaacagaaccgccagagccctgggcaacctggccatggagcccgagagctgcggcgacatccactgcgccggcgccgtgcccctgctggtggagagcctgaccgcctgccaggacagccagtgcctgcagagcgtggtgagagccctgagaaacctggccgacagcccccagcacagactggccctggcccagcagggcgccgtgagacccctggccgagctgctggccaccgcccccgacgccgccctgaccctggccctggtgagagccctgctggagctgagcagaggctgcagcagagcctgcgccgagcagctgagcctgggcggcggcctgggccccctggtgagcctggccagccaccccaagagagccgtgagagagggcaccatcctgatcctggccaacctgtgcgcccagggcctgatcagacccgccctgggcaacgccggcggcgtggaggtgctggtggacgagctgagacagagaagagaccccaacggcgccagccccaccagccagcagcccctggtgagagccgtgtgcctgctgtgcagagaggccatcaacagagccagactgagagacgccggcggcctggacctgctgatgggcctgctgagagaccccagagccagcgcctggcaccccagaatcgtggccgccctggtgggcttcctgtacgacaccggcgccctgggcagactgcaggccctgggcctggtgcccctgctggccggccagctgtgcggcgaggccggcgaggaggaggaggagggcagagaggccgccagctgggacttccccgaggagagaacccccgagagagcccagggcggcagcttcagaagcctgagaagctggctgatcagcgagggctacgccaccggccccgacgacatcagccccgactggagccccgagcagtgcccccccgagcccatggagcccgccagccccgcccccacccccaccagcctgagagcccccagaacccagagaacccccggcagaagccccgccgccgccatcgaggagccctggggcagagagggccccgccctgctgctgctgagcagattcagccaggcccccgaccccagcggcgccctggtgaccggccccgccctgtacggcctgctgacctacgtgaccggcgcccccggcccccccagccccagagccctgagaatcctgagcagactgacctgcaaccccgcctgcctggaggccttcgtgagaagctacggcgccgccctgctgagagcctggctggtgctgggcgtggcccccgacgactggcccgcccccagagccagacccaccctgcacagcagacacagagagctgggcgagagactgctgcagaacctgaccgtgcaggccgagagccccttcggcgtgggcgccctgacccacctgctgctgagcggcagccccgaggacagagtggcctgcgccctgaccctgcccttcatctgcagaaagcccagcctgtggagaagactgctgctggagcagggcggcctgagactgctgctggccgccctgaccagacccgccccccaccccctgttcctgttcttcgccgccgacagcctgagctgcctgcaggacctggtgagccccaccgtgagccccgccgtgccccaggccgtgcccatggacctggacagccccagcccctgcctgtacgagcccctgctgggccccgcccccgtgcccgcccccgacctgcacttcctgctggacagcggcctgcagctgcccgcccagagagccgccagcgccaccgccagccccttcttcagagccctgctgagcggcagcttcgccgaggcccagatggacctggtgcccctgagaggcctgagccccggcgccgcctggcccgtgctgcaccacctgcacggctgcagaggctgcggcgccgccctgggccccgtgcccccccccggccagcccctgctgggcagcgaggccgaggaggccctggaggccgccggcagattcctgctgcccggcctggaggaggagctggaggaggccgtgggcagaatccacctgggcccccagggcggccccgagagcgtgggcgaggtgttcagactgggcagacccagactggccgcccactgcgccagatggaccctgggcagcgagcagtgccccagaaagagaggcctggccctggtgggcctggtggaggccgccggcgaggaggccggccccctgaccgaggccctgctggccgtggtgatgggcatcgagctgggcgccagagtgcccgcctag

SEQ ID NO: 18087 - DNA, 1431 bp, Artificial Sequence
  Description of Artificial Sequence: Synthetic coding sequence
atggtgagcaagagaatcgcccaggagaccttcgacgccgccgtgagagagaacatcgaggagttcgccatgggccccgaggaggccgtgaaggaggccgtggagcagttcgagagccagggcgtggacctgagcaacatcgtgaagaccgcccccaaggtgagcgccgacggcagccaggagcccacccacgacatcctgcagatgctgagcgacctgcaggagagcgtggccagcagcagaccccaggaggtgagcgcctacctgaccagattctgcgaccagtgcaagcaggacaaggcctgcagattcctggccgcccagaagggcgcctaccccatcatcttcaccgcctggaagctggccaccgccggcgaccagggcctgctgctgcagagcctgaacgccctgagcgtgctgaccgacggccagcccgacctgctggacgcccagggcctgcagctgctggtggccaccctgacccagaacgccgacgaggccgacctgacctgcagcggcatcagatgcgtgagacacgcctgcctgaagcacgagcagaacagacaggacctggtgaaggccggcgtgctgcccctgctgaccggcgccatcacccaccacggccaccacaccgacgtggtgagagaggcctgctgggccctgagagtgatgaccttcgacgacgacatcagagtgcccttcggccacgcccacaaccacgccaagatgatcgtgcaggagaacaagggcctgaaggtgctgatcgaggccaccaaggccttcctggacaaccccggcatcctgagcgagctgtgcggcaccctgagcagactggccatcagaaacgagttctgccaggaggtggtggacctgggcggcctgagcatcctggtgagcctgctggccgactgcaacgaccaccagatgagagaccagagcggcgtgcaggagctggtgaagcaggtgctgagcaccctgagagccatcgccggcaacgacgacgtgaaggacgccatcgtgagagccggcggcaccgagagcatcgtggccgccatgacccagcacctgaccagcccccaggtgtgcgagcagagctgcgccgccctgtgcttcctggccctgagaaagcccgacaacagcagaatcatcgtggagggcggcggcgccgtggccgccctgcaggccatgaaggcccacccccagaaggccggcgtgcagaagcaggcctgcatgctgatcagaaacctggtggcccacggccaggccttcagcaagcccatcctggacctgggcgccgaggccctgatcatgcaggccagaagcgcccacagagactgcgaggacgtggccaaggccgccctgagagacctgggctgccacgtggagctgagagagctgtggaccggccagagaggcaacctggccccctag

SEQ ID NO: 18088 - DNA, 1395 bp, Artificial Sequence
  Description of Artificial Sequence: Synthetic coding sequence
atgaccagctgcagatgcagcgtgaccagcagaagcctgtggcccgccctggcccccagaagatgccagcacaccagccccgccagcgcccagtgcaagcaggacaaggcctgcagattcctggccgcccagaagggcgcctaccccatcatcttcaccgcctggaagctggccaccgccggcgaccagggcctgctgctgcagagcctgaacgccctgagcgtgctgaccgacggccagcccgacctgctggacgcccagggcctgcagctgctggtggccaccctgacccagaacgccgacgaggccgacctgacctgcagcggcatcagatgcgtgagacacgcctgcctgaagcacgagcagaacagacaggacctggtgaaggccggcgtgctgcccctgctgaccggcgccatcacccaccacggccaccacaccgacgtggtgagagaggcctgctgggccctgagagtgatgaccttcgacgacgacatcagagtgcccttcggccacgcccacaaccacgccaagatgatcgtgcaggagaacaagggcctgaaggtgctgatcgaggccaccaaggccttcctggacaaccccggcatcctgagcgagctgtgcggcaccctgagcagactggccatcagaaacgagttctgccaggaggtggtggacctgggcggcctgagcatcctggtgagcctgctggccgactgcaacgaccaccagatgagagaccagagcggcgtgcaggagctggtgaagcaggtgctgagcaccctgagagccatcgccggcaacgacgacgtgaaggacgccatcgtgagagccggcggcaccgagagcatcgtggccgccatgacccagcacctgaccagcccccaggtgtgcgagcagagctgcgccgccctgtgcttcctggccctgagaaagcccgacaacagcagaatcatcgtggagggcggcggcgccgtggccgccctgcaggccatgaaggcccacccccagaaggccggcgtgcagaagcaggcctgcatgctgatcagaaacctggtggcccacagacccagcagaagccccagctggacctggggcctgagacacagcagctgcagacccgacctgcccaccgtgaccgtgagaacctggcccagacccccctgcggcacctgggtggtgatgagcagcagcgagagctgcggccaggccagaggcgccacctggagacacgaccccagacccagcctggtgaccctgggcgagagctgcgacagcggcatgggcgtggacccctgcccccccctgagccccatcagcagcgtgcccttcaccatgagaagcgtgttctggcaggccctgggcaagggcagcggcgagggcggcgccctgtag

SEQ ID NO: 18089 - DNA, 1431 bp, Artificial Sequence; identical to SEQ ID NO: 18087
  Description of Artificial Sequence: Synthetic coding sequence

SEQ ID NO: 18090 - DNA, 1506 bp, Artificial Sequence
  Description of Artificial Sequence: Synthetic coding sequence
atgagcgagagatgctgcagcagatacagcagcggcgccagcatcggctgcacccccaccagcacccaggccaagatggtgagcaagagaatcgcccaggagaccttcgacgccgccgtgagagagaacatcgaggagttcgccatgggccccgaggaggccgtgaaggaggccgtggagcagttcgagagccagggcgtggacctgagcaacatcgtgaagaccgcccccaaggtgagcgccgacggcagccaggagcccacccacgacatcctgcagatgctgagcgacctgcaggagagcgtggccagcagcagaccccaggaggtgagcgcctacctgaccagattctgcgaccagtgcaagcaggacaaggcctgcagattcctggccgcccagaagggcgcctaccccatcatcttcaccgcctggaagctggccaccgccggcgaccagggcctgctgctgcagagcctgaacgccctgagcgtgctgaccgacggccagcccgacctgctggacgcccagggcctgcagctgctggtggccaccctgacccagaacgccgacgaggccgacctgacctgcagcggcatcagatgcgtgagacacgcctgcctgaagcacgagcagaacagacaggacctggtgaaggccggcgtgctgcccctgctgaccggcgccatcacccaccacggccaccacaccgacgtggtgagagaggcctgctgggccctgagagtgatgaccttcgacgacgacatcagagtgcccttcggccacgcccacaaccacgccaagatgatcgtgcaggagaacaagggcctgaaggtgctgatcgaggccaccaaggccttcctggacaaccccggcatcctgagcgagctgtgcggcaccctgagcagactggccatcagaaacgagttctgccaggaggtggtggacctgggcggcctgagcatcctggtgagcctgctggccgactgcaacgaccaccagatgagagaccagagcggcgtgcaggagctggtgaagcaggtgctgagcaccctgagagccatcgccggcaacgacgacgtgaaggacgccatcgtgagagccggcggcaccgagagcatcgtggccgccatgacccagcacctgaccagcccccaggtgtgcgagcagagctgcgccgccctgtgcttcctggccctgagaaagcccgacaacagcagaatcatcgtggagggcggcggcgccgtggccgccctgcaggccatgaaggcccacccccagaaggccggcgtgcagaagcaggcctgcatgctgatcagaaacctggtggcccacggccaggccttcagcaagcccatcctggacctgggcgccgaggccctgatcatgcaggccagaagcgcccacagagactgcgaggacgtggccaaggccgccctgagagacctgggctgccacgtggagctgagagagctgtggaccggccagagaggcaacctggccccctag

SEQ ID NO: 18091 - DNA, 1506 bp, Artificial Sequence; identical to SEQ ID NO: 18090
  Description of Artificial Sequence: Synthetic coding sequence

SEQ ID NO: 18092 - DNA, 213 bp, Artificial Sequence
  Description of Artificial Sequence: Synthetic coding sequence
atggtgagcaagagaatcgcccaggagaccttcgacgccgccgtgagagagaacatcgaggagttcgccatgggccccgaggaggccgtgaaggaggccgtggagcagttcgagagccagggcgtggacctgagcaacatcgtgaagaccgcccccaaggtgagcgccgacggcagccaggagcccacccacgacatcctgcagatgctgtag

SEQ ID NO: 18093 - DNA, 774 bp, Artificial Sequence
  Description of Artificial Sequence: Synthetic coding sequence
atggtgagcaagagaatcgcccaggagaccttcgacgccgccgtgagagagaacatcgaggagttcgccatgggccccgaggaggccgtgaaggaggccgtggagcagttcgagagccagggcgtggacctgagcaacatcgtgaagaccgcccccaaggtgagcgccgacggcagccaggagcccacccacgacatcctgcagatgctgagcgacctgcaggagagcgtggccagcagcagaccccaggaggtgagcgcctacctgaccagattctgcgaccagtgcaagcaggacaaggcctgcagattcctggccgcccagaagggcgcctaccccatcatcttcaccgcctggaagctggccaccgccggcgaccagggcctgctgctgcagagcctgaacgccctgagcgtgctgaccgacggccagcccgacctgctggacgcccagggcctgcagctgctggtggccaccctgacccagaacgccgacgaggccgacctgacctgcagcggcatcagatgcgtgagacacgcctgcctgaagcacgagcagaacagacaggacctggtgaaggccggcgtgctgcccctgctgaccggcgccatcacccaccacggccaccacaccgacgtggtgagagaggcctgctgggccctgagagtgatgaccttcgacgacgacatcagagtgcccttcggccacgcccacaaccacgccaagatgatcgtgcaggagaacaagggcctgaaggtgctgatcgaggcctag

SEQ ID NO: 18094 - DNA, 312 bp, Artificial Sequence
  Description of Artificial Sequence: Synthetic coding sequence
atggtgagcaagagaatcgcccaggagaccttcgacgccgccgtgagagagaacatcgaggagttcgccatgggccccgaggaggccgtgaaggaggccgtggagcagttcgagagccagggcgtggacctgagcaacatcgtgaagaccgcccccaaggtgagcgccgacggcagccaggagcccacccacgacatcctgcagatgctgagcgacctgcaggagagcgtggccagcagcagaccccaggaggtgagcgcctacctgaccagattctgcgaccagtgcaagcaggacaaggcctgcagatag

SEQ ID NO: 18095 - DNA, 246 bp, Artificial Sequence
  Description of Artificial Sequence: Synthetic coding sequence
tgaaaggcccacccccagaaggccggcgtgcagaagcaggcctgcatgctgatcagaaacctggtggcccacggccaggccttcagcaagcccatcctggacctgggcgccgaggccctgatcatgcaggccagaagcgcccacagagactgcgaggacgtggccaaggccgccctgagagacctgggctgccacgtggagctgagagagctgtggaccggccagagaggcaacctggccccctag

SEQ ID NO: 18096 - DNA, 93 bp, Artificial Sequence
  Description of Artificial Sequence: Synthetic coding sequence
atggtgagcaagagaatcgcccaggagaccttcgacgccgccgtgagagagaacatcgaggagttcgccatgggccccgaggaggccgtgtag

SEQ ID NO: 18097 - DNA, 486 bp, Artificial Sequence
  Description of Artificial Sequence: Synthetic coding sequence
atggtgagcaagagaatcgcccaggagaccttcgacgccgccgtgagagagaacatcgaggagttcgccatgggccccgaggaggccgtgaaggaggccgtggagcagttcgagagccagggcgtggacctgagcaacatcgtgaagaccgcccccaaggtgagcgccgacggcagccaggagcccacccacgacatcctgcagatgctgagcgacctgcaggagagcgtggccagcagcagaccccaggaggtgagcgcctacctgaccagattctgcgaccagtgcaagcaggacaaggcctgcagattcctggccgcccagaagggcgcctaccccatcatcttcaccgcctggaagctggccaccgccggcgaccagggcctgctgctgcagagcctgaacgccctgagcgtgctgaccgacggccagcccgacctgctggacgcccagggcctgcagctgctggtggccaccctgacctag

SEQ ID NO: 18098 - DNA, 492 bp, Artificial Sequence
  Description of Artificial Sequence: Synthetic coding sequence
atgagcgagagatgctgcagcagatacagcagcggcgccagcatcggctgcacccccaccagcacccaggccaagatggtgagcaagagaatcgcccaggagaccttcgacgccgccgtgagagagaacatcgaggagttcgccatgggccccgaggaggccgtgaaggaggccgtggagcagttcgagagccagggcgtggacctgagcaacatcgtgaagaccgcccccaaggtgagcgccgacggcagccaggagcccacccacgacatcctgcagatgctgagcgacctgcaggagagcgtggccagcagcagaccccaggaggtgagcgcctacctgaccagattctgcgaccagtgcaagcaggacaaggcctgcagattcctggccgcccagaagggcgcctaccccatcatcttcaccgcctggaagctggccaccgccggcgaccagggcctgctgctgcagagcctgaacgccctgagctag

SEQ ID NO: 18099 - DNA, 780 bp, Artificial Sequence
  Description of Artificial Sequence: Synthetic coding sequence
atggtgagcaagagaatcgcccaggagaccttcgacgccgccgtgagagagaacatcgaggagttcgccatgggccccgaggaggccgtgaaggaggccgtggagcagttcgagagccagggcgtggacctgagcaacatcgtgaagaccgcccccaaggtgagcgccgacggcagccaggagcccacccacgacatcctgcagatgctgagcgacctgcaggagagcgtggccagcagcagaccccaggaggtgagcgcctacctgaccagattctgcgaccagtgcaagcaggacaaggcctgcagattcctggccgcccagaagggcgcctaccccatcatcttcaccgcctggaagctggccaccgccggcgaccagggcctgctgctgcagagcctgaacgccctgagcgtgctgaccgacggccagcccgacctgctggacgcccagggcctgcagctgctggtggccaccctgacccagaacgccgacgaggccgacctgacctgcagcggcatcagatgcgtgagacacgcctgcctgaagcacgagcagaacagacaggacctggtgaaggccggcgtgctgcccctgctgaccggcgccatcacccaccacggccaccacaccgacgtggtgagagaggcctgctgggccctgagagtgatgaccttcgacgacgacatcagagtgcccttcggccacgcccacaaccacgccaagatgatcgtgcaggagaacaagggcctgaaggtgctgatcgaggccaccaagtag

SEQ ID NO: 18100 - DNA, 597 bp, Artificial Sequence
  Description of Artificial Sequence: Synthetic coding sequence
atggcccagaagcccaaggtggacccccacgtgggcagactgggctacctgcaggccctggtgaccgagttccaggagacccagagccaggacgccaaggagcaggtgctggccaacctggccaacttcgcctacgaccccagcaactacgagtacctgagacagctgcaggtgctggacctgttcctggacagcctgagcgaggagaacgagaccctggtggagttcgccatcggcggcctgtgcaacctgtgccccgacagagccaacaaggagcacatcctgcacgccggcggcgtgcccctgatcatcaactgcctgagcagccccaacgaggagaccgtgctgagcgccatcaccaccctgatgcacctgagcccccccggcagaagcttcctgcccgagctgaccgccacccccgtggtgcagtgcatgctgagattcagcctgagcgccagcgccagactgagaaacctggcccagatcttcctggaggacttctgcagccccagacaggtggccgaggccagaagcagacaggcccacagcgccctgggcatccccctgcccagaagcgtggcccccagacagagatag

SEQ ID NO: 18101 - DNA, 1158 bp, Artificial Sequence
  Description of Artificial Sequence: Synthetic coding sequence
atggaggtgaccgccagcagcagacactacgtggacagactgttcgaccccgacccccagaaggtgctgcagggcgtgatcgacatgaagaacgccgtgatcggcaacaacaagcagaaggccaacctgatcgtgctgggcgccgtgcccagactgctgtacctgctgcagcaggagaccagcagcaccgagctgaagaccgagtgcgccgtggtgctgggcagcctggccatgggcaccgagaacaacgtgaagagcctgctggactgccacatcatccccgccctgctgcagggcctgctgagccccgacctgaagttcatcgaggcctgcctgagatgcctgagaaccatcttcaccagccccgtgacccccgaggagctgctgtacaccgacgccaccgtgatcccccacctgatggccctgctgagcagaagcagatacacccaggagtacatctgccagatcttcagccactgctgcaagggccccgaccaccagaccatcctgttcaaccacggcgccgtgcagaacatcgcccacctgctgaccagcctgagctacaaggtgagaatgcaggccctgaagtgcttcagcgtgctggccttcgagaacccccaggtgagcatgaccctggtgaacgtgctggtggacggcgagctgctgccccagatcttcgtgaagatgctgcagagagacaagcccatcgagatgcagctgaccagcgccaagtgcctgacctacatgtgcagagccggcgccatcagaaccgacgacaactgcatcgtgctgaagaccctgccctgcctggtgagaatgtgcagcaaggagagactgctggaggagagagtggagggcgccgagaccctggcctacctgatcgagcccgacgtggagctgcagagaatcgccagcatcaccgaccacctgatcgccatgctggccgactacttcaagtaccccagcagcgtgagcgccatcaccgacatcaagagactggaccacgacctgaagcacgcccacgagctgagacaggccgccttcaagctgtacgccagcctgggcgccaacgacgaggacatcagaaagaaggtgagcctgggcgagggcagaccccccgtgctgaccgccagcagacagggcgtgaccagcacctag

SEQ ID NO: 18102 - DNA, 1992 bp, Artificial Sequence
  Description of Artificial Sequence: Synthetic coding sequence
atgagcgtgctgagcgaggtgaccgccagcagcagacactacgtggacagactgttcgaccccgacccccagaaggtgctgcagggcgtgatcgacatgaagaacgccgtgatcggcaacaacaagcagaaggccaacctgatcgtgctgggcgccgtgcccagactgctgtacctgctgcagcaggagaccagcagcaccgagctgaagaccgagtgcgccgtggtgctgggcagcctggccatgggcaccgagaacaacgtgaagagcctgctggactgccacatcatccccgccctgctgcagggcctgctgagccccgacctgaagttcatcgaggcctgcctgagatgcctgagaaccatcttcaccagccccgtgacccccgaggagctgctgtacaccgacgccaccgtgatcccccacctgatggccctgctgagcagaagcagatacacccaggagtacatctgccagatcttcagccactgctgcaagggccccgaccaccagaccatcctgttcaaccacggcgccgtgcagaacatcgcccacctgctgaccagcctgagctacaaggtgagaatgcaggccctgaagtgcttcagcgtgctggccttcgagaacccccaggtgagcatgaccctggtgaacgtgctggtggacggcgagctgctgccccagatcttcgtgaagatgctgcagagagacaagcccatcgagatgcagctgaccagcgccaagtgcctgacctacatgtgcagagccggcgccatcagaaccgacgacaactgcatcgtgctgaagaccctgccctgcctggtgagaatgtgcagcaaggagagactgctggaggagagagtggagggcgccgagaccctggcctacctgatcgagcccgacgtggagctgcagagaatcgccagcatcaccgaccacctgatcgccatgctggccgactacttcaagtaccccagcagcgtgagcgccatcaccgacatcaagagactggaccacgacctgaagcacgcccacgagctgagacaggccgccttcaagctgtacgccagcctgggcgccaacgacgaggacatcagaaagaagatcatcgagaccgagaacatgatggacagaatcgtgaccggcctgagcgagagcagcgtgaaggtgagactggccgccgtgagatgcctgcacagcctgagcagaagcgtgcagcagctgagaaccagcttccaggaccacgccgtgtggaagcccctgatgaaggtgctgcagaacgcccccgacgagatcctggtggtggccagcagcatgctgtgcaacctgctgctggagttcagccccagcaaggagcccatcctggagagcggcgccgtggagctgctgtgcggcctgacccagagcgagaaccccgccctgagagtgaacggcatctgggccctgatgaacatggccttccaggccgagcagaagatcaaggccgacatcctgagaagcctgagcaccgagcagctgttcagactgctgagcgacagcgacctgaacgtgctgatgaagaccctgggcctgctgagaaacctgctgagcaccagaccccacatcgacaagatcatgagcacccacggcaagcagatcatgcaggccgtgaccctgatcctggagggcgagcacaacatcgaggtgaaggagcagaccctgtgcatcctggccaacatcgccgacggcaccaccgccaaggacctgatcatgaccaacgacgacatcctgcagaagatcaagtactacatgggccacagccacgtgaagctgcagctggccgccatgttctgcatcagcaacctgatctggaacgaggaggagggcagccaggagagacaggacaagctgagagacatgggcatcgtggacatcctgcacaagctgagccagagccccgacagcaacctgtgcgacaaggccaagatggccctgcagcagtacctggcctag

SEQ ID NO: 18103 - DNA, 597 bp, Artificial Sequence
  Description of Artificial Sequence: Synthetic coding sequence
atggcctgcctgctggagacccccatcagaatgagcgtgctgagcgaggtgaccgccagcagcagacactacgtggacagactgttcgaccccgacccccagaaggtgctgcagggcgtgatcgacatgaagaacgccgtgatcggcaacaacaagcagaaggccaacctgatcgtgctgggcgccgtgcccagactgctgtacctgctgcagcaggagaccagcagcaccgagctgaagaccgagtgcgccgtggtgctgggcagcctggccatgggcaccgagaacaacgtgaagagcctgctggactgccacatcatccccgccctgctgcagggcctgctgagccccgacctgaagttcatcgaggcctgcctgagatgcctgagaaccatcttcaccagccccgtgacccccgaggagctgctgtacaccgacgccaccgtgatcccccacctgatggccctgctgagcagaagcagatacacccaggagtacatctgccagatcttcagccactgctgcaagggccccgaccaccagaccatcctgttcaaccacggcgccgtgcagaacatcgcccacctgctgacctag

SEQ ID NO: 18104 - DNA, 393 bp, Artificial Sequence
  Description of Artificial Sequence: Synthetic coding sequence
atgaagaacgccgtgatcggcaacaacaagcagaaggccaacctgatcgtgctgggcgccgtgcccagactgctgtacctgctgcagcaggagaccagcagcaccgagctgaagaccgagtgcgccgtggtgctgggcagcctggccatgggcaccgagaacaacgtgaagagcctgctggactgccacatcatccccgccctgctgcagggcctgctgagccccgacctgaagttcatcgaggcctgcctgagatgcctgagaaccatcttcaccagccccgtgacccccgaggagctgctgtacaccgacgccaccgtgatcccccacctgatggccctgctgagcagaagcagatacacccaggagtacatctgccagatcttcagctag

SEQ ID NO: 18105 - DNA, 81 bp, Artificial Sequence
  Description of Artificial Sequence: Synthetic coding sequence
atggaggtgaccgccagcagcagacactacgtggacagactgttcgaccccgacccccagaaggtgctgcagggcgtgtag

SEQ ID NO: 18106 - DNA, 2022 bp, Artificial Sequence
  Description of Artificial Sequence: Synthetic coding sequence
atggcctgcctgctggagacccccatcagaatgagcgtgctgagcgaggtgaccgccagcagcagacactacgtggacagactgttcgaccccgacccccagaaggtgctgcagggcgtgatcgacatgaagaacgccgtgatcggcaacaacaagcagaaggccaacctgatcgtgctgggcgccgtgcccagactgctgtacctgctgcagcaggagaccagcagcaccgagctgaagaccgagtgcgccgtggtgctgggcagcctggccatgggcaccgagaacaacgtgaagagcctgctggactgccacatcatccccgccctgctgcagggcctgctgagccccgacctgaagttcatcgaggcctgcctgagatgcctgagaaccatcttcaccagccccgtgacccccgaggagctgctgtacaccgacgccaccgtgatcccccacctgatggccctgctgagcagaagcagatacacccaggagtacatctgccagatcttcagccactgctgcaagggccccgaccaccagaccatcctgttcaaccacggcgccgtgcagaacatcgcccacctgctgaccagcctgagctacaaggtgagaatgcaggccctgaagtgcttcagcgtgctggccttcgagaacccccaggtgagcatgaccctggtgaacgtgctggtggacggcgagctgctgccccagatcttcgtgaagatgctgcagagagacaagcccatcgagatgcagctgaccagcgccaagtgcctgacctacatgtgcagagccggcgccatcagaaccgacgacaactgcatcgtgctgaagaccctgccctgcctggtgagaatgtgcagcaaggagagactgctggaggagagagtggagggcgccgagaccctggcctacctgatcgagcccgacgtggagctgcagagaatcgccagcatcaccgaccacctgatcgccatgctggccgactacttcaagtaccccagcagcgtgagcgccatcaccgacatcaagagactggaccacgacctgaagcacgcccacgagctgagacaggccgccttcaagctgtacgccagcctgggcgccaacgacgaggacatcagaaagaagatcatcgagaccgagaacatgatggacagaatcgtgaccggcctgagcgagagcagcgtgaaggtgagactggccgccgtgagatgcctgcacagcctgagcagaagcgtgcagcagctgagaaccagcttccaggaccacgccgtgtggaagcccctgatgaaggtgctgcagaacgcccccgacgagatcctggtggtggccagcagcatgctgtgcaacctgctgctggagttcagccccagcaaggagcccatcctggagagcggcgccgtggagctgctgtgcggcctgacccagagcgagaaccccgccctgagagtgaacggcatctgggccctgatgaacatggccttccaggccgagcagaagatcaaggccgacatcctgagaagcctgagcaccgagcagctgttcagactgctgagcgacagcgacctgaacgtgctgatgaagaccctgggcctgctgagaaacctgctgagcaccagaccccacatcgacaagatcatgagcacccacggcaagcagatcatgcaggccgtgaccctgatcctggagggcgagcacaacatcgaggtgaaggagcagaccctgtgcatcctggccaacatcgccgacggcaccaccgccaaggacctgatcatgaccaacgacgacatcctgcagaagatcaagtactacatgggccacagccacgtgaagctgcagctggccgccatgttctgcatcagcaacctgatctggaacgaggaggagggcagccaggagagacaggacaagctgagagacatgggcatcgtggacatcctgcacaagctgagccagagccccgacagcaacctgtgcgacaaggccaagatggccctgcagcagtacctggcctag

SEQ ID NO: 18107 - DNA, 1158 bp, Artificial Sequence; identical to SEQ ID NO: 18101
  Description of Artificial Sequence: Synthetic coding sequence

SEQ ID NO: 18108 - DNA, 1980 bp, Artificial Sequence
  Description of Artificial Sequence: Synthetic coding sequence
atggaggtgaccgccagcagcagacactacgtggacagactgttcgaccccgacccccagaaggtgctgcagggcgtgatcgacatgaagaacgccgtgatcggcaacaacaagcagaaggccaacctgatcgtgctgggcgccgtgcccagactgctgtacctgctgcagcaggagaccagcagcaccgagctgaagaccgagtgcgccgtggtgctgggcagcctggccatgggcaccgagaacaacgtgaagagcctgctggactgccacatcatccccgccctgctgcagggcctgctgagccccgacctgaagttcatcgaggcctgcctgagatgcctgagaaccatcttcaccagccccgtgacccccgaggagctgctgtacaccgacgccaccgtgatcccccacctgatggccctgctgagcagaagcagatacacccaggagtacatctgccagatcttcagccactgctgcaagggccccgaccaccagaccatcctgttcaaccacggcgccgtgcagaacatcgcccacctgctgaccagcctgagctacaaggtgagaatgcaggccctgaagtgcttcagcgtgctggccttcgagaacccccaggtgagcatgaccctggtgaacgtgctggtggacggcgagctgctgccccagatcttcgtgaagatgctgcagagagacaagcccatcgagatgcagctgaccagcgccaagtgcctgacctacatgtgcagagccggcgccatcagaaccgacgacaactgcatcgtgctgaagaccctgccctgcctggtgagaatgtgcagcaaggagagactgctggaggagagagtggagggcgccgagaccctggcctacctgatcgagcccgacgtggagctgcagagaatcgccagcatcaccgaccacctgatcgccatgctggccgactacttcaagtaccccagcagcgtgagcgccatcaccgacatcaagagactggaccacgacctgaagcacgcccacgagctgagacaggccgccttcaagctgtacgccagcctgggcgccaacgacgaggacatcagaaagaagatcatcgagaccgagaacatgatggacagaatcgtgaccggcctgagcgagagcagcgtgaaggtgagactggccgccgtgagatgcctgcacagcctgagcagaagcgtgcagcagctgagaaccagcttccaggaccacgccgtgtggaagcccctgatgaaggtgctgcagaacgcccccgacgagatcctggtggtggccagcagcatgctgtgcaacctgctgctggagttcagccccagcaaggagcccatcctggagagcggcgccgtggagctgctgtgcggcctgacccagagcgagaaccccgccctgagagtgaacggcatctgggccctgatgaacatggccttccaggccgagcagaagatcaaggccgacatcctgagaagcctgagcaccgagcagctgttcagactgctgagcgacagcgacctgaacgtgctgatgaagaccctgggcctgctgagaaacctgctgagcaccagaccccacatcgacaagatcatgagcacccacggcaagcagatcatgcaggccgtgaccctgatcctggagggcgagcacaacatcgaggtgaaggagcagaccctgtgcatcctggccaacatcgccgacggcaccaccgccaaggacctgatcatgaccaacgacgacatcctgcagaagatcaagtactacatgggccacagccacgtgaagctgcagctggccgccatgttctgcatcagcaacctgatctggaacgaggaggagggcagccaggagagacaggacaagctgagagacatgggcatcgtggacatcctgcacaagctgagccagagccccgacagcaacctgtgcgacaaggccaagatggccctgcagcagtacctggcctag

SEQ ID NO: 18109 - DNA, 1896 bp, Artificial Sequence
  Description of Artificial Sequence: Synthetic coding sequence
atgaagaacgccgtgatcggcaacaacaagcagaaggccaacctgatcgtgctgggcgccgtgcccagactgctgtacctgctgcagcaggagaccagcagcaccgagctgaagaccgagtgcgccgtggtgctgggcagcctggccatgggcaccgagaacaacgtgaagagcctgctggactgccacatcatccccgccctgctgcagggcctgctgagccccgacctgaagttcatcgaggcctgcctgagatgcctgagaaccatcttcaccagccccgtgacccccgaggagctgctgtacaccgacgccaccgtgatcccccacctgatggccctgctgagcagaagcagatacacccaggagtacatctgccagatcttcagccactgctgcaagggccccgaccaccagaccatcctgttcaaccacggcgccgtgcagaacatcgcccacctgctgaccagcctgagctacaaggtgagaatgcaggccctgaagtgcttcagcgtgctggccttcgagaacccccaggtgagcatgaccctggtgaacgtgctggtggacggcgagctgctgccccagatcttcgtgaagatgctgcagagagacaagcccatcgagatgcagctgaccagcgccaagtgcctgacctacatgtgcagagccggcgccatcagaaccgacgacaactgcatcgtgctgaagaccctgccctgcctggtgagaatgtgcagcaaggagagactgctggaggagagagtggagggcgccgagaccctggcctacctgatcgagcccgacgtggagctgcagagaatcgccagcatcaccgaccacctgatcgccatgctggccgactacttcaagtaccccagcagcgtgagcgccatcaccgacatcaagagactggaccacgacctgaagcacgcccacgagctgagacaggccgccttcaagctgtacgccagcctgggcgccaacgacgaggacatcagaaagaagatcatcgagaccgagaacatgatggacagaatcgtgaccggcctgagcgagagcagcgtgaaggtgagactggccgccgtgagatgcctgcacagcctgagcagaagcgtgcagcagctgagaaccagcttccaggaccacgccgtgtggaagcccctgatgaaggtgctgcagaacgcccccgacgagatcctggtggtggccagcagcatgctgtgcaacctgctgctggagttcagccccagcaaggagcccatcctggagagcggcgccgtggagctgctgtgcggcctgacccagagcgagaaccccgccctgagagtgaacggcatctgggccctgatgaacatggccttccaggccgagcagaagatcaaggccgacatcctgagaagcctgagcaccgagcagctgttcagactgctgagcgacagcgacctgaacgtgctgatgaagaccctgggcctgctgagaaacctgctgagcaccagaccccacatcgacaagatcatgagcacccacggcaagcagatcatgcaggccgtgaccctgatcctggagggcgagcacaacatcgaggtgaaggagcagaccctgtgcatcctggccaacatcgccgacggcaccaccgccaaggacctgatcatgaccaacgacgacatcctgcagaagatcaagtactacatgggccacagccacgtgaagctgcagctggccgccatgttctgcatcagcaacctgatctggaacgaggaggagggcagccaggagagacaggacaagctgagagacatgggcatcgtggacatcctgcacaagctgagccagagccccgacagcaacctgtgcgacaaggccaagatggccctgcagcagtacctggcctag

SEQ ID NO: 18110 - DNA, 1929 bp, Artificial Sequence
  Description of Artificial Sequence: Synthetic coding sequence
atggcctgcctgctggagacccccatcagaatgagcgtgctgagcgaggtgaccgccagcagcagacactacgtggacagactgttcgaccccgacccccagaaggtgctgcagggcgtgatcgacatgaagaacgccgtgatcggcaacaacaagcagaaggccaacctgatcgtgctgggcgccgtgcccagactgctgtacctgctgcagcaggagaccagcagcaccgagctgaagaccgagtgcgccgtggtgctgggcagcctggccatgggcaccgagaacaacgtgaagagcctgctggactgccacatcatccccgccctgctgcagggcctgctgagccccgacctgaagttcatcgaggcctgcctgagatgcctgagaaccatcttcaccagccccgtgacccccgaggagctgctgtacaccggccccgaccaccagaccatcctgttcaaccacggcgccgtgcagaacatcgcccacctgctgaccagcctgagctacaaggtgagaatgcaggccctgaagtgcttcagcgtgctggccttcgagaacccccaggtgagcatgaccctggtgaacgtgctggtggacggcgagctgctgccccagatcttcgtgaagatgctgcagagagacaagcccatcgagatgcagctgaccagcgccaagtgcctgacctacatgtgcagagccggcgccatcagaaccgacgacaactgcatcgtgctgaagaccctgccctgcctggtgagaatgtgcagcaaggagagactgctggaggagagagtggagggcgccgagaccctggcctacctgatcgagcccgacgtggagctgcagagaatcgccagcatcaccgaccacctgatcgccatgctggccgactacttcaagtaccccagcagcgtgagcgccatcaccgacatcaagagactggaccacgacctgaagcacgcccacgagctgagacaggccgccttcaagctgtacgccagcctgggcgccaacgacgaggacatcagaaagaagatcatcgagaccgagaacatgatggacagaatcgtgaccggcctgagcgagagcagcgtgaaggtgagactggccgccgtgagatgcctgcacagcctgagcagaagcgtgcagcagctgagaaccagcttccaggaccacgccgtgtggaagcccctgatgaaggtgctgcagaacgcccccgacgagatcctggtggtggccagcagcatgctgtgcaacctgctgctggagttcagccccagcaaggagcccatcctggagagcggcgccgtggagctgctgtgcggcctgacccagagcgagaaccccgccctgagagtgaacggcatctgggccctgatgaacatggccttccaggccgagcagaagatcaaggccgacatcctgagaagcctgagcaccgagcagctgttcagactgctgagcgacagcgacctgaacgtgctgatgaagaccctgggcctgctgagaaacctgctgagcaccagaccccacatcgacaagatcatgagcacccacggcaagcagatcatgcaggccgtgaccctgatcctggagggcgagcacaacatcgaggtgaaggagcagaccctgtgcatcctggccaacatcgccgacggcaccaccgccaaggacctgatcatgaccaacgacgacatcctgcagaagatcaagtactacatgggccacagccacgtgaagctgcagctggccgccatgttctgcatcagcaacctgatctggaacgaggaggagggcagccaggagagacaggacaagctgagagacatgggcatcgtggacatcctgcacaagctgagccagagccccgacagcaacctgtgcgacaaggccaagatggccctgcagcagtacctggcctag

SEQ ID NO: 18111 - DNA, 1593 bp, Artificial Sequence
  Description of Artificial Sequence: Synthetic coding sequence
taccaggacgccaccgtgatcccccacctgatggccctgctgagcagaagcagatacacccaggagtacatctgccagatcttcagccactgctgcaagggccccgaccaccagaccatcctgttcaaccacggcgccgtgcagaacatcgcccacctgctgaccagcctgagctacaaggtgagaatgcaggccctgaagtgcttcagcgtgctggccttcgagaacccccaggtgagcatgaccctggtgaacgtgctggtggacggcgagctgctgccccagatcttcgtgaagatgctgcagagagacaagcccatcgagatgcagctgaccagcgccaagtgcctgacctacatgtgcagagccggcgccatcagaaccgacgacaactgcatcgtgctgaagaccctgccctgcctggtgagaatgtgcagcaaggagagactgctggaggagagagtggagggcgccgagaccctggcctacctgatcgagcccgacgtggagctgcagagaatcgccagcatcaccgaccacctgatcgccatgctggccgactacttcaagtaccccagcagcgtgagcgccatcaccgacatcaagagactggaccacgacctgaagcacgcccacgagctgagacaggccgccttcaagctgtacgccagcctgggcgccaacgacgaggacatcagaaagaagatcatcgagaccgagaacatgatggacagaatcgtgaccggcctgagcgagagcagcgtgaaggtgagactggccgccgtgagatgcctgcacagcctgagcagaagcgtgcagcagctgagaaccagcttccaggaccacgccgtgtggaagcccctgatgaaggtgctgcagaacgcccccgacgagatcctggtggtggccagcagcatgctgtgcaacctgctgctggagttcagccccagcaaggagcccatcctggagagcggcgccgtggagctgctgtgcggcctgacccagagcgagaaccccgccctgagagtgaacggcatctgggccctgatgaacatggccttccaggccgagcagaagatcaaggccgacatcctgagaagcctgagcaccgagcagctgttcagactgctgagcgacagcgacctgaacgtgctgatgaagaccctgggcctgctgagaaacctgctgagcaccagaccccacatcgacaagatcatgagcacccacggcaagcagatcatgcaggccgtgaccctgatcctggagggcgagcacaacatcgaggtgaaggagcagaccctgtgcatcctggccaacatcgccgacggcaccaccgccaaggacctgatcatgaccaacgacgacatcctgcagaagatcaagtactacatgggccacagccacgtgaagctgcagctggccgccatgttctgcatcagcaacctgatctggaacgaggaggagggcagccaggagagacaggacaagctgagagacatgggcatcgtggacatcctgcacaagctgagccagagccccgacagcaacctgtgcgacaaggccaagatggccctgcagcagtacctggcctag

SEQ ID NO: 18112 - DNA, 1998 bp, Artificial Sequence
  Description of Artificial Sequence: Synthetic coding sequence
atgggcgacatcctggcccacgagagcgagctgctgggcctggtgaaggagtacctggacttcgccgagttcgaggacaccctgaagaccttcagcaaggagtgcaagatcaagggcaagcccctgtgcaagaccgtgggcggcagcttcagagacagcaagagcctgaccatccagaaggacctggtggccgccttcgacaacggcgaccagaaggtgttcttcgacctgtgggaggagcacatcagcagcagcatcagagacggcgacagcttcgcccagaagctggagttctacctgcacatccacttcgccatctacctgctgaagtacagcgtgggcagacccgacaaggaggagctggacgagaagatcagctacttcaagacctacctggagaccaagggcgccgccctgagccagaccaccgagttcctgcccttctacgccctgcccttcgtgcccaaccccatggtgcaccccagcttcaaggagctgttccaggacagctggacccccgagctgaagctgaagctgatcaagttcctggccctgatcagcaaggccagcaacacccccaagctgctgaccatctacaaggagaacggccagagcaacaaggagatcctgcagcagctgcaccagcagctggtggaggccgagagaagaagcgtgacctacctgaagagatacaacaagatccaggccgactaccacaacctgatcggcgtgaccgccgagctggtggacagcctggaggccaccgtgagcggcaagatgatcacccccgagtacctgcagagcgtgtgcgtgagactgttcagcaaccagatgagacagagcctggcccacagcgtggacttcaccagacccggcaccgccagcaccatgctgagagccagcctggcccccgtgaagctgaaggacgtgcccctgctgcccagcctggactacgagaagctgaagaaggacctgatcctgggcagcgacagactgaaggccttcctgctgcaggccctgagatggagactgaccaccagccaccccggcgagcagagagagaccgtgctgcaggcctacatcagcaacgacctgctggactgctacagccacaaccagagaagcgtgctgcagctgctgcacagcaccagcgacgtggtgagacagtacatggccagactgatcaacgccttcgccagcctggccgagggcagactgtacctggcccagaacaccaaggtgctgcagatgctggagggcagactgaaggaggaggacaaggacatcatcaccagagagaacgtgctgggcgccctgcagaagttcagcctgagaagacccctgcagaccgccatgatccaggacggcctgatcttctggctggtggacgtgctgaaggaccccgactgcctgagcgactacaccctggagtacagcgtggccctgctgatgaacctgtgcctgagaagcaccggcaagaacatgtgcgccaaggtggccggcctggtgctgaaggtgctgagcgacctgctgggccacgagaaccacgagatccagccctacgtgaacggcgccctgtacagcatcctgagcgtgcccagcatcagagaggaggccagagccatgggcatggaggacatcctgagatgcttcatcaaggagggcaacgccgagatgatcagacagatcgagttcatcatcaagcagctgaacagcgaggagctgcccgacggcgtgctggagagcgacgacgacgaggacgaggacgacgaggaggaccacgacatcatggaggccgacctggacaaggacgagctgatccagccccagctgggcgagctgagcggcgagaagctgctgaccaccgagtacctgggcatcatgaccaacaccggcaagaccagaagaaagggcctggccaacgtgcagtggagcggcgacgagcccctgcagagacccgtgacccccggcggccacagaaacggctaccccgtgtag

SEQ ID NO: 18113 - DNA, 2451 bp, Artificial Sequence
  Description of Artificial Sequence: Synthetic coding sequence
atgggcgacatcctggcccacgagagcgagctgctgggcctggtgaaggagtacctggacttcgccgagttcgaggacaccctgaagaccttcagcaaggagtgcaagatcaagggcaagcccctgtgcaagaccgtgggcggcagcttcagagacagcaagagcctgaccatccagaaggacctggtggccgccttcgacaacggcgaccagaaggtgttcttcgacctgtgggaggagcacatcagcagcagcatcagagacggcgacagcttcgcccagaagctggagttctacctgcacatccacttcgccatctacctgctgaagtacagcgtgggcagacccgacaaggaggagctggacgagaagatcagctacttcaagacctacctggagaccaagggcgccgccctgagccagaccaccgagttcctgcccttctacgccctgcccttcgtgcccaaccccatggtgcaccccagcttcaaggagctgttccaggacagctggacccccgagctgaagctgaagctgatcaagttcctggccctgatcagcaaggccagcaacacccccaagctgctgaccatctacaaggagaacggccagagcaacaaggagatcctgcagcagctgcaccagcagctggtggaggccgagagaagaagcgtgacctacctgaagagatacaacaagatccaggccgactaccacaacctgatcggcgtgaccgccgagctggtggacagcctggaggccaccgtgagcggcaagatgatcacccccgagtacctgcagagcgtgtgcgtgagactgttcagcaaccagatgagacagagcctggcccacagcgtggacttcaccagacccggcaccgccagcaccatgctgagagccagcctggcccccgtgaagctgaaggacgtgcccctgctgcccagcctggactacgagaagctgaagaaggacctgatcctgggcagcgacagactgaaggccttcctgctgcaggccctgagatggagactgaccaccagccaccccggcgagcagagagagaccgtgctgcaggcctacatcagcaacgacctgctggactgctacagccacaaccagagaagcgtgctgcagctgctgcacagcaccagcgacgtggtgagacagtacatggccagactgatcaacgccttcgccagcctggccgagggcagactgtacctggcccagaacaccaaggtgctgcagatgctggagggcagactgaaggaggaggacaaggacatcatcaccagagagaacgtgctgggcgccctgcagaagttcagcctgagaagacccctgcagaccgccatgatccaggacggcctgatcttctggctggtggacgtgctgaaggaccccgactgcctgagcgactacaccctggagtacagcgtggccctgctgatgaacctgtgcctgagaagcaccggcaagaacatgtgcgccaaggtggccggcctggtgctgaaggtgctgagcgacctgctgggccacgagaaccacgagatccagccctacgtgaacggcgccctgtacagcatcctgagcgtgcccagcatcagagaggaggccagagccatgggcatggaggacatcctgagatgcttcatcaaggagggcaacgccgagatgatcagacagatcgagttcatcatcaagcagctgaacagcgaggagctgcccgacggcgtgctggagagcgacgacgacgaggacgaggacgacgaggaggaccacgacatcatggaggccgacctggacaaggacgagctgatccagccccagctgggcgagctgagcggcgagaagctgctgaccaccgagtacctgggcatcatgaccaacaccggcaagaccagaagaaagggcctggccaacgtgcagtggagcggcgacgagcccctgcagagacccgtgacccccggcggccacagaaacggctaccccgtggtggaggaccagcacacccccccccagaccgcccagcacgccagaaacggccacccccaggccctgcccgccgcccacgaggccgtgtacagagagggcaagcccagcacccccgagagctgcgtgagcagcagcagcgccatcatcgccaagcccggcgagtggctgcccagaggcagacaggaggagcccagacccgcccccacccccagacagcccagagaggccccccaggaccccggcaacggcgtgaccaccagagagtgcgccagcgccttcacctgcaagcccagagccccctgcacccccgagatgctggactggaacccccccaaggccaaggccagcgtgctggcccccctgttcagcagctgcggcccccagcaggccagcagacccggcagcaccgccagcagcaccagaggcctgcccagcaaggagacccaccccaagtag

SEQ ID NO: 18114 - DNA, 501 bp, Artificial Sequence
  Description of Artificial Sequence: Synthetic coding sequence
atgggcgacatcctggcccacgagagcgagctgctgggcctggtgaaggagtacctggacttcgccgagttcgaggacaccctgaagaccttcagcaaggagtgcaagatcaagggcaagcccctgtgcaagaccgtgggcggcagcttcagagacagcaagagcctgaccatccagaaggacctggtggccgccttcgacaacggcgaccagaaggtgttcttcgacctgtgggaggagcacatcagcagcagcatcagagacggcgacagcttcgcccagaagctggagttctacctgcacatccacttcgccatctacctgctgaagtacagcgtgggcagacccgacaaggaggagctggacgagaagatcagctacttcaagacctacctggagaccaagggcgccgccctgagccagaccaccgagttcctgcccttctacgccctgcccttcgtgcccaaccccatggtgcaccccagcttcaaggagctgtag

SEQ ID NO: 18115 - DNA, 1140 bp, Artificial Sequence
  Description of Artificial Sequence: Synthetic coding sequence
atgggctacgccagaaaggtgggctgggtgaccgccggcctggtgatcggcgccggcgcctgctactgcatctacagactgaccagaggcagaaagcagaacaaggagaagatggccgagggcggcagcggcgacgtggacgacgccggcgactgcagcggcgccagatacaacgactggagcgacgacgacgacgacagcaacgagagcaagagcatcgtgtggtaccccccctgggccagaatcggcaccgaggccggcaccagagccagagccagagccagagccagagccaccagagccagaagagccgtgcagaagagagccagccccaacagcgacgacaccgtgctgagcccccaggagctgcagaaggtgctgtgcctggtggagatgagcgagaagccctacatcctggaggccgccctgatcgccctgggcaacaacgccgcctacgccttcaacagagacatcatcagagacctgggcggcctgcccatcgtggccaagatcctgaacaccagagaccccatcgtgaaggagaaggccctgatcgtgctgaacaacctgagcgtgaacgccgagaaccagagaagactgaaggtgtacatgaaccaggtgtgcgacgacaccatcaccagcagactgaacagcagcgtgcagctggccggcctgagactgctgaccaacatgaccgtgaccaacgagtaccagcacatgctggccaacagcatcagcgacttcttcagactgttcagcgccggcaacgaggagaccaagctgcaggtgctgaagctgctgctgaacctggccgagaaccccgccatgaccagagagctgctgagagcccaggtgcccagcagcctgggcagcctgttcaacaagaaggagaacaaggaggtgatcctgaagctgctggtgatcttcgagaacatcaacgacaacttcaagtgggaggagaacgagcccacccagaaccagttcggcgagggcagcctgttcttcttcctgaaggagttccaggtgtgcgccgacaaggtgctgggcatcgagagccaccacgacttcctggtgaaggtgaaggtgggcaagttcatggccaagctggccgagcacatgttccccaagagccaggagtag

SEQ ID NO: 18116 - DNA, 1140 bp, Artificial Sequence; identical to SEQ ID NO: 18115
  Description of Artificial Sequence: Synthetic coding sequence

SEQ ID NO: 18117 - DNA, 6873 bp, Artificial Sequence
  Description of Artificial Sequence: Synthetic coding sequence
atgggcagaatccaggaggtgggctgggtgaccgccggcctggtgatctgggccggcacctgctactacatctacaagttcaccaagggcagagcccagagcgtgagaaccctggccagaaacggcagcaccgtgaagatggagaccgtggtgggcgtgcagagccagaccctggccatcaacgaggccgagatcaagaccaagccccaggtggagatcggcgccgagaccggcgccagaagcggccccagagccgaggtggagaccaaggccaccgccatcgccatccacagagccaacagccaggccaaggccatggtgggcgccgagcccgagacccagagcgagagcaaggtggtggccggcaccctggtgatgaccgaggccgtgaccctgaccgaggtgaaggccaaggccagagaggtggccatgaaggaggccgtgacccagaccgacgccgaggccggcaagatcgtgaagaaggaggccgtgacccagaccaaggccaaggcctgggccctggtggccaagaccgaggccaagagagaggccatgacccagaccaaggccgagacccacatcctggccgagaaggagaccgagatcaacagagtgatggtgacccagagcgagaccctggccgtgcccagagaggtggccaagatgggcgccaccaacaagaccggcatcgtggacgagaccaagaccagagccctggaggagaccgtgagcgtggccaagacccagagcgaggccagacccggcgccaccgtggacgccagaggcaaccccaacggcatgagcagagaggtggccggcgtggacatgaagagctgcgcccagagccaggccgtgaccaagatccagggcgacgacatgcccggcaccggcgtggaggacatgggcaactgcaagaccatgagcagagccgagagcggcgccgacaccagagccagcgcccagccccagatcttcgccaagacccagaccgaggccatccccggcgccaagatcgacgccggcggcaacaccaacgccatgtgcaaggtgggcgccggcgccgacgtgagagcctgcatccagccccagaccgtggccaagaagcaggccgaggtgaccagcggcgccagagtggacggcagaggcaacaccaacgtgatcagcaaggccatcaccggcgccgacatgagagccgccgcccagccccaggccgtggccagcacccacgccgaggccatgagcgacgccaaggtgaagaacagaggcaaccccaacgccatgaccaaggccggcgccaaggccaacctgagagccaacagccaggtggaggccctgcccgacgccagagacaagagcagaggcaaccccaacgtgatggccaaggtgggcgacggcaccgacatgctgagctgcacccagccccagctggtggccagcgtgcaggccgacaccctgagcgacggcaagatcaaggtgagaggcaacgtgaacaccatgcccaaggagggcgccggcgtggacatgaaggcccagggcatggcccagagccagggcgaggccctgcccaacaccagaggcaaggccagaggcaaggccaaggccaagtgcaagaccggccccggcatggacatgaagacctgcacccagccccaggccggcgtgaagacccccgccgaggccctgctggacagcagagtggacggcagaggcaaccccaacgccaccagcaaggccggcaccaaggccgaccagagagtgtgcggccagcccctggtggtggccaacccccagggcgaggccctgcccggcgccaagaacaaggtgaagggcaacccccacaccgtgctgaaggtgggcgccggcgagggcaccaccgacagcgcccagcccgaggccgtggtgagcttccagggcgaggccctgctgggcaccaagaacaaggtgaagggcaaccccaacgtggtgctgaaggccgaggtgggcgagggcgccatgggcaccgcccagctgcagatcatggccagcagcaagggcgaggccctgctggacagcaagaacaaggtgaagggcaacagcaacgccgtgagcaaggccggcgccggcaccgacaccaccggcagcgtgcagccccagatcgtggccaacagccagggcgaggtgctgcccggcgccaagaacaagatcagaggcaaccccaccaccgtgcccaacagcggcgtgggcccctacaccaccgacagcgccagactgcaggccgtggccaacagccagggcgaggtgctgcccggcgccaagaacaaggtgaaggccaacctgaacgccgtgagcaaggccgaggccggcatgggcgccaccggcagcgtgcagccccaggccgtggccaacagccactgcgagaccctgcccggcgccaagaacaaggtgagaggcaactggaacgccgtgagcaaggccggcgccggcatggacaccagaggcagcgcccagccccaggccgtggccaacagccagggcgaggtgctgcccggcgccaagaacaaggtgaagggcaaccccaacgtggtgagcaaggccggcgccagagaggacaccgtgggcagcacccagccccaggtgctggccagcagccagagagagaccctgcccggcgccagaaacaaggtgaagggcaacagcaacgtggtgagcaaggccggcgccagagaggacaccatgggcagcgcccagccccaggtggtggccaacagccagagagagaccctgcccggcgccagaaacaaggtgaagggcaacagcaacgccatcagcaaggccgaggccggcgccggcatcatgggcagcgtgcaggtgcaggtggtggccagcttccagggcgaggtgctgcccggcgccaagaacaaggtgagaggcaacagcaacgccgtgcccaaggccgaggccggcgccgacaccgtgggcagcgcccagccccaggccgtggccaacagccagagcgagaccctgctgggcgccagaaacaaggtgaagggcaacaccatcgccgtgcccaaggccggcaccggcgccggcaccagacacagcgcccagccccagatcgtggccggcagccagggcgagaccctgcccggcgccagagacaagagcatgagcaccagcgaggccgaggccaccgccgaggacgaggcctacgccaagcccgaggccgaggccatgcccaccagcgagagcgagggcggcagcggcacccaggcctgcagaaagacccagcccaacatccacgactactactggaacggcatcggcgtggaggactggatcgccgccgagagatggatcaagttcagattccagaccatggacggcgactgggagaacagcgtgagctgggccgacgacgagaacgaggccagcatcggcagctggagcggcgccagcgacaaggccggcatcatcagaagctgggccgtggcctgcgacgagaccagcgtgaagagctgggccggcgccagagccgagaacgtggtgggcatcggcacctgggccagagccggcgagcaggccagcggcggcctgtgggccggcggccagaccagcgagggcacctgggccggcgacaaggccagcggcggcgcctggaccggcgccgagaaccaggccagcggcggcagctgggccctggccggcaaccaggccatcggcgagctgtgggccgccggccaggccagcgacggcagctggcccggcggccaggccagcggcgtgagctgggtgggcgaggaggccatcggcggcagctggaccggcgccgagaaccaggccagcgagggcagctgggccggcgccggcgccggcaacatgagcagcgtgagctactgggccggcgtggtggaccaggccggcggcggcagctgggccggcaccagcgaccagagcggcggcggcagcaagcccagattcgaggaccaggccagcggcgagggcagctgggccggcgccggcggccaggccagcggcggcagcatgctgggccccgaggaccagagcagcggcagaagctgggccgacaccgccgaccaggccagcggcggcagcagactgggccacgtggaccagagcagcggcggcgcctgggccggcaccctggaccagagcggcggcggcagcaagcccagattcgagaaccagaccaccgaggagggcagctgggccggcgccggcggccaggccggcggcggcagcaaggtgggccccgaggaccagagcagcggcagaagctgggccaacagcggcgaccagatcagcggcggcttcctggtgggcatcgtggaccaggccaacggcggcagctggaccggcgccggccaccccgccagcgtgggccccaagcccatcttcgaggaccaggtgagcggcagaggcagctgggccgacgccagagagcaggtggtgggcgacagcagactgggcctgagagaccagagcagcggcgacagctgggccgacaccggcgaccaggccagcggctggttctgcgtgtgccccggcagccagaccaacggcggcagctggggcggcgccagcggccaggacgtgggcggcagcagacccggccccaccaaccagagcagcgccggcagctgggacagccccggcagccaggtgagcggcagctgctggaccggcgccggcgccgtggaccaggccggcggctgcagcaagcccggcttcgaggaccaggccatcggcggcggcttctggcccggcgccggcgaccagaccggcggcggcagcagacccggcagcgaggaccagagcagcggcatcggcagctggggcgtggccggcggccaggtgctgggcggcgccagacccggccccgccgaccagagcagcggcggcagctgggccggcaccggcaaccagagcagcggcagaagctggatcggccccggcgaccaggccgtggactgcagcaagcccgagttcgaggaccaggcctgcggcggcggcagctgggccggcgccggcagccaggccagcggcgagagctgggccggcagcagacccggcaacgaggccatcggcggcagcagaatgggcagcgaggaccaggccaccggcggcagctgggccagaagcgaggaccaggccagcggcagattccaggtgagcttcgaggtggaggccaacgagggcttctggttcggccccggcgccgaggccgtgatcggcagctggtgctggaccgaggagaaggccgacatcgtgagcagacccgacgacaaggacgaggccaccaccgccagcagaagcggcgccggcgaggaggccatgatctgcagcagaatcgaggccgagaacaaggccagcagcggcagctggatcagaagcgaggaggtggcctacatgggcagctgcgtgggcgccgaggccggcgccggcgccgaggccggcgccggcgccgaggccggcgccggcgccggcgccgaggccggcgccgaggccggcgccggcgccggcgccggccccggcaccgagagcggcgccggcatctggagctgggacggcgacgccaccaccgtggagagcagactgggcgccggcgaggaggccggcgtggagagctggaccctggccagaaacgtgggcgaggacgagctgagcagagagagcagccccgacatcgaggagatcagcctgagaagcctgttctgggccgagagcgagaacagcaacaccttcagaagcaagagcggcaaggacgccagcttcgagagcggcgccggcgacaacaccagcatcaaggacaagttcgaggccgccggcggcgtggacatcggcagctggttctgcgccggcaacgagaacaccagcgaggacaagagcgcccccaaggccaaggccaagaagagcagcgagagcagaggcatctacccctacatggtgcccggcgccggcatgggcagctgggacggcgccatgatctggagcgagaccaagttcgcccaccagagcgaggccagcttccccgtggaggacgagagcagaaagcagaccagaaccggcgagaagaccagaccctggagctgcagatgcaagcacgaggccaacatggaccccagagacctggagaagctgatctgcatgatcgagatgaccgaggaccccagcgtgcacgagatcgccaacaacgccctgtacaacagcgccgactacagctacagccacgaggtggtgagaaacgtgggcggcatcagcgtgatcgagagcctgctgaacaacccctaccccagcgtgagacagaaggccctgaacgccctgaacaacatcagcgtggccgccgagaaccacagaaaggtgaagacctacctgaaccaggtgtgcgaggacaccgtgacctaccccctgaacagcaacgtgcagctggccggcctgagactgatcagacacctgaccatcaccagcgagtaccagcacatggtgaccaactacatcagcgagttcctgagactgctgaccgtgggcagcggcgagaccaaggaccacgtgctgggcatgctgctgaacttcagcaagaaccccagcatgaccaaggacctgctgatcgccaacgcccccaccagcctgatcaacatcttcagcaagaaggagaccaaggagaacatcctgaacgccctgagcctgttcgagaacatcaactaccacttcaagagaagagccaaggccttcacccaggacaagttcagcaagaacagcctgtacttcctgttccagagacccaaggcctgcgccaagaagctgagagccctggccgccgagtgcaacgaccccgaggtgaaggagagagtggagctgctgatcagcaagctgtag

SEQ ID NO: 18118 - DNA, 903 bp, Artificial Sequence
  Description of Artificial Sequence: Synthetic coding sequence
atgggcagagccagagaggtgggctggatggccgccggcctgatgatcggcgccggcgcctgctactgcgtgtacaagctgaccatcggcagagacgacagcgagaagctggaggaggagggcgaggaggagtgggacgacgaccaggagctggacgaggaggagcccgacatctggttcgacttcgagaccatggccagaccctggaccgaggacggcgactggaccgagcccggcgcccccggcggcaccgaggacagacccagcggcggcggcaaggccaacagagcccaccccatcaagcagagacccttcccctacgagcacaagaacacctggagcgcccagaactgcaagaacggcagctgcgtgctggacctgagcaagtgcctgttcatccagggcaagctgctgttcgccgagcccaaggacgccggcttccccttcagccaggacatcaacagccacctggccagcctgagcatggccagaaacaccagccccacccccgaccccaccgtgagagaggccctgtgcgcccccgacaacctgaacgccagcatcgagagccagggccagatcaagatgtacatcaacgaggtgtgcagagagaccgtgagcagatgctgcaacagcttcctgcagcaggccggcctgaacctgctgatcagcatgaccgtgatcaacaacatgctggccaagagcgccagcgacctgaagttccccctgatcagcgagggcagcggctgcgccaaggtgcaggtgctgaagcccctgatgggcctgagcgagaagcccgtgctggccggcgagctggtgggcgcccagatgctgttcagcttcatgagcctgttcatcagaaacggcaacagagagatcctgctggagacccccgccccctag

SEQ ID NO: 18119 - DNA, 903 bp, Artificial Sequence; identical to SEQ ID NO: 18118
  Description of Artificial Sequence: Synthetic coding sequence

SEQ ID NO: 18120 - DNA, 903 bp, Artificial Sequence; identical to SEQ ID NO: 18118
  Description of Artificial Sequence: Synthetic coding sequence

SEQ ID NO: 18121 - DNA, 1677 bp, Artificial Sequence
  Description of Artificial Sequence: Synthetic coding sequence
atggtggacagcggcaccgaggccagagccagaggcaaggccgaggccggcctgcaggacggcatcagcggccccgccaccgccagagtgaacggcaagacccaggccgaggccgtggccgaggccgagctgaagaccgagagcgtgacccaggccaaggccggcgacggcgccatgaccagaacccacaccgtgacctacagagaggccatggccgtgaccagagaggtgatcaaggtggaggacaccaccaagaccagagtgatggtggagaccaagaccaagcccctggccgagagaagcatcgtgccccagaccaagagcaaggccatgcccatgagcagagtgagcaccgtgaccaagagcgaggtgaaggtggtggccgtgatcgaggccaacatcagaagctacgccaagagccacgacaaggccaacaccggcagcagacccgacagaagagaggagaccagcatcggcatgaagagcagcgacgaggacgaggagaacatctgcagctggttctggaccggcgaggagcccagcgtgggcagctggttctggcccgaggaggagaccagcctgcaggtgtacaagcccctgcccaagatccaggagaagcccaagcccacccacaagcccaccctgaccatcaagcagaaggtgatcgcctggagcagagccagatacatcgtgctggtgcccgtggagggcggcgagcagagcctgccccccgagggcaactggaccctggtggagaccctgatcgagacccccctgggcatcagacccctgaccaagatccccccctaccacggcccctactaccagaccctggccgagatcaagaagcagatcagacagagagagaagtacggccccaaccccaaggcctgccactgcaagagcagaggcttcagcctggagcccaaggagttcgacaagctggtggccctgctgaagctgaccaaggaccccttcatccacgagatcgccaccatgatcatgggcatcagccccgcctaccccttcacccaggacatcatccacgacgtgggcatcaccgtgatgatcgagaacctggtgaacaaccccaacgtgaaggagcaccccggcgccctgagcatggtggacgacagcagcgagagcagcgaggagcccaagagcggcgagagctacatccaccaggtgtgcaagggcatcatcagctgccccctgaacagccccgtgcagctggccggcctgaagctgctgggccacctgagcatcaagttcgaggaccactacgtgatcaccagctacatccccgacttcctgaccctgctgaacaagggcagcgtgaagaccaagttctacgtgctgaaggtgttcagctgcctgagcaagaaccacgccaacaccagagagctgatcagcgccaaggtgctgagcagcctggtggcccccttcaacaagaacgagagcaaggccaacatcctgaacatcatcgagatcttcgagaacatcaacttccagttcaagaccaaggccaagctgttcaccaaggagaagttcaccaagagcgagctgatcagcatcttccaggaggccaagcagttcggccagaagctgcaggacctggccgagcacagcgaccccgaggtgagagacaaggtgatcagactgatcctgaagctgtag

SEQ ID NO: 18122 - DNA, 1677 bp, Artificial Sequence; identical to SEQ ID NO: 18121
  Description of Artificial Sequence: Synthetic coding sequence

SEQ ID NO: 18123 - DNA, 1677 bp, Artificial Sequence; identical to SEQ ID NO: 18121
  Description of Artificial Sequence: Synthetic coding sequence

SEQ ID NO: 18124 - DNA, 1677 bp, Artificial Sequence; identical to SEQ ID NO: 18121
  Description of Artificial Sequence: Synthetic coding sequence

SEQ ID NO: 18125 - DNA, 1677 bp, Artificial Sequence; identical to SEQ ID NO: 18121
  Description of Artificial Sequence: Synthetic coding sequence

SEQ ID NO: 18126 - DNA, 633 bp, Artificial Sequence
  Description of Artificial Sequence: Synthetic coding sequence
atgttcgagagcttcaacgtgcccggcctgtacatcgccgtgcaggccgtgctggccctggccgccagctggaccagcagacaggtgggcgagagaaccctgaccggcatcgtgatcgacagcggcgacggcgtgacccacgtgatccccgtggccgagggctacgtgatcggcagctgcatcaagcacatccccatcgccggcagagacatcacctacttcatccagcagctgctgagagagagagaggtgggcatcccccccgagcagagcctggagaccgccaaggccatcaaggagaagtactgctacatctgccccgacatcgtgaaggagttcgccaagtacgacgtggacccccagaagtggatcaagcagtacaccggcatcaacgccatcaaccagaagaagttcgtgatcgacgtgggctacgagagattcctgggccccgagatcttcttccaccccgagttcgccaaccccgacagcatggagagcatcagcgacgtggtggacgaggtgatccagaactgccccatcgacgtgagaagacccctgtacaagatggagcagatccccctgagctacccccagggccacggcttccaccccctgagcccccccttccactag

SEQ ID NO: 18127 - DNA, 156 bp, Artificial Sequence
  Description of Artificial Sequence: Synthetic coding sequence
atgttcgagagcttcaacgtgcccggcctgtacatcgccgtgcaggccgtgctggccctggccgccagctggaccagcagacaggtgggcgagagaaccctgaccggcatcgtgatcgacagcggcgacggcgtgacccacgtgatccccgtgtag

SEQ ID NO: 18128 - DNA, 633 bp, Artificial Sequence; identical to SEQ ID NO: 18126
  Description of Artificial Sequence: Synthetic coding sequence

SEQ ID NO: 18129 - DNA, 1878 bp, Artificial Sequence
  Description of Artificial Sequence: Synthetic coding sequence
atgaccgccaccctgagaccctacctgagcgccgtgagagccaccctgcaggccgccctgtgcctggagaacttcagcagccaggtggtggagagacacaacaagcccgaggtggaggtgagaagcagcaaggagctgctgctgcagcccgtgaccatcagcagaaacgagaaggagaaggtgctgatcgagggcagcatcaacagcgtgagagtgagcatcgccgtgaagcaggccgacgagatcgagaagatcctgtgccacaagttcatgagattcatgatgatgagagccgagaacttcttcatcctgagaagaaagcccgtggagcagaagaagatcttcaccatccagggctgctaccccgtgatcagatgcctgctgagaagaagaggctgggtggagaagaagatggtgcacagaagcggccccaccctgctgcccccccagaaggacctggacagcagcgccatgggcgacagcgacaccaccgaggacgaggacgaggacgaggacgaggagttccagcccagccagctgttcgacttcgacgacctgctgaagttcgacgacctggacggcacccacgccctgatggtgggcctgtgcctgaacctgagaaacctgccctggttcgacgaggtggacgccaacagcttcttccccagatgctactgcctgggcgccgaggacgacaagaaggccttcatcggcgacaagcagcccaagaagcaggagaagaaccccgtgctggtgagccccgagttcgtggacgaggccctgtgcgcctgcgaggagtacctgagcaacctggcccacatggacatcgacaaggacctggaggcccccctgtacctgacccccgagggctggagcctgttcctgcagagatactaccaggtggtgcacgagggcgccgagctgagacacctggacacccaggtgcagagatgcgaggacatcctgcagcagctgcaggccgtggtgccccagatcgacatggagggcgacagaaacatctggatcgtgaagcccggcgccaagagcagaggcagaggcatcatgtgcatggaccacctggaggagatgctgaagctggtgaacggcaaccccgtggtgatgaaggacggcaagtgggtggtgcagaagtacatcgagagacccctgctgatcttcggcaccaagttcgacctgagacagtggttcctggtgaccgactggaaccccctgaccgtgtggttctacagagacagctacatcagattcagcacccagcccttcagcctgaagaacctggacaacagcgtgcacctgtgcaacaacagcatccagaagcacctggagaacagctgccacagacaccccctgctgccccccgacaacatgtggagcagccagagattccaggcccacctgcaggagatgggcgcccccaacgcctggagcaccatcatcgtgcccggcatgaaggacgccgtgatccacgccctgcagaccagccaggacaccgtgcagtgcagaaaggccagcttcgagctgtacggcgccgacttcgtgttcggcgaggacttccagccctggctgatcgagatcaacgccagccccaccatggcccccagcaccgccgtgaccgccagactgtgcgccggcgtgcaggccgacaccctgagagtggtgatcgacagaatgctggacagaaactgcgacaccggcgccttcgagctgatctacaagcagcccgtgaccaccagccccgccagcacccccagacccagctgcctgctgcccatgtacagcgacaccagagccagaagcagcgacgacagcaccgccagctggtgggccctgagaccctgcagaccccaggccagaccctag

SEQ ID NO: 18130 - DNA, 1683 bp, Artificial Sequence
  Description of Artificial Sequence: Synthetic coding sequence
gccggccccagagccgcctgcagcgagcccaacccctgcacccaggtggtgatgaacagccacagctacaacggcagcgtgggcagacccctgggcagcggccccggcgccctgggcagagacccccccgaccccgaggccggccaccccccccagcccccccacagccccggcctgcaggtggtggtggccaagagcgagcccgccagacccagccccggcagccccagaggccagccccaggaccaggacgacgacgaggacgacgaggaggacgaggccggcagacagagagccagcggcaagcccagcaacgtgggccacagactgggccacagaagagccctgttcgagaagagaaagagactgagcgactacgccctgatcttcggcatgttcggcatcgtggtgatggtgaccgagaccgagctgagctggggcgtgtacaccaaggagagcctgtacagcttcgccctgaagtgcctgatcagcctgagcaccgccatcctgctgggcctggtggtgctgtaccacgccagagagatccagctgttcatggtggacaacggcgccgacgactggagaatcgccatgacctgcgagagagtgttcctgatcagcctggagctggccgtgtgcgccatccaccccgtgcccggccactacagattcacctggaccgccagactggccttcacctacgcccccagcgtggccgaggccgacgtggacgtgctgctgagcatccccatgttcctgagactgtacctgctgggcagagtgatgctgctgcacagcaagatcttcaccgacgccagcagcagaagcatcggcgccctgaacaagatcaccttcaacaccagattcgtgatgaagaccctgatgaccatctgccccggcaccgtgctgctggtgttcagcatcagcagctggatcatcgccgcctggaccgtgagagtgtgcgagagataccacgacaagcaggaggtgaccagcaacttcctgggcgccatgtggctgatcagcatcaccttcctgagcatcggctacggcgacatggtgccccacacctactgcggcaagggcgtgtgcctgctgaccggcatcatgggcgccggctgcaccgccctggtggtggccgtggtggccagaaagctggagctgaccaaggccgagaagcacgtgcacaacttcatgatggacacccagctgaccaagagagtgaagaacgccgccgccaacgtgctgagagagacctggctgatctacaagcacaccagactggtgaagaagcccgaccaggccagagtgagaaagcaccagagaaagttcctgcaggccatccaccacggcagaatgctgagaagcgtgaagatcgagcagggcaagctgaacgaccaggccaacaccctgaccgacctggccaagacccagaccgtgatgtacgacctggtgagcgagctgcacgcccagcacgaggagctggaggccagactggccaccctggagagcagactggacgccctgggcgccagcctgcaggccctgcccggcctgatcgcccaggccatcagacccccccccccccccctgccccccagacccggccccggcccccaggaccaggccgccagaagcagcccctgcagatggacccccgtggcccccagcgactgcggctag

SEQ ID NO: 18131 - DNA, 1209 bp, Artificial Sequence
  Description of Artificial Sequence: Synthetic coding sequence
atgagaagcggcggcgtgagaagcttcgccctggagctggccagaggccccggcggcgcctacagaggcggcgagagactgtgcggcagagtgctgctggaggccgccgcccccctgagagtgagagccctggaggtgaaggccagaggcggcgccgccacccactggctggagggcagaagcgtgggcgtgaacgccgtgagcagcgactacgccgccgccgagacctacctgagaagaagacagctgctgctgagagacaccggcgagaccaccaccctgccccccggcagacacgagttcctgttcagcttccagctgccccccaccctggtgaccagcttcgagggcaagcacggcagcgtgagatactgcatcaaggccaccctgcacagaccctgggtgcccgccagaagagccagaaaggtgttcaccgtgatcgagcccgtggacatcaacacccccgccctgctggccccccaggccggcgccagagagaaggtggccagaagctggtactgcaacagaggcctggtgagcctgagcgccaagatcgacagaaagggctacacccccggcgaggtgatccccgtgttcgccgagatcgacaacggcagcaccagacccgtgctgcccagagccgccgtggtgcagacccagaccttcatggccagaggcgccagaaagcagaagagagccgtggtggccagcctggccggcgagcccgtgggccccggccagagagccctgtggcagggcagagccctgagaatcccccccgtgggccccagcatcctgcactgcagagtgctgcacgtggactacgccctgaaggtgtgcgtggacatccccggcaccagcaagctgctgctggagctgcccctggtgatcggcaccatccccctgcaccccttcggcagcagaagcagcagcgtgggcagccacgccagcttcctgctggactggagactgggcgccctgcccgagagacccgaggccccccccgagtacagcgaggtggtggccgacaccgaggaggccgccctgggccagagccccttccccctgccccaggaccccgacatgagcctggagggccccttcttcgcctacatccaggagttcagatacagacccccccccctgtacagcgaggaggaccccaaccccctgctgggcgacatgagacccagatgcatgacctgctag

SEQ ID NO: 18132 - DNA, 1257 bp, Artificial Sequence
  Description of Artificial Sequence: Synthetic coding sequence
atgggcggcgaggccggctgcgccgccgccgtgggcgccgagggcagagtgaagagcctgggcctggtgttcgaggacgagagaaagggctgctacagcagcggcgagaccgtggccggccacgtgctgctggaggccagcgagcccgtggccctgagagccctgagactggaggcccagggcagagccaccgccgcctggggccccagcacctgccccagagccagcgccagcaccgccgccctggccgtgttcagcgaggtggagtacctgaacgtgagactgagcctgagagagccccccgccggcgagggcatcatcctgctgcagcccggcaagcacgagttccccttcagattccagctgcccagcgagcccctggtgaccagcttcaccggcaagtacggcagcatccagtactgcgtgagagccgtgctggagagacccaaggtgcccgaccagagcgtgaagagagagctgcaggtggtgagccacgtggacgtgaacacccccgccctgctgacccccgtgctgaagacccaggagaagatggtgggctgctggttcttcaccagcggccccgtgagcctgagcgccaagatcgagagaaagggctactgcaacggcgaggccatccccatctacgccgagatcgagaactgcagcagcagactgatcgtgcccaaggccgccatcttccagacccagacctacctggccagcggcaagaccaagaccatcagacacatggtggccaacgtgagaggcaaccacatcgccagcggcagcaccgacacctggaacggcaagaccctgaagatcccccccgtgacccccagcatcctggactgctgcatcatcagagtggactacagcctggccgtgtacatccacatccccggcgccaagaagctgatgctggagctgcccctggtgatcggcaccatcccctacaacggcttcggcagcagaaacagcagcatcgccagccagttcagcatggacatgagctggctgaccctgaccctgcccgagcagcccgaggccccccccaactacgccgacgtggtgagcgaggaggagttcagcagacacatccccccctacccccagccccccaactgcgagggcgaggtgtgctgccccgtgttcgcctgcatccaggagttcagattccagcccccccccctgtacagcgaggtggacccccaccccagcgacgtggaggagagccagcccgtgagcttcatcctgtag

SEQ ID NO: 18133 - DNA, 996 bp, Artificial Sequence
  Description of Artificial Sequence: Synthetic coding sequence
atgcagggcgaggccgacgccagaaccggctgcgccgagtggcagggcgagggcatcatcctgctgcagcccggcaagcacgagttccccttcagattccagctgcccagcgagcccctggtgaccagcttcaccggcaagtacggcagcatccagtactgcgtgagagccgtgctggagagacccaaggtgcccgaccagagcgtgaagagagagctgcaggtggtgagccacgtggacgtgaacacccccgccctgctgacccccgtgctgaagacccaggagaagatggtgggctgctggttcttcaccagcggccccgtgagcctgagcgccaagatcgagagaaagggctactgcaacggcgaggccatccccatctacgccgagatcgagaactgcagcagcagactgatcgtgcccaaggccgccatcttccagacccagacctacctggccagcggcaagaccaagaccatcagacacatggtggccaacgtgagaggcaaccacatcgccagcggcagcaccgacacctggaacggcaagaccctgaagatcccccccgtgacccccagcatcctggactgctgcatcatcagagtggactacagcctggccgtgtacatccacatccccggcgccaagaagctgatgctggagctgcccctggtgatcggcaccatcccctacaacggcttcggcagcagaaacagcagcatcgccagccagttcagcatggacatgagctggctgaccctgaccctgcccgagcagcccgaggccccccccaactacgccgacgtggtgagcgaggaggagttcagcagacacatccccccctacccccagccccccaactgcgagggcgaggtgtgctgccccgtgttcgcctgcatccaggagttcagattccagcccccccccctgtacagcgaggtggacccccaccccagcgacgtggaggagagccagcccgtgagcttcatcctgtag

SEQ ID NO: 18134 - DNA, 1029 bp, Artificial Sequence
  Description of Artificial Sequence: Synthetic coding sequence
atgggcgacagagaggagtgcctgagcaccccccagccccccatgagcgtggtgaagagcatcgagctggtgctgcccgaggacagaatctacctggccggcagcagcatcaagggccaggtgatcctgaccctgaacagcaccctggtggaccccatcgtgaaggtggagctggtgggcagaggctacgtggagtggagcgaggaggccggcgccagctgcgactacagcagaaacgtgatctgcaacaacaaggccgactacgtgcacaagaccaagaccttccccgtggaggacaactggctgagcgccggcagccacaccttcgacttccacttcaacctgccccccagactgcccagcaccttcaccagcaagttcggccacgtgttctacttcgtgcaggccagctgcatgggcagagagcacatcctggccaagaagagaatgtacctgctggtgcagggcaccagcaccttccacaaggagacccccttccagaaccccctgttcgtggaggccgaggagaaggtgagctacaactgctgcagacagggcaccgtgtgcctgcagatccagatggagagaaacaccttcacccccggcgagaaggtggtgttcaccaccgagatcaacaaccagaccagcaagtgcatcaagaccgtggtgttcgccctgtacgcccacatccagtacgagggcttcacccccagcgccgagagaagaagcagactggacagcagcgagctgctgagacaggaggccaacacccccgtgaccagattcaacaccaccaaggtggtgagcaccttcaacctgcccctgctgctgagcgtgagcagcagcacccaggacggcgagatcatgcacaccagatacgagctggtgaccaccgtgcacctgccctggagcctgaccagcctgaaggccaaggtgcccatcatcatcaccagcgccagcgtggacagcgccatctgccagctgagcgaggacggcgtgctgcccgtgaaccccgaccaccagaactag

SEQ ID NO: 18135 - DNA, 843 bp, Artificial Sequence
  Description of Artificial Sequence: Synthetic coding sequence
atggagacccaccacggcatctgcagcagactgtgcaaggagagcgacagcgtggtgctggccgtgggctacagaaagctgcccaagcacaagttccccgtgcccgtgagagactgcctggtggccaccatccacttcctgaagagcctggacgcctacggcgtggaccccgccagagtggtggtgtgcggcgacagcttcggcggcgccatcgccgccgtggtgtgccagcagctggtggacagacccgacctgcccagaatcagagcccagatcctgatctacgccatcctgcaggccctggacctgcagacccccagcttccagcagagaaagaacatccccctgctgacctggagcttcatctgctactgcttcttccagaacctggacttcagcagcagctggcaggaggtgatcatgaagggcgcccacctgcccgccgaggtgtgggagaagtacagaaagtggctgggccccgagaacatccccgagagattcaaggagagaggctaccagctgaagccccacgagcccatgaacgaggccgcctacctggaggtgagcgtggtgctggacgtgatgtgcagccccctgatcgccgaggacgacatcgtgagccagctgcccgagacctgcatcgtgagctgcgagtacgacgccctgagagacaacagcctgctgtacaagaagagactggaggacctgggcgtgcccgtgacctggcaccacatggaggacggcttccacggcgtgctgagaaccatcgacatgagcttcctgcacttcccctgcagcatgagaatcctgagcgccctggtgcagttcgtgaagggcctgtag

SEQ ID NO: 18136 - DNA, 1053 bp, Artificial Sequence
  Description of Artificial Sequence: Synthetic coding sequence
atgatcttcgagaagctgagaatctgcagcatgccccagttcttctgcttcatgcaggacctgccccccctgaagtacgaccccgacgtggtggtgaccgacttcagattcggcaccatccccgtgaagctgtaccagagcaaggccagcacctgcaccctgaagcccggcatcgtgtactaccacggcggcggcggcgtgatgggcagcctgaagacccaccacggcatctgcagcagactgtgcaaggagagcgacagcgtggtgctggccgtgggctacagaaagctgcccaagcacaagttccccgtgcccgtgagagactgcctggtggccaccatccacttcctgaagagcctggacgcctacggcgtggaccccgccagagtggtggtgtgcggcgacagcttcggcggcgccatcgccgccgtggtgtgccagcagctggtggacagacccgacctgcccagaatcagagcccagatcctgatctacgccatcctgcaggccctggacctgcagacccccagcttccagcagagaaagaacatccccctgctgacctggagcttcatctgctactgcttcttccagaacctggacttcagcagcagctggcaggaggtgatcatgaagggcgcccacctgcccgccgaggtgtgggagaagtacagaaagtggctgggccccgagaacatccccgagagattcaaggagagaggctaccagctgaagccccacgagcccatgaacgaggccgcctacctggaggtgagcgtggtgctggacgtgatgtgcagccccctgatcgccgaggacgacatcgtgagccagctgcccgagacctgcatcgtgagctgcgagtacgacgccctgagagacaacagcctgctgtacaagaagagactggaggacctgggcgtgcccgtgacctggcaccacatggaggacggcttccacggcgtgctgagaaccatcgacatgagcttcctgcacttcccctgcagcatgagaatcctgagcgccctggtgcagttcgtgaagggcctgtag

SEQ ID NO: 18137 - DNA, 1578 bp, Artificial Sequence
  Description of Artificial Sequence: Synthetic coding sequence
atgggctggctgttcctgaaggtgctgctggccggcgtgagcttcagcggcttcctgtaccccctggtggacttctgcatcagcggcaagaccagaggccagaagcccaacttcgtgatcatcctggccgacgacatgggctggggcgacctgggcgccaactgggccgagaccaaggacaccgccaacctggacaagatggccagcgagggcatgagattcgtggacttccacgccgccgccagcacctgcagccccagcagagccagcctgctgaccggcagactgggcctgagaaacggcgtgaccagaaacttcgccgtgaccagcgtgggcggcctgcccctgaacgagaccaccctggccgaggtgctgcagcaggccggctacgtgaccggcatcatcggcaagtggcacctgggccaccacggcagctaccaccccaacttcagaggcttcgactactacttcggcatcccctacagccacgacatgggctgcaccgacacccccggctacaaccaccccccctgccccgcctgcccccagggcgacggccccagcagaaacctgcagagagactgctacaccgacgtggccctgcccctgtacgagaacctgaacatcgtggagcagcccgtgaacctgagcagcctggcccagaagtacgccgagaaggccacccagttcatccagagagccagcaccagcggcagacccttcctgctgtacgtggccctggcccacatgcacgtgcccctgcccgtgacccagctgcccgccgcccccagaggcagaagcctgtacggcgccggcctgtgggagatggacagcctggtgggccagatcaaggacaaggtggaccacaccgtgaaggagaacaccttcctgtggttcaccggcgacaacggcccctgggcccagaagtgcgagctggccggcagcgtgggccccttcaccggcttctggcagaccagacagggcggcagccccgccaagcagaccacctgggagggcggccacagagtgcccgccctggcctactggcccggcagagtgcccgtgaacgtgaccagcaccgccctgctgagcgtgctggacatcttccccaccgtggtggccctggcccaggccagcctgccccagggcagaagattcgacggcgtggacgtgagcgaggtgctgttcggcagaagccagcccggccacagagtgctgttccaccccaacagcggcgccgccggcgagttcggcgccctgcagaccgtgagactggagagatacaaggccttctacatcaccggcggcgccagagcctgcgacggcagcaccggccccgagctgcagcacaagttccccctgatcttcaacctggaggacgacaccgccgaggccgtgcccctggagagaggcggcgccgagtaccaggccgtgctgcccgaggtgagaaaggtgctggccgacgtgctgcaggacatcgccaacgacaacatcagcagcgccgactacacccaggaccccagcgtgaccccctgctgcaacccctaccagatcgcctgcagatgccaggccgcctag

SEQ ID NO: 18138 - DNA, 1932 bp, Artificial Sequence
  Description of Artificial Sequence: Synthetic coding sequence
atgtgcggcatctgctgcagcgtgaacttcagcgccgagcacttcagccaggacctgaaggaggacctgctgtacaacctgaagcagagaggccccaacagcagcaagcagctgctgaagagcgacgtgaactaccagtgcctgttcagcgcccacgtgctgcacctgagaggcgtgctgaccacccagcccgtggaggacgagagaggcaacgtgttcctgtggaacggcgagatcttcagcggcatcaaggtggaggccgaggagaacgacacccagatcctgttcaactacctgagcagctgcaagaacgagagcgagatcctgagcctgttcagcgaggtgcagggcccctggagcttcatctactaccaggccagcagccactacctgtggttcggcagagacttcttcggcagaagaagcctgctgtggcacttcagcaacctgggcaagagcttctgcctgagcagcgtgggcacccagaccagcggcctggccaaccagtggcaggaggtgcccgccagcggcctgttcagaatcgacctgaagagcaccgtgatcagcggctgcatcatcctgcagctgtacccctggaagtacatcagcagagagaacatcatcgaggagaacgtgaacagcctgagccagatcagcgccgacctgcccgccttcgtgagcgtggtggccaacgaggccaagctgtacctggagaagcccgtggtgcccctgaacatgatgctgccccaggccgccctggagacccactgcagcaacatcagcaacgtgccccccaccagagagatcctgcaggtgttcctgaccgacgtgcacatgaaggaggtgatccagcagttcatcgacgtgctgagcgtggccgtgaagaagagagtgctgtgcctgcccagagacgagaacctgaccgccaacgaggtgctgaagacctgcgacagaaaggccaacgtggccatcctgttcagcggcggcatcgacagcatggtgatcgccaccctggccgacagacacatccccctggacgagcccatcgacctgctgaacgtggccttcatcgccgaggagaagaccatgcccaccaccttcaacagagagggcaacaagcagaagaacaagtgcgagatccccagcgaggagttcagcaaggacgtggccgccgccgccgccgacagccccaacaagcacgtgagcgtgcccgacagaatcaccggcagagccggcctgaaggagctgcaggccgtgagccccagcagaatctggaacttcgtggagatcaacgtgagcatggaggagctgcagaagctgagaagaaccagaatctgccacctgatcagacccctggacaccgtgctggacgacagcatcggctgcgccgtgtggttcgccagcagaggcatcggctggctggtggcccaggagggcgtgaagagctaccagagcaacgccaaggtggtgctgaccggcatcggcgccgacgagcagctggccggctacagcagacacagagtgagattccagagccacggcctggagggcctgaacaaggagatcatgatggagctgggcagaatcagcagcagaaacctgggcagagacgacagagtgatcggcgaccacggcaaggaggccagattccccttcctggacgagaacgtggtgagcttcctgaacagcctgcccatctgggagaaggccaacctgaccctgcccagaggcatcggcgagaagctgctgctgagactggccgccgtggagctgggcctgaccgccagcgccctgctgcccaagagagccatgcagttcggcagcagaatcgccaagatggagaagatcaacgagaaggccagcgacaagtgcggcagactgcagatcatgagcctggagaacctgagcatcgagaaggagaccaagctgtag

SEQ ID NO: 18139 - DNA, 1857 bp, Artificial Sequence
  Description of Artificial Sequence: Synthetic coding sequence
atgtgcggcatctgctgcagcgtgaacttcagcgccgagcacttcagccaggacctgaaggaggacctgctgtacaacctgaagcagagaggccccaacagcagcaagcagctgctgaagagcgacgtgaactaccagtgcctgttcagcgcccacgtgctgcacctgagaggcgtgctgaccacccagcccgtggaggacgagagaggcaacgtgttcctgtggaacggcgagatcttcagcggcatcaaggtggaggccgaggagaacgacacccagatcctgttcaactacctgagcagctgcaagaacgagagcgagatcctgagcctgttcagcgaggtgcagggcccctggagcttcatctactaccaggccagcagccactacctgtggttcggcagagacttcttcggcagaagaagcctgctgtggcacttcagcaacctgggcaagagcttctgcctgagcagcgtgggcacccagaccagcggcctggccaaccagtggcaggaggtgcccgccagcggcctgttcagaatcgacctgaagagcaccgtgatcagcggctgcatcatcctgcagctgtacccctggaagtacatcagcagagagaacatcatcgaggagaacgtgaacagcctgagccagatcagcgccgacctgcccgccttcgtgagcgtggtggccaacgaggccaagctgtacctggagaagcccgtggtgcccctgaacatgatgctgccccaggccgccctggagacccactgcagcaacatcagcaacgtgccccccaccagagagatcctgcaggtgttcctgaccgacgtgcacatgaaggaggtgatccagcagttcatcgacgtgctgagcgtggccgtgaagaagagagtgctgtgcctgcccagagacgagaacctgaccgccaacgaggtgctgaagacctgcgacagaaaggccaacgtggccatcctgttcagcggcggcatcgacagcatggtgatcgccaccctggccgacagacacatccccctggacgagcccatcgacctgctgaacgtggccttcatcgccgaggagaagaccatgcccaccaccttcaacagagagggcaacaagcagaagaacaagtgcgagatccccagcgaggagttcagcaaggacgtggccgccgccgccgccgacagccccaacaagcacgtgagcgtgcccgacagaatcaccggcagagccggcctgaaggagctgcaggccgtgagccccagcagaatctggaacttcgtggagatcaacgtgagcatggaggagctgcagaagctgagaagaaccagaatctgccacctgatcagacccctggacaccgtgctggacgacagcatcggctgcgccgtgtggttcgccagcagaggcatcggctggctggtggcccaggagggcgtgaagagctaccagagcaacgccaaggtggtgctgaccggcatcggcgccgacgagcagctggccggctacagcagacacagagtgagattccagagccacggcctggagggcctgaacaaggagatcatgatggagctgggcagaatcagcagcagaaacctgggcagagacgacagagtgatcggcgaccacggcaaggaggccagattccccttcctggacgagaacgtggtgagcttcctgaacagcctgcccatctgggagaaggccaacctgaccctgcccagaggcatcggcgagaagctgctgctgagactggccgccgtggagctgggcctgaccgccagcgccctgctgcccaagagagccatgcagttcggcagcagaatcgccaagatggagaagatcaacgagtag

SEQ ID NO: 18140 - DNA, 222 bp, Artificial Sequence
  Description of Artificial Sequence: Synthetic coding sequence
atgtgcggcatctgctgcagcgtgaacttcagcgccgagcacttcagccaggacctgaaggaggacctgctgtacaacctgaagcagagaggccccaacagcagcaagcagctgctgaagagcgacgtgaactaccagtgcctgttcagcgcccacgtgctgcacctgagaggcgtgctgaccacccagcccgtggaggacgagagaggcaacgtgttctag

SEQ ID NO: 18141 - DNA, 564 bp, Artificial Sequence
  Description of Artificial Sequence: Synthetic coding sequence
atggagagaagcgccttcatggagctggacgccggcagcagactggtgatgcacctgagagagtggcccgccctgctggtgagcagcaccggctggaccgagttcgagcagctgaccctggacggccacaacctgcccagcctggtgtgcgtgatcaccggcagcgtggacctgggcgtgtgcctgcacatgagcagcagcggcctggacctgcccatgaaggtggtggacatgttcggctgctgcctgcccgtgtgcgccgtgaacttcaagtgcctgcacgagctggtgaagcacgaggagaacggcctggtgttcgaggacagcgaggagctggccgccctgcagatgctgttcagcaacttccccgaccccgccggcaagctgaaccagttctggaagaacctgagagagagccagcagctgagatgggacgagagctgggtgcagaccgtgctgcccctggtgatggacatccagctgctgggccagagactgaagcccagagacccctgctgccccagcagaagcttcttcagcgagagccagggcaagcccttctag

SEQ ID NO: 18142 - DNA, 537 bp, Artificial Sequence
  Description of Artificial Sequence: Synthetic coding sequence
atgggcgacagagtgaagggcagcaagagcagaagacccgacctggtggtggaggtggcccaccccaagatcatccacgagagcggcgcccagatcctgagacacgccaacctgctgagcctgagagtgaccatggccacccaccccgacggcttcagactggagggccccctggccgccgcccacagccccggcccctgcaccgtgctgtacgagggccccgtgagaggcctgtgccccttcgcccccagaaacagcaacaccatggccgccgccgccctggccgcccccagcctgggcttcgacggcgtgatcggcgtgctggtggccgacaccagcctgaccgacatgcacgtggtggacgtggagctgagcggccccagaggccccaccggcagaagcttcgccgtgcacaccagaagagagaaccccgccgagcccggcgccgtgaccggcagcgccaccgtgaccgccttctggcagagcctgctggcctgctgccagctgcccagcagacccggcatccacctgtgctag

SEQ ID NO: 18143 - DNA, 852 bp, Artificial Sequence
  Description of Artificial Sequence: Synthetic coding sequence
atggccgacagaggcccctggagagtgggcgtggtgggctacggcagactgggccagagcctggtgagcagactgctggcccagggccccgagctgggcctggagctggtgttcgtgtggaacagagaccccggcagaatggccggcagcgtgccccccagcctgcagctgcagaacctggccgccctgggcgagagaagacccgacctggtggtggaggtggcccaccccaagatcatccacgagagcggcgcccagatcctgagacacgccaacctgctggtgggcagccccagcgccctgagcgaccagaccaccgagagacagctgctggaggccagccagcactgggaccacgccgtgttcgtggccagaggcgccctgtggggcgccgaggacatcagaagactggacgccgccggcggcctgagaagcctgagagtgaccatggccacccaccccgacggcttcagactggagggccccctggccgccgcccacagccccggcccctgcaccgtgctgtacgagggccccgtgagaggcctgtgccccttcgcccccagaaacagcaacaccatggccgccgccgccctggccgcccccagcctgggcttcgacggcgtgatcggcgtgctggtggccgacaccagcctgaccgacatgcacgtggtggacgtggagctgagcggccccagaggccccaccggcagaagcttcgccgtgcacaccagaagagagaaccccgccgagcccggcgccgtgaccggcagcgccaccgtgaccgccttctggcagagcctgctggcctgctgccagctgcccagcagacccggcatccacctgtgctag

SEQ ID NO: 18144 - DNA, 1458 bp, Artificial Sequence
  Description of Artificial Sequence: Synthetic coding sequence
atgagcggccacagccccaccagaggcgccatgcaggtggccatgaacggcaaggccagaaaggaggccgtgcagaccgccgccaaggagctgctgaagttcgtgaacagaagccccagccccttccacgccgtggccgagtgcagaaacagactgctgcaggccggcttcagcgagctgaaggagaccgagaagtggaacatcaagcccgagagcaagtacttcatgaccagaaacagcagcaccatcatcgccttcgccgtgggcggccagtacgtgcccggcaacggcttcagcctgatcggcgcccacaccgacagcccctgcctgagagtgaagagaagaagcagaagaagccaggtgggcttccagcaggtgggcgtggagacctacggcggcggcatctggagcacctggttcgacagagacctgaccctggccggcagagtgatcgtgaagtgccccaccagcggcagactggagcagcagctggtgcacgtggagagacccatcctgagaatcccccacctggccatccacctgcagagaaacatcaacgagaacttcggccccaacaccgagatgcacctggtgcccatcctggccaccgccatccaggaggagctggagaagggcacccccgagcccggccccctgaacgccgtggacgagagacaccacagcgtgctgatgagcctgctgtgcgcccacctgggcctgagccccaaggacatcgtggagatggagctgtgcctggccgacacccagcccgtggtgctgggcggcgcctacgacgagttcatcttcgcccccagactggacaacctgcacagctgcttctgcgccctgcaggccctgatcgacagctgcgccggccccggcagcctggccaccgagccccacgtgagaatggtgaccctgtacgacaacgaggaggtgggcagcgagagcgcccagggcgcccagagcctgctgaccgagctggtgctgagaagaatcagcgccagctgccagcaccccaccgccttcgaggaggccatccccaagagcttcatgatcagcgccgacatggcccacgccgtgcaccccaactacctggacaagcacgaggagaaccacagacccctgttccacaagggccccgtgatcaaggtgaacagcaagcagagatacgccagcaacgccgtgagcgaggccctgatcagagaggtggccaacaaggtgaaggtgcccctgcaggacctgatggtgagaaacgacaccccctgcggcaccaccatcggccccatcctggccagcagactgggcctgagagtgctggacctgggcagcccccagctggccatgcacagcatcagagagatggcctgcaccaccggcgtgctgcagaccctgaccctgttcaagggcttcttcgagctgttccccagcctgagccacaacctgctggtggactag

SEQ ID NO: 18145 - DNA, 1326 bp, Artificial Sequence
  Description of Artificial Sequence: Synthetic coding sequence
atgagcggccacagccccaccagaggcgccatgcaggtggccatgaacggcaaggccagaaaggaggccgtgcagaccgccgccaaggagctgctgaagttcgtgaacagaagccccagccccttccacgccgtggccgagtgcagaaacagactgctgcaggccggcttcagcgagctgaaggagaccgagaagtggaacatcaagcccgagagcaagtacttcatgaccagaaacagcagcaccatcatcgccttcgccgtgggcggccagtacgtgcccggcaacggcttcagcctgatcggcgcccacaccgacagcccctgcctgagagtgaagagaagaagcagaagaagccaggtgggcttccagcaggtgggcgtggagacctacggcggcggcatctggagcacctggttcgacagagacctgaccctggccggcagagtgatcgtgaagtgccccaccagcggcagactggagcagcagctggtgcacgtggagagacccatcctgagaatcccccacctggccatccacctgcagagaaacatcaacgagaacttcggccccaacaccgagatgcacctggtgcccatcctggccaccgccatccaggaggagctggagaagggcacccccgagcccggccccctgaacgccgtggacgagagacaccacagcgtgctgatgagcctgctgtgcgcccacctgggcctgagccccaaggacatcgtggagatggagctgtgcctggccgacacccagcccgtggtgctgggcggcgcctacgacgagttcatcttcgcccccagactggacaacctgcacagctgcttctgcgccctgcaggccctgatcgacagctgcgccggccccggcagcctggccaccgagccccacgtgagaatggtgaccctgtacgacaacgaggaggtgggcagcgagagcgcccagggcgcccagagcctgctgaccgagctggtgctgagaagaatcagcgccagctgccagcaccccaccgccttcgaggaggccatccccaagagcttcatgatcagcgccgacatggcccacgccgtgcaccccaactacctggacaagcacgaggagaaccacagacccctgttccacaagggccccgtgatcaaggtgaacagcaagcagagatacgccagcaacgccgtgagcgaggccctgatcagagaggtggccaacaagagcagaagcccctgcagaatcagctggagcggcatgaccccccccgtggagccccccctggacctgagctggctgctgggctggggctgcggctgctggatctag

SEQ ID NO: 18146 - DNA, 1137 bp, Artificial Sequence
  Description of Artificial Sequence: Synthetic coding sequence
ctgagcctgagcctgagcctgagcctgttcctggacgtgagcctgagcctgagcgtgagcctgagcttcagcctgagccaccccggcagcacctggttcgacagagacctgaccctggccggcagagtgatcgtgaagtgccccaccagcggcagactggagcagcagctggtgcacgtggagagacccatcctgagaatcccccacctggccatccacctgcagagaaacatcaacgagaacttcggccccaacaccgagatgcacctggtgcccatcctggccaccgccatccaggaggagctggagaagggcacccccgagcccggccccctgaacgccgtggacgagagacaccacagcgtgctgatgagcctgctgtgcgcccacctgggcctgagccccaaggacatcgtggagatggagctgtgcctggccgacacccagcccgtggtgctgggcggcgcctacgacgagttcatcttcgcccccagactggacaacctgcacagctgcttctgcgccctgcaggccctgatcgacagctgcgccggccccggcagcctggccaccgagccccacgtgagaatggtgaccctgtacgacaacgaggaggtgggcagcgagagcgcccagggcgcccagagcctgctgaccgagctggtgctgagaagaatcagcgccagctgccagcaccccaccgccttcgaggaggccatccccaagagcttcatgatcagcgccgacatggcccacgccgtgcaccccaactacctggacaagcacgaggagaaccacagacccctgttccacaagggccccgtgatcaaggtgaacagcaagcagagatacgccagcaacgccgtgagcgaggccctgatcagagaggtggccaacaaggtgaaggtgcccctgcaggacctgatggtgagaaacgacaccccctgcggcaccaccatcggccccatcctggccagcagactgggcctgagagtgctggacctgggcagcccccagctggccatgcacagcatcagagagatggcctgcaccaccggcgtgctgcagaccctgaccctgttcaagggcttcttcgagctgttccccagcctgagccacaacctgctggtggactag

SEQ ID NO: 18147 - DNA, 1296 bp, Artificial Sequence
  Description of Artificial Sequence: Synthetic coding sequence
atggagggcgtgggcggcctgtggccctgggtgctgggcctgctgagcctgcccggcgtgatcctgggcgcccccctggccagcagctgcgccggcgcctgcggcaccagcttccccgacggcctgacccccgagggcacccaggccagcggcgacaaggacatccccgccatcaaccagggcctgatcctggaggagacccccgagagcagcttcctgatcgagggcgacatcatcagacccagccccttcagactgctgagcgccaccagcaacaagtggcccatgggcggcagcggcgtggtggaggtgcccttcctgctgagcagcaagtacgacgagcccagcagacaggtgatcctggaggccctggccgagttcgagagaagcacctgcatcagattcgtgacctaccaggaccagagagacttcatcagcatcatccccatgtacggctgcttcagcagcgtgggcagaagcggcggcatgcaggtggtgagcctggcccccacctgcctgcagaagggcagaggcatcgtgctgcacgagctgatgcacgtgctgggcttctggcacgagcacaccagagccgacagagacagatacatcagagtgaactggaacgagatcctgcccggcttcgagatcaacttcatcaagagccagagcagcaacatgctgaccccctacgactacagcagcgtgatgcactacggcagactggccttcagcagaagaggcctgcccaccatcacccccctgtgggcccccagcgtgcacatcggccagagatggaacctgagcgccagcgacatcaccagagtgctgaagctgtacggctgcagccccagcggccccagacccagaggcagaggcagccacgcccacagcaccggcagaagccccgcccccgccagcctgagcctgcagagactgctggaggccctgagcgccgagagcagaagccccgaccccagcggcagcagcgccggcggccagcccgtgcccgccggccccggcgagagcccccacggctgggagagccccgccctgaagaagctgagcgccgaggccagcgccagacagccccagaccctggccagcagccccagaagcagacccggcgccggcgcccccggcgtggcccaggagcagagctggctggccggcgtgagcaccaagcccaccgtgcccagcagcgaggccggcatccagcccgtgcccgtgcagggcagccccgccctgcccggcggctgcgtgcccagaaaccacttcaagggcatgagcgaggactag

SEQ ID NO: 18148 - DNA, 2040 bp, Artificial Sequence
  Description of Artificial Sequence: Synthetic coding sequence
atgggcatcagaggcctgatgagcttcgtggaggaccacagcaacgagttcttcaccgacctgaagctgagagacaccaagatcgtgatcgacggctacgccctgttccacagactgtgcttcagcagcaacctggacctgagatacggcggcgactacgacagcttcgccgacgtggtgcagaagttcttcgagagcctgttcgcctgcaacatctgcccctacgtggtgctggacggcggctgcgacatcagcgacaagaagctgaccaccctgaaggacagagccagagagaagatccagatggcccacagcctgagcgtgggcggcagcggctacgtgtgccccctgctgatcagagaggtgttcatccaggtgctgatcaagctgagagtgtgcttcgtgcagtgcttcagcgaggccgacagagacatcatgaccctggccaaccactggaactgccccgtgctgagcagcgacagcgacttctgcatcttcgacctgaagaccggcttctgccccctgaacagcttccagtggagaaacatgaacaccatcaagggcacccagaactacatccccgccaagtgcttcagcctggacgccttctgccaccacttcagcaacatgaacaaggccctgctgcccctgttcgccgtgctgtgcggcaacgaccacgtgaacctgcccatcatggagaccttcctgagcaaggccagactgcccctgggcgccaccagcagcaagggcagaagacaccacagaatcctgggcctgctgaactggctgagccacttcgccaaccccaccgaggccctggacaacgtgctgaagtacctgcccaagaaggacagagagaacgtgaaggagctgctgtgctgcagcatggaggagtaccagcagagccaggtgaagctgcaggacttcttccagtgcggcacctacgtgtgccccgacgccctgaacctgggcctgcccgagtgggtgctggtggccctggccaagggccagctgagccccttcatcagcgacgccctggtgctgagaagaaccatcctgcccacccaggtggagaacatgcagcagcccaacgcccacagaatcagccagcccatcagacagatcatctacggcctgctgctgaacgccagcccccacctggacaagaccagctggaacgccctgcccccccagcccctggccttcagcgaggtggagagaatcaacaagaacatcagaaccagcatcatcgacgccgtggagctggccaaggaccacagcgacctgagcagactgaccgagctgagcctgagaagaagacagatgctgctgctggagaccctgaaggtgaagcagaccatcctggagcccatccccaccagcctgaagctgcccatcgccgtgagctgctactggctgcagcacaccgagaccaaggccaagctgcaccacctgcagagcctgctgctgaccatgctggtgggccccctgatcgccatcatcaacagccccggcaaggaggagctgcaggaggacggcgccaagatgctgtacgccgagttccagagagtgaaggcccagaccagactgggcaccagactggacctggacaccgcccacatcttctgccagtggcagagctgcctgcagatgggcatgtacctgaaccagctgctgagcacccccctgcccgagcccgacctgaccagactgtacagcggcagcctggtgcacggcctgtgccagcagctgctggccagcaccagcgtggagagcctgctgagcatctgccccgaggccaagcagctgtacgagtacctgttcaacgccaccagaagctacgcccccgccgagatcttcctgcccaagggcagaagcaacagcaagaagaagagacagaagaagcagaacaccagctgcagcaagaacagaggcagaaccaccgcccacaccaagtgctggtacgagggcaacaacagattcggcctgctgatggtggagaacctggaggagcacagcgaggccagcaacatcgagtag

SEQ ID NO: 18149 - DNA, 1194 bp, Artificial Sequence
  Description of Artificial Sequence: Synthetic coding sequence
atgggcatcagaggcctgatgagcttcgtggaggaccacagcaacgagttcttcaccgacctgaagctgagagacaccaagatcgtgatcgacggctacgccctgttccacagactgtgcttcagcagcaacctggacctgagatacggcggcgactacgacagcttcgccgacgtggtgcagaagttcttcgagagcctgttcgcctgcaacatctgcccctacgtggtgctggacggcggctgcgacatcagcgacaagaagctgaccaccctgaaggacagagccagagagaagatccagatggcccacagcctgagcgtgggcggcagcggctacgtgtgccccctgctgatcagagaggtgttcatccaggtgctgatcaagctgagagtgtgcttcgtgcagtgcttcagcgaggccgacagagacatcatgaccctggccaaccactggaactgccccgtgctgagcagcgacagcgacttctgcatcttcgacctgaagaccggcttctgccccctgaacagcttccagtggagaaacatgaacaccatcaagggcacccagaactacatccccgccaagtgcttcagcctggacgccttctgccaccacttcagcaacatgaacaaggccctgctgcccctgttcgccgtgctgtgcggcaacgaccacgtgaacctgcccatcatggagaccttcctgagcaaggccagactgcccctgggcgccaccagcagcaagggcagaagacaccacagaatcctgggcctgctgaactggctgagccacttcgccaaccccaccgaggccctggacaacgtgctgaagtacctgcccaagaaggacagagagaacgtgaaggagctgctgtgctgcagcatggaggagtaccagcagagccaggtgaagctgcaggacttcttccagtgcggcacctacgtgtgccccgacgccctgaacctgggcctgcccgagtgggtgctggtggccctggccaagggccagctgagccccttcatcagcgacgccctggtgctgagaagaaccatcctgcccacccaggtggagaacatgcagcccctggccttcagcgaggtggagagaatcaacaagaacatcagaaccagcatcctgaccgcccacaacgccagcggcgccctggactgccacaaccagcagccctggtag

SEQ ID NO: 18150 - DNA, 147 bp, Artificial Sequence
  Description of Artificial Sequence: Synthetic coding sequence
atgggcatcagaggcctgatgagcttcgtggaggaccacagcaacgagttcttcaccgacctgaagctgagagacaccaagatcgtgatcgacggctacgccctgttccacagactgtgcttcagcagcaacctggacctgagatag

SEQ ID NO: 18151 - DNA, 153 bp, Artificial Sequence
  Description of Artificial Sequence: Synthetic coding sequence
atgggcatcagaggcctgatgagcttcgtggaggaccacagcaacgagttcttcaccgacctgaagctgagagacaccaagatcgtgatcgacggctacgccctgttccacagactgtgcttcagcagcaacctggacctgagatacggctag

SEQ ID NO: 18152 - DNA, 24 bp, Artificial Sequence
  Description of Artificial Sequence: Synthetic coding sequence
atgggcatcagaggcctgatgtag

SEQ ID NO: 18153 - DNA, 255 bp, Artificial Sequence
  Description of Artificial Sequence: Synthetic coding sequence
atggagagaaagaacgaccccctgcccatcagcaccgtgggcaccagaggcaagggccccaagagagacgagcagtacagaatcatgtggaacgagctggagaccctggtgagagcccacatcaacaacagcgagaagcaccagagagtgctggagtgcctgatggcctgcagaagcaagccccccgaggaggaggagagaaagaaggaggaggagagaggcaagaccaagagaaccagccagagaaagcagtag

SEQ ID NO: 18154 - DNA, 2121 bp, Artificial Sequence
  Description of Artificial Sequence: Synthetic coding sequence
atgaagatcttcagcgagagccacaagaccgtgttcgtggtggaccactgcccctacatggccgagagctgcagacagcacgtggagttcgacatgctggtgaagaacagaacccagggcatcatccccctggcccccatcagcaagagcctgtggacctgcagcgtggagagcagcatggagtactgcagaatcatgtacgacatcttccccttcaagaagctggtgaacttcatcgtgagcgacagcggcgcccacgtgctgaacagctggacccaggaggaccagaacctgcaggagctgatggccgccctggccgccgtgggcccccccaaccccagagccgaccccgagtgctgcagcatcctgcacggcctggtggccgccgtggagaccctgtgcaagatcaccgagtaccagcacgaggccagaaccctgctgatggagaacgccgagagagtgggcaacagaggcagaatcatctgcatcaccaacgccaagagcgacagccacgtgagaatgctggaggactgcgtgcaggagaccatccacgagcacaacaagctggccgccaacagcgaccacctgatgcagatccagaagtgcgagctggtgctgatccacacctaccccgtgggcgaggacagcctggtgagcgacagaagcaagaaggagctgagccccgtgctgaccagcgaggtgcacagcgtgagagccggcagacacctggccaccaagctgaacatcctggtgcagcagcacttcgacctggccagcaccaccatcaccaacatccccatgaaggaggagcagcacgccaacaccagcgccaactacgacgtggagctgctgcaccacaaggacgcccacgtggacttcctgaagagcggcgacagccacctgggcggcggcagcagagagggcagcttcaaggagaccatcaccctgaagtggtgcacccccagaaccaacaacatcgagctgcactactgcaccggcgcctacagaatcagccccgtggacgtgaacagcagacccagcagctgcctgaccaacttcctgctgaacggcagaagcgtgctgctggagcagcccagaaagagcggcagcaaggtgatcagccacatgctgagcagccacggcggcgagatcttcctgcacgtgctgagcagcagcagaagcatcctggaggacccccccagcatcagcgagggctgcggcggcagagtgaccgactacagaatcaccgacttcggcgagttcatgagagagaacagactgacccccttcctggaccccagatacaagatcgacggcagcctggaggtgcccctggagagagccaaggaccagctggagaagcacaccagatactggcccatgatcatcagccagaccaccatcttcaacatgcaggccgtggtgcccctggccagcgtgatcgtgaaggagagcctgaccgaggaggacgtgctgaactgccagaagaccatctacaacctggtggacatggagagaaagaacgaccccctgcccatcagcaccgtgggcaccagaggcaagggccccaagagagacgagcagtacagaatcatgtggaacgagctggagaccctggtgagagcccacatcaacaacagcgagaagcaccagagagtgctggagtgcctgatggcctgcagaagcaagccccccgaggaggaggagagaaagaagagaggcagaaagagagaggacaaggaggacaagagcgagaaggccgtgaaggactacgagcaggagaagagctggcaggacagcgagagactgaagggcatcctggagagaggcaaggaggagctggccgaggccgagatcatcaaggacagccccgacagccccgagccccccaacaagaagcccctggtggagatggacgagaccccccaggtggagaagagcaagggccccgtgagcctgctgagcctgtggagcaacagaatcaacaccgccaacagcagaaagcaccaggagttcgccggcagactgaacagcgtgaacaacagagccgagctgtaccagcacctgaaggaggagaacggcatggagaccaccgagaacggcaaggccagcagacagtag

SEQ ID NO: 18155 - DNA, 882 bp, Artificial Sequence
  Description of Artificial Sequence: Synthetic coding sequence
atggtggtgctgttctactggaacaaccacgagagccaggtgctgaagagcctggtgatctgcctggtggccatggaggagagattcctgcacgtgctgagcagcagcagaagcatcctggaggacccccccagcatcagcgagggctgcggcggcagagtgaccgactacagaatcaccgtggtgcccctggccagcgtgatcgtgaaggagagcctgaccgaggaggacgtgctgaactgccagaagaccatctacaacctggtggacatggagagaaagaacgaccccctgcccatcagcaccgtgggcaccagaggcaagggccccaagagagacgagcagtacagaatcatgtggaacgagctggagaccctggtgagagcccacatcaacaacagcgagaagcaccagagagtgctggagtgcctgatggcctgcagaagcaagccccccgaggaggaggagagaaagaagagaggcagaaagagagaggacaaggaggacaagagcgagaaggccgtgaaggactacgagcaggagaagagctggcaggacagcgagagactgaagggcatcctggagagaggcaaggaggagctggccgaggccgagatcatcaaggacagccccgacagccccgagccccccaacaagaagcccctggtggagatggacgagaccccccaggtggagaagagcaagggccccgtgagcctgctgagcctgtggagcaacagaatcaacaccgccaacagcagaaagcaccaggagttcgccggcagactgaacagcgtgaacaacagagccgagctgtaccagcacctgaaggaggagaacggcatggagaccaccgagaacggcaaggccagcagacagtag

SEQ ID NO: 18156 - DNA, 492 bp, Artificial Sequence
  Description of Artificial Sequence: Synthetic coding sequence
atgaagatcttcagcgagagccacaagaccgtgttcgtggtggaccactgcccctacatggccgagagctgcagacagcacgtggagttcgacatgctggtgaagaacagaacccagggcatcatccccctggcccccatcagcaagagcctgtggacctgcagcgtggagagcagcatggagtactgcagaatcatgtacgacatcttccccttcaagaagctggtgaacttcatcgtgagcgacagcggcgcccacgtgctgaacagctggacccaggaggaccagaacctgcaggagctgatggccgccctggccgccgtgggcccccccaaccccagagccgaccccgagtgctgcagcatcctgcacggcctggtggccgccgtggagaccctgtgcaagatcaccgagtaccagcacgaggccagaaccctgctgatggagaacgccgagagagtgggcaacagaggcagaatcatctgcatctag

SEQ ID NO: 18157 - DNA, 375 bp, Artificial Sequence
  Description of Artificial Sequence: Synthetic coding sequence
atggccgccctggccgccgtgggcccccccaaccccagagccgaccccgagtgctgcagcatcctgcacggcctggtggccgccgtggagaccctgtgcaagatcaccgagtaccagcacgaggccagaaccctgctgatggagaacgccgagagagtgggcaacagaggcagaatcatctgcatcaccaacgccaagagcgacagccacgtgagaatgctggaggactgcgtgcaggagaccatccacgagcacaacaagctggccgccaacagcgaccacctgatgcagatccagaagtgcgagctggtgctgatccacacctaccccgtgggcgaggacagcctggtgagcgacagaagcaagaaggagtag

SEQ ID NO: 18158 - DNA, 1818 bp, Artificial Sequence
  Description of Artificial Sequence: Synthetic coding sequence
atggccgccctggccgccgtgggcccccccaaccccagagccgaccccgagtgctgcagcatcctgcacggcctggtggccgccgtggagaccctgtgcaagatcaccgagtaccagcacgaggccagaaccctgctgatggagaacgccgagagagtgggcaacagaggcagaatcatctgcatcaccaacgccaagagcgacagccacgtgagaatgctggaggactgcgtgcaggagaccatccacgagcacaacaagctggccgccaacagcgaccacctgatgcagatccagaagtgcgagctggtgctgatccacacctaccccgtgggcgaggacagcctggtgagcgacagaagcaagaaggagctgagccccgtgctgaccagcgaggtgcacagcgtgagagccggcagacacctggccaccaagctgaacatcctggtgcagcagcacttcgacctggccagcaccaccatcaccaacatccccatgaaggaggagcagcacgccaacaccagcgccaactacgacgtggagctgctgcaccacaaggacgcccacgtggacttcctgaagagcggcgacagccacctgggcggcggcagcagagagggcagcttcaaggagaccatcaccctgaagtggtgcacccccagaaccaacaacatcgagctgcactactgcaccggcgcctacagaatcagccccgtggacgtgaacagcagacccagcagctgcctgaccaacttcctgctgaacggcagaagcgtgctgctggagcagcccagaaagagcggcagcaaggtgatcagccacatgctgagcagccacggcggcgagatcttcctgcacgtgctgagcagcagcagaagcatcctggaggacccccccagcatcagcgagggctgcggcggcagagtgaccgactacagaatcaccgacttcggcgagttcatgagagagaacagactgacccccttcctggaccccagatacaagatcgacggcagcctggaggtgcccctggagagagccaaggaccagctggagaagcacaccagatactggcccatgatcatcagccagaccaccatcttcaacatgcaggccgtggtgcccctggccagcgtgatcgtgaaggagagcctgaccgaggaggacgtgctgaactgccagaagaccatctacaacctggtggacatggagagaaagaacgaccccctgcccatcagcaccgtgggcaccagaggcaagggccccaagagagacgagcagtacagaatcatgtggaacgagctggagaccctggtgagagcccacatcaacaacagcgagaagcaccagagagtgctggagtgcctgatggcctgcagaagcaagccccccgaggaggaggagagaaagaagagaggcagaaagagagaggacaaggaggacaagagcgagaaggccgtgaaggactacgagcaggagaagagctggcaggacagcgagagactgaagggcatcctggagagaggcaaggaggagctggccgaggccgagatcatcaaggacagccccgacagccccgagccccccaacaagaagcccctggtggagatggacgagaccccccaggtggagaagagcaagggccccgtgagcctgctgagcctgtggagcaacagaatcaacaccgccaacagcagaaagcaccaggagttcgccggcagactgaacagcgtgaacaacagagccgagctgtaccagcacctgaaggaggagaacggcatggagaccaccgagaacggcaaggccagcagacagtag

SEQ ID NO: 18159 - DNA, 678 bp, Artificial Sequence
  Description of Artificial Sequence: Synthetic coding sequence
atgaagatcttcagcgagagccacaagaccgtgttcgtggtggaccactgcccctacatggccgagagctgcagacagcacgtggagttcgacatgctggtgaagaacagaacccagggcatcatccccctggcccccatcagcaagagcctgtggacctgcagcgtggagagcagcatggagtactgcagaatcatgtacgacatcttccccttcaagaagctggtgaacttcatcgtgagcgacagcggcgcccacgtgctgaacagctggacccaggaggaccagaacctgcaggagctgatggccgccctggccgccgtgggcccccccaaccccagagccgaccccgagtgctgcagcatcctgcacggcctggtggccgccgtggagaccctgtgcaagatcaccgagtaccagcacgaggccagaaccctgctgatggagaacgccgagagagtgggcaacagaggcagaatcatctgcatcaccaacgccaagagcgacagccacgtgagaatgctggaggactgcgtgcaggagaccatccacgagcacaacaagctggccgccaacagcgaccacctgatgcagatccagaagtgcgagctggtgctgatccacacctaccccgtgggcgaggacagcctggtgagcgacagaagcaagaaggagtag

SEQ ID NO: 18160 - DNA, 4812 bp, Artificial Sequence
  Description of Artificial Sequence: Synthetic coding sequence
atgagagtgaagccccagggcctggtggtgaccagcagcgccgtgtgcagcagccccgactacctgagagagcccaagtactaccccggcggcccccccacccccagacccctgctgcccaccagaccccccgccagcccccccgacaaggccttcagcacccacgccttcagcgagaaccccagacccccccccagaagagaccccagcaccagaagaccccccgtgctggccaagggcgacgaccccctgccccccagagccgccagacccgtgagccaggccagatgccccacccccgtgggcgacggcagcagcagcagaagatgctgggacaacggcagagtgaacctgagacccgtggtgcagctgatcgacatcatgaaggacctgaccagactgagccaggacctgcagcacagcggcgtgcacctggactgcggcggcctgagactgagcagaccccccgcccccccccccggcgacctgcagtacagcttcttcagcagccccagcctggccaacagcatcagaagccccgaggagagagccaccccccacgccaagagcgagagacccagccaccccctgtacgagcccgagcccgagcccagagacagcccccagcccggccagggccacagccccggcgccaccgccgccgccaccggcctgccccccgagcccgagcccgacagcaccgactacagcgagctggccgacgccgacatcctgagcgagctggccagcctgacctgccccgaggcccagctgctggaggcccaggccctggagccccccagccccgagcccgagccccagctgctggacccccagcccagattcctggacccccaggccctggagcccctgggcgaggccctggagctgccccccctgcagcccctggccgaccccctgggcctgcccggcctggccctgcaggccctggacaccctgcccgacagcctggagagccagctgctggacccccaggccctggaccccctgcccaagctgctggacgtgcccggcagaagactggagccccagcagcccctgggccactgccccctggccgagcccctgagactggacctgtgcagcccccacggcccccccggccccgagggccaccccaagtacgccctgagaagaaccgacagacccaagatcctgtgcagaagaagaaaggccggcagaggcagaaaggccgacgccggccccgagggcagactgctgcccctgcccatgcccaccggcctggtggccgccctggccgagccccccccccccccccccccccccccccccgccctgcccggccccggccccgtgagcgtgcccgagctgaagcccgagagcagccagacccccgtggtgagcaccagaaagggcaagtgcagaggcgtgagaagaatggtggtgaagatggccaagatccccgtgagcctgggcagaagaaacaagaccacctacaaggtgagcagcctgagcagcagcctgagcgtggagggcaaggagctgggcctgagagtgagcgccgagcccacccccctgctgaagatgaagaacaacggcagaaacgtggtggtggtgttcccccccggcgagatgcccatcatcctgaagagaaagagaggcagaccccccaagaacctgctgctgggccccggcaagcccaaggagcccgccgtggtggccgccgaggccgccaccgtggccgccgccaccatggccatgcccgaggtgaagaagagaagaagaagaaagcagaagctggccagcccccagcccagctacgccgccgacgccaacgacagcaaggccgagtacagcgacgtgctggccaagctggccttcctgaacagacagagccagtgcgccggcagatgcagcccccccagatgctggacccccagcgagcccgagagcgtgcaccaggcccccgacacccagagcatcagccacttcctgcacagagtgcagggcttcagaagaagaggcggcaaggccggcggcttcggcggcagaggcggcggccacgccgccaagagcgccagatgcagcttcagcgacttcttcgagggcatcggcaagaagaagaaggtggtggccgtggccgccgccggcgtgggcggccccggcctgaccgagctgggccaccccagaaagagaggcagaggcgaggtggacgccgtgaccggcaagcccaagagaaagagaagaagcagaaagaacggcaccctgttccccgagcaggtgcccagcggccccggcttcggcgaggccggcgccgagtgggccggcgacaagggcggcggctgggccccccaccacggccaccccggcggccaggccggcagaaactgcggcttccagggcaccgaggccagagccttcgccagcaccggcctggagagcggcgccagcggcagaggcagctactacagcaccggcgcccccagcggccagaccgagctgagccaggagagacagaacctgttcaccggctacttcagaagcctgctggacagcgacgacagcagcgacctgctggacttcgccctgagcgccagcagacccgagagcagaaaggccagcggcacctacgccggcccccccaccagcgccctgcccgcccagagaggcctggccaccttccccagcagaggcgccaaggccagccccgtggccgtgggcagcagcggcgccggcgccgaccccagcttccagcccgtgctgagcgccagacagaccttcccccccggcagagccgccagctacggcctgacccccgccgccagcgactgcagagccgccgagaccttccccaagctggtgcccccccccagcgccatggccagaagccccaccacccacccccccgccaacacctacctgccccagtacggcggctacggcgccggccagagcgtgttcgcccccaccaagcccttcaccggccaggactgcgccaacagcaaggactgcagcttcgcctacggcagcggcaacagcctgcccgccagccccagcagcgcccacagcgccggctacgcccccccccccaccggcggcccctgcctgccccccagcaaggccagcttcttcagcagcagcgagggcgcccccttcagcggcagcgcccccacccccctgagatgcgacagcagagccagcaccgtgagccccggcggctacatggtgcccaagggcaccaccgccagcgccaccagcgccgccagcgccgccagcagcagcagcagcagcttccagcccagccccgagaactgcagacagttcgccggcgccagccagtggcccttcagacagggctacggcggcctggactgggccagcgaggccttcagccagctgtacaaccccagcttcgactgccacgtgagcgagcccaacgtgatcctggacatcagcaactacaccccccagaaggtgaagcagcagaccgccgtgagcgagaccttcagcgagagcagcagcgacagcacccagttcaaccagcccgtgggcggcggcggcttcagaagagccaacagcgaggccagcagcagcgagggccagagcagcctgagcagcctggagaagctgatgatggactggaacgaggccagcagcgcccccggctacaactggaaccagagcgtgctgttccagagcagcagcaagcccggcagaggcagaagaaagaaggtggacctgttcgaggccagccacctgggcttccccaccagcgccagcgccgccgccagcggctaccccagcaagagaagcaccggccccagacagcccagaggcggcagaggcggcggcgcctgcagcgccaagaaggagagaggcggcgccgccgccaaggccaagttcatccccaagccccagcccgtgaaccccctgttccaggacagccccgacctgggcctggactactacagcggcgacagcagcatgagccccctgcccagccagagcagagccttcggcgtgggcgagagagacccctgcgacttcatcggcccctacagcatgaaccccagcacccccagcgacggcaccttcggccagggcttccactgcgacagccccagcctgggcgcccccgagctggacggcaagcacttcccccccctggcccacccccccaccgtgttcgacgccggcctgcagaaggcctacagccccacctgcagccccaccctgggcttcaaggaggagctgagacccccccccaccaagctggccgcctgcgagcccctgaagcacggcctgcagggcgccagcctgggccacgccgccgccgcccaggcccacctgagctgcagagacctgcccctgggccagccccactacgacagccccagctgcaagggcaccgcctactggtacccccccggcagcgccgccagaagccccccctacgagggcaaggtgggcaccggcctgctggccgacttcctgggcagaaccgaggccgcctgcctgagcgccccccacctggccagcccccccgccacccccaaggccgacaaggagcccctggagatggccagaccccccggcccccccagaggccccgccgccgccgccgccggctacggctgccccctgctgagcgacctgaccctgagccccgtgcccagagacagcctgctgcccctgcaggacaccgcctacagataccccggcttcatgccccaggcccaccccggcctgggcggcggccccaagagcggcttcctgggccccatggccgagccccaccccgaggacaccttcaccgtgaccagcctgtag

SEQ ID NO: 18161 - DNA, 4812 bp, Artificial Sequence; identical to SEQ ID NO: 18160
  Description of Artificial Sequence: Synthetic coding sequence

SEQ ID NO: 18162 - DNA, 450 bp, Artificial Sequence
  Description of Artificial Sequence: Synthetic coding sequence
atgagagtgaagccccagggcctggtggtgaccagcagcgccgtgtgcagcagccccgactacctgagagagcccaagtactaccccggcggcccccccacccccagacccctgctgcccaccagaccccccgccagcccccccgacaaggccttcagcacccacgccttcagcgagaaccccagacccccccccagaagagaccccagcaccagaagaccccccgtgctggccaagggcgacgaccccctgccccccagagccgccagacccgtgagccaggccagatgccccacccccgtgggcgacggcagcagcagcagaagatgctgggacaacggcagagtgaacctgagacccgtggtgcagctgatcgacatcatgaaggacctgaccagactgagccaggacctgcagcacagcggcgtgcacctggactgcggcggctag

SEQ ID NO: 18163 - DNA, 1239 bp, Artificial Sequence
  Description of Artificial Sequence: Synthetic coding sequence
atggaggccctgcagaagcagcaggccgccagactggcccagggcgtgggccccctggcccccgcctgccccctgctgcccccccagccccccctgcccgaccacagaaccctgcaggcccccgagggcgccctgggcaacgtgggcgccgaggaggaggaggacgccgaggaggacgaggagaagagagaggaggccggcgccgaggaggaggccgccgaggagagcagacccggcgcccagggccccagcagccccagcagccagccccccggcctgcacccccacgagtggacctacgaggagcagttcaagcagctgtacgagctggacgccgaccccaagagaaaggagttcctggacgacctgttcagcttcatgcagaagagaggcacccccgtgaacagagtgcccatcatggccaagcaggtgctggacctgtacgccctgttcagactggtgaccgccaagggcggcctggtggaggtgatcaacagaaaggtgtggagagaggtgaccagaggcctgagcctgcccaccaccatcaccagcgccgccttcaccctgagaacccagtacatgaagtacctgtacccctacgagtgcgagaccagagccctgagcagccccggcgagctgcaggccgccatcgacagcaacagaagagagggcagaagacaggcctacaccgccacccccctgttcggcctggccggccccccccccagaggcgcccaggaccccgccctgggccccggccccgccccccccgccacccagagcagccccggccccgcccagggcagcaccagcggcctgcccgcccacgcctgcgcccagctgagccccagccccatcaagaaggaggagagcggcatccccaacccctgcctggccctgcccgtgggcctggccctgggccccaccagagagaagctggcccccgaggagccccccgagaagagagccgtgctgatgggccccatggacccccccagaccctgcatgccccccagcttcctgcccagaggcaaggtgcccctgagagaggagagactggacggccccctgaacctggccggcagcggcatcagcagcatcaacatggccctggagatcaacggcgtggtgtacaccggcgtgctgttcgccagaagacagcccgtgcccgccagccagggccccaccaaccccgcccccccccccagcaccggcccccccagcagcatcctgccctag

SEQ ID NO: 18164 - DNA, 441 bp, Artificial Sequence
  Description of Artificial Sequence: Synthetic coding sequence
atgaccagcgagagaagcagaatcccctgcctgagcgccgccgccgccgagggcaccggcaagaagcagcaggagggcagagccatggccaccctggacagaaaggtgcccagccccgaggccttcctgggcaagccctggagcagctggatcgacgccgccaagctgcactgcagcgacaacgtggacctggaggaggccggcaaggagggcggcaagagcagagaggtgatgagactgaacaaggaggacatgcacctgttcggccactaccccgcccacgacgacttctacctggtggtgtgcagcgcctgcaaccaggtggtgaagccccaggtgttccagagccactgcggcagaaagcaggacaacagaagaaacgagggcatcagcagaagcggccccgagagcagccaggccatcgagaagcaccaggtgtag

SEQ ID NO: 18165 - DNA, 1602 bp, Artificial Sequence
  Description of Artificial Sequence: Synthetic coding sequence
atggacggcgccgacgagagcgagaagctggactgccagttcagcacccaccaccccagacccctggccttctgcagcttcggcagcagactgatgggcagaggctactacgtgttcgacagaagatgggacagattcagattcgccctgaacagcatggtggagaagcacctgaacagccagatgtggaagcacagaaaccccagccacagagccagcggccccagccccctgttcagaacctgcctgaccaacctgctgagcctgagcaacatcggcgccgcctgggtgagcaccctggagagcgtggcccccagataccccctgaacctggccgcccagacccccggccccggcggccccgagcccggcggcatggccgccgacggcggcgtggaggacatcagaaagaagagaaacggccaggacagcttcttcttcaacaagcacctgaccctgcaccaggagccccccacccagtacagcctgagcgccagaaagatcccccccgccgccgacagccccctgcccagccccgccgcccacatcaccacccccgtgcccgccagcgtgctgcagcccttcagcaaccccagcgccgtgtacctgcccagcgcccccatcagcagcagactgaccagcagctacatcatgaccagcgccatgctgagcaacgccgccttcgtgaccagccccgaccccagcgccctgatgagccacaccaccgccttcccccacgtggccgccaccctgagcatcatggacagcaccttcaaggcccccagcgccgtgagccccatccccgccgtgatccccagccccagccacaagcccagcaagaccaagaccagcaagagcagcaaggtgaaggacctgagcaccagaagcgacgagagccccagcaacaagaagagaaagccccagagcagcaccagcagcagcagcagcagcagcagcagcagcctgcagaccagcctgagcagccccctgagcggcccccacaagaagaactgcgtgctgaacgccagcagcgccctgaacagctaccaggccgcccccccctacaacagcctgagcgtgcacaacagcaacaacggcgtgagccccctgagcgccaagctggagcccagcggcagaaccagcctgcccggcggccccgccgacatcgtgagacaggtgggcgccgtgggcggcagcagcgacagctgccccctgagcgtgcccagcctggccctgcacgccggcgacctgagcctggccagccacaacgccgtgagcagcctgcccctgagcttcgacaagagcgagggcaagaagagaaagaacagcagcagcagcagcaaggcctgcaagatcaccaagatgcccggcatgaacagcgtgcacaagaagaacccccccagcctgctggcccccgtgcccgaccccgtgaacagcaccagcagcagacaggtgagagacctgctggccccccccagccccgccctgggcggcagaggcagctgggccgcccccctgctgagcagagccgcccccaccggcaacaccagcctgatccccgtgctggtgttccccgagggcagcttccaccccctgctgtag

SEQ ID NO: 18166 - DNA, 2586 bp, Artificial Sequence
  Description of Artificial Sequence: Synthetic coding sequence
atgaccagcgagagaagcagaatcccctgcctgagcgccgccgccgccgagggcaccggcaagaagcagcaggagggcagagccatggccaccctggacagaaaggtgcccagccccgaggccttcctgggcaagccctggagcagctggatcgacgccgccaagctgcactgcagcgacaacgtggacctggaggaggccggcaaggagggcggcaagagcagagaggtgatgagactgaacaaggaggacatgcacctgttcggccactaccccgcccacgacgacttctacctggtggtgtgcagcgcctgcaaccaggtggtgaagccccaggtgttccagagccactgcgagagaagacacggcagcatgtgcagacccagccccagccccgtgagccccgccagcaaccccagaaccagcctggtgcaggtgaagaccaaggcctgcctgagcggccaccacagcgccagcagcaccagcaagcccttcaagacccccaaggacaacctgctgaccagcagcagcaagcagcacaccgtgttccccgccaagggcagcagagacaagccctgcgtgcccgtgcccgtggtgagcctggagaagatccccaacctggtgaaggccgacggcgccaacgtgaagatgaacagcaccaccaccaccgccgtgagcgccagcagcaccagcagcagcgccgtgagcaccccccccctgatcaagcccgtgctgatgagcaagagcgtgccccccagccccgagaagatcctgaacggcaagggcatcctgcccaccaccatcgacaagaagcaccagaacggcaccaagaacagcaacaagccctacagaagactgagcgagagagagttcgaccccaacaagcactgcggcgtgctggaccccgagaccaagaagccctgcaccagaagcctgacctgcaagacccacagcctgagccacagaagagccgtgcccggcagaaagaagcagttcgacctgctgctggccgagcacaaggccaagagcagagagaaggaggtgaaggacaaggagcacctgctgaccagcaccagagagatcctgcccagccagagcggccccgcccaggacagcctgctgggcagcagcggcagcagcggccccgagcccaaggtggccagccccgccaagagcagaccccccaacagcgtgctgcccagacccagcagcgccaacagcatcagcagcagcaccagcagcaaccacagcggccacacccccgagccccccctgccccccgtgggcggcgacctggccagcagactgagcagcgacgagggcgagatggacggcgccgacgagagcgagaagctggactgccagttcagcacccaccaccccagacccctggccttctgcagcttcggcagcagactgatgggcagaggctactacgtgttcgacagaagatgggacagattcagattcgccctgaacagcatggtggagaagcacctgaacagccagatgtggaagaagatcccccccgccgccgacagccccctgcccagccccgccgcccacatcaccacccccgtgcccgccagcgtgctgcagcccttcagcaaccccagcgccgtgtacctgcccagcgcccccatcagcagcagactgaccagcagctacatcatgaccagcgccatgctgagcaacgccgccttcgtgaccagccccgaccccagcgccctgatgagccacaccaccgccttcccccacgtggccgccaccctgagcatcatggacagcaccttcaaggcccccagcgccgtgagccccatccccgccgtgatccccagccccagccacaagcccagcaagaccaagaccagcaagagcagcaaggtgaaggacctgagcaccagaagcgacgagagccccagcaacaagaagagaaagccccagagcagcaccagcagcagcagcagcagcagcagcagcagcctgcagaccagcctgagcagccccctgagcggcccccacaagaagaactgcgtgctgaacgccagcagcgccctgaacagctaccaggccgcccccccctacaacagcctgagcgtgcacaacagcaacaacggcgtgagccccctgagcgccaagctggagcccagcggcagaaccagcctgcccggcggccccgccgacatcgtgagacaggtgggcgccgtgggcggcagcagcgacagctgccccctgagcgtgcccagcctggccctgcacgccggcgacctgagcctggccagccacaacgccgtgagcagcctgcccctgagcttcgacaagagcgagggcaagaagagaaagaacagcagcagcagcagcaaggcctgcaagatcaccaagatgcccggcatgaacagcgtgcacaagaagaacccccccagcctgctggcccccgtgcccgaccccgtgaacagcaccagcagcagacaggtgggcaagaacagcagcctggccctgagccagagcagccccagcagcatcagcagccccggccacagcagacagaacaccaacagaaccggcagaatcagaaccctgccctag

SEQ ID NO: 18167 - DNA, 2217 bp, Artificial Sequence
  Description of Artificial Sequence: Synthetic coding sequence
atgtgcagacccagccccagccccgtgagccccgccagcaaccccagaaccagcctggtgcaggtgaagaccaaggcctgcctgagcggccaccacagcgccagcagcaccagcaagcccttcaagacccccaaggacaacctgctgaccagcagcagcaagcagcacaccgtgttccccgccaagggcagcagagacaagccctgcgtgcccgtgcccgtggtgagcctggagaagatccccaacctggtgaaggccgacggcgccaacgtgaagatgaacagcaccaccaccaccgccgtgagcgccagcagcaccagcagcagcgccgtgagcaccccccccctgatcaagcccgtgctgatgagcaagagcgtgccccccagccccgagaagatcctgaacggcaagggcatcctgcccaccaccatcgacaagaagcaccagaacggcaccaagaacagcaacaagccctacagaagactgagcgagagagagttcgaccccaacaagcactgcggcgtgctggaccccgagaccaagaagccctgcaccagaagcctgacctgcaagacccacagcctgagccacagaagagccgtgcccggcagaaagaagcagttcgacctgctgctggccgagcacaaggccaagagcagagagaaggaggtgaaggacaaggagcacctgctgaccagcaccagagagatcctgcccagccagagcggccccgcccaggacagcctgctgggcagcagcggcagcagcggccccgagcccaaggtggccagccccgccaagagcagaccccccaacagcgtgctgcccagacccagcagcgccaacagcatcagcagcagcaccagcagcaaccacagcggccacacccccgagccccccctgccccccgtgggcggcgacctggccagcagactgagcagcgacgagggcgagatggacggcgccgacgagagcgagaagctggactgccagttcagcacccaccaccccagacccctggccttctgcagcttcggcagcagactgatgggcagaggctactacgtgttcgacagaagatgggacagattcagattcgccctgaacagcatggtggagaagcacctgaacagccagatgtggaagaagatcccccccgccgccgacagccccctgcccagccccgccgcccacatcaccacccccgtgcccgccagcgtgctgcagcccttcagcaaccccagcgccgtgtacctgcccagcgcccccatcagcagcagactgaccagcagctacatcatgaccagcgccatgctgagcaacgccgccttcgtgaccagccccgaccccagcgccctgatgagccacaccaccgccttcccccacgtggccgccaccctgagcatcatggacagcaccttcaaggcccccagcgccgtgagccccatccccgccgtgatccccagccccagccacaagcccagcaagaccaagaccagcaagagcagcaaggtgaaggacctgagcaccagaagcgacgagagccccagcaacaagaagagaaagccccagagcagcaccagcagcagcagcagcagcagcagcagcagcctgcagaccagcctgagcagccccctgagcggcccccacaagaagaactgcgtgctgaacgccagcagcgccctgaacagctaccaggccgcccccccctacaacagcctgagcgtgcacaacagcaacaacggcgtgagccccctgagcgccaagctggagcccagcggcagaaccagcctgcccggcggccccgccgacatcgtgagacaggtgggcgccgtgggcggcagcagcgacagctgccccctgagcgtgcccagcctggccctgcacgccggcgacctgagcctggccagccacaacgccgtgagcagcctgcccctgagcttcgacaagagcgagggcaagaagagaaagaacagcagcagcagcagcaaggcctgcaagatcaccaagatgcccggcatgaacagcgtgcacaagaagaacccccccagcctgctggcccccgtgcccgaccccgtgaacagcaccagcagcagacaggtgggcaagaacagcagcctggccctgagccagagcagccccagcagcatcagcagccccggccacagcagacagaagaacaccaacagaaccggcagaatcagaaccctgccctag

SEQ ID NO: 18168 - DNA, 1050 bp, Artificial Sequence
  Description of Artificial Sequence: Synthetic coding sequence
atgcccagaggcggcacccaggccagcagcgaggagagcgaggaggagggcaccagcgacgacctgcaccccccccccgactgccactacgccaccagaccccccagaccccaggccttctgcaccttcggcagcagactggtgagccccggctgctacgtgttcagcagaagactggacagattctgcagcgccctgagcagcatgctggagagacacctgagcacccacatgtggaagaagatcccccccgccgccgagccccccgcccacctggtgaacagccccctgagcgcccccctgagccccagcagcaccggcacctgccccagactgcccggccccaccctgagacccgcctgccccgccagcatgccccccaccaaggacaacctggtgcccagctaccccgccggcagccccagcgtggccgccgcctgcagccaggccgagtgcatgggcggcagccaggccatcaccagccccctgcccgccaacacccccagccccagcttcagcaagctgccccccagcaaggccagcaagagcagcaagggcaaggacggcgtggaggtggaggcccccagcagaaagagaaagctgagccccggccccaccaccctgaagagaacctgcatcctggagcccaccggcaagggcaagcccagcggctgcagaggcctgagcgccaagaccaagaccgccctgagcatgggcctgaacggcaccatgggccccagagtgaagagagccggccccctggactgcagaggcagcccccaccagctgcccacccccgtgaaggccagccagctggagaacagaggcgccgccggccaccccgccaaggccctgcccaccaactgcctgagcgaggaggaggtggccaagaagagaaagaacctggccacctactgcagacccgtgaaggccaagcactgccaggccggcgcccccgccgacgtggcctgcagcgtgagaagaaagaagcccggccccgccctggccttcgaggagaagtgcagcaccctgaagagcaaggcccactag

SEQ ID NO: 18169 - DNA, 2169 bp, Artificial Sequence
  Description of Artificial Sequence: Synthetic coding sequence
atggccgtgagagagagagccgccgccgccatggccgccctggagagaagagtgcccagcctggacgacttcgccggccagagctggagcagctgggtggagagagccgacctgcccgccgccgacggcgccgagctggaggagagcagcaagaacaccaagaagctggacgccatgaccctgatcaaggaggacatgagcatcttcggccactgccccgcccacgacgacttctacctggtggtgtgcaaccactgcagccaggtggtgaagccccaggccttccagaagcactgcgagagaagacacggccccctgagcaagctgtacggcagagcccccccccccccccccgcccccgccagcagccagaagtgccacgtggtgaacggccagggccccgcctgcagagcccccggcagcaccaagaccagcagcagagagaagggccagggcagcagaagcagaggccaccagccccccgagaagacccagaaggacaacctgtgccagcccggcggcctgaccaaggacagccccggcaagccccccatggccccccccagcaaggagccccccggcagagagaacatcgagatcatccccagcgagggcagcagccactgggccgagggcagcccccccgagaaggagcccagcggcaccagactgccccccaagacccacagaaagatggccagaaaggagtgcgacctgaacagacagtgcggcgtgatcaaccccgagaccaagaagatctgcaccagactgctgacctgcaagatccacagcgtgcaccagagaagagaggtgcagggcagagccaaggacttcgacgtgctggtggccgagctgaaggccaacagcagaaagggcgagagccccaaggagaagagccccggcagaaaggagcaggtgctggagagacccagccaggagctgcccagcagcgtgcaggtggtggccgccgtggccgcccccagcagcaccttcagcgtgagagccaagcagacctacccctactgcgccctgcccagaagcagagccagcagcgagagcgagctggacgacgagggcccctgcggcggcgacggcgaccccggcctgttccccttccccatgcccagaggcggcacccaggccagcagcgaggagagcgaggaggagggcaccagcgacgacctgcaccccccccccgactgccactacgccaccagaccccccagaccccaggccttctgcaccttcggcagcagactggtgagccccggctgctacgtgttcagcagaagactggacagattctgcagcgccctgagcagcatgctggagagacacctgagcacccacatgtggaagaagatcccccccgccgccgagccccccgcccacctggtgaacagccccctgagcgcccccctgagccccagcagcaccggcacctgccccagactgcccggccccaccctgagacccgcctgccccgccagcatgccccccaccaaggacaacctggtgcccagctaccccgccggcagccccagcgtggccgccgcctgcagccaggccgagtgcatgggcggcagccaggccatcaccagccccctgcccgccaacacccccagccccagcttcagcaagctgccccccagcaaggccagcaagagcagcaagggcaaggacggcgtggaggtggaggcccccagcagaaagagaaagctgagccccggccccaccaccctgaagagaacctgcatcctggagcccaccggcaagggcaagcccagcggctgcagaggcctgagcgccaagaccaagaccgccctgagcatgggcctgaacggcaccatgggccccagagtgaagagagccggccccctggactgcagaggcagcccccaccagctgcccacccccgtgaaggccagccagctggagaacagaggcgccgccggccaccccgccaaggccctgcccaccaactgcctgagcgaggaggaggtggccaagaagagaaagaacctggccacctactgcagacccgtgaaggccaagcactgccaggccggcgcccccgccgacgtggcctgcagcgtgagaagaaagaagcccggccccgccctggccttcgaggagaagtgcagcaccctgaagagcaaggcccactag

SEQ ID NO: 18170 - DNA, 1743 bp, Artificial Sequence
  Description of Artificial Sequence: Synthetic coding sequence
atggccgtgagagagagagccgccgccgccatggccgccctggagagaagagtgcccagcctggacgacttcgccggccagagctggagcagctgggtggagagagccgacctgcccgccgccgacggcgccgagctggaggagagcagcaagaacaccaagaagctggacgccatgaccctgatcaaggaggacatgagcatcttcggccactgccccgcccacgacgacttctacctggtggtgtgcaaccactgcagccaggtggtgaagccccaggccttccagaagcactgcgagagaagacacggccccctgagcaagctgtacggcagagcccccccccccccccccgcccccgccagcagccagaagtgccacgtggtgaacggccagggccccgcctgcagagcccccggcagcaccaagaccagcagcagagagaagggccagggcagcagaagcagaggccaccagccccccgagaagacccagaaggacaacctgtgccagcccggcggcctgaccaaggacagccccggcaagccccccatggccccccccagcaaggagccccccggcagagagaacatcgagatcatccccagcgagggcagcagccactgggccgagggcagcccccccgagaaggagcccagcggcaccagactgccccccaagacccacagaaagatggccagaaaggagtgcgacctgaacagacagtgcggcgtgatcaaccccgagaccaagaagatctgcaccagactgctgacctgcaagatccacagcgtgcaccagagaagagaggtgcagggcagagccaaggacttcgacgtgctggtggccgagctgaaggccaacagcagaaagggcgagagccccaaggagaagagccccggcagaaaggagcaggtgctggagagacccagccaggagctgcccagcagcgtgcaggtggtggccgccgtggccgcccccagcagcaccttcagcgtgagagccaagcagacctacccctactgcgccctgcccagaagcagagccagcagcgagagcgagctggacgacgagggcccctgcggcggcgacggcgaccccggcctgttccccttccccatgcccagaggcggcacccaggccagcagcgaggagagcgaggaggagggcaccagcgacgacctgcaccccccccccgactgccactacgccaccagaccccccagaccccaggccttctgcaccttcggcagcagactggtgagccccggctgctacgtgttcagcagaagactggacagattctgcagcgccctgagcagcatgctggagagacacctgagcacccacatgtggaagaagatcccccccgccgccgagccccccgcccacctggtgaacagccccctgagcgcccccctgagccccagcagcaccggcacctgccccagactgcccggccccaccctgagacccgcctgccccgccagcatgccccccaccaaggacaacctggtgcccagctaccccgccggcagccccagcgtggccgccgcctgcagccaggccgagtgcatgggcgagcccggctaccacctgaccaccgcctgccagcacgccatccccgtgctgcagcaggccgccgccttccagggccagcaggtgatccagagacagggcagaggcggcggcggcggccccttcagcaaggccgaggtgatcccctggccctaccacagctag

SEQ ID NO: 18171 - DNA, 294 bp, Artificial Sequence
  Description of Artificial Sequence: Synthetic coding sequence
atggaggagatcagcctggccaacctggacaccaacaagctggaggccatcgcccaggagatctacgtggacctgatcgaggacagctgcctgggcttctgcttcgaggtgcacagagccgtgaagtgcggctacttctacctggagttcgccgagaccggcagcgtgaaggacttcggcatccagcccgtggaggacaagggcgcctgcagactgcccctgtgcagcctgcccggcgagcccggcaacggccccgaccagcagctgcagagaagcccccccgagttccagtag

SEQ ID NO: 18172 - DNA, 1860 bp, Artificial Sequence
  Description of Artificial Sequence: Synthetic coding sequence
atgctgctggccagcgccgtggtggtgtgggagtggctgaacgagcacggcagatggagaccctacagccccgccgtgagccaccacatcgaggccgtggtgagagccggccccagagccggcggcagcgtggtgctgggccaggtggacagcagactggccccctacatcatcgacctgcagagcatgaaccagttcagacaggacaccggcaccctgagacccgtgagaagaaactactacgaccccagcagcgcccccggcaagggcgtggtgtgggagtgggagaacgacaacggcagctggaccccctacgacatggaggtgggcatcaccatccagcacgcctacgagaagcagcacccctggatcgacctgaccagcatcggcttcagctacgtgatcgacttcaacaccatgggccagatcaacagacagacccagagacagagaagagtgagaagaagactggacctgatctaccccatggtgaccggcaccctgcccaaggcccagagctggcccgtgagccccggccccgccaccagcccccccatgagcccctgcagctgcccccagtgcgtgctggtgatgagcgtgaaggccgccgtggtgaacggcagcaccggccccctgcagctgcccgtgaccagaaagaacatgcccccccccggcgtggtgaagctgccccccctgcccggcagcggcgccaagcccctggacagcaccggcaccatcagaggccccctgaagaccgcccccagccaggtgatcagaagacaggccagcagcatgcccaccggcaccaccatgggcagccccgccagcccccccggccccaacagcaagaccggcagagtggccctggccaccctgaacagaaccaacctgcagagactggccatcgcccagagcagagtgctgatcgccagcggcgtgcccaccgtgcccgtgaagaacctgaacggcagcagccccgtgaaccccgccctggccggcatcaccggcatcctgatgagcgccgccggcctgcccgtgtgcctgaccagaccccccaagctggtgctgcaccccccccccgtgagcaagagcgagatcaagagcatccccggcgtgagcaacaccagcagaaagaccaccaagaagcaggccaagaagggcaagacccccgaggaggtgctgaagaagtacctgcagaaggtgagacacccccccgacgaggactgcaccatctgcatggagagactgaccgcccccagcggctacaagggcccccagcccaccgtgaagcccgacctggtgggcaagctgagcagatgcggccacgtgtaccacatctactgcctggtggccatgtacaacaacggcaacaaggacggcagcctgcagtgccccacctgcaagaccatctacggcgtgaagaccggcacccagccccccggcaagatggagtaccacctgatcccccacagcctgcccggccaccccgactgcaagaccatcagaatcatctacagcatcccccccggcatccagggccccgagcaccccaaccccggcaagagcttcagcgccagaggcttccccagacactgctacctgcccgacagcgagaagggcagaaaggtgctgaagctgctgctggtggcctgggacagaagactgatcttcgccatcggcaccagcagcaccaccggcgagagcgacaccgtgatctggaacgaggtgcaccacaagaccgagttcggcagcaacctgaccggccacggctaccccgacgccaactacctggacaacgtgctggccgagctggccgcccagggcatcagcgaggacagcaccgcccaggagaaggactag

SEQ ID NO: 18173 - DNA, 996 bp, Artificial Sequence
  Description of Artificial Sequence: Synthetic coding sequence
atggccgtggccatggtgaagctgtgcgagagagccggcctgcccctgctggccgcccccctgctgagaagcctgctgcccagagccccccagcccggccccgcccagcccagaagcgtgcagggccagagatgccccgccagacacccccccggcaacctggtgtgcgagagaggcgccggcgtgaacggcgtgaccgccggcgccggcggcagactgagaggcctgcacagaggcggcagagccctgggctgcagcgcccacagacccctgcacagcgccagagtgagaccccccgcccacctggccgccccccccggcagcagcgccagaggctgcagactgaccgagctgggctacgccctgaacgagtggctgcaggacatcagaaagaaccagctgcccggcctgctgggcggcgtgggccccatgcacagcgtggtgcagctgttccagggcttcagagacctgctgtggctgcccatcgagcagtacagaaaggacggcagactgatgagaggcctgcagagaggcgccgccagcttcggcagcagcaccgccagcgccgccctggagctgagcaacagactggtgcaggccatccaggccaccgccgagaccgtgtacgacatcctgagccccgccgcccccgtgagcagaagcctgcaggacaagagaagcgccagaagactgagaagaggccagcagcccgccgacctgagagagggcgtggccaaggcctacgacaccgtgagagagggcatcctggacaccgcccagaccatctgcgacgtggccagcagaggccacgagcagaagggcctgaccggcgccgtgggcggcgtgatcagacagctgccccccaccgtggtgaagcccctgatcctggccaccgaggccaccagcagcctgctgggcggcatgagaaaccagatcgtgcccgacgcccacaaggaccacgccctgaagtggagaagcgacagcgcccaggactag

SEQ ID NO: 18174 - DNA, 5817 bp, Artificial Sequence
  Description of Artificial Sequence: Synthetic coding sequence
atgagcagatggctgtggccctggagcaactgcgtgaaggagagagtgtgcagatacctgctgcaccactacctgggccacttcttccaggagcacctgagcctggaccagctgagcctggacctgtacaagggcagcgtggccctgagagacatccacctggagatctggagcgtgaacgaggtgctggagagcatggagagccccctggagctggtggagggcttcgtgggcagcatcgaggtggccgtgccctgggccgccctgctgaccgaccactgcaccgtgagagtgagcggcctgcagctgaccctgcagcccagaagaggccccgcccccggcgccgccgacagccagagctgggccagctgcatgaccaccagcctgcagctggcccaggagtgcctgagagacggcctgcccgagcccagcgagcccccccagcccctggagggcctggagatgttcgcccagaccatcgagaccgtgctgagaagaatcaaggtgaccttcctggacaccgtggtgagagtggagcacagccccggcgacggcgagagaggcgtggccgtggaggtgagagtgcagagactggagtactgcgacgaggccgtgagagaccccagccaggccccccccgtggacgtgcaccagccccccgccttcctgcacaagctgctgcagctggccggcgtgagactgcactacgaggagctgcccgcccaggaggagccccccgagccccccctgcagatcggcagctgcagcggctacatggagctgatggtgaagctgaagcagaacgaggccttccccggccccaagctggaggtggccggccagctgggcagcctgcacctgctgctgacccccagacagctgcagcagctgcaggagctgctgagcgccgtgagcctgaccgaccacgagggcctggccgacaagctgaacaagagcagacccctgggcgccgaggacctgtggctgatcgagcaggacctgaaccagcagctgcaggccggcgccgtggccgagcccctgagccccgaccccctgaccaaccccctgctgaacctggacaacaccgacctgttcttcagcatggccggcctgaccagcagcgtggccagcgccctgagcgagctgagcctgagcgacgtggacctggccagcagcgtgagaagcgacatggccagcagaagactgagcgcccaggcccaccccgccggcaagatggcccccaaccccctgctggacaccatgagacccgacagcctgctgaagatgaccctgggcggcgtgaccctgaccctgctgcagaccagcgcccccagcagcggcccccccgacctggccacccacttcttcaccgagttcgacgccaccaaggacggccccttcggcagcagagacttccaccacctgagacccagattccagagagcctgcccctgcagccacgtgagactgaccggcaccgccgtgcagctgagctgggagctgagaaccggcagcagaggcagaagaaccaccagcatggaggtgcacttcggccagctggaggtgctggagtgcctgtggcccagaggcaccagcgagcccgagtacaccgagatcctgaccttccccggcaccctgggcagccaggccagcgccagaccctgcgcccacctgagacacacccagatcctgagaagagtgcccaagagcagacccagaagaagcgtggcctgccactgccacagcgagctggccctggacctggccaacttccaggccgacgtggagctgggcgccctggacagactggccgccctgctgagactggccaccgtgcccgccgagccccccgccggcctgctgaccgagcccctgcccgccatggagcagcagaccgtgttcagactgagcgcccccagagccaccctgagactgagattccccatcgccgacctgagacccgagcccgacccctgggccggccaggccgtgagagccgagcagctgagactggagctgagcgagccccagttcagaagcgagctgagcagcggccccggcccccccgtgcccacccacctggagctgacctgcagcgacctgcacggcatctacgaggacggcggcaagccccccgtgccctgcctgagagtgagcaaggccctggaccccaagagcaccggcagaaagtacttcctgccccaggtggtggtgaccgtgaacccccagagcagcagcacccagtgggaggtggcccccgagaagggcgaggagctggagctgagcgtggagagcccctgcgagctgagagagcccgagcccagccccttcagcagcaagagaaccatgtacgagaccgaggagatggtgatccccggcgaccccgaggagatgagaaccttccagagcagaaccctggccctgagcagatgcagcctggaggtgatcctgcccagcgtgcacatcttcctgcccagcaaggaggtgtacgagagcatctacaacagaatcaacaacgacctgctgatgtgggagcccgccgacctgctgcccacccccgaccccgccgcccagcccagcggcttccccggccccagcggcttctggcacgacagcttcaagatgtgcaagagcgccttcaagctggccaactgcttcgacctgacccccgacagcgacagcgacgacgaggacgcccacttcttcagcgtgggcgccagcggcggcccccaggccgccgcccccgaggcccccagcctgcacctgcagagcaccttcagcaccctggtgaccgtgctgaagggcagaatcaccgccctgtgcgagaccaaggacgagggcggcaagagactggaggccgtgcacggcgagctggtgctggacatggagcacggcaccctgttcagcgtgagccagtactgcggccagcccggcctgggctacttctgcctggaggccgagaaggccaccctgtaccacagagccgccgtggacgactaccccctgcccagccacctggacctgcccagcttcgccccccccgcccagctggcccccaccatctaccccagcgaggagggcgtgaccgagagaggcgccagcggcagaaagggccagggcagaggcccccacatgctgagcaccgccgtgagaatccacctggacccccacaagaacgtgaaggagttcctggtgaccctgagactgcacaaggccaccctgagacactacatggccctgcccgagcagagctggcacagccagctgctggagttcctggacgtgctggacgaccccgtgctgggctacctgccccccaccgtgatcaccatcctgcacacccacctgttcagctgcagcgtggactacagacccctgtacctgcccgtgagagtgctgatcaccgccgagaccttcaccctgagcagcaacatcatcatggacaccagcaccttcctgctgagattcatcctggacgacagcgccctgtacctgagcgacaagtgcgaggtggagaccctggacctgagaagagactacgtgtgcgtgctggacgtggacctgctggagctggtgatcaagacctggaagggcagcaccgagggcaagctgagccagcccctgttcgagctgagatgcagcaacaacgtggtgcacgtgcacagctgcgccgacagctgcgccctgctggtgaacctgctgcagtacgtgatgagcaccggcgacctgcaccccccccccagaccccccagccccaccgagatcgccggccagaagctgagcgagagccccgccagcctgcccagctgcccccccgtggagaccgccctgatcaaccagagagacctggccgacgccctgctggacaccgagagaagcctgagagagctggcccagcccagcggcggccacctgccccaggccagccccatcagcgtgtacctgttccccggcgagagaagcggcgcccccccccccagcccccccgtgggcggccccgccggcagcctgggcagctgcagcgaggagaaggaggacgagagagaggaggagggcgacggcgacaccctggacagcgacgagttctgcatcctggacgcccccggcctgggcatcccccccagagacggcgagcccgtggtgacccagctgcaccccggccccatcgtggtgagagacggctacttcagcagacccatcggcagcaccgacctgctgagagcccccgcccacttccccgtgcccagcaccagagtggtgctgagagaggtgagcctggtgtggcacctgtacggcggcagagacttcggcccccaccccggccacagagccagaaccggcctgagcggccccagaagcagccccagcagatgcagcggccccaacagaccccagaacagctggagaacccagggcggcagcggcagacagcaccacgtgctgatggagatccagctgagcaaggtgagcttccagcacgaggtgtaccccgccgagcccgccaccggccccgccgcccccagccaggagctggaggagagacccctgagcagacaggtgttcatcgtgcaggagctggaggtgagagacagactggccagcagccagatcaacaagttcctgtacctgcacaccagcgagagaatgcccagaagagcccacagcaacatgctgaccatcaaggccctgcacgtggcccccaccaccaacctgggcggccccgagtgctgcctgagagtgagcctgatgcccctgagactgaacgtggaccaggacgccctgttcttcctgaaggacttcttcaccagcctggtggccggcatcaaccccgtggtgcccggcgagaccagcgccgaggccagacccgagaccagagcccagcccagcagccccctggagggccaggccgagggcgtggagaccaccggcagccaggaggcccccggcggcggccacagccccagcccccccgaccagcagcccatctacttcagagagttcagattcaccagcgaggtgcccatctggctggactaccacggcaagcacgtgaccatggaccaggtgggcaccttcgccggcctgctgatcggcctggcccagctgaactgcagcgagctgaagctgaagagactgtgctgcagacacggcctgctgggcgtggacaaggtgctgggctacgccctgaacgagtggctgcaggacatcagaaagaaccagctgcccggcctgctgggcggcgtgggccccatgcacagcgtggtgcagctgttccagggcttcagagacctgctgtggctgcccatcgagcagtacagaaaggacggcagactgatgagaggcctgcagagaggcgccgccagcttcggcagcagcaccgccagcgccgccctggagctgagcaacagactggtgcaggccatccaggccaccgccgagaccgtgtacgacatcctgagccccgccgcccccgtgagcagaagcctgcaggacaagagaagcgccagaagactgagaagaggccagcagcccgccgacctgagagagggcgtggccaaggcctacgacaccgtgagagagggcatcctggacaccgcccagaccatctgcgacgtggccagcagaggccacgagcagaagggcctgaccggcgccgtgggcggcgtgatcagacagctgccccccaccgtggtgaagcccctgatcctggccaccgaggccaccagcagcctgctgggcggcatgagaaaccagatcgtgcccgacgcccacaaggaccacgccctgaagtggagaagcgacagcgcccaggactag

SEQ ID NO: 18175 - DNA, 5823 bp, Artificial Sequence
  Description of Artificial Sequence: Synthetic coding sequence
atgagcagatggctgtggccctggagcaactgcgtgaaggagagagtgtgcagatacctgctgcaccactacctgggccacttcttccaggagcacctgagcctggaccagctgagcctggacctgtacaagggcagcgtggccctgagagacatccacctggagatctggagcgtgaacgaggtgctggagagcatggagagccccctggagctggtggagggcttcgtgggcagcatcgaggtggccgtgccctgggccgccctgctgaccgaccactgcaccgtgagagtgagcggcctgcagctgaccctgcagcccagaagaggccccgcccccggcgccgccgacagccagagctgggccagctgcatgaccaccagcctgcagctggcccaggagtgcctgagagacggcctgcccgagcccagcgagcccccccagcccctggagggcctggagatgttcgcccagaccatcgagaccgtgctgagaagaatcaaggtgaccttcctggacaccgtggtgagagtggagcacagccccggcgacggcgagagaggcgtggccgtggaggtgagagtgcagagactggagtactgcgacgaggccgtgagagaccccagccaggccccccccgtggacgtgcaccagccccccgccttcctgcacaagctgctgcagctggccggcgtgagactgcactacgaggagctgcccgcccaggaggagccccccgagccccccctgcagatcggcagctgcagcggctacatggagctgatggtgaagctgaagcagaacgaggccttccccggccccaagctggaggtggccggccagctgggcagcctgcacctgctgctgacccccagacagctgcagcagctgcaggagctgctgagcgccgtgagcctgaccgaccacgagggcctggccgacaagctgaacaagagcagacccctgggcgccgaggacctgtggctgatcgagcaggacctgaaccagcagctgcaggccggcgccgtggccgagcccctgagccccgaccccctgaccaaccccctgctgaacctggacaacaccgacctgttcttcagcatggccggcctgaccagcagcgtggccagcgccctgagcgagctgagcctgagcgacgtggacctggccagcagcgtgagaagcgacatggccagcagaagactgagcgcccaggcccaccccgccggcaagatggcccccaaccccctgctggacaccatgagacccgacagcctgctgaagatgaccctgggcggcgtgaccctgaccctgctgcagaccagcgcccccagcagcggcccccccgacctggccacccacttcttcaccgagttcgacgccaccaaggacggccccttcggcagcagagacttccaccacctgagacccagattccagagagcctgcccctgcagccacgtgagactgaccggcaccgccgtgcagctgagctgggagctgagaaccggcagcagaggcagaagaaccaccagcatggaggtgcacttcggccagctggaggtgctggagtgcctgtggcccagaggcaccagcgagcccgagtacaccgagatcctgaccttccccggcaccctgggcagccaggccagcgccagaccctgcgcccacctgagacacacccagatcctgagaagagtgcccaagagcagacccagaagaagcgtggcctgccactgccacagcgagctggccctggacctggccaacttccaggccgacgtggagctgggcgccctggacagactggccgccctgctgagactggccaccgtgcccgccgagccccccgccggcctgctgaccgagcccctgcccgccatggagcagcagaccgtgttcagactgagcgcccccagagccaccctgagactgagattccccatcgccgacctgagacccgagcccgacccctgggccggccaggccgtgagagccgagcagctgagactggagctgagcgagccccagttcagaagcgagctgagcagcggccccggcccccccgtgcccacccacctggagctgacctgcagcgacctgcacggcatctacgaggacggcggcaagccccccgtgccctgcctgagagtgagcaaggccctggaccccaagagcaccggcagaaagtacttcctgccccaggtggtggtgaccgtgaacccccagagcagcagcacccagtgggaggtggcccccgagaagggcgaggagctggagctgagcgtggagagcccctgcgagctgagagagcccgagcccagccccttcagcagcaagagaaccatgtacgagaccgaggagatggtgatccccggcgaccccgaggagatgagaaccttccagagcagaaccctggccctgagcagatgcagcctggaggtgatcctgcccagcgtgcacatcttcctgcccagcaaggaggtgtacgagagcatctacaacagaatcaacaacgacctgctgatgtgggagcccgccgacctgctgcccacccccgaccccgccgcccagcccagcggcttccccggccccagcggcttctggcacgacagcttcaagatgtgcaagagcgccttcaagctggccaactgcttcgacctgacccccgacagcgacagcgacgacgaggacgcccacttcttcagcgtgggcgccagcggcggcccccaggccgccgcccccgaggcccccagcctgcacctgcagagcaccttcagcaccctggtgaccgtgctgaagggcagaatcaccgccctgtgcgagaccaaggacgagggcggcaagagactggaggccgtgcacggcgagctggtgctggacatggagcacggcaccctgttcagcgtgagccagtactgcggccagcccggcctgggctacttctgcctggaggccgagaaggccaccctgtaccacagagccgccgtggacgactaccccctgcccagccacctggacctgcccagcttcgccccccccgcccagctggcccccaccatctaccccagcgaggagggcgtgaccgagagaggcgccagcggcagaaagggccagggcagaggcccccacatgctgagcaccgccgtgagaatccacctggacccccacaagaacgtgaaggagttcctggtgaccctgagactgcacaaggccaccctgagacactacatggccctgcccgagcagagctggcacagccagctgctggagttcctggacgtgctggacgaccccgtgctgggctacctgccccccaccgtgatcaccatcctgcacacccacctgttcagctgcagcgtggactacagacccctgtacctgcccgtgagagtgctgatcaccgccgagaccttcaccctgagcagcaacatcatcatggacaccagcaccttcctgctgagattcatcctggacgacagcgccctgtacctgagcgacaagtgcgaggtggagaccctggacctgagaagagactacgtgtgcgtgctggacgtggacctgctggagctggtgatcaagacctggaagggcagcaccgagggcaagctgagccagcccctgttcgagctgagatgcagcaacaacgtggtgcacgtgcacagctgcgccgacagctgcgccctgctggtgaacctgctgcagtacgtgatgagcaccggcgacctgcaccccccccccagaccccccagccccaccgagatcgccggccagaaggtgcagctgagcgagagccccgccagcctgcccagctgcccccccgtggagaccgccctgatcaaccagagagacctggccgacgccctgctggacaccgagagaagcctgagagagctggcccagcccagcggcggccacctgccccaggccagccccatcagcgtgtacctgttccccggcgagagaagcggcgcccccccccccagcccccccgtgggcggccccgccggcagcctgggcagctgcagcgaggagaaggaggacgagagagaggaggagggcgacggcgacaccctggacagcgacgagttctgcatcctggacgcccccggcctgggcatcccccccagagacggcgagcccgtggtgacccagctgcaccccggccccatcgtggtgagagacggctacttcagcagacccatcggcagcaccgacctgctgagagcccccgcccacttccccgtgcccagcaccagagtggtgctgagagaggtgagcctggtgtggcacctgtacggcggcagagacttcggcccccaccccggccacagagccagaaccggcctgagcggccccagaagcagccccagcagatgcagcggccccaacagaccccagaacagctggagaacccagggcggcagcggcagacagcaccacgtgctgatggagatccagctgagcaaggtgagcttccagcacgaggtgtaccccgccgagcccgccaccggccccgccgcccccagccaggagctggaggagagacccctgagcagacaggtgttcatcgtgcaggagctggaggtgagagacagactggccagcagccagatcaacaagttcctgtacctgcacaccagcgagagaatgcccagaagagcccacagcaacatgctgaccatcaaggccctgcacgtggcccccaccaccaacctgggcggccccgagtgctgcctgagagtgagcctgatgcccctgagactgaacgtggaccaggacgccctgttcttcctgaaggacttcttcaccagcctggtggccggcatcaaccccgtggtgcccggcgagaccagcgccgaggccagacccgagaccagagcccagcccagcagccccctggagggccaggccgagggcgtggagaccaccggcagccaggaggcccccggcggcggccacagccccagcccccccgaccagcagcccatctacttcagagagttcagattcaccagcgaggtgcccatctggctggactaccacggcaagcacgtgaccatggaccaggtgggcaccttcgccggcctgctgatcggcctggcccagctgaactgcagcgagctgaagctgaagagactgtgctgcagacacggcctgctgggcgtggacaaggtgctgggctacgccctgaacgagtggctgcaggacatcagaaagaaccagctgcccggcctgctgggcggcgtgggccccatgcacagcgtggtgcagctgttccagggcttcagagacctgctgtggctgcccatcgagcagtacagaaaggacggcagactgatgagaggcctgcagagaggcgccgccagcttcggcagcagcaccgccagcgccgccctggagctgagcaacagactggtgcaggccatccaggccaccgccgagaccgtgtacgacatcctgagccccgccgcccccgtgagcagaagcctgcaggacaagagaagcgccagaagactgagaagaggccagcagcccgccgacctgagagagggcgtggccaaggcctacgacaccgtgagagagggcatcctggacaccgcccagaccatctgcgacgtggccagcagaggccacgagcagaagggcctgaccggcgccgtgggcggcgtgatcagacagctgccccccaccgtggtgaagcccctgatcctggccaccgaggccaccagcagcctgctgggcggcatgagaaaccagatcgtgcccgacgcccacaaggaccacgccctgaagtggagaagcgacagcgcccaggactag

SEQ ID NO: 18176 - DNA, 6237 bp, Artificial Sequence
  Description of Artificial Sequence: Synthetic coding sequence
atgccctggcccttcagcgagagcatcaagaagagagcctgcagatacctgctgcagagatacctgggccacttcctgcaggagaagctgagcctggagcagctgagcctggacctgtaccagggcaccggcagcctggcccaggtgcccctggacaagtggtgcctgaacgagatcctggagagcgccgacgcccccctggaggtgaccgagggcttcatccagagcatcagcctgagcgtgccctggggcagcctgctgcaggacaactgcgccctggaggtgagaggcctggagatggtgttcagacccagacccagacccgccaccggcagcgagcccatgtactggagcagcttcatgaccagcagcatgcagctggccaaggagtgcctgagccagaagctgaccgacgagcagggcgagggcagccagcccttcgagggcctggagaagttcgccgagaccatcgagaccgtgctgagaagagtgaaggtgaccttcatcgacaccgtgctgagaatcgagcacgtgcccgagaacagcaagaccggcaccgccctggagatcagaatcgagagaaccgtgtactgcgacgagaccgccgacgagagcagcggcatcaacgtgcaccagcccaccgccttcgcccacaagctgctgcagctgagcggcgtgagcctgttctgggacgagttcagcgccagcgccaagagcagccccgtgtgcagcaccgcccccgtggagaccgagcccaagctgagccccagctggaaccccaagatcatctacgagccccacccccagctgaccagaaacctgcccgagatcgcccccagcgaccccgtgcagatcggcagactgatcggcagactggagctgagcctgaccctgaagcagaacgaggtgctgcccggcgccaagctggacgtggacggccagatcgacagcatccacctgctgctgagccccagacaggtgcacctgctgctggacatgctggccgccatcgccggccccgagaacagcagcaagatcggcctggccaacaaggacagaaagaacagacccatgcagcaggaggacgagtacagaatccagatggagctgaacagatactacctgagaaaggacagcctgagcgtgggcgtgagcagcgagcagagcttctacgagaccgagaccgccagaacccccagcagcagagaggaggaggtgttcttcagcatggccgacatggacatgagccacagcctgagcagcctgccccccctgggcgacccccccaacatggacctggagctgagcctgaccagcacctacaccaacacccccgccggcagccccctgagcgccaccgtgctgcagcccacctggggcgagttcctggaccaccacaaggagcagcccgtgagaggcagcaccttccccagcaacctggtgcaccccacccccctgcagaagaccagcctgcccagcagaagcgtgagcgtggacgagagcagacccgagctgatcttcagactggccgtgggcaccttcagcatcagcgtgctgcacatcgaccccctgagcccccccgagaccagccagaacctgaaccccctgacccccatggccgtggccttcttcacctgcatcgagaagatcgaccccgccagattcagcaccgaggacttcaagagcttcagagccgtgttcgccgaggcctgcagccacgaccacctgagattcatcggcaccggcatcaaggtgagctacgagcagagacagagaagcgccagcagatacttcagcaccgacatgagcatcggccagatggagttcctggagtgcctgttccccaccgacttccacagcgtgcccccccactacaccgagctgctgaccttccacagcaaggaggagaccggcagccacagccccgtgtgcctgcagctgcactacaagcacagcgagaacagaggcccccagggcaaccaggccagactgagcagcgtgccccacaaggccgagctgcagatcaagctgaaccccgtgtgctgcgagctggacatcagcatcgtggacagactgaacagcctgctgcagccccagaagctggccaccgtggagatgatggccagccacatgtacaccagctacaacaagcacatcagcctgcacaaggccttcaccgaggtgttcctggacgacagccacagccccgccaactgcagaatcagcgtgcaggtggccacccccgccctgaacctgagcgtgagattccccatccccgacctgagaagcgaccaggagagaggcccctggttcaagaagagcctgcagaaggagatcctgtacctggccttcaccgacctggagttcaagaccgagttcatcggcggcagcacccccgagcagatcaagctggagctgaccttcagagagctgatcggcagcttccaggaggagaagggcgaccccagcatcaagttcttccacgtgagcagcggcgtggacggcgacaccaccagcagcgacgacttcgactggcccagaatcgtgctgaagatcaacccccccgccatgcacagcatcctggagagaatcgccgccgaggaggaggaggagaacgacggccactaccaggaggaggaggagggcggcgcccacagcctgaaggacgtgtgcgacctgagaagacccgcccccagccccttcagcagcagaagagtgatgttcgagaacgagcagatggtgatgcccggcgaccccgtggagatgaccgagttccaggacaaggccatcagcaacagccactacgtgctggagctgaccctgcccaacatctacgtgaccctgcccaacaagagcttctacgagaagctgtacaacagaatcttcaacgacctgctgctgtgggagcccaccgcccccagccccgtggagaccttcgagaacatcagctacggcatcggcctgagcgtggccagccagctgatcaacaccttcaacaaggacagcttcagcgccttcaagagcgccgtgcactacgacgaggagagcggcagcgaggaggagaccctgcagtacttcagcaccgtggaccccaactacagaagcagaagaaagaagaagctggacagccagaacaagaacagccagagcttcctgagcgtgctgctgaacatcaaccacggcctgatcgccgtgttcaccgacgtgaagcaggacaacggcgacctgctggagaacaagcacggcgagttctggctggagttcaacagcggcagcctgttctgcgtgaccaagtacgagggcttcgacgacaagcactacatctgcctgcacagcagcagcttcagcctgtaccacaagggcatcgtgaacggcgtgatcctgcccaccgagaccagactgcccagcagcaccagaccccactggctggagcccaccatctacagcagcgaggaggacggcctgagcaagaccagcagcgacggcgtgggcggcgacagcctgaacatgctgagcgtggccgtgaagatcctgagcgacaagagcgagagcaacaccaaggagttcctgatcgccgtgggcctgaagggcgccaccctgcagcacagaatgctgcccagcggcctgagctggcacgagcagatcctgtacttcctgaacatcgccgacgagcccgtgctgggctacaacccccccaccagcttcaccaccttccacgtgcacctgtggagctgcgccctggactacagacccctgtacctgcccatcagaagcctgctgaccgtggagaccttcagcgtgagcagcagcgtggccctggacaagagcagcagcaccctgagaatcatcctggacgaggccgccctgcacctgagcgacaagtgcaacaccgtgaccatcaacctgagcagagactacgtgagagtgatggacatgggcctgctggagctgaccatcaccgccgtgaagagcgacagcgacggcgagcagaccgagcccagattcgagctgcactgcagcagcgacgtggtgcacatcagaacctgcagcgacagctgcgccgccctgatgaacctgatccagtacatcgccagctacggcgacctgcagacccccaacaaggccgacatgaagcccggcgccttccagagaagaagcaaggtggacagcagcggcagaagcagcagcagaggccccgtgctgcccgaggccgaccagcagatgctgagagacctgatgagcgacgccatggaggagatcgacatgcagcagggcaccagcagcgtgaagccccaggccaacggcgtgctggacgagaagagccagatccaggagccctgctgcagcgacctgttcctgttccccgacgagagcggcaacgtgagccaggagagcggccccacctacgccagcttcagccaccacttcatcagcgacgccatgaccggcgtgcccaccgagaacgacgacttctgcatcctgttcgcccccaaggccgccatgcaggagaaggaggaggagcccgtgatcaagatcatggtggacgacgccatcgtgatcagagacaactacttcagcctgcccgtgaacaagaccgacaccagcaaggcccccctgcacttccccatccccgtgatcagatacgtggtgaaggaggtgagcctggtgtggcacctgtacggcggcaaggacttcggcatcgtgccccccaccagccccgccaagagctacatcagcccccacagcagccccagccacacccccaccagacacggcagaaacaccgtgtgcggcggcaagggcagaaaccacgacttcctgatggagatccagctgagcaaggtgaagttccagcacgaggtgtaccccccctgcaagcccgactgcgacagcagcctgagcgagcaccccgtgagcagacaggtgttcatcgtgcaggacctggagatcagagacagactggccaccagccagatgaacaagttcctgtacctgtactgcagcaaggagatgcccagaaaggcccacagcaacatgctgaccgtgaaggccctgcacgtgtgccccgagagcggcagaagcccccaggagtgctgcctgagagtgagcctgatgcccctgagactgaacatcgaccaggacgccctgttcttcctgaaggacttcttcaccagcctgagcgccgaggtggagctgcagatgacccccgaccccgaggtgaagaagagccccggcgccgacgtgacctgcagcctgcccagacacctgagcaccagcaaggagcccaacctggtgatcagcttcagcggccccaagcagcccagccagaacgacagcgccaacagcgtggaggtggtgaacggcatggaggagaagaacttcagcgccgaggaggccagcttcagagaccagcccgtgttcttcagagagttcagattcaccagcgaggtgcccatcagactggactaccacggcaagcacgtgagcatggaccagggcaccctggccggcatcctgatcggcctggcccagctgaactgcagcgagctgaagctgaagagactgagctacagacacggcctgctgggcgtggacaagctgttcagctacgccatcaccgagtggctgaacgacatcaagaagaaccagctgcccggcatcctgggcggcgtgggccccatgcacagcctggtgcagctggtgcagggcctgaaggacctggtgtggctgcccatcgagcagtacagaaaggacggcagaatcgtgagaggcttccagagaggcgccgccagcttcggcaccagcaccgccatggccgccctggagctgaccaacagaatggtgcagaccatccaggccgccgccgagaccgcctacgacatggtgagccccggcaccctgagcatcgagcccaagaagaccaagagattcccccaccacagactggcccaccagcccgtggacctgagagagggcgtggccaaggcctacagcgtggtgaaggagggcatcaccgacaccgcccagaccatctacgagaccgccgccagagagcacgagagcagaggcgtgaccggcgccgtgggcgaggtgctgagacagatcccccccgccgtggtgaagcccctgatcgtggccaccgaggccaccagcaacgtgctgggcggcatgagaaaccagatcagacccgacgtgagacaggacgagagccagaagtggagacacggcgacgactag

SEQ ID NO: 18177 - DNA, 2214 bp, Artificial Sequence
  Description of Artificial Sequence: Synthetic coding sequence
atggaggacgccggcgaggaccccaccaccttcgccgcccacagcctgcccagcgaccccagactgctggccaccgtgaccaacgcctacctgggcaccagagtgttccacgacaccctgcacgtgagcggcgtgtacaacggcgccggcggcgacacccacagagccatgctgcccagccccctgaacgtgagactggaggcccccgccggcatgggcgagcagctgaccgagaccttcgccctggacaccaacaccggcagcttcctgcacaccctggagggccccagattcagagccagccagtgcatctacgcccacagaaccctgccccacgtgctggccttcagagtgagcatcgccagactggcccccggcagcggccccatcaccctgctgctgagaagcgccttcagccccgagagccccgacctggacctgcaccagggccccgacttccagggcgccagatacctgtacggccacaccctgacccccgagcagcccggcggcccccagcaggaggtgcacatgctgtggacccccgccccccccgacctgaccctgggcgagggcgaggaggccagaacctgggacttcctgaccgccgtgggcggcagccaggccgaggcccaggcctgcctgaccgaggccctgcagctgcaggccagaggcgccctgtacaccgcccacgcccaggcctgggcccagctgtgggtggagtgcggcctggacgtggtgggccccctgcagctgagacaggccctgagaggcagcctgtactacctgctgagcgccctgccccagcccaaggcccccggctacatctgccacggcctgagccccggcggcctgagcaacggcagcagagaggagtgctactggggccacgtgttctgggaccaggacctgtggatgttccccagcatcctgatgttccaccccgaggccgccagagccatcctggagtacagaatcagaaccctggacggcgccctggagaacgcccagaacctgggctaccagggcgccaagttcgcctgggagagcgccgacagcggcctggaggtgtgccccgaggacatctacggcgtgcaggaggtgcacgtgaacggcgccgtggtgctggccttcgagctgtactaccacaccacccaggacctgcagctgttcagagaggccggcggctgggacgtggtgagagccgtggccgagttctggtgcagcagagtggagtggagccccagagaggagaagtaccacctgagaggcgtgatgagccccgacgagtaccacagcggcgtgaacaacagcgtgtacaccaacgtgctggtgcagaacagcctgagattcgccgccgccctggcccaggacctgggcctgcccatccccagccagtggctggccgtggccgacaagatcaaggtgcccttcgacgtggagcagaacttccaccccgagttcgacggctacgagcccggcgaggtggtgaagcaggccgacgtggtgctgctgggctaccccgtgcccttcagcctgagccccgacgtgagaagaaagaacctggagatctacgaggccgtgaccagcccccagggccccgccatgacctggagcatgttcgccgtgggctggatggagctgaaggacgccgtgagagccagaggcctgctggacagaagcttcgccaacatggccgagcccttcaaggtgtggaccgagaacgccgacggcagcggcgccgtgaacttcctgaccggcatgggcggcttcctgcaggccgtggtgttcggctgcaccggcttcagagtgaccagagccggcgtgaccttcgaccccgtgtgcctgagcggcatcagcagagtgagcgtgagcggcatcttctaccagggcaacaagctgaacttcagcttcagcgaggacagcgtgaccgtggaggtgaccgccagagccggcccctgggccccccacctggaggccgagctgtggcccagccagagcagactgagcctgctgcccggccacaaggtgagcttccccagaagcgccggcagaatccagatgagcccccccaagctgcccggcagcagcagcagcgagttccccggcagaaccttcagcgacgtgagagaccccctgcagagccccctgtgggtgaccctgggcagcagcagccccaccgagagcctgaccgtggaccccgccagcgagtag

SEQ ID NO: 18178 - DNA, 804 bp, Artificial Sequence
  Description of Artificial Sequence: Synthetic coding sequence
atgagagtggccgccctgatcagcggcggcaaggacagctgctacaacatgatgcagtgcatcgccgccggccaccagatcgtggccctggccaacctgagacccgccgagaaccaggtgggcagcgacgagctggacagctacatgtaccagaccgtgggccaccacgccatcgacctgtacgccgaggccatggccctgcccctgtacagaagaaccatcagaggcagaagcctggacaccagacaggtgtacaccaagtgcgagggcgacgaggtggaggacctgtacgagctgctgaagctggtgaaggagaaggaggaggtggagggcatcagcgtgggcgccatcctgagcgactaccagagaatcagagtggagaacgtgtgcaagagactgaacctgcagcccctggcctacctgtggcagagaaaccaggaggacctgctgagagagatgatcagcagcaacatccaggccatgatcatcaaggtggccgccctgggcctggaccccgacaagcacctgggcaagaccctggaccagatggagccctacctgatcgagctgagcaagaagtacggcgtgcacgtgtgcggcgagggcggcgagtacgagaccttcaccctggactgccccctgttcaagaagaagatcatcgtggacagcagcgaggtggtgatccacagcgccgacgccttcgcccccgtggcctacctgagattcctggagctgcacctggaggacaaggtgagcagcgtgcccgacaactacagaaccagcaactacatctacaacttctag

SEQ ID NO: 18179 - DNA, 498 bp, Artificial Sequence
  Description of Artificial Sequence: Synthetic coding sequence
atgagagtggccgccctgatcagcggcggcaaggacagctgctacaacatgatgcagtgcatcgccgccggccaccagatcgtggccctggccaacctgagacccgccgagaaccaggtgggcagcgacgagctggacagctacatgtaccagaccgtgggccaccacgccatcgacctgtacgccgaggccatggccctgcccctgtacagaagaaccatcagaggcagaagcctggacaccagacaggtgtacaccaagtgcgagggcgacgaggtggaggacctgtacgagctgctgaagctggtgaagggcatcaccagaatgaccctgctggccgagtacgacgccctgaacctgcaggacttccacatgcacctgaaggtgggcagccaggccatcgtgtacagaacccccaacgagctgtgcacccacagcaagttcgacaagcacaccttcccccccttcatcagcgagatcgccaagtgcgaggtgtag

SEQ ID NO: 18180 - DNA, 3306 bp, Artificial Sequence
  Description of Artificial Sequence: Synthetic coding sequence
atgagcgccaaggccatcagcgagcagaccggcaaggagctgctgtacaagttcatctgcaccaccagcgccatccagaacagattcaagtacgccagagtgacccccgacaccgactgggccagactgctgcaggaccacccctggctgctgagccagaacctggtggtgaagcccgaccagctgatcaagagaagaggcaagctgggcctggtgggcgtgaacctgaccctggacggcgtgaagagctggctgaagcccagactgggccaggaggccaccgtgggcaaggccaccggcttcctgaagaacttcctgatcgagcccttcgtgccccacagccaggccgaggagttctacgtgtgcatctacgccaccagagagggcgactacgtgctgttccaccacgagggcggcgtggacgtgggcgacgtggacgccaaggcccagaagctgctggtgggcgtggacgagaagctgaaccccgaggacatcaagaagcacctgctggtgcacgcccccgaggacaagaaggagatcctggccagcttcatcagcggcctgttcaacttctacgaggacctgtacttcacctacctggagatcaaccccctggtggtgaccaaggacggcgtgtacgtgctggacctggccgccaaggtggacgccaccgccgactacatctgcaaggtgaagtggggcgacatcgagttccccccccccttcggcagagaggcctaccccgaggaggcctacatcgccgacctggacgccaagagcggcgccagcctgaagctgaccctgctgaaccccaagggcagaatctggaccatggtggccggcggcggcgccagcgtggtgtacagcgacaccatctgcgacctgggcggcgtgaacgagctggccaactacggcgagtacagcggcgcccccagcgagcagcagacctacgactacgccaagaccatcctgagcctgatgaccagagagaagcaccccgacggcaagatcctgatcatcggcggcagcatcgccaacttcaccaacgtggccgccaccttcaagggcatcgtgagagccatcagagactaccagggccccctgaaggagcacgaggtgaccatcttcgtgagaagaggcggccccaactaccaggagggcctgagagtgatgggcgaggtgggcaagaccaccggcatccccatccacgtgttcggcaccgagacccacatgaccgccatcgtgggcatggccctgggccacagacccatccccaaccagccccccaccgccgcccacaccgccaacttcctgctgaacgccagcggcagcaccagcacccccgcccccagcagaaccgccagcttcagcgagagcagagccgacgaggtggcccccgccaagaaggccaagcccgccatgccccaggacagcgtgcccagccccagaagcctgcagggcaagagcaccaccctgttcagcagacacaccaaggccatcgtgtggggcatgcagaccagagccgtgcagggcatgctggacttcgactacgtgtgcagcagagacgagcccagcgtggccgccatggtgtaccccttcaccggcgaccacaagcagaagttctactggggccacaaggagatcctgatccccgtgttcaagaacatggccgacgccatgagaaagcaccccgaggtggacgtgctgatcaacttcgccagcctgagaagcgcctacgacagcaccatggagaccatgaactacgcccagatcagaaccatcgccatcatcgccgagggcatccccgaggccctgaccagaaagctgatcaagaaggccgaccagaagggcgtgaccatcatcggccccgccaccgtgggcggcatcaagcccggctgcttcaagatcggcaacaccggcggcatgctggacaacatcctggccagcaagctgtacagacccggcagcgtggcctacgtgagcagaagcggcggcatgagcaacgagctgaacaacatcatcagcagaaccaccgacggcgtgtacgagggcgtggccatcggcggcgacagataccccggcagcaccttcatggaccacgtgctgagataccaggacacccccggcgtgaagatgatcgtggtgctgggcgagatcggcggcaccgaggagtacaagatctgcagaggcatcaaggagggcagactgaccaagcccatcgtgtgctggtgcatcggcacctgcgccaccatgttcagcagcgaggtgcagttcggccacgccggcgcctgcgccaaccaggccagcgagaccgccgtggccaagaaccaggccctgaaggaggccggcgtgttcgtgcccagaagcttcgacgagctgggcgagatcatccagagcgtgtacgaggacctggtggccaacggcgtgatcgtgcccgcccaggaggtgcccccccccaccgtgcccatggactacagctgggccagagagctgggcctgatcagaaagcccgccagcttcatgaccagcatctgcgacgagagaggccaggagctgatctacgccggcatgcccatcaccgaggtgttcaaggaggagatgggcatcggcggcgtgctgggcctgctgtggttccagaagagactgcccaagtacagctgccagttcatcgagatgtgcctgatggtgaccgccgaccacggccccgccgtgagcggcgcccacaacaccatcatctgcgccagagccggcaaggacctggtgagcagcctgaccagcggcctgctgaccatcggcgacagattcggcggcgccctggacgccgccgccaagatgttcagcaaggccttcgacagcggcatcatccccatggagttcgtgaacaagatgaagaaggagggcaagctgatcatgggcatcggccacagagtgaagagcatcaacaaccccgacatgagagtgcagatcctgaaggactacgtgagacagcacttccccgccacccccctgctggactacgccctggaggtggagaagatcaccaccagcaagaagcccaacctgatcctgaacgtggacggcctgatcggcgtggccttcgtggacatgctgagaaactgcggcagcttcaccagagaggaggccgacgagtacatcgacatcggcgccctgaacggcatcttcgtgctgggcagaagcatgggcttcatcggccactacctggaccagaagagactgaagcagggcctgtacagacacccctgggacgacatcagctacgtgctgcccgagcacatgagcatgtag

SEQ ID NO: 18181 - DNA, 288 bp, Artificial Sequence
  Description of Artificial Sequence: Synthetic coding sequence
atggcccacttcaaggacgacctgcagaccaacgtggagatcatccccggcgagagcgcccccagaaaggagagccccagaccccccgccccccccagcagcgccgccggcgtgggcggctgcagcaaccacagccccagcgtgcaggagagccccctgagcccccccgccctggcccagctgggcagcgcccagcagcccagcatgagaaccgagctgagcttcagcgagaagaaggacaccatgatcatctggcagatcaccatcaccgtgtggtgccagagatag

SEQ ID NO: 18182 - DNA, 288 bp, Artificial Sequence; identical to SEQ ID NO: 18181
  Description of Artificial Sequence: Synthetic coding sequence

SEQ ID NO: 18183 - DNA, 1173 bp, Artificial Sequence
  Description of Artificial Sequence: Synthetic coding sequence
atgccccccagcggcctgagactgctgcccctgctgctgcccctgctgtggctgctggtgctgacccccggcagacccgccgccggcctgagcacctgcaagaccatcgacatggagctggtgaagagaaagagaatcgaggccatcagaggccagatcctgagcaagctgagactggccagcccccccagccagggcgaggtgccccccggccccctgcccgaggccgtgctggccctgtacaacagcaccagagacagagtggccggcgagagcgccgagcccgagcccgagcccgaggccgactactacgccaaggaggtgaccagagtgctgatggtggagacccacaacgagatctacgacaagttcaagcagagcacccacagcatctacatgttcttcaacaccagcgagctgagagaggccgtgcccgagcccgtgctgctgagcagagccgagctgagactgctgagactgaagctgaaggtggagcagcacgtggagctgtaccagaagtacagcaacaacagctggagatacctgagcaacagactgctggcccccagcgacagccccgagtggctgagcttcgacgtgaccggcgtggtgagacagtggctgagcagaggcggcgagatcgagggcttcagactgagcgcccactgcagctgcgacagcagagacaacaccctgcaggtggacatcaacggcttcaccaccggcagaagaggcgacctggccaccatccacggcatgaacagacccttcctgctgctgatggccacccccctggagagagcccagcacctgcagagcagcagacacagaagagccctggacaccaactactgcttcagcagcaccgagaagaactgctgcgtgagacagctgtacatcgacttcagaaaggacctgggctggaagtggatccacgagcccaagggctaccacgccaacttctgcctgggcccctgcccctacatctggagcctggacacccagtacagcaaggtgctggccctgtacaaccagcacaaccccggcgccagcgccgccccctgctgcgtgccccaggccctggagcccctgcccatcgtgtactacgtgggcagaaagcccaaggtggagcagctgagcaacatgatcgtgagaagctgcaagtgcagctag

SEQ ID NO: 18184 - DNA, 576 bp, Artificial Sequence
  Description of Artificial Sequence: Synthetic coding sequence
atgtgggacctggtgctggaggacagaagaatgaacagcctgagactggtggcccccatgtggaacggcagaatcagaggcatccacagactgggcgccgccgtggcccccgagggcaaccagaagaagaagagaaccatcctgcagttcctgaccaactacttctacgacgtggaggccctgagagactacctgctgcagagagagatgtacaaggtgcacgagaagaacagaagctacacctggctggagaagcagcacggcccctacggcgccggcgccttcttcatcctgaagcagggcggcgccgtgaagttcagagacaaggagtggatcagacccgacaagtacggccacttcagccaggagttctggaacttctgcgaggtgcccgtggaggccgtggacgccggcgactgcgacatcaactacgagggcctggacaacctgagaaccagcgccggctggaccagcagaaccagcctgccctgccccaccctggccagcctgagatactggtggagaagatgctgccccatcgccagactgtgggagagcaccggcctgagagcctag

SEQ ID NO: 18185 - DNA, 792 bp, Artificial Sequence
  Description of Artificial Sequence: Synthetic coding sequence
atgtgggacctggtgctggaggacagaagaatgaacagcctgagactggtggcccccatgtggaacggcagaatcagaggcatccacagactgggcgccgccgtggcccccgagggcaaccagaagaagaagagaaccatcctgcagttcctgaccaactacttctacgacgtggaggccctgagagactacctgctgcagagagagatgtacaaggtgcacgagaagaacagaagctacacctggctggagaagcagcacggcccctacggcgccggcgccttcttcatcctgaagcagggcggcgccgtgaagttcagagacaaggagtggatcagacccgacaagtacggccacttcagccaggagttctggaacttctgcgaggtgcccgtggaggccgtggacgccggcgactgcgacatcaactacgagggcctggacaacctgctgagactgaaggagctgcagagcctgagcctgcagagatgctgccacgtggacgactggtgcctgagcagactgtaccccctggccgacagcctgcaggagctgagcctggccggctgccccagaatcagcgagagaggcctggcctgcctgcaccacctgcagaacctgagaagactggacatcagcgacctgcccgccgtgagcaaccccggcctgacccagatcctggtggaggagatgctgcccaactgcgaggtggtgggcgtggactgggccgagggcctgaagagcggccccgaggagcagcccagagacaccgccagccccgtgcccgcctag

SEQ ID NO: 18186 - DNA, 693 bp, Artificial Sequence
  Description of Artificial Sequence: Synthetic coding sequence
atggccgccccctgggccagcctgagactggtggcccccatgtggaacggcagaatcagaggcatccacagactgggcgccgccgtggcccccgagggcaaccagaagaagaagagaaccatcctgcagttcctgaccaactacttctacgacgtggaggccctgagagactacctgctgcagagagagatgtacaaggtgcacgagaagaacagattcagagacaaggagtggatcagacccgacaagtacggccacttcagccaggagttctggaacttctgcgaggtgcccgtggaggccgtggacgccggcgactgcgacatcaactacgagggcctggacaacctgctgagactgaaggagctgcagagcctgagcctgcagagatgctgccacgtggacgactggtgcctgagcagactgtaccccctggccgacagcctgcaggagctgagcctggccggctgccccagaatcagcgagagaggcctggcctgcctgcaccacctgcagaacctgagaagactggacatcagcgacctgcccgccgtgagcaaccccggcctgacccagatcctggtggaggagatgctgcccaactgcgaggtggtgggcgtggactgggccgagggcctgaagagcggccccgaggagcagcccagagacaccgccagccccgtgcccgcctag

SEQ ID NO: 18187 - DNA, 1002 bp, Artificial Sequence
  Description of Artificial Sequence: Synthetic coding sequence
atggagctggacatccacagcgcccaggtgcccctgcccgtgggcagaggcagacacagagacgccacccccgagagcaagggcagcctgcaggacctgggctggagcgccgtggcccagagccagctgaccgccaccagcaccagccccgcccaggtgatcccccccccccagcccagatggagcagaacccccggcttcaagagatgcttcagactgggcctgcacaaggtgctgggcagccagagcctgagactggtggcccccatgtggaacggcagaatcagaggcatccacagactgggcgccgccgtggcccccgagggcaaccagaagaagaagagaaccatcctgcagttcctgaccaactacttctacgacgtggaggccctgagagactacctgctgcagagagagatgtacaaggtgcacgagaagaacagaagctacacctggctggagaagcagcacggcccctacggcgccggcgccttcttcatcctgaagcagggcggcgccgtgaagttcagagacaaggagtggatcagacccgacaagtacggccacttcagccaggagttctggaacttctgcgaggtgcccgtggaggccgtggacgccggcgactgcgacatcaactacgagggcctggacaacctgctgagactgaaggagctgcagagcctgagcctgcagagatgctgccacgtggacgactggtgcctgagcagactgtaccccctggccgacagcctgcaggagctgagcctggccggctgccccagaatcagcgagagaggcctggcctgcctgcaccacctgcagaacctgagaagactggacatcagcgacctgcccgccgtgagcaaccccggcctgacccagatcctggtggaggagatgctgcccaactgcgaggtggtgggcgtggactgggccgagggcctgaagagcggccccgaggagcagcccagagacaccgccagccccgtgcccgcctag

SEQ ID NO: 18188 - DNA, 693 bp, Artificial Sequence; identical to SEQ ID NO: 18186
  Description of Artificial Sequence: Synthetic coding sequence

SEQ ID NO: 18189 - DNA, 3663 bp, Artificial Sequence
  Description of Artificial Sequence: Synthetic coding sequence
atgggcgacatggccaacagcagcatcgagttccaccccaagccccagcagcagagagacgtgccccaggccggcggcttcggctgcaccctggccgagctgagaaccctgatggagctgagaggcgccgaggccctgcagaagatcgaggaggcctacggcgacgtgagcggcctgtgcagaagactgaagaccagccccaccgagggcctggccgacaacaccaacgacctggagaagagaagacagatctacggccagaacttcatcccccccaagcagcccaagaccttcctgcagctggtgtgggaggccctgcaggacgtgaccctgatcatcctggaggtggccgccatcgtgagcctgggcctgagcttctacgccccccccggcgaggagagcgaggcctgcggcaacgtgagcggcggcgccgaggacgagggcgaggccgaggccggctggatcgagggcgccgccatcctgctgagcgtgatctgcgtggtgctggtgaccgccttcaacgactggagcaaggagaagcagttcagaggcctgcagagcagaatcgagcaggagcagaagttcaccgtgatcagaaacggccagctgctgcaggtgcccgtggccgccctggtggtgggcgacatcgcccaggtgaagtacggcgacctgctgcccgccgacggcgtgctgatccaggccaacgacctgaagatcgacgagagcagcctgaccggcgagagcgaccacgtgagaaagagcgccgacaaggaccccatgctgctgagcggcacccacgtgatggagggcagcggcagaatggtggtgaccgccgtgggcgtgaacagccagaccggcatcatcttcaccctgctgggcgccggcggcgaggaggaggagaagaaggacaagaagggcaagcagcaggacggcgccatggagagcagccagaccaaggccaagaagcaggacggcgccgtggccatggagatgcagcccctgaagagcgccgagggcggcgagatggaggagagagagaagaagaaggccaacgcccccaagaaggagaagagcgtgctgcagggcaagctgaccaagctggccgtgcagatcggcaaggccggcctggtgatgagcgccatcaccgtgatcatcctggtgctgtacttcgtgatcgagaccttcgtggtggagggcagaacctggctggccgagtgcacccccgtgtacgtgcagtacttcgtgaagttcttcatcatcggcgtgaccgtgctggtggtggccgtgcccgagggcctgcccctggccgtgaccatcagcctggcctacagcgtgaagaagatgatgaaggacaacaacctggtgagacacctggacgcctgcgagaccatgggcaacgccaccgccatctgcagcgacaagaccggcaccctgaccaccaacagaatgaccgtggtgcagagctacctgggcgacacccactacaaggagatccccgcccccagcgccctgacccccaagatcctggacctgctggtgcacgccatcagcatcaacagcgcctacaccaccaagatcctgccccccgagaaggagggcgccctgcccagacaggtgggcaacaagaccgagtgcgccctgctgggcttcgtgctggacctgaagagagacttccagcccgtgagagagcagatccccgaggacaagctgtacaaggtgtacaccttcaacagcgtgagaaagagcatgagcaccgtgatcagaatgcccgacggcggcttcagactgttcagcaagggcgccagcgagatcctgctgaagaagtgcaccaacatcctgaacagcaacggcgagctgagaggcttcagacccagagacagagacgacatggtgagaaagatcatcgagcccatggcctgcgacggcctgagaaccatctgcatcgcctacagagacttcagcgccggccaggagcccgactgggacaacgagaacgaggtggtgggcgacctgacctgcatcgccgtggtgggcatcgaggaccccgtgagacccgaggtgcccgaggccatcagaaagtgccagagagccggcatcaccgtgagaatggtgaccggcgacaacatcaacaccgccagagccatcgccgccaagtgcggcatcatccagcccggcgaggacttcctgtgcctggagggcaaggagttcaacagaagaatcagaaacgagaagggcgagatcgagcaggagagactggacaaggtgtggcccaagctgagagtgctggccagaagcagccccaccgacaagcacaccctggtgaagggcatcatcgacagcaccaccggcgagcagagacaggtggtggccgtgaccggcgacggcaccaacgacggccccgccctgaagaaggccgacgtgggcttcgccatgggcatcgccggcaccgacgtggccaaggaggccagcgacatcatcctgaccgacgacaacttcaccagcatcgtgaaggccgtgatgtggggcagaaacgtgtacgacagcatcagcaagttcctgcagttccagctgaccgtgaacgtggtggccgtgatcgtggccttcaccggcgcctgcatcacccaggacagccccctgaaggccgtgcagatgctgtgggtgaacctgatcatggacaccttcgccagcctggccctggccaccgagccccccaccgagagcctgctgctgagaaagccctacggcagagacaagcccctgatcagcagaaccatgatgaagaacatcctgggccacgccgtgtaccagctggccatcatcttcaccctgctgttcgtgggcgagctgttcttcgacatcgacagcggcagaaacgcccccctgcacagcccccccagcgagcactacaccatcatcttcaacaccttcgtgatgatgcagctgttcaacgagatcaacgccagaaagatccacggcgagagaaacgtgttcgacggcatcttcagcaaccccatcttctgcaccatcgtgctgggcaccttcggcatccagatcgtgatcgtgcagttcggcggcaagcccttcagctgcagccccctgagcaccgagcagtggctgtggtgcctgttcgtgggcgtgggcgagctggtgtggggccaggtgatcgccaccatccccaccagccagctgaagtgcctgaaggaggccggccacggccccggcaaggacgagatgaccgacgaggagctggccgagggcgaggaggagatcgaccacgccgagagagagctgagaagaggccagatcctgtggttcagaggcctgaacagaatccagacccagatcagagtggtgaaggccttcagaagcagcctgtacgagggcctggagaagcccgagagcaagaccagcatccacaacttcatggccacccccgagttcctgatcaacgactacacccacaacatccccctgatcgacgacaccgacgtggacgagaacgaggagagactgagagccccccccccccccagccccaaccagaacaacaacgccatcgacagcggcatctacctgaccacccacgtgaccaagagcgccaccagcagcgtgttcagcagcagccccggcagccccctgcacagcgtggagaccagcctgtag

SEQ ID NO: 18190 - DNA, 4377 bp, Artificial Sequence
  Description of Artificial Sequence: Synthetic coding sequence
atggtgaacaccagaaagagcagcctgagactgctgggcagcaagagccccggccccggccccggccccggcgccggcgccgagcccggcgccaccggcggcagcagccacttcatcagcagcagaaccagaagcagcaagaccagagccgccagctgccccgccgccaaggccggcggcagcggcggcgccggcgtgaccctggacgaggccagaaaggtggaggtggacggcagcctgagcgacagccacgtgagcccccccgccaagagaaccctgaagcagcccgacagcgtgtgcaaggacaagagcaagagcagaagcaccggccagagagaggagtggaacctgagcaccggccaggccagactgaccagccagcccggcgccaccctgcccaacggccacagcggcctgagcctgagaagccaccccctgagaggcgagaagaagggcgacggcgacctgagctgcatcaacggcgacatggaggtgagaaagagctgcagaagcagaaagaacagattcgagagcgtgaaccagagcctgctgttcgaccagctggtgaacagcaccgccgaggccgtgctgcaggagatggacaacatcaacatcagacagaacagaagaagcggcgaggtggagagactgagaatgtggaccgacaccgagttcgagaacatggacatgtacagcagagtgaagagaagaagaaagagcctgagaagaaacagctacggcatccagaaccaccacgaggtgagcaccgagggcgaggaggaggagagccaggaggaggacggcgacatcgaggtggaggaggccgagggcgaggagaacgacagaccctacaacctgagacagagaaagaccgtggacagataccaggccccccccatcgtgcccgcccaccagaagaagagagagaacaccctgttcgacatccacagaagccccgccagaagaagccacatcagaagaaagaagcacgccatccacagcagcgacaccaccagcagcgacgaggagagattcgagagaagaaagagcaagagcatggccagagccagaaacagatgcctgcccatgaacttcagagccgaggacctggccagcggcatcctgagagagagagtgaaggtgggcgccagcctggccgacgtggaccccatgaacatcgacaagagcgtgagattcgacagcatcggcggcctgagccaccacatccacgccctgaaggagatggtggtgttccccctgctgtaccccgagatcttcgagaagttcaagatccagccccccagaggctgcctgttctacggcccccccggcaccggcaagaccctggtggccagagccctggccaacgagtgcagccagggcgacaagaaggtggccttcttcatgagaaagggcgccgactgcctgagcaagtgggtgggcgagagcgagagacagctgagactgctgttcgaccaggcctacctgatgagacccagcatcatcttcttcgacgagatcgacggcctggcccccgtgagaagcagcagacaggaccagatccacagcagcatcgtgagcaccctgctggccctgatggacggcctggacaacagaggcgagatcgtggtgatcggcgccaccaacagactggacagcatcgaccccgccctgagaagacccggcagattcgacagagagttcctgttcaacctgcccgaccagaaggccagaaagcacatcctgcagatccacaccagagactggaaccccaagctgagcgacgccttcctgggcgagctggccgagaagtgcgtgggctactgcggcgccgacatcaaggccctgtgcaccgaggccgccctgatcgccctgagaagaagatacccccagatctacgccagcagccacaagctgcagctggacgtgagcagcatcgtgctgagcgcccaggacttctaccacgccatgcagaacatcgtgcccgccagccagagagccgtgatgagcagcggccacgccctgagccccatcatcagacccctgctggagagaagcttcaacaacatcctggccgtgctgcagaaggtgttcccccacgccgagatcagccagagcgacaagaaggaggacatcgagaccctgatcctggaggacagcgaggacgagaacgccctgagcatcttcgagaccaactgccacagcggcagccccaagaagcagagcagcagcgccgccatccacaagccctacctgcacttcaccatgagcccctaccaccagcccaccagctacagacccagactgctgctgagcggcgagagaggcagcggccagaccagccacctggcccccgccctgctgcacaccctggagagattcagcgtgcacagactggacctgcccgccctgtacagcgtgagcgccaagacccccgaggagagctgcgcccagatcttcagagaggccagaagaaccgtgcccagcatcgtgtacatgccccacatcggcgactggtgggaggccgtgagcgagaccgtgagagccaccttcctgaccctgctgcaggacatccccagcttcagccccatcttcctgctgagcaccagcgagaccatgtacagcgagctgcccgaggaggtgaagtgcatcttcagaatccagtacgaggaggtgctgtacatccagagacccatcgaggaggacagaagaaagttcttccaggagctgatcctgaaccaggccagcatggccccccccagaagaaagcacgccgccctgtgcgccatggaggtgctgcccctggccctgcccagcccccccagacagctgagcgagagcgagaagagcagaatggaggaccaggaggagaacaccctgagagagctgagactgttcctgagagacgtgaccaagagactggccaccgacaagagattcaacatcttcagcaagcccgtggacatcgaggaggtgagcgactacctggaggtgatcaaggagcccatggacctgagcaccgtgatcaccaagatcgacaagcacaactacctgaccgccaaggacttcctgaaggacatcgacctgatctgcagcaacgccctggagtacaaccccgacaaggaccccggcgacaagatcatcagacacagagcctgcaccctgaaggacaccgcccacgccatcatcgccgccgagctggaccccgagttcaacaagctgtgcgaggagatcaaggaggccagaatcaagagaggcctgagcgtgaccagcgagcagatcaacccccacagcaccggcgccagaaagaccgagaccagagtggaggaggccttcagacacaagcagagaaaccccatggacgtgtggcacaacagcgccaacaagtgcgccttcagagtgagaagaaagagcagaagaagaagccagtggggcaagggcatcatcaagaagagaaaggtgaacaacctgaagaaggacgaggaggacaccaagttcgccgactacgagaaccacaccgaggacagaaagctgctggagaacggcgagttcgaggtgagcaccgactgccacgaggagaacggcgaggagaccggcgacctgagcatgaccaacgacgagagcagctgcgacatcatggacctggaccagggccagagactgaacaacggcgccggcaccaaggagaacttcgccagcaccgaggaggagagcagcaacgagagcctgctggtgaacagcagcagcagcctgaaccccgagcagaccagcagaaaggagaccttcctgaagggcaactgcctgaacggcgaggccagcaccgacagcttcgagggcatccccgtgctggagtgccagaacggcaagctggaggtggtgagcttctgcgacagcggcgacaagtgcagcagcgagcagaagatcctgctggaggaccagagcaaggagaagcccgagaccagcaccgagaaccacggcgacgacctggagaagctggaggccctggagtgcagcaacaacgagaagctggagcccggcagcgacgtggaggtgaaggacgccgagctggacaaggagggcgccagcaaggtgaagaagtacagaaagctgatcctggagcaggccaagaccaccagcctggagctggtgcccgaggagcccagcgagcccgtgccccccctgatcgtggacagagagagactgaagaagctgctggacctgctggtggacaagagcaacaacctggccgtggaccagctggagagactgtacagcctgctgagccagtgcatctacagacacagaaaggactacgacaagagccagctggtggaggagatggagagaaccgtgcacatgttcgagaccttcctgtag

SEQ ID NO: 18191 - DNA, 639 bp, Artificial Sequence
  Description of Artificial Sequence: Synthetic coding sequence
atggaggtgagaaagagctgcagaagcagaaagaacagattcgagagcgtgaaccagagcctgctgttcgaccagctggtgaacagcaccgccgaggccgtgctgcaggagatggacaacatcaacatcagacagaacagaagaagcggcgaggtggagagactgagaatgtggaccgacaccgagttcgagaacatggacatgtacagcagagtgaagagaagaagaaagagcctgagaagaaacagctacggcatccagaaccaccacgaggtgagcaccgagggcgaggaggaggccagaaccagcaagctgctgcccctggagaagatcagcatcgagagccaggaggaggacggcgacatcgaggtggaggaggccgagggcgaggagaacgacagaccctacaacctgagacagagaaagaccgtggacagataccaggccccccccatcgtgcccgcccaccagaagaagagagagaacaccctgttcgacatccacagaagccccgccagaagaagccacatcagaagaaagaagcacgccatccacagcagcgacaccaccagcagcgacgaggagagattcgagagaagaaagagcaagagcatggccagagccagaaacagaaagtag

SEQ ID NO: 18192 - DNA, 1881 bp, Artificial Sequence
  Description of Artificial Sequence: Synthetic coding sequence
atgccccacatcggcgactggtgggaggccgtgagcgagaccgtgagagccaccttcctgaccctgctgcaggacatccccagcttcagccccatcttcctgctgagcaccagcgagaccatgtacagcgagctgcccgaggaggtgaagtgcatcttcagaatccagtacgaggaggtgctgtacatccagagacccatcgaggaggacagaagaaagttcttccaggagctgatcctgaaccaggccagcatggccccccccagaagaaagcacgccgccctgtgcgccatggaggtgctgcccctggccctgcccagcccccccagacagctgagcgagagcgagaagagcagaatggaggaccaggaggagaacaccctgagagagctgagactgttcctgagagacgtgaccaagagactggccaccgacaagagattcaacatcttcagcaagcccgtggacatcgaggaggtgagcgactacctggaggtgatcaaggagcccatggacctgagcaccgtgatcaccaagatcgacaagcacaactacctgaccgccaaggacttcctgaaggacatcgacctgatctgcagcaacgccctggagtacaaccccgacaaggaccccggcgacaagatcatcagacacagagcctgcaccctgaaggacaccgcccacgccatcatcgccgccgagctggaccccgagttcaacaagctgtgcgaggagatcaaggaggccagaatcaagagaggcctgagcgtgaccagcgagcagatcaacccccacagcaccggcgccagaaagaccgagaccagagtggaggaggccttcagacacaagcagagaaaccccatggacgtgtggcacaacagcgccaacaagtgcgccttcagagtgagaagaaagagcagaagaagaagccagtggggcaagggcatcatcaagaagagaaaggtgaacaacctgaagaaggacgaggaggacaccaagttcgccgactacgagaaccacaccgaggacagaaagctgctggagaacggcgagttcgaggtgagcaccgactgccacgaggagaacggcgaggagaccggcgacctgagcatgaccaacgacgagagcagctgcgacatcatggacctggaccagggccagagactgaacaacggcgccggcaccaaggagaacttcgccagcaccgaggaggagagcagcaacgagagcctgctggtgaacagcagcagcagcctgaaccccgagcagaccagcagaaaggagaccttcctgaagggcaactgcctgaacggcgaggccagcaccgacagcttcgagggcatccccgtgctggagtgccagaacggcaagctggaggtggtgagcttctgcgacagcggcgacaagtgcagcagcgagcagaagatcctgctggaggaccagagcaaggagaagcccgagaccagcaccgagaaccacggcgacgacctggagaagctggaggccctggagtgcagcaacaacgagaagctggagcccggcagcgacgtggaggtgaaggacgccgagctggacaaggagggcgccagcaaggtgaagaagtacagaaagctgatcctggagcaggccaagaccaccagcctggagctggtgcccgaggagcccagcgagcccgtgccccccctgatcgtggacagagagagactgaagaagctgctggacctgctggtggacaagagcaacaacctggccgtggaccagctggagagactgtacagcctgctgagccagtgcatctacagacacagaaaggactacgacaagagccagctggtggaggagatggagagaaccgtgcacatgttcgagaccttcctgtag

SEQ ID NO: 18193 - DNA, 1236 bp, Artificial Sequence
  Description of Artificial Sequence: Synthetic coding sequence
atgagcaaggacgccctgaacctggcccagatgcaggagcagaccctgcagctggagcagcagagcaagctgaagcagctggtgaacgaggacctgagaaagcaggaggagagcgtgcagaagcaccaccagaccttcctggagagcatcagagccgccggcaccctgttcggcgagggcttcagagccttcgtgaccgacagagacaaggtgaccgccaccgtggccggcctgaccctgctggccgtgggcgtgtacagcgccaagaacgccaccgccgtgaccggcagatacatcgaggccagactgggcaagcccagcctggtgagagagaccagcagaatcaccgtgctggaggccctgagacaccccatccagcaggtgagcagaagactgctgagcagaccccaggacgtgctggagggcgtggtgctgagccccagcctggaggccagagtgagagacatcgccatcatgaccagaaacatcaagaagaacagaggcctgtacagacacatcctgctgtacggcccccccggcaccggcaagaccctgttcgccaagaagctggccctgcacagcggcatggactacgccatcatgaccggcggcgacgtggcccccatgggcagagagggcgtgaccgccatgcacaagctgttcgactgggccaacaccagcagaagaggcctgctgctgttcgtggacgaggccgacgccttcctgagaaagagagccaccgagaagatcagcgaggacctgagagccaccctgaacgccttcctgtacagaaccggccagcacagcaacaagttcatgctgatcctggccagctgccaccccgagcagttcgactgggccatcaacgcctgcatcgacgtgatggtgcacttcgacctgcccggccaggaggagagagccagactggtgagaatgtacctgaacgagtacgtgctgaagcccgccaccgagggcaagagaagactgaagctggcccagttcgactacggcagaaagtgcctggagatcgccagactgaccgagggcatgagctgcagaaagatcgcccagctggccgtgagctggcaggccaccgcctacgccagcaaggacggcgtgctgaccgaggccatgatggacgcctgcgtgcaggacttcgtgcagcagcaccagcagatgatgagatggctgaagggcgagagacccggccccgaggacgagcagcccagcagctag

SEQ ID NO: 18194 - DNA, 2112 bp, Artificial Sequence
  Description of Artificial Sequence: Synthetic coding sequence
atggccacctgcgccgagatcctgagaagcgagttccccgagatcgacggccaggtgttcgactacgtgaccggcgtgctgcacagcggcagcgccgacttcgagagcgtggacgacctggtggaggccgtgggcgagctgctgcaggaggtgagcggcgacagcaaggacgacgccggcatcagagccgtgtgccagagaatggccgagccccagagccagggcaacagccaggtgctgctggacgcccccatccagctgagcaagatcaccgagaactacgactgcggcaccaagctgcccggcctgctgaagagagagcagagcagcaccgtgaacgccaagaagctggagaaggccgaggccagactgaaggccaagcaggagaagagaagcgagaaggacaccctgaagaccagcaaccccctggtgctggaggaggccagcgccagccaggccggcagcagaaaggagagcagactggagagcagcggcaagaacaagagctacgacgtgagaatcgagaacttcgacgtgagcttcggcgacagagtgctgctggccggcgccgacgtgaacctggcctggggcagaagatacggcctggtgggcagaaacggcctgggcaagaccaccctgctgaagatgctggccaccagaagcctgagagtgcccgcccacatcagcctgctgcacgtggagcaggaggtggccggcgacgacacccccgccctgcagagcgtgctggagagcgacagcgtgagagaggacctgctgagaagagagagagagctgaccgcccagatcgccgccggcagagccgagggcagcgaggccgccgagctggccgagatctacgccaagctggaggagatcgaggccgacaaggcccccgccagagccagcgtgatcctggccggcctgggcttcacccccaagatgcagcagcagcccaccagagagttcagcggcggctggagaatgagactggccctggccagagccctgttcgccagacccgacctgctgctgctggacgagcccaccaacatgctggacgtgagagccatcctgtggctggagaactacctgcagacctggcccagcaccatcctggtggtgagccacgacagaaacttcctgaacgccatcgccaccgacatcatccacctgcacagccagagactggacggctacagaggcgacttcgagaccttcatcaagagcaagcaggagagactgctgaaccagcagagagagtacgaggcccagcagcagtacagacagcacatccaggtgttcatcgacagattcagatacaacgccaacagagccagccaggtgcagagcaagctgaagatgctggagaagctgcccgagctgaagcccgtggacaaggagagcgaggtggtgatgaagttccccgacggcttcgagaagttcagcccccccatcctgcagctggacgaggtggacttctactacgaccccaagcacgtgatcttcagcagactgagcgtgagcgccgacctggagagcagaatctgcgtggtgggcgagaacggcgccggcaagagcaccatgctgaagctgctgctgggcgacctggcccccgtgagaggcatcagacacgcccacagaaacctgaagatcggctacttcagccagcaccacgtggagcagctggacctgaacgtgagcgccgtggagctgctggccagaaagttccccggcagacccgaggaggagtacagacaccagctgggcagatacggcatcagcggcgagctggccatgagacccctggccagcctgagcggcggccagaagagcagagtggccttcgcccagatgaccatgccctgccccaacttctacatcctggacgagcccaccaaccacctggacatggagaccatcgaggccctgggcagagccctgaacaacttcagaggcggcgtgatcctggtgagccacgacgagagattcatcagactggtgtgcagagagctgtgggtgtgcgagggcggcggcgtgaccagagtggagggcggcttcgaccagtacagagccctgctgcaggagcagttcagaagagagggcttcctgtag

SEQ ID NO: 18195 - DNA, 2130 bp, Artificial Sequence
  Description of Artificial Sequence: Synthetic coding sequence
atggccacctgcgccgagatcctgagaagcgagttccccgagatcgacggccaggtgttcgactacgtgaccggcgtgctgcacagcggcagcgccgacttcgagagcgtggacgacctggtggaggccgtgggcgagctgctgcaggaggtgagcggcgacagcaaggacgacgccggcatcagagccgtgtgccagagaatgtacaacaccctgagactggccgagccccagagccagggcaacagccaggtgctgctggacgcccccatccagctgagcaagatcaccgagaactacgactgcggcaccaagctgcccggcctgctgaagagagagcagagcagcaccgtgaacgccaagaagctggagaaggccgaggccagactgaaggccaagcaggagaagagaagcgagaaggacaccctgaagaccagcaaccccctggtgctggaggaggccagcgccagccaggccggcagcagaaaggagagcagactggagagcagcggcaagaacaagagctacgacgtgagaatcgagaacttcgacgtgagcttcggcgacagagtgctgctggccggcgccgacgtgaacctggcctggggcagaagatacggcctggtgggcagaaacggcctgggcaagaccaccctgctgaagatgctggccaccagaagcctgagagtgcccgcccacatcagcctgctgcacgtggagcaggaggtggccggcgacgacacccccgccctgcagagcgtgctggagagcgacagcgtgagagaggacctgctgagaagagagagagagctgaccgcccagatcgccgccggcagagccgagggcagcgaggccgccgagctggccgagatctacgccaagctggaggagatcgaggccgacaaggcccccgccagagccagcgtgatcctggccggcctgggcttcacccccaagatgcagcagcagcccaccagagagttcagcggcggctggagaatgagactggccctggccagagccctgttcgccagacccgacctgctgctgctggacgagcccaccaacatgctggacgtgagagccatcctgtggctggagaactacctgcagacctggcccagcaccatcctggtggtgagccacgacagaaacttcctgaacgccatcgccaccgacatcatccacctgcacagccagagactggacggctacagaggcgacttcgagaccttcatcaagagcaagcaggagagactgctgaaccagcagagagagtacgaggcccagcagcagtacagacagcacatccaggtgttcatcgacagattcagatacaacgccaacagagccagccaggtgcagagcaagctgaagatgctggagaagctgcccgagctgaagcccgtggacaaggagagcgaggtggtgatgaagttccccgacggcttcgagaagttcagcccccccatcctgcagctggacgaggtggacttctactacgaccccaagcacgtgatcttcagcagactgagcgtgagcgccgacctggagagcagaatctgcgtggtgggcgagaacggcgccggcaagagcaccatgctgaagctgctgctgggcgacctggcccccgtgagaggcatcagacacgcccacagaaacctgaagatcggctacttcagccagcaccacgtggagcagctggacctgaacgtgagcgccgtggagctgctggccagaaagttccccggcagacccgaggaggagtacagacaccagctgggcagatacggcatcagcggcgagctggccatgagacccctggccagcctgagcggcggccagaagagcagagtggccttcgcccagatgaccatgccctgccccaacttctacatcctggacgagcccaccaaccacctggacatggagaccatcgaggccctgggcagagccctgaacaacttcagaggcggcgtgatcctggtgagccacgacgagagattcatcagactggtgtgcagagagctgtgggtgtgcgagggcggcggcgtgaccagagtggagggcggcttcgaccagtacagagccctgctgcaggagcagttcagaagagagggcttcctgtag

SEQ ID NO: 18196 - DNA, 3573 bp, Artificial Sequence
  Description of Artificial Sequence: Synthetic coding sequence
atgaagaccagacagaacaaggacagcatgagcatgagaagcggcagaaagaaggaggcccccggccccagagaggagctgagaagcagaggcagagccagccccggcggcgtgagcaccagcagcagcgacggcaaggccgagaagagcagacagaccgccaagaaggccagagtggaggaggccagcacccccaaggtgaacaagcagggcagaagcgaggagatcagcgagagcgagagcgaggagaccaacgcccccaagaagaccaagaccgagcaggagctgcccagaccccagagccccagcgacctggacagcctggacggcagaagcctgaacgacgacggcagcagcgaccccagagacatcgaccaggacaacagaagcaccagccccagcatctacagccccggcagcgtggagaacgacagcgacagcagcagcggcctgagccagggccccgccagaccctaccaccccccccccctgttcccccccagcccccagccccccgacagcacccccagacagcccgaggccagcttcgagccccaccccagcgtgacccccaccggctaccacgcccccatggagccccccaccagcagaatgttccaggccccccccggcgccccccccccccacccccagctgtaccccggcggcaccggcggcgtgctgagcggcccccccatgggccccaagggcggcggcgccgccagcagcgtgggcggccccaacggcggcaagcagcaccccccccccaccacccccatcagcgtgagcagcagcggcgccagcggcgccccccccaccaagccccccaccacccccgtgggcggcggcaacctgcccagcgcccccccccccgccaacttcccccacgtgacccccaacctgccccccccccccgccctgagacccctgaacaacgccagcgccagcccccccggcctgggcgcccagcccctgcccggccacctgcccagcccccacgccatgggccagggcatgggcggcctgccccccggccccgagaagggccccaccctggcccccagcccccacagcctgccccccgccagcagcagcgcccccgccccccccatgagattcccctacagcagcagcagcagcagcagcgccgccgccagcagcagcagcagcagcagcagcagcagcgccagccccttccccgccagccaggccctgcccagctacccccacagcttccccccccccaccagcctgagcgtgagcaaccagccccccaagtacacccagcccagcctgcccagccaggccgtgtggagccagggccccccccccccccccccctacggcagactgctggccaacagcaacgcccaccccggccccttcccccccagcaccggcgcccagagcaccgcccacccccccgtgagcacccaccaccaccaccaccagcagcagcagcagcagcagcagcagcagcagcagcagcagcagcagcagcagcagcaccacggcaacagcggcccccccccccccggcgccttcccccaccccctggagggcggcagcagccaccacgcccacccctacgccatgagccccagcctgggcagcctgagaccctacccccccggccccgcccacctgccccccccccacagccaggtgagctacagccaggccggccccaacggcccccccgtgagcagcagcagcaacagcagcagcagcaccagccagggcagctacccctgcagccaccccagccccagccagggcccccagggcgccccctaccccttcccccccgtgcccaccgtgaccaccagcagcgccaccctgagcaccgtgatcgccaccgtggccagcagccccgccggctacaagaccgccagcccccccggcccccccccctacggcaagagagcccccagccccggcgcctacaagaccgccaccccccccggctacaagcccggcagcccccccagcttcagaaccggcaccccccccggctacagaggcaccagcccccccgccggccccggcaccttcaagcccggcagccccaccgtgggccccggccccctgccccccgccggccccagcggcctgcccagcctgccccccccccccgccgcccccgccagcggcccccccctgagcgccacccagatcaagcaggagcccgccgaggagtacgagacccccgagagccccgtgccccccgccagaagccccagccccccccccaaggtggtggacgtgcccagccacgccagccagagcgccagattcaacaagcacctggacagaggcttcaacagctgcgccagaagcgacctgtacttcgtgcccctggagggcagcaagctggccaagaagagagccgacctggtggagaaggtgagaagagaggccgagcagagagccagagaggagaaggagagagagagagagagagagagagagaaggagagagagagagagaaggagagagagctggagagaagcgtgaagctggcccaggagggcagagcccccgtggagtgccccagcctgggccccgtgccccacagaccccccttcgagcccggcagcgccgtggccaccgtgcccccctacctgggccccgacacccccgccctgagaaccctgagcgagtacgccagaccccacgtgatgagccccggcaacagaaaccaccccttctacgtgcccctgggcgccgtggaccccggcctgctgggctacaacgtgcccgccctgtacagcagcgaccccgccgccagagagagagagagagaggccagagagagagacctgagagacagactgaagcccggcttcgaggtgaagcccagcgagctggagcccctgcacggcgtgcccggccccggcctggaccccttccccagacacggcggcctggccctgcagcccggcccccccggcctgcaccccttccccttccaccccagcctgggccccctggagagagagagactggccctggccgccggccccgccctgagacccgacatgagctacgccgagagactggccgccgagagacagcacgccgagagagtggccgccctgggcaacgaccccctggccagactgcagatgctgaacgtgaccccccaccaccaccagcacagccacatccacagccacctgcacctgcaccagcaggacgccatccacgccgccagcgccagcgtgcaccccctgatcgaccccctggccagcggcagccacctgaccagaatcccctaccccgccggcaccctgcccaaccccctgctgccccaccccctgcacgagaacgaggtgctgagacaccagctgttcgccgccccctacagagacctgcccgccagcctgagcgcccccatgagcgccgcccaccagctgcaggccatgcacgcccagagcgccgagctgcagagactggccctggagcagcagcagtggctgcacgcccaccaccccctgcacagcgtgcccctgcccgcccaggaggactactacagccacctgaagaaggagagcgacaagcccctgtag

SEQ ID NO: 18197 - DNA, 3573 bp, Artificial Sequence; identical to SEQ ID NO: 18196
  Description of Artificial Sequence: Synthetic coding sequence

SEQ ID NO: 18198 - DNA, 3780 bp, Artificial Sequence
  Description of Artificial Sequence: Synthetic coding sequence
atggacggccccaccagaggccacggcctgagaaagaagagaagaagcagaagccagagagacagagagagaagaagcagaggcggcctgggcgccggcgccgccggcggcggcggcgccggcagaaccagagccctgagcctggccagcagcagcggcagcgacaaggaggacaacggcaagccccccagcagcgcccccagcagacccagaccccccagaagaaagagaagagagagcaccagcgccgaggaggacatcatcgacggcttcgccatgaccagcttcgtgaccttcgaggccctggagaaggacgtggccctgaagccccaggagagagtggagaagagacagacccccctgaccaagaagaagagagaggccctgaccaacggcctgagcttccacagcaagaagagcagactgagccacccccaccactacagcagcgacagagagaacgacagaaacctgtgccagcacctgggcaagagaaagaagatgcccaaggccctgagacagctgaagcccggccagaacagctgcagagacagcgacagcgagagcgccagcggcgagagcaagggcttccacagaagcagcagcagagagagactgagcgacagcagcgcccccagcagcctgggcaccggctacttctgcgacagcgacagcgaccaggaggagaaggccagcgacgccagcagcgagaagctgttcaacaccgtgatcgtgaacaaggaccccgagctgggcgtgggcaccctgcccgagcacgacagccaggacgccggccccatcgtgcccaagatcagcggcctggagagaagccaggagaagagccaggactgctgcaaggagcccatcttcgagcccgtggtgctgaaggacccctgcccccaggtggcccagcccatcccccagccccagaccgagccccagctgagagcccccagccccgaccccgacctggtgcagagaaccgaggcccccccccagcccccccccctgagcacccagcccccccagggcccccccgaggcccagctgcagcccgccccccagccccaggtgcagagaccccccagaccccagagccccacccagctgctgcaccagaacctgccccccgtgcaggcccaccccagcgcccagagcctgagccagcccctgagcgcctacaacagcagcagcctgagcctgaacagcctgagcagcagcagaagcagcacccccgccaagacccagcccgcccccccccacatcagccaccaccccagcgccagccccttccccctgagcctgcccaaccacagccccctgcacagcttcacccccaccctgcagccccccgcccacagccaccaccccaacatgttcgccccccccaccgccctgcccccccccccccccctgaccagcggcagcctgcaggtggccggccaccccgccggcagcacctacagcgagcaggacatcctgagacaggagctgaacaccagattcctggccagccagagcgccgacagaggcgccagcctgggcccccccccctacctgagaaccgagttccaccagcaccagcaccagcaccagcacacccaccagcacacccaccagcacaccttcacccccttcccccacgccatcccccccaccgccatcatgcccacccccgccccccccatgttcgacaagtaccccaccaaggtggaccccttctacagacacagcctgttccacagctacccccccgccgtgagcggcatcccccccatgatcccccccaccggccccttcggcagcctgcagggcgccttccagcccaagaccagcaaccccatcgacgtggccgccagacccggcaccgtgccccacaccctgctgcagaaggaccccagactgaccgaccccttcagacccatgctgagaaagcccggcaagtggtgcgccatgcacgtgcacatcgcctggcagatctaccaccaccagcagaaggtgaagaagcagatgcagagcgacccccacaagctggacttcggcctgaagcccgagttcctgagcagaccccccggccccagcctgttcggcgccatccaccacccccacgacctggccagacccagcaccctgttcagcgccgccggcgccgcccaccccaccggcacccccttcggcccccccccccaccacagcaacttcctgaaccccgccgcccacctggagcccttcaacagacccagcaccttcaccggcctggccgccgtgggcggcaacgccttcggcggcctgggcaaccccagcgtgacccccaacagcatgttcggccacaaggacggccccagcgtgcagaacttcagcaacccccacgagccctggaacagactgcacagaaccccccccagcttccccaccccccccccctggctgaagcccggcgagctggagagaagcgccagcgccgccgcccacgacagagacagagacgtggacaagagagacagcagcgtgagcaaggacgacaaggagagagagagcgtggagaagagacacagcagccaccccagccccgcccccgtgctgcccgtgaacgccctgggccacaccagaagcagcaccgagcagatcagagcccacctgaacaccgaggccagagagaaggacaagcccaaggagagagagagagaccacagcgagagcagaaaggacctggccgccgacgagcacaaggccaaggagggccacctgcccgagaaggacggccacggccacgagggcagagccgccggcgaggaggccaagcagctggccagagtgcccagcccctacgtgagaacccccgtggtggagagcgccagacccaacagcaccagcagcagagaggccgagcccagaaagggcgagcccgcctacgagaaccccaagaagagcagcgaggtgaaggtgaaggaggagagaaaggaggaccacgacctgccccccgaggccccccagacccacagagccagcgagccccccccccccaacagcagcagcagcgtgcaccccggccccctggccagcatgcccatgaccgtgggcgtgaccggcatccaccccatgaacagcatcagcagcctggacagaaccagaatgatgacccccttcatgggcatcagccccctgcccggcggcgagagattcccctaccccagcttccactgggaccccatcagagaccccctgagagacccctacagagagctggacatccacagaagagaccccctgggcagagacttcctgctgagaaacgaccccctgcacagactgagcacccccagactgtacgaggccgacagaagcttcagagacagagagccccacgactacagccaccaccaccaccaccaccaccaccccctgagcgtggaccccagaagagagcacgagagaggcggccacctggacgagagagagagactgcacatgctgagagaggactacgagcacaccagactgcacagcgtgcaccccgccagcctggacggccacctgccccaccccagcctgatcacccccggcctgcccagcatgcactaccccagaatcagccccaccgccggcaaccagaacggcctgctgaacaagaccccccccaccgccgccctgagcgcccccccccccctgatcagcaccctgggcggcagacccgtgagccccagaagaaccacccccctgagcgccgagatcagagagagaccccccagccacaccctgaaggacatcgaggccagatag

SEQ ID NO: 18199 - DNA, 801 bp, Artificial Sequence
  Description of Artificial Sequence: Synthetic coding sequence
atggacggccccaccagaggccacggcctgagaaagaagagaagaagcagaagccagagagacagagagagaagaagcagaggcggcctgggcgccggcgccgccggcggcggcggcgccggcagaaccagagccctgagcctggccagcagcagcggcagcgacaaggaggacaacggcaagccccccagcagcgcccccagcagacccagaccccccagaagaaagagaagagagagcaccagcgccgaggaggacatcatcgacggcttcgccatgaccagcttcgtgaccttcgaggccctggagaaggacgtggccctgaagccccaggagagagtggagaagagacagacccccctgaccaagaagaagagagaggccctgaccaacggcctgagcttccacagcaagaagagcagactgagccacccccaccactacagcagcgacagagagaacgacagaaacctgtgccagcacctgggcaagagaaagaagatgcccaaggccctgagacagctgaagcccggccagaacagctgcagagacagcgacagcgagagcgccagcggcgagagcaagggcttccacagaagcagcagcagagagagactgagcgacagcagcgcccccagcagcctgggcaccggctacttcagaagcggcaagatgtgcctgggcgaggaggcctgcctgaagagcggcaacgacatgaagagagacgtgagcaacaccagcagctgggccagcaacagagagagcttcttcagcctggtgaagctgctgaagggcttctag

SEQ ID NO: 18200 - DNA, 3708 bp, Artificial Sequence
  Description of Artificial Sequence: Synthetic coding sequence
atggacggccccaccagaggccacggcctgagaaagaagagaagaagcagaagccagagagacagagagagaagaagcagaggcggcctgggcgccggcgccgccggcggcggcggcgccggcagaaccagagccctgagcctggccagcagcagcggcagcgacaaggaggacaacggcaagccccccagcagcgcccccagcagacccagaccccccagaagaaagagaagagagagcaccagcgccgaggaggacatcatcgacggcttcgccatgaccagcttcgtgaccttcgaggccctggagaaggacgtggccctgaagccccaggagagagtggagaagagacagacccccctgaccaagaagaagagagaggccctgaccaacggcctgagcttccacagcaagaagagcagactgagccacccccaccactacagcagcgacagagagaacgacagaaacctgtgccagcacctgggcaagagaaagaagatgcccaaggccctgagacagctgaagcccggccagaacagctgcagagacagcgacagcgagagcgccagcggcgagagcaagggcttccacagaagcagcagcagagagagactgagcgacagcagcgcccccagcagcctgggcaccggctacttctgcgacagcgacagcgaccaggaggagaaggccagcgacgccagcagcgagaagctgttcaacaccgtgatcgtgaacaaggaccccgagctgggcgtgggcaccctgcccgagcacgacagccaggacgccggccccatcgtgcccaagatcagcggcctggagagaagccaggagaagagccaggactgctgcaaggagcccatcttcgagcccgtggtgctgaaggacccctgcccccaggtggcccagcccatcccccagccccagaccgagccccagctgagagcccccagccccgaccccgacctggtgcagagaaccgaggcccccccccagcccccccccctgagcacccagcccccccagggcccccccgaggcccagctgcagcccgccccccagccccaggtgcagagaccccccagaccccagagccccacccagctgctgcaccagaacctgccccccgtgcaggcccaccccagcgcccagagcctgagccagcccctgagcgcctacaacagcagcagcctgagcctgaacagcctgagcagcagcagaagcagcacccccgccaagacccagcccgcccccccccacatcagccaccaccccagcgccagccccttccccctgagcctgcccaaccacagccccctgcacagcttcacccccaccctgcagccccccgcccacagccaccaccccaacatgttcgccccccccaccgccctgcccccccccccccccctgaccagcggcagcctgcaggtggccggccaccccgccggcagcacctacagcgagcaggacatcctgagacaggagctgaacaccagattcctggccagccagagcgccgacagaggcgccagcctgggcccccccccctacctgagaaccgagttccaccagcaccagcaccagcaccagcacacccaccagcacacccaccagcacaccttcacccccttcccccacgccatcccccccaccgccatcatgcccacccccgccccccccatgttcgacaagtaccccaccaaggtggaccccttctacagacacagcctgttccacagctacccccccgccgtgagcggcatcccccccatgatcccccccaccggccccttcggcagcctgcagggcgccttccagcccaagctgaccgaccccttcagacccatgctgagaaagcccggcaagtggtgcgccatgcacgtgcacatcgcctggcagatctaccaccaccagcagaaggtgaagaagcagatgcagagcgacccccacaagctggacttcggcctgaagcccgagttcctgagcagaccccccggccccagcctgttcggcgccatccaccacccccacgacctggccagacccagcaccctgttcagcgccgccggcgccgcccaccccaccggcacccccttcggcccccccccccaccacagcaacttcctgaaccccgccgcccacctggagcccttcaacagacccagcaccttcaccggcctggccgccgtgggcggcaacgccttcggcggcctgggcaaccccagcgtgacccccaacagcatgttcggccacaaggacggccccagcgtgcagaacttcagcaacccccacgagccctggaacagactgcacagaaccccccccagcttccccaccccccccccctggctgaagcccggcgagctggagagaagcgccagcgccgccgcccacgacagagacagagacgtggacaagagagacagcagcgtgagcaaggacgacaaggagagagagagcgtggagaagagacacagcagccaccccagccccgcccccgtgctgcccgtgaacgccctgggccacaccagaagcagcaccgagcagatcagagcccacctgaacaccgaggccagagagaaggacaagcccaaggagagagagagagaccacagcgagagcagaaaggacctggccgccgacgagcacaaggccaaggagggccacctgcccgagaaggacggccacggccacgagggcagagccgccggcgaggaggccaagcagctggccagagtgcccagcccctacgtgagaacccccgtggtggagagcgccagacccaacagcaccagcagcagagaggccgagcccagaaagggcgagcccgcctacgagaaccccaagaagagcagcgaggtgaaggtgaaggaggagagaaaggaggaccacgacctgccccccgaggccccccagacccacagagccagcgagccccccccccccaacagcagcagcagcgtgcaccccggccccctggccagcatgcccatgaccgtgggcgtgaccggcatccaccccatgaacagcatcagcagcctggacagaaccagaatgatgacccccttcatgggcatcagccccctgcccggcggcgagagattcccctaccccagcttccactgggaccccatcagagaccccctgagagacccctacagagagctggacatccacagaagagaccccctgggcagagacttcctgctgagaaacgaccccctgcacagactgagcacccccagactgtacgaggccgacagaagcttcagagacagagagccccacgactacagccaccaccaccaccaccaccaccaccccctgagcgtggaccccagaagagagcacgagagaggcggccacctggacgagagagagagactgcacatgctgagagaggactacgagcacaccagactgcacagcgtgcaccccgccagcctggacggccacctgccccaccccagcctgatcacccccggcctgcccagcatgcactaccccagaatcagccccaccgccggcaaccagaacggcctgctgaacaagaccccccccaccgccgccctgagcgcccccccccccctgatcagcaccctgggcggcagacccgtgagccccagaagaaccacccccctgagcgccgagatcagagagagaccccccagccacaccctgaaggacatcgaggccagatag

SEQ ID NO: 18201 - DNA, 423 bp, Artificial Sequence
  Description of Artificial Sequence: Synthetic coding sequence
atggtgaccgccatggccctgagcaagagcaccaacagccacaagaacgccaccgaggacctgtacgaggtggacaagctgaagaaggagtgctacgagtggatcaacacctgcagctgcctgctgagcaacatcaagggcagaaagatcaccctgctgacctacgaggagatcgagagactgctggaggaggaggccgtgaaggagttcatcgagcccgagatcgacgagagcttcaaggaggacgaggaggagagcaaggaggacagaaagctgcaggaggagaacaaggagagagccgaggagcagcccagcaccagcaccgagaaggagaagctgatcagattcatcggcgaggacgagaacgtgcacagcaagcccctgttcgagaccgacgtgctgagcagctggaagaacatctag

SEQ ID NO: 18202 - DNA, 2691 bp, Artificial Sequence
  Description of Artificial Sequence: Synthetic coding sequence
atggtggacagaagcaagctgctgcccaccagcctgcagaacgagttcatccccaaggaggtgctgctgagcctgacctacgccgccaacgccggcccctgccccgagaacctgctgccccccaagaagatcaagacccccaagggcaccctgcccagactggtggaccacgtgtggcaccaccccgtgagaagaaacaagttcaagtacctgatcgaccaccccgtgagcctgaccggcgccggcagagacatcagcttcctgtacgacgtgacctacgccaagggccagaccagagagaaggccgtgtgccccccccacctggccagaagcctgcagagccacgacggcgtgatcgtgccccacaagcccaagaccctgaccgacaccctgatccccgaggagttccacatcgtgagcagcaccggcgtgagcggcctggagtgctacgacgacaagtacaccaccctgctgaccgacagcgagaacagactgctgctgttccccagcatgaagcccaacaagagagtggaggtggcccagctgaacgacgtgatggacaccatgctggagagagccggcgtggagaaccaggagtacaccggccccaccaagatgcacaagctgctgcacatcctgaagaaggagcagaccatctacaacatgatcttccacgagctgatcagacaggtgagcgtggactgcgccgacagaggcgagctgctgagcaaggtgagagagagatacgtgcagatgctggaccagatcgccagacagatgatcgacttctacaaggacctggtgacccagagagtgatggaccagagaatcctggaggagctgtacaacttcaagcacgtgatcgaggagctgaccagagagctgtgcctggtgagagcccacgacgtgaagctgaccaaggagaccgagaaggcccacaaggacctggcccaggccctgctgaacgccgagaagaacgccaagatcgtggaggagtaccacgacctgtacaccctgcagagagagagaatggagaacgacatgaagaagctggtggccgagagagacatctggagcagcgccacctacgagctggccctgaaggtgatcgagagaaacagagtgatcctggccagaagactgtacctgaacgagaagggctggaacaagtacaccaagcacttcatcatcctgctgagcaacaaggacaccgaggacctggccctgctgcagaagctgacccagaagtggagaaacctggtgaacaagctgaagcaggaggtggagcagatggaggagagcaccagcgagaccctgaagatcgtgaaggacggcctgatcaagtggcaggagttcttcaacgagaaggacatcctgagccccaacaagggcaacatcttcaacagcgtgctgctggacttcaagcagtggcagaagatcctgaacgagaagaaggaggagttcaccggcgacgtgctgctgagcaagtacgacaccctgaagatcatcaagcacctgcaggagaactgggccgacatcggcctgggcatcttcaacagacacaagagcctggagggcgagatgcccagcgagagacagtacatggaggagatcatcaagaacatccagaagctgtacaaggagtacgagatcagaatcaacggcgacaacggctacagcaagatcctgcccagcctgatcagcagcctggacttctgcagcttcaagctggagaacctggagttccccgacacccccctggaggagtggcaggagatcgacgagaagatcaacgagatgaagagccacctggacatcctgctgaacctgaccggcatcgtgccccagcacatcgacgtggacagcgtgagcgtgctgcaggcctacatcttcaacatgatccagcagtggctgctgaagatcggcaacgagatcaacaacggcaacatcgagctgcagcaccacatggacgagctgcacatcagcatgatccagtggatggtgaacctgctgatcctgatgatccccaacttcaccgaccaggactgcctgctgaagctggaggaggagagcgccgagaagcacgacatcggcgtggccagactggagctggacgccatcgagctgaccagaaagctgtaccagtacagcagctacctgagcagctgctgcaagggcatggtgaccgccatggccctgagcaagagcaccaacagccacaagaacgccaccgaggacctgtacgaggtggacaagctgaagcagcccagcaccagcaccgagaaggagaagctgatcagattcatcggcgaggacgagaacgtgcacagcaagcccctgttcgagaccgacgtgctgagcagctggagagagagcgccaagcagggcaccctggcccagaagtacctggaggccatggccgtgatcgagcacatgcaggagaagctgctggaggtggagaacagagccagacaggccgaggagaagttcgaggacgcctacgagaagctgcaccacaccctgatcaagaacaaggacctggaggagctggtgatgaccagcagaaaggagagcaaggaggagaaggagaaccaggacgagagagaggtgaaggaggaggaggagcagcaggaggaggaggaggtgagaagcgccgagaacagcagcaagagccccaagaagggccactag

SEQ ID NO: 18203 - DNA, 3039 bp, Artificial Sequence
  Description of Artificial Sequence: Synthetic coding sequence
atgagcctgcccaagacccccagcacccccctgaacagcaccagcaccagcgagagcaagaagctgaaggtgagcgtggccaaggagggcaccagaggcctgcccgagctgaaggagaagaagaacatggtggacagaagcaagctgctgcccaccagcctgcagaacgagttcatccccaaggaggtgctgctgagcctgacctacgccgccaacgccggcccctgccccgagaacctgctgccccccaagaagatcaagacccccaagggcaccctgcccagactggtggaccacgtgtggcaccaccccgtgagaagaaacaagttcaagtacctgatcgaccaccccgtgagcctgaccggcgccggcagagacatcagcttcctgtacgacgtgacctacgccaagggccagaccagagagaaggccgtgtgccccccccacctggccagaagcctgcagagccacgacggcgtgatcgtgccccacaagcccaagaccctgaccgacaccctgatccccgaggagttccacatcgtgagcagcaccggcgtgagcggcctggagtgctacgacgacaagtacaccaccctgctgaccgacagcgagaacagactgctgctgttccccagcatgaagcccaacaagagagtggaggtggcccagctgaacgacgtgatggacaccatgctggagagagccggcgtggagaaccaggagtacaccggccccaccaagatgcacaagctgctgcacatcctgaagaaggagcagaccatctacaacatgatcttccacgagctgatcagacaggtgagcgtggactgcgccgacagaggcgagctgctgagcaaggtgagagagagatacgtgcagatgctggaccagatcgccagacagatgatcgacttctacaaggacctggtgacccagagagtgatggaccagagaatcctggaggagctgtacaacttcaagcacgtgatcgaggagctgaccagagagctgtgcctggtgagagcccacgacgtgaagctgaccaaggagaccgagaaggcccacaaggacctggcccaggccctgctgaacgccgagaagaacgccaagatcgtggaggagtaccacgacctgtacaccctgcagagagagagaatggagaacgacatgaagaagctggtggccgagagagacatctggagcagcgccacctacgagctggccctgaaggtgatcgagagaaacagagtgatcctggccagaagactgtacctgaacgagaagggctggaacaagtacaccaagcacttcatcatcctgctgagcaacaaggacaccgaggacctggccctgctgcagaagctgacccagaagtggagaaacctggtgaacaagctgaagcaggaggtggagcagatggaggagagcaccagcgagaccctgaagatcgtgaaggacggcctgatcaagtggcaggagttcttcaacgagaaggacatcctgagccccaacaagggcaacatcttcaacagcgtgctgctggacttcaagcagtggcagaagatcctgaacgagaagaaggaggagttcaccggcgacgtgctgctgagcaagtacgacaccctgaagatcatcaagcacctgcaggagaactgggccgacatcggcctgggcatcttcaacagacacaagagcctggagggcgagatgcccagcgagagacagtacatggaggagatcatcaagaacatccagaagctgtacaaggagtacgagatcagaatcaacggcgacaacggctacagcaagatcctgcccagcctgatcagcagcctggacttctgcagcttcaagctggagaacctggagttccccgacacccccctggaggagtggcaggagatcgacgagaagatcaacgagatgaagagccacctggacatcctgctgaacctgaccggcatcgtgccccagcacatcgacgtggacagcgtgagcgtgctgcaggcctacatcttcaacatgatccagcagtggctgctgaagatcggcaacgagatcaacaacggcaacatcgagctgcagcaccacatggacgagctgcacatcagcatgatccagtggatggtgaacctgctgatcctgatgatccccaacttcaccgaccaggactgcctgctgaagctggaggaggagagcgccgagaagcacgacatcggcgtggccagactggagctggacgccatcgagctgaccagaaagctgtaccagtacagcagctacctgagcagctgctgcaagggcatggtgaccgccatggccctgagcaagagcaccaacagccacaagaacgccaccgaggacctgtacgaggtggacaagctgaagaaggagtgctacgagtggatcaacacctgcagctgcctgctgagcaacatcaagggcagaaagatcaccctgctgacctacgaggagatcgagagactgctggaggaggaggccgtgaaggagttcatcgagcccgagatcgacgagagcttcaaggaggacgaggaggagagcaaggaggacagaaagctgcaggaggagaacaaggagagagccgaggagcagcccagcaccagcaccgagaaggagaagctgatcagattcatcggcgaggacgagaacgtgcacagcaagcccctgttcgagaccgacgtgctgagcagctggagagagagcgccaagcagggcaccctggcccagaagtacctggaggccatggccgtgatcgagcacatgcaggagaagctgctggaggtggagaacagagccagacaggccgaggagaagttcgaggacgcctacgagaagctgcaccacaccctgatcaagaacaaggacctggaggagctggtgatgaccagcagaaaggagagcaaggaggagaaggagaaccaggacgagagagaggtgaaggaggaggaggagcagcaggaggaggaggaggtgagaagcgccgagaacagcagcaagagccccaagaagggccactag

SEQ ID NO: 18204 - DNA, 1968 bp, Artificial Sequence
  Description of Artificial Sequence: Synthetic coding sequence
atgagcctgcccaagacccccagcacccccctgaacagcaccagcaccagcgagagcaagaagctgaaggtgagcgtggccaaggagggcaccagaggcctgcccgagctgaaggagaagaagaacatggtggacagaagcaagctgctgcccaccagcctgcagaacgagttcatccccaaggaggtgctgctgagcctgacctacgccgccaacgccggcccctgccccgagaacctgctgccccccaagaagatcaagacccccaagggcaccctgcccagactggtggaccacgtgtggcaccaccccgtgagaagaaacaagttcaagtacctgatcgaccaccccgtgagcctgaccggcgccggcagagacatcagcttcctgtacgacgtgacctacgccaagggccagaccagagagaaggccgtgtgccccccccacctggccagaagcctgcagagccacgacggcgtgatcgtgccccacaagcccaagaccctgaccgacaccctgatccccgaggagttccacatcgtgagcagcaccggcgtgagcggcctggagtgctacgacgacaagtacaccaccctgctgaccgacagcgagaacagactgctgctgttccccagcatgaagcccaacaagagagtggaggtggcccagctgaacgacgtgatggacaccatgctggagagagccggcgtggagaaccaggagtacaccggccccaccaagatgcacaagctgctgcacatcctgaagaaggagcagaccatctacaacatgatcttccacgagctgatcagacaggtgagcgtggactgcgccgacagaggcgagctgctgagcaaggtgagagagagatacgtgcagatgctggaccagatcgccagacagatgatcgacttctacaaggacctggtgacccagagagtgatggaccagagaatcctggaggagctgtacaacttcaagcacgtgatcgaggagctgaccagagagctgtgcctggtgagagcccacgacgtgaagctgaccaaggagaccgagaaggcccacaaggacctggcccaggccctgctgaacgccgagaagaacgccaagatcgtggaggagtaccacgacctgtacaccctgcagagagagagaatggagaacgacatgaagaagctggtggccgagagagacatctggagcagcgccacctacgagctggccctgaaggtgatcgagagaaacagagtgatcctggccagaagactgtacctgaacgagaagggctggaacaagtacaccaagcacttcatcatcctgctgagcaacaaggacaccgaggacctggccctgctgcagaagctgacccagaagtggagaaacctggtgaacaagctgaagcaggaggtggagcagatggaggagagcaccagcgagaccctgaagatcgtgaaggacggcctgatcaagtggcaggagttcttcaacgagaaggacatcctgagccccaacaagggcaacatcttcaacagcgtgctgctggacttcaagcagtggcagaagatcctgaacgagaagaaggaggagttcaccggcgacgtgctgctgagcaagtacgacaccctgaagatcatcaagcacctgcaggagaactgggccgacatcggcctgggcatcttcaacagacacaagagcctggagggcgagatgcccagcgagagacagtacatggaggagatcatcaagaacatccagaagctgtacaaggagtacgagatcagaatcaacggcgacaacgagaccggcagccacagagtggcccaggccggcctgaagctgctgggcagcagcgaccaccccaccagcgccccccagagcgccggcatcagaggcatcatccacagaacctggccctgggtgaacttctacatcgtgtgcgaggtgacccccaagttcttccaggtgtag

SEQ ID NO: 18205 - DNA, 237 bp, Artificial Sequence
  Description of Artificial Sequence: Synthetic coding sequence
atgagcctgcccaagacccccagcacccccctgaacagcaccagcaccagcgagagcaagaagctgaaggtgagcgtggccaaggagggcaccagaggcctgcccgagctgaaggagaagaagaacatggtggacagaagcaagctgctgcccaccagcctgcagaacgagttcatccccaaggaggtgctgctgagcctgacctacgccgccaacgccggcccctgccccgagtag

SEQ ID NO: 18206 - DNA, 378 bp, Artificial Sequence
  Description of Artificial Sequence: Synthetic coding sequence
atgagcctgcccaagacccccagcacccccctgaacagcaccagcaccagcgagagcaagaagctgaaggtgagcgtggccaaggagggcaccagaggcctgcccgagctgaaggagaagaagaacatggtggacagaagcaagctgctgcccaccagcctgcagaacgagttcatccccaaggaggtgctgctgagcctgacctacgccgccaacgccggcccctgccccgagaacctgctgccccccaagaagatcaagacccccaagggcaccctgcccagactggtggaccacgtgtggcaccaccccgtgagaagaaacaagttcaagtacctgatcgaccaccccgtgagcctgaccggcgccggcagatag

SEQ ID NO: 18207 - DNA, 120 bp, Artificial Sequence
  Description of Artificial Sequence: Synthetic coding sequence
atggccgccggcgccgtgttcctggccctgagcgcccagctgctgcaggccagactgatgaaggaggagagccccgtggtgagctggagactggagcccgaggacggcaccgccctgtag

SEQ ID NO: 18208 - DNA, 147 bp, Artificial Sequence
  Description of Artificial Sequence: Synthetic coding sequence
atggccgccggcgccgtgttcctggccctgagcgcccagctgctgcaggccagactgatgaaggaggtgagccccgtggtgagctggagactggagcccgaggacggcaccgccctgagcggcgtgagcctgtgcagacccggctag

SEQ ID NO: 18209 - DNA, 582 bp, Artificial Sequence
  Description of Artificial Sequence: Synthetic coding sequence
atgcccctgccctgggactaccccgaggccccctggagaagactgcacagcagcccccccagaccctgccccagagccctgcagggcggcggcagaagaggccccaaccccgaccccagaggcagcaagggcctgaagcagaccgtgggcgccctgaaccccaacctgcacctgtggggcatctgcagctgccagttcctgctgagaagcaagggcagagacttcgtgcacagcgtgcaggagacccacagccagctgctgggcagctgggacccctgggaggagcccgaggacgccgcccccgtggcccccagcgtgcccgccagcggctaccccgagctgcccacccccagaagagaggtgcagagcgagagcgcccaggagcccggcgccagagacgtggaggcccagctgagaagactgcaggaggagagaacctgcaaggtgtgcctggacagagccgtgagcatcgtgttcgtgccctgcggccacctggtgtgcgccgagtgcgcccccggcctgcagctgtgccccatctgcagagcccccgtgagaagcagagtgagaaccttcctgagctag

SEQ ID NO: 18210 - DNA, 7827 bp, Artificial Sequence
  Description of Artificial Sequence: Synthetic coding sequence
atggacggcagagacttcgccccccccccccacctgctgagcgagagaggcagcctgggccacagaagcgccgccgccgccgccagactggcccccgccggccccgccgcccagccccccgcccacttccagcccggcaagtacttccccagccccctgcccatggccagccacaccggcagcgccagaaagatgggcagctgccccgcccccagcttcctgcccagcttcctggagagacccctgtaccccgcccccaccaagaccgtgagcggccccagcctgagaccccccaccgccgccatcagaagccccacccccgactgcgcccagaagtggagccagaacgcccacgaggcccccggctaccccagattcagcggcagcctggccagcaccttcctgcccgtgagccacctggaccaccacggcaacagcaacgtgctgtacggccagcacagattctacggcacccagaaggacaacttctacctgagaaacctgcccccccagcccaccctgctgcccgccaaccacaacttccccagcgtggccagagccgcccccgcccaccccatgggcagctgcagcagagacagagacagaggcgaggccggcagcctgcagaagggccccaaggacttcgacagattcctggtgggcaaggagctgggcagagagaaggccggcaaggccgccgagggcaaggagagacccgccgccgaggaggacggcggcaaggagagacacaagctggtgctgcccgtgcccgccgacggccactgcagagagggcggccccgcccccagaggcgcctgcgagggcagacccaagcacctgaccagctgcctgctgaacaccaaggtgctgaacggcgagatgggcagagccgccctggccagctgcgccggcggcatgctgggcagacccggcaccggcgtggtgaccagcggcagatgcgccaaggaggccgccggcccccccgagcccggccccgccttcagcgagtgcctggagagaagacagatgctgcaccacaccgccagctacgccggcccccccccccccctgagcaccgccgccggcagcttcccctgcctgcagctgcacggcggccccgacggcctgtgccccctgcaggacaaggcccccagagacctgaaggccagcggccccaccttcgtgcccagcgtgggccacctggccgacaagggcagacccttccaggccgccgaggcctgcgccgtggccggcgagggcaaggacagacacctggagggcaccatggcccccgaccacgccgccccctacggcgtgagctacgcccacctgaaggccgagggcaagggcgagagaagacccggcggcttcgaggccgccctgaaccccagactgaagggcctggactacctgagcagcgccggccccgaggccagcttccccggcctgcccaagagcggcctggacaagagcggctacttcgagctgcccaccagcagccaggactgcgccagacccggccaccaggaccccctgggcggcaaggccccccaggcctgctgcaccctggacaagaccgtgggcaaggaggcccccgccggcccccccggcgcccagaaggtggccagaatcagacaccagcagcacctgatggccgccgaggtggagcagggcggcatcggcgccgaggccaagagaaagagcctggagctggccagcctgggctacagcggcccccacctgcccccctggggcgtgcaggccggccagggcaccgccatggccatcagcgaggagagaaaggccggcgcctacctggaccccttcggcagcggcctgcagcaggccgccctgctgccccaggagctgcccgccccccccgacgaggtgagcgccatgaagaacctgctgaagtacagcagccaggccctggtggtgggccagaaggcccccctggtgggcctgggcggcctgaaggccagctgcatccagcaggaggccaagttcctgagcagcaagggccccggccagagcgagagacccgactgcgccagaagcagagagcacgacaccacccacggcgacggcgaggtgagacagccccccgtgggcatcgccgtggccctggccagacagaaggacaccgtgagcagaagcgaggccgcctacggcaccaacaccgccagacagggcagagccgcccccgccttcaagggcggcggcggccccagaagcacccacgccctggacctggaggccgaggaggagagaaccagactgtgcgacgacagactgggcctggccagcagagagctgctgctgcaggacagcaaggacagagtggagttcgccagaatccacccccccagcagctgccccggcgacctggccccccacctgatgatgcagagcggccagctgggcggcgaccccgccccccacacccacccccaccccccctggctgcccagaaccagaagccccagcctgtggatgggcggccacagctacggcctgggccaccccgccctgcaccagaacctgccccccggcttccccgccagcgtggccggccccgtgcccagcgtgttccccctgccccaggacgcccccacccagctggtgatcctgcccagcgagcccaccccccacagcgccccccacgccctggccgacgtgatggaccaggccagcctgtggccccccatgtacggcggcagaggccccgccagccacatgcagcaccccggccagctgcccgtgtacagcagaccccagctgctgagacagcaggagctgtacgccctgcagcagcagagagccgcccagttccagagaaagcccgaggaccagcacctggacctggaggagcccgcccaggagaaggcccccaagagcacccacaagcccgtggccctgacccccaccgcccccggcgcccccagccccgccgccggccccaccaagctgcccccctgctgccacccccccgaccccaagccccccgccagcagccccacccccccccccagacccagcgccccctgcaccctgaacgtgtgccccgccagcagccccggccccggcagcagagtgagaagcgccgaggagaagaacggcgagggccagcagagcaccgccgacatcatcaccagcgagcccgacctgccccccggctacctgagacccatggccggcctgggcttcagcctgcccagcgacgtgcacagcagcaacctggaggaccccgagaccatgcagaccaccgcccccggcgcccagcccgagcccaccagaaccttcctgcccggcgagccccccccctgcagccccagaagcctggaggagcccggcctgctgagcggcgccagagaggccacccaggacctggccgccaccccctaccccaccgagagaggcccccagggcaaggccgccgaccccagccccctggagggcctgcaggagctgcagtgcgccgccctgctggaggccggcggccccgaggccaccggccaggcccacagcacccagggcggcgccagagaggagagaagcagagaggagggcgagcagggccccagcagcggcgccagcagccaggtgctggagcagagagccggcagccccggcgccctggaggacgagggcgagcagcccgcccccgaggaggacgagctggaggaggacgagctgggccagcagagcatggaggacagcgaggaggactgcggcggcgcccccgacaacagccacccccccagagccctgcccggcctggacgccctggtggccgccaccatcaacctgggcgacctgcccagcgacagcccccccgacccccagccccccgccgccagcggcccccccagcaccgtgcccctgccccacagcagcggcatccacggcatcgccctgctgagcgagctggccgacctggccatccagagacagagaagcgagagaaccgtgcccgaggaggaggaggacgtgctggccttcaacctgcagcacctggccaccctggccaccgcctggagcctggtggaggccgccggcctggacagcagcaccgcccccgcccagccccccaccgccaacccctgcagcggccccagactgacccccagaatgcagatcctgcagagaaaggacacctggacccccaagaccaagcccgtgtgccccctgaaggccgccatcgacagactggacacccaggaggtgggcatgagagtgagactggccgagctgcagagaagatacaaggagaagcagagagagctggccagactgcagagaaagcacgaccacgagagagacgagagcagcagaagccccgccagaagaggccccggcagacccagaaagagaaagcacagcagcagcctgcccgcccccagacccaccggccccctgcccagaagcgacggcaagaaggtgaaggccgtgagaaccagcctgggcctgctgtgcgccgagctgagaggcggcagcggcggcgagcccgccaagaagagaagcaagctggagagaagcgtgtacgccggcctgcagaccgccagcgtggagaaggcccagtgcaagaagagcagctgccagggcggcctggcccccagcgtggcccacagagtggcccagctgaagcccaaggtgaagagcaagggcctgcccaccggcctgagcagcttccagcagaaggaggccacccccggcggcagaatcagagagaagctgagcagagccaagagcgccaaggtgagcggcgccaccagacacccccagcccaagggccacggcagcagagagacccccagatgccccgcccagcccagcgtggccgccagccaggaggccggcagcggctacgacagcgaggactgcgagggcctgctgggcaccgaggccccccccagagaggccggcctgctgctgcacaccggcgccagcgtggccgtgctgggccccagccccagcagcgtggtgaagatggaggccaaccagaaggccaagaagaagaaggagagacagggcctgctgggcgcctgcagactgagcagccccgagagcgaggtgaagatcaagagaagaagcgtgaaggccaaggtgggcaccaccctggagagagcccccggccagagaccccccggcgccctgggcaagaagaaggccaagggcaaggccaagggcagcctgagagccgagcccggcgccacccccagcagagacgccctgttcaaccccagcagagccttcgcctgcagagaggagggcagccagctggccagcgagagactgaagagagccaccagaaagggcaccgtgctgcagcccgtgctgagaagaaagaacggcgccctgagcatcaccctggccaccagaaacgccaaggccatcctgggcaagggcagaaagctgagcaaggtgaagcacaaggccggcaagcagggcaagggcagagccgtgagcagactgctggagagcttcgccgtggaggaggacttcgagttcgacgacaacagcagcttcagcgaggaggaggaggacgaggaggaggaggaggaggacagcggccccctgagcgccgagcagagcgccgccctggccagaagctgcgccatccacaaggaggacctgagagacggcctgcccgtgctgatccccaaggaggacagcctgctgtacgccggcagcgtgagaaccctgcagccccccgacatctacagcatcgtgatcgagggcgagagaggcaacagacagagaatctacagcctggagcagctgctgcaggaggccgtgctggacgtgagaccccagagcagcagatacctgccccccggcaccagagtgtgcgcctactggagccagaagagcagatgcctgtaccccggcaacgtggtgagaggcgccagcggcgacgaggacgaggacctggacagcgtggtggtggagttcgacgacggcgacaccggccacatcgccgtgagcaacgtgagactgctgccccccgacttcaagatccagtgcaccgagcccagccccgccctgctggtgagcagcagctgcagaagaaccaagaaggtgagcagcgaggcccccccccccagcgaggccgccacccccagcctgagccccaaggcccaggacggccccgaggccctgaagacccccggcaagaagagcatcagcaaggacaaggccggcaaggccgagctgctgaccagcggcgccaagagccccaccggcgccagcgaccacttcctgggcagaagaggcagccccctgctgagctggagcgccgtggcccagaccaagagaaaggccgtggccgccgccagcaagggccccggcgtgctgcagaacctgttccagctgaacggcagcagcaagaagctgagagccagagaggccctgttccccgtgcacagcgtggccacccccatcttcggcaacggcttcagagccgacagcttcagcagcctggccagcagctacgcccccttcgtgggcggcaccggccccggcctgcccagaggcgcccacaagctgctgagagccaagaaggccgagagagtggaggccgagaagggcggcagaagaagagccggcggcgagttcctggtgaagctggaccacgagggcgtgaccagccccaagaacaagacctgcaaggccctgctgatgggcgacaaggacttcagccccaagctgggcagacccctgcccagccccagctacgtgcaccccgccctggtgggcaaggacaagaagggcagagcccccatcccccccctgcccatgggcctggccctgagaaagtacgccggccaggccgagttccccctgccctacgacagcgactgccacagcagcttcagcgacgaggacgaggacggccccggcctggccgccggcgtgcccagcagattcctggccagactgagcgtgagcagcagcagcagcggcagcagcaccagcagcagcagcggcagcgtgagcaccagcagcctgtgcagcagcgacaacgaggacagcagctacagcagcgacgacgaggaccccgccctgctgctgcagacctgcctgacccaccccgtgcccaccctgctggcccagcccgaggccctgagaagcaagggcagcggcccccacgcccacgcccagagatgcttcctgagcagagccaccgtggccggcaccggcgccggcagcggccccagcagcagcagcaagagcaagctgaagagaaaggaggccctgagcttcagcaaggccaaggagctgagcagaagacagagaccccccagcgtggagaacagacccaagatcagcgccttcctgcccgccagacagctgtggaagtggagcggcaaccccacccagagaagaggcatgaagggcaaggccagaaagctgttctacaaggccatcgtgagaggcgaggagaccctgagagtgggcgactgcgccgtgttcctgagcgccggcagacccaacctgccctacatcggcagaatcgagagcatgtgggagagctggggcagcaacatggtggtgaaggtgaagtggttctaccaccccgaggagaccaagctgggcaagagacagtgcgacggcaagaacgccctgtaccagagctgccacgaggacgagaacgacgtgcagaccatcagccacaagtgccaggtggtggccagagagcagtacgagcagatggccagaagcagaaagtgccaggacagacaggacctgtactacctggccggcacctacgaccccaccaccggcagactggtgaccgccgacggcgtgcccatcctgtgctag

SEQ ID NO: 18211 - DNA, 1260 bp, Artificial Sequence
  Description of Artificial Sequence: Synthetic coding sequence
atgaacaagcaccagaagcccgtgctgaccggccagagattcaagaccagaaagagagacgagaaggagaagttcgagcccaccgtgttcagagacaccctggtgcagggcctgaacgaggccggcgacgacctggaggccgtggccaagttcctggacagcaccggcagcagactggactacagaagatacgccgacaccctgttcgacatcctggtggccggcagcatgctggcccccggcggcaccagaatcgacgacggcgacaagaccaagatgaccaaccactgcgtgttcagcgccaacgaggaccacgagaccatcagaaactacgcccaggtgttcaacaagctgatcagaagatacaagtacctggagaaggccttcgaggacgagatgaagaagctgctgctgttcctgaaggccttcagcgagaccgagcagaccaagctggccatgctgagcggcatcctgctgggcaacggcaccctgcccgccaccatcctgaccagcctgttcaccgacagcctggtgaaggagggcatcgccgccagcttcgccgtgaagctgttcaaggcctggatggccgagaaggacgccaacagcgtgaccagcagcctgagaaaggccaacctggacaagagactgctggagctgttccccgtgaacagacagagcgtggaccacttcgccaagtacttcaccgacgccggcctgaaggagctgagcgacttcctgagagtgcagcagagcctgggcaccagaaaggagctgcagaaggagctgcaggagagactgagccaggagtgccccatcaaggaggtggtgctgtacgtgaaggaggagatgaagagaaacgacctgcccgagaccgccgtgatcggcctgctgtggacctgcatcatgaacgccgtggagtggaacaagaaggaggagctggtggccgagcaggccctgaagcacctgaagcagtacgcccccctgctggccgtgttcagcagccagggccagagcgagctgatcctgctgcagaaggtgcaggagtactgctacgacaacatccacttcatgaaggccttccagaagatcgtggtgctgttctacaaggccgacgtgctgagcgaggaggccatcctgaagtggtacaaggaggcccacgtggccaagggcaagagcgtgttcctggaccagatgaagaagttcgtggagtggctgcagaacgccgaggaggagagcgagagcgagggcgaggagaactag

SEQ ID NO: 18212 - DNA, 1227 bp, Artificial Sequence
  Description of Artificial Sequence: Synthetic coding sequence
atgaacaagcaccagaagcccgtgctgaccggccagagattcaagaccagaaagagagacgagaaggagaagttcgagcccaccgtgttcagagacaccctggtgcagggcctgaacgaggccggcgacgacctggaggccgtggccaagttcctggacagcaccggcagcagactggactacagaagatacgccgacaccctgttcgacatcctggtggccggcagcatgctggcccccggcggcaccagaatcgacgacggcgacaagaccaagatgaccaaccactgcgtgttcagcgccaacgaggaccacgagaccatcagaaactacgcccaggtgttcaacaagctgatcagaagatacaagtacctggagaaggccttcgaggacgagatgaagaagctgctgctgttcctgaaggccttcagcgagaccgagcagaccaagctggccatgctgagcggcatcctgctgggcaacggcaccctgcccgccaccatcctgaccagcctgttcaccgacagcctggtgaaggagggcatcgccgccagcttcgccgtgaagctgttcaaggcctggatggccgagaaggacgccaacagcgtgaccagcagcctgagaaaggccaacctggacaagagactgctggagctgttccccgtgaacagacagagcgtggaccacttcgccaagtacttcaccgacgccggcctgaaggagctgagcgacttcctgagagtgcagcagagcctgggcaccagaaaggagctgcagaaggagctgcaggagagactgagccaggagtgccccatcaaggaggtggtgctgtacgtgaaggaggagatgaagagaaacgacctgcccgagaccgccgtgatcggcctgctgtggacctgcatcatgaacgccgtggagtggaacaagaaggaggagctggtggccgagcaggccctgaagcacctgaagcagtacgcccccctgctggccgtgttcagcagccagggccagagcgagctgatcctgctgcagaaggtgcaggagtactgctacgacaacatccacttcatgaaggccttccagaagatcgtggtgctgttctacaaggccgacgtgctgagcgaggaggccatcctgaagtggtacaaggaggcccacgtggccaagggcaagagcgtgttcctggaccagatgaagaagttcgtggagtggctgcagaacgcctag

SEQ ID NO: 18213 - DNA, 492 bp, Artificial Sequence
  Description of Artificial Sequence: Synthetic coding sequence
atgaacaagcaccagaagcccgtgctgaccggccagagattcaagaccagaaagagagacgagaaggagaagttcgagcccaccgtgttcagagacaccctggtgcagggcctgaacgaggccggcgacgacctggaggccgtggccaagttcctggacagcaccggcagcagactggactacagaagatacgccgacaccctgttcgacatcctggtggccggcagcatgctggcccccggcggcaccagaatcgacgacggcgacaagaccaagatgaccaaccactgcgtgttcagcgccaacgaggaccacgagaccatcagaaactacgcccaggtgttcaacaagctgatcagaagatacaagtacctggagaaggccttcgaggacgagatgaagaagctgctgctgttcctgaaggccttcagcgagaccgagcagaccaagctggccatgctgagcggcatcctgctgggcaacggcacctag

SEQ ID NO: 18214 - DNA, 1260 bp, Artificial Sequence; identical to SEQ ID NO: 18211
  Description of Artificial Sequence: Synthetic coding sequence

SEQ ID NO: 18215 - DNA, 627 bp, Artificial Sequence
  Description of Artificial Sequence: Synthetic coding sequence
atgaacaagcaccagaagcccgtgctgaccggccagagattcaagaccagaaagagagacgagaaggagaagttcgagcccaccgtgttcagagacaccctggtgcagggcctgaacgaggccggcgacgacctggaggccgtggccaagttcctggacagcaccggcagcagactggactacagaagatacgccgacaccctgttcgacatcctggtggccggcagcatgctggcccccggcggcaccagaatcgacgacggcgacaagaccaagatgaccaaccactgcgtgttcagcgccaacgaggaccacgagaccatcagaaactacgcccaggtgttcaacaagctgatcagaagatacaagtacctggagaaggccttcgaggacgagatgaagaagctgctgctgttcctgaaggccttcagcgagaccgagcagaccaagctggccatgctgagcggcatcctgctgggcaacggcaccctgcccgccaccatcctgaccagcctgttcaccgacagcctggtgaaggagggcatcgccgccagcttcgccgtgaagctgttcaaggcctggatggccgagaaggacgccaacagcgtgaccagcagcctgagatag

SEQ ID NO: 18216 - DNA, 825 bp, Artificial Sequence
  Description of Artificial Sequence: Synthetic coding sequence
atgaacaagcaccagaagcccgtgctgaccggccagagattcaagaccagaaagagagacgagaaggagaagttcgagcccaccgtgttcagagacaccctggtgcagggcctgaacgaggccggcgacgacctggaggccgtggccaagttcctggacagcaccggcagcagactggactacagaagatacgccgacaccctgttcgacatcctggtggccggcagcatgctggcccccggcggcaccagaatcgacgacggcgacaagaccaagatgaccaaccactgcgtgttcagcgccaacgaggaccacgagaccatcagaaactacgcccaggtgttcaacaagctgatcagaagatacaagtacctggagaaggccttcgaggacgagatgaagaagctgctgctgttcctgaaggccttcagcgagaccgagcagaccaagctggccatgctgagcggcatcctgctgggcaacggcaccctgcccgccaccatcctgaccagcctgttcaccgacagcctggtgaaggagggcatcgccgccagcttcgccgtgaagctgttcaaggcctggatggccgagaaggacgccaacagcgtgaccagcagcctgagaaaggccaacctggacaagagactgctggagctgttccccgtgaacagacagagcgtggaccacttcgccaagtacttcaccgacgccggcctgaaggagctgagcgacttcctgagagtgcagcagagcctgggcaccagaaaggagctgcagaaggagctgcaggagagactgagccaggagtgccccatcaaggagtag

SEQ ID NO: 18217 - DNA, 486 bp, Artificial Sequence
  Description of Artificial Sequence: Synthetic coding sequence
atgaacaagcaccagaagcccgtgctgaccggccagagattcaagaccagaaagagagacgagaaggagaagttcgagcccaccgtgttcagagacaccctggtgcagggcctgaacgaggccggcgacgacctggaggccgtggccaagttcctggacagcaccggcagcagactggactacagaagatacgccgacaccctgttcgacatcctggtggccggcagcatgctggcccccggcggcaccagaatcgacgacggcgacaagaccaagatgaccaaccactgcgtgttcagcgccaacgaggaccacgagaccatcagaaactacgcccaggtgttcaacaagctgatcagaagatacaagtacctggagaaggccttcgaggacgagatgaagaaggccctgagaccccacctgctgagcagcttcagcaagcacggctggcagaagaagatgcccaccctgctgcccagactgtag

SEQ ID NO: 18218 - DNA, 477 bp, Artificial Sequence
  Description of Artificial Sequence: Synthetic coding sequence
atgaaccaggagaagctggccaagctgcaggcccaggtgagaatcggcggcaagggcaccgccagaagaaagaagaaggtggtgcacagaaccgccaccgccgacgacaagaagctgcagagcagcctgaagaagctggccgtgaacaacatcgccggcatcgaggaggtgaacatgatcaaggacgacggcaccgtgatccacttcaacaaccccaaggtgcaggccagcctgagcgccaacaccttcgccatcaccggccacgccgaggccaagcccatcaccgagatgctgcccggcatcctgagccagctgggcgccgacagcctgaccagcctgagaaagctggccgagcagttccccagacaggtgctggacagcaaggcccccaagcccgaggacatcgacgaggaggacgacgacgtgcccgacctggtggagaacttcgacgaggccagcaagaacgaggccaactag

SEQ ID NO: 18219 - DNA, 303 bp, Artificial Sequence
  Description of Artificial Sequence: Synthetic coding sequence
atgatcaaggacgacggcaccgtgatccacttcaacaaccccaaggtgcaggccagcctgagcgccaacaccttcgccatcaccggccacgccgaggccaagcccatcaccgagatgctgcccggcatcctgagccagctgggcgccgacagcctgaccagcctgagaaagctggccgagcagttccccagacaggtgctggacagcaaggcccccaagcccgaggacatcgacgaggaggacgacgacgtgcccgacctggtggagaacttcgacgaggccagcaagaacgaggccaactag

SEQ ID NO: 18220 - DNA, 213 bp, Artificial Sequence
  Description of Artificial Sequence: Synthetic coding sequence
atggccgaggtgaagagcatgttcagagaggtgctgcccaagcagggccccctgttcgtggaggacatcatgaccatggtgctgtgcaagcccaagctgctgcccctgaagagcctgaccctggagaagctggagaagatgcaccaggccgcccagaacaccatcagacagcaggagatggccgagaaggaccagagacagatcacccactag

SEQ ID NO: 18221 - DNA, 213 bp, Artificial Sequence; identical to SEQ ID NO: 18220
  Description of Artificial Sequence: Synthetic coding sequence

SEQ ID NO: 18222 - DNA, 279 bp, Artificial Sequence
  Description of Artificial Sequence: Synthetic coding sequence
atgctgaaggccgccgccaagagacccgagctgagcggcaagaacaccatcagcaacaacagcgacatggccgaggtgaagagcatgttcagagaggtgctgcccaagcagggccccctgttcgtggaggacatcatgaccatggtgctgtgcaagcccaagctgctgcccctgaagagcctgaccctggagaagctggagaagatgcaccaggccgcccagaacaccatcagacagcaggagatggccgagaaggaccagagacagatcacccactag

SEQ ID NO: 18223 - DNA, 204 bp, Artificial Sequence
  Description of Artificial Sequence: Synthetic coding sequence
atgctgaaggccgccgccaagagacccgagctgagcggccccctgttcgtggaggacatcatgaccatggtgctgtgcaagcccaagctgctgcccctgaagagcctgaccctggagaagctggagaagatgcaccaggccgcccagaacaccatcagacagcaggagatggccgagaaggaccagagacagatcacccactag

SEQ ID NO: 18224 - DNA, 312 bp, Artificial Sequence
  Description of Artificial Sequence: Synthetic coding sequence
atgctgaaggccgccgccaagagacccgagctgagcggcctgctgaagttcaacaactacggcatcctgagcgagagccccctgaccagccagagaaccacctggctgctgtaccagagccccagcttcatccccggcttcgcctaccccagcagatgcctgaagaccatcggcggcgtgtacaagcaggccagaaagaagcactacatccagcagctgagatacggcagaagcgaggtgaacgtgcccggcagcagcagcaaggccagagccaccgtgtgcggcagatacaacgacaacggcgccgtgtag

SEQ ID NO: 18225 - DNA, 879 bp, Artificial Sequence
  Description of Artificial Sequence: Synthetic coding sequence
atggccgtgcccaccgagctggacggcggcagcgtgaaggagaccgccgccgaggaggagagcagagtgctggcccccggcgccgcccccttcggcaacttcccccactacagcagattccacccccccgagcagagactgagactgctgccccccgagctgctgagacagctgttccccgagagccccgagaacggccccatcctgggcctggacgtgggctgcaacagcggcgacctgagcgtggccctgtacaagcacttcctgagcctgcccgacggcgagacctgcagcgacgccagcagagagttcagactgctgtgctgcgacatcgaccccgtgctggtgaagagagccgagaaggagtgccccttccccgacgccctgaccttcatcaccctggacttcatgaaccagagaaccagaaaggtgctgctgagcagcttcctgagccagttcggcagaagcgtgttcgacatcggcttctgcatgagcatcaccatgtggatccacctgaaccacggcgaccacggcctgtgggagttcctggcccacctgagcagcctgtgccactacctgctggtggagccccagccctggaagtgctacagagccgccgccagaagactgagaaagctgggcctgcacgacttcgaccacttccacagcctggccatcagaggcgacatgcccaaccagatcgtgcagatcctgacccaggaccacggcatggagctgatctgctgcttcggcaacaccagctgggacagaagcctgctgctgttcagagccaagcagaccatcgagacccaccccatccccgagagcctgatcgagaagggcaaggagaagaacagactgagcttccagaagcagtag

SEQ ID NO: 18226 - DNA, 741 bp, Artificial Sequence
  Description of Artificial Sequence: Synthetic coding sequence
atgagcctgcagtggaccgccgtggccaccttcctgtacgccgaggtgttcgtggtgctgctgctgtgcatccccttcatcagccccaagagatggcagaagatcttcaagagcagactggtggagctgctggtgagctacggcaacaccttcttcgtggtgctgatcgtgatcctggtgctgctggtgatcgacgccgtgagagagatcagaaagtacgacgacgtgaccgagaaggtgaacctgcagaacaaccccggcgccatggagcacttccacatgaagctgttcagagcccagagaaacctgtacatcgccggcttcagcctgctgctgagcttcctgctgagaagactggtgaccctgatcagccagcaggccaccctgctggccagcaacgaggccttcaagaagcaggccgagagcgccagcgaggccgccaagaagtacatggaggagaacgaccagctgaagaagggcgccgccgtggacggcggcaagctggacgtgggcaacgccgaggtgaagctggaggaggagaacagaagcctgaaggccgacctgcagaagctgaaggacgagctggccagcaccaagcagaagctggagaaggccgagaaccaggtgctggccatgagaaagcagagcgagggcctgaccaaggagtacgacagactgctggaggagcacgccaagctgcaggccgccgtggacggccccatggacaagaaggaggagtag

SEQ ID NO: 18227 - DNA, 741 bp, Artificial Sequence; identical to SEQ ID NO: 18226
  Description of Artificial Sequence: Synthetic coding sequence

SEQ ID NO: 18228 - DNA, 636 bp, Artificial Sequence
  Description of Artificial Sequence: Synthetic coding sequence
atggcccaggccaagatcaacgccaaggccaacgagggcagattctgcagaagcagcagcatggccgacagaagcagcagactgctggagagcctggaccagctggagctgagagtggaggccctgagagaggccgccaccgccgtggagcaggagaaggagatcctgctggagatgatccacagcatccagaacagccaggacatgagacagatcagcgacggcgagagagaggagctgaacctgaccgccaacagactgatgggcagaaccctgaccgtggaggtgagcgtggagaccatcagaaacccccagcagcaggagagcctgaagcacgccaccagaatcatcgacgaggtggtgaacaagttcctggacgacctgggcaacgccaagagccacctgatgagcctgtacagcgcctgcagcagcgaggtgccccacggccccgtggaccagaagttccagagcatcgtgatcggctgcgccctggaggaccagaagaagatcaagagaagactggagaccctgctgagaaacatcgagaacagcgacaaggccatcaagctgctggagcacagcaagggcgccggcagcaagaccctgcagcagaacgccgagagcagattcaactag

SEQ ID NO: 18229 - DNA, 327 bp, Artificial Sequence
  Description of Artificial Sequence: Synthetic coding sequence
atgccccacatgtgggtggaggccctgagagaggccgccaccgccgtggagcaggagaaggagatcctgctggagatgatccacagcatcctgaccgccaacagactgatgggcagaaccctgaccgtggaggtgagcgtggagaccatcagaaacccccagcagcaggagagcctgaagcacgccaccagaatcatcgacgaggtggtgaacaagttcctggacgacctgggcaacgccaagagccacctgatgagcctgtacagcgcctgcagcagcgaggtgccccacggccccgtggaccagaagttccagagcatcgtgtag

SEQ ID NO: 18230 - DNA, 537 bp, Artificial Sequence
  Description of Artificial Sequence: Synthetic coding sequence
atgccccacatgtgggtggaggccctgagagaggccgccaccgccgtggagcaggagaaggagatcctgctggagatgatccacagcatccagaacagccaggacatgagacagatcagcgacggcgagagagaggagctgaacctgaccgccaacagactgatgggcagaaccctgaccgtggaggtgagcgtggagaccatcagaaacccccagcagcaggagagcctgaagcacgccaccagaatcatcgacgaggtggtgaacaagttcctggacgacctgggcaacgccaagagccacctgatgagcctgtacagcgcctgcagcagcgaggtgccccacggccccgtggaccagaagttccagagcatcgtgatcggctgcgccctggaggaccagaagaagatcaagagaagactggagaccctgctgagaaacatcgagaacagcgacaaggccatcaagctgctggagcacagcaagggcgccggcagcaagaccctgcagcagaacgccgagagcagattcaactag

SEQ ID NO: 18231 - DNA, 1938 bp, Artificial Sequence
  Description of Artificial Sequence: Synthetic coding sequence
atgagcgagagaacccaggagcaggacttcgtgatcatcaccgtggacgacagcgacgacaacaacgactgcagcatcgagatggtggaggtgagcgagaccgccgacaacagcaccaacgacatcgccgacgacagcacctacgtgaccgccgacaaccccaccgacgacaccgccacccagcccaacttccccggcggcaacgacggccaccacagacccctgcagatgagctacggcagcggcagcgtgacccaggccggcgtgcagtggcacgaccacagcagcctgcagccccagcccctgggcctgaagcagttcttccacctgagcctgcccagcagctgggacgacagaagaacccccccctgccccgtggcccacggcgaccagatcgtgagccagatcaaccaccccgtgcacctgagaagatacagctacaacagcgaggaggtggacttccccaagagaggcagattctacacccccgaggtgcagagcagcatcagcccccccgccgagagacaggagacccacgcctgggccagccccgccgtgaccagcctggagagcgccgcctgccacgagctgcaggaggccgacctgagcgagagcctgagctaccccagaatcgtgagcagcagcagcctgcagcagtacgtggcccagggcggcagcttcccctgcttcggcatgccctggaacttcatcagcggcggcgccgagagcaccaacgccgtgatcagcttcgccaacgccaccaccgccgtgcccatggccgtgctgagcagaagagagagcagcctggccaacaaccccggcgtggtgaactacagcgccctgcccgagaacgagaacgtgggccccggcagagccctgagcagcttctgcttccaccccaacctggagagcggcccccagatgagctacggcaccatgagctacagcaccgagatgaagaacaactgcgaccaggacgacgccagcgccagcgcctgcctgacccccgacttcgccctgctgcccctgaacatcctggtgaaggtggacaccaacaccgagaacagcgtgaacaccatgaacagaagcaccctgctggacagcgacagcggccaggacagcagcagcagcagcgtgtgcatcccccccaagtacggctacctgggcgaccccaagagaaacgtgagagtgctgaagatccacctgctggccgtgcagaacatggccaagcccaagcaggccgcctgctacctggtgagaatcctgttcagcaaggagatcctgatcagcagcagcgtggacatccacctgaaggacagccagagcctggaccccaacaagatggccgccctgagagagtacctggccaccaccttccccacctgcgacctgcacgagcacggcaaggactggcaggactgcatcagcggcatcaacagcatgatctactgcctgtgcagcgagggcaagagcacccccaagaccgtgagaaagaacaagaagagaaccaacagagtggccagcgccagcgccgacagaaacgaccagagaggcagagacggcggcgagggctgcagctggatgttccagcccatgaacaacagcaagatgagagagaagagaaacctgcagcccaacagcaacgccatccccgagggcatgagagagcccagcaccgacaaccccgaggagcccggcgaggcctggagctacttcggcagaccctggagaaacatcagaatgccctgcagcgtgctgaccctggccaagaccaagagctgcgccagcctgagcgccagatacctgatccagaagctgttcaccaaggacgtgctggtgcagagcaacgtgtacggcaacctgaagcacggcctgtgcgccctggaccccaacaagatcagcgccctgagaggcctgctgcacatcgagtacgtgtag

SEQ ID NO: 18232 - DNA, 2400 bp, Artificial Sequence
  Description of Artificial Sequence: Synthetic coding sequence
atgagcgagagaacccaggagcaggacttcgtgatcatcaccgtggacgacagcgacgacaacaacgactgcagcatcgagatggtggaggtgagcgagaccgccgacaacagcaccaacgacatcgccgacgacagcacctacgtgaccgccgacaaccccaccgacgacaccgccacccagcccaacttccccggcggcaacgacggccaccacagacccctgcagatgagctacggcagcggcagcgtgacccaggccggcgtgcagtggcacgaccacagcagcctgcagccccagcccctgggcctgaagcagttcttccacctgagcctgcccagcagctgggacgacagaagaacccccccctgccccgtggcccacggcgaccagatcgtgagccagatcaaccaccccgtgcacctgagaagatacagctacaacagcgaggaggtggacttccccaagagaggcagattctacacccccgaggtgcagagcagcatcagcccccccgccgagagacaggagacccacgcctgggccagccccgccgtgaccagcctggagagcgccgcctgccacgagctgcaggaggccgacctgagcgagagcctgagctaccccagaatcgtgagcagcagcagcctgcagcagtacgtggcccagggcggcagcttcccctgcttcggcatgccctggaacttcatcagcggcggcgccgagagcaccaacgccgtgatcagcttcgccaacgccaccaccgccgtgcccatggccgtgctgagcagaagagagagcagcctggccaacaaccccggcgtggtgaactacagcgccctgcccgagaacgagaacgtgggccccggcagagccctgagcagcttctgcttccaccccaacctggagatgcccgagagacccgccaacagcagcaagaacagcaccgagaccgccaactaccccaccctgatgggcaactacaacggccagaacaccgccagcctgagcgtgttcatccccccctacttcgccgagaagatcatcctgaccgagatgcccggcaccaccgagaccaacgtggagaacaacagccagaccgtgtactaccccgccctgagcggcaacaccagcgccccctaccccgccagcagctacctgcccatcaccagcaacttcgagagcggcccccagatgagctacggcaccatgagctacagcaccgagatgaagaacaactgcgaccaggacgacgccagcgccagcgcctgcctgacccccgacttcgccctgctgcccctgaacatcctggtgaaggtggacaccaacaccgagaacagcgtgaacaccatgaacagaagcaccctgctggacagcgacagcggccaggacagcagcagcagcagcgtgtgcatcccccccaagtacggctacctgggcgaccccaagagaaacgtgagagtgctgaagatccacctgctggccgtgcagaacatggccaagcccaagcaggccgcctgctacctggtgagaatcctgttcagcaaggagatcctgatcagcagcagcgtggacatccacctgaaggacagccagagcctggaccccaacaagatggccgccctgagagagtacctggccaccaccttccccacctgcgacctgcacgagcacggcaaggactggcaggactgcatcagcggcatcaacagcatgatctactgcctgtgcagcgagggcaagagcacccccaagaccgtgagaaagaacaagaagagaaccaacagagtggccagcgccagcgccgacagaaacgaccagagaggcagagacggcggcgagggctgcagctggatgttccagcccatgaacaacagcaagatgagagagaagagaaacctgcagcccaacagcaacgccatccccgagggcatgagagagcccagcaccgacaaccccgaggagcccggcgaggcctggagctacttcggcagaccctggagaaacatcagaatgccctgcagcgtgctgaccctggccaagaccaagagctgcgccagcctgagcgccagatacctgatccagaagctgttcaccaaggacgtgctggtgcagagcaacgtgtacggcaacctgaagcacggcctgtgcgccctggaccccaacaagatcagcgccctgagagagttcctgcaggagaactaccccatctgcgacctgagcgagaacggcagagactggaagagctgcgtgaccagcatcaacagcggcatcagaagcctgagacacgacgtgagaagagccgaggccagaagccagagcctgcccgccgtgaccccccccgagctggagcaggagagcaagcccggcgaccccgacgccaccgaccccagcacctag

SEQ ID NO: 18233 - DNA, 2487 bp, Artificial Sequence
  Description of Artificial Sequence: Synthetic coding sequence
atgaacagcaccgagttcaccgaggacgtggaggaggtgctgaagagcatcaccgtgaaggtggagaccgaggccgaggacgccgccctggactgcagcgtgaacagcagaaccagcgagaagcacagcgtggacagcgtgctgaccgccctgcaggacagcagcaagagaaagcagctggtgagcgacggcctgctggacagcgtgcccggcgtgaagagaagaagactgatccccgaggccctgctggccggcatgagaaacagagagaacagcagcccctgccagggcaacggcgagcaggccggcagaggcagaagcctgggcaacgtgtggcccggcgaggaggagccctgcaacgacgccaccacccccagctacaagaagcccctgtacggcatcagccacaagatcatggagaagaagaacccccccagcggcgacctgctgaacgtgtacgagctgttcgagaaggccaacgccagcaacagccccagcagcctgagactgctgaacgagccccagaagagagactgcggcagcaccggcgccggcaccgacaacgaccccaacatctacttcctgatccagaagatgttctacatgctgaacaccctgaccagcaacatgagccagctgcacagcaaggtggacctgctgagcctggaggtgagcagaatcaagaagcaggtgagccccaccgagatggtggccaagttccagcccccccccgagtaccagctgaccgccgccgagctgaagcagatcgtggaccagagcctgagcggcggcgacctggcctgcagactgctggtgcagctgttccccgagctgttcagcgacgtggacttcagcagaggctgcagcgcctgcggcttcgccgccaagagaaagctggagagcctgcacctgcagctgatcagaaactacgtggaggtgtactaccccagcgtgaaggacaccgccgtgtggcaggccgagtgcctgccccagctgaacgacttcttcagcagattctgggcccagagagagatggaggacagccagcccagcggccaggtggccagcttcttcgaggccgagcaggtggaccccggccacttcctggacaacaaggaccaggaggaggccctgagcctggacagaagcagcaccatcgccagcgaccacgtggtggacacccaggacctgaccgagttcctggacgaggccagcagccccggcgagttcgccgtgttcctgctgcacagactgttccccgagctgttcgaccacagaaagctgggcgagcagtacagctgctacggcgacggcggcaagcaggagctggacccccagagactgcagatcatcagaaactacaccgagatctacttccccgacatgcaggaggaggaggcctggctgcagcagtgcgcccagagaatcaacgacgagctggagggcctgggcctggacgccggcagcgagggcgacccccccagagacgactgctacgacagcagcagcctgcccgacgacatcagcgtggtgaaggtggaggacagcttcgagggcgagagacccggcagaagaagcaagaagatctggctggtgcccatcgacttcgacaagctggagatcccccagcccgacttcgaggtgcccggcgccgactgcctgctgagcaaggagcagctgagaagcatctacgagagcagcctgagcatcggcaacttcgccagcagactgctggtgcacctgttccccgagctgttcacccacgagaacctgagaaagcagtacaactgcagcggcagcctgggcaagaagcagctggaccccagcagaatcaagctgatcagacactacgtgcagctgctgtaccccagagccaagaacgacagagtgtggaccctggagttcgtgggcaagctggacgagagatgcagaagaagagacaccgagcagagaagaagctaccagcagcagagaaaggtgcacgtgcccggccccgagtgcagagacctgaccagctacgccatcaaccccgagagattcagagaggagttcgagggcccccccctgccccccgagagaagcagcaaggacttctgcaagatccccctggacgagctggtggtgcccagccccgacttccccgtgcccagcccctacctgctgagcgacaaggaggtgagagagatcgtgcagcagagcctgagcgtgggcaacttcgccgccagactgctggtgagactgttccccgagctgttcaccgccgagaacctgagactgcagtacaaccacagcggcgcctgcaacaagaagcagctggaccccaccagactgagactgatcagacactacgtggaggccgtgtaccccgtggagaagatggaggaggtgtggcactacgagtgcatccccagcatcgacgagagatgcagaagacccaacagaaagaagtgcgacatcctgaagaaggccaagaaggtggagaagtag

SEQ ID NO: 18234 - DNA, 2487 bp, Artificial Sequence; identical to SEQ ID NO: 18233
  Description of Artificial Sequence: Synthetic coding sequence

SEQ ID NO: 18235 - DNA, 1218 bp, Artificial Sequence
  Description of Artificial Sequence: Synthetic coding sequence
atgcagcccgccgaggagggccccagcgtgcccaagatctacaagcagagaagcccctacagcgtgctgaagaccttccccagcctgaacgtggtgagcgagagcagaatgatcctggacgccttcgcccagcagtgcagcagagtgctgagcctgctgaactgcggcggcaagctgctggacagcaaccacagccagagcatgatcagctgcgtgaagcaggagggcagcagctacaacgagagacaggagcactgccacatcggcaagggcgtgcacagccagaccagcgacaacgtggacatcgagatgcagtacatgcagagaaagcagcagaccagcgccttcctgagagtgttcaccgacagcctgcagaactacctgctgagcggcagcttccccacccccaaccccagcagcgccagcgagtacggccacctggccgacgtggaccccctgagcaccagccccgtgcacaccctgggcggctggaccagccccgccaccagcgagagccacggccaccccagcagcagcaccctgcccgaggaggaggaggaggaggacgaggagggctactgccccagatgccaggagctggagcaggaggtgatcagcctgcagcaggagaacgaggagctgagaagaaagctggagagcatccccgtgccctgccagaccgtgctggactacctgaagatggtgctgcagcaccacaaccagctgctgatcccccagcccgccgaccagcccaccgagggcagcaagcagctgctgaacaactaccccgtgtacatcaccagcaagcagtgggacgaggccgtgaacagcagcaagaaggacggcagaagactgctgagatacctgatcagattcgtgttcaccaccgacgagctgaagtacagctgcggcctgggcaagagaaagagaagcgtgcagagcggcgagaccggccccgagagaagacccctggaccccgtgaaggtgacctgcctgagagagttcatcagaatgcactgcaccagcaaccccgactggtggatgcccagcgaggagcagatcaacaaggtgttcagcgacgccgtgggccacgccagacagggcagagccgtgggcaccttcctgcacaacggcggcagcttctacgagggcatcgaccaccaggccagccaggacgaggtgttcaacaagagcagccaggacggcagcggcgactag

SEQ ID NO: 18236 - DNA, 1605 bp, Artificial Sequence
  Description of Artificial Sequence: Synthetic coding sequence
atggaggaggagatgcagcccgccgaggagggccccagcgtgcccaagatctacaagcagagaagcccctacagcgtgctgaagaccttccccagcaagagacccgccctggccaagagatacgagagacccaccctggtggagctgccccacgtgagagcccccccccccccccccccccccttcgccccccacgccgccgtgagcatcagcagcagcgagccccccccccagcagttccaggcccagagcagctacccccccggccccggcagagccgccgccgccgccagcagcagcagccccagctgcacccccgccaccagccagggccacctgagaacccccgcccagcccccccccgccagccccgccgccagcagcagcagcagcttcgccgccgtggtgagatacggccccggcgccgccgccgccgccggcaccggcggcaccggcagcgacagcgccagcctggagctgagcgccgagagcagaatgatcctggacgccttcgcccagcagtgcagcagagtgctgagcctgctgaactgcggcggcaagctgctggacagcaaccacagccagagcatgatcagctgcgtgaagcaggagggcagcagctacaacgagagacaggagcactgccacatcggcaagggcgtgcacagccagaccagcgacaacgtggacatcgagatgcagtacatgcagagaaagcagcagaccagcgccttcctgagagtgttcaccgacagcctgcagaactacctgctgagcggcagcttccccacccccaaccccagcagcgccagcgagtacggccacctggccgacgtggaccccctgagcaccagccccgtgcacaccctgggcggctggaccagccccgccaccagcgagagccacggccaccccagcagcagcaccctgcccgaggaggaggaggaggaggacgaggagggctactgccccagatgccaggagctggagcaggaggtgatcagcctgcagcaggagaacgaggagctgagaagaaagctggagagcatccccgtgccctgccagaccgtgctggactacctgaagatggtgctgcagcaccacaaccagctgctgatcccccagcccgccgaccagcccaccgagggcagcaagcagctgctgaacaactaccccgtgtacatcaccagcaagcagtgggacgaggccgtgaacagcagcaagaaggacggcagaagactgctgagatacctgatcagattcgtgttcaccaccgacgagctgaagtacagctgcggcctgggcaagagaaagagaagcgtgcagagcggcgagaccggccccgagagaagacccctggaccccgtgaaggtgacctgcctgagagagttcatcagaatgcactgcaccagcaaccccgactggtggatgcccagcgaggagcagatcaacaaggtgttcagcgacgccgtgggccacgccagacagggcagagccgtgggcaccttcctgcacaacggcggcagcttctacgagggcatcgaccaccaggccagccaggacgaggtgttcaacaagagcagccaggacggcagcggcgactag

SEQ ID NO: 18237 - DNA, 1314 bp, Artificial Sequence
  Description of Artificial Sequence: Synthetic coding sequence
atgcagcccgccgaggagggccccagcgtgcccaagatctacaagcagagaagcccctacagcgtgctgaagaccttccccagcaagagacccgccctggccaagagatacgagagacccaccctggtggagctgccccacgtgagagcccccccccccccccccccccccttcgccccccacgccgccgtgagcatcagcagcagcgagccccccccccagcagttccaggcccagagcagctacccccccggccccggcagagccgccgccgccgccagcagcagcagccccagctgcacccccgccaccagccagggccacctgagaacccccgcccagcccccccccgccagccccgccgccagcagcagcagcagcttcgccgccgtggtgagatacggccccggcgccgccgccgccgccggcaccggcggcaccggcagcgacagcgccagcctggagctgagcgccgagagcagaatgatcctggacgccttcgcccagcagtgcagcagagtgctgagcctgctgaactgcggcggcaagctgctggacagcaaccacagccagagcatgatcagctgcgtgaagcaggagggcagcagctacaacgagagacaggagcactgccacatcggcaagggcgtgcacagccagaccagcgacaacgtggacatcgagatgcagtacatgcagagaaagcagcagaccagcgccttcctgagagtgttcaccgacagcctgcagaactacctgctgagcggcagcttccccacccccaaccccagcagcgccagcgagtacggccacctggccgacgtggaccccctgagcaccagccccgtgcacaccctgggcggctggaccagccccgccaccagcgagagccacggccaccccagcagcagcaccctgcccgaggaggaggaggaggaggacgaggagggctactgccccagatgccaggagctggagcaggaggtgatcagcctgcagcaggagaacgaggagctgagaagaaagctggagagcatccccgtgccctgccagaccgtgctggactacctgaagatggtgctgcagcaccacaaccagctgctgatcccccagcccgccgaccagcccaccgagggcagcaagcagctgctgaacaactaccccgtgtacatcaccagcaagcagtgggacgaggccgtgaacagcagcaagaaggacggcagaagactgctgagatacctgatcagattcgtgttcaccaccgacgagctgaagtacagctgcggcctgggcaagagaaagagaatccactag

SEQ ID NO: 18238 - DNA, 570 bp, Artificial Sequence
  Description of Artificial Sequence: Synthetic coding sequence
atgcagaagatcgtgcagaccgacgagatcaccaacacccaggccttcagaaagggcaagagaaagagaaccgagaccatggacagcgagaacgccaacagcgacatggacaagggccagagagacccctacagcggcaacgccttcctgcccggcgagagcagcagcgaggacgaggagcccctggccgagctgagcaaggaggagctgtgcgccaagatcaagagcctgaaggagaagctgaccaacaccagaaaggagaacagcagactgagacagagcctggtgatgctgcaggtgctgccccaggccgtgacccagttcgaggagctggtgggcatggccgaggccctgctgaagggcggcggcaccatgagcaccagcgccagcaccctgtggagagccaccaacaacagcagccccgacagcttcgccagcacctgcagcaacagcaacagcaacagcagcagccccgtgagcctgaagcccgaggaggagcaccagaccgacgagaagcagttccagatcgagaagtggcagaaccccctgctgcagggcaccaagctgtag

SEQ ID NO: 18239 - DNA, 390 bp, Artificial Sequence
  Description of Artificial Sequence: Synthetic coding sequence
atgcagaagatcgtgcagaccgacgagatcaccaacacccaggccttcagaaagggcaagagaaagagaaccgagaccatggacagcgagaacgccaacagcgacatggacaagggccagagagacccctacagcggcaacgccttcctgcccggcgagagcagcagcgaggacgaggagcccctggccgagctgagcaaggaggagctgtgcgccaagatcaagagcctgaaggagaagctgaccaacaccagaaaggagaacagcagactgagacagagcctggtgatgctgcagggcaacaagctggacatcaccaccgagaagaccatcctgcacggcggcatgaagaccctgaacgtggtgaccaccagcagccaccccgtgtag

SEQ ID NO: 18240 - DNA, 840 bp, Artificial Sequence
  Description of Artificial Sequence: Synthetic coding sequence
atgcagaagatcgtgcagaccgacgagatcaccaacacccaggccttcagaaagggcaagagaaagagaaccgagaccatggacagcgagaacgccaacagcgacatggacaagggccagagagacccctacagcggcaacgccttcctgcccggcgagagcagcagcgaggacgaggagcccctggccgagctgagcaaggaggagctgtgcgccaagatcaagagcctgaaggagaagctgaccaacaccagaaaggagaacagcagactgagacagagcctggtgatgctgcaggtgctgccccaggccgtgacccagttcgaggagctggtgggcatggccgaggccctgctgaagggcggcggcaccatgagcaccagcgccagcaccctgtggagagccaccaacaacagcagccccgacagcttcgccagcacctgcagcaacagcaacagcaacagcagcagccccgtgagcctgaagcccgaggaggagcaccagaccgacgagaagcagttccagatcgagaagtggcagatcgccagatgcaacaagagcaagccccagaagttcatcaacgacctgatgcaggtgctgtacaccaacgagtacatggccacccacagcctgaccggcgccaagagcagcaccagcagagacaaggccgtgaagcccgccatgaaccagaacgaggtgcaggagatcatcggcgtgaccaagcagctgttccccaacaccgacgacgtgagcatcagaagaatgatcggccagaagctgaacaactgcaccaagaagcccaacctgagcaagaacctgaacagccaggacatcaagtag

SEQ ID NO: 18241 - DNA, 321 bp, Artificial Sequence
  Description of Artificial Sequence: Synthetic coding sequence
atgcagaagatcgtgcagaccgacgagatcaccaacacccaggccttcagaaagggcaagagaaagagaaccgagaccatggacagcgagaacgccaacagcgacatggacaagggccagagagacccctacagcggcaacgccttcctgcccggcgagagcagcagcgaggacgaggagcccctggccgagctgagcaaggaggagctgtgcgccaagatcaagagcctgaaggagaagctgaccaacaccagaaaggagaacagcagactgagacagagcctggtgatgctgcaggcctggagcagagagctgccctag

SEQ ID NO: 18242 - DNA, 390 bp, Artificial Sequence; identical to SEQ ID NO: 18239
  Description of Artificial Sequence: Synthetic coding sequence

SEQ ID NO: 18243 - DNA, 546 bp, Artificial Sequence
  Description of Artificial Sequence: Synthetic coding sequence
atgctgctgccccaggccgtgacccagttcgaggagctggtgggcatggccgaggccctgctgaagggcggcggcaccatgagcaccagcgccagcaccctgtggagagccaccaacaacagcagccccgacagcttcgccagcacctgcagcaacagcaacagcaacagcagcagccccgtgagcctgaagcccgaggaggagcaccagaccgacgagaagcagttccagatcgagaagtggcagatcgccagatgcaacaagagcaagccccagaagttcatcaacgacctgatgcaggtgctgtacaccaacgagtacatggccacccacagcctgaccggcgccaagagcagcaccagcagagacaaggccgtgaagcccgccatgaaccagaacgaggtgcaggagatcatcggcgtgaccaagcagctgttccccaacaccgacgacgtgagcatcagaagaatgatcggccagaagctgaacaactgcaccaagaagcccaacctgagcaagaacctgaacagccaggacatcaagtag

SEQ ID NO: 18244 - DNA, 1407 bp, Artificial Sequence
  Description of Artificial Sequence: Synthetic coding sequence
atggagatcaagaagcagatcaccggcatgagaagactgctgaacgacagcaccggcagaatctaccagagagtgggcaaggagggcgagaagctgaaggaggagccccaggacctggacctggtgtggccccccagactgaacagcagcgccgaggccccccagagcctgcaccccagcagcagaggcgtgtggaacgagctgcccccccagagcggccagttcagcggccagtacggcaccagaagcagaaccttccagagccagccccaccccaccaccagcagcaacggcgagctgcccgtggtgaacagcagcgccggcagcaactgctgcacctgcaactgccagagcaccctgcaggccatcctgcaggagctgaagaccatgagaaagctgatgcagatccaggccgtgggcacccagaacagacagcagccccccatcagcctgatctgcagccagagaaccgccgtgagcagaaagagaaacaagaagaagaaggtgccccccaagaccgtggagcccctgaccgtgaagcagaagcccagcggcagcgagatggagaagaagagcgtggtggccagcgagctgagcgccctgcaggccgccgagcacaccagccccgaggagagcagagtgctgggcttcggcatcgtgctggagagccccagcagcgaccccgaggtgcagctggccgagggcttcgacgtgttcatgcccaagagccagctggacagcatcctgagcaactacaccagaagcggcagcctgctgttcagaaagctggtgtgcgccttcttcgacgacaagaccctggccaacagcctgcccaacggcaagagaaagagaggcctgaacgacaacagaaagggcctggaccagaacatcgtgggcgccatcaaggtgttcaccgagaagtactgcaccgccaaccacgtggacaagctgcccggccccagagactgggtgcagatcctgcaggaccagatcaagctggccagaagaagactgaagagaggcagcgccgagatcgccgacagcgacgagagactggacggcatcgccctgccccccaccggcgcctgcggcggcccctgcaccgtgctgcccggcggcagcgccgccgtgaccctggtgctgcagagcagcccccagaccatgagccaggagaagggccagatggccgagccctgggaggagcagcacctggtgctgctgaacaacctgaccagagacagagccgagaccggcgccctgagccagaccagccaggacttcaagcaccacagcttcctgatcacccaggtgagcgccaccctgcaccaccagagaggcatcagaaacttccccacccccggcagcgccaagagcctgaccctgcacatcagctgcctgagcctgtag

SEQ ID NO: 18245 - DNA, 1125 bp, Artificial Sequence
  Description of Artificial Sequence: Synthetic coding sequence
atggagatcaagaagcagatcaccggcatgagaagactgctgaacgacagcaccggcagaatctaccagagagtgggcaaggagggcgagaagctgaaggaggagccccaggacctggacctggtgtggccccccagactgaacagcagcgccgaggccccccagagcctgcaccccagcagcagaggcgtgtggaacgagctgcccccccagagcggccagttcagcggccagtacggcaccagaagcagaaccttccagagccagccccaccccaccaccagcagcaacggcatggtggtgaacaagcacagcgagggcagccacggcggcgagctgcccgtggtgaacagcagcgccggcagcaactgctgcacctgcaactgccagagcaccctgcaggccatcctgcaggagctgaagaccatgagaaagctgatgcagatccaggccgtgggcacccagaacagacagcagccccccatcagcctgatctgcagccagagaaccgccgtgagcagaaagagaaacaagaagaagaaggtgccccccaagaccgtggagcccctgaccgtgaagcagaagcccagcggcagcgagatggagaagaagagcgtggtggccagcgagctgagcgccctgcaggccgccgagcacaccagccccgaggagagcagagtgctgggcttcggcatcgtgctggagagccccagcagcgaccccgaggtgcagctggccgagggcttcgacgtgttcatgcccaagagccagctggacagcatcctgagcaactacaccagaagcggcagcctgctgttcagaaagctggtgtgcgccttcttcgacgacaagaccctggccaacagcctgcccaacggcaagagaaagagaggcctgaacgacaacagaaagggcctggaccagaacatcgtgggcgccatcaaggtgttcaccgagaagtactgcaccgccaaccacgtggacaagctgcccggccccagagactgggtgcagatcctgcaggaccagatcaagctggccagaagaagactgaagagaggcagcgagatcgccgacagcgacgagagactggacggcatcgccctgccccccaccgtggtgtag

SEQ ID NO: 18246 - DNA, 1281 bp, Artificial Sequence
  Description of Artificial Sequence: Synthetic coding sequence
atggagttcagcgagagaaagagaagcagaaagagccagagcttcaagctggtgagcagagactaccaccacgaggtgtacaagatccccgagttcagcaacgacgtgaacggcgaggccaaggagacccagcccatcttcctgggcgacgagagcatggagatcaagaagcagatcaccggcatgagaagactgctgaacgacagcaccggcagaatctaccagagagtgggcaaggagggcgagaagctgaaggaggagccccaggacctggacctggtgtggccccccagactgaacagcagcgccgaggccccccagagcctgcaccccagcagcagaggcgtgtggaacgagctgcccccccagagcggccagttcagcggccagtacggcaccagaagcagaaccttccagagccagccccaccccaccaccagcagcaacggcatggtggtgaacaagcacagcgagggcagccacggcggcgagctgcccgtggtgaacagcagcgccggcagcaactgctgcacctgcaactgccagagcaccctgcaggccatcctgcaggagctgaagaccatgagaaagctgatgcagatccaggccgtgggcacccagaacagacagcagccccccatcagcctgatctgcagccagagaaccgccgtgagcagaaagagaaacaagaagaagaaggtgccccccaagaccgtggagcccctgaccgtgaagcagaagcccagcggcagcgagatggagaagaagagcgtggtggccagcgagctgagcgccctgcaggccgccgagcacaccagccccgaggagagcagagtgctgggcttcggcatcgtgctggagagccccagcagcgaccccgaggtgcagctggccgagggcttcgacgtgttcatgcccaagagccagctggacagcatcctgagcaactacaccagaagcggcagcctgctgttcagaaagctggtgtgcgccttcttcgacgacaagaccctggccaacagcctgcccaacggcaagagaaagagaggcctgaacgacaacagaaagggcctggaccagaacatcgtgggcgccatcaaggtgttcaccgagaagtactgcaccgccaaccacgtggacaagctgcccggccccagagactgggtgcagatcctgcaggaccagatcaagctggccagaagaagactgaagagaggcagcgagatcgccgacagcgacgagagactggacggcatcgccctgccccccaccgtggtgtag

SEQ ID NO: 18247 - DNA, 1560 bp, Artificial Sequence
  Description of Artificial Sequence: Synthetic coding sequence
atggagttcagcgagagaaagagaagcagaaagagccagagcttcaagctggtgagcagagactaccaccacgaggtgtacaagatccccgagttcagcaacgacgtgaacggcgaggccaaggagacccagcccatcttcctgggcgacgagagcatggagatcaagaagcagatcaccggcatgagaagactgctgaacgacagcaccggcagaatctaccagagagtgggcaaggagggcgagaagctgaaggaggagccccaggacctggacctggtgtggccccccagactgaacagcagcgccgaggccccccagagcctgcaccccagcagcagaggcgtgtggaacgagctgcccccccagagcggccagttcagcggccagtacggcaccagaagcagaaccttccagagccagccccaccccaccaccagcagcaacggcgagctgcccgtggtgaacagcagcgccggcagcaactgctgcacctgcaactgccagagcaccctgcaggccatcctgcaggagctgaagaccatgagaaagctgatgcagatccaggccgtgggcacccagaacagacagcagccccccatcagcctgatctgcagccagagaaccgccgtgagcagaaagagaaacaagaagaagaaggtgccccccaagaccgtggagcccctgaccgtgaagcagaagcccagcggcagcgagatggagaagaagagcgtggtggccagcgagctgagcgccctgcaggccgccgagcacaccagccccgaggagagcagagtgctgggcttcggcatcgtgctggagagccccagcagcgaccccgaggtgcagctggccgagggcttcgacgtgttcatgcccaagagccagctggacagcatcctgagcaactacaccagaagcggcagcctgctgttcagaaagctggtgtgcgccttcttcgacgacaagaccctggccaacagcctgcccaacggcaagagaaagagaggcctgaacgacaacagaaagggcctggaccagaacatcgtgggcgccatcaaggtgttcaccgagaagtactgcaccgccaaccacgtggacaagctgcccggccccagagactgggtgcagatcctgcaggaccagatcaagctggccagaagaagactgaagagaggcagcgagatcgccgacagcgacgagagactggacggcatcgccctgccccccaccggcgcctgcggcggcccctgcaccgtgctgcccggcggcagcgccgccgtgaccctggtgctgcagagcagcccccagaccatgagccaggagaagggccagatggccgagccctgggaggagcagcacctggtgctgctgaacaacctgaccagagacagagccgagaccggcgccctgagccagaccagccaggacttcaagcaccacagcttcctgatcacccaggtgagcgccaccctgcaccaccagagaggcatcagaaacttccccacccccggcagcgccaagagcctgaccctgcacatcagctgcctgagcctgtag

SEQ ID NO: 18248 - DNA, 354 bp, Artificial Sequence
  Description of Artificial Sequence: Synthetic coding sequence
ctggacagcatcctgagcaactacaccagaagcggcagcctgctgttcagaaagctggtgtgcgccttcttcgacgacaagaccctggccaacagcctgcccaacggcaagagaaagagaggcctgaacgacaacagaaagggcctggaccagaacatcgtgggcgccatcaaggtgttcaccgagaagtactgcaccgccaaccacgtggacaagctgcccggccccagagactgggtgcagatcctgcaggaccagatcaagctggccagaagaagactgaagagaggcagcgagatcgccgacagcgacgagagactggacggcatcgccctgccccccaccggcaagtag

SEQ ID NO: 18249 - DNA, 3069 bp, Artificial Sequence
  Description of Artificial Sequence: Synthetic coding sequence
atgcccgacttccagcccggcgacaccaccgtgagactggacaagagaatgagcctgaccgccatctacgacaagagaagagagaccgactacagcgacaagggctacaacctggccttcgtgagccaggacgagcaggagaacagcagcttcaccatcctgtacgaggagcccctgcaggaggaggacaagtacgccagcgccgaggccagacagacccagagcgtgctgttccacgacaccagcgccgacagcatgcccgtgctggcctgcgagagaagcgagagcagaaccgacctggtgcaccacttcgagaagggcaccaagctgggcgagaccttcgacagcgacagcagcgagatgttcctgagcgtggaggccaagagatacaagatctaccccctggccctgagccccatctacgaggacgacagcagccaggaggacatcctgagcagcgaggtgagccccggccaccacggccccagaaagagcagagacagcgagaaccagagcagcagcgtgctgagcctgctgcagagcgtgagcgagagactgaagatgaacttcgacgaggacgacagagaggccgccgacgaggaggaggaggaggaggaggccgccgtgctgcacaagggcgacctgagagccggcagcggcgagagagtgaccttccagctgcccgaccccagcatcaccttctaccccgacgaccaggagagcgtgggcatcagcaagaacagctacgtgatgcccaacgagcccaccaccagcaacctgcaggtgggcctgtggcccgagaagaccagcttcctgcagaagagcgacctgaccagcaagctgcacagcagcctgaagagcgcctaccaccagtacctgcagaccagccagagccacagcagcgagaagggcgccagattcggcggcatcttccaggagcccgtgagcaagtacttcagagtgcaggacagccccggcagactgagccccttcatcgagaacgtggacaagcagaccctgagatgcaaccccagacccggcaagatggtgatctacgacctgcacgagagcacctacaagcaggaggtgtactgcaacatccccgacgccaccagctggagcttccccaacggcgtgctgatcaaggtggtgagaggctgctggatcctgtacgagaagccccacttcagaggccagaagtgcgtgctggaggagggcgagaaggtgctgaacagagactggatcctgcagaacagaagacacccccagagaaacttcatcctgggcagcctgaagagagtgctgaaggactgcagcatccccgagatcgagctgttcccccagagcgaccccgcctgctgccccgtgtacatccagagagccgtgcccaacctggaggagctgaacatcagcaagagcgtgagcttcaccgtgaagagcggcgtgtggctggcctaccccgacatcaacttcaagggccaggccaccgtgctggaggaggaccacggcctgttcgagatcagcaccgccgagatgaagagcctgcaccccctgcagatgggcggcctgaaggtggagatgcccatgaacctgaaggtgatcatctacgagaagccccacttccacggccaggccaaggagttcagcgagcacatcgacagcgtgcccaacttcctgaagaacaacggcgacttccacagaatcggcagcatcagagtgatcggcggcgtgtgggtggcctacgagaaggagcacttcaagggccagcagttcctgctggaggagggcgacttcgaggacagcaacgcctgcggcgccctgagcagccccatcctgagcttcagatacctgcaggccaacttcatcgagagcagcgtgaccctgttcgagagcgacctggagagcggcaagttcatcgacatcaccaaccaggagatcagcgacctggaggagatcggcttcggcagcaagaccagaagcatccacgtgaagagcggcgtgtgggtggcctaccagcagaagttcttctgcggcgagcagtacatcctggagaagggcaagtacaagtgcttcttcgactggggcggcagcaacaacatcatcatgagcatcagacccatccagctggagcccctgggcatcaacgagcccccccacctgctgaaggccttcagcaagcccggcttccagggcgagtgcatcgacttcaccgaggagaccagcgacctgaccagcctgatgccctgcagcttcaaggtgctgagaggctgctggctgctgtactaccaggaggacatgttcgtgaaccactgcgtgctggaggagggcctgtacgccgacctgaccagctgcggctgccccgccagcaaggtgaagagcctgaagcccatcgactacgtgttcgaggagcccagcatcagcctgttcgccctggagcactgcgagggcagagagctgcacctggaggaggccgtgaacagcgtgctgaacaaggacctgcacttctacacccagagcgtgtgggtgaagagcggcctgtggatcgcctacgagggcagcaacttcctgggcagacagatcctgctgagacccaacgagatccccaactggaccgccttcagcagatggaagaccatcggcagcctgagacccatgaagcagcccgccgtgtacatcagaatcaagaacagagcccagggcgagtacctgaccgtgaccggcagcctggccgacaccagagccaccagcgtgtgcatcagcccctacagcggcaagaacacccagatctggtactactgcagaggcctgttcaagagcaaggccagcgacacctgcctggacgtgatcggcggcagagacacccccggcgccaaggtggccctgtggaccgagcacggccagttcagacagaagtggagactgaacaagaacggcaccatcagcagctacctgagcgaccagctggtgctggacgtgaagggcggcaactactgcgacaagacccacgtgatcgtgaaccagcccctggagggcgaggagacccagaagtgggacatcgagatcctgtag

SEQ ID NO: 18250 - DNA, 690 bp, Artificial Sequence
  Description of Artificial Sequence: Synthetic coding sequence
atgaacgagaagaagaaggtgttcgaggagcccagcatcagcctgttcgccctggagcactgcgagggcagagagctgcacctggaggaggccgtgaacagcgtgctgaacaaggacctgcacttctacacccagagcgtgtgggtgaagagcggcctgtggatcgcctacgagggcagcaacttcctgggcagacagatcctgctgagacccaacgagatccccaactggaccgccttcagcagatggaagaccatcggcagcctgagacccatgaagcagcccgccgtgtacatcagaatcaagaacagagcccagggcgagtacctgaccgtgaccggcagcctggccgacaccagagccaccagcgtgtgcatcagcccctacagcggcaagaacacccagatctggtactactgcagaggcctgttcaagagcaaggccagcgacacctgcctggacgtgatcggcggcagagacacccccggcgccaaggtggccctgtggaccgagcacggccagttcagacagaagtggagactgaacaagaacggcaccatcagcagctacctgagcgaccagctggtgctggacgtgaagggcggcaactactgcgacaagacccacgtgatcgtgaaccagcccctggagggcgaggagacccagaagtgggacatcgagatcctgtag

SEQ ID NO: 18251 - DNA, 396 bp, Artificial Sequence
  Description of Artificial Sequence: Synthetic coding sequence
atgaacaagaagaaggtgttcgaggagcccagcatcagcctgttcgccctggagcactgcgagggcagagagctgcacctggaggaggccgtgaacagcgtgctgaacaaggacctgcacttctacacccagagcgtgtgggtgaagagcggcctgtggatcgcctacgagggcagcaacttcctgggcagacagatcctgctgagacccaacgagatccccaactggaccgccttcagcagatggaagaccatcggcagcctgagacccatgaagcagcccgccgtgtacatcagaatcaagaacagagcccagggcgagtacctgaccgtgaccggcagcctggccgacaccagagccaccagcgtgtgcatcagcccctacagcggcaagtag

SEQ ID NO: 18252 - DNA, 9156 bp, Artificial Sequence
  Description of Artificial Sequence: Synthetic coding sequence
atggccaccaacccccagccccagccccccccccccgcccccccccccccccccccccagccccagccccagccccccccccccccccccggccccggcgccggccccggcgccggcggcgccggcggcgccggcgccggcgccggcgacccccagctggtggccatgatcgtgaaccacctgaagagccagggcctgttcgaccagttcagaagagactgcctggccgacgtggacaccaagcccgcctaccagaacctgagacagagagtggacaacttcgtggccaaccacctggccacccacacctggagcccccacctgaacaagaaccagctgagaaacaacatcagacagcaggtgctgaagagcggcatgctggagagcggcatcgacagaatcatcagccaggtggtggaccccaagatcaaccacaccttcagaccccaggtggagaaggccgtgcacgagttcctggccaccctgaaccacaaggaggagggcagcggcaacaccgcccccgacgacgagaagcccgacaccagcctgatcacccagggcgtgcccacccccggccccagcgccaacgtggccaacgacgccatgagcatcctggagaccatcaccagcctgaaccaggaggccagcgccgccagagccagcaccgagaccagcaacgccaagaccagcgagagagccagcaagaagctgcccagccagcccaccaccgacaccagcaccgacaaggagagaaccagcgaggacatggccgacaaggagaagagcaccgccgacagcggcggcgagggcctggagaccgcccccaagagcgaggagttcagcgacctgccctgccccgtggaggagatcaagaactacaccaaggagcacaacaacctgatcctgctgaacaaggacgtgcagcaggagagcagcgagcagaagaacaagagcaccgacaagggcgagaagaagcccgacagcaacgagaagggcgagagaaagaaggagaagaaggagaagaccgagaagaagttcgaccacagcaagaagagcgaggacacccagaaggtgaaggacgagaagcaggccaaggagaaggaggtggagagcctgaagctgcccagcgagaagaacagcaacaaggccaagaccgtggagggcaccaaggaggacttcagcctgatcgacagcgacgtggacggcctgaccgacatcaccgtgagcagcgtgcacaccagcgacctgagcagcttcgaggaggacaccgaggaggaggtggtgaccagcgacagcatggaggagggcgagatcaccagcgacgacgaggagaagaacaagcagaacaagaccaagacccagaccagcgacagcagcgagggcaagaccaagagcgtgagacacgcctacgtgcacaagccctacctgtacagcaagtactacagcgacagcgacgacgagctgaccgtggagcagagaagacagagcatcgccaaggagaaggaggagagactgctgagaagacagatcaacagagagaagctggaggagaagagaaagcagaaggccgagaagaccaagagcagcaagaccaagggccagggcagaagcagcgtggacctggaggagagcagcaccaagagcctggagcccaaggccgccagaatcaaggaggtgctgaaggagagaaaggtgctggagaagaaggtggccctgagcaagaagagaaagaaggacagcagaaacgtggaggagaacagcaagaagaagcagcagtacgaggaggacagcaaggagaccctgaagaccagcgagcactgcgagaaggagaagatcagcagcagcaaggagctgaagcacgtgcacgccaagagcgagcccagcaagcccgccagaagactgagcgagagcctgcacgtggtggacgagaacaagaacgagagcaagctggagagagagcacaagagaagaaccagcacccccgtgatcatggagggcgtgcaggaggagaccgacaccagagacgtgaagagacaggtggagagaagcgagatctgcaccgaggagccccagaagcagaagagcaccctgaagaacgagaagcacctgaagaaggacgacagcgagaccccccacctgaagagcctgctgaagaaggaggtgaagagcagcaaggagaagcccgagagagagaagacccccagcgaggacaagctgagcgtgaagcacaagtacaagggcgactgcatgcacaagaccggcgacgagaccgagctgcacagcagcgagaagggcctgaaggtggaggagaacatccagaagcagagccagcagaccaagctgagcagcgacgacaagaccgagagaaagagcaagcacagaaacgagagaaagctgagcgtgctgggcaaggacggcaagcccgtgagcgagtacatcatcaagaccgacgagaacgtgagaaaggagaacaacaagaaggagagaagactgagcgccgagaagaccaaggccgagcacaagagcagaagaagcagcgacagcaagatccagaaggacagcctgggcagcaagcagcacggcatcaccctgcagagaagaagcgagagctacagcgaggacaagtgcgacatggacagcaccaacatggacagcaacctgaagcccgaggaggtggtgcacaaggagaagagaagaaccaagagcctgctggaggagaagctggtgctgaagagcaagagcaagacccagggcaagcaggtgaaggtggtggagaccgagctgcaggagggcgccaccaagcaggccaccacccccaagcccgacaaggagaagaacaccgaggagaacgacagcgagaagcagagaaagagcaaggtggaggacaagcccttcgaggagaccggcgtggagcccgtgctggagaccgccagcagcagcgcccacagcacccagaaggacagcagccacagagccaagctgcccctggccaaggagaagtacaagagcgacaaggacagcaccagcaccagactggagagaaagctgagcgacggccacaagagcagaagcctgaagcacagcagcaaggacatcaagaagaaggacgagaacaagagcgacgacaaggacggcaaggaggtggacagcagccacgagaaggccagaggcaacagcagcctgatggagaagaagctgagcagaagactgtgcgagaacagaagaggcagcctgagccaggagatggccaagggcgaggagaagctggccgccaacaccctgagcacccccagcggcagcagcctgcagagacccaagaagagcggcgacatgaccctgatccccgagcaggagcccatggagatcgacagcgagcccggcgtggagaacgtgttcgaggtgagcaagacccaggacaacagaaacaacaacagccagcaggacatcgacagcgagaacatgaagcagaagaccagcgccaccgtgcagaaggacgagctgagaacctgcaccgccgacagcaaggccaccgcccccgcctacaagcccggcagaggcaccggcgtgaacagcaacagcgagaagcacgccgaccacagaagcaccctgaccaagaagatgcacatccagagcgccgtgagcaagatgaaccccggcgagaaggagcccatccacagaggcaccaccgaggtgaacatcgacagcgagaccgtgcacagaatgctgctgagcgcccccagcgagaacgacagagtgcagaagaacctgaagaacaccgccgccgaggagcacgtggcccagggcgacgccaccctggagcacagcaccaacctggacagcagccccagcctgagcagcgtgaccgtggtgcccctgagagagagctacgaccccgacgtgatccccctgttcgacaagagaaccgtgctggagggcagcaccgccagcaccagccccgccgaccacagcgccctgcccaaccagagcctgaccgtgagagagagcgaggtgctgaagaccagcgacagcaaggagggcggcgagggcttcaccgtggacacccccgccaaggccagcatcaccagcaagagacacatccccgaggcccaccaggccaccctgctggacggcaagcagggcaaggtgatcatgcccctgggcagcaagctgaccggcgtgatcgtggagaacgagaacatcaccaaggagggcggcctggtggacatggccaagaaggagaacgacctgaacgccgagcccaacctgaagcagaccatcaaggccaccgtggagaacggcaagaaggacggcatcgccgtggaccacgtggtgggcctgaacaccgagaagtacgccgagaccgtgaagctgaagcacaagagaagccccggcaaggtgaaggacatcagcatcgacgtggagagaagaaacgagaacagcgaggtggacaccagcgccggcagcggcagcgcccccagcgtgctgcaccagagaaacggccagaccgaggacgtggccaccggccccagaagagccgagaagaccagcgtggccaccagcaccgagggcaaggacaaggacgtgaccctgagccccgtgaaggccggccccgccaccaccaccagcagcgagaccagacagagcgaggtggccctgccctgcaccagcatcgaggccgacgagggcctgatcatcggcacccacagcagaaacaaccccctgcacgtgggcgccgaggccagcgagtgcaccgtgttcgccgccgccgaggagggcggcgccgtggtgaccgagggcttcgccgagagcgagaccttcctgaccagcaccaaggagggcgagagcggcgagtgcgccgtggccgagagcgaggacagagccgccgacctgctggccgtgcacgccgtgaagatcgaggccaacgtgaacagcgtggtgaccgaggagaaggacgacgccgtgaccagcgccggcagcgaggagaagtgcgacggcagcctgagcagagacagcgagatcgtggagggcaccatcaccttcatcagcgaggtggagagcgacggcgccgtgaccagcgccggcaccgagatcagagccggcagcatcagcagcgaggaggtggacggcagccagggcaacatgatgagaatgggccccaagaaggagaccgagggcaccgtgacctgcaccggcgccgagggcagaagcgacaacttcgtgatctgcagcgtgaccggcgccggccccagagaggagagaatggtgaccggcgccggcgtggtgctgggcgacaacgacgccccccccggcaccagcgccagccaggagggcgacggcagcgtgaacgacggcaccgagggcgagagcgccgtgaccagcaccggcatcaccgaggacggcgagggccccgccagctgcaccggcagcgaggacagcagcgagggcttcgccatcagcagcgagagcgaggagaacggcgagagcgccatggacagcaccgtggccaaggagggcaccaacgtgcccctggtggccgccggcccctgcgacgacgagggcatcgtgaccagcaccggcgccaaggaggaggacgaggagggcgaggacgtggtgaccagcaccggcagaggcaacgagatcggccacgccagcacctgcaccggcctgggcgaggagagcgagggcgtgctgatctgcgagagcgccgagggcgacagccagatcggcaccgtggtggagcacgtggaggccgaggccggcgccgccatcatgaacgccaacgagaacaacgtggacagcatgagcggcaccgagaagggcagcaaggacaccgacatctgcagcagcgccaagggcatcgtggagagcagcgtgaccagcgccgtgagcggcaaggacgaggtgacccccgtgcccggcggctgcgagggccccatgaccagcgccgccagcgaccagagcgacagccagctggagaaggtggaggacaccaccatcagcaccggcctggtgggcggcagctacgacgtgctggtgagcggcgaggtgcccgagtgcgaggtggcccacaccagccccagcgagaaggaggacgaggacatcatcaccagcgtggagaacgaggagtgcgacggcctgatggccaccaccgccagcggcgacatcaccaaccagaacagcctggccggcggcaagaaccagggcaaggtgctgatcatcagcaccagcaccaccaacgactacaccccccaggtgagcgccatcaccgacgtggagggcggcctgagcgacgccctgagaaccgaggagaacatggagggcaccagagtgaccaccgaggagttcgaggcccccatgcccagcgccgtgagcggcgacgacagccagctgaccgccagcagaagcgaggagaaggacgagtgcgccatgatcagcaccagcatcggcgaggagttcgagctgcccatcagcagcgccaccaccatcaagtgcgccgagagcctgcagcccgtggccgccgccgtggaggagagagccaccggccccgtgctgatcagcaccgccgacttcgagggccccatgcccagcgccccccccgaggccgagagccccctggccagcaccagcaaggaggagaaggacgagtgcgccctgatcagcaccagcatcgccgaggagtgcgaggccagcgtgagcggcgtggtggtggagagcgagaacgagagagccggcaccgtgatggaggagaaggacggcagcggcatcatcagcaccagcagcgtggaggactgcgagggccccgtgagcagcgccgtgccccaggaggagggcgaccccagcgtgacccccgccgaggagatgggcgacaccgccatgatcagcaccagcaccagcgagggctgcgaggccgtgatgatcggcgccgtgctgcaggacgaggacagactgaccatcaccagagtggaggacctgagcgacgccgccatcatcagcaccagcaccgccgagtgcatgcccatcagcgccagcatcgacagacacgaggagaaccagctgaccgccgacaaccccgagggcaacggcgacctgagcgccaccgaggtgagcaagcacaaggtgcccatgcccagcctgatcgccgagaacaactgcagatgccccggccccgtgagaggcggcaaggagcccggccccgtgctggccgtgagcaccgaggagggccacaacggccccagcgtgcacaagcccagcgccggccagggccaccccagcgccgtgtgcgccgagaaggaggagaagcacggcaaggagtgccccgagatcggccccttcgccggcagaggccagaaggagagcaccctgcacctgatcaacgccgaggagaagaacgtgctgctgaacagcctgcagaaggaggacaagagccccgagaccggcaccgccggcggcagcagcaccgccagctacagcgccggcagaggcctggagggcaacgccaacagccccgcccacctgagaggccccgagcagaccagcggccagaccgccaaggaccccagcgtgagcatcagatacctggccgccgtgaacaccggcgccatcaaggccgacgacatgccccccgtgcagggcaccgtggccgagcacagcttcctgcccgccgagcagcagggcagcgaggacaacctgaagaccagcaccaccaagtgcatcaccggccaggagagcaagatcgcccccagccacaccatgatcccccccgccacctacagcgtggccctgctggcccccaagtgcgagcaggacctgaccatcaagaacgactacagcggcaagtggaccgaccaggccagcgccgagaagaccggcgacgacaacagcaccagaaagagcttccccgaggagggcgacatcatggtgaccgtgagcagcgaggagaacgtgtgcgacatcggcaacgaggagagccccctgaacgtgctgggcggcctgaagctgaaggccaacctgaagatggaggcctacgtgcccagcgaggaggagaagaacggcgagatcctggccccccccgagagcctgtgcggcggcaagcccagcggcatcgccgagctgcagagagagcccctgctggtgaacgagagcctgaacgtggagaacagcggcttcagaaccaacgaggagatccacagcgagagctacaacaagggcgagatcagcagcggcagaaaggacaacgccgaggccatcagcggccacagcgtggaggccgaccccaaggaggtggaggaggaggagagacacatgcccaagagaaagagaaagcagcactacctgagcagcgaggacgagcccgacgacaaccccgacgtgctggacagcagaatcgagaccgcccagagacagtgccccgagaccgagccccacgacaccaaggaggagaacagcagagacctggaggagctgcccaagaccagcagcgagaccaacagcaccaccagcagagtgatggaggagaaggacgagtacagcagcagcgagaccaccggcgagaagcccgagcagaacgacgacgacaccatcaagagccaggaggaggaccagcccatcatcatcaagagaaagagaggcagacccagaaagtaccccgtggagaccaccctgaagatgaaggacgacagcaagaccgacaccggcatcgtgaccgtggagcagagccccagcagcagcaagctgaaggtgatgcagaccgacgagagcaacaaggagaccgccaacctgcaggagagaagcatcagcaacgacgacggcgaggagaagatcgtgaccagcgtgagaagaagaggcagaaagcccaagagaagcctgaccgtgagcgacgacgccgagagcagcgagcccgagagaaagagacagaagagcgtgagcgaccccgtggaggacaagaaggagcaggagagcgacgaggaggaggaggaggaggaggaggacgagcccagcggcgccaccaccagaagcaccaccagaagcgaggcccagagaagcaagacccagctgagccccagcatcaagagaaagagagaggtgagcccccccggcgccagaaccagaggccagcagagagtggaggaggcccccgtgaagaaggccaagagatag

SEQ ID NO: 18253 - DNA, 519 bp, Artificial Sequence
  Description of Artificial Sequence: Synthetic coding sequence
atggccgacggcggcggcggcggcagcggcggcgccggccccgccagcaccagagccagcggcggcggcggccccatcaaccccgccagcctgccccccggcgacccccagctgatcgccatcatcgtgggccagctgaagagcagaggcctgttcgacagcttcagaagagactgcaaggccgacgtggacaccaagcccgcctaccagaacctgagccagaaggccgacaacttcgtgagcacccacctggacaagcaggagtggaacccccccgccaacgacaaccagctgcacgacggcctgagacagagcgtggtgcagagcggcagaagcgaggccggcgtggacagaatcagcagccaggtggtggaccccaagctgaaccacatcttcagaccccagatcgagcagatcatccacgagttcctggtggcccagaaggaggccgccgtgcccgccctgccccccgagcccgagggccaggacccccccgcccccagccaggacaccagctag

SEQ ID NO: 18254 - DNA, 414 bp, Artificial Sequence
  Description of Artificial Sequence: Synthetic coding sequence
atgctgagcggcagactggtgctgggcctggtgagcatggccggcagagtgtgcctgtgccagggcagcgccggcagcggcgccatcggccccgtggaggccgccatcagaaccaagctggaggaggccctgagccccgaggtgctggagctgagaaacgagagcggcggccacgccgtgccccccggcagcgagacccacttcagagtggccgtggtgagcagcagattcgagggcctgagccccctgcagagacacagactggtgcacgccgccctggccgaggagctgggcggccccgtgcacgccctggccatccaggccagaacccccgcccagtggagagagaacagccagctggacaccagccccccctgcctgggcggcaacaagaagaccctgggcaccccctag

SEQ ID NO: 18255 - DNA, 459 bp, Artificial Sequence
  Description of Artificial Sequence: Synthetic coding sequence
atggccagcgccaagagcctggacagatggaaggccagactgctggagggcggcagcaccgccctgacctacgccctggtgagagccgaggtgagcttccccgccgaggtggcccccgtgagacagcagggcagcgtggccggcgccagagccggcgtggtgagcctgctgggctgcagaagcagctggaccgccgccatggagctgagcgccgagtacctgagagagaagctgcagagagacctggaggccgagcacgtggaggtggaggacaccaccctgaacagatgcagctgcagcttcagagtgctggtggtgagcgccaagttcgagggcaagcccctgctgcagagacacagactggtgaacgcctgcctggccgaggagctgccccacatccacgccttcgagcagaagaccctgacccccgaccagtgggccagagagagacagaagtag

SEQ ID NO: 18256 - DNA, 1593 bp, Artificial Sequence
  Description of Artificial Sequence: Synthetic coding sequence
atgaccagcagcctgcagagaccctggagagtgccctggctgccctggaccatcctgctggtgagcaccgccgccgccagccagaaccaggagagactgtgcgccttcaaggacccctaccagcaggacctgggcatcggcgagagcagaatcagccacgagaacggcaccatcctgtgcagcaagggcagcacctgctacggcctgtgggagaagagcaagggcgacatcaacctggtgaagcagggctgctggagccacatcggcgacccccaggagtgccactacgaggagtgcgtggtgaccaccaccccccccagcatccagaacggcacctacagattctgctgctgcagcaccgacctgtgcaacgtgaacttcaccgagaacttccccccccccgacaccacccccctgagccccccccacagcttcaacagagacgagaccatcatcatcgccctggccagcgtgagcgtgctggccgtgctgatcgtggccctgtgcttcggctacagaatgctgaccggcgacagaaagcagggcctgcacagcatgaacatgatggaggccgccgccagcgagcccagcctggacctggacaacctgaagctgctggagctgatcggcagaggcagatacggcgccgtgtacaagggcagcctggacgagagacccgtggccgtgaaggtgttcagcttcgccaacagacagaacttcatcaacgagaagaacatctacagagtgcccctgatggagcacgacaacatcgccagattcatcgtgggcgacgagagagtgaccgccgacggcagaatggagtacctgctggtgatggagtactaccccaacggcagcctgtgcaagtacctgagcctgcacaccagcgactgggtgagcagctgcagactggcccacagcgtgaccagaggcctggcctacctgcacaccgagctgcccagaggcgaccactacaagcccgccatcagccacagagacctgaacagcagaaacgtgctggtgaagaacgacggcacctgcgtgatcagcgacttcggcctgagcatgagactgaccggcaacagactggtgagacccggcgaggaggacaacgccgccatcagcgaggtgggcaccatcagatacatggcccccgaggtgctggagggcgccgtgaacctgagagactgcgagagcgccctgaagcaggtggacatgtacgccctgggcctgatctactgggagatcttcatgagatgcaccgacctgttccccggcgagagcgtgcccgagtaccagatggccttccagaccgaggtgggcaaccaccccaccttcgaggacatgcaggtgctggtgagcagagagaagcagagacccaagttccccgaggcctggaaggagaacagcctggccgtgagaagcctgaaggagaccatcgaggactgctgggaccaggacgccgaggccagactgaccgcccagtgcgccgaggagagaatggccgagctgatgatgatctgggagagaaacaagagcgtgagccccaccgtgaaccccatgagcaccgccatgcagaacgagagaagatag

SEQ ID NO: 18257 - DNA, 1470 bp, Artificial Sequence
  Description of Artificial Sequence: Synthetic coding sequence
atgaacaagctgagccccgtgctgctgttcctgaaccagcagaactaccagatcgacaaggacgtggaggacaagagacagaaggccatcgaggagttcttcaccaaggacgtgatcgtgcccagcccctggaccgaccacgagggcaagcagctgagccagtgccacagcagcaagtgcaccaacatcaacagcgacagccccgtgggcaagaagctgaccatccacagcgagaagagcgacgccgcctgccagaccctgctgagcctgcccgtggacttcaacctggagaacatcctgggcgactacttcagagccgacgagttcgccgaccagagccccggcaacctgagcagcagcagcctgagaagaaagctgttcctggacggcaacggcagcatcagcgacagcctgcccagcgccagccccggcagcccccacagcggcgtgcagaccagcctggagatgttctacagcatcgacctgagccccgtgaagtgcagaagccccctgcagacccccagcagcggccagttcagcagcagccccatccaggccagcgccaagaagtacagcctgggcagcatcaccagccccagccccatcagcagccccaccttcagccccatcgagttccagatcggcgagacccccctgagcgagcagagaaagttcaccgtgcacagccccgacgccagcagcggcaccaacagcaacggcatcaccaacccctgcatcagaagcccctacatcgacggctgcagccccatcaagaactggagccccatgagactgcagatgtacagcggcggcacccagtacagaaccagcgtgatccagatccccttcaccctggagacccagggcgaggacgaggaggacaaggagaacatccccagcaccgacgtgagcagccccgccatggacgccgccggcatccacctgagacagttcagcaacgaggccagcacccacggcacccacctggtggtgaccgccatgagcgtgacccagaaccagagcagcgccagcgagaaggagctggccctgctgcaggacgtggagagagagaaggacaacaacaccgtggacatggtggaccccatcgagatcgccgacgagaccacctggatcaaggagcccgtggacaacggcagcctgcccatgaccgacttcgtgagcggcatcgccttcagcatcgagaacagccacatgtgcatgagccccctggccgagagcagcgtgatcccctgcgagagcagcaacatccagatggacagcggctacaacacccagaactgcggcagcaacatcatggacaccgtgggcgccgagagctactgcaaggagagcgacgcccagacctgcgaggtggagagcaagagccaggccttcaacatgaagcaggaccacaccacccagagatgctggatgaagaccgccagccccttccagtgcagcagcccctag

SEQ ID NO: 18258 - DNA, 1680 bp, Artificial Sequence
  Description of Artificial Sequence: Synthetic coding sequence
atgggcgacgtgaaggagagcaagatgcagatcacccccgagacccccggcagaatccccgtgctgaaccccttcgagagccccagcgactacagcaacctgcacgagcagaccctggccagccccagcgtgttcaagagcaccaagctgcccacccccggcaagttcagatggagcatcgaccagctggccgtgatcaaccccgtggagatcgaccccgaggacatccacagacaggccctgtacctgagccacagcagaatcgacaaggacgtggaggacaagagacagaaggccatcgaggagttcttcaccaaggacgtgatcgtgcccagcccctggaccgaccacgagggcaagcagctgagccagtgccacagcagcaagtgcaccaacatcaacagcgacagccccgtgggcaagaagctgaccatccacagcgagaagagcgacgccgcctgccagaccctgctgagcctgcccgtggacttcaacctggagaacatcctgggcgactacttcagagccgacgagttcgccgaccagagccccggcaacctgagcagcagcagcctgagaagaaagctgttcctggacggcaacggcagcatcagcgacagcctgcccagcgccagccccggcagcccccacagcggcgtgcagaccagcctggagatgttctacagcatcgacctgagccccgtgaagtgcagaagccccctgcagacccccagcagcggccagttcagcagcagccccatccaggccagcgccaagaagtacagcctgggcagcatcaccagccccagccccatcagcagccccaccttcagccccatcgagttccagatcggcgagacccccctgagcgagcagagaaagttcaccgtgcacagccccgacgccagcagcggcaccaacagcaacggcatcaccaacccctgcatcagaagcccctacatcgacggctgcagccccatcaagaactggagccccatgagactgcagatgtacagcggcggcacccagtacagaaccagcgtgatccagatccccttcaccctggagacccagggcgaggacgaggaggacaaggagaacatccccagcaccgacgtgagcagccccgccatggacgccgccggcatccacctgagacagttcagcaacgaggccagcacccacggcacccacctggtggtgaccgccatgagcgtgacccagaaccagagcagcgccagcgagaaggagctggccctgctgcaggacgtggagagagagaaggacaacaacaccgtggacatggtggaccccatcgagatcgccgacgagaccacctggatcaaggagcccgtggacaacggcagcctgcccatgaccgacttcgtgagcggcatcgccttcagcatcgagaacagccacatgtgcatgagccccctggccgagagcagcgtgatcccctgcgagagcagcaacatccagatggacagcggctacaacacccagaactgcggcagcaacatcatggacaccgtgggcgccgagagctactgcaaggagagcgacgcccagacctgcgaggtggagagcaagagccaggccttcaacatgaagcaggaccacaccacccagagatgctggatgaagaccgccagccccttccagtgcagcagcccctag

SEQ ID NO: 18259 - DNA, 2007 bp, Artificial Sequence
  Description of Artificial Sequence: Synthetic coding sequence
atgaccagcaccggcaaggacggcggcgcccagcacgcccagtacgtgggcccctacagactggagaagaccctgggcaagggccagaccggcctggtgaagctgggcgtgcactgcgtgacctgccagaaggtggccatcaagatcgtgaacagagagaagctgagcgagagcgtgctgatgaaggtggagagagagatcgccatcctgaagctgatcgagcacccccacgtgctgaagctgcacgacgtgtacgagaacaagaagtacctgtacctggtgctggagcacgtgagcggcggcgagctgttcgactacctggtgaagaagggcagactgacccccaaggaggccagaaagttcttcagacagatcatcagcgccctggacttctgccacagccacagcatctgccacagagacctgaagcccgagaacctgctgctggacgagaagaacaacatcagaatcgccgacttcggcatggccagcctgcaggtgggcgacagcctgctggagaccagctgcggcagcccccactacgcctgccccgaggtgatcagaggcgagaagtacgacggcagaaaggccgacgtgtggagctgcggcgtgatcctgttcgccctgctggtgggcgccctgcccttcgacgacgacaacctgagacagctgctggagaaggtgaagagaggcgtgttccacatgccccacttcatcccccccgactgccagagcctgctgagaggcatgatcgaggtggacgccgccagaagactgaccctggagcacatccagaagcacatctggtacatcggcggcaagaacgagcccgagcccgagcagcccatccccagaaaggtgcagatcagaagcctgcccagcctggaggacatcgaccccgacgtgctggacagcatgcacagcctgggctgcttcagagacagaaacaagctgctgcaggacctgctgagcgaggaggagaaccaggagaagatgatctacttcctgctgctggacagaaaggagagataccccagccaggaggacgaggacctgccccccagaaacgagatcgacccccccagaaagagagtggacagccccatgctgaacagacacggcaagagaagacccgagagaaagagcatggaggtgctgagcgtgaccgacggcggcagccccgtgcccgccagaagagccatcgagatggcccagcacggccagagaagcagaagcatcagcggcgccagcagcggcctgagcaccagccccctgagcagccccagagtgaccccccaccccagccccagaggcagccccctgcccacccccaagggcacccccgtgcacacccccaaggagagccccgccggcacccccaaccccaccccccccagcagccccagcgtgggcggcgtgccctggagagccagactgaacagcatcaagaacagcttcctgggcagccccagattccacagaagaaagctgcaggtgcccacccccgaggagatgagcaacctgacccccgagagcagccccgagctggccaagaagagctggttcggcaacttcatcagcctggagaaggaggagcagatcttcgtggtgatcaaggacaagcccctgagcagcatcaaggccgacatcgtgcacgccttcctgagcatccccagcctgagccacagcgtgatcagccagaccagcttcagagccgagtacaaggccaccggcggccccgccgtgttccagaagcccgtgaagttccaggtggacatcacctacaccgagggcggcgaggcccagaaggagaacggcatctacagcgtgaccttcaccctgctgagcggccccagcagaagattcaagagagtggtggagaccatccaggcccagctgctgagcacccacgacccccccgccgcccagcacctgagcgacaccaccaactgcatggagatgatgaccggcagactgagcaagtgcggcatcatccccaagagctag

SEQ ID NO: 18260 - DNA, 2091 bp, Artificial Sequence
  Description of Artificial Sequence: Synthetic coding sequence
atgaccagcaccggcaaggacggcggcgcccagcacgcccagtacgtgggcccctacagactggagaagaccctgggcaagggccagaccggcctggtgaagctgggcgtgcactgcgtgacctgccagaaggtggccatcaagatcgtgaacagagagaagctgagcgagagcgtgctgatgaaggtggagagagagatcgccatcctgaagctgatcgagcacccccacgtgctgaagctgcacgacgtgtacgagaacaagaagtacctgtacctggtgctggagcacgtgagcggcggcgagctgttcgactacctggtgaagaagggcagactgacccccaaggaggccagaaagttcttcagacagatcatcagcgccctggacttctgccacagccacagcatctgccacagagacctgaagcccgagaacctgctgctggacgagaagaacaacatcagaatcgccgacttcggcatggccagcctgcaggtgggcgacagcctgctggagaccagctgcggcagcccccactacgcctgccccgaggtgatcagaggcgagaagtacgacggcagaaaggccgacgtgtggagctgcggcgtgatcctgttcgccctgctggtgggcgccctgcccttcgacgacgacaacctgagacagctgctggagaaggtgaagagaggcgtgttccacatgccccacttcatcccccccgactgccagagcctgctgagaggcatgatcgaggtggacgccgccagaagactgaccctggagcacatccagaagcacatctggtacatcggcggcaagaacgagcccgagcccgagcagcccatccccagaaaggtgcagatcagaagcctgcccagcctggaggacatcgaccccgacgtgctggacagcatgcacagcctgggctgcttcagagacagaaacaagctgctgcaggacctgctgagcgaggaggagaaccaggagaagatgatctacttcctgctgctggacagaaaggagagataccccagccaggaggacgaggacctgccccccagaaacgagatcgacccccccagaaagagagtggacagccccatgctgaacagacacggcaagagaagacccgagagaaagagcatggaggtgctgagcgtgaccgacggcggcagccccgtgcccgccagaagagccatcgagatggcccagcacggccagagcaaggccatgttcagcaagagcctggacatcgccgaggcccacccccagttcagcaaggaggacagaagcagaagcatcagcggcgccagcagcggcctgagcaccagccccctgagcagccccagagtgaccccccaccccagccccagaggcagccccctgcccacccccaagggcacccccgtgcacacccccaaggagagccccgccggcacccccaaccccaccccccccagcagccccagcgtgggcggcgtgccctggagagccagactgaacagcatcaagaacagcttcctgggcagccccagattccacagaagaaagctgcaggtgcccacccccgaggagatgagcaacctgacccccgagagcagccccgagctggccaagaagagctggttcggcaacttcatcagcctggagaaggaggagcagatcttcgtggtgatcaaggacaagcccctgagcagcatcaaggccgacatcgtgcacgccttcctgagcatccccagcctgagccacagcgtgatcagccagaccagcttcagagccgagtacaaggccaccggcggccccgccgtgttccagaagcccgtgaagttccaggtggacatcacctacaccgagggcggcgaggcccagaaggagaacggcatctacagcgtgaccttcaccctgctgagcggccccagcagaagattcaagagagtggtggagaccatccaggcccagctgctgagcacccacgacccccccgccgcccagcacctgagcgagccccccccccccgcccccggcctgagctggggcgccggcctgaagggccagaaggtggccaccagctacgagagcagcctgtag

SEQ ID NO: 18261 - DNA, 2301 bp, Artificial Sequence
  Description of Artificial Sequence: Synthetic coding sequence
atgagccccgagggccaccccagcagatgggccagacccagaagaccctgcatctgccccagcagcctgtgcagccccagagagcccagaagcggccccgccgtgggcagaggcggcgccgcccaccacagagtgcccgccggccacacccccggcccccagctgctgcagccccacctgcacctgccccagggccagacctggctgtgcctgcagcccagccccgccggcctggtgaagctgggcgtgcactgcgtgacctgccagaaggtggccatcaagatcgtgaacagagagaagctgagcgagagcgtgctgatgaaggtggagagagagatcgccatcctgaagctgatcgagcacccccacgtgctgaagctgcacgacgtgtacgagaacaagaagtacctgtacctggtgctggagcacgtgagcggcggcgagctgttcgactacctggtgaagaagggcagactgacccccaaggaggccagaaagttcttcagacagatcatcagcgccctggacttctgccacagccacagcatctgccacagagacctgaagcccgagaacctgctgctggacgagaagaacaacatcagaatcgccgacttcggcatggccagcctgcaggtgggcgacagcctgctggagaccagctgcggcagcccccactacgcctgccccgaggtgatcagaggcgagaagtacgacggcagaaaggccgacgtgtggagctgcggcgtgatcctgttcgccctgctggtgggcgccctgcccttcgacgacgacaacctgagacagctgctggagaaggtgaagagaggcgtgttccacatgccccacttcatcccccccgactgccagagcctgctgagaggcatgatcgaggtggacgccgccagaagactgaccctggagcacatccagaagcacatctggtacatcggcggcaagaacgagcccgagcccgagcagcccatccccagaaaggtgcagatcagaagcctgcccagcctggaggacatcgaccccgacgtgctggacagcatgcacagcctgggctgcttcagagacagaaacaagctgctgcaggacctgctgagcgaggaggagaaccaggagaagatgatctacttcctgctgctggacagaaaggagagataccccagccaggaggacgaggacctgccccccagaaacgagatcgacccccccagaaagagagtggacagccccatgctgaacagacacggcaagagaagacccgagagaaagagcatggaggtgctgagcgtgaccgacggcggcagccccgtgcccgccagaagagccatcgagatggcccagcacggccagagaagcagaagcatcagcggcgccagcagcggcctgagcaccagccccctgagcagccccagagtgaccccccaccccagccccagaggcagccccctgcccacccccaagggcacccccgtgcacacccccaaggagagccccgccggcacccccaaccccaccccccccagcagccccagcgtgggcggcgtgccctggagagccagactgaacagcatcaagaacagcttcctgggcagccccagattccacagaagaaagctgcaggtgcccacccccgaggagatgagcaacctgacccccgagagcagccccgagctggccaagaagagctggttcggcaacttcatcagcctggagaaggaggagcagatcttcgtggtgatcaaggacaagcccctgagcagcatcaaggccgacatcgtgcacgccttcctgagcatccccagcctgagccacagcgtgatcagccagaccagcttcagagccgagtacaaggccaccggcggccccgccgtgttccagaagcccgtgaagttccaggtggacatcacctacaccgagggcggcgaggcccagaaggagaacggcatctacagcgtgaccttcaccctgctgagcggccccagcagaagattcaagagagtggtggagaccatccaggcccagctgctgagcacccacgacccccccgccgcccagcacctgagcgacaccaccaactgcatggagatgatgaccggcagactgagcaagtgcgacgagaagaacggccaggccgcccaggcccccagcacccccgccaagagaagcgcccacggccccctgggcgacagcgccgccgccggccccggccccggcggcgacgccgagtaccccaccggcaaggacaccgccaagatgggcccccccaccgccagaagagagcagccctag

SEQ ID NO: 18262 - DNA, 2091 bp, Artificial Sequence; identical to SEQ ID NO: 18260
  Description of Artificial Sequence: Synthetic coding sequence

SEQ ID NO: 18263 - DNA, 2211 bp, Artificial Sequence
  Description of Artificial Sequence: Synthetic coding sequence
atgaccagcaccggcaaggacggcggcgcccagcacgcccagtacgtgggcccctacagactggagaagaccctgggcaagggccagaccggcctggtgaagctgggcgtgcactgcgtgacctgccagaaggtggccatcaagatcgtgaacagagagaagctgagcgagagcgtgctgatgaaggtggagagagagatcgccatcctgaagctgatcgagcacccccacgtgctgaagctgcacgacgtgtacgagaacaagaagtacctgtacctggtgctggagcacgtgagcggcggcgagctgttcgactacctggtgaagaagggcagactgacccccaaggaggccagaaagttcttcagacagatcatcagcgccctggacttctgccacagccacagcatctgccacagagacctgaagcccgagaacctgctgctggacgagaagaacaacatcagaatcgccgacttcggcatggccagcctgcaggtgggcgacagcctgctggagaccagctgcggcagcccccactacgcctgccccgaggtgatcagaggcgagaagtacgacggcagaaaggccgacgtgtggagctgcggcgtgatcctgttcgccctgctggtgggcgccctgcccttcgacgacgacaacctgagacagctgctggagaaggtgaagagaggcgtgttccacatgccccacttcatcccccccgactgccagagcctgctgagaggcatgatcgaggtggacgccgccagaagactgaccctggagcacatccagaagcacatctggtacatcggcggcaagaacgagcccgagcccgagcagcccatccccagaaaggtgcagatcagaagcctgcccagcctggaggacatcgaccccgacgtgctggacagcatgcacagcctgggctgcttcagagacagaaacaagctgctgcaggacctgctgagcgaggaggagaaccaggagaagatgatctacttcctgctgctggacagaaaggagagataccccagccaggaggacgaggacctgccccccagaaacgagatcgacccccccagaaagagagtggacagccccatgctgaacagacacggcaagagaagacccgagagaaagagcatggaggtgctgagcgtgaccgacggcggcagccccgtgcccgccagaagagccatcgagatggcccagcacggccagagaagcagaagcatcagcggcgccagcagcggcctgagcaccagccccctgagcagccccagagtgaccccccaccccagccccagaggcagccccctgcccacccccaagggcacccccgtgcacacccccaaggagagccccgccggcacccccaaccccaccccccccagcagccccagcgtgggcggcgtgccctggagagccagactgaacagcatcaagaacagcttcctgggcagccccagattccacagaagaaagctgcaggtgcccacccccgaggagatgagcaacctgacccccgagagcagccccgagctggccaagaagagctggttcggcaacttcatcagcctggagaaggaggagcagatcttcgtggtgatcaaggacaagcccctgagcagcatcaaggccgacatcgtgcacgccttcctgagcatccccagcctgagccacagcgtgatcagccagaccagcttcagagccgagtacaaggccaccggcggccccgccgtgttccagaagcccgtgaagttccaggtggacatcacctacaccgagggcggcgaggcccagaaggagaacggcatctacagcgtgaccttcaccctgctgagcggccccagcagaagattcaagagagtggtggagaccatccaggcccagctgctgagcacccacgacccccccgccgcccagcacctgagcgacaccaccaactgcatggagatgatgaccggcagactgagcaagtgcggcagccccctgagcaacttcttcgacgtgatcaagcagctgttcagcgacgagaagaacggccaggccgcccaggcccccagcacccccgccaagagaagcgcccacggccccctgggcgacagcgccgccgccggccccggccccggcggcgacgccgagtaccccaccggcaaggacaccgccaagatgggcccccccaccgccagaagagagcagccctag

SEQ ID NO: 18264 - DNA, 2025 bp, Artificial Sequence
  Description of Artificial Sequence: Synthetic coding sequence
atgaccagcaccggcaaggacggcggcgcccagcacgcccagtacgtgggcccctacagactggagaagaccctgggcaagggccagaccggcctggtgaagctgggcgtgcactgcgtgacctgccagaaggtggccatcaagatcgtgaacagagagaagctgagcgagagcgtgctgatgaaggtggagagagagatcgccatcctgaagctgatcgagcacccccacgtgctgaagctgcacgacgtgtacgagaacaagaagtacctgtacctggtgctggagcacgtgagcggcggcgagctgttcgactacctggtgaagaagggcagactgacccccaaggaggccagaaagttcttcagacagatcatcagcgccctggacttctgccacagccacagcatctgccacagagacctgaagcccgagaacctgctgctggacgagaagaacaacatcagaatcgccgacttcggcatggccagcctgcaggtgggcgacagcctgctggagaccagctgcggcagcccccactacgcctgccccgaggtgatcagaggcgagaagtacgacggcagaaaggccgacgtgtggagctgcggcgtgatcctgttcgccctgctggtgggcgccctgcccttcgacgacgacaacctgagacagctgctggagaaggtgaagagaggcgtgttccacatgccccacttcatcccccccgactgccagagcctgctgagaggcatgatcgaggtggacgccgccagaagactgaccctggagcacatccagaagcacatctggtacatcggcggcaagaacgagcccgagcccgagcagcccatccccagaaaggtgcagatcagaagcctgcccagcctggaggacatcgaccccgacgtgctggacagcatgcacagcctgggctgcttcagagacagaaacaagctgctgcaggacctgctgagcgaggaggagaaccaggagaagatgatctacttcctgctgctggacagaaaggagagataccccagccaggaggacgaggacctgccccccagaaacgagatcgacccccccagaaagagagtggacagccccatgctgaacagacacggcaagagaagacccgagagaaagagcatggaggtgctgagcgtgaccgacggcggcagccccgtgcccgccagaagagccatcgagatggcccagcacggccagagaagcagaagcatcagcggcgccagcagcggcctgagcaccagccccctgagcagccccagagtgaccccccaccccagccccagaggcagccccctgcccacccccaagggcacccccgtgcacacccccaaggagagccccgccggcacccccaaccccaccccccccagcagccccagcgtgggcggcgtgccctggagagccagactgaacagcatcaagaacagcttcctgggcagccccagattccacagaagaaagctgcaggtgcccacccccgaggagatgagcaacctgacccccgagagcagccccgagctggccaagaagagctggttcggcaacttcatcagcctggagaaggaggagcagatcttcgtggtgatcaaggacaagcccctgagcagcatcaaggccgacatcgtgcacgccttcctgagcatccccagcctgagccacagcgtgatcagccagaccagcttcagagccgagtacaaggccaccggcggccccgccgtgttccagaagcccgtgaagttccaggtggacatcacctacaccgagggcggcgaggcccagaaggagaacggcatctacagcgtgaccttcaccctgctgagcggccccagcagaagattcaagagagtggtggagaccatccaggcccagctgctgagcacccacgacccccccgccgcccagcacctgagcgagccccccccccccgcccccggcctgagctggggcgccggcctgaagggccagaaggtggccaccagctacgagagcagcctgtag

SEQ ID NO: 18265 - DNA, 1110 bp, Artificial Sequence
  Description of Artificial Sequence: Synthetic coding sequence
atgcacagcctgggctgcttcagagacagaaacaagctgctgcaggacctgctgagcgaggaggagaaccaggagaagatgatctacttcctgctgctggacagaaaggagagataccccagccaggaggacgaggacctgccccccagaaacgagatcgacccccccagaaagagagtggacagccccatgctgaacagacacggcaagagaagacccgagagaaagagcatggaggtgctgagcgtgaccgacggcggcagccccgtgcccgccagaagagccatcgagatggcccagcacggccagagaagcagaagcatcagcggcgccagcagcggcctgagcaccagccccctgagcagccccagagtgaccccccaccccagccccagaggcagccccctgcccacccccaagggcacccccgtgcacacccccaaggagagccccgccggcacccccaaccccaccccccccagcagccccagcgtgggcggcgtgccctggagagccagactgaacagcatcaagaacagcttcctgggcagccccagattccacagaagaaagctgcaggtgcccacccccgaggagatgagcaacctgacccccgagagcagccccgagctggccaagaagagctggttcggcaacttcatcagcctggagaaggaggagcagatcttcgtggtgatcaaggacaagcccctgagcagcatcaaggccgacatcgtgcacgccttcctgagcatccccagcctgagccacagcgtgatcagccagaccagcttcagagccgagtacaaggccaccggcggccccgccgtgttccagaagcccgtgaagttccaggtggacatcacctacaccgagggcggcgaggcccagaaggagaacggcatctacagcgtgaccttcaccctgctgagcggccccagcagaagattcaagagagtggtggagaccatccaggcccagctgctgagcacccacgacccccccgccgcccagcacctgagcgagccccccccccccgcccccggcctgagctggggcgccggcctgaagggccagaaggtggccaccagctacgagagcagcctgtag

SEQ ID NO: 18266 - DNA, 336 bp, Artificial Sequence
  Description of Artificial Sequence: Synthetic coding sequence
atggagaacgtgcccaaggagaacaaggtggtggagaaggcccccgtgcagaacgaggcccccgccctgggcggcggcgagtaccaggagcccggcggcaacgtgaagggcgtgtgggccccccccgcccccggcttcggcgaggacgtgcccaacagactggtggacaacatcgacatgatcgacggcgacggcgacgacatggagagattcatggaggagatgagagagctgagaagaaagatcagagagctgcagctgagatacagcctgagaatcctgatcggcgaccccccccaccacgaccaccacgacgagttctgcctgatgccctag

SEQ ID NO: 18267 - DNA, 336 bp, Artificial Sequence; identical to SEQ ID NO: 18266
  Description of Artificial Sequence: Synthetic coding sequence

SEQ ID NO: 18268 - DNA, 2478 bp, Artificial Sequence
  Description of Artificial Sequence: Synthetic coding sequence
atggccgccggcaagttcgccagcctgcccagaaacatgcccgtgaaccaccagttccccctggccagcagcatggacctgctgagcagcagaagccccctggccgagcacagacccgacgcctaccaggacgtgagcatccacggcaccctgcccagaaagaagaagggccccccccccatcagaagctgcgacgacttcagccacatgggcaccctgccccacagcaagagccccagacagaacagccccgtgacccaggacggcatccaggagagcccctggcaggacagacacggcgagaccttcaccttcagagacccccacctgctggaccccaccgtggagtacgtgaagttcagcaaggagagacacatcatggacagaacccccgagaagctgaagaaggagctggaggaggagctgctgctgagcagcgaggacctgagaagccacgcctggtaccacggcagaatccccagacaggtgagcgagaacctggtgcagagagacggcgacttcctggtgagagacagcctgagcagccccggcaacttcgtgctgacctgccagtggaagaacctggcccagcacttcaagatcaacagaaccgtgctgagactgagcgaggcctacagcagagtgcagtaccagttcgagatggagagcttcgacagcatccccggcctggtgagatgctacgtgggcaacagaagacccatcagccagcagagcggcgccatcatcttccagcccatcaacagaaccgtgcccctgagatgcctggaggagcactacggcaccagccccggccaggccagagagggcagcctgaccaagggcagacccgacgtggccaagagactgagcctgaccatgggcggcgtgcaggccagagagcagaacctgcccagaggcaacctgctgagaaacaaggagaagagcggcagccagcccgcctgcctggaccacatgcaggacagaagagccctgagcctgaaggcccaccagagcgagagctacctgcccatcggctgcaagctgcccccccagagcagcggcgtggacaccagcccctgccccaacagccccgtgttcagaaccggcagcgagcccgccctgagccccgccgtggtgagaagagtgagcagcgacgccagagccggcgaggccctgagaggcagcgacagccagctgtgccccaagcccccccccaagccctgcaaggtgcccttcctgaaggtgcccagcagccccagcgcctggctgaacagcgaggccaactactgcgagctgaaccccgccttcgccaccggctgcggcagaggcgccaagctgcccagctgcgcccagggcagccacaccgagctgctgaccgccaagcagaacgaggcccccggccccagaaacagcggcgtgaactacctgatcctggacgacgacgacagagagagaccctgggagcccgccgccgcccagatggagaagggccagtgggacaagggcgagttcgtgacccccctgctggagaccgtgagcagcttcagacccaacgagttcgagagcaagttcctgccccccgagaacaagcccctggagaccgccatgctgaagagagccaaggagctgttcaccaacaacgaccccaaggtgatcgcccagcacgtgctgagcatggactgcagagtggccagaatcctgggcgtgagcgaggagatgagaagaaacatgggcgtgagcagcggcctggagctgatcaccctgccccacggccaccagctgagactggacatcatcgagagacacaacaccatggccatcggcatcgccgtggacatcctgggctgcaccggcaccctggaggacagagccgccaccctgagcaagatcatccaggtggccgtggagctgaaggacagcatgggcgacctgtacagcttcagcgccctgatgaaggccctggagatgccccagatcaccagactggagaagacctggaccgccctgagacaccagtacacccagaccgccatcctgtacgagaagcagctgaagcccttcagcaagctgctgcacgagggcagagagagcacctgcgtgccccccaacaacgtgagcgtgcccctgctgatgcccctggtgaccctgatggagagacaggccgtgaccttcgagggcaccgacatgtgggagaagaacgaccagagctgcgagatcatgctgaaccacctggccaccgccagattcatggccgaggccgccgacagctacagaatgaacgccgagagaatcctggccggcttccagcccgacgaggagatgaacgagatctgcaagaccgagttccagatgagactgctgtggggcagcaagggcgcccaggtgaaccagaccgagagatacgagaagttcaaccagatcctgaccgccctgagcagaaagctggagcccccccccgtgaagcaggccgagctgtag

SEQ ID NO: 18269 - DNA, 2478 bp, Artificial Sequence; identical to SEQ ID NO: 18268
  Description of Artificial Sequence: Synthetic coding sequence

SEQ ID NO: 18270 - DNA, 2478 bp, Artificial Sequence; identical to SEQ ID NO: 18268
  Description of Artificial Sequence: Synthetic coding sequence

SEQ ID NO: 18271 - DNA, 2205 bp, Artificial Sequence
  Description of Artificial Sequence: Synthetic coding sequence
atgcccaaggagtgcagcgccttccacgccctgagcgccgccctgtgctgcttctaccacagaaagagcttcatcggcgtgaagttcagcaaggagagacacatcatggacagaacccccgagaagctgaagaaggagctggaggaggagctgctgctgagcagcgaggacctgagaagccacgcctggtaccacggcagaatccccagacaggtgagcgagaacctggtgcagagagacggcgacttcctggtgagagacagcctgagcagccccggcaacttcgtgctgacctgccagtggaagaacctggcccagcacttcaagatcaacagaaccgtgctgagactgagcgaggcctacagcagagtgcagtaccagttcgagatggagagcttcgacagcatccccggcctggtgagatgctacgtgggcaacagaagacccatcagccagcagagcggcgccatcatcttccagcccatcaacagaaccgtgcccctgagatgcctggaggagcactacggcaccagccccggccaggccagagagggcagcctgaccaagggcagacccgacgtggccaagagactgagcctgaccatgggcggcgtgcaggccagagagcagaacctgcccagaggcaacctgctgagaaacaaggagaagagcggcagccagcccgcctgcctggaccacatgcaggacagaagagccctgagcctgaaggcccaccagagcgagagctacctgcccatcggctgcaagctgcccccccagagcagcggcgtggacaccagcccctgccccaacagccccgtgttcagaaccggcagcgagcccgccctgagccccgccgtggtgagaagagtgagcagcgacgccagagccggcgaggccctgagaggcagcgacagccagctgtgccccaagcccccccccaagccctgcaaggtgcccttcctgaaggtgcccagcagccccagcgcctggctgaacagcgaggccaactactgcgagctgaaccccgccttcgccaccggctgcggcagaggcgccaagctgcccagctgcgcccagggcagccacaccgagctgctgaccgccaagcagaacgaggcccccggccccagaaacagcggcgtgaactacctgatcctggacgacgacgacagagagagaccctgggagcccgccgccgcccagatggagaagggccagtgggacaagggcgagttcgtgacccccctgctggagaccgtgagcagcttcagacccaacgagttcgagagcaagttcctgccccccgagaacaagcccctggagaccgccatgctgaagagagccaaggagctgttcaccaacaacgaccccaaggtgatcgcccagcacgtgctgagcatggactgcagagtggccagaatcctgggcgtgagcgaggagatgagaagaaacatgggcgtgagcagcggcctggagctgatcaccctgccccacggccaccagctgagactggacatcatcgagagacacaacaccatggccatcggcatcgccgtggacatcctgggctgcaccggcaccctggaggacagagccgccaccctgagcaagatcatccaggtggccgtggagctgaaggacagcatgggcgacctgtacagcttcagcgccctgatgaaggccctggagatgccccagatcaccagactggagaagacctggaccgccctgagacaccagtacacccagaccgccatcctgtacgagaagcagctgaagcccttcagcaagctgctgcacgagggcagagagagcacctgcgtgccccccaacaacgtgagcgtgcccctgctgatgcccctggtgaccctgatggagagacaggccgtgaccttcgagggcaccgacatgtgggagaagaacgaccagagctgcgagatcatgctgaaccacctggccaccgccagattcatggccgaggccgccgacagctacagaatgaacgccgagagaatcctggccggcttccagcccgacgaggagatgaacgagatctgcaagaccgagttccagatgagactgctgtggggcagcaagggcgcccaggtgaaccagaccgagagatacgagaagttcaaccagatcctgaccgccctgagcagaaagctggagcccccccccgtgaagcaggccgagctgtag

SEQ ID NO: 18272 - DNA, 1506 bp, Artificial Sequence
  Description of Artificial Sequence: Synthetic coding sequence
atgcaggacagaagagccctgagcctgaaggcccaccagagcgagagctacctgcccatcggctgcaagctgcccccccagagcagcggcgtggacaccagcccctgccccaacagccccgtgttcagaaccggcagcgagcccgccctgagccccgccgtggtgagaagagtgagcagcgacgccagagccggcgaggccctgagaggcagcgacagccagctgtgccccaagcccccccccaagccctgcaaggtgcccttcctgaaggtgcccagcagccccagcgcctggctgaacagcgaggccaactactgcgagctgaaccccgccttcgccaccggctgcggcagaggcgccaagctgcccagctgcgcccagggcagccacaccgagctgctgaccgccaagcagaacgaggcccccggccccagaaacagcggcgtgaactacctgatcctggacgacgacgacagagagagaccctgggagcccgccgccgcccagatggagaagggccagtgggacaagggcgagttcgtgacccccctgctggagaccgtgagcagcttcagacccaacgagttcgagagcaagttcctgccccccgagaacaagcccctggagaccgccatgctgaagagagccaaggagctgttcaccaacaacgaccccaaggtgatcgcccagcacgtgctgagcatggactgcagagtggccagaatcctgggcgtgagcgaggagatgagaagaaacatgggcgtgagcagcggcctggagctgatcaccctgccccacggccaccagctgagactggacatcatcgagagacacaacaccatggccatcggcatcgccgtggacatcctgggctgcaccggcaccctggaggacagagccgccaccctgagcaagatcatccaggtggccgtggagctgaaggacagcatgggcgacctgtacagcttcagcgccctgatgaaggccctggagatgccccagatcaccagactggagaagacctggaccgccctgagacaccagtacacccagaccgccatcctgtacgagaagcagctgaagcccttcagcaagctgctgcacgagggcagagagagcacctgcgtgccccccaacaacgtgagcgtgcccctgctgatgcccctggtgaccctgatggagagacaggccgtgaccttcgagggcaccgacatgtgggagaagaacgaccagagctgcgagatcatgctgaaccacctggccaccgccagattcatggccgaggccgccgacagctacagaatgaacgccgagagaatcctggccggcttccagcccgacgaggagatgaacgagatctgcaagaccgagttccagatgagactgctgtggggcagcaagggcgcccaggtgaaccagaccgagagatacgagaagttcaaccagatcctgaccgccctgagcagaaagctggagcccccccccgtgaagcaggccgagctgtag

SEQ ID NO: 18273 - DNA, 4452 bp, Artificial Sequence
  Description of Artificial Sequence: Synthetic coding sequence
atggcccccctgctgggcagaaagcccttccccctggtgaagcccctgcccggcgaggagcccctgttcaccatcccccacacccaggaggccttcagaaccagagaggagtacgaggccagactggagagatacagcgagagaatctggacctgcaagagcaccggcagcagccagctgacccacaaggaggcctgggaggaggagcaggaggtggccgagctgctgaaggaggagttccccgcctggtacgagaagctggtgctggagatggtgcaccacaacaccgccagcctggagaagctggtggacaccgcctggctggagatcatgaccaagtacgccgtgggcgaggagtgcgacttcgaggtgggcaaggagaagatgctgaaggtgaagatcgtgaagatccaccccctggagaaggtggacgaggaggccaccgagaagaagagcgacggcgcctgcgacagccccagcagcgacaaggagaacagcagccagatcgcccaggaccaccagaagaaggagaccgtggtgaaggaggacgagggcagaagagagagcatcaacgacagagccagaagaagccccagaaagctgcccaccagcctgaagaagggcgagagaaagtgggccccccccaagttcctgccccacaagtacgacgtgaagctgcagaacgaggacaagatcatcagcaacgtgcccgccgacagcctgatcagaaccgagagaccccccaacaaggagatcgtgagatacttcatcagacacaacgccctgagagccggcaccggcgagaacgccccctgggtggtggaggacgagctggtgaagaagtacagcctgcccagcaagttcagcgacttcctgctggacccctacaagtacatgaccctgaaccccagcaccaagagaaagaacaccggcagccccgacagaaagcccagcaagaagagcaagaccgacaacagcagcctgagcagccccctgaaccccaagctgtggtgccacgtgcacctgaagaagagcctgagcggcagccccctgaaggtgaagaacagcaagaacagcaagagccccgaggagcacctggaggagatgatgaagatgatgagccccaacaagctgcacaccaacttccacatccccaagaagggcccccccgccaagaagcccggcaagcacagcgacaagcccctgaaggccaagggcagaagcaagggcatcctgaacggccagaagagcaccggcaacagcaagagccccaagaagggcctgaagacccccaagaccaagatgaagcagatgaccctgctggacatggccaagggcacccagaagatgaccagagcccccagaaacagcggcggcacccccagaaccagcagcaagccccacaagcacctgccccccgccgccctgcacctgatcgcctactacaaggagaacaaggacagagaggacaagagaagcgccctgagctgcgtgatcagcaagaccgccagactgctgagcagcgaggacagagccagactgcccgaggagctgagaagcctggtgcagaagagatacgagctgctggagcacaagaagagatgggccagcatgagcgaggagcagagaaaggagtacctgaagaagaagagagaggagctgaagaagaagctgaaggagaaggccaaggagagaagagagaaggagatgctggagagactggagaagcagaagagatacgaggaccaggagctgaccggcaagaacctgcccgccttcagactggtggacacccccgagggcctgcccaacaccctgttcggcgacgtggccatggtggtggagttcctgagctgctacagcggcctgctgctgcccgacgcccagtaccccatcaccgccgtgagcctgatggaggccctgagcgccgacaagggcggcttcctgtacctgaacagagtgctggtgatcctgctgcagaccctgctgcaggacgagatcgccgaggactacggcgagctgggcatgaagctgagcgagatccccctgaccctgcacagcgtgagcgagctggtgagactgtgcctgagaagaagcgacgtgcaggaggagagcgagggcagcgacaccgacgacaacaaggacagcgccgccttcgaggacaacgaggtgcaggacgagttcctggagaagctggagaccagcgagttcttcgagctgaccagcgaggagaagctgcagatcctgaccgccctgtgccacagaatcctgatgacctacagcgtgcaggaccacatggagaccagacagcagatgagcgccgagctgtggaaggagagactggccgtgctgaaggaggagaacgacaagaagagagccgagaagcagaagagaaaggagatggaggccaagaacaaggagaacggcaaggtggagaacggcctgggcaagaccgacagaaagaaggagatcgtgaagttcgagccccaggtggacaccgaggccgaggacatgatcagcgccgtgaagagcagaagactgctggccatccaggccaagaaggagagagagatccaggagagagagatgaaggtgaagctggagagacaggccgaggaggagagaatcagaaagcacaaggccgccgccgagaaggccttccaggagggcatcgccaaggccaagctggtgatgagaagaacccccatcggcaccgacagaaaccacaacagatactggctgttcagcgacgaggtgcccggcctgttcatcgagaagggctgggtgcacgacagcatcgactacagattcaaccaccactgcaaggaccacaccgtgagcggcgacgaggactactgccccagaagcaagaaggccaacctgggcaagaacgccagcatgaacacccagcacggcaccgccaccgaggtggccgtggagaccaccacccccaagcagggccagaacctgtggttcctgtgcgacagccagaaggagctggacgagctgctgaactgcctgcacccccagggcatcagagagagccagctgaaggagagactggagaagagataccaggacatcatccacagcatccacctggccagaaagcccaacctgggcctgaagagctgcgacggcaaccaggagctgctgaacttcctgagaagcgacctgatcgaggtggccaccagactgcagaagggcggcctgggctacgtggaggagaccagcgagttcgaggccagagtgatcagcctggagaagctgaaggacttcggcgagtgcgtgatcgccctgcaggccagcgtgatcaagaagttcctgcagggcttcatggcccccaagcagaagagaagaaagctgcagagcgaggacagcgccaagaccgaggaggtggacgaggagaagaagatggtggaggaggccaaggtggccagcgccctggagaagtggaagaccgccatcagagaggcccagaccttcagcagaatgcacgtgctgctgggcatgctggacgcctgcatcaagtgggacatgagcgccgagaacgccagatgcaaggtgtgcagaaagaagggcgaggacgacaagctgatcctgtgcgacgagtgcaacaaggccttccacctgttctgcctgagacccgccctgtacgaggtgcccgacggcgagtggcagtgccccgcctgccagcccgccaccgccagaagaaacagcagaggcagaaactacaccgaggagagcgccagcgaggacagcgaggacgacgagagcgacgaggaggaggaggaggaggaggaggaggaggaggaggaggactacgaggtggccggcctgagactgagacccagaaagaccatcagaggcaagcacagcgtgatcccccccgccgccagaagcggcagaagacccggcaagaagccccacagcaccagaagaagccagcccaaggccccccccgtggacgacgccgaggtggacgagctggtgctgcagaccaagagaagcagcagaagacagagcctggagctgcagaagtgcgaggagatcctgcacaagatcgtgaagtacagattcagctggcccttcagagagcccgtgaccagagacgaggccgaggactactacgacgtgatcacccaccccatggacttccagaccgtgcagaacaagtgcagctgcggcagctacagaagcgtgcaggagttcctgaccgacatgaagcaggtgttcaccaacgccgaggtgtacaactgcagaggcagccacgtgctgagctgcatggtgaagaccgagcagtgcctggtggccctgctgcacaagcacctgcccggccacccctacgtgagaagaaagagaaagaagttccccgacagactggccgaggacgagggcgacagcgagcccgaggccgtgggccagagcagaggcagaagacagaagaagtag

SEQ ID NO: 18274 - DNA, 1506 bp, Artificial Sequence
  Description of Artificial Sequence: Synthetic coding sequence
atgaagggctaccagagcctggtgttcaacttcttcttcctgaagctgagcgccgagaacgagagcacccccatccagcagctgctggagcacttcctgagacagctgcagagaaaggacccccacggcttcttcgccttccccgtgaccgacgccatcgcccccggctacagcatgatcatcaagcaccccatggacttcggcaccatgaaggacaagatcgtggccaacgagtacaagagcgtgaccgagttcaaggccgacttcaagctgatgtgcgacaacgccatgacctacaacagacccgacaccgtgtactacaagctggccaagaagatcctgcacgccggcttcaagatgatgagcaaggagagactgctggccctgaagagaagcatgagcttcatgcaggacatggacttcagccagcaggccgccctgctgggcaacgaggacaccgccgtggaggagcccgtgcccgaggtggtgcccgtgcaggtggagaccgccaagaagagcaagaagcccagcagagaggtgatcagctgcatgttcgagcccgagggcaacgcctgcagcctgaccgacagcaccgccgaggagcacgtgctggccctggtggagcacgccgccgacgaggccagagacagaatcaacagattcctgcccggcggcaagatgggctacctgaagagaaacggcgacggcagcctgctgtacagcgtggtgaacaccgccgagcccgacgccgacgaggaggagacccaccccgtggacctgagcagcctgagcagcaagctgctgcccggcttcaccaccctgggcttcaaggacgagagaagaaacaaggtgaccttcctgagcagcgccaccaccgccctgagcatgcagaacaacagcgtgttcggcgacctgaagagcgacgagatggagctgctgtacagcgcctacggcgacgagaccggcgtgcagtgcgccctgagcctgcaggagttcgtgaaggacgccggcagctacagcaagaaggtggtggacgacctgctggaccagatcaccggcggcgaccacagcagaaccctgttccagctgaagcagagaagaaacgtgcccatgaagccccccgacgaggccaaggtgggcgacaccctgggcgacagcagcagcagcgtgctggagttcatgagcatgaagagctaccccgacgtgagcgtggacatcagcatgctgagcagcctgggcaaggtgaagaaggagctggaccccgacgacagccacctgaacctggacgagaccaccaagctgctgcaggacctgcacgaggcccaggccgagagaggcggcagcagacccagcagcaacctgagcagcctgagcaacgccagcgagagagaccagcaccacctgggcagccccagcagactgagcgtgggcgagcagcccgacgtgacccacgacccctacgagttcctgcagagccccgagcccgccgccagcgccaagacctag

SEQ ID NO: 18275 - DNA, 561 bp, Artificial Sequence
  Description of Artificial Sequence: Synthetic coding sequence
gccgtgtgcagcctgagactgcccagcagccccgacaagagaagcagagccatgcaggtgaccctgatcctggccgaggaggagacccaccccgtggacctgagcagcctgagcagcaagctgctgcccggcttcaccaccctgggcttcaaggacgagagaagaaacaaggtgaccttcctgagcagcgccaccaccgccctgagcatgcagaacaacagcgtgttcggcgacctgaagagcgacgagatggagctgctgtacagcgcctacggcgacgagaccggcgtgcagtgcgccctgagcctgcaggagttcgtgaaggacgccggcagctacagcaagaaggtggtggacgacctgctggaccagatcaccggcggcgaccacagcagaaccctgttccagctgaagcagagaagaaacgtgcccatgaagccccccgacgaggccaaggtgggcgacaccctgggcgacagcagcagcagcgtgctggagttcatgagcatgaagagctaccccgacgtgagcgtggacatcagcatgctgagcagcctgtag

SEQ ID NO: 18276 - DNA, 1446 bp, Artificial Sequence
  Description of Artificial Sequence: Synthetic coding sequence
atgaagggctaccagagcctggtgttcaacttcttcttcctgaagctgagcgccgagaacgagagcacccccatccagcagctgctggagcacttcctgagacagctgcagagaaaggacccccacggcttcttcgccttccccgtgaccgacgccatcgcccccggctacagcatgatcatcaagcaccccatggacttcggcaccatgaaggacaagatcgtggccaacgagtacaagagcgtgaccgagttcaaggccgacttcaagctgatgtgcgacaacgccatgacctacaacagacccgacaccgtgtactacaagctggccaagaagatcctgcacgccggcttcaagatgatgagcaagcaggccgccctgctgggcaacgaggacaccgccgtggaggagcccgtgcccgaggtggtgcccgtgcaggtggagaccgccaagaagagcaagaagcccagcagagaggtgatcagctgcatgttcgagcccgagggcaacgcctgcagcctgaccgacagcaccgccgaggagcacgtgctggccctggtggagcacgccgccgacgaggccagagacagaatcaacagattcctgcccggcggcaagatgggctacctgaagagaaacggcgacggcagcctgctgtacagcgtggtgaacaccgccgagcccgacgccgacgaggaggagacccaccccgtggacctgagcagcctgagcagcaagctgctgcccggcttcaccaccctgggcttcaaggacgagagaagaaacaaggtgaccttcctgagcagcgccaccaccgccctgagcatgcagaacaacagcgtgttcggcgacctgaagagcgacgagatggagctgctgtacagcgcctacggcgacgagaccggcgtgcagtgcgccctgagcctgcaggagttcgtgaaggacgccggcagctacagcaagaaggtggtggacgacctgctggaccagatcaccggcggcgaccacagcagaaccctgttccagctgaagcagagaagaaacgtgcccatgaagccccccgacgaggccaaggtgggcgacaccctgggcgacagcagcagcagcgtgctggagttcatgagcatgaagagctaccccgacgtgagcgtggacatcagcatgctgagcagcctgggcaaggtgaagaaggagctggaccccgacgacagccacctgaacctggacgagaccaccaagctgctgcaggacctgcacgaggcccaggccgagagaggcggcagcagacccagcagcaacctgagcagcctgagcaacgccagcgagagagaccagcaccacctgggcagccccagcagactgagcgtgggcgagcagcccgacgtgacccacgacccctacgagttcctgcagagccccgagcccgccgccagcgccaagacctag

SEQ ID NO: 18277 - DNA, 645 bp, Artificial Sequence
  Description of Artificial Sequence: Synthetic coding sequence
atgaagggctaccagagcctggtgttcaacttcttcttcctgaagctgagcgccgagaacgagagcacccccatccagcagctgctggagcacttcctgagacagctgcagagaaaggacccccacggcttcttcgccttccccgtgaccgacgccatcgcccccggctacagcatgatcatcaagcaccccatggacttcggcaccatgaaggacaagatcgtggccaacgagtacaagagcgtgaccgagttcaaggccgacttcaagctgatgtgcgacaacgccatgacctacaacagacccgacaccgtgtactacaagctggccaagaagatcctgcacgccggcttcaagatgatgagcaagcaggccgccctgctgggcaacgaggacaccgccgtggaggagcccgtgcccgaggtggtgcccgtgcaggtggagaccgccaagaagagcaagaagcccagcagagaggtgatcagctgcatgttcgagcccgagggcaacgcctgcagcctgaccgacagcaccgccgaggagcacgtgctggccctggtggagcacgccgccgacgaggccagagacagaatcaacagattcctgcccggcggcaagagaagaagacccaccagatggacctag

SEQ ID NO: 18278 - DNA, 1794 bp, Artificial Sequence
  Description of Artificial Sequence: Synthetic coding sequence
atgggcaagaagcacaagaagcacaaggccgagtggagaagcagctacgaggactacgccgacaagcccctggagaagcccctgaagctggtgctgaaggtgggcggcagcgaggtgaccgagctgagcggcagcggccacgacagcagctactacgacgacagaagcgaccacgagagagagagacacaaggagaagaagaagaagaagaagaagaagagcgagaaggagaagcacctggacgacgaggagagaagaaagagaaaggaggagaagaagagaaagagagagagagagcactgcgacaccgagggcgaggccgacgacttcgaccccggcaagaaggtggaggtggagcccccccccgacagacccgtgagagcctgcagaacccagcccgccgagaacgagagcacccccatccagcagctgctggagcacttcctgagacagctgcagagaaaggacccccacggcttcttcgccttccccgtgaccgacgccatcgcccccggctacagcatgatcatcaagcaccccatggacttcggcaccatgaaggacaagatcgtggccaacgagtacaagagcgtgaccgagttcaaggccgacttcaagctgatgtgcgacaacgccatgacctacaacagacccgacaccgtgtactacaagctggccaagaagatcctgcacgccggcttcaagatgatgagcaagcaggccgccctgctgggcaacgaggacaccgccgtggaggagcccgtgcccgaggtggtgcccgtgcaggtggagaccgccaagaagagcaagaagcccagcagagaggtgatcagctgcatgttcgagcccgagggcaacgcctgcagcctgaccgacagcaccgccgaggagcacgtgctggccctggtggagcacgccgccgacgaggccagagacagaatcaacagattcctgcccggcggcaagatgggctacctgaagagaaacggcgacggcagcctgctgtacagcgtggtgaacaccgccgagcccgacgccgacgaggaggagacccaccccgtggacctgagcagcctgagcagcaagctgctgcccggcttcaccaccctgggcttcaaggacgagagaagaaacaaggtgaccttcctgagcagcgccaccaccgccctgagcatgcagaacaacagcgtgttcggcgacctgaagagcgacgagatggagctgctgtacagcgcctacggcgacgagaccggcgtgcagtgcgccctgagcctgcaggagttcgtgaaggacgccggcagctacagcaagaaggtggtggacgacctgctggaccagatcaccggcggcgaccacagcagaaccctgttccagctgaagcagagaagaaacgtgcccatgaagccccccgacgaggccaaggtgggcgacaccctgggcgacagcagcagcagcgtgctggagttcatgagcatgaagagctaccccgacgtgagcgtggacatcagcatgctgagcagcctgggcaaggtgaagaaggagctggaccccgacgacagccacctgaacctggacgagaccaccaagctgctgcaggacctgcacgaggcccaggccgagagaggcggcagcagacccagcagcaacctgagcagcctgagcaacgccagcgagagagaccagcaccacctgggcagccccagcagactgagcgtgggcgagcagcccgacgtgacccacgacccctacgagttcctgcagagccccgagcccgccgccagcgccaagacctag

SEQ ID NO: 18279 - DNA, 1635 bp, Artificial Sequence
  Description of Artificial Sequence: Synthetic coding sequence
atgatgaccggccagaccatgagcgagagaggcaccaagaagagaaagagaagaagaagaagaagccccagaagaagaagcatctggaccatgagaaaggagggcagcgagagaaagagaagaagcggcagcgagagaggcagcaccgtgaccagaagagagagactgaccaccctgatcctgggcagaagatggagatggagcagaccccagatcggccagagcgagagagccggccacagccagcccaagatgagagcccacctgttcagcaacagctggaacaccagcagcgccagcttcagagacccccacggcttcttcgccttccccgtgaccgacgccatcgcccccggctacagcatgatcatcaagcaccccatggacttcggcaccatgaaggacaagatcgtggccaacgagtacaagagcgtgaccgagttcaaggccgacttcaagctgatgtgcgacaacgccatgacctacaacagacccgacaccgtgtactacaagctggccaagaagatcctgcacgccggcttcaagatgatgagcaagcaggccgccctgctgggcaacgaggacaccgccgtggaggagcccgtgcccgaggtggtgcccgtgcaggtggagaccgccaagaagagcaagaagcccagcagagaggtgatcagctgcatgttcgagcccgagggcaacgcctgcagcctgaccgacagcaccgccgaggagcacgtgctggccctggtggagcacgccgccgacgaggccagagacagaatcaacagattcctgcccggcggcaagatgggctacctgaagagaaacggcgacggcagcctgctgtacagcgtggtgaacaccgccgagcccgacgccgacgaggaggagacccaccccgtggacctgagcagcctgagcagcaagctgctgcccggcttcaccaccctgggcttcaaggacgagagaagaaacaaggtgaccttcctgagcagcgccaccaccgccctgagcatgcagaacaacagcgtgttcggcgacctgaagagcgacgagatggagctgctgtacagcgcctacggcgacgagaccggcgtgcagtgcgccctgagcctgcaggagttcgtgaaggacgccggcagctacagcaagaaggtggtggacgacctgctggaccagatcaccggcggcgaccacagcagaaccctgttccagctgaagcagagaagaaacgtgcccatgaagccccccgacgaggccaaggtgggcgacaccctgggcgacagcagcagcagcgtgctggagttcatgagcatgaagagctaccccgacgtgagcgtggacatcagcatgctgagcagcctgggcaaggtgaagaaggagctggaccccgacgacagccacctgaacctggacgagaccaccaagctgctgcaggacctgcacgaggcccaggccgagagaggcggcagcagacccagcagcaacctgagcagcctgagcaacgccagcgagagagaccagcaccacctgggcagccccagcagactgagcgtgggcgagcagcccgacgtgacccacgacccctacgagttcctgcagagccccgagcccgccgccagcgccaagacctag

SEQ ID NO: 18280 - DNA, 438 bp, Artificial Sequence
  Description of Artificial Sequence: Synthetic coding sequence
atgctgggctggatccagcccagcagacagccccagctgagagccgccccccccaccagaacccccagcgccaagagatgcatcctgtgcaacttcctgcccggctgctggctggtgggcgacgtggccggcagcagacagcccagcgccccccagaccctgagacagagacagcacaccagaccccccccccaggagagaggcagcggcagaagaagccccctgagagaggccagaagagccaacccccacttcaagagcttccccgtgctggaggccagaggcctgccctgcggcgccagaagaaccggccccagaagacccgtgagagagatgaccctgcccagcgaccccgagagagccaccctgcccaaccccagactgggcgcccccgccgtgcccagaagaggccccagaagccacggcggcagaagatag

SEQ ID NO: 18281 - DNA, 522 bp, Artificial Sequence
  Description of Artificial Sequence: Synthetic coding sequence
atggccgagggcgaggacgtgggctggtggagaagctggctgcagcagagctaccaggccgtgaaggagaagagcagcgaggccctggagttcatgaagagagacctgaccgagttcacccaggtggtgcagcacgacaccgcctgcaccatcgccgccaccgccagcgtggtgaaggagaagctggccaccgagggcagcagcggcgccaccgagaagatgaagaagggcctgagcgacttcctgggcgtgatcagcgacaccttcgcccccagccccgacaagaccatcgactgcgacgtgatcaccctgatgggcacccccagcggcaccgccgagccctacgacggcaccaaggccagactgtacagcctgcagagcgaccccgccacctactgcaacgagcccgacggcccccccgagctgttcgacgcctgccagcccgagctgtgggcccagatcctggtggccccctgctggcccagctgggccagcgcccacacctgggagggcgccctgtag

SEQ ID NO: 18282 - DNA, 1425 bp, Artificial Sequence
  Description of Artificial Sequence: Synthetic coding sequence
atggccgagggcgaggacgtgggctggtggagaagctggctgcagcagagctaccaggccgtgaaggagaagagcagcgaggccctggagttcatgaagagagacctgaccgagttcacccaggtggtgcagcacgacaccgcctgcaccatcgccgccaccgccagcgtggtgaaggagaagctggccatcgccgcctgcagcagaggcgcctgcttcctgtgccccttcagcatccagaccgagggcagcagcggcgccaccgagaagatgaagaagggcctgagcgacttcctgggcgtgatcagcgacaccttcgcccccagccccgacaagaccatcgactgcgacgtgatcaccctgatgggcacccccagcggcaccgccgagccctacgacggcaccaaggccagactgtacagcctgcagagcgaccccgccacctactgcaacgagcccgacggcccccccgagctgttcgacgcctggctgagccagttctgcctggaggagaagaagggcgagatcagcgagctgctggtgggcagccccagcatcagagccctgtacaccaagatggtgcccgccgccgtgagccacagcgagttctggcacagatacttctacaaggtgcaccagctggagcaggagcaggccagaagagacgccctgaagcagagagccgagcagagcatcagcgaggagcccggctgggaggaggaggaggaggagctgatgggcatcagccccatcagccccaaggaggccaaggtgcccgtggccaagatcagcaccttccccgagggcgagcccggcccccagagcccctgcgaggagaacctggtgaccagcgtggagccccccgccgaggtgacccccagcgagagcagcgagagcatcagcctggtgacccagatcgccaaccccgccaccgcccccgaggccagagtgctgcccaaggacctgagccagaagctgctggaggccagcctggaggagcagggcctggccgtggacgtgggcgagaccggccccagcccccccatccacagcaagcccctgacccccgccggccacaccggcggccccgagcccagaccccccgccagagtggagaccctgagagaggaggcccccaccgacctgagagtgttcgagctgaacagcgacagcggcaagagcacccccagcaacaacggcaagaagggcagcagcaccgacatcagcgaggactgggagaaggacttcgacctggacatgaccgaggaggaggtgcagatggccctgagcaaggtggacgccagcggcgaggtgagcggccccggcggcagcgagggcagcgagcccaacggccccggctgcgagagcagcccccagcccgcccagctgagcccccaggagggcccctgcagctgcctgagatag

SEQ ID NO: 18283 - DNA, 1110 bp, Artificial Sequence
  Description of Artificial Sequence: Synthetic coding sequence
atggccgagggcgaggacgtgggctggtggagaagctggctgcagcagagctaccaggccgtgaaggagaagagcagcgaggccctggagttcatgaagagagacctgaccgagttcacccaggtggtgcagcacgacaccgcctgcaccatcgccgccaccgccagcgtggtgaaggagaagctggccaccgagggcagcagcggcgccaccgagaagatgaagaagggcctgagcgacttcctgggcgtgatcagcgacaccttcgcccccagccccgacaagaccatcgactgcgacgtgatcaccctgatgggcacccccagcggcaccgccgagccctacgacggcaccaaggccagactgtacagcctgcagagcgaccccgccacctactgcaacgagcccgacggcccccccgagctgttcgacgccctgaagcagagagccgagcagagcatcagcgaggagcccggctgggaggaggaggaggaggagctgatgggcatcagccccatcagccccaaggaggccaaggtgcccgtggccaagatcagcaccttccccgagggcgagcccggcccccagagcccctgcgaggagaacctggtgaccagcgtggagccccccgccgaggtgacccccagcgagagcagcgagagcatcagcctggtgacccagatcgccaaccccgccaccgcccccgaggccagagtgctgcccaaggacctgagccagaagctgctggaggccagcctggaggagcagggcctggccgtggacgtgggcgagaccggccccagcccccccatccacagcaagcccctgacccccgccggccacaccggcggccccgagcccagaccccccgccagagtggagaccctgagagaggaggcccccaccgacctgagagtgttcgagctgaacagcgacagcggcaagagcacccccagcaacaacggcaagaagggcagcagcaccgacatcagcgaggactgggagaaggacttcgacctggacatgaccgaggaggaggtgcagatggccctgagcaaggtggacgccagcggcgagctggaggacgtggagtgggaggactgggagtag

SEQ ID NO: 18284 - DNA, 1125 bp, Artificial Sequence
  Description of Artificial Sequence: Synthetic coding sequence
atggccgagggcgaggacgtgggctggtggagaagctggctgcagcagagctaccaggccgtgaaggagaagagcagcgaggccctggagttcatgaagagagacctgaccgagttcacccaggtggtgcagcacgacaccgcctgcaccatcgccgccaccgccagcgtggtgaaggagaagctggccgccagactgtacagcctgcagagcgaccccgccacctactgcaacgagcccgacggcccccccgagctgttcgacgcctggctgagccagttctgcctggaggagaagaagggcgagatcagcgagctgctggtgggcagccccagcatcagagccctgtacaccaagatggtgcccgccgccgtgagccacagcgagttctggcacagatacttctacaaggtgcaccagctggagcaggagcaggccagaagagacgccctgaagcagagagccgagcagagcatcagcgaggagcccggctgggaggaggaggaggaggagctgatgggcatcagccccatcagccccaaggaggccaaggtgcccgtggccaagatcagcaccttccccgagggcgagcccggcccccagagcccctgcgaggagaacctggtgaccagcgtggagccccccgccgaggtgacccccagcgagagcagcgagagcatcagcctggtgacccagatcgccaaccccgccaccgcccccgaggccagagtgctgcccaaggacctgagccagaagctgctggaggccagcctggaggagcagggcctggccgtggacgtgggcgagaccggccccagcccccccatccacagcaagcccctgacccccgccggccacaccggcggccccgagcccagaccccccgccagagtggagaccctgagagaggaggcccccaccgacctgagagtgttcgagctgaacagcgacagcggcaagagcacccccagcaacaacggcaagaagggcagcagcaccgacatcagcgaggactgggagaaggacttcgacctggacatgaccgaggaggaggtgcagatggccctgagcaaggtggacgccagcggcgagctggaggacgtggagtgggaggactgggagtag

SEQ ID NO: 18285 - DNA, 1344 bp, Artificial Sequence
  Description of Artificial Sequence: Synthetic coding sequence
atggccgagggcgaggacgtgggctggtggagaagctggctgcagcagagctaccaggccgtgaaggagaagagcagcgaggccctggagttcatgaagagagacctgaccgagttcacccaggtggtgcagcacgacaccgcctgcaccatcgccgccaccgccagcgtggtgaaggagaagctggccatcgccgcctgcagcagaggcgcctgcttcctgtgccccttcagcatccagaccgagggcagcagcggcgccaccgagaagatgaagaagggcctgagcgacttcctgggcgtgatcagcgacaccttcgcccccagccccgacaagaccatcgactgcgacgtgatcaccctgatgggcacccccagcggcaccgccgagccctacgacggcaccaaggccagactgtacagcctgcagagcgaccccgccacctactgcaacgagcccgacggcccccccgagctgttcgacgcctggctgagccagttctgcctggaggagaagaagggcgagatcagcgagctgctggtgggcagccccagcatcagagccctgtacaccaagatggtgcccgccgccgtgagccacagcgagttctggcacagatacttctacaaggtgcaccagctggagcaggagcaggccagaagagacgccctgaagcagagagccgagcagagcatcagcgaggagcccggctgggaggaggaggaggaggagctgatgggcatcagccccatcagccccaaggaggccaaggtgcccgtggccaagatcagcaccttccccgagggcgagcccggcccccagagcccctgcgaggagaacctggtgaccagcgtggagccccccgccgaggtgacccccagcgagagcagcgagagcatcagcctggtgacccagatcgccaaccccgccaccgcccccgaggccagagtgctgcccaaggacctgagccagaagctgctggaggccagcctggaggagcagggcctggccgtggacgtgggcgagaccggccccagcccccccatccacagcaagcccctgacccccgccggccacaccggcggccccgagcccagaccccccgccagagtggagaccctgagagaggaggcccccaccgacctgagagtgttcgagctgaacagcgacagcggcaagagcacccccagcaacaacggcaagaagggcagcagcaccgacatcagcgaggactgggagaaggacttcgacctggacatgaccgaggaggaggtgcagatggccctgagcaaggtggacgccagcggcgagctggaggacgtggagtgggaggactgggagtag

SEQ ID NO: 18286 - DNA, 1269 bp, Artificial Sequence
  Description of Artificial Sequence: Synthetic coding sequence
atggccgagggcgaggacgtgggctggtggagaagctggctgcagcagagctaccaggccgtgaaggagaagagcagcgaggccctggagttcatgaagagagacctgaccgagttcacccaggtggtgcagcacgacaccgcctgcaccatcgccgccaccgccagcgtggtgaaggagaagctggccaccgagggcagcagcggcgccaccgagaagatgaagaagggcctgagcgacttcctgggcgtgatcagcgacaccttcgcccccagccccgacaagaccatcgactgcgacgtgatcaccctgatgggcacccccagcggcaccgccgagccctacgacggcaccaaggccagactgtacagcctgcagagcgaccccgccacctactgcaacgagcccgacggcccccccgagctgttcgacgcctggctgagccagttctgcctggaggagaagaagggcgagatcagcgagctgctggtgggcagccccagcatcagagccctgtacaccaagatggtgcccgccgccgtgagccacagcgagttctggcacagatacttctacaaggtgcaccagctggagcaggagcaggccagaagagacgccctgaagcagagagccgagcagagcatcagcgaggagcccggctgggaggaggaggaggaggagctgatgggcatcagccccatcagccccaaggaggccaaggtgcccgtggccaagatcagcaccttccccgagggcgagcccggcccccagagcccctgcgaggagaacctggtgaccagcgtggagccccccgccgaggtgacccccagcgagagcagcgagagcatcagcctggtgacccagatcgccaaccccgccaccgcccccgaggccagagtgctgcccaaggacctgagccagaagctgctggaggccagcctggaggagcagggcctggccgtggacgtgggcgagaccggccccagcccccccatccacagcaagcccctgacccccgccggccacaccggcggccccgagcccagaccccccgccagagtggagaccctgagagaggaggcccccaccgacctgagagtgttcgagctgaacagcgacagcggcaagagcacccccagcaacaacggcaagaaggagaccagaagccagttcaccgtggacttcctgtggaagatcagcgtgaccctgctggagcccctgggccagagcgccagccccctgttcagcaacctgcccttccccagatag

SEQ ID NO: 18287 - DNA, 1293 bp, Artificial Sequence
  Description of Artificial Sequence: Synthetic coding sequence
atggccgagggcgaggacgtgggctggtggagaagctggctgcagcagagctaccaggccgtgaaggagaagagcagcgaggccctggagttcatgaagagagacctgaccgagttcacccaggtggtgcagcacgacaccgcctgcaccatcgccgccaccgccagcgtggtgaaggagaagctggccaccgagggcagcagcggcgccaccgagaagatgaagaagggcctgagcgacttcctgggcgtgatcagcgacaccttcgcccccagccccgacaagaccatcgactgcgacgtgatcaccctgatgggcacccccagcggcaccgccgagccctacgacggcaccaaggccagactgtacagcctgcagagcgaccccgccacctactgcaacgagcccgacggcccccccgagctgttcgacgcctggctgagccagttctgcctggaggagaagaagggcgagatcagcgagctgctggtgggcagccccagcatcagagccctgtacaccaagatggtgcccgccgccgtgagccacagcgagttctggcacagatacttctacaaggtgcaccagctggagcaggagcaggccagaagagacgccctgaagcagagagccgagcagagcatcagcgaggagcccggctgggaggaggaggaggaggagctgatgggcatcagccccatcagccccaaggaggccaaggtgcccgtggccaagatcagcaccttccccgagggcgagcccggcccccagagcccctgcgaggagaacctggtgaccagcgtggagccccccgccgaggtgacccccagcgagagcagcgagagcatcagcctggtgacccagatcgccaaccccgccaccgcccccgaggccagagtgctgcccaaggacctgagccagaagctgctggaggccagcctggaggagcagggcctggccgtggacgtgggcgagaccggccccagcccccccatccacagcaagcccctgacccccgccggccacaccggcggccccgagcccagaccccccgccagagtggagaccctgagagaggaggcccccaccgacctgagagtgttcgagctgaacagcgacagcggcaagagcacccccagcaacaacggcaagaagggcagcagcaccgacatcagcgaggactgggagaaggacttcgacctggacatgaccgaggaggaggtgcagatggccctgagcaaggtggacgccagcggcgagctggaggacgtggagtgggaggactgggagtag

SEQ ID NO: 18288 - DNA, 1008 bp, Artificial Sequence
  Description of Artificial Sequence: Synthetic coding sequence
atggccgagggcgaggacgtgggctggtggagaagctggctgcagcagagctaccaggccgtgaaggagaaggccagactgtacagcctgcagagcgaccccgccacctactgcaacgagcccgacggcccccccgagctgttcgacgcctggctgagccagttctgcctggaggagaagaagggcgagatcagcgagctgctggtgggcagccccagcatcagagccctgtacaccaagatggtgcccgccgccgtgagccacagcgagttctggcacagatacttctacaaggtgcaccagctggagcaggagcaggccagaagagacgccctgaagcagagagccgagcagagcatcagcgaggagcccggctgggaggaggaggaggaggagctgatgggcatcagccccatcagccccaaggaggccaaggtgcccgtggccaagatcagcaccttccccgagggcgagcccggcccccagagcccctgcgaggagaacctggtgaccagcgtggagccccccgccgaggtgacccccagcgagagcagcgagagcatcagcctggtgacccagatcgccaaccccgccaccgcccccgaggccagagtgctgcccaaggacctgagccagaagctgctggaggccagcctggaggagcagggcctggccgtggacgtgggcgagaccggccccagcccccccatccacagcaagcccctgacccccgccggccacaccggcggccccgagcccagaccccccgccagagtggagaccctgagagaggaggcccccaccgacctgagagtgttcgagctgaacagcgacagcggcaagagcacccccagcaacaacggcaagaagggcagcagcaccgacatcagcgaggactgggagaaggacttcgacctggacatgaccgaggaggaggtgcagatggccctgagcaaggtggacgccagcggcgagctggaggacgtggagtgggaggactgggagtag

SEQ ID NO: 18289 - DNA, 1158 bp, Artificial Sequence
  Description of Artificial Sequence: Synthetic coding sequence
atggccagcctgggccccgccgccgccggcgagcaggccagcggcgccgaggccgagcccggccccgccggccccccccccccccccagccccagcagcctgggccccctgctgcccctgcagagagagcccctgtacaactggcaggccaccaaggccagcctgaaggagagattcgccttcctgttcaacagcgagctgctgagcgacgtgagattcgtgctgggcaagggcagaggcgccgccgccgccggcggcccccagagaatccccgcccacagattcgtgctggccgccggcagcgccgtgttcgacgccatgttcaacggcggcatggccaccaccagcgccgagatcgagctgcccgacgtggagcccgccgccttcctggccctgctgagattcctgtacagcgacgaggtgcagatcggccccgagaccgtgatgaccaccctgtacaccgccaagaagtacgccgtgcccgccctggaggcccactgcgtggagttcctgaccaagcacctgagagccgacaacgccttcatgctgctgacccaggccagactgttcgacgagccccagctggccagcctgtgcctggacaccatcgacaagagcaccatggacgccatcagcgccgagggcttcaccgacatcgacatcgacaccctgtgcgccgtgctggagagagacaccctgagcatcagagagagcagactgttcggcgccgtggtgagatgggccgaggccgagtgccagagacagcagctgcccgtgaccttcggcaacaagcagaaggtgctgggcaaggccctgagcctgatcagattccccctgatgaccatcgaggagttcgccgccggccccgcccagagcggcatcctgagcgacagagaggtggtgaacctgttcctgcacttcaccgtgaaccccaagcccagagtggagtacatcgacagacccagatgctgcctgagaggcaaggagtgctgcatcaacagattccagcaggtggagagcagatggggctacagcggcaccagcgacagaatcagaagcctgaacatgagaaagagcaagccctgggacagaatgatccccgccctggtggtgatgggccagctgacccacagcggcagctgcagcagaaacccctag

SEQ ID NO: 18290 - DNA, 1521 bp, Artificial Sequence
  Description of Artificial Sequence: Synthetic coding sequence
atgatcatgagcaacacccacaaggccagactggagagaagagtgaccggcagcaccaacagatggagactgcccaagcagcccttcagcggcgacctgctgagcctgagccagatgtgcaaggccctgagcatcgacttcgaggaggccctgagaaaccccgacagactgtgcatcagccagatccagaagttcttcttcgagaacttcaagaacaaggacatccagagcggcgaggccgacgtgatcctggagtgcctgggcttcaagtgggagctgcaccagccccagctgttccagagcgagaccctggccaagctgtacctgaaggccctggcccagggcaccacccaccccctgagagagctggaggagctgctgagagcccagagccccaagaagaccaaggagaagagccccgccaagagaatcatcatcagcctgaagatcaacgaccccctggtgaccaaggtggccttcgccaccgccctgaagaacctgtacatgagcgaggtggagatcaacctggaggacctgctgggcgtgctggccagcgcccacatcctgcagttcagcggcctgttccagagatgcgtggacgtgatgatcgccagactgaagcccagcaccatcaagaagttctacgaggccggctgcaagtacaaggaggagcagctgaccaccggctgcgagaagtggctggagatgaacctggtgcccctgggcggcacccagatccacctgcacaagatcccccaggacctgctgcacaaggtgctgaagagccccagactgttcaccttcagcgagttccacctgctgaagaccatgctgctgtgggtgttcctgcagctgaactacaagatccaggccatccccacctacgagaccgtgatgaccttcttcaagagcttccccgagaactgctgcttcctggacagagacatcggcagaagcctgagacccctgttcctgtgcctgagactgcacggcatcaccaagggcaaggacctggaggtgctgagacacctgaacttcttccccgagagctggctggaccaggtgaccgtgaaccactaccacgccctggagaacggcggcgacatggtgcacctgaaggacctgaacacccaggccgtgagattcggcctgctgttcaaccaggagaacaccacctacagcaagaccatcgccctgtacggcttcttcttcaagatcaagggcctgaagcacgacaccaccagctacagcttctacatgcagagaatcaagcacaccgacctggagagccccagcgccgtgtacgagcacaaccacgtgagcctgagagccgccagactggtgaagtacgagatcagagccgaggccctggtggacggcaagtggcaggagttcagaaccaaccagatcaagcagaagttcggcctgaccaccagcagctgcaagagccacaccctgaagatccagaccgtgggcatccccatctacgtgagcttcgccttcatcttccccgccagctag

SEQ ID NO: 18291 - DNA, 1524 bp, Artificial Sequence
  Description of Artificial Sequence: Synthetic coding sequence
atgatcatgagcaacacccagcacaaggccagactggagagaagagtgaccggcagcaccaacagatggagactgcccaagcagcccttcagcggcgacctgctgagcctgagccagatgtgcaaggccctgagcatcgacttcgaggaggccctgagaaaccccgacagactgtgcatcagccagatccagaagttcttcttcgagaacttcaagaacaaggacatccagagcggcgaggccgacgtgatcctggagtgcctgggcttcaagtgggagctgcaccagccccagctgttccagagcgagaccctggccaagctgtacctgaaggccctggcccagggcaccacccaccccctgagagagctggaggagctgctgagagcccagagccccaagaagaccaaggagaagagccccgccaagagaatcatcatcagcctgaagatcaacgaccccctggtgaccaaggtggccttcgccaccgccctgaagaacctgtacatgagcgaggtggagatcaacctggaggacctgctgggcgtgctggccagcgcccacatcctgcagttcagcggcctgttccagagatgcgtggacgtgatgatcgccagactgaagcccagcaccatcaagaagttctacgaggccggctgcaagtacaaggaggagcagctgaccaccggctgcgagaagtggctggagatgaacctggtgcccctgggcggcacccagatccacctgcacaagatcccccaggacctgctgcacaaggtgctgaagagccccagactgttcaccttcagcgagttccacctgctgaagaccatgctgctgtgggtgttcctgcagctgaactacaagatccaggccatccccacctacgagaccgtgatgaccttcttcaagagcttccccgagaactgctgcttcctggacagagacatcggcagaagcctgagacccctgttcctgtgcctgagactgcacggcatcaccaagggcaaggacctggaggtgctgagacacctgaacttcttccccgagagctggctggaccaggtgaccgtgaaccactaccacgccctggagaacggcggcgacatggtgcacctgaaggacctgaacacccaggccgtgagattcggcctgctgttcaaccaggagaacaccacctacagcaagaccatcgccctgtacggcttcttcttcaagatcaagggcctgaagcacgacaccaccagctacagcttctacatgcagagaatcaagcacaccgacctggagagccccagcgccgtgtacgagcacaaccacgtgagcctgagagccgccagactggtgaagtacgagatcagagccgaggccctggtggacggcaagtggcaggagttcagaaccaaccagatcaagcagaagttcggcctgaccaccagcagctgcaagagccacaccctgaagatccagaccgtgggcatccccatctacgtgagcttcgccttcatcttccccgccagctag

SEQ ID NO: 18292 - DNA, 2139 bp, Artificial Sequence
  Description of Artificial Sequence: Synthetic coding sequence
atgtgcagccccgccagccccaagatcctgtacagaaaccccagattcctgagactggccttcctgcagctgcaccaccagcagcagagcgacgtgttctgcgacgtgctgctgcaggccgagggcgaggccgtgcccgcccactgctgcatcctgagcgcctgcagccccttcttcaccgagagactggagagagagagacccgcccagggcggcaaggtggtgctggagctgggcggcctgaagatcagcaccctgagaaagctggtggacttcctgtacaccagcgagatggaggtgagccaggaggaggcccaggacgtgctgagcgccgccagacagctgagagtgagcgagctggagagcctgcagctggagggcggcaagctggtgaaggccccccagggcagaagactgaacagagagtgcctgcagcccaccagcgccgcccccatcagcgccagagtggtgacccccagccaccacccccacacccccctgcccaccaaccagaccccctgccccctgggcgccatcagactgaagagcctgggcaaggaggagggcccccaggagaacaacagacagaacgccgacaacctgagcggcaccctgctgctgaagagaaaggccagagcctgccccaccccccaggagaagaacagcagccccagcagccacagccaggagcccagagagaacaagaacgacaccgccctggaccccaccgtgctgagcccccccagcctgtaccccagcgtggacaagcacctgctgcccagaaagatcagactgagcagaagcaagcccagccccggcatctgcaccagcaagcccagcagcatcctgagcggcagcagcagcgtgcccgccacccccggcagaagactgtggagacagagaagcgtgaacaaggagacccccgaggacaagcccaagcccggcagagccagccccctgcagagcacccccaaccccagcggcctgggcaagaccggcggcagcagaaagagaagccccgaggtgagagcccccaacagcgacagcgccgaggagggccaggtgggcagagtgaagctgagaaagatcgtgaacggcacctgctgggaggtggtgcaggagacccccctgaagaacacccaggacagcccccagatccccgaccccggcggcgacttccaggagcccagcggcacccagcccttcagcagcaacgagcaggagatgagccccaccagaaccgagctgtgccaggacagccccatgtgcaccaagctgcaggacatcctggtgagcgccagccacagccccgaccaccccgtggtgaagagcgagttcgagagcagccccgagctggtggagaaggagcccatgctggccatcgactgcagagagccctacgccttcgacaccgccctgctggagcagccctgcgaggccgaggagtacagaatcaccagcgccgccgccaccagcgagctggaggagatcctggacttcatgctgtgcggcagcgacatcgagccccccatcggcagcctggagagccccggcgccgagggctgcagaacccccacctaccacctgaccgagaccggcaagaactggatcgagggcgaggagtggtgcctgcccgacatggagctgtggcccagagagctgaccgagctggagaaggagcccgccggcgagaacagaggccccaccgagctgctgagccccctggtgatgcccagcgaggtgagcgaggtgctgagcgtgggcggcagatggacccccgacctggagatcaccagcagccagcccctggacggccaggaggacaagctgctgcacgtgagcagcctggacaccccccagagaagctacggcgacctgagccccccctgcagcaactgggtggagaccggcctggaggtgagcctgaccaccgacgagctgctgtaccccagccccaaggccggcaaggaggtgagcggccacagcgagctgctgggcagcctgcccgccagcagcgaggaggaggagatcgacgtggtggactggaccgccgagggcagactggtgcccaccaccgtgcccagcgtgtggcccgaccccagcagcgagagcgagaccgaggtggacatcctgacctag

SEQ ID NO: 18293 - DNA, 2139 bp, Artificial Sequence; identical to SEQ ID NO: 18292
  Description of Artificial Sequence: Synthetic coding sequence

SEQ ID NO: 18294 - DNA, 270 bp, Artificial Sequence
  Description of Artificial Sequence: Synthetic coding sequence
atgtgcagccccgccagccccaagatcctgtacagaaaccccagattcctgagactggccttcctgcagctgcaccaccagcagcagagcgacgtgttctgcgacgtgctgctgcaggccgagggcgaggccgtgcccgcccactgctgcatcctgagcgcctgcagccccttcttcaccgagagactggagagagagagacccgcccagggcggcaaggtggtgctggagctgggcggcctgaagatcagcaccctgagaaagctgtag

SEQ ID NO: 18295 - DNA, 876 bp, Artificial Sequence
  Description of Artificial Sequence: Synthetic coding sequence
atggagcccctgggcctggtggtgcacggcaaggccgagcccttcagcgccgccctgagaagcctggtgaacaaccccagatacagcgacgtgtgcttcgtggtgggccaggagagacaggaggtgttcgcccacagatgcctgctggcctgcagatgcaacttcttccagagactgctgggcaccgagcccggccccggcgtgcccagccccgtggtgctgagcaccgtgcccaccgaggccttcctggccgtgctggagttcctgtacaccaacagcgtgaagctgtacagacacagcgtgctggaggtgctgaccgccgccgtggagtacggcctggaggagctgagagagctgtgcctgcagttcgtggtgaaggtgctggacgtggacctggtgtgcgaggccctgcaggtggccgtgaccttcggcctgggccagctgcaggagagatgcgtggccttcatcgaggcccacagccaggaggccctgagaaccagaggcttcctggagctgagcgccgccgccctgctgcccctgctgagaagcgacaagctgtgcgtggacgaggccgagctggtgagagccgccagaagctgggccagagtgggcgccgccgtgctggagagacccgtggccgaggtggccgcccccgtggtgaaggagctgagactggccctgctggcccccgccgagctgagcgccctggaggagcagaacagacaggagcccctgatccccgtggagcagatcgtggaggcctggaagtgccacgccctgagaagaggcgacgaggccagaggcgccccctgcagaagaagaagaggcaccctgcccagagagcaccacagattcctggacctgagcttcaagtag

SEQ ID NO: 18296 - DNA, 489 bp, Artificial Sequence
  Description of Artificial Sequence: Synthetic coding sequence
atggagcccctgggcctggtggtgcacggcaaggccgagcccttcagcgccgccctgagaagcctggtgaacaaccccagatacagcgacgtgtgcttcgtggtgggccaggagagacaggaggtgttcgcccacagatgcctgctggcctgcagatgcaacttcttccagagactgctgggcaccgagcccggccccggcgtgcccagccccgtggtgctgagcaccgtgcccaccgaggccttcctggccgtgctggagttcctgtacaccaacagcgtgaagctgtacagacacagcgtgctggaggtgctgaccgccgccgtggagtacggcctggaggagctgagagagctgtgcctgcagttcgtggtgaaggtgctggacgtggacctggtgtgcgaggccctgcagcacttctggagacccagaagagccgaccaggaggtgagaagaagcagacccagctggctgaccagatggccctag

SEQ ID NO: 18297 - DNA, 1386 bp, Artificial Sequence
  Description of Artificial Sequence: Synthetic coding sequence
atggccgccgacatcttccccagaaagaagcccgccaacagcagcagcaccagcgtgcagcagtaccaccagcagaacctgagcaacaacaacctgatccccgcccccaactggcagggcctgtaccccaccatcagagagagaaacgccatgatgttcaacaacgacctgatggccgacgtgcacttcgtggtgggcccccccggcggcacccagagactgcccggccacaagtacgtgctggccgtgggcagcagcgtgttccacgccatgttctacggcgagctggccgaggacaaggacgagatcagaatccccgacgtggagcccgccgccttcctggccatgctgaagtacatctactgcgacgagatcgacctggccgccgacaccgtgctggccaccctgtacgccgccaagaagtacatcgtgccccacctggccagagcctgcgtgaacttcctggagaccagcctgagcgccaagaacgcctgcgtgctgctgagccagagctgcctgttcgaggagcccgacctgacccagagatgctgggaggtgatcgacgcccaggccgagctggccctgaagagcgagggcttctgcgacatcgacttccagaccctggagagcatcctgagaagagagaccctgaacgccaaggagatcgtggtgttcgaggccgccctgaactgggccgaggtggagtgccagagacaggacctggccctgagcatcgagaacaagagaaaggtgctgggcaaggccctgtacctgatcagaatccccaccatggccctggacgacttcgccaacggcgccgcccagagcggcgtgctgaccctgaacgagaccaacgacatcttcctgtggtacaccgccgccaagaagcccgagctgcagttcgtgagcaaggccagaaagggcctggtgccccagagatgccacagattccagagctgcgcctacagaagcaaccagtggagatacagaggcagatgcgacagcatccagttcgccgtggacaagagagtgttcatcgccggcttcggcctgtacggcagcagctgcggcagcgccgagtacagcgccaagatcgagctgaagagacagggcgtggtgctgggccagaacctgagcaagtacttcagcgacggcagcagcaacaccttccccgtgtggttcgagtaccccgtgcagatcgagcccgacaccttctacaccgccagcgtgatcctggacggcaacgagctgagctacttcggccaggagggcatgaccgaggtgcagtgcggcaaggtgaccgtgcagttccagtgcagcagcgacagcaccaacggcaccggcgtgcagggcggccagatccccgagctgatcttctacgcctag

SEQ ID NO: 18298 - DNA, 1569 bp, Artificial Sequence
  Description of Artificial Sequence: Synthetic coding sequence
atggtggacgacaaggagaagaacatgaagtgcctgaccttcttcctgatgctgcccgagaccgtgaagaacagaagcaagaagagcagcaagaaggccaacaccagcagcagcagcagcaacagcagcaagctgccccccgtgtgctacgagatcatcaccctgaagaccaagaagaagaagatggccgccgacatcttccccagaaagaagcccgccaacagcagcagcaccagcgtgcagcagtaccaccagcagaacctgagcaacaacaacctgatccccgcccccaactggcagggcctgtaccccaccatcagagagagaaacgccatgatgttcaacaacgacctgatggccgacgtgcacttcgtggtgggcccccccggcggcacccagagactgcccggccacaagtacgtgctggccgtgggcagcagcgtgttccacgccatgttctacggcgagctggccgaggacaaggacgagatcagaatccccgacgtggagcccgccgccttcctggccatgctgaagtacatctactgcgacgagatcgacctggccgccgacaccgtgctggccaccctgtacgccgccaagaagtacatcgtgccccacctggccagagcctgcgtgaacttcctggagaccagcctgagcgccaagaacgcctgcgtgctgctgagccagagctgcctgttcgaggagcccgacctgacccagagatgctgggaggtgatcgacgcccaggccgagctggccctgaagagcgagggcttctgcgacatcgacttccagaccctggagagcatcctgagaagagagaccctgaacgccaaggagatcgtggtgttcgaggccgccctgaactgggccgaggtggagtgccagagacaggacctggccctgagcatcgagaacaagagaaaggtgctgggcaaggccctgtacctgatcagaatccccaccatggccctggacgacttcgccaacggcgccgcccagagcggcgtgctgaccctgaacgagaccaacgacatcttcctgtggtacaccgccgccaagaagcccgagctgcagttcgtgagcaaggccagaaagggcctggtgccccagagatgccacagattccagagctgcgcctacagaagcaaccagtggagatacagaggcagatgcgacagcatccagttcgccgtggacaagagagtgttcatcgccggcttcggcctgtacggcagcagctgcggcagcgccgagtacagcgccaagatcgagctgaagagacagggcgtggtgctgggccagaacctgagcaagtacttcagcgacggcagcagcaacaccttccccgtgtggttcgagtaccccgtgcagatcgagcccgacaccttctacaccgccagcgtgatcctggacggcaacgagctgagctacttcggccaggagggcatgaccgaggtgcagtgcggcaaggtgaccgtgcagttccagtgcagcagcgacagcaccaacggcaccggcgtgcagggcggccagatccccgagctgatcttctacgcctag

SEQ ID NO: 18299 - DNA, 1386 bp, Artificial Sequence; identical to SEQ ID NO: 18297
  Description of Artificial Sequence: Synthetic coding sequence

SEQ ID NO: 18300 - DNA, 1569 bp, Artificial Sequence; identical to SEQ ID NO: 18298
  Description of Artificial Sequence: Synthetic coding sequence

SEQ ID NO: 18301 - DNA, 411 bp, Artificial Sequence
  Description of Artificial Sequence: Synthetic coding sequence
atggccgccgacatcttccccagaaagaagcccgccaacagcagcagcaccagcgtgcagcagtaccaccagcagaacctgagcaacaacaacctgatccccgcccccaactggcagggcctgtaccccaccatcagagagagaaacgccatgatgttcaacaacgacctgatggccgacgtgcacttcgtggtgggcccccccggcggcacccagagactgcccggccacaagtacgtgctggccgtgggcagcagcgtgttccacgccatgttctacggcgagctggccgaggacaaggacgagatcagaatccccgacgtggagcccgccgccttcctggccatgctgaagtacatctactgcgacgagatcgacctggccgccgacaccgtgctggccaccctgtag

SEQ ID NO: 18302 - DNA, 9 bp, Artificial Sequence
  Description of Artificial Sequence: Synthetic coding sequence
atggcctag

SEQ ID NO: 18303 - DNA, 1860 bp, Artificial Sequence
  Description of Artificial Sequence: Synthetic coding sequence
atggccgccgccccccccctgagcaaggccgagtacctgaagagatacctgagcggcgccgacgccggcgtggacagaggcagcgagagcggcagaaagagaagaaagaagagacccaagcccggcggcgccggcggcaagggcatgagaatcgtggacgacgacgtgagctggaccgccatcagcaccaccaagctggagaaggaggaggaggaggacgacggcgacctgcccgtggtggccgagttcgtggacgagagacccgaggaggtgaagcagatggaggccttcagaagcagcgccaagtggaagctgctgggcggccacaacgaggacctgcccagcaacagacacttcagacacgacacccccgacagcagccccagaagagtgagacacggcacccccgaccccagccccagaaaggacagacacgacacccccgaccccagccccagaagagccagacacgacacccccgaccccagccccctgagaggcgccagacacgacagcgacaccagcccccccagaagaatcagacacgacagcagcgacaccagcccccccagaagagccagacacgacagccccgaccccagcccccccagaagaccccagcacaacagcagcggcgccagccccagaagagtgagacacgacagccccgaccccagcccccccagaagagccagacacggcagcagcgacatcagcagccccagaagagtgcacaacaacagccccgacaccagcagaagaaccctgggcagcagcgacacccagcagctgagaagagccagacacgacagccccgacctggcccccaacgtgacctacagcctgcccagaaccaagagcggcaaggcccccgagagagccagcagcaagaccagcccccactggaaggagagcggcgccagccacctgagcttccccaagaacagcaagtacgagtacgaccccgacatcagcccccccagaaagaagcaggccaagagccacttcggcgacaagaagcagctggacagcaagggcgactgccagaaggccaccgacagcgacctgagcagccccagacacaagcagagccccggccaccaggacagcgacagcgacctgagcccccccagaaacagacccagacacagaagcagcgacagcgacctgagcccccccagaagaagacagagaaccaagagcagcgacagcgacctgagcccccccagaagaagccagccccccggcaagaaggccgcccacatgtacagcggcgccaagaccggcctggtgctgaccgacatccagagagagcagcaggagctgaaggagcaggaccaggagaccatggccttcgaggccgagttccagtacgccgagaccgtgttcagagacaagagcggcagaaagagaaacctgaagctggagagactggagcagagaagaaaggccgagaaggacagcgagagagacgagctgtacgcccagtggggcaagggcctggcccagagcagacagcagcagcagaacgtggaggacgccatgaaggagatgcagaagcccctggccagatacatcgacgacgaggacctggacagaatgctgagagagcaggagagagagggcgaccccatggccaacttcatcaagaagaacaaggccaaggagaacaagaacaagaaggtgagacccagatacagcggccccgcccccccccccaacagattcaacatctggcccggctacagatgggacggcgtggacagaagcaacggcttcgagcagaagagattcgccagactggccagcaagaaggccgtggaggagctggcctacaagtggagcgtggaggacatgtag

SEQ ID NO: 18304 - DNA, 1458 bp, Artificial Sequence
  Description of Artificial Sequence: Synthetic coding sequence
atggccgccgccccccccctgagcaaggccgagtacctgaagagatacctgagcggcgccgacgccggcgtggacagaggcagcgagagcggcagaaagagaagaaagaagagacccaagcccggcggcgccggcggcaagggcatgagaatcgtggacgacgacgtgagctggaccgccatcagcaccaccaagctggagaaggaggaggaggaggacgacggcgacctgcccgtggtggccgagttcgtggacgagagacccgaggaggtgaagcagatggaggccttcagaagcagcgccaagtggaagctgctgggcggccacaacgaggacctgcccagcaacagacacttcagacacgacacccccgacagcagccccagaagagtgagacacggcacccccgaccccagccccagaaaggacagacacgacacccccgaccccagccccagaagagccagacacgacacccccgaccccagccccctgagaggcgccagacacgacagcgacaccagcccccccagaagaatcagacacgacagcagcgacaccagcccccccagaagagccagacacgacagccccgaccccagcccccccagaagaccccagcacaacagcagcggcgactgccagaaggccaccgacagcgacctgagcagccccagacacaagcagagccccggccaccaggacagcgacagcgacctgagcccccccagaaacagacccagacacagaagcagcgacagcgacctgagcccccccagaagaagacagagaaccaagagcagcgacagcgacctgagcccccccagaagaagccagccccccggcaagaaggccgcccacatgtacagcggcgccaagaccggcctggtgctgaccgacatccagagagagcagcaggagctgaaggagcaggaccaggagaccatggccttcgaggccgagttccagtacgccgagaccgtgttcagagacaagagcggcagaaagagaaacctgaagctggagagactggagcagagaagaaaggccgagaaggacagcgagagagacgagctgtacgcccagtggggcaagggcctggcccagagcagacagcagcagcagaacgtggaggacgccatgaaggagatgcagaagcccctggccagatacatcgacgacgaggacctggacagaatgctgagagagcaggagagagagggcgaccccatggccaacttcatcaagaagaacaaggccaaggagaacaagaacaagaaggtgagacccagatacagcggccccgcccccccccccaacagattcaacatctggcccggctacagatgggacggcgtggacagaagcaacggcttcgagcagaagagattcgccagactggccagcaagaaggccgtggaggagctggcctacaagtggagcgtggaggacatgtag

SEQ ID NO: 18305 - DNA, 600 bp, Artificial Sequence
  Description of Artificial Sequence: Synthetic coding sequence
gcccccggcagactggccagcagacccccccccccccccgccagaagatggagactggccgcccccagatacagcagcgccagcggccccagcggccccgccgccagactgtgcgccgagacccagggcgaggcccccagaggccccagagccgtgggcggcagcggcggcgccggcgagcccagatggagcagaggccccgcccagagagagagactgctgggctgcagctgctgcttccccagcttcttcaccggcacctgcagcttcagaaccagctggagcgccttcaccctggagctgaccagcagcatccccgcccccctgccccccccccccgccgccctgagcctgagccagcagcagggcaagagcagaagaaaggaggccagcacccccctgacccccgccgaggcccccgcctacagcagagccagacccagaagacagggcagccccagcgccggccccgaggcccccctggccaccgacgagccccccccccagagaagaagcggcatcagaggcggcagcgccaacatcagaagcctgcagcccagcagcctgagacccagcgcccacagaggcagcgccctgtag

SEQ ID NO: 18306 - DNA, 1185 bp, Artificial Sequence
  Description of Artificial Sequence: Synthetic coding sequence
atgagcagaatctaccacgacggcgccctgagaaacaaggccgtgcagagcgtgagactgcccggcgcctgggaccccgccgcccaccagggcggcaacggcgtgctgctggagggcgagctgatcgacgtgagcagacacagcatcctggacacccacggcagaaaggagagatactacgtgctgtacatcagacccagccacatccacagaagaaagttcgacgccaagggcaacgagatcgagcccaacttcagcgccaccagaaaggtgaacaccggcttcctgatgagcagctacaaggtggaggccaagggcgacaccgacagactgacccccgaggccctgaagggcctggtgaacaagcccgagctgctggccctgaccgagagcctgacccccgaccacaccgtggccttctggatgcccgagagcgagatggaggtgatggagctggagctgggcgccggcgtgagactgaagaccagaggcgacggccccttcctggacagcctggccaagctggaggccggcaccgtgaccaagtgcaacttcaccggcgacggcaagaccggcgccagctggaccgacaacatcatggcccagaagtgcagcaagggcgccgccgccgagatcagagagcagggcgacggcgccgaggacgaggagtggcccgaggagatccagcagcagatcgtgagagagaccttccacctggtgctgaagagagacgacaacatctgcaacttcctggagggcggcagcctgatcggcggcagcgactacaagctgatctacagacactacgccaccctgtacttcgtgttctgcgtggacagcagcgagagcgagctgggcatcctggacctgatccaggtgttcgtggagaccctggacaagtgcttcgagaacgtgtgcgagctggacctgatcttccacatggacaaggtgcactacatcctgcaggaggtggtgatgggcggcatggtgctggagaccaacatgaacgagatcgtggcccagatcgaggcccagaacagactggagaagagcgagggcggcctgagcgccgcccccgccagagccgtgagcgccgtgaagaacatcaacctgcccgagatccccagaaacatcaacatcggcgacctgaacatcaaggtgcccaacctgagccagttcgtgtag

SEQ ID NO: 18307 - DNA, 1176 bp, Artificial Sequence
  Description of Artificial Sequence: Synthetic coding sequence
atggccggcagcatggtgacccccctgctgtacagaagaaagctgagacccggcgagagaaagatgagacccgaggtgggcagagagcccgccgccctgcagcccagacagagacccagaagcgaccaccagctgcacagaagccccttcaccgtgccccccagaacccccgcctgcagaagccccggccccagcccccccatcgccgtggccctggaggtgaagccccagctggaggacgccgtgggcaagctggccgccgaggccgtggccgtgagagtgttccccctggccgtggacgacctggagagcgacgtgctggtgggcagacccagagtggaggcccaggacggcgagatcctggtggtgggcgccggcctgcaggaggtgctgggcagaggcgccctggtggacgaggtgggcgtggaggacgtggagctggtgagcctgcacgacctgggcagatgggtggtgaaggtggtggtgagactggtggtgctggtgcccctggaggccagagtgcacgccgtggaggaggccagactggcctggcccgtgctggtgggcccccaggtgggcctggccggcgagtggcacctgcacgccgagctgagactggtgctggcccacgccctgctgggcccccccgaggaggacgtgctgggcgccctggccggcgtgagcagagacctggagctgctggccagagagctgcaggccctgcaggtgctgatcagattccagcacgtgagagtgcagtggcagctggtgagaagagagcagcccagagccgtgcccgccggcgtggtggtggtgcaggccctgctggaccaggtgctgctgcacgagcacagactggccctggccctggccctgaccgtgcccgtggccgtggccctgtgcagaggcagagccgtgcacctgggcctgagaggcgccgccctgagaggcggccccggcagaggcggcagaagagtgctgagactgcaggccgccgccggcggcctgggcctgctgctggaggacggcgagcagagactggccctgcacgccctgctgctgctgcagttcgtgcagctgctgccccagcacgtgctggtggccctgacccagcccagcgcccacagagccagagccatgtgggccagaagctgctgcagaagactgagccagtag

SEQ ID NO: 18308 - DNA, 1062 bp, Artificial Sequence
  Description of Artificial Sequence: Synthetic coding sequence
atgtggctgctggagaaggccggctacaaggtgggcgccgccgagcccgccgccagatgggcccccagcggcctgttcagcaagagaagagcccccggcccccccaccagcgcctgccccaacgtgctgacccccgacagaatcccccagttcttcatcccccccagactgcccgaccccggcggcgccgtgcccgccgccagaagacacgtggccggcagaggcctgcccgccacctgcagcctgccccacctggccggcagagagggctgggccttcctgcccgagagcccccacaccagaagaagagagagcctgttccacggccccccccccgcccccgccggcggcctgcccgccgcccagagcagactgcacgtgagcgcccccgacctgagactgtgcagagcccccgacagcgacaccgccagcagccccgacagcagccccttcggcagccccagacccggcctgggcagaagaagagtgagcagaccccacagcctgagccccgagaaggccagcagcgccgacaccagcccccacagccccagaagagccggcccccccaccccccccctgttccacctggacttcctgtgctgccagctgagacccaccagagagagcgtgctgagactgggccccagaggcggccagctgagactgagcaccgagtaccaggccggccccggcagactgagactgagactggtgagcgccgagggcctgcccagacccagaagcagacccggcagcggcggcggcggctgctgcgtggtgctgagactgagacccagagtgagacccagagagcagcagagcagagtggtgaagtgcagcgccaaccccatcttcaacgaggacttcttcttcgacggcctgggcccccccgacctggccgccagaagcctgagagccaaggtgctggacagaggcgccggcctgagaagagacgtgctgctgggcgagtgcgagacccccctgatcgccctgctgccccccctgggcggcggcctgggccccggcagcagcctggcccccacccacctgagcctgtag

SEQ ID NO: 18309 - DNA, 2124 bp, Artificial Sequence
  Description of Artificial Sequence: Synthetic coding sequence
atggaccccggctggggccagagagacgtgggctgggccgccctgctgatcctgttcgccgccagcctgctgaccgtgttcgcctggctgctgcagtacgccagaggcctgtggctggccagagccagaggcgacagaggccccggccccgccctggccggcgagcccgccggcagcctgagagagctgggcgtgtggagaagcctgctgagactgagagccaccagagccggcgccgccgaggagcccggcgtgagaggcctgctggccagcctgttcgccttcaagagcttcagagagaactggcagagagcctgggtgagagccctgaacgagcaggcctgcagaaacggcagcagcatccagatcgccttcgaggaggtgccccagctgccccccagagccagcatcagccacgtgacctgcgtggaccagagcgagcacaccatggtgctgagatgccagctgagcgccgaggaggtgagattccccgtgagcgtgacccagcagagccccgccgccgtgagcatggagacctaccacgtgaccctgaccctgccccccacccagctggaggtgaacctggaggagatccccggcgagggcctgctgatcagctgggccttcaccgacagacccgacctgagcctgaccgtgctgcccaagctgcaggccagagagagaggcgaggagcaggtggagctgagcaccatcgaggagctgatcaaggacgccatcgtgagcacccagcccgccatgatggtgaacctgagagcctgcagcgcccccggcggcctggtgcccagcgagaagccccccatgatgccccaggcccagcccgccatccccagacccaacagactgttcctgagacagctgagagccagccacctgggcaacgagctggagggcaccgaggagctgtgctgcgtggccgagctggacaaccccatgcagcagaagtggaccaagcccgccagagccggcagcgaggtggagtggaccgaggacctggccctggacctgggcccccagagcagagagctgaccctgaaggtgctgagaagcagcagctgcggcgacaccgagctgctgggccaggccaccctgcccgtgggcagccccagcagacccctgagcagaagacagctgtgccccctgacccccggccccggcaaggccctgggccccgccgccaccatggccgtggagctgcactacgaggagggcagccccagaaacctgggcacccccaccagcagcacccccagacccagcatcacccccaccaagaagatcgagctggacagaaccatcatgcccgacggcaccatcgtgaccaccgtgaccaccgtgcagagcagacccagaatcgacggcaagctggacagccccagcagaagccccagcaaggtggaggtgaccgagaagaccaccaccgtgctgagcgagagcagcggccccagcaacaccagccacagcagcagccccggcgacagccacctgagcaacggcctggaccccgtggccgagaccgccatcagacagctgaccgagcccagcggcagagtggccaagaagacccccaccaagagaagcaccctgatcatcagcggcgtgagcaaggtgcccatcgcccaggacgagctggccctgagcctgggctacgccgccagcctggaggccagcgtgcaggacgacgccggcaccagcggcggccccagcagcccccccagcgacccccccgccatgagccccggccccctggacgccctgagcagccccaccagcgtgcaggaggccgacgagaccaccagaagcgacatcagcgagagacccagcgtggacgacatcgagagcgagaccggcagcaccggcgccctggagaccagaagcctgaaggaccacaaggtgagcttcctgagaagcggcaccaagctgatcttcagaagaagacccagacagaaggaggccggcctgagccagagccacgacgacctgagcaacgccaccgccacccccagcgtgagaaagaaggccggcagcttcagcagaagactgatcaagagattcagcttcaagagcaagcccaaggccaacggcaaccccagcccccagctgtag

SEQ ID NO: 18310 - DNA, 840 bp, Artificial Sequence
  Description of Artificial Sequence: Synthetic coding sequence
atgatcaaccagctgaccggcaccatccaggtggcccagagaatcgacagagacgccggcgagctgagacagaaccccaccatcagcctggaggtgctggtgaaggacagaccctacggcggccaggagaacagaatccagatcaccttcatcgtggaggacgtgaacgacaaccccgccacctgccagaagttcaccttcagcatcatggtgcccgagagaaccgccaagggcaccctgctgctggacctgaacaagttctgcttcgacgacgacagcgaggcccccaacaacagattcaacttcaccatgcccagcggcgtgggcagcggcagcagattcctgcaggaccccgccggcagcggcaagatcgtgctgatcggcgacctggactacgagaaccccagcaacctggccgccggcaacaagtacaccgtgatcatccaggtgcaggacgtggcccccccctactacaagagcaagtacaacgtgtacgtgtacatcctgaccagccccgagaacgagttccccctgatcttcgacagacccagctacgtgttcgacgtgagcgagagaagacccgcccagggccacctgagcggccccgaggagaagagactgctgagcatctgcatggtgagagccgtgtgccaccacttcggcctgcacatcgccagcggcagccccagagtgcccggcagacccatcggccagagccacccccagaccctgcccctgcaggactgggaggagcagggcaccagcgtgagagagatccccaacgaggactgcagagagagaagaagaggcggcaactaccccgacgagcactacctgtag

SEQ ID NO: 18311 - DNA, 957 bp, Artificial Sequence
  Description of Artificial Sequence: Synthetic coding sequence
tacaccgtgctggaggagctgagccccggcaccatcgtggccaacatcaccgccgaggaccccgacgacgagggcttccccagccacctgctgtacagcatcaccaccgtgagcaagtacttcatgatcaaccagctgaccggcaccatccaggtggcccagagaatcgacagagacgccggcgagctgagacagaaccccaccatcagcctggaggtgctggtgaaggacagaccctacggcggccaggagaacagaatccagatcaccttcatcgtggaggacgtgaacgacaaccccgccacctgccagaagttcaccttcagcatcatggtgcccgagagaaccgccaagggcaccctgctgctggacctgaacaagttctgcttcgacgacgacagcgaggcccccaacaacagattcaacttcaccatgcccagcggcgtgggcagcggcagcagattcctgcaggaccccgccggcagcggcaagatcgtgctgatcggcgacctggactacgagaaccccagcaacctggccgccggcaacaagtacaccgtgatcatccaggtgcaggacgtggcccccccctactacaagaacaacgtgtacgtgtacatcctgaccagccccgagaacgagttccccctgatcttcgacagacccagctacgtgttcgacgtgagcgagagaagacccgcccagggccacctgagcggccccgaggagaagagactgctgagcatctgcatggtgagagccgtgtgccaccacttcggcctgcacatcgccagcggcagccccagagtgcccggcagacccatcggccagagccacccccagaccctgcccctgcaggactgggaggagcagggcaccagcgacaaggagagaagaaacgaggactgcagagagagaagaagaggcggcaactaccccgacgagcactacctgtag

SEQ ID NO: 18312 - DNA, 450 bp, Artificial Sequence
  Description of Artificial Sequence: Synthetic coding sequence
atgcaggaggccatcatcctgctggccctgctgggcgccatgagcggcggcgaggccctgcacctgatcctgctgcccgccaccggcaacgtggccgagaacagcccccccggcaccagcgtgcacaagttcagcgtgaagctgagcgccagcctgagccccgtgatccccggcttcccccagatcgtgaacagcaaccccctgaccgaggccttcagagtgaactggctgagcggcacctacttcgaggtggtgaccaccggcatggagcagctggacttcgagaccggccccaacatcttcgacctgcagatctacgtgaaggacgaggtgggcgtgaccgacctgcaggtgctgaccgtgcaggtgaccgacgtgaacgagcccccccagttccagggcaacctggccgaggccagacacgagtgcacccagagctggagaaactag

SEQ ID NO: 18313 - DNA, 2658 bp, Artificial Sequence
  Description of Artificial Sequence: Synthetic coding sequence
atgcaggaggccatcatcctgctggccctgctgggcgccatgagcggcggcgaggccctgcacctgatcctgctgcccgccaccggcaacgtggccgagaacagcccccccggcaccagcgtgcacaagttcagcgtgaagctgagcgccagcctgagccccgtgatccccggcttcccccagatcgtgaacagcaaccccctgaccgaggccttcagagtgaactggctgagcggcacctacttcgaggtggtgaccaccggcatggagcagctggacttcgagaccggccccaacatcttcgacctgcagatctacgtgaaggacgaggtgggcgtgaccgacctgcaggtgctgaccgtgcaggtgaccgacgtgaacgagcccccccagttccagggcaacctggccgagggcctgcacctgtacatcgtggagagagccaaccccggcttcatctaccaggtggaggccttcgaccccgaggacaccagcagaaacatccccctgagctacttcctgatcagcccccccaagagcttcagaatgagcgccaacggcaccctgttcagcaccaccgagctggacttcgaggccggccacagaagcttccacctgatcgtggaggtgagagacagcggcggcctgaaggccagcaccgagctgcaggtgaacatcgtgaacctgaacgacgaggtgcccagattcaccagccccaccagagtgtacaccgtgctggaggagctgagccccggcaccatcgtggccaacatcaccgccgaggaccccgacgacgagggcttccccagccacctgctgtacagcatcaccaccgtgagcaagtacttcatgatcaaccagctgaccggcaccatccaggtggcccagagaatcgacagagacgccggcgagctgagacagaaccccaccatcagcctggaggtgctggtgaaggacagaccctacggcggccaggagaacagaatccagatcaccttcatcgtggaggacgtgaacgacaaccccgccacctgccagaagttcaccttcagcatcatggtgcccgagagaaccgccaagggcaccctgctgctggacctgaacaagttctgcttcgacgacgacagcgaggcccccaacaacagattcaacttcaccatgcccagcggcgtgggcagcggcagcagattcctgcaggaccccgccggcagcggcaagatcgtgctgatcggcgacctggactacgagaaccccagcaacctggccgccggcaacaagtacaccgtgatcatccaggtgcaggacgtggcccccccctactacaagaacaacgtgtacgtgtacatcctgaccagccccgagaacgagttccccctgatcttcgacagacccagctacgtgttcgacgtgagcgagagaagacccgccagaaccagagtgggccaggtgagagccaccgacaaggacctgccccagagcagcctgctgtacagcatcagcaccggcggcgccagcctgcagtaccccaacgtgttctggatcaaccccaagaccggcgagctgcagctggtgaccaaggtggactgcgagaccacccccatctacatcctgagaatccaggccaccaacaacgaggacaccagcagcgtgaccgtgaccgtgaacatcctggaggagaacgacgagaagcccatctgcacccccaacagctacttcctggccctgcccgtggacctgaaggtgggcaccaacatccagaacttcaagctgacctgcaccgacctggacagcagccccagaagcttcagatacagcatcggccccggcaacgtgaacaaccacttcaccttcagccccaacgccggcagcaacgtgaccagactgctgctgaccagcagattcgactacgccggcggcttcgacaagatctgggactacaagctgctggtgtacgtgaccgacgacaacctgatgagcgacagaaagaaggccgaggccctggtggagaccggcaccgtgaccctgagcatcaaggtgatcccccaccccaccaccatcatcaccaccacccccagacccagagtgacctaccaggtgctgagaaagaacgtgtacagccccagcgcctggtacgtgcccttcgtgatcaccctgggcagcatcctgctgctgggcctgctggtgtacctggtggtgctgctggccaaggccatccacagacactgcccctgcaagaccggcaagaacaaggagcccctgaagaagaagaccgagaccaagaccgccgagagagacgtggtggtggagaccatccagatgaacaccatcttcgacggcgaggccatcgaccccgtgaccggcgagacctacgagttcaacagcaagaccggcgccagaaagtggaaggaccccctgacccagatgcccaagtggaaggagagcagccaccagggcgccgcccccagaagagtgaccgccggcgagggcatgggcagcctgagaagcgccaactgggaggaggacgagctgagcggcaaggcctgggccgaggacgccggcctgggcagcagaaacgagggcggcaagctgggcaaccccaagaacagaaaccccgccttcatgaacagagcctaccccaagccccaccccggcaagtag

SEQ ID NO: 18314 - DNA, 945 bp, Artificial Sequence
  Description of Artificial Sequence: Synthetic coding sequence
atgagcgccgccgaggccggcggcgtgttccacagagccagaggcagaaccctggccgccttccccgccgagaaggagagcgagtggaagggccccttctacttcatcctgggcgccgacccccagttcggcctgatcaaggcctggagcaccggcgactgcgacaacggcggcgacgagtgggagcaggagatcagactgaccgagcaggccgtgcaggccatcaacaagctgaaccccaagcccaagttcttcgtgctgtgcggcgacctgatccacgccatgcccggcaagccctggagaaccgagcagaccgaggacctgaagagagtgctgagagccgtggacagagccatccccctggtgctggtgagcggcaaccacgacatcggcaacacccccaccgccgagaccgtggaggagttctgcagaacctggggcgacgactacttcagcttctgggtgggcggcgtgctgttcctggtgctgaacagccagttctacgagaaccccagcaagtgccccagcctgaagcaggcccaggaccagtggctggacgagcagctgagcatcgccagacagagacactgccagcacgccatcgtgttccagcacatccccctgttcctggagagcatcgacgaggacgacgactactacttcaacctgagcaagagcaccagaaagaagctggccgacaagttcatccacgccggcgtgaaggtggtgttcagcggccactaccacagaaacgccggcggcacctaccagaacctggacatggtggtgagcagcgccatcggctgccagctgggcagagacccccacggcctgagagtggtggtggtgaccgccgagaagatcgtgcacagatactacagcctggacgagctgagcgagaagggcatcgaggacgacctgatggacctgatcaagaagaagtag

SEQ ID NO: 18315 - DNA, 519 bp, Artificial Sequence
  Description of Artificial Sequence: Synthetic coding sequence
atgagcgccgccgaggccggcggcgtgttccacagagccagaggcagaaccctggccgccttccccgccgagaaggagagcgagtggaagggccccttctacttcatcctgggcgccgacccccagttcggcctgatcaaggcctggagcaccggcgactgcgacaacggcggcgacgagtgggagcaggagatcagactgaccgagcaggccgtgcaggccatcaacaagctgaaccccaagcccaagttcttcgtgctgtgcggcgacctgatccacgccatgcccggcgtgaaggtggtgttcagcggccactaccacagaaacgccggcggcacctaccagaacctggacatggtggtgagcagcgccatcggctgccagctgggcagagacccccacggcctgagagtggtggtggtgaccgccgagaagatcgtgcacagatactacagcctggacgagctgagcgagaagggcatcgaggacgacctgatggacctgatcaagaagaagtag

SEQ ID NO: 18316 - DNA, 426 bp, Artificial Sequence
  Description of Artificial Sequence: Synthetic coding sequence
atgggcttccagaagttcagccccttcctggccctgagcatcctggtgctgctgcaggccggcagcctgcacgccgcccccttcagaagcgccctggagagcagccccgccgaccccgccaccctgagcgaggacgaggccagactgctgctggccgccctggtgcaggactacgtgcagatgaaggccagcgagctggagcaggagcaggagagagagggcagcagcctggacagccccagaagcaagagatgcggcaacctgagcacctgcatgctgggcacctacacccaggacttcaacaagttccacaccttcccccagaccgccatcggcgtgggcgcccccggcaagaagagagacatgagcagcgacctggagagagaccacagaccccacgtgagcatgccccagaacgccaactag

SEQ ID NO: 18317 - DNA, 564 bp, Artificial Sequence
  Description of Artificial Sequence: Synthetic coding sequence
atgggcaacaagcagaccatcttcaccgaggagcagctggacaactaccaggactgcaccttcttcaacaagaaggacatcctgaagctgcacagcagattctacgagctggcccccaacctggtgcccatggactacagaaagagccccatcgtgcacgtgcccatgagcctgatcatccagatgcccgagctgagagagaaccccttcaaggagagaatcgtggccgccttcagcgaggacggcgagggcaacctgaccttcaacgacttcgtggacatgttcagcgtgctgtgcgagagcgcccccagagagctgaaggccaactacgccttcaagatctacgacttcaacaccgacaacttcatctgcaaggaggacctggagctgaccctggccagactgaccaagagcgagctggacgaggaggaggtggtgctggtgtgcgacaaggtgatcgaggaggccgacctggacggcgacggcaagctgggcttcgccgacttcgaggacatgatcgccaaggcccccgacttcctgagcaccttccacatcagaatctag

SEQ ID NO: 18318 - DNA, 564 bp, Artificial Sequence
  Description of Artificial Sequence: Synthetic coding sequence
atgggcaacaagcagaccgtgttcacccacgagcagctggaggcctaccaggactgcaccttcttcaccagaaaggagatcatgagactgttctacagataccaggacctggccccccagctggtgcccctggactacaccacctgccccgacgtgaaggtgccctacgagctgatcggcagcatgcccgagctgaaggacaaccccttcagacagagaatcgcccaggtgttcagcgaggacggcgacggccacatgaccctggacaacttcctggacatgttcagcgtgatgagcgagatggcccccagagacctgaaggcctactacgccttcaagatctacgacttcaacaacgacgactacatctgcgcctgggacctggagcagaccgtgaccaagctgaccagaggcggcctgagcgccgaggaggtgagcctggtgtgcgagaaggtgctggacgaggccgacggcgaccacgacggcagactgagcctggaggacttccagaacatgatcctgagagcccccgacttcctgagcaccttccacatcagaatctag

SEQ ID NO: 18319 - DNA, 417 bp, Artificial Sequence
  Description of Artificial Sequence: Synthetic coding sequence
atgggcaacaagcagaccgtgttcacccacgagcagctggaggcctaccaggacaaccccttcagacagagaatcgcccaggtgttcagcgaggacggcgacggccacatgaccctggacaacttcctggacatgttcagcgtgatgagcgagatggcccccagagacctgaaggcctactacgccttcaagatctacgacttcaacaacgacgactacatctgcgcctgggacctggagcagaccgtgaccaagctgaccagaggcggcctgagcgccgaggaggtgagcctggtgtgcgagaaggtgctggacgaggccgacggcgaccacgacggcagactgagcctggaggacttccagaacatgatcctgagagcccccgacttcctgagcaccttccacatcagaatctag

SEQ ID NO: 18320 - DNA, 93 bp, Artificial Sequence
  Description of Artificial Sequence: Synthetic coding sequence
atgggcaacaagcagaccgtgttcacccacgagcagctggaggcctaccaggactgcaccttcttcaccagaaaggagatcatgagattctag

SEQ ID NO: 18321 - DNA, 558 bp, Artificial Sequence
  Description of Artificial Sequence: Synthetic coding sequence
atgggccagtgcctgagataccagatgcactgggaggacctggaggagtaccaggccctgaccttcctgaccagaaacgagatcctgtgcatccacgacaccttcctgaagctgtgcccccccggcaagtactacaaggaggccaccctgaccatggaccaggtgagcagcctgcccgccctgagagtgaaccccttcagagacagaatctgcagagtgttcagccacaagggcatgttcagcttcgaggacgtgctgggcatggccagcgtgttcagcgagcaggcctgccccagcctgaagatcgagtacgccttcagaatctacgacttcaacgagaacggcttcatcgacgaggaggacctgcagagaatcatcctgagactgctgaacagcgacgacatgagcgaggacctgctgatggacctgaccaaccacgtgctgagcgagagcgacctggacaacgacaacatgctgagcttcagcgagttcgagcacgccatggccaagagccccgacttcatgaacagcttcagaatccacttctggggctgctag

SEQ ID NO: 18322 - DNA, 450 bp, Artificial Sequence
  Description of Artificial Sequence: Synthetic coding sequence
atggccgccgagcacctgctgcccggccccccccccagcctggccgacttcagactggaggccggcggcaagggcaccgagagaggcagcggcagcagcaagcccaccggcagcagcagaggccccagaatggccaagttcctgagccaggaccagatcaacgacggcaacggcgagctggacttcagcaccttcctgaccatcatgcacatgcagatcaagcaggaggaccccaagaaggagatcctgctggccatgctgatggtggacaaggagaagaagggctacgtgatggccagcgacctgagaagcaagctgaccagcctgggcgagaagctgacccacaaggaggtggacgacctgttcagagaggccgacatcgagcccaacggcaaggtgaagtacgacgagttcatccacaagatcaccctgcccggcagagactactag

SEQ ID NO: 18323 - DNA, 591 bp, Artificial Sequence
  Description of Artificial Sequence: Synthetic coding sequence
atggccgccgagcacctgctgcccggccccccccccagcctggccgacttcagactggaggccggcggcaagggcaccgagagaggcagcggcagcagcaagcccaccggcagcagcagaggccccagaatggccaagttcctgagccaggaccagatcaacgagtacaaggagtgcttcagcctgtacgacaagcagcagagaggcaagatcaaggccaccgacctgatggtggccatgagatgcctgggcgccagccccacccccggcgaggtgcagagacacctgcagacccacggcatcgacggcaacggcgagctggacttcagcaccttcctgaccatcatgcacatgcagatcaagcaggaggaccccaagaaggagatcctgctggccatgctgatggtggacaaggagaagaagggctacgtgatggccagcgacctgagaagcaagctgaccagcctgggcgagaagctgacccacaaggaggtggacgacctgttcagagaggccgacatcgagcccaacggcaaggtgaagtacgacgagttcatccacaagatcaccctgcccggcagagactactag

SEQ ID NO: 18324 - DNA, 363 bp, Artificial Sequence
  Description of Artificial Sequence: Synthetic coding sequence
atggtggccatgagatgcctgggcgccagccccacccccggcgaggtgcagagacacctgcagacccacggcatcgacggcaacggcgagctggacttcagcaccttcctgaccatcatgcacatgcagatcaagcaggaggaccccaagaaggagatcctgctggccatgctgatggtggacaaggagaagaagggctacgtgatggccagcgacctgagaagcaagctgaccagcctgggcgagaagctgacccacaaggaggtggacgacctgttcagagaggccgacatcgagcccaacggcaaggtgaagtacgacgagttcatccacaagatcaccctgcccggcagagactactag

SEQ ID NO: 18325 - DNA, 441 bp, Artificial Sequence
  Description of Artificial Sequence: Synthetic coding sequence
atggccggcgagctgacccccgaggaggaggcccagtacaagaaggccttcagcgccgtggacaccgacggcaacggcaccatcaacgcccaggagctgggcgccgccctgaaggccaccggcaagaacctgagcgaggcccagctgagaaagctgatcagcgaggtggacagcgacggcgacggcgagatcagcttccaggagttcctgaccgccgccaagaaggccagagccggcctggaggacctgcaggtggccttcagagccttcgaccaggacggcgacggccacatcaccgtggacgagctgagaagagccatggccggcctgggccagcccctgccccaggaggagctggacgccatgatcagagaggccgacgtggaccaggacggcagagtgaactacgaggagttcgccagaatgctggcccaggagtag

SEQ ID NO: 18326 - DNA, 2010 bp, Artificial Sequence
  Description of Artificial Sequence: Synthetic coding sequence
atggcctactaccaggagcccagcgtggagaccagcatcatcaagttcaaggaccaggacttcaccaccctgagagaccactgcctgagcatgggcagaaccttcaaggacgagaccttccccgccgccgacagcagcatcggccagaagctgctgcaggagaagagactgagcaacgtgatctggaagagaccccaggacctgcccggcggccccccccacttcatcctggacgacatcagcagattcgacatccagcagggcggcgccgccgactgctggttcctggccgccctgggcagcctgacccagaacccccagtacagacagaagatcctgatggtgcagagcttcagccaccagtacgccggcatcttcagattcagattctggcagtgcggccagtgggtggaggtggtgatcgacgacagactgcccgtgcagggcgacaagtgcctgttcgtgagacccagacaccagaaccaggagttctggccctgcctgctggagaaggcctacgccaagctgctgggcagctacagcgacctgcactacggcttcctggaggacgccctggtggacctgaccggcggcgtgatcaccaacatccacctgcacagcagccccgtggacctggtgaaggccgtgaagaccgccaccaaggccggcagcctgatcacctgcgccacccccagcggccccaccgacaccgcccaggccatggagaacggcctggtgagcctgcacgcctacaccgtgaccggcgccgagcagatccagtacagaagaggctgggaggagatcatcagcctgtggaacccctggggctggggcgaggccgagtggagaggcagatggagcgacggcagccaggagtgggaggagacctgcgaccccagaaagagccagctgcacaagaagagagaggacggcgagttctggatgagctgccaggacttccagcagaagttcatcgccatgttcatctgcagcgagatccccatcaccctggaccacggcaacaccctgcacgagggctggagccagatcatgttcagaaagcaggtgatcctgggcaacaccgccggcggccccagaaacgacgcccagttcaacttcagcgtgcaggagcccatggagggcaccaacgtggtggtgtgcgtgaccgtggccgtgacccccagcaacctgaaggccgaggacgccaagttccccctggacttccaggtgatcctggccggcagccagagattcagagagaagttcccccccgtgttcttcagcagcttcagaaacaccgtgcagagcagcaacaacaagttcagaagaaacttcaccatgacctaccacctgagccccggcaactacgtggtggtggcccagaccagaagaaagagcgccgagttcctgctgagaatcttcctgaagatgcccgacagcgacagacacctgagcagccacttcaacctgagaatgaagggcagccccagcgagcacggcagccagcagagcatcttcaacagatacgcccagcagagactggacatcgacgccacccagctgcagggcctgctgaaccaggagctgctgaccggcccccccggcgacatgttcagcctggacgagtgcagaagcctggtggccctgatggagctgaaggtgaacggcagactggaccaggaggagttcgccagactgtggaagagactggtgcactaccagcacgtgttccagaaggtgcagaccagccccggcgtgctgctgagcagcgacctgtggaaggccatcgagaacaccgacttcctgagaggcatcttcatcagcagagagctgctgcacctggtgaccctgagatacagcgacagcgtgggcagagtgagcttccccagcctggtgtgcttcctgatgagactggaggccatggccaagaccttcagaaacctgagcaaggacggcaagggcctgtacctgaccgagatggagtggatgagcctggtgatgtacaactag

SEQ ID NO: 18327 - DNA, 2010 bp, Artificial Sequence
  Description of Artificial Sequence: Synthetic coding sequence
atggcctactaccaggagcccagcgtggagaccagcatcatcaagttcaaggaccaggacttcaccaccctgagagaccactgcctgagcatgggcagaaccttcaaggacgagaccttccccgccgccgacagcagcatcggccagaagctgctgcaggagaagagactgagcaacgtgatctggaagagaccccaggacctgcccggcggccccccccacttcatcctggacgacatcagcagattcgacatccagcagggcggcgccgccgactgctggttcctggccgccctgggcagcctgacccagaacccccagtacagacagaagatcctgatggtgcagagcttcagccaccagtacgccggcatcttcagattcagattctggcagtgcggccagtgggtggaggtggtgatcgacgacagactgcccgtgcagggcgacaagtgcctgttcgtgagacccagacaccagaaccaggagttctggccctgcctgctggagaaggcctacgccaagctgctgggcagctacagcgacctgcactacggcttcctggaggacgccctggtggacctgaccggcggcgtgatcaccaacatccacctgcacagcagccccgtggacctggtgaaggccgtgaagaccgccaccaaggccggcagcctgatcacctgcgccacccccagcggccccaccgacaccgcccaggccatggagaacggcctggtgagcctgcacgcctacaccgtgaccggcgccgagcagatccagtacagaagaggctgggaggagatcatcagcctgtggaacccctggggctggggcgaggccgagtggagaggcagatggagcgacggcagccaggagtgggaggagacctgcgaccccagaaagagccagctgcacaagaagagagaggacggcgagttctggatgagctgccaggacttccagcagaagttcatcgccatgttcatctgcagcgagatccccatcaccctggaccacggcaacaccctgcacgagggctggagccagatcatgttcagaaagcaggtgatcctgggcaacaccgccggcggccccagaaacgacgcccagttcaacttcagcgtgcaggagcccatggagggcaccaacgtggtggtgtgcgtgaccgtggccgtgacccccagcaacctgaaggccgaggacgccaagttccccctggacttccaggtgatcctgaccagcgtgcagagattcagagagaagttcccccccgtgttcttcagcagcttcagaaacaccgtgcagagcagcaacaacaagttcagaagaaacttcaccatgacctaccacctgagccccggcaactacgtggtggtggcccagaccagaagaaagagcgccgagttcctgctgagaatcttcctgaagatgcccgacagcgacagacacctgagcagccacttcaacctgagaatgaagggcagccccagcgagcacggcagccagcagagcatcttcaacagatacgcccagcagagactggacatcgacgccacccagctgcagggcctgctgaaccaggagctgctgaccggcccccccggcgacatgttcagcctggacgagtgcagaagcctggtggccctgatggagctgaaggtgaacggcagactggaccaggaggagttcgccagactgtggaagagactggtgcactaccagcacgtgttccagaaggtgcagaccagccccggcgtgctgctgagcagcgacctgtggaaggccatcgagaacaccgacttcctgagaggcatcttcatcagcagagagctgctgcacctggtgaccctgagatacagcgacagcgtgggcagagtgagcttccccagcctggtgtgcttcctgatgagactggaggccatggccaagaccttcagaaacctgagcaaggacggcaagggcctgtacctgaccgagatggagtggatgagcctggtgatgtacaactag

SEQ ID NO: 18328 - DNA, 2055 bp, Artificial Sequence
  Description of Artificial Sequence: Synthetic coding sequence
atgagcctgtggccccccttcagatgcagatggaagctggcccccagatacagcagaagagccagcccccagcagccccagcaggacttcgaggccctgctggccgagtgcctgagaaacggctgcctgttcgaggacaccagcttccccgccaccctgagcagcatcggcagcggcagcctgctgcagaagctgccccccagactgcagtggaagagaccccccgagctgcacagcaacccccagttctacttcgccaaggccaagagactggacctgtgccagggcatcgtgggcgactgctggttcctggccgccctgcaggccctggccctgcaccaggacatcctgagcagagtggtgcccctgaaccagagcttcaccgagaagtacgccggcatcttcagattctggttctggcactacggcaactgggtgcccgtggtgatcgacgacagactgcccgtgaacgaggccggccagctggtgttcgtgagcagcacctacaagaacctgttctggggcgccctgctggagaaggcctacgccaagctgagcggcagctacgaggacctgcagagcggccaggtgagcgaggccctggtggacttcaccggcggcgtgaccatgaccatcaacctggccgaggcccacggcaacctgtgggacatcctgatcgaggccacctacaacagaaccctgatcggctgccagacccacagcggcgagaagatcctggagaacggcctggtggagggccacgcctacaccctgaccggcatcagaaaggtgacctgcaagcacagacccgagtacctggtgaagctgagaaacccctggggcaaggtggagtggaagggcgactggagcgacagcagcagcaagtgggagctgctgagccccaaggagaagatcctgctgctgagaaaggacaacgacggcgagttctggatgaccctgcaggacttcaagacccacttcgtgctgctggtgatctgcaagctgacccccggcctgctgagccaggaggccgcccagaagtggacctacaccatgagagagggcagatgggagaagagaagcaccgccggcggccagagacagctgctgcaggacaccttctggaagaacccccagttcctgctgagcgtgtggagacccgaggagggcagaagaagcctgagaccctgcagcgtgctggtgagcctgctgcagaagcccagacacagatgcagaaagagaaagcccctgctggccatcggcttctacctgtacagaatgaacaagtaccacgacgaccagagaagactgccccccgagttcttccagagaaacacccccctgagccagcccgacagattcctgaaggagaaggaggtgagccaggagctgtgcctggagcccggcacctacctgatcgtgccctgcatcctggaggcccaccagaagagcgagttcgtgctgagagtgttcagcagaaagcacatcttctacgagatcggcagcaacagcggcgtggtgttcagcaaggagatcgaggaccagaacgagagacaggacgagttcttcaccaagttcttcgagaagcaccccgagatcaacgccgtgcagctgcagaacctgctgaaccagatgacctggagcagcctgggcagcagacagcccttcttcagcctggaggcctgccagggcatcctggccctgctggacctgaacgccagcggcaccatgagcatccaggagttcagagacctgtggaagcagctgaagctgagccagaaggtgttccacaagcaggacagaggcagcggctacctgaactgggagcagctgcacgccgccatgagagaggccggcatcatgctgagcgacgacgtgtgccagctgatgctgatcagatacggcggccccagactgcagatggacttcgtgagcttcatccacctgatgctgagagtggagaacatggaggacgtgttccagaacctgacccaggacggcaagggcatctacctgcagaagcccgagtggatgatgatggccctgtacagctag

SEQ ID NO: 18329 - DNA, 2055 bp, Artificial Sequence
  Description of Artificial Sequence: Synthetic coding sequence
atgagcctgtggccccccttcagatgcagatggaagctggcccccagatacagcagaagagccagcccccagcagccccagcaggacttcgaggccctgctggccgagtgcctgagaaacggctgcctgttcgaggacaccagcttccccgccaccctgagcagcatcggcagcggcagcctgctgcagaagctgccccccagactgcagtggaagagaccccccgagctgcacagcaacccccagttctacttcgccaaggccaagagactggacctgtgccagggcatcgtgggcgactgctggttcctggccgccctgcaggccctggccctgcaccaggacatcctgagcagagtggtgcccctgaaccagagcttcaccgagaagtacgccggcatcttcagattctggttctggcactacggcaactgggtgcccgtggtgatcgacgacagactgcccgtgaacgaggccggccagctggtgttcgtgagcagcacctacaagaacctgttctggggcgccctgctggagaaggcctacgccaagctgagcggcagctacgaggacctgcagagcggccaggtgagcgaggccctggtggacttcaccggcggcgtgaccatgaccatcaacctggccgaggcccacggcaacctgtgggacatcctgatcgaggccacctacaacagaaccctgatcggctgccagacccacagcggcgagaagatcctggagaacggcctggtggagggccacgcctacaccctgaccggcatcagaaaggtgacctgcaagcacagacccgagtacctggtgaagctgagaaacccctggggcaaggtggagtggaagggcgactggagcgacagcagcagcaagtgggagctgctgagccccaaggagaagatcctgctgctgagaaaggacaacgacggcgagttctggatgaccctgcaggacttcaagacccacttcgtgctgctggtgatctgcaagctgacccccggcctgctgagccaggaggccgcccagaagtggacctacaccatgagagagggcagatgggagaagagaagcaccgccggcggccagagacagctgctgcaggacaccttctggaagaacccccagttcctgctgagcgtgtggagacccgaggagggcagaagaagcctgagaccctgcagcgtgctggtgagcctgctgcagaagcccagacacagatgcagaaagagaaagcccctgctggccatcggcttctacctgtacagagtggccaagtaccacgacgaccagagaagactgccccccgagttcttccagagaaacacccccctgagccagcccgacagattcctgaaggagaaggaggtgagccaggagctgtgcctggagcccggcacctacctgatcgtgccctgcatcctggaggcccaccagaagagcgagttcgtgctgagagtgttcagcagaaagcacatcttctacgagatcggcagcaacagcggcgtggtgttcagcaaggagatcgaggaccagaacgagagacaggacgagttcttcaccaagttcttcgagaagcaccccgagatcaacgccgtgcagctgcagaacctgctgaaccagatgacctggagcagcctgggcagcagacagcccttcttcagcctggaggcctgccagggcatcctggccctgctggacctgaacgccagcggcaccatgagcatccaggagttcagagacctgtggaagcagctgaagctgagccagaaggtgttccacaagcaggacagaggcagcggctacctgaactgggagcagctgcacgccgccatgagagaggccggcatcatgctgagcgacgacgtgtgccagctgatgctgatcagatacggcggccccagactgcagatggacttcgtgagcttcatccacctgatgctgagagtggagaacatggaggacgtgttccagaacctgacccaggacggcaagggcatctacctgcagaagcccgagtggatgatgatggccctgtacagctag

SEQ ID NO: 18330 - DNA, 2046 bp, Artificial Sequence
  Description of Artificial Sequence: Synthetic coding sequence
atggccgcccaggccgccggcgtgagcagacagagagccgccacccagggcctgggcagcaaccagaacgccctgaagtacctgggccaggacttcaagaccctgagacagcagtgcctggacagcggcgtgctgttcaaggaccccgagttccccgcctgccccagcgccctgggctacaaggacctgggccccggcagcccccagacccagggcatcatctggaagagacccaccgagctgtgccccagcccccagttcatcgtgggcggcgccaccagaaccgacatctgccagggcggcctgggcgactgctggctgctggccgccatcgccagcctgaccctgaacgaggagctgctgtacagagtggtgcccagagaccaggacttccaggagaactacgccggcatcttccacttccagttctggcagtacggcgagtgggtggaggtggtgatcgacgacagactgcccaccaagaacggccagctgctgttcctgcacagcgagcagggcaacgagttctggagcgccctgctggagaaggcctacgccaagctgaacggctgctacgaggccctggccggcggcagcaccgtggagggcttcgaggacttcaccggcggcatcagcgagttctacgacctgaagaagccccccgccaacctgtaccagatcatcagaaaggccctgtgcgccggcagcctgctgggctgcagcatcgacgtgagcagcgccgccgaggccgaggccatcaccagccagaagctggtgaagagccacgcctacagcgtgaccggcgtggaggaggtgaacttccagggccaccccgagaagctgatcagactgagaaacccctggggcgaggtggagtggagcggcgcctggagcgacgacgccagccccgtgatcagccccagcgccgagggctgcagagtgaagcacaccaccatgagaagcatgagccagatgagcctgagcgacttcgtgagacagttcagcagactggagatctgcaacctgagccccgacagcctgagcagcgaggaggtgcacaagtggaacctggtgctgttcaacggccactggaccagaggcagcaccgccggcggctgccagaactaccccgccacctactggaccaacccccagttcaagatcagactggacgaggtggacgaggaccaggaggagagcatcggcgagccctgctgcaccgtgctgctgggcctgatgcagaagaacagaagatggagaaagagaatcggccagggcatgctgagcatcggctacgccgtgtaccaggtgctgctgtgctggtacaccctggacgtgctgggcctgaacatcctggccagccactgcagcaccagcttcctgctgctggaggaggccagcctgctgctgtacatccccctgcccgtggccctgctgagattcagagacagcttcctgtggctgaacaccagaagactgagaagaatctgcccccaggcctgccacgacgccctgcccttctggcagagacccagcagcgtgccccacccctggatggtgagcctggaggtgttctacagaggcggcagcttcccccacctgcagatgatcagattccccctgcccttcagcagaaccgacatcaagttcgacggcttcaacatcaacacctgcagagagatgatcagcctgctggacagcaacggcaccggcaccctgggcgccgtggagttcaagaccctgtggctgaagatccagaagtacctggagatctactgggagaccgactacaaccacagcggcaccatcgacgcccacgagatgagaaccgccctgagaaaggccggcttcaccctgaacagccaggtgcagcagaccatcgccctgagatacgcctgcagcaagctgggcatcaacttcgacagcttcgtggcctgcatgatcagactggagaccctgttcaagctgttcagcctgctggacgaggacaaggacggcatggtgcagctgagcctggccgagtggctgtgctgcgtgctggtgtag

SEQ ID NO: 18331 - DNA, 1146 bp, Artificial Sequence
  Description of Artificial Sequence: Synthetic coding sequence
atggccgcccaggccgccggcgtgagcagacagagagccgccacccagggcctgggcagcaaccagaacgccctgaagtacctgggccaggacttcaagaccctgagacagcagtgcctggacagcggcgtgctgttcaaggaccccgagttccccgcctgccccagcgccctgggctacaaggacctgggccccggcagcccccagacccagggcatcatctggaagagacccaccgagctgtgccccagcccccagttcatcgtgggcggcgccaccagaaccgacatctgccagggcggcctgggcgactgctggctgctggccgccatcgccagcctgaccctgaacgaggagctgctgtacagagtggtgcccagagaccaggacttccaggagaactacgccggcatcttccacttccagttctggcagtacggcgagtgggtggaggtggtgatcgacgacagactgcccaccaagaacggccagctgctgttcctgcacagcgagcagggcaacgagttctggagcgccctgctggagaaggcctacgccaagctgaacggctgctacgaggccctggccggcggcagcaccgtggagggcttcgaggacttcaccggcggcatcagcgagttctacgacctgaagaagccccccgccaacctgtaccagatcatcagaaaggccctgtgcgccggcagcctgctgggctgcagcatcgacgtgagcagcgccgccgaggccgaggccatcaccagccagaagctggtgaagagccacgcctacagcgtgaccggcgtggaggaggtgaacttccagggccaccccgagaagctgatcagactgagaaacccctggggcgaggtggagtggagcggcgcctggagcgacgacgcccccgagtggaaccacatcgaccccagaagaaaggaggagctggacaagaaggtggaggacggcgagttctggatgagcctgagcgacttcgtgagacagttcagcagactggagatctgcaacctgagccccgacagcctgagcagcgaggaggtgcacaagtggaacctggtgctgttcaacggccactggaccagaggcagcaccgccggcggctgccagaactaccccggcagcagctag

SEQ ID NO: 18332 - DNA, 1314 bp, Artificial Sequence
  Description of Artificial Sequence: Synthetic coding sequence
atggccgcccaggccgccggcgtgagcagacagagagccgccacccagggcctgggcagcaaccagaacgccctgaagtacctgggccaggacttcaagaccctgagacagcagtgcctggacagcggcgtgctgttcaaggaccccgagttccccgcctgccccagcgccctgggctacaaggacctgggccccggcagcccccagacccagggcatcatctggaagagacccaccgagctgtgccccagcccccagttcatcgtgggcggcgccaccagaaccgacatctgccagggcggcctgggcgactgctggctgctggccgccatcgccagcctgaccctgaacgaggagctgctgtacagagtggtgcccagagaccaggacttccaggagaactacgccggcatcttccacttccagttctggcagtacggcgagtgggtggaggtggtgatcgacgacagactgcccaccaagaacggccagctgctgttcctgcacagcgagcagggcaacgagttctggagcgccctgctggagaaggcctacgccaagctgaacggctgctacgaggccctggccggcggcagcaccgtggagggcttcgaggacttcaccggcggcatcagcgagttctacgacctgaagaagccccccgccaacctgtaccagatcatcagaaaggccctgtgcgccggcagcctgctgggctgcagcatcgacgtgagcagcgccgccgaggccgaggccatcaccagccagaagctggtgaagagccacgcctacagcgtgaccggcgtggaggaggtgaacttccagggccaccccgagaagctgatcagactgagaaacccctggggcgaggtggagtggagcggcgcctggagcgacgacgcccccgagtggaaccacatcgaccccagaagaaaggaggagctggacaagaaggtggaggacggcgagttctggatgagcctgagcgacttcgtgagacagttcagcagactggagatctgcaacctgagccccgacagcctgagcagcgaggaggtgcacaagtggaacctggtgctgttcaacggccactggaccagaggcagcaccgccggcggctgccagaactaccccgccacctactggaccaacccccagttcaagatcagactggacgaggtggacgaggaccaggaggagagcatcggcgagccctgctgcaccgtgctgctgggcctgatgcagaagaacagaagatggagaaagagaatcggccagggcatgctgagcatcggctacgccgtgtaccagtag

SEQ ID NO: 18333 - DNA, 2151 bp, Artificial Sequence
  Description of Artificial Sequence: Synthetic coding sequence
atgagcggcagcaagaagaagaaggtgaccaaggccgagagactgaagctgctgcaggaggaggaggagagaagactgaaggaggaggaggaggccagactgaagtacgagaaggaggagatggagagactggagatccagagaatcgagaaggagaagtggcacagactggaggccaaggacctggagagaagaaacgaggagctggaggagctgtacctgctggagagatgcttccccgaggccgagaagctgaagcaggagaccaagctgctgagccagtggaagcactacatccagtgcgacggcagccccgaccccagcgtggcccaggagatgaacaccttcatcagcctgtggaaggagaagaccaacgagaccttcgaggaggtgatcgagaagagcaaggtggtgctgaacctgatcgagaagctgaagttcatcctgctggagacccccccctgcgacctgcaggacaagaacatcatccagtaccaggagagcatcctgcagctgcaggagctgctgcacctgaagttcggcgtggccaccgagatcctgctgaagcaggccagcaccctggccgacctggacagcggcaacatggagaaggtgatcaaggacgagaacgtgaccctgtacgtgtgggccaacctgaagaagaaccccagacacagaagcgtgagattcagcgagacccagatcggcttcgagatccccagaatcctggccaccagcgacatcgccgtgagactgctgcacacccactacgaccacgtgagcgccctgcaccccgtgagcacccccagcaaggagtacaccagcgccgtgaccgagctggtgaaggacgacgtgaagaacgtggagaaggccatcagcaaggaggtggaggaggagagcaagcagcaggagagaggcagccacctgatccaggaggaggagatcaaggtggaggaggagcagggcgacatcgaggtgaagatgagcagcgccgaggaggagagcgaggccatcaagtgcgagagagagatgaaggtgctgagcgagaccgtgagcgccgcccagctgctgctggtggagaacagcagcgagaagcccgacttcttcgaggacaacgtggtggacctgtgccagttcaccaccctgggcggcgtgtaccacctggacatcctggagctgcccccccagtgcaagcccgtgaagggctggatgatcgtggagatcctgaaggagggcctgcagaagtacacctacccccccgagaccaccgaggagttcgagaccgagaacgccttcccccccatcgaggtgaccctggaggtgcacgagaacgtgatcttcttcgaggaccccgtggtggtgagatgggacgccgagggcaagcactggagaaccgacggcatcagcaacgtgagctacaagcccaaggagagactggtgaccttcagcctggacaccttcggccccgtgaccctgatccaggacgcccacatcaacatgccctaccagagctgggagctgagacccctggacgtgaacaaggtgctgctgaccgtgaccaccgtgttcaccgagatccagatccagatcaaggagaacctgtgcatgctgagcagcatcaagctgaaggacaagaagcacatcagcatcctggagggcacctggatgacccccatccccttcatcatcgccctgaaggaggccggcctgaacatcttccccaccagacacagccacttctacgtgatcatcaacaacaaggtgcccctggtggaggtgaaggcctacagacagatggccctgctgagcagcgccttcgccttcggctggagcaagtggaacctgctgtgcaacagcaccaaggtggtgttcaaggtgagagagcacctgaccgaggcctgcaccgagaaccccaactgggccctgctgatgttcagcggcgacagagcccagagactgaagatcaaggaggagagcgaggccttcagcgaggccctgaaggaggagaccgagttccacagcaccctgtaccacatggtgaaggacttcgccagcgaggaggccatggagaaggtgagaagcagcaactgccagttcgtgaacagcgtgtgccacatgctgctgagcaccagactgctgagctacagctag

SEQ ID NO: 18334 - DNA, 2073 bp, Artificial Sequence
  Description of Artificial Sequence: Synthetic coding sequence
atgagacagaccggcggcggcgccaccaccgacagcgccagccccgtgctgaacaacgtgatcaagagccagagctacttcaccgccaagagagtgggcctgggcaacaacagctacctgggcgtgggcagacccagcagccagcagtggctgagcctgcccggccccggcggccagggccccaaggccaagaagagcggcagcaagaagaagaaggtgaccaaggccgagagactgaagctgctgcaggaggaggaggagagaagactgaaggaggaggaggaggccagactgaagtacgagaaggaggagatggagagactggagatccagagaatcgagaaggagaagtggcacagactggaggccaaggacctggagagaagaaacgaggagctggaggagctgtacctgctggagagatgcttccccgaggccgagaagctgaagcaggagaccaagctgctgagccagtggaagcactacatccagtgcgacggcagccccgaccccagcgtggcccaggagatgaacaccttcatcagcctgtggaaggagaagaccaacgagaccttcgaggaggtgatcgagaagagcaaggtggtgctgaacctgatcgagaagctgaagttcatcctgctggagacccccccctgcgacctgcaggacaagaacatcatccagtaccaggagagcatcctgcagctgcaggagctgctgcacctgaagttcggcgtggccaccgagatcctgctgaagcaggccagcaccctggccgacctggacagcggcaacatggagaaggtgatcaaggacgagaacgtgaccctgtacgtgtgggccaacctgaagaagaaccccagacacagaagcgtgagattcagcgagacccagatcggcttcgagatccccagaatcctggccaccagcgacatcgccgtgagactgctgcacacccactacgaccacgtgagcgccctgcaccccgtgagcacccccagcaaggagtacaccagcgccgtgaccgagctggtgaaggacgacgtgaagaacgtggagaaggccatcagcaaggaggtggaggaggagagcaagcagcaggagagaggcagccacctgatccaggaggaggagatcaaggtggaggaggagcagggcgacatcgaggtgaagatgagcagcgccgaggaggagagcgaggccatcaagtgcgagagagagatgaaggtgctgagcgagaccgtgagcgccgcccagctgctgctggtggagaacagcagcgagaagcccgacttcttcgaggacaacgtggtggacctgtgccagttcaccaccctgggcggcgtgtaccacctggacatcctggagctgcccccccagtgcaagcccgtgaagggctggatgatcgtggagatcctgaaggagggcctgcagaagtacacctacccccccgagaccaccgaggagttcgagaccgagaacgccttcccccccatcgaggtgaccctggaggtgcacgagaacgtgatcttcttcgaggaccccgtggtggtgagatgggacgccgagggcaagcactggagaaccgacggcatcagcaacgtgagctacaagcccaaggagagactggtgaccttcagcctggacaccttcggccccgtgaccctgatccaggacgcccacatcaacatgccctaccagagctgggagctgagacccctggacgtgaacaaggtgctgctgaccgtgaccaccgtgttcaccgagatccagatccagatcaaggagaacctgtgcatgctgagcagcatcaagctgaaggacaagaagcacatcagcatcctggagggcacctggatgacccccatccccttcatcatcgccctgaaggaggccggcctgaacatcttccccaccagacacagccacttctacgtgatcatcaacaacaaggtgcccctggtggaggtgaaggcctacagacagatggccctgctgagcagcgccttcgccttcggctggagcaagtggaacctgctgtgcaacagcaccaaggtggtgttcaagtggtag

SEQ ID NO: 18335 - DNA, 1311 bp, Artificial Sequence
  Description of Artificial Sequence: Synthetic coding sequence
atggagagactggagatccagagaatcgagaaggagaagtggcacagactggaggccaaggacctggagagaagaaacgaggagctggaggagctgtacctgctggagagatgcttccccgaggccgagaagctgaagcaggagaccaagctgctgagccagtggaagcactacatccagtgcgacggcagccccgaccccagcgtggcccaggagatgaacaccttcatcagcctgtggaaggagtacaccagcgccgtgaccgagctggtgaaggacgacgtgaagaacgtggagaaggccatcagcaaggaggtggaggaggagagcaagcagcaggagagaggcagccacctgatccaggaggaggagatcaaggtggaggaggagcagggcgacatcgaggtgaagatgagcagcgccgaggaggagagcgaggccatcaagtgcgagagagagatgaaggtgctgagcgagaccgtgagcgccgcccagctgctgctggtggagaacagcagcgagaagcccgacttcttcgaggacaacgtggtggacctgtgccagttcaccaccctgggcggcgtgtaccacctggacatcctggagctgcccccccagtgcaagcccgtgaagggctggatgatcgtggagatcctgaaggagggcctgcagaagtacacctacccccccgagaccaccgaggagttcgagaccgagaacgccttcccccccatcgaggtgaccctggaggtgcacgagaacgtgatcttcttcgaggaccccgtggtggtgagatgggacgccgagggcaagcactggagaaccgacggcatcagcaacgtgagctacaagcccaaggagagactggtgaccttcagcctggacaccttcggccccgtgaccctgatccaggacgcccacatcaacatgccctaccagagctgggagctgagacccctggacgtgaacaaggtgctgctgaccgtgaccaccgtgttcaccgagatccagatccagatcaaggagaacctgtgcatgctgagcagcatcaagctgaaggacaagaagcacatcagcatcctggagggcacctggatgacccccatccccttcatcatcgccctgaaggaggccggcctgaacatcttccccaccagacacagccacttctacgtgatcatcaacaacaaggtgcccctggtggaggtgaaggcctacagacagatggccctgctgagcagcgccttcgccttcggctggagcaagtggaacctgctgtgcaacagcaccaaggtggtgttcaagtggtag

SEQ ID NO: 18336 - DNA, 2169 bp, Artificial Sequence
  Description of Artificial Sequence: Synthetic coding sequence
atgggccccaaggccaagaagagcggcagcaagaagaagaaggtgaccaaggccgagagactgaagctgctgcaggaggaggaggagagaagactgaaggaggaggaggaggccagactgaagtacgagaaggaggagatggagagactggagatccagagaatcgagaaggagaagtggcacagactggaggccaaggacctggagagaagaaacgaggagctggaggagctgtacctgctggagagatgcttccccgaggccgagaagctgaagcaggagaccaagctgctgagccagtggaagcactacatccagtgcgacggcagccccgaccccagcgtggcccaggagatgaacaccttcatcagcctgtggaaggagaagaccaacgagaccttcgaggaggtgatcgagaagagcaaggtggtgctgaacctgatcgagaagctgaagttcatcctgctggagacccccccctgcgacctgcaggacaagaacatcatccagtaccaggagagcatcctgcagctgcaggagctgctgcacctgaagttcggcgtggccaccgagatcctgctgaagcaggccagcaccctggccgacctggacagcggcaacatggagaaggtgatcaaggacgagaacgtgaccctgtacgtgtgggccaacctgaagaagaaccccagacacagaagcgtgagattcagcgagacccagatcggcttcgagatccccagaatcctggccaccagcgacatcgccgtgagactgctgcacacccactacgaccacgtgagcgccctgcaccccgtgagcacccccagcaaggagtacaccagcgccgtgaccgagctggtgaaggacgacgtgaagaacgtggagaaggccatcagcaaggaggtggaggaggagagcaagcagcaggagagaggcagccacctgatccaggaggaggagatcaaggtggaggaggagcagggcgacatcgaggtgaagatgagcagcgccgaggaggagagcgaggccatcaagtgcgagagagagatgaaggtgctgagcgagaccgtgagcgccgcccagctgctgctggtggagaacagcagcgagaagcccgacttcttcgaggacaacgtggtggacctgtgccagttcaccaccctgggcggcgtgtaccacctggacatcctggagctgcccccccagtgcaagcccgtgaagggctggatgatcgtggagatcctgaaggagggcctgcagaagtacacctacccccccgagaccaccgaggagttcgagaccgagaacgccttcccccccatcgaggtgaccctggaggtgcacgagaacgtgatcttcttcgaggaccccgtggtggtgagatgggacgccgagggcaagcactggagaaccgacggcatcagcaacgtgagctacaagcccaaggagagactggtgaccttcagcctggacaccttcggccccgtgaccctgatccaggacgcccacatcaacatgccctaccagagctgggagctgagacccctggacgtgaacaaggtgctgctgaccgtgaccaccgtgttcaccgagatccagatccagatcaaggagaacctgtgcatgctgagcagcatcaagctgaaggacaagaagcacatcagcatcctggagggcacctggatgacccccatccccttcatcatcgccctgaaggaggccggcctgaacatcttccccaccagacacagccacttctacgtgatcatcaacaacaaggtgcccctggtggaggtgaaggcctacagacagatggccctgctgagcagcgccttcgccttcggctggagcaagtggaacctgctgtgcaacagcaccaaggtggtgttcaaggtgagagagcacctgaccgaggcctgcaccgagaaccccaactgggccctgctgatgttcagcggcgacagagcccagagactgaagatcaaggaggagagcgaggccttcagcgaggccctgaaggaggagaccgagttccacagcaccctgtaccacatggtgaaggacttcgccagcgaggaggccatggagaaggtgagaagcagcaactgccagttcgtgaacagcgtgtgccacatgctgctgagcaccagactgctgagctacagctag

SEQ ID NO: 18337 - DNA, 2031 bp, Artificial Sequence
  Description of Artificial Sequence: Synthetic coding sequence
atggagagactggagatccagagaatcgagaaggagaagtggcacagactggaggccaaggacctggagagaagaaacgaggagctggaggagctgtacctgctggagagatgcttccccgaggccgagaagctgaagcaggagaccaagctgctgagccagtggaagcactacatccagtgcgacggcagccccgaccccagcgtggcccaggagatgaacaccttcatcagcctgtggaaggagaagaccaacgagaccttcgaggaggtgatcgagaagagcaaggtggtgctgaacctgatcgagaagctgaagttcatcctgctggagacccccccctgcgacctgcaggacaagaacatcatccagtaccaggagagcatcctgcagctgcaggagctgctgcacctgaagttcggcgtggccaccgagatcctgctgaagcaggccagcaccctggccgacctggacagcggcaacatggagaaggtgatcaaggacgagaacgtgaccctgtacgtgtgggccaacctgaagaagaaccccagacacagaagcgtgagattcagcgagacccagatcggcttcgagatccccagaatcctggccaccagcgacatcgccgtgagactgctgcacacccactacgaccacgtgagcgccctgcaccccgtgagcacccccagcaaggagtacaccagcgccgtgaccgagctggtgaaggacgacgtgaagaacgtggagaaggccatcagcaaggaggtggaggaggagagcaagcagcaggagagaggcagccacctgatccaggaggaggagatcaaggtggaggaggagcagggcgacatcgaggtgaagatgagcagcgccgaggaggagagcgaggccatcaagtgcgagagagagatgaaggtgctgagcgagaccgtgagcgccgcccagctgctgctggtggagaacagcagcgagaagcccgacttcttcgaggacaacgtggtggacctgtgccagttcaccaccctgggcggcgtgtaccacctggacatcctggagctgcccccccagtgcaagcccgtgaagggctggatgatcgtggagatcctgaaggagggcctgcagaagtacacctacccccccgagaccaccgaggagttcgagaccgagaacgccttcccccccatcgaggtgaccctggaggtgcacgagaacgtgatcttcttcgaggaccccgtggtggtgagatgggacgccgagggcaagcactggagaaccgacggcatcagcaacgtgagctacaagcccaaggagagactggtgaccttcagcctggacaccttcggccccgtgaccctgatccaggacgcccacatcaacatgccctaccagagctgggagctgagacccctggacgtgaacaaggtgctgctgaccgtgaccaccgtgttcaccgagatccagatccagatcaaggagaacctgtgcatgctgagcagcatcaagctgaaggacaagaagcacatcagcatcctggagggcacctggatgacccccatccccttcatcatcgccctgaaggaggccggcctgaacatcttccccaccagacacagccacttctacgtgatcatcaacaacaaggtgcccctggtggaggtgaaggcctacagacagatggccctgctgagcagcgccttcgccttcggctggagcaagtggaacctgctgtgcaacagcaccaaggtggtgttcaaggtgagagagcacctgaccgaggcctgcaccgagaaccccaactgggccctgctgatgttcagcggcgacagagcccagagactgaagatcaaggaggagagcgaggccttcagcgaggccctgaaggaggagaccgagttccacagcaccctgtaccacatggtgaaggacttcgccagcgaggaggccatggagaaggtgagaagcagcaactgccagttcgtgaacagcgtgtgccacatgctgctgagcaccagactgctgagctacagctag

SEQ ID NO: 18338 - DNA, 1458 bp, Artificial Sequence
  Description of Artificial Sequence: Synthetic coding sequence
atgggccccaaggccaagaagagcggcagcaagaagaagaaggtgaccaaggccgagagactgaagctgctgcaggaggaggaggagagaagactgaaggaggaggaggaggccagactgaagtacgagaaggaggagatggagagactggagatccagagaatcgagaaggagaagtggcacagactggaggccaaggacctggagagaagaaacgaggagctggaggagctgtacctgctggagagatgcttccccgaggccgagaagctgaagcaggagaccaagctgctgagccagtggaagcactacatccagtgcgacggcagccccgaccccagcgtggcccaggagatgaacaccttcatcagcctgtggaaggagaagaccaacgagaccttcgaggaggtgatcgagaagagcaaggtggtgctgaacctgatcgagaagctgaagttcatcctgctggagacccccccctgcgacctgcaggacaagaacatcatccagtaccaggagagcatcctgcagctgcaggagctgctgcacctgaagttcggcgtggccaccgagatcctgctgaagcaggccagcaccctggccgacctggacagcggcaacatggagaaggtgatcaaggacgagaacgtgaccctgtacgtgtgggccaacctgaagaagaaccccagacacagaagcgtgagattcagcgagacccagatcggcttcgagatccccagaatcctggccaccagcgacatcgccgtgagactgctgcacacccactacgaccacgtgagcgccctgcaccccgtgagcacccccagcaaggagtacaccagcgccgtgaccgagctggtgaaggacgacgtgaagaacgtggagaaggccatcagcaaggaggtggaggaggagagcaagcagcaggagagaggcagccacctgatccaggaggaggagatcaaggtggaggaggagcagggcgacatcgaggtgaagatgagcagcgccgaggaggagagcgaggccatcaagtgcgagagagagatgaaggtgctgagcgagaccgtgagcgccgcccagctgctgctggtggagaacagcagcgagaagcccgacttcttcgaggacaacgtggtggacctgtgccagttcaccaccctgggcggcgtgtaccacctggacatcctggagctgcccccccagtgcaagcccgtgaagggctggatgatcgtggagatcctgaaggagggcctgcagaagtacacctacccccccgagaccaccgaggagttcgagaccgagaacgccttcccccccatcgaggtgaccctggaggtgcacgagaacgtgatcttcttcgaggaccccgtggtggtgagatggatgctgaaggtgaacatcggcgagctgatggccagcgccatgtaccccaccaaccagaagaaggacctgtag

SEQ ID NO: 18339 - DNA, 1545 bp, Artificial Sequence
  Description of Artificial Sequence: Synthetic coding sequence
atgaacaccttcatcagcctgtggaaggagaagaccaacgagaccttcgaggaggtgatcgagaagagcaaggtggtgctgaacctgatcgagaagctgaagttcatcctgctggagacccccccctgcgacctgcaggacaagaacatcatccagtaccaggagagcatcctgcagctgcaggagctgctgcacctgaagttcggcgtggccaccgagatcctgctgaagcaggccagcaccctggccgacctggacagcggcaacatggagaaggtgatcaaggacgagaacgtgaccctgtacgtgtgggccaacctgaagaagaaccccagacacagaagcgtgagattcagcgagacccagatcggcttcgagatccccagaatcctggccaccagcgacatcgccgtgagactgctgcacacccactacgaccacgtgagcgccctgcaccccgtgagcacccccagcaaggagtacaccagcgccgtgaccgagctggtgaaggacgacgtgaagaacgtggagaaggccatcagcaaggaggtggaggaggagagcaagcagcaggagagaggcagccacctgatccaggaggaggagatcaaggtggaggaggagcagggcgacatcgaggtgaagatgagcagcgccgaggaggagagcgaggccatcaagtgcgagagagagatgaaggtgctgagcgagaccgtgagcgccgcccagctgctgctggtggagaacagcagcgagaagcccgacttcttcgaggacaacgtggtggacctgtgccagttcaccaccctgggcggcgtgtaccacctggacatcctggagctgcccccccagtgcaagcccgtgaagggctggatgatcgtggagatcctgaaggagggcctgcagaagtacacctacccccccgagaccaccgaggagttcgagaccgagaacgccttcccccccatcgaggtgaccctggaggtgcacgagaacgtgatcttcttcgaggaccccgtggtggtgagatgggacgccgagggcaagcactggagaaccgacggcatcagcaacgtgagctacaagcccaaggagagactggtgaccttcagcctggacaccttcggccccgtgaccctgatccaggacgcccacatcaacatgccctaccagagctgggagctgagacccctggacgtgaacaaggtgctgctgaccgtgaccaccgtgttcaccgagatccagatccagatcaaggagaacctgtgcatgctgagcagcatcaagctgaaggacaagaagcacatcagcatcctggagggcacctggatgacccccatccccttcatcatcgccctgaaggaggccggcctgaacatcttccccaccagacacagccacttctacgtgatcatcaacaacaaggtgcccctggtggaggtgaaggcctacagacagatggccctgctgagcagcgccttcgccttcggctggagcaagtggaacctgctgtgcaacagcaccaaggtggtgttcaagtggtag

SEQ ID NO: 18340 - DNA, 279 bp, Artificial Sequence
  Description of Artificial Sequence: Synthetic coding sequence
atggagagactggagatccagagaatcgagaaggagaagtggcacagactggaggccaaggacctggagagaagaaacgaggagctggaggagctgtacctgctggagagatgcttccccgaggccgagaagctgaagcaggagaccaagctgctgagccagtggaagcactacatccagtgcgacggcagccccgaccccagcgtggcccaggagatgaacaccttcatcagcctgtggaaggagaagaccaacgagaccttcgaggaggtgatctag

SEQ ID NO: 18341 - DNA, 1974 bp, Artificial Sequence
  Description of Artificial Sequence: Synthetic coding sequence
atggacctggagagaagaaacgaggagctggaggagctgtacctgctggagagatgcttccccgaggccgagaagctgaagcaggagaccaagctgctgagccagtggaagcactacatccagtgcgacggcagccccgaccccagcgtggcccaggagatgaacaccttcatcagcctgtggaaggagaagaccaacgagaccttcgaggaggtgatcgagaagagcaaggtggtgctgaacctgatcgagaagctgaagttcatcctgctggagacccccccctgcgacctgcaggacaagaacatcatccagtaccaggagagcatcctgcagctgcaggagctgctgcacctgaagttcggcgtggccaccgagatcctgctgaagcaggccagcaccctggccgacctggacagcggcaacatggagaaggtgatcaaggacgagaacgtgaccctgtacgtgtgggccaacctgaagaagaaccccagacacagaagcgtgagattcagcgagacccagatcggcttcgagatccccagaatcctggccaccagcgacatcgccgtgagactgctgcacacccactacgaccacgtgagcgccctgcaccccgtgagcacccccagcaaggagtacaccagcgccgtgaccgagctggtgaaggacgacgtgaagaacgtggagaaggccatcagcaaggaggtggaggaggagagcaagcagcaggagagaggcagccacctgatccaggaggaggagatcaaggtggaggaggagcagggcgacatcgaggtgaagatgagcagcgccgaggaggagagcgaggccatcaagtgcgagagagagatgaaggtgctgagcgagaccgtgagcgccgcccagctgctgctggtggagaacagcagcgagaagcccgacttcttcgaggacaacgtggtggacctgtgccagttcaccaccctgggcggcgtgtaccacctggacatcctggagctgcccccccagtgcaagcccgtgaagggctggatgatcgtggagatcctgaaggagggcctgcagaagtacacctacccccccgagaccaccgaggagttcgagaccgagaacgccttcccccccatcgaggtgaccctggaggtgcacgagaacgtgatcttcttcgaggaccccgtggtggtgagatgggacgccgagggcaagcactggagaaccgacggcatcagcaacgtgagctacaagcccaaggagagactggtgaccttcagcctggacaccttcggccccgtgaccctgatccaggacgcccacatcaacatgccctaccagagctgggagctgagacccctggacgtgaacaaggtgctgctgaccgtgaccaccgtgttcaccgagatccagatccagatcaaggagaacctgtgcatgctgagcagcatcaagctgaaggacaagaagcacatcagcatcctggagggcacctggatgacccccatccccttcatcatcgccctgaaggaggccggcctgaacatcttccccaccagacacagccacttctacgtgatcatcaacaacaaggtgcccctggtggaggtgaaggcctacagacagatggccctgctgagcagcgccttcgccttcggctggagcaagtggaacctgctgtgcaacagcaccaaggtggtgttcaaggtgagagagcacctgaccgaggcctgcaccgagaaccccaactgggccctgctgatgttcagcggcgacagagcccagagactgaagatcaaggaggagagcgaggccttcagcgaggccctgaaggaggagaccgagttccacagcaccctgtaccacatggtgaaggacttcgccagcgaggaggccatggagaaggtgagaagcagcaactgccagttcgtgaacagcgtgtgccacatgctgctgagcaccagactgctgagctacagctag

SEQ ID NO: 18342 - DNA, 411 bp, Artificial Sequence
  Description of Artificial Sequence: Synthetic coding sequence
atgatgcacaccaccagctacagaagactgagccccccccacctgaccgaccagcccagcgcctacagccacacccacagaaccttcagccacttcagctgcggcagccagcccgccgcccagagactgcacgtggagctgtggaacgccgacctgcagagcgagttcctgtgcccctgcctgggcctgaccctgtacctgacctgcaacccccagctgggcaagagaaagttctgcagccacagcagcgaggacatgagcaagatggtgagcagaagaaacgtgaaggacagccacgaggtgagcggcagcctgcaggccaccctgcaggtgatcagcttcagcttccccttcctgctgcacacctgcagccaccccctgagccaccccaccagcggccagagaagatag

SEQ ID NO: 18343 - DNA, 570 bp, Artificial Sequence
  Description of Artificial Sequence: Synthetic coding sequence
atgaccgacaagaccgagaaggtggccgtggaccccgagaccgtgttcaagagacccagagagtgcgacagccccagctaccagaagagacagagaatggccctgctggccagaaagcagggcgccggcgacagcctgatcgccggcagcgccatgagcaaggagaagaagctgatgaccggccacgccatcccccccagccagctggacagccagatcgacgacttcaccggcttcagcaaggacagaatgatgcagaagcccggcagcaacgcccccgtgggcggcaacgtgaccagcagcttcagcggcgacgacctggagtgcagagagaccgccagcagccccaagagccagagagagatcaacgccgacatcaagagaaagctggtgaaggagctgagatgcgtgggccagaagtacgagaagatcttcgagatgctggagggcgtgcagggccccaccgccgtgagaaagagattcttcgagagcatcatcaaggaggccgccagatgcatgagaagagacttcgtgaagcacctgaagaagaagctgaagagaatgatctag

SEQ ID NO: 18344 - DNA, 867 bp, Artificial Sequence
  Description of Artificial Sequence: Synthetic coding sequence
atgagcgccaccggcgacagacaccccacccagggcgaccaggaggcccccgtgagccaggagggcgcccaggccgaggccgccggcgccggcaaccaggagggcggcgacagcggccccgacagcagcgacgtggtgcccgccgccgaggtggtgggcgtggccggccccgtggagggcctgggcgaggaggagggcgagcaggccgccggcctggccgccgtgcccagaggcggcagcgccgaggaggacagcgacatcggccccgccaccgaggaggaggaggaggaggagggcaacgaggccgccaacttcgacctggccgtggtggccagaagataccccgccagcggcatccacttcgtgctgctggacatggtgcacagcctgctgcacagactgagccacaacgaccacatcctgatcgagaacagacagctgagcagactgatggtgggcccccacgccgccgccagaaacctgtggggcaacctgccccccctgctgctgccccagagactgggcgccggcgccgccgccagagccggcgagggcctgggcctgatccaggaggccgccagcgtgcccgagcccgccgtgcccgccgacctggccgagatggccagagagcccgccgaggaggccgccgaggagaagctgagcgaggaggccaccgaggagcccgacgccgaggagcccgccaccgaggagcccaccgcccaggaggccaccgcccccgaggaggtgaccaagagccagcccgagaagtgggacgaggaggcccaggacgccgccggcgaggaggagaaggagcaggagaaggagaaggacgccgagaacaaggtgaagaacagcaagggcacctag

SEQ ID NO: 18345 - DNA, 867 bp, Artificial Sequence; identical to SEQ ID NO: 18344
  Description of Artificial Sequence: Synthetic coding sequence

SEQ ID NO: 18346 - DNA, 495 bp, Artificial Sequence
  Description of Artificial Sequence: Synthetic coding sequence
atgggcgacctgcccggcctggtgagactgagcatcgccctgagaatccagcccaacgacggccccgtgttctacaaggtggacggccagagattcggccagaacagaaccatcaagctgctgaccggcagcagctacaaggtggaggtgaagatcaagcccagcaccctgcaggtggagaacatcagcatcggcggcgtgctggtgcccctggagctgaagagcaaggagcccgacggcgacagagtggtgtacaccggcacctacgacaccgagggcgtgacccccaccaagagcggcgagagacagcccatccagatcaccatgcccttcaccgacatcggcaccttcgagaccgtgtggcaggtgaagttctacaactaccacaagagagaccactgccagtggggcagccccttcagcgtgatcgagtacgagtgcaagcccaacgagaccagaagcctgatgtgggtgaacaaggagagcttcctgtag

SEQ ID NO: 18347 - DNA, 387 bp, Artificial Sequence
  Description of Artificial Sequence: Synthetic coding sequence
atgggcgacctgcccggcctggtgagactgagcatcgccctgagaatccagcccaacgacggccccgtgttctacaaggtggacggccagagattcggccagaacagaaccatcaagctgctgaccggcagcagctacaaggtggaggtgaagatcaagcccagcaccctgcaggtggagaacatcagcatcggcggcgtgctggtgcccctggagctgaagagcaaggagcccgacggcgacagagtggtgtacaccggcacctacgacaccgagggcgtgacccccaccaagagcggcgagagacagcccatccagatcaccatgcccgagtgcctggagcagagaccccaggagatcagcctgacctacgagtgcgaggagtag

SEQ ID NO: 18348 - DNA, 279 bp, Artificial Sequence
  Description of Artificial Sequence: Synthetic coding sequence
atgaacgactacaagctggaggaggaccccgtgaccaaggagagaaccttcaagagattcgcccccagaaagggcgacaagatctaccaggagttcaagaagctgtacttctacagcgacgcctacagacccctgaagttcgcctgcgagaccatcatcgaggagtacgaggacgagatcagcagcctgatcgcccaggagacccactacctggccgacaagctgtgcagcgagaagagcgacctgtgcgagaccagcgccaaccacaccgagctgtag

SEQ ID NO: 18349 - DNA, 3141 bp, Artificial Sequence
  Description of Artificial Sequence: Synthetic coding sequence
atgcagaagcccagcggcctgaagccccccggcagaggcggcaagcacagcagccccatgggcagaaccagcaccggcagcgccagcagcagcgccgccgtggccgccagcagcaaggagggcagccccctgcacaagcagagcagcggccccagcagcagccccgccgccgccgccgcccccgagaagcccggccccaaggccgccgaggtgggcgacgacttcctgggcgacttcgtggtgggcgagagagtgtgggtgaacggcgtgaagcccggcgtggtgcagtacctgggcgagacccagttcgcccccggccagtgggccggcgtggtgctggacgaccccgtgggcaagaacgacggcgccgtgggcggcgtgagatacttcgagtgccccgccctgcagggcatcttcaccagacccagcaagctgaccagacagcccaccgccgagggcagcggcagcgacgcccacagcgtggagagcctgaccgcccagaacctgagcctgcacagcggcaccgccaccccccccctgaccagcagagtgatccccctgagagagagcgtgctgaacagcagcgtgaagaccggcaacgagagcggcagcaacctgagcgacagcggcagcgtgaagagaggcgagaaggacctgagactgggcgacagagtgctggtgggcggcaccaagaccggcgtggtgagatacgtgggcgagaccgacttcgccaagggcgagtggtgcggcgtggagctggacgagcccctgggcaagaacgacggcgccgtggccggcaccagatacttccagtgcccccccaagttcggcctgttcgcccccatccacaaggtgatcagaatcggcttccccagcaccagccccgccaaggccaagaagaccaagagaatggccatgggcgtgagcgccctgacccacagccccagcagcagcagcatcagcagcgtgagcagcgtggccagcagcgtgggcggcagacccagcagaagcggcctgctgaccgagaccagcagcagatacgccagaaagatcagcggcaccaccgccctgcaggaggccctgaaggagaagcagcagcacatcgagcagctgctggccgagagagacctggagagagccgaggtggccaaggccaccagccacatctgcgaggtggagaaggagatcgccctgctgaaggcccagcacgagcagtacgtggccgaggccgaggagaagctgcagagagccagactgctggtggagagcgtgagaaaggagaaggtggacctgagcaaccagctggaggaggagagaagaaaggtggaggacctgcagttcagagtggaggaggagagcatcaccaagggcgacctggagacccagacccagctggagcacgccagaatcggcgagctggagcagagcctgctgctggagaaggcccaggccgagagactgctgagagagctggccgacaacagactgaccaccgtggccgagaagagcagagtgctgcagctggaggaggagctgaccctgagaagaggcgagatcgaggagctgcagcagtgcctgctgcacagcggcccccccccccccgaccaccccgacgccgccgagatcctgagactgagagagagactgctgagcgccagcaaggagcaccagagagagagcggcgtgctgagagacaagtacgagaaggccctgaaggcctaccaggccgaggtggacaagctgagagccgccaacgagaagtacgcccaggaggtggccggcctgaaggacaaggtgcagcaggccaccagcgagaacatgggcctgatggacaactggaagagcaagctggacagcctggccagcgaccaccagaagagcctggaggacctgaaggccaccctgaacagcggccccggcgcccagcagaaggagatcggcgagctgaaggccgtgatggagggcatcaagatggagcaccagctggagctgggcaacctgcaggccaagcacgacctggagaccgccatgcacgtgaaggagaaggaggccctgagagagaagctgcaggaggcccaggaggagctggccggcctgcagagacactggagagcccagctggaggtgcaggccagccagcacagactggagctgcaggaggcccaggaccagagaagagacgccgagctgagagtgcacgagctggagaagctggacgtggagtacagaggccaggcccaggccatcgagttcctgaaggagcagatcagcctggccgagaagaagatgctggactacgagagactgcagagagccgaggcccagggcaagcaggaggtggagagcctgagagagaagctgctggtggccgagaacagactgcaggccgtggaggccctgtgcagcagccagcacacccacatgatcgagagcaacgacatcagcgaggagaccatcagaaccaaggagaccgtggagggcctgcaggacaagctgaacaagagagacaaggaggtgaccgccctgaccagccagaccgagatgctgagagcccaggtgagcgccctggagagcaagtgcaagagcggcgagaagaaggtggacgccctgctgaaggagaagagaagactggaggccgagctggagaccgtgagcagaaagacccacgacgccagcggccagctggtgctgatcagccaggagctgctgagaaaggagagaagcctgaacgagctgagagtgctgctgctggaggccaacagacacagccccggccccgagagagacctgagcagagaggtgcacaaggccgagtggagaatcaaggagcagaagctgaaggacgacatcagaggcctgagagagaagctgaccggcctggacaaggagaagagcctgagcgaccagagaagatacagcctgatcgacagaagcagcgcccccgagctgctgagactgcagcaccagctgatgagcaccgaggacgccctgagagacgccctggaccaggcccagcaggtggagaagctgatggaggccatgagaagctgccccgacaaggcccagaccatcggcaacagcggcagcgccaacggcatccaccagcaggacaaggcccagaagcaggaggacaagcactag

SEQ ID NO: 18350 - DNA, 2118 bp, Artificial Sequence
  Description of Artificial Sequence: Synthetic coding sequence
atgaccatcgaggacctgcccgacttccccctggagggcaaccccctgttcggcagataccccttcatcttcagcgccagcgacacccccgtgatcttcagcatcagcgccgcccccatgcccagcgactgcgagttcagcttcttcgaccccaacgacgccagctgccaggagatcctgttcgaccccaagaccagcgtgagcgagctgttcgccatcctgagacagtgggtgccccaggtgcagcagaacatcgacatcatcggcaacgagatcctgaagagaggctgcaacgtgaacgacagagacggcctgaccgacatgaccctgctgcactacacctgcaagagcggcgcccacggcatcggcgacgtggagaccgccgtgaagttcgccacccagctgatcgacctgggcgccgacatcagcctgagaagcagatggaccaacatgaacgccctgcactacgccgcctacttcgacgtgcccgagctgatcagagtgatcctgaagaccagcaagcccaaggacgtggacgccacctgcagcgacttcaacttcggcaccgccctgcacatcgccgcctacaacctgtgcgccggcgccgtgaagtgcctgctggagcagggcgccaaccccgccttcagaaacgacaagggccagatccccgccgacgtggtgcccgaccccgtggacatgcccctggagatggccgacgccgccgccaccgccaaggagatcaagcagatgctgctggacgccgtgcccctgagctgcaacatcagcaaggccatgctgcccaactacgaccacgtgaccggcaaggccatgctgaccagcctgggcctgaagctgggcgacagagtggtgatcgccggccagaaggtgggcaccctgagattctgcggcaccaccgagttcgccagcggccagtgggccggcatcgagctggacgagcccgagggcaagaacaacggcagcgtgggcaaggtgcagtacttcaagtgcgcccccaagtacggcatcttcgcccccctgagcaagatcagcaaggccaagggcagaagaaagaacatcacccacacccccagcaccaaggccgccgtgcccctgatcagaagccagaagatcgacgtggcccacgtgaccagcaaggtgaacaccggcctgatgaccagcaagaaggacagcgccagcgagagcaccctgagcctgccccccggcgaggagctgaagaccgtgaccgagaaggacgtggccctgctgggcagcgtgagcagctgcagcagcaccagcagcctggagcacagacagagctaccccaagaagcagaacgccatcagcagcaacaagaagaccatgagcaagagccccagcctgagcagcagagccagcgccggcctgaacagcagcgccaccagcaccgccaacaacagcagatgcgagggcgagctgagactgggcgagagagtgctggtggtgggccagagactgggcaccatcagattcttcggcaccaccaacttcgcccccggctactggtacggcatcgagctggagaagccccacggcaagaacgacggcagcgtgggcggcgtgcagtacttcagctgcagccccagatacggcatcttcgccccccccagcagagtgcagagagtgaccgacagcctggacaccctgagcgagatcagcagcaacaagcagaaccacagctaccccggcttcagaagaagcttcagcaccaccagcgccagcagccagaaggagatcaacagaagaaacgccttcagcaagagcaaggccgccctgagaagaagctggagcagcacccccaccgccggcggcatcgagggcagcgtgaagctgcacgagggcagccaggtgctgctgaccagcagcaacgagatgggcaccgtgagatacgtgggccccaccgacttcgccagcggcatctggctgggcctggagctgagaagcgccaagggcaagaacgacggcagcgtgggcgacaagagatacttcacctgcaagcccaaccacggcgtgctggtgagacccagcagagtgacctacagaggcatcaacggcagcaagctggtggacgagaactgctag

SEQ ID NO: 18351 - DNA, 2172 bp, Artificial Sequence
  Description of Artificial Sequence: Synthetic coding sequence
aagatgaccatcgaggacctgcccgacttccccctggagggcaaccccctgttcggcagataccccttcatcttcagcgccagcgacacccccgtgatcttcagcatcagcgccgcccccatgcccagcgactgcgagttcagcttcttcgaccccaacgacgccagctgccaggagatcctgttcgaccccaagaccagcgtgagcgagctgttcgccatcctgagacagtgggtgccccaggtgcagcagaacatcgacatcatcggcaacgagatcctgaagagaggctgcaacgtgaacgacagagacggcctgaccgacatgaccctgctgcactacacctgcaagagcggcgcccacggcatcggcgacgtggagaccgccgtgaagttcgccacccagctgatcgacctgggcgccgacatcagcctgagaagcagatggaccaacatgaacgccctgcactacgccgcctacttcgacgtgcccgagctgatcagagtgatcctgaagaccagcaagcccaaggacgtggacgccacctgcagcgacttcaacttcggcaccgccctgcacatcgccgcctacaacctgtgcgccggcgccgtgaagtgcctgctggagcagggcgccaaccccgccttcagaaacgacaagggccagatccccgccgacgtggtgcccgaccccgtggacatgcccctggagatggccgacgccgccgccaccgccaaggagatcaagcagatgctgctggacgccgtgcccctgagctgcaacatcagcaaggccatgctgcccaactacgaccacgtgaccggcaaggccatgctgaccagcctgggcctgaagctgggcgacagagtggtgatcgccggccagaaggtgggcaccctgagattctgcggcaccaccgagttcgccagcggccagtgggccggcatcgagctggacgagcccgagggcaagaacaacggcagcgtgggcaaggtgcagtacttcaagtgcgcccccaagtacggcatcttcgcccccctgagcaagatcagcaaggccaagggcagaagaaagaacatcacccacacccccagcaccaaggccgccgtgcccctgatcagaagccagaagatcgacgtggcccacgtgaccagcaaggtgaacaccggcctgatgaccagcaagaaggacagcgccagcgagagcaccctgagcctgccccccggcgaggagctgaagaccgtgaccgagaaggacgtggccctgctgggcagcgtgagcagctgcagcagcaccagcagcctggagcacagacagagctaccccaagaagcagaacgccatcagcagcaacaagaagaccatgagcaagagccccagcctgagcagcagagccagcgccggcatctacggcttcttcaaccaggccttcctggtgttcttcatcctggtgtgcctgttcgagttcctgagcaacatctacagcaacagcagatgcgagggcgagctgagactgggcgagagagtgctggtggtgggccagagactgggcaccatcagattcttcggcaccaccaacttcgcccccggctactggtacggcatcgagctggagaagccccacggcaagaacgacggcagcgtgggcggcgtgcagtacttcagctgcagccccagatacggcatcttcgccccccccagcagagtgcagagagtgaccgacagcctggacaccctgagcgagatcagcagcaacaagcagaaccacagctaccccggcttcagaagaagcttcagcaccaccagcgccagcagccagaaggagatcaacagaagaaacgccttcagcaagagcaaggccgccctgagaagaagctggagcagcacccccaccgccggcggcatcgagggcagcgtgaagctgcacgagggcagccaggtgctgctgaccagcagcaacgagatgggcaccgtgagatacgtgggccccaccgacttcgccagcggcatctggctgggcctggagctgagaagcgccaagggcaagaacgacggcagcgtgggcgacaagagatacttcacctgcaagcccaaccacggcgtgctggtgagacccagcagagtgacctacagaggcatcaacggcagcaagctggtggacgagaactgctag

SEQ ID NO: 18352 - DNA, 2124 bp, Artificial Sequence
  Description of Artificial Sequence: Synthetic coding sequence
atgaccatcgaggacctgcccgacttccccctggagggcaaccccctgttcggcagataccccttcatcttcagcgccagcgacacccccgtgatcttcagcatcagcgccgcccccatgcccagcgactgcgagttcagcttcttcgaccccaacgacgccagctgccaggagatcctgttcgaccccaagaccagcgtgagcgagctgttcgccatcctgagacagtgggtgccccaggtgcagcagaacatcgacatcatcggcaacgagatcctgaagagaggctgcaacgtgaacgacagagacggcctgaccgacatgaccctgctgcactacacctgcaagagcggcgcccacggcatcggcgacgtggagaccgccgtgaagttcgccacccagctgatcgacctgggcgccgacatcagcctgagaagcagatggaccaacatgaacgccctgcactacgccgcctacttcgacgtgcccgagctgatcagagtgatcctgaagaccagcaagcccaaggacgtggacgccacctgcagcgacttcaacttcggcaccgccctgcacatcgccgcctacaacctgtgcgccggcgccgtgaagtgcctgctggagcagggcgccaaccccgccttcagaaacgacaagggccagatccccgccgacgtggtgcccgaccccgtggacatgcccctggagatggccgacgccgccgccaccgccaaggagatcaagcagatgctgctggacgccgtgcccctgagctgcaacatcagcaaggccatgctgcccaactacgaccacgtgaccggcaaggccatgctgaccagcctgggcctgaagctgggcgacagagtggtgatcgccggccagaaggtgggcaccctgagattctgcggcaccaccgagttcgccagcggccagtgggccggcatcgagctggacgagcccgagggcaagaacaacggcagcgtgggcaaggtgcagtacttcaagtgcgcccccaagtacggcatcttcgcccccctgagcaagatcagcaaggccaagggcagaagaaagaacatcacccacacccccagcaccaaggccgccgtgcccctgatcagaagccagaagatcgacgtggcccacgtgaccagcaaggtgaacaccggcctgatgaccagcaagaaggacagcgccagcgagagcaccctgagcctgccccccggcgaggagctgaagaccgtgaccgagaaggacgtggccctgctgggcagcgtgagcagctgcagcagcaccagcagcctggagcacagacagagctaccccaagaagcagaacgccatcagcagcaacaagaagaccatgagcaagagccccagcctgagcagcagagccagcgccggcctgaacagcagcgccaccagcaccgccaacaacagcagatgcgagggcgagctgagactgggcgagagagtgctggtggtgggccagagactgggcaccatcagattcttcggcaccaccaacttcgcccccgtgctgggctactggtacggcatcgagctggagaagccccacggcaagaacgacggcagcgtgggcggcgtgcagtacttcagctgcagccccagatacggcatcttcgccccccccagcagagtgcagagagtgaccgacagcctggacaccctgagcgagatcagcagcaacaagcagaaccacagctaccccggcttcagaagaagcttcagcaccaccagcgccagcagccagaaggagatcaacagaagaaacgccttcagcaagagcaaggccgccctgagaagaagctggagcagcacccccaccgccggcggcatcgagggcagcgtgaagctgcacgagggcagccaggtgctgctgaccagcagcaacgagatgggcaccgtgagatacgtgggccccaccgacttcgccagcggcatctggctgggcctggagctgagaagcgccaagggcaagaacgacggcagcgtgggcgacaagagatacttcacctgcaagcccaaccacggcgtgctggtgagacccagcagagtgacctacagaggcatcaacggcagcaagctggtggacgagaactgctag

SEQ ID NO: 18353 - DNA, 2118 bp, Artificial Sequence; identical to SEQ ID NO: 18350
  Description of Artificial Sequence: Synthetic coding sequence

SEQ ID NO: 18354 - DNA, 645 bp, Artificial Sequence
  Description of Artificial Sequence: Synthetic coding sequence
atgaccatcgaggacctgcccgacttccccctggagggcaaccccctgttcggcagataccccttcatcttcagcgccagcgacacccccgtgatcttcagcatcagcgccgcccccatgcccagcgactgcgagttcagcttcttcgaccccaacgacgccagctgccaggagatcctgttcgaccccaagaccagcgtgagcgagctgttcgccatcctgagacagtgggtgccccaggtgcagcagaacatcgacatcatcggcaacgagatcctgaagagaggctgcaacgtgaacgacagagacggcctgaccgacatgaccctgctgcactacacctgcaagagcggcgcccacggcatcggcgacgtggagaccgccgtgaagttcgccacccagctgatcgacctgggcgccgacatcagcctgagaagcagatggaccaacatgaacgccctgcactacgccgcctacttcgacgtgcccgagctgatcagagtgatcctgaagaccagcaagcccaaggacgtggacgccacctgcagcgacttcaacttcggcaccgccctgcacatcgccgcctacaacctgtgcgccggcgccgtgaagtgcctgctggagcagggcgccaaccccgcctag

SEQ ID NO: 18355 - DNA, 1998 bp, Artificial Sequence
  Description of Artificial Sequence: Synthetic coding sequence
atgcagagaagaaagcagaagcagaagaacctgaacgagagccactacctgtgcatgctgctgcagagcgagctgagcgagttcagcttcttcgaccccaacgacgccagctgccaggagatcctgttcgaccccaagaccagcgtgagcgagctgttcgccatcctgagacagtgggtgccccaggtgcagcagaacatcgacatcatcggcaacgagatcctgaagagaggctgcaacgtgaacgacagagacggcctgaccgacatgaccctgctgcactacacctgcaagagcggcgcccacggcatcggcgacgtggagaccgccgtgaagttcgccacccagctgatcgacctgggcgccgacatcagcctgagaagcagatggaccaacatgaacgccctgcactacgccgcctacttcgacgtgcccgagctgatcagagtgatcctgaagaccagcaagcccaaggacgtggacgccacctgcagcgacttcaacttcggcaccgccctgcacatcgccgcctacaacctgtgcgccggcgccgtgaagtgcctgctggagcagggcgccaaccccgccttcagaaacgacaagggccagatccccgccgacgtggtgcccgaccccgtggacatgcccctggagatggccgacgccgccgccaccgccaaggagatcaagcagatgctgctggacgccgtgcccctgagctgcaacatcagcaaggccatgctgcccaactacgaccacgtgaccggcaaggccatgctgaccagcctgggcctgaagctgggcgacagagtggtgatcgccggccagaaggtgggcaccctgagattctgcggcaccaccgagttcgccagcggccagtgggccggcatcgagctggacgagcccgagggcaagaacaacggcagcgtgggcaaggtgcagtacttcaagtgcgcccccaagtacggcatcttcgcccccctgagcaagatcagcaaggccaagggcagaagaaagaacatcacccacacccccagcaccaaggccgccgtgcccctgatcagaagccagaagatcgacgtggcccacgtgaccagcaaggtgaacaccggcctgatgaccagcaagaaggacagcgccagcgagagcaccctgagcctgccccccggcgaggagctgaagaccgtgaccgagaaggacgtggccctgctgggcagcgtgagcagcaacaagaagaccatgagcaagagccccagcctgagcagcagagccagcgccggcctgaacagcagcgccaccagcaccgccaacaacagcagatgcgagggcgagctgagactgggcgagagagtgctggtggtgggccagagactgggcaccatcagattcttcggcaccaccaacttcgcccccggctactggtacggcatcgagctggagaagccccacggcaagaacgacggcagcgtgggcggcgtgcagtacttcagctgcagccccagatacggcatcttcgccccccccagcagagtgcagagagtgaccgacagcctggacaccctgagcgagatcagcagcaacaagcagaaccacagctaccccggcttcagaagaagcttcagcaccaccagcgccagcagccagaaggagatcaacagaagaaacgccttcagcaagagcaaggccgccctgagaagaagctggagcagcacccccaccgccggcggcatcgagggcagcgtgaagctgcacgagggcagccaggtgctgctgaccagcagcaacgagatgggcaccgtgagatacgtgggccccaccgacttcgccagcggcatctggctgggcctggagctgagaagcgccaagggcaagaacgacggcagcgtgggcgacaagagatacttcacctgcaagcccaaccacggcgtgctggtgagacccagcagagtgacctacagaggcatcaacggcagcaagctggtggacgagaactgctag

SEQ ID NO: 18356 - DNA, 1173 bp, Artificial Sequence
  Description of Artificial Sequence: Synthetic coding sequence
atggtgaccagagccggcgccggcaccgccgtggccggcgccgtggtggtggccctgctgagcgccgccctggccctgtacggcccccccctggacgccgtgctggagagagccttcagcctgagaaaggcccacagcatcaaggacatggagaacaccctgcagctggtgagaaacatcatcccccccctgagcagcaccaagcacaagggccaggacggcagaatcggcgtggtgggcggctgccaggagtacaccggcgccccctacttcgccgccatcagcgccctgaaggtgggcgccgacctgagccacgtgttctgcgccagcgccgccgcccccgtgatcaaggcctacagccccgagctgatcgtgcaccccgtgctggacagccccaacgccgtgcacgaggtggagaagtggctgcccagactgcacgccctggtggtgggccccggcctgggcagagacgacgccctgctgagaaacgtgcagggcatcctggaggtgagcaaggccagagacatccccgtggtgatcgacgccgacggcctgtggctggtggcccagcagcccgccctgatccacggctacagaaaggccgtgctgacccccaaccacgtggagttcagcagactgtacgacgccgtgctgagaggccccatggacagcgacgacagccacggcagcgtgctgagactgagccaggccctgggcaacgtgaccgtggtgcagaagggcgagagagacatcctgagcaacggccagcaggtgctggtgtgcagccaggagggcagcagcagaagatgcggcggccagggcgacctgctgagcggcagcctgggcgtgctggtgcactgggccctgctggccggcccccagaagaccaacggcggcatcagcgacctgaagctgaccatctggggccccgagatcgagaccggcgtgaagaccagagcccagggcagctgcggccccagaaccaccacccccaccagcccccacctgctgctgagccccagcccccaggtgcagcccagccccggcggcagagtgtggagactgctgagccaccaggccgtgcagccccccagcctgcccgaggccagaagcctgcaccaccacctgagacacgacagaagaggcggcggcagactgcagcaggccctgtag

SEQ ID NO: 18357 - DNA, 366 bp, Artificial Sequence
  Description of Artificial Sequence: Synthetic coding sequence
atggccctgggccccagatgcggcgccatcagagcctgcagaagagtgctggagagagccttcagcctgagaaaggcccacagcatcaaggacatggagaacaccctgcagctggtgagaaacatcatcccccccctgagcagcaccaagcacaagggccaggacggcagaatcggcgtggtgggcggctgccaggacgacagccccaacgccgtgcacgaggtggagaagtggctgcccagactgcacgccctggtggtgggccccggcctgggcagagacgacgccctgctgagaaacgtgcagggcatcctggaggtgagcaaggccagagacatccccgtggtgatcgacgccgtgagctag

SEQ ID NO: 18358 - DNA, 714 bp, Artificial Sequence
  Description of Artificial Sequence: Synthetic coding sequence
atgctgcccgacggccccggcagcagcctgtggggcaaccccggcctgcagaccagcgacagccccaacgccgtgcacgaggtggagaagtggctgcccagactgcacgccctggtggtgggccccggcctgggcagagacgacgccctgctgagaaacgtgcagggcatcctggaggtgagcaaggccagagacatccccgtggtgatcgacgccgacggcctgtggctggtggcccagcagcccgccctgatccacggctacagaaaggccgtgctgacccccaaccacgtggagttcagcagactgtacgacgccgtgctgagaggccccatggacagcgacgacagccacggcagcgtgctgagactgagccaggccctgggcaacgtgaccgtggtgcagaagggcgagagagacatcctgagcaacggccagcaggtgctggtgtgcagccaggagggcagcagcagaagatgcggcggccagggcgacctgctgagcggcagcctgggcgtgctggtgcactgggccctgctggccggcccccagaagaccaacggcagcagccccctgctggtggccgccttcggcgcctgcagcctgaccagacagtgcaaccaccaggccttccagaagcacggcagaagcaccaccaccagcgacatgatcgccgaggtgggcgccgccttcagcaagctgttcgagacctag

SEQ ID NO: 18359 - DNA, 972 bp, Artificial Sequence
  Description of Artificial Sequence: Synthetic coding sequence
atggccctgggccccagatgcggcgccatcagagcctgcagaagagtgctggagagagccttcagcctgagaaaggcccacagcatcaaggacatggagaacaccctgcagctggtgagaaacatcatcccccccctgagcagcaccaagcacaagggccaggacggcagaatcggcgtggtgggcggctgccaggagtacaccggcgccccctacttcgccgccatcagcgccctgaaggtgggcgccgacctgagccacgtgttctgcgccagcgccgccgcccccgtgatcaaggcctacagccccgagctgatcgtgcaccccgtgctggacagccccaacgccgtgcacgaggtggagaagtggctgcccagactgcacgccctggtggtgggccccggcctgggcagagacgacgccctgctgagaaacgtgcagggcatcctggaggtgagcaaggccagagacatccccgtggtgatcgacgccgacggcctgtggctggtggcccagcagcccgccctgatccacggctacagaaaggccgtgctgacccccaaccacgtggagttcagcagactgtacgacgccgtgctgagaggccccatggacagcgacgacagccacggcagcgtgctgagactgagccaggccctgggcaacgtgaccgtggtgcagaagggcgagagagacatcctgagcaacggccagcaggtgctggtgtgcagccaggagggcagcagcagaagatgcggcggccagggcgacctgctgagcggcagcctgggcgtgctggtgcactgggccctgctggccggcccccagaagaccaacggcagcagccccctgctggtggccgccttcggcgcctgcagcctgaccagacagtgcaaccaccaggccttccagaagcacggcgcctgccagatcttcaacctgagcatcaactggctgcccctgagaatctag

SEQ ID NO: 18360 - DNA, 651 bp, Artificial Sequence
  Description of Artificial Sequence: Synthetic coding sequence
atggccgtgttccccgccaccgccagaggccagctgggcatcagaaacgccgccagatggccctgggtgctggccgtgggccagagcggcctggccgacgagggcatcctggaggtgagcaaggccagagacatccccgtggtgatcgacgccgacggcctgtggctggtggcccagcagcccgccctgatccacggctacagaaaggccgtgctgacccccaaccacgtggagttcagcagactgtacgacgccgtgctgagaggccccatggacagcgacgacagccacggcagcgtgctgagactgagccaggccctgggcaacgtgaccgtggtgcagaagggcgagagagacatcctgagcaacggccagcaggtgctggtgtgcagccaggagggcagcagcagaagatgcggcggccagggcgacctgctgagcggcagcctgggcgtgctggtgcactgggccctgctggccggcccccagaagaccaacggcagcagccccctgctggtggccgccttcggcgcctgcagcctgaccagacagtgcaaccaccaggccttccagaagcacggcagaagcaccaccaccagcgacatgatcgccgaggtgggcgccgccttcagcaagctgttcgagacctag

SEQ ID NO: 18361 - DNA, 789 bp, Artificial Sequence
  Description of Artificial Sequence: Synthetic coding sequence
atgagcagactgagctggggctacagagagcacaacggccccatccactggaaggagttcttccccatcgccgacggcgaccagcagagccccatcgagatcaagaccaaggaggtgaagtacgacagcagcctgagacccctgagcatcaagtacgaccccagcagcgccaagatcatcagcaacagcggccacagcttcaacgtggacttcgacgacaccgagaacaagagcgtgctgagaggcggccccctgaccggcagctacagactgagacaggtgcacctgcactggggcagcgccgacgaccacggcagcgagcacatcgtggacggcgtgagctacgccgccgagctgcacgtggtgcactggaacagcgacaagtaccccagcttcgtggaggccgcccacgagcccgacggcctggccgtgctgggcgtgttcctgcagatcggcgagcccaacagccagctgcagaagatcaccgacaccctggacagcatcaaggagaagggcaagcagaccagattcaccaacttcgacctgctgagcctgctgccccccagctgggactactggacctaccccggcagcctgaccgtgccccccctgctggagagcgtgacctggatcgtgctgaagcagcccatcaacatcagcagccagcagctggccaagttcagaagcctgctgtgcaccgccgagggcgaggccgccgccttcctggtgagcaaccacagacccccccagcccctgaagggcagaaaggtgagagccagcttccactag

SEQ ID NO: 18362 - DNA, 1311 bp, Artificial Sequence
  Description of Artificial Sequence: Synthetic coding sequence
atgcagggcacccccggcggcggcaccagacccggccccagccccgtggacagaagaaccctgctggtgttcagcttcatcctggccgccgccctgggccagatgaacttcaccggcgaccaggtgctgagagtgctggccaaggacgagaagcagctgagcctgctgggcgacctggagggcctgaagccccagaaggtggacttctggagaggccccgccagacccagcctgcccgtggacatgagagtgcccttcagcgagctgaaggacatcaaggcctacctggagagccacggcctggcctacagcatcatgatcaaggacatccaggtgctgctggacgaggagagacaggccatggccaagagcagaagactggagagaagcaccaacagcttcagctacagcagctaccacaccctggaggagatctacagctggatcgacaacttcgtgatggagcacagcgacatcgtgagcaagatccagatcggcaacagcttcgagaaccagagcatcctggtgctgaagttcagcaccggcggcagcagacaccccgccatctggatcgacaccggcatccacagcagagagtggatcacccacgccaccggcatctggaccgccaacaagatcgtgagcgactacggcaaggacagagtgctgaccgacatcctgaacgccatggacatcttcatcgagctggtgaccaaccccgacggcttcgccttcacccacagcatgaacagactgtggagaaagaacaagagcatcagacccggcatcttctgcatcggcgtggacctgaacagaaactggaagagcggcttcggcggcaacggcagcaacagcaacccctgcagcgagacctaccacggccccagcccccagagcgagcccgaggtggccgccatcgtgaacttcatcaccgcccacggcaacttcaaggccctgatcagcatccacagctacagccagatgctgatgtacccctacggcagactgctggagcccgtgagcaaccagagagagctgtacgacctggccaaggacgccgtggaggccctgtacaaggtgcacggcatcgagtacatcttcggcagcatcagcaccaccctgtacgtggccagcggcatcaccgtggactgggcctacgacagcggcatcaagtacgccttcagcttcgagctgagagacaccggccagtacggcttcctgctgcccgccacccagatcatccccaccgcccaggagacctggatggccctgagaaccatcatggagcacaccctgaaccacccctactag

SEQ ID NO: 18363 - DNA, 1311 bp, Artificial Sequence; identical to SEQ ID NO: 18362
  Description of Artificial Sequence: Synthetic coding sequence

SEQ ID NO: 18364 - DNA, 2196 bp, Artificial Sequence
  Description of Artificial Sequence: Synthetic coding sequence
atgagcagacccggcaccgccacccccgccctggccctggtgctgctggccgtgaccctggccggcgtgggcgcccagggcgccgccctggaggaccccgactactacggccaggagatctggagcagagagccctactacgccagacccgagcccgagctggagaccttcagcccccccctgcccgccggccccggcgaggagtgggagagaagaccccaggagcccagaccccccaagagagccaccaagcccaagaaggcccccaagagagagaagagcgcccccgagccccccccccccggcaagcacagcaacaagaaggtgatgagaaccaagagcagcgagaaggccgccaacgacgaccacagcgtgagagtggccagagaggacgtgagagagagctgcccccccctgggcctggagaccctgaagatcaccgacttccagctgcacgccagcaccgtgaagagatacggcctgggcgcccacagaggcagactgaacatccaggccggcatcaacgagaacgacttctacgacggcgcctggtgcgccggcagaaacgacctgcagcagtggatcgaggtggacgccagaagactgaccagattcaccggcgtgatcacccagggcagaaacagcctgtggctgagcgactgggtgaccagctacaaggtgatggtgagcaacgacagccacacctgggtgaccgtgaagaacggcagcggcgacatgatcttcgagggcaacagcgagaaggagatccccgtgctgaacgagctgcccgtgcccatggtggccagatacatcagaatcaacccccagagctggttcgacaacggcagcatctgcatgagaatggagatcctgggctgccccctgcccgaccccaacaactactaccacagaagaaacgagatgaccaccaccgacgacctggacttcaagcaccacaactacaaggagatgagacagctgatgaaggtggtgaacgagatgtgccccaacatcaccagaatctacaacatcggcaagagccaccagggcctgaagctgtacgccgtggagatcagcgaccaccccggcgagcacgaggtgggcgagcccgagttccactacatcgccggcgcccacggcaacgaggtgctgggcagagagctgctgctgctgctggtgcagttcgtgtgccaggagtacctggccagaaacgccagaatcgtgcacctggtggaggagaccagaatccacgtgctgcccagcctgaaccccgacggctacgagaaggcctacgagggcggcagcgagctgggcggctggagcctgggcagatggacccacgacggcatcgacatcaacaacaacttccccgacctgaacaccctgctgagcgagaacgccaccgtggccgccgagaccagagccgtgatcgcctggatggagaagatccccttcgtgctgggcggcaacctgcagggcggcgagctggtggtggcctacccctacgacctggtgagaagcccctggaagacccaggagcacacccccacccccgacgaccacgtgttcagatggctggcctacagctacgccagcacccacagactgatgaccgacgccagaagaagagtgtgccacaccgaggacttccagaaggaggagggcaccgtgaacggcgccagctggcacaccgtggccggcagcctgaacgacttcagctacctgcacaccaactgcttcgagctgagcatctacgtgggctgcgacaagtacccccacgagagccagctgcccgaggagtgggagaacaacagagagagcctgatcgtgttcatggagcaggtgcacagaggcatcaagggcctggtgagagacagccacggcaagggcatccccaacgccatcatcagcgtggagggcatcaaccacgacatcagaaccgccaacgacggcgactactggagactgctgaaccccggcgagtacgtggtgaccgccaaggccgagggcttcaccgccagcaccaagaactgcatggtgggctacgacatgggcgccaccagatgcgacttcaccctgagcaagaccaacatggccagaatcagagagatcatggagaagttcggcaagcagcccgtgagcctgcccgccagaagactgaagctgagaggccagaagagaagacagagaggctag

SEQ ID NO: 18365 - DNA, 1770 bp, Artificial Sequence
  Description of Artificial Sequence: Synthetic coding sequence
ctggagatccaggccggcatcaacgagaacgacttctacgacggcgcctggtgcgccggcagaaacgacctgcagcagtggatcgaggtggacgccagaagactgaccagattcaccggcgtgatcacccagggcagaaacagcctgtggctgagcgactgggtgaccagctacaaggtgatggtgagcaacgacagccacacctgggtgaccgtgaagaacggcagcggcgacatgatcttcgagggcaacagcgagaaggagatccccgtgctgaacgagctgcccgtgcccatggtggccagatacatcagaatcaacccccagagctggttcgacaacggcagcatctgcatgagaatggagatcctgggctgccccctgcccgaccccaacaactactaccacagaagaaacgagatgaccaccaccgacgacctggacttcaagcaccacaactacaaggagatgagacagctgatgaaggtggtgaacgagatgtgccccaacatcaccagaatctacaacatcggcaagagccaccagggcctgaagctgtacgccgtggagatcagcgaccaccccggcgagcacgaggtgggcgagcccgagttccactacatcgccggcgcccacggcaacgaggtgctgggcagagagctgctgctgctgctggtgcagttcgtgtgccaggagtacctggccagaaacgccagaatcgtgcacctggtggaggagaccagaatccacgtgctgcccagcctgaaccccgacggctacgagaaggcctacgagggcggcagcgagctgggcggctggagcctgggcagatggacccacgacggcatcgacatcaacaacaacttccccgacctgaacaccctgctgtgggaggccgaggacagacagaacgtgcccagaaaggtgcccaaccactacatcgccatccccgagtggttcctgagcgagaacgccaccgtggccgccgagaccagagccgtgatcgcctggatggagaagatccccttcgtgctgggcggcaacctgcagggcggcgagctggtggtggcctacccctacgacctggtgagaagcccctggaagacccaggagcacacccccacccccgacgaccacgtgttcagatggctggcctacagctacgccagcacccacagactgatgaccgacgccagaagaagagtgtgccacaccgaggacttccagaaggaggagggcaccgtgaacggcgccagctggcacaccgtggccggcagcctgaacgacttcagctacctgcacaccaactgcttcgagctgagcatctacgtgggctgcgacaagtacccccacgagagccagctgcccgaggagtgggagaacaacagagagagcctgatcgtgttcatggagcaggtgcacagaggcatcaagggcctggtgagagacagccacggcaagggcatccccaacgccatcatcagcgtggagggcatcaaccacgacatcagaaccgccaacgacggcgactactggagactgctgaaccccggcgagtacgtggtgaccgccaaggccgagggcttcaccgccagcaccaagaactgcatggtgggctacgacatgggcgccaccagatgcgacttcaccctgagcaagaccaacatggccagaatcagagagatcatggagaagttcggcaagcagcccgtgagcctgcccgccagaagactgaagctgagaggccagaagagaagacagagaggctag

SEQ ID NO: 18366 - DNA, 1464 bp, Artificial Sequence
  Description of Artificial Sequence: Synthetic coding sequence
atgagcgacctgctgagcatctacagcgcccccgtggtggtgagcaccgtgctgcacatcaccatcgtgttccccatcctgcagatcagaaagctgagactgggcagagtgcacaagctgcccagagtgctggaggtgggcaacagcggcaccatgagcagagcctacaccttcttcttcctgagatggaacagcatggccctgaccggctacagctggctgctgctgagcgccaccttcctgaacgtgggcgccgagatcagcatcaccctggagcccgcccagcccagcgagggcgacaacgtgaccctggtggtgcacggcctgagcggcgagctgctggcctacagctggtacgccggccccaccctgagcgtgagctacctggtggccagctacatcgtgagcaccggcgacgagacccccggccccgcccacaccggcagagaggccgtgagacccgacggcagcctggacatccagggcatcctgcccagacacagcggcacctacatcctgcagaccttcaacagacagctgcagaccgaggtgggctacggccacgtgcaggtgcacgagatcctggcccagcccaccgtgctggccaacagcaccgccctggtggagagaagagacaccctgagactgatgtgcagcagccccagccccaccgccgaggtgagatggttcttcaacggcggcgccctgcccgtggccctgagactgggcctgagccccgacggcagagtgctggccagacacggcatcagaagagaggaggccggcgcctaccagtgcgaggtgtggaaccccgtgagcgtgagcagaagcgagcccatcaacctgaccgtgtacttcggccccgagagagtggccatcctgcaggacagcaccaccagaaccggctgcaccatcaaggtggacttcaacaccagcctgaccctgtggtgcgtgagcagaagctgccccgagcccgagtacgtgtggaccttcaacggccaggccctgaagaacggccaggaccacctgaacatcagcagcatgaccgccgcccaggagggcacctacacctgcatcgccaagaacaccaagaccctgctgagcggcagcgccagcgtggtggtgaagctgagcgccgccgccgtggccaccatgatcgtgcccgtgcccaccaagcccaccgagggccaggacgtgaccctgaccgtgcagggctaccccaaggacctgctggtgtacgcctggtacagaggccccgccagcgagcccaacagactgctgagccagctgcccagcggcacctggatcgccggccccgcccacaccggcagagaggtgggcttccccaactgcagcctgctggtgcagaagctgaacctgaccgacaccggcagatacaccctgaagaccgtgaccgtgcagggcaagaccgagaccctggaggtggagctgcaggtggcctag

SEQ ID NO: 18367 - DNA, 1278 bp, Artificial Sequence
  Description of Artificial Sequence: Synthetic coding sequence
atggccctgaccggctacagctggctgctgctgagcgccaccttcctgaacgtgggcgccgagatcagcatcaccctggagcccgcccagcccagcgagggcgacaacgtgaccctggtggtgcacggcctgagcggcgagctgctggcctacagctggtacgccggccccaccctgagcgtgagctacctggtggccagctacatcgtgagcaccggcgacgagacccccggccccgcccacaccggcagagaggccgtgagacccgacggcagcctggacatccagggcatcctgcccagacacagcggcacctacatcctgcagaccttcaacagacagctgcagaccgaggtgggctacggccacgtgcaggtgcacgagatcctggcccagcccaccgtgctggccaacagcaccgccctggtggagagaagagacaccctgagactgatgtgcagcagccccagccccaccgccgaggtgagatggttcttcaacggcggcgccctgcccgtggccctgagactgggcctgagccccgacggcagagtgctggccagacacggcatcagaagagaggaggccggcgcctaccagtgcgaggtgtggaaccccgtgagcgtgagcagaagcgagcccatcaacctgaccgtgtacttcggccccgagagagtggccatcctgcaggacagcaccaccagaaccggctgcaccatcaaggtggacttcaacaccagcctgaccctgtggtgcgtgagcagaagctgccccgagcccgagtacgtgtggaccttcaacggccaggccctgaagaacggccaggaccacctgaacatcagcagcatgaccgccgcccaggagggcacctacacctgcatcgccaagaacaccaagaccctgctgagcggcagcgccagcgtggtggtgaagctgagcgccgccgccgtggccaccatgatcgtgcccgtgcccaccaagcccaccgagggccaggacgtgaccctgaccgtgcagggctaccccaaggacctgctggtgtacgcctggtacagaggccccgccagcgagcccaacagactgctgagccagctgcccagcggcacctggatcgccggccccgcccacaccggcagagaggtgggcttccccaactgcagcctgctggtgcagaagctgaacctgaccgacaccggcagatacaccctgaagaccgtgaccgtgcagggcaagaccgagaccctggaggtggagctgcaggtggcccccctgggctag

SEQ ID NO: 18368 - DNA, 1092 bp, Artificial Sequence
  Description of Artificial Sequence: Synthetic coding sequence
atggacctgagcagacccagatggagcctgtggagaagagtgttcctgatggccagcctgctggcctgcggcatctgccaggccagcggccagatcttcatcacccagaccctgggcatcaagggctacagaaccgtggtggccctggacaaggtgcccgaggacgtgcaggagtacagctggtactggggcgccaacgacagcgccggcaacatgatcatcagccacaagccccccagcgcccagcagcccggccccatgtacaccggcagagagagagtgaacagagagggcagcctgctgatcagacccaccgccctgaacgacaccggcaactacaccgtgagagtggtggccggcaacgagacccagagagccaccggctggctggaggtgctggagctgggcagcaacctgggcatcagcgtgaacgccagcagcctggtggagaacatggacagcgtggccgccgactgcctgaccaacgtgaccaacatcacctggtacgtgaacgacgtgcccaccagcagcagcgacagaatgaccatcagccccgacggcaagaccctggtgatcctgagagtgagcagatacgacagaaccatccagtgcatgatcgagagcttccccgagatcttccagagaagcgagagaatcagcctgaccgtggcctacggccccgactacgtgctgctgagaagcaaccccgacgacttcaacggcatcgtgaccgccgagatcggcagccaggtggagatggagtgcatctgctacagcttcctggacctgaagtaccactggatccacaacggcagcctgctgaacttcagcgacgccaagatgaacctgagcagcctggcctgggagcagatgggcagatacagatgcaccgtggagaaccccgtgacccagctgatcatgtacatggacgtgagaatccaggccccccacgagtgccccctgcccagcggcatcctgcccgtggtgcacagagacttcagcatcagcggcagcatggtgatgttcctgatcatgctgaccgtgctgggcggcgtgtacatctgcggcgtgctgatccacgccctgatctag

SEQ ID NO: 18369 - DNA, 1197 bp, Artificial Sequence
  Description of Artificial Sequence: Synthetic coding sequence
atggaggtgagcggctgccccacccccgccggccagagcgccccctggggcggcaaggccgccctgaaggccggcagaagagacagacagcccctgtgccaggagacccaggtgctggagggcgccgaggaggtggccgtgagcctggagggccccctgctgctggaggaccccagacagctgatggacctgagcagacccagatggagcctgtggagaagagtgttcctgatggccagcctgctggcctgcggcatctgccaggccagcggccagatcttcatcacccagaccctgggcatcaagggctacagaaccgtggtggccctggacaaggtgcccgaggacgtgcaggagtacagctggtactggggcgccaacgacagcgccggcaacatgatcatcagccacaagccccccagcgcccagcagcccggccccatgtacaccggcagagagagagtgaacagagagggcagcctgctgatcagacccaccgccctgaacgacaccggcaactacaccgtgagagtggtggccggcaacgagacccagagagccaccggctggctggaggtgctggagctgggcagcaacctgggcatcagcgtgaacgccagcagcctggtggagaacatggacagcgtggccgccgactgcctgaccaacgtgaccaacatcacctggtacgtgaacgacgtgcccaccagcagcagcgacagaatgaccatcagccccgacggcaagaccctggtgatcctgagagtgagcagatacgacagaaccatccagtgcatgatcgagagcttccccgagatcttccagagaagcgagagaatcagcctgaccgtggcctacggccccgactacgtgctgctgagaagcaaccccgacgacttcaacggcatcgtgaccgccgagatcggcagccaggtggagatggagtgcatctgctacagcttcctggacctgaagtaccactggatccacaacggcagcctgctgaacttcagcgacgccaagatgaacctgagcagcctggcctgggagcagatgggcagatacagatgcaccgtggagaaccccgtgacccagctgatcatgtacatggacgtgagaatccaggccccccacgagtgcagcagcagcccccccggcagctgcttcgcccacctgcccgccagcatgccctgctag

SEQ ID NO: 18370 - DNA, 705 bp, Artificial Sequence
  Description of Artificial Sequence: Synthetic coding sequence
atggagaagtgcaagggcaccagcagaatggccggcaccaccagcgccgacgtgaagatgagcagcagcgaggaggtgagctggatcagctggttctgcggcctgagaggcaacgagttcttctgcgaggtggacgaggactacatccaggacaagttcaacctgaccggcctgaacgagcaggtgccccactacagacaggccctggacatgatcctggacctggagcccgacgaggagctggaggacaaccccaaccagagcgacctgatcgagcaggccgccgagatgctgtacggcctgatccacgccagatacatcctgaccaacagaggcatcgcccagatgctggagaagtaccagcagggcgacttcggctactgccccagagtgtactgcgagaaccagcccatgctgcccatcggcctgagcgacatccccggcgaggccatggtgaagctgtactgccccaagtgcatggacgtgtacacccccaagagcagcagacaccaccacaccgacggcgcctacttcggcaccggcttcccccacatgctgttcatggtgcaccccgagtacagacccaagagacccgccaaccagttcgtgcccagactgtacggcttcaagatccaccccatggcctaccagctgcagctgcaggccgccagcaacttcaagagccccgtgaagaccatcagatag

SEQ ID NO: 18371 - DNA, 294 bp, Artificial Sequence
  Description of Artificial Sequence: Synthetic coding sequence
atggccgacaaggtgctgaaggagaagagaaagctgttcatccacagcatgggcgagggcaccatcaacggcctgctggacgagctgctgcagaccagagtgctgaaccaggaggagatggagaaggtgaagagagagaacgccaccgtgatggacaagaccagagccctgatcgacagcgtgatccccaagggcgcccaggcctgccagatctgcatcacctacatctgcgaggaggacagctacctggccgagaccctgggcctgagcgccggccccatccccggcaactag

SEQ ID NO: 18372 - DNA, 594 bp, Artificial Sequence
  Description of Artificial Sequence: Synthetic coding sequence
atggccgacaaggtgctgaaggagaagagaaagctgttcatccacagcatgggcgagggcaccatcaacggcctgctggacgagctgctgcagaccagagtgctgaaccaggaggagatggagaaggtgaagagagagaacgccaccgtgatggacaagaccagagccctgatcgacagcgtgatccccaagggcgcccaggcctgccagatctgcatcacctacatctgcgaggaggacagctacctggccgagaccctgggcctgagcgccgccctgcaggccgtgcaggacaaccccgccatgcccacctgcagcagccccgagggcagaatcaagctgtgcttcctggaggacgcccagagaatctggaagcagaagctgcagagatgccacgtgcagaacaccatcatcaagtggagcgagagatacaccagcggcagcttcgagatgcagtggctgttcctgagaaccaacttcatcgagagattctggagaaacatcctgctgctgcccctgcacaagggcagcctgtaccccagaatccccggcctgggcaaggagctgcagaccggcacccacaagctgagctag

SEQ ID NO: 18373 - DNA, 294 bp, Artificial Sequence; identical to SEQ ID NO: 18371
  Description of Artificial Sequence: Synthetic coding sequence

SEQ ID NO: 18374 - DNA, 273 bp, Artificial Sequence
  Description of Artificial Sequence: Synthetic coding sequence
atggccgaccagctgctgagaaagaagagaagaatcttcatccacagcgtgggcgccggcaccatcaacgccctgctggactgcctgctggaggacgaggtgatcagccaggaggacatgaacaaggtgagagacgagaacgacaccgtgatggacaaggccagagtgctgatcgacctggtgaccggcaagggccccaagagctgctgcaagttcatcaagcacctgtgcgaggaggacccccagctggccagcaagatgggcctgcactag

SEQ ID NO: 18375 - DNA, 672 bp, Artificial Sequence
  Description of Artificial Sequence: Synthetic coding sequence
atggccctgagcgtgcccctgctgtacagcctggtgagagccatcagcgaggccggcgccccccccggcagcgccggccccctgctgctgcagccccagagacacagagccgccggctgcttcctgggcacctgcctggacctgctggacagcttcaccctggtggagctgatgctggagggcagagtgcccctgcccgcccacctgagatacctgctgatcgccgtgtacttcctgaccctggccagccccgtgctgtggctgtacgagctgaacgccgccgccgccgccgccgccagctggggccaggccagcggccccggcagctgcagcagactgctgagactgctgggcggctgcctggtggacgtgcccctgctggccctgagatgcctgctggtggtgagctaccagcagcccctgagcatcttcatgctgaagaacctgttcttcctgggctgcagaggcctggaggccctggagggctgctgggacagaggcaacagagccagccccagcagagccagaggcggctacggcgccccccccagcgcccccccccccccccccccccccccccagggcggcagccagctgggccactgcatcagcgagaacgagggcggcgcccacggctacgtgaacaccctggccgtggccagccagaactag

SEQ ID NO: 18376 - DNA, 1737 bp, Artificial Sequence
  Description of Artificial Sequence: Synthetic coding sequence
atgagacccgccctgggccaccccagaagcgtgagcagcgccagcggcagcttcccccccccccccgccgccgccagactgcagcccctgttcctgagaggcggcagcttcagaggcagaagaggcagcggcgacagcagcaccagcaccagcaccagcagaggcggcggcggcggcagaagaggcggcggcggcggcagccccagcagcagcaccggcgccgagagagaggacgacgacgagagcctgagcgtgagcaagcccctggtgcccaacgccgccctgctgggcccccccgcccaggtgggcgcccccgccggccccgcccccgtggccttcagcagcagcgccgccaccagcagcagcaccagcacccccaccagcagctgcagcatgaccgccgccgacttcggcggcggcgccgccgccggcgccgtgggcggccccggcagcagaagcgccggcggcgccggcggcaccggcaccggcagcggcgccagctgctgcccctgctgctgctgctgcggctgccccgacagacccggcagaagaggcagaagaagaggctgcgcccccagccccagatgcagatggggctaccaggccctgagcgtggtgctgctgctggcccagggcggcctgctggacctgtacctgatcgccgtgaccgacctgtactggtgcagctggatcgccaccgacctggtggtggtggtgggctgggccatcttcttcgccaagaacagcagaggcagaagaggcggcgccgccagcggcgcccacaaccaccacctgcaccaccaccacgccgccccccccctgcacctgcccgcccccagcgccgccaccgccggcgccaaggccagaggcgccagaggcggcgccggcggcgccggcggcggcctgggcgccgccgccgccgccggcgagttcgccttcgcctacctggcctggctgatctacagcatcgccttcacccccaaggtggtgctgatcctgggcaccagcatcctggacctgatcgagctgagagcccccttcggcaccaccggcttcagactgaccatggccctgagcgtgcccctgctgtacagcctggtgagagccatcagcgaggccggcgccccccccggcagcgccggccccctgctgctgcagccccagagacacagagccgccggctgcttcctgggcacctgcctggacctgctggacagcttcaccctggtggagctgatgctggagggcagagtgcccctgcccgcccacctgagatacctgctgatcgccgtgtacttcctgaccctggccagccccgtgctgtggctgtacgagctgaacgccgccgccgccgccgccgccagctggggccaggccagcggccccggcagctgcagcagactgctgagactgctgggcggctgcctggtggacgtgcccctgctggccctgagatgcctgctggtggtgagctaccagcagcccctgagcatcttcatgctgaagaacctgttcttcctgggctgcagaggcctggaggccctggagggctgctgggacagaggcaacagagccagccccagcagagccagaggcggctacggcgccccccccagcgcccccccccccccccccccccccccccagggcggcagccagctgggccactgcatcagcgagaacgagggcggcgcccacggctacgtgaacaccctggccgtggccagccagaactag

SEQ ID NO: 18377 - DNA, 2262 bp, Artificial Sequence
  Description of Artificial Sequence: Synthetic coding sequence
atggccgacaagagaaagctgcagggcgagatcgacagatgcctgaagaaggtgagcgagggcgtggagcagttcgaggacatctggcagaagctgcacaacgccgccaacgccaaccagaaggagaagtacgaggccgacctgaagaaggagatcaagaagctgcagagactgagagaccagatcaagacctgggtggccagcaacgagatcaaggacaagagacagctgatcgacaacagaaagctgatcgagacccagatggagagattcaaggtggtggagagagagaccaagaccaaggcctacagcaaggagggcctgggcctggcccagaaggtggaccccgcccagaaggagaaggaggaggtgggccagtggctgaccaacaccatcgacaccctgaacatgcaggtggaccagttcgagagcgaggtggagagcctgagcgtgcagaccagaaagaagaagggcgacaaggacaagcaggacagaatcgagggcctgaagagacacatcgagaagcacagataccacgtgagaatgctggagaccatcctgagaatgctggacaacgacagcatcctggtggacgccatcagaaagatcaaggacgacgtggagtactacgtggacagcagccaggaccccgacttcgaggagaacgagttcctgtacgacgacctggacctggaggacatcccccaggccctggtggccaccagcccccccagccacagccacatggaggacgagatcttcaaccagagcagcagcacccccaccagcaccaccagcagcagccccatcccccccagccccgccaactgcaccaccgagaacagcgaggacgacaagaagagaggcagaagcaccgacagcgaggtgagccagagccccgccaagaacggcagcaagcccgtgcacagcaaccagcacccccagagccccgccgtgccccccacctaccccagcggccccccccccgccgccagcgccctgagcaccacccccggcaacaacggcgtgcccgcccccgccgccccccccagcgccctgggccccaaggccagccccgcccccagccacaacagcggcacccccgccccctacgcccaggccgtggccccccccgcccccagcggccccagcaccacccagcccagaccccccagcgtgcagcccagcggcggcggcggcggcggcagcggcggcggcggcagcagcagcagcagcaacagcagcgccggcggcggcgccggcaagcagaacggcgccaccagctacagcagcgtggtggccgacagccccgccgaggtggccctgagcagcagcggcggcaacaacgccagcagccaggccctgggcccccccagcggcccccacaaccccccccccagcaccagcaaggagcccagcgccgccgcccccaccggcgccggcggcgtggcccccggcagcggcaacaacagcggcggccccagcctgctggtgcccctgcccgtgaacccccccagcagccccacccccagcttcagcgacgccaaggccgccggcgccctgctgaacggccccccccagttcagcaccgcccccgagatcaaggcccccgagcccctgagcagcctgaagagcatggccgagagagccgccatcagcagcggcatcgaggaccccgtgcccaccctgcacctgaccgagagagacatcatcctgagcagcaccagcgccccccccgccagcgcccagccccccctgcagctgagcgaggtgaacatccccctgagcctgggcgtgtgccccctgggccccgtgcccctgaccaaggagcagctgtaccagcaggccatggaggaggccgcctggcaccacatgccccaccccagcgacagcgagagaatcagacagtacctgcccagaaacccctgccccacccccccctaccaccaccagatgccccccccccacagcgacaccgtggagttctaccagagactgagcaccgagaccctgttcttcatcttctactacctggagggcaccaaggcccagtacctggccgccaaggccctgaagaagcagagctggagattccacaccaagtacatgatgtggttccagagacacgaggagcccaagaccatcaccgacgagttcgagcagggcacctacatctacttcgactacgagaagtggggccagagaaagaaggagggcttcaccttcgagtacagatacctggaggacagagacctgcagtag

SEQ ID NO: 18378 - DNA, 2262 bp, Artificial Sequence; identical to SEQ ID NO: 18377
  Description of Artificial Sequence: Synthetic coding sequence

SEQ ID NO: 18379 - DNA, 2262 bp, Artificial Sequence; identical to SEQ ID NO: 18377
  Description of Artificial Sequence: Synthetic coding sequence

SEQ ID NO: 18380 - DNA, 2262 bp, Artificial Sequence; identical to SEQ ID NO: 18377
  Description of Artificial Sequence: Synthetic coding sequence

SEQ ID NO: 18381 - DNA, 2262 bp, Artificial Sequence; identical to SEQ ID NO: 18377
  Description of Artificial Sequence: Synthetic coding sequence

SEQ ID NO: 18382 - DNA, 2262 bp, Artificial Sequence; identical to SEQ ID NO: 18377
  Description of Artificial Sequence: Synthetic coding sequence

SEQ ID NO: 18383 - DNA, 2262 bp, Artificial Sequence; identical to SEQ ID NO: 18377
  Description of Artificial Sequence: Synthetic coding sequence

SEQ ID NO: 18384 - DNA, 810 bp, Artificial Sequence
  Description of Artificial Sequence: Synthetic coding sequence
atggagagactggtgatcagaatgcccttcagccacctgagcacctacagcctggtgtgggtgatggccgccgtggtgctgtgcaccgcccaggtgcaggtggtgacccaggacgagagagagcagctgtacacccccgccagcctgaagtgcagcctgcagaacgcccaggaggccctgatcgtgacctggcagaagaagaaggccgtgagccccgagaacatggtgaccttcagcgagaaccacggcgtggtgatccagcccgcctacaaggacaagatcaacatcacccagctgggcctgcagaacagcaccatcaccttctggaacatcaccctggaggacgagggctgctacatgtgcctgttcaacaccttcggcttcggcaagatcagcggcaccgcctgcctgaccgtgtacgtgcagcccatcgtgagcctgcactacaagttcagcgaggaccacctgaacatcacctgcagcgccaccgccagacccgcccccatggtgttctggaaggtgcccagaagcggcatcgagaacagcaccgtgaccctgagccaccccaacggcaccaccagcgtgaccagcatcctgcacatcaaggaccccaagaaccaggtgggcaaggaggtgatctgccaggtgctgcacctgggcaccgtgaccgacttcaagcagaccgtgaacaagggctactggttcagcgtgcccctgctgctgagcatcgtgagcctggtgatcctgctggtgctgatcagcatcctgctgtactggaagagacacagaaaccaggacagagagccctag

SEQ ID NO: 18385 - DNA, 885 bp, Artificial Sequence
  Description of Artificial Sequence: Synthetic coding sequence
atggagagactgaccctgaccagaaccatcggcggccccctgctgaccgccaccctgctgggcaagaccaccatcaacgactaccaggtgatcagaatgcccttcagccacctgagcacctacagcctggtgtgggtgatggccgccgtggtgctgtgcaccgcccaggtgcaggtggtgacccaggacgagagagagcagctgtacacccccgccagcctgaagtgcagcctgcagaacgcccaggaggccctgatcgtgacctggcagaagaagaaggccgtgagccccgagaacatggtgaccttcagcgagaaccacggcgtggtgatccagcccgcctacaaggacaagatcaacatcacccagctgggcctgcagaacagcaccatcaccttctggaacatcaccctggaggacgagggctgctacatgtgcctgttcaacaccttcggcttcggcaagatcagcggcaccgcctgcctgaccgtgtacgtgcagcccatcgtgagcctgcactacaagttcagcgaggaccacctgaacatcacctgcagcgccaccgccagacccgcccccatggtgttctggaaggtgcccagaagcggcatcgagaacagcaccgtgaccctgagccaccccaacggcaccaccagcgtgaccagcatcctgcacatcaaggaccccaagaaccaggtgggcaaggaggtgatctgccaggtgctgcacctgggcaccgtgaccgacttcaagcagaccgtgaacaagggctactggttcagcgtgcccctgctgctgagcatcgtgagcctggtgatcctgctggtgctgatcagcatcctgctgtactggaagagacacagaaaccaggacagagagccctag

SEQ ID NO: 18386 - DNA, 1377 bp, Artificial Sequence
  Description of Artificial Sequence: Synthetic coding sequence
atgaacagaggcgtgcccttcagacacctgctgctggtgctgcagctggccctgctgcccgccgccacccagggcaagaaggtggtgctgggcaagaagggcgacaccgtggagctgacctgcaccgccagccagaagaagagcatccagttccactggaagaacagcaaccagatcaagatcctgggcaaccagggcagcttcctgaccaagggccccagcaagctgaacgacagagccgacagcagaagaagcctgtgggaccagggcaacttccccctgatcatcaagaacctgaagatcgaggacagcgacacctacatctgcgaggtggaggaccagaaggaggaggtgcagctgctggtgttcggcctgaccgccaacagcgacacccacctgctgcagggccagagcctgaccctgaccctggagagcccccccggcagcagccccagcgtgcagtgcagaagccccagaggcaagaacatccagggcggcaagaccctgagcgtgagccagctggagctgcaggacagcggcacctggacctgcaccgtgctgcagaaccagaagaaggtggagttcaagatcgacatcgtggtgctggccttccagaaggccagcagcatcgtgtacaagaaggagggcgagcaggtggagttcagcttccccctggccttcaccgtggagaagctgaccggcagcggcgagctgtggtggcaggccgagagagccagcagcagcaagagctggatcaccttcgacctgaagaacaaggaggtgagcgtgaagagagtgacccaggaccccaagctgcagatgggcaagaagctgcccctgcacctgaccctgccccaggccctgccccagtacgccggcagcggcaacctgaccctggccctggaggccaagaccggcaagctgcaccaggaggtgaacctggtggtgatgagagccacccagctgcagaagaacctgacctgcgaggtgtggggccccaccagccccaagctgatgctgagcctgaagctggagaacaaggaggccaaggtgagcaagagagagaaggccgtgtgggtgctgaaccccgaggccggcatgtggcagtgcctgctgagcgacagcggccaggtgctgctggagagcaacatcaaggtgctgcccacctggagcacccccgtgcagcccatggccctgatcgtgctgggcggcgtggccggcctgctgctgttcatcggcctgggcatcttcttctgcgtgagatgcagacacagaagaagacaggccgagagaatgagccagatcaagagactgctgagcgagaagaagacctgccagtgcccccacagattccagaagacctgcagccccatctag

SEQ ID NO: 18387 - DNA, 789 bp, Artificial Sequence
  Description of Artificial Sequence: Synthetic coding sequence
atggtggcctggagaagcgccttcctggtgtgcctggccttcagcctggccaccctggtgcagagaggcagcggcgacttcgacgacttcaacctggaggacgccgtgaaggagaccagcagcgtgaagcagccctgggaccacaccaccaccaccaccaccaacagacccggcaccaccagagcccccgccaagccccccggcagcggcctggacctggccgacgccctggacgaccaggacgacggcagaagaaagcccggcatcggcggcagagagagatggaaccacgtgaccaccaccaccaagagacccgtgaccaccagagcccccgccaacaccctgggcaacgacttcgacctggccgacgccctggacgacagaaacgacagagacgacggcagaagaaagcccatcgccggcggcggcggcttcagcgacaaggacctggaggacatcgtgggcggcggcgagtacaagcccgacaagggcaagggcgacggcagatacggcagcaacgacgaccccggcagcggcatggtggccgagcccggcaccatcgccggcgtggccagcgccctggccatggccctgatcggcgccgtgagcagctacatcagctaccagcagaagaagttctgcttcagcatccagcagggcctgaacgccgactacgtgaagggcgagaacctggaggccgtggtgtgcgaggagccccaggtgaagtacagcaccctgcacacccagagcgccgagcccccccccccccccgagcccgccagaatctag

SEQ ID NO: 18388 - DNA, 1437 bp, Artificial Sequence
  Description of Artificial Sequence: Synthetic coding sequence
atggccgccgccgccgccggcggcgcccccggccccgcccccggccccgccggcccccccccccccgccgcccccaccagcgccgccagagcccccccccaggccctgagaagaagaggcgacagcagaagaagacaggccgccctgttcttcctgaacaacatcagcctggacggcagaccccccagcctgggccccggcggcgagaagcccccccccccccccgccgaggccagagagccccccgccccccccccccccgagccccccaccggcctgcccgccagaacccccgccccccagggcctgctgagccccacccaggtgcccaccggcctgggcctggacggccagagacagagaaagagagtgaccagccagagatgcagcctggagttcctggaggacgccgtgggctgcgcccccgcccagagaaccaagcacaccagcggcagccccagacacaagggcctgaagaagacccacttcatcaagaacatgagacagtacgacaccagaaacagcagaatcgtgctgatctgcgccaagagaagcctgtgcgccgccttcagcgtgctgccctacggcgagggcctgagaatcagcgacctgagagtggacagccagaagcagagacaccccagcggcggcgtgagcgtgagcagcgagatggtgttcgagctggagggcgtggagctgggcgccgacggcaaggtggtgagctacgccaagttcctgtaccccaccaacgccctggtgacccacaagagcgacagccacggcctgctgcccacccccagacccagcgtgcccagaaccctgcccggcagcagacacaagcccgcccccaccaagagcgcccccgccagcaccgagctgggcagcgacgtgggcgacaccctggagtacaaccccaacctgctggacgacccccagtggccctgcggcaagcacaagagagtgctgatcttcgccagctacatgaccaccgtgatcgagtacgtgaagcccagcgacctgaagaaggacatgaacgagaccttcagagagaagttcccccacgtgaagctgaccctgagcaagatcagaagcctgaagagagagatgagaagcctgagcgaggagtgcagcctggagcccgtgaccgtggccatggcctacgtgtacttcgagaagctggtgctgcagggcaagctgagcaagcagaacagaaagctgtgcgccggcgcctgcgtgctgctggccgccaagatcagcagcgacctgagaaagagcggcgtgacccagctgatcgacaagctggaggagagattcagattcaacagaagagacctgatcggcttcgagttcaccgtgctggtggccctggagctggccctgtacctgcccgagaaccaggtgctgccccactacagaagactgacccagcagttctag

SEQ ID NO: 18389 - DNA, 801 bp, Artificial Sequence
  Description of Artificial Sequence: Synthetic coding sequence
gacagagcccacctgtgccaggccgtgcccgtgagaggcctgctgggccccgccctgtggggcagacccgccgaccaggtggtgagctacgccaagttcctgtaccccaccaacgccctggtgacccacaagagcgacagccacggcctgctgcccacccccagacccagcgtgcccagaaccctgcccggcagcagacacaagcccgcccccaccaagagcgcccccgccagcaccgagctgggcagcgacgtgggcgacaccctggagtacaaccccaacctgctggacgacccccagtggccctgcggcaagcacaagagagtgctgatcttcgccagctacatgaccaccgtgatcgagtacgtgaagcccagcgacctgaagaaggacatgaacgagaccttcagagagaagttcccccacgtgaagctgaccctgagcaagatcagaagcctgaagagagagatgagaagcctgagcgaggagtgcagcctggagcccgtgaccgtggccatggcctacgtgtacttcgagaagctggtgctgcagggcaagctgagcaagcagaacagaaagctgtgcgccggcgcctgcgtgctgctggccgccaagatcagcagcgacctgagaaagagcggcgtgacccagctgatcgacaagctggaggagagattcagattcaacagaagagacctgatcggcttcgagttcaccgtgctggtggccctggagctggccctgtacctgcccgagaaccaggtgctgccccactacagaagactgacccagcagttctag

SEQ ID NO: 18390 - DNA, 777 bp, Artificial Sequence
  Description of Artificial Sequence: Synthetic coding sequence
tgacaccaggagcagcaggacagagcccacctgtgccaggccgtgcccgtgagaggcctgctgggccccgccctgtggggcagacccgccgaccaggtggtgagctacgccaagttcctgtaccccaccaacgccctggtgacccacaagagcgacagccacggcctgctgcccacccccagacccagcgtgcccagaaccctgcccggcagcagacacaagcccgcccccaccaagagcgcccccgccagcaccgagctgggcagcgacgtgggcgacaccctggagtacaaccccaacctgctggacgacccccagtggccctgcggcaagcacaagagagtgctgatcttcgccagctacatgaccaccgtgatcgagtacgtgaagcccagcgacctgaagaaggacatgaacgagaccttcagagagaagttcccccacgtgaagctgaccctgagcaagatcagaagcctgaagagagagatgagaagcctgagcgaggagtgcagcctggagcccgtgaccgtggccatggcctacgtgtacttcgagaagctggtgctgcagggcaagctgagcaagcagaacagaaagctgtgcgccggcgcctgcgtgctgctggccgccaagatcagcagcgacctgagaaagagcggcgtgacccagctgatcgacaagctggaggagagattcagattcaacagaagagacctgatcggcttcgagttcaccgtgctggtggccctggagctggccctgtacctgcccgagtag

SEQ ID NO: 18391 - DNA, 258 bp, Artificial Sequence
  Description of Artificial Sequence: Synthetic coding sequence
atggtgggcggcgaggccgccgccgccgtggaggagctggtgagcggcgtgagacaggccgccgacttcgccgagcagttcagaagctacagcgagagcgagaagcagtggaaggccagaatggagttcatcctgagacacctgcccgactacagagacccccccgacggcagcggcagactggaccagctgctgagcctgagcatggtgtgggccaaccacctgttcctgggctgcagccccagaggccccaagtag

SEQ ID NO: 18392 - DNA, 351 bp, Artificial Sequence
  Description of Artificial Sequence: Synthetic coding sequence
atggtgggcggcgaggccgccgccgccgtggaggagctggtgagcggcgtgagacaggccgccgacttcgccgagcagttcagaagctacagcgagagcgagaagcagtggaaggccagaatggagttcatcctgagacacctgcccgactacagagacccccccgacggcagcggcagactggaccagctgctgagcctgagcatggtgtgggccaaccacctgttcctgggctgcagctacaacaaggacctgctggacaaggtgatggagatggccgacggcatcgaggtggaggacctgccccagttcaccaccagaagcgagctgatgaagaagcaccagagctag

SEQ ID NO: 18393 - DNA, 372 bp, Artificial Sequence
  Description of Artificial Sequence: Synthetic coding sequence
atgagcagcggcggcagccccggctgcctgagactggccgagggctgccccaaccacagagcctgggtgagatggaacagaagacagccccacagcgccttcctgatcgccagccacctgttcctgagcgtgctggtgtggttcaacagcttccagggcctggagctggagagcgagaaccccagacacctgctgtggaacgtgtgcctggtggtgctggtgtgccccagcagcagcctggcctgcagattccaggtgtaccagagaaccttctgcagcgtggagagccacagaaccaagagaaagatcctgcagctgttcgccaacatcctgccctacctgtacaagcagccctacaccaagaagcactag

SEQ ID NO: 18394 - DNA, 396 bp, Artificial Sequence
  Description of Artificial Sequence: Synthetic coding sequence
atgggccccgccgccagacccagaagattcgtgcccggcccccccggcgacgccaccaccctggagctgtacaccaaggtgtgcctgcccagaaagagatggagactgcccctgggcagactggccagaagccccagactgcaggcccccagagtgagagccggcagcagccacagctgcaaggaggccgccaagtacgtgttccagaccttccacggcagcaagctgagcgccagcatcaagagaagcggcgtgagaggcaagagcatcctgggcatcagcatgcagatgaacggccccggcttccagctgagaagcggcttcccccccctgagagccgagctggcccccagccacgccagacccgaggccagcggcagatgccccggcggctag

SEQ ID NO: 18395 - DNA, 438 bp, Artificial Sequence
  Description of Artificial Sequence: Synthetic coding sequence
atgggcctgaagagccacgtgctgcccgcccccaacagccagggccagggcagcctgtgcatcttcgtgtacgtgaccagctacatggactacatccagctgcagggcaaggagaacctggactgcagcggcctgaacaagcagaagatcgtgttcccccacagcatggacagcggcgacggctggctgatggtgctggtgcagcagctgcacgagggcagaggccacgtgctggaccccttcgccctgatcagcgtgctggtgaccagctggagccaggacggctgctgcatccccaagaaccacgtgtgcgtgcagggcagaagaggcggcggcagaggcagagccaagctggccggccccgtgaccttctaccagaaggtgaagcccagacagaagagcgtgagctgcagcctgcccctgcacatcttcacctag

SEQ ID NO: 18396 - DNA, 387 bp, Artificial Sequence
  Description of Artificial Sequence: Synthetic coding sequence
atgctgcaggaggccctgaccgaggccagcttcctgaagctggtgatcttcttcttcttcttcagcttcctgagaagaagcctggccctgagccccagactggagtgcagcggcgccatcagcgcccactgcaacctgagactgctgggcagcagctacagcctggccagcgccagcagagtgagcggcatcaccggcagcagacaccacgcccagctgttcttcgtgttcctggtggagaccggcttccaccacatcggccaggccggcctggagctgctgaccagcggcgacccccccaccagcgccagccagagcgtgggcatcaccggcgtgagccacagagcccagcagatgagaatcatcttcatcttcatcaagctgtag

SEQ ID NO: 18397 - DNA, 597 bp, Artificial Sequence
  Description of Artificial Sequence: Synthetic coding sequence
atgaccctgaaggagcacgccgccttcaagcacctgttcaacaaggcccacctggccccccccctgatccacctgaccctgagcggccacagcacctgcttcagagagcacagagtgggcggcaaggtgatcgaccagcagcaccccaaggccgaggagagcttcctggtgcagaacaagatggagagccccatgagcaccttcttctacagcagacacggcaacaacctgatcagcctgagcttcccccacatcagccccttcagcatcccccagaacagacactgccaccacggcctgttcagcatgagctgctgggtgagactgcccgacggcgtggccgccggccagagaggcagcagcctgcccagaagaggcggcagagccgaggccccccccaccagcagaaccggcagaagacccggcggcggcgccccccacttccccgacagagtggccgccggcagaagaggcagcagcctgctgagaagaggcggctgctgggccgagggcctgctgaccagccagaccggcagacccggcagagacgccccccacctgcccgacggcgtggccgccggccagagatgcagctag

SEQ ID NO: 18398 - DNA, 450 bp, Artificial Sequence
  Description of Artificial Sequence: Synthetic coding sequence
atgcaggagatccacgagaaggtgctgaacgaggtggtgggcgccatgatgtaccacaccttcagcctgaccagagaggacctggagaacttcaaggccctgagagtgatcgtgcaggtgggcagcggctacgacaacgtggccatcaaggccgccggcgagctggagatcgccgtgtgcagcatccccagcgccgccgtggaggagaccgccgacagcaccaccggccacatcctgaacctgtactggggcaacagaagcctgtaccaggccctgagagagggcaccagagtgcagagcgtggagcagatcggcgaggtggccagcgtgaaggccagaatcagaggcgagatcctgggcctgatcggcttcggcagaacccagcaggaggtggccgtgagagccaaggccttcgccggctgggacagagccgtgcccggctgcgcctag

SEQ ID NO: 18399 - DNA, 381 bp, Artificial Sequence
  Description of Artificial Sequence: Synthetic coding sequence
atgggcctgcccgcccccagcctgcacgccaccagcaccctgagacccgaccagttcagcccccacaccaaccccagcctgagcctgccctgcctgaagagcttccccgtgagcctgtggccctggggcagagccagcctgctgtgccacctgagcagactgttcgtgtgccacagacccctgacccccaccagccaggcccccaacatgttcagctgcgtgagcagcagcctgaccctggccgccagcagcgcctggcccgccagccacctgcccatcagccacagccccttcctgcccccccacctgctgagaagccagctgagcgtgaccagcagcagagagcccagactgagcctgcccctgcagctgggccagtag

SEQ ID NO: 18400 - DNA, 1548 bp, Artificial Sequence
  Description of Artificial Sequence: Synthetic coding sequence
atggagtggaagctggagagaaccgcccccagaagagtgagaaccgaggaggagatgctgtgggagagcatcatgagagtgctgagcaaggacctgaagcagaagagaagccaggacagcgccaacgtgctggacagcgtgaacgccacctacagcgacttcaagagcaacttcgccaagagactgagcgccgaggtgcccgtggccagcagccccatcaccaccagatggcagcagagccagaccagagccctgagcagcgacagcttcggcgaggagcagagcaccacctacctgcccgaggccagcggcagcgtgctgaagaccccccccgagaaggagaccctgaccctgggcagcagaaaggagcagctgaagacccccagcaagggcatcagcgagaccagcaacagcgccctgcacttctgcaaggccccccacgccatggacagagactggaaggagagcgtggccagcaagggccagaagtgcctgaagcagctgttcgtgacccagaacgtggtgcagcaggccaacggcaagatgcagctgtgcgagcagagcgagtgcgtgtggaagggctgcaaggacggcgtgagagacgagagcttccacctgaagagcagcggcgacatcaacgacagcatcctgcagcccgaggtgaagatccacatcaccggcctgagaaacgactactacctgaacatcctggactggagcttccagaacctggtggccatcgccctgggcagcgccgtgtacatctggaacggcgagaaccacaacggcatcgagaacatcgacctgagcctgacctgcaactacatcagcagcgtgagctggatcaaggagggcacctgcctggccgtgggcaccagcgagggcgaggtgcagctgtgggacgtggtgaccaagaagagactgagaaacatgctgggccacctgagcgtggtgggcgccctgagctggaaccacttcatcctgagcagcggcagcagactgggcagagtgtaccaccacgacgtgagagtggcccagcaccacgtgggcaccctgagacacaagcaggccgtgtgcgccctgaagtggagccccgacggcagactgctgagcagcggctgcagcgacggcctgctgaccatctggccccacgaccccggcgccagcgcccagggccagcccctgaaggtgatcacccagagcaccgccgtgaaggccatggactggtgcccctggcagagcggcgtgctggccatcggcggcggcatgaaggacggcagactgcacatcctggacatcaacgccggcaagagcatccagacccccagcaccaacagccagatctgcagcctgatctggctgcccaagaccaaggagatcgccaccggccagggcacccccaagaacgacgtgaccgtgtggacctgccccaccgtgagcagaagcggccacagaggcagagtgctgcacctgagcctgagccccgaccagaccagagtgttcagcgccgccgccgacggcaccgccagcgtgtggaactgctactag

SEQ ID NO: 18401 - DNA, 1434 bp, Artificial Sequence
  Description of Artificial Sequence: Synthetic coding sequence
atggagtggaagctggagagaaccgcccccagaagagtgagaaccgaggaggagatgctgtgggagagcatcatgagagtgctgagcaaggacctgaagcagaagagaagccaggacagcgccaacgtgctggacagcgtgaacgccacctacagcgacttcaagagcaacttcgccaagagactgagcgccgaggtgcccgtggccagcagccccatcaccaccagatggcagcagagccagaccagagccctgagcagcgacagcttcggcgaggagcagagcaccacctacctgcccgaggccagcggcagcgtgctgaagaccccccccgagaaggagaccctgaccctgggcagcagaaaggagcagctgaagacccccagcaagggcatcagcgagaccagcaacagcgccctgcacttctgcaaggccccccacgccatggacagagactggaaggagagcgtggccagcaagggccagaagtgcctgaagcagctgttcgtgacccagaacgtggtgcagcaggccaacggcaagatgcagctgtgcgagcagagcgagtgcgtgtggaagggctgcaaggacggcgtgagagacgagagcttccacctgaagagcagcggcgacatcaacgacagcatcctgcagcccgaggtgaagatccacatcaccggcctgagaaacgactactacctgaacatcctggactggagcttccagaacctggtggccatcgccctgggcagcgccgtgtacatctggaacggcgagaaccacaacggcatcgagaacatcgacctgagcctgacctgcaactacatcagcagcgtgagctggatcaaggagggcacctgcctggccgtgggcaccagcgagggcgaggtgcagctgtgggacgtggtgaccaagaagagactgagaaacatgctgggccacctgagcgtggtgggcgccctgagctggaaccacttcatcctgagcagcggcagcagactgggcagagtgtaccaccacgacgtgagagtggcccagcaccacgtgggcaccctgagacacaagcaggccgtgtgcgccctgaagtggagccccgacggcagactgctgagcagcggctgcagcgacggcctgctgaccatctggccccacgaccccggcgccagcgcccagggccagcccctgaaggtgatcacccagagcaccgccgtgaagatctgcagcctgatctggctgcccaagaccaaggagatcgccaccggccagggcacccccaagaacgacgtgaccgtgtggacctgccccaccgtgagcagaagcggcggcttcttcggccacagaggcagagtgctgcacctgagcctgagccccgaccagaccagagtgttcagcgccgccgccgacggcaccgccagcgtgtggaactgctactag

SEQ ID NO: 18402 - DNA, 579 bp, Artificial Sequence
  Description of Artificial Sequence: Synthetic coding sequence
atggagtggaagctggagagaaccgcccccagaagagtgagaaccgaggaggagatgctgtgggtgctggacagcgtgaacgccacctacagcgacttcaagagcaacttcgccaagagactgagcgccgaggtgcccgtggccagcagccccatcaccaccagatggcagcagagccagaccagagccctgagcagcgacagcttcggcgaggagcagagcaccacctacctgcccgaggccagcggcagcgtgctgaagaccccccccgagaaggagaccctgaccctgggcagcagaaaggagcagctgaagacccccagcaagggcatcagcgagaccagcaacagcgccctgcacttctgcaaggccccccacgccatggacagagactggaaggagagcgtggccagcaagggccagaagtgcctgaagcagctgttcgtgacccagaacgtggtgcagcaggccaacggcaagatgcagctgtgcgagcagagcgagtgcgtgtggaaggaccacttcagcggcagcatgaagaagagattcgagcaggaggacgtgggcggcaaggactag

SEQ ID NO: 18403 - DNA, 1119 bp, Artificial Sequence
  Description of Artificial Sequence: Synthetic coding sequence
atggagtggaagctggagagaaccgcccccagaagagtgagaaccgaggaggagatgctgtgggagagcatcatgagagtgctgagcaaggacctgaagcagaagagaagccaggacagcgccaacgtgctggacagcgtgaacgccacctacagcgacttcaagagcaacttcgccaagagactgagcgccgaggtgcccgtggccagcagccccatcaccaccagatggcagcagagccagaccagagccctgagcagcgacagcttcggcgaggagcagagcaccacctacctgcccgaggccagcggcagcgtgctgaagaccccccccgagaaggagaccctgaccctgggcagcagaaaggagcagctgaagacccccagcaagggcatcagcgagaccagcaacagcgccctgcacttctgcaaggccccccacgccatggacagagactggaaggagagcgtggccagcaagggccagaagtgcctgaagcagctgttcgtgacccagaacgtggtgcagcaggccaacggcaagatgcagctgtgcgagcagagcgagtgcgtgtggaagggctgcaaggacggcgtgagagacgagagcttccacctgaagagcagcggcgacatcaacgacagcatcctgcagcccgaggtgaagatccacatcaccggcctgagaaacgactactacctgaacatcctggactggagcttccagaacctggtggccatcgccctgggcagcgccgtgtacatctggaacggcgagaaccacaacggcatcgagaacatcgacctgagcctgacctgcaactacatcagcagcgtgagctggatcaaggagggcacctgcctggccgtgggcaccagcgagggcgaggtgcagctgtgggacgtggtgaccaagaagagactgagaaacatgctgggccacctgagcgtggtgggcgccctgagctggaaccacttcatcctgagcagactggagttcagcggcgtgatcagcgcccactgcaacctgcacctgcccagcagctgggactacagaagaccccccccctgcctggtgggccaggactggggcgtgttcatcatcaccatgttcggctag

SEQ ID NO: 18404 - DNA, 1560 bp, Artificial Sequence
  Description of Artificial Sequence: Synthetic coding sequence
atggagtggaagctggagagaaccgcccccagaagagtgagaaccgaggaggagatgctgtgggagagcatcatgagagtgctgagcaaggacctgaagcagaagagaagccaggacagcgccaacgtgctggacagcgtgaacgccacctacagcgacttcaagagcaacttcgccaagagactgagcgccgaggtgcccgtggccagcagccccatcaccaccagatggcagcagagccagaccagagccctgagcagcgacagcttcggcgaggagcagagcaccacctacctgcccgaggccagcggcagcgtgctgaagaccccccccgagaaggagaccctgaccctgggcagcagaaaggagcagctgaagacccccagcaagggcatcagcgagaccagcaacagcgccctgcacttctgcaaggccccccacgccatggacagagactggaaggagagcgtggccagcaagggccagaagtgcctgaagcagctgttcgtgacccagaacgtggtgcagcaggccaacggcaagatgcagctgtgcgagcagagcgagtgcgtgtggaagggctgcaaggacggcgtgagagacgagagcttccacctgaagagcagcggcgacatcaacgacagcatcctgcagcccgaggtgaagatccacatcaccggcctgagaaacgactactacctgaacatcctggactggagcttccagaacctggtggccatcgccctgggcagcgccgtgtacatctggaacggcgagaaccacaacggcatcgagaacatcgacctgagcctgacctgcaactacatcagcagcgtgagctggatcaaggagggcacctgcctggccgtgggcaccagcgagggcgaggtgcagctgtgggacgtggtgaccaagaagagactgagaaacatgctgggccacctgagcgtggtgggcgccctgagctggaaccacttcatcctgagcagcggcagcagactgggcagagtgtaccaccacgacgtgagagtggcccagcaccacgtgggcaccctgagacacaagcaggccgtgtgcgccctgaagtggagccccgacggcagactgctgagcagcggctgcagcgacggcctgctgaccatctggccccacgaccccggcgccagcgcccagggccagcccctgaaggtgatcacccagagcaccgccgtgaaggccatggactggtgcccctggcagagcggcgtgctggccatcggcggcggcatgaaggacggcagactgcacatcctggacatcaacgccggcaagagcatccagacccccagcaccaacagccagatctgcagcctgatctggctgcccaagaccaaggagatcgccaccggccagggcacccccaagaacgacgtgaccgtgtggacctgccccaccgtgagcagaagcggcggcttcttcggccacagaggcagagtgctgcacctgagcctgagccccgaccagaccagagtgttcagcgccgccgccgacggcaccgccagcgtgtggaactgctactag

SEQ ID NO: 18405 - DNA, 807 bp, Artificial Sequence
  Description of Artificial Sequence: Synthetic coding sequence
atgggcagcgccaagagcgtgcccgtgacccccgccagaccccccccccacaacaagcacctggccagagtggccgaccccagaagccccagcgccggcatcctgagaacccccatccaggtggagagcagcccccagcccggcctgcccgccggcgagcagctggagggcctgaagcacgcccaggacagcgaccccagaagccccaccctgggcatcgccagaacccccatgaagaccagcagcggcgacccccccagccccctggtgaagcagctgagcgaggtgttcgagaccgaggacagcaagagcaacctgccccccgagcccgtgctgccccccgaggcccccctgagcagcgagctggacctgcccctgggcacccagctgagcgtggaggagcagatgcccccctggaaccagaccgagttccccagcaagcaggtgttcagcaaggaggaggccagacagcccaccgagacccccgtggccagccagagcagcgacaagcccagcagagaccccgagacccccagaagcagcggcagcatgagaaacagatggaagcccaacagcagcaaggtgctgggcagaagccccctgaccatcctgcaggacgacaacagccccggcaccctgaccctgagacagggcaagagacccagccccctgagcgagaacgtgagcgagctgaaggagggcgccatcctgggcaccggcagactgctgaagaccggcggcagagcctgggagcagggccaggaccacgacaaggagaaccagcacttccccctggtggagagctag

SEQ ID NO: 18406 - DNA, 435 bp, Artificial Sequence
  Description of Artificial Sequence: Synthetic coding sequence
atggccttcaccttcgccgccttctgctacatgctggccctgctgctgaccgccgccctgatcttcttcgccatctggcacatcatcgccttcgacgagctgaagaccgactacaagaaccccatcgaccagtgcaacaccctgaaccccctggtgctgcccgagtacctgatccacgccttcttctgcgtgatgttcctgtgcgccgccgagtggctgaccctgggcctgaacatgcccctgctggcctaccacatctggagatacatgagcagacccgtgatgagcggccccggcctgtacgaccccaccaccatcatgaacgccgacatcctggcctactgccagaaggagggctggtgcaagctggccttctacctgctggccttcttctactacctgtacggcatgatctacgtgctggtgagcagctag

SEQ ID NO: 18407 - DNA, 225 bp, Artificial Sequence
  Description of Artificial Sequence: Synthetic coding sequence
atgaagttccaggagtgccacagcgaggtgatgagacacggccagaagatctaccccagccaccacagaatcgagatggccgtggagatcgccagcctgaagtgccagcacagcagcatcaaccagagccccaccagaaagaacagcaacagcaccaccggctggctgctgtgggacctgctgatgggcatcggcaacagcggcagcaacgtggtgctgacctag

SEQ ID NO: 18408 - DNA, 750 bp, Artificial Sequence
  Description of Artificial Sequence: Synthetic coding sequence
atgaccaccgccgtggagagaaagtacatcaacatcagaaagagactggaccagctgggctacagacagaccctgaccgtggagtgcctgcccctggtggagaagctgttcagcgacctggtgcacaccaccgagagcctgagacagagcaagctgagcgccgtgaaggccgagaaggagagcgccaacttcgacttcgtgctggagccctacaagctggagaacgccagactgagcagagagaacaacgagctgtacctggagctgatgaagctgagagagcacagcgaccagcacgtgaaggagctgaagaccagcctgaagaagtgcgccagagagaccgccgacctgaagttcctgaacaaccagtacgcccacaagctgaagctgctggagaaggagagcaaggccaagaacgagagaatccagcagctgcaggagaagaacctgcacgccgtggtgcagacccccggcggcaagaagagaagcatcgccttcagaagacagagaatgcagatcgacgagcccgtgccccccagcgaggtgagcagctaccccgtgccccagcccgacgacccctacatcgccgacctgctgcaggtggccgacaacagaatccaggagctgcagcaggaggtgcaccagctgcaggagaagctggccatgatggagagcggcgtgagagactacagcaagcaggtgggcttcctgttcacctgcatcgtgggcatcgagatcggcatgctgtag

SEQ ID NO: 18409 - DNA, 165 bp, Artificial Sequence
  Description of Artificial Sequence: Synthetic coding sequence
atgagcctgagaagacacatcggcaaccccgagtacctgatgaagagaatcccccagaaccccagataccagcacatcaagagcagactggacaccggcgcctgcgtgtacctgaccagcagccccgccctgcccgactgcgccatgaacggcctgtgcttctag

SEQ ID NO: 18410 - DNA, 411 bp, Artificial Sequence
  Description of Artificial Sequence: Synthetic coding sequence
atgctgagcagcttcaacgagtggttctggcaggacagattctggctgccccccaacgtgacctggaccgagctggaggacagagacggcagagtgtacccccacccccaggacctgctggccgccctgcccctggccctggtgctgctggccatgagactggccttcgagagattcatcggcctgcccctgagcagatggctgggcgtgagagaccagaccagaagacaggtgaagcccaacgccaccctggagaagcacttcctgaccgagggccacagacccaaggagccccagctgagcctgctggccgcccagtgcggcctgaccctgcagcagacccagagatggttcagaagaagaagaaaccaggacagaccccagctgaccaagaagttctgcgaggcctag

SEQ ID NO: 18411 - DNA, 1398 bp, Artificial Sequence
  Description of Artificial Sequence: Synthetic coding sequence
atgagaagagccgccggcatggaggacttcagcgccgaggaggaggagagctggtacgaccagcaggacctggagcaggacctgcacctggccgccgagctgggcaagaccctgctggagagaaacaaggagctggagggcagcctgcagcagatgtacagcaccaacgaggagcaggtgcaggagatcgagtacctgaccaagcagctggacaccctgagacacgtgaacgagcagcacgccaaggtgtacgagcagctggacctgaccgccagagacctggagctgaccaaccacagactggtgctggagagcaaggccgcccagcagaagatccacggcctgaccgagaccatcgagagactgcaggcccaggtggaggagctgcaggcccaggtggagcagctgagaggcctggagcagctgagagtgctgagagagaagagagagagaagaagaaccatccacaccttcccctgcctgaaggagctgtgcaccagccccagatgcaaggacgccttcagactgcacagcagcagcctggagctgggccccagacccctggagcaggagaacgagagactgcagaccctggtgggcgccctgagaagccaggtgagccaggagagacagagaaaggagagagccgagagagagtacaccgccgtgctgcaggagtacagcgagctggagagacagctgtgcgagatggaggcctgcagactgagagtgcaggagctggaggccgagctgctggagctgcagcagatgaagcaggccaagacctacctgctgggccccgacgaccacctggccgaggccctgctggcccccctgacccaggcccccgaggccgacgacccccagcccggcagaggcgacgacctgggcgcccaggacggcgtgagcagccccgccgccagccccggccacgtggtgagaaagagctgcagcgacaccgccctgaacgccatcgtggccaaggaccccgccagcagacacgccggcaacctgaccctgcacgccaacagcgtgagaaagagaggcatgagcatcctgagagaggtggacgagcagtaccacgccctgctggagaagtacgaggagctgctgagcaagtgcagacagcacggcgccggcgtgagacacgccggcgtgcagaccagcagacccatcagcagagacagcagctggagagacctgagaggcggcgaggagggccagggcgaggtgaaggccggcgagaagagcctgagccagcacgtggaggccgtggacaagagactggagcagagccagcccgagtacaaggccctgttcaaggagatcttcagcagaatccagaagaccaaggccgacatcaacgccaccaaggtgaagacccacagcagcaagtag

SEQ ID NO: 18412 - DNA, 555 bp, Artificial Sequence
  Description of Artificial Sequence: Synthetic coding sequence
atgtgggtgttcggctacggcagcctgatctggaaggtggacttcccctaccaggacaagctggtgggctacatcaccaactacagcagaagattctggcagggcagcaccgaccacagaggcgtgcccggcaagcccggcagagtggtgaccctggtggaggaccccgccggctgcgtgtggggcgtggcctacagactgcccgtgggcaaggaggaggaggtgaaggcctacctggacttcagagagaagggcggctacagaaccaccaccgtgatcttctaccccaaggaccccaccaccaagcccttcagcgtgctgctgtacatcggcacctgcgacaaccccgactacctgggccccgcccccctggaggacatcgccgagcagatcttcaacgccgccggccccagcggcagaaacaccgagtacctgttcgagctggccaacagcatcagaaacctggtgcccgaggaggccgacgagcacctgttcgccctggagaagctggtgaaggagagactggagggcaagcagaacctgaactgcatctag

SEQ ID NO: 18413 - DNA, 285 bp, Artificial Sequence
  Description of Artificial Sequence: Synthetic coding sequence
atgatgggcctgagcctggccagcgccgtgctgctggccagcctgctgagcctgcacctgggcaccgccaccagaggcagcgacatcagcaagacctgctgcttccagtacagccacaagcccctgccctggacctgggtgagaagctacgagttcaccagcaacagctgcagccagagagccgtgatcttcaccaccaagagaggcaagaaggtgtgcacccaccccagaaagaagtgggtgcagaagtacatcagcctgctgaagacccccaagcagctgtag

SEQ ID NO: 18414 - DNA, 729 bp, Artificial Sequence
  Description of Artificial Sequence: Synthetic coding sequence
atgtgggccagcagagaccacctgcccgagcccgacctgggcgacgccgccccccccggcagccccagcagcttctggaccagcggcctgcccagacaggagagaagcaccagcagacagagaagcagaggcagccccagcagcacctgcgtgccctacaaggtgcacgccctggccaccttcgagtgcagcgccaccagccacgccagcagactgtggcagaccctgcagcagttctgggccgaccacatcagcagacccttcagccccagaagaccccccctgagaagaatgcccagcctgagcaccttctacctgctggaccacaacaccagacaggccgagctgggcctggcctacggcgccccctgcatgagactgagcaaccaggccttcgtgttcagaggcggcagatggaccaccgagagccagctggccagaaccagaagccccctgctgagcagaaccgcctggggctggaaggcccaggtgcagagaagcaagagccaggtgctgctggaggagaacaactacctgaagctgcagcaggagctgctgatcgacatgctgaccgagaccatggccagaatgcacctgctggagaagcagagaaaccccgaggtgatccccaccgccgccgccagagccggccagagaaagatgagaaagagagccggcgccagcgccggcgtgctgatgatccagccctgcgccctggacagccagtag

SEQ ID NO: 18415 - DNA, 237 bp, Artificial Sequence
  Description of Artificial Sequence: Synthetic coding sequence
atgagcgccaccaccgcctgctggcccgccttcaccgtgctgggcgaggccagaggcgaccaggtggactggagcagactgtacagagacaccggcctggtgaagatgagcagaaagcccagagccagcagccccttcagcaacaaccaccccagcacccccaagagattccccagacagcccaagagagagaagggccccgtgaaggaggtgcccggcaccaagggcagcccctag

SEQ ID NO: 18416 - DNA, 222 bp, Artificial Sequence
  Description of Artificial Sequence: Synthetic coding sequence
atgagcgccaccaccgcctgctggcccgccttcaccgtgctgggcgaggccagaggcgaccaggtggactggagcagactgtacagagacaccggcctggtgaagatgagcagaaagcccagagccagcagccccttcagcaacaaccaccccagcacccccaagagaagaggcagaggcaagcaccccctgatccccggccccgaggccctgagcaagtag

SEQ ID NO: 18417 - DNA, 237 bp, Artificial Sequence; identical to SEQ ID NO: 18415
  Description of Artificial Sequence: Synthetic coding sequence

SEQ ID NO: 18418 - DNA, 333 bp, Artificial Sequence
  Description of Artificial Sequence: Synthetic coding sequence
atgtggatgggcctgatccagctggtggagggcgtgaagagaaaggaccagggcttcctggagaaggagttctaccacaagaccaacatcaagatgagatgcgagttcctggcctgctggcccgccttcaccgtgctgggcgaggcctggagagaccaggtggactggagcagactgctgagagacgccggcctggtgaagatgagcagaaagcccagagccagcagccccctgagcaacaaccacccccccacccccaagagattccccagacagcccggcagagagaagggccccatcaaggaggtgcccggcaccaagggcagcccctag

SEQ ID NO: 18419 - DNA, 492 bp, Artificial Sequence
  Description of Artificial Sequence: Synthetic coding sequence
atgagcaagggcctgctgctgctgctgctgctgagcatgggcggcacctgggccagcaaggagcccctgagacccagatgcagacccatcaacgccaccctggccgtggagaaggagggctgccccgtgtgcatcaccgtgaacaccaccatctgcgccggctactgccccaccatgaccagagtgctgcagggcgtgctgcccgccctgccccaggtggtgtgcaactacagagacgtgagattcgagagcatcagactgcccggctgccccagaggcgtgaaccccgtggtgagctacgccgtggccctgagctgccagtgcgccctgtgcagaagaagcaccaccgactgcggcggccccaaggaccaccccctgacctgcgacgaccccagattccaggccagcagcagcagcaaggcccccccccccagcctgcccagccccagcagactgcccggccccagcgacacccccatcctgccccagtag

SEQ ID NO: 18420 - DNA, 417 bp, Artificial Sequence
  Description of Artificial Sequence: Synthetic coding sequence
atgagcaagggcctgctgctgctgctgctgctgagcatgggcggcacctgggccagcaaggagcccctgagacccagatgcagacccatcaacgccaccctggccgtggagaaggagggctgccccgtgtgcatcaccgtgaacaccaccatctgcgccggctactgccccaccatgaccagagtgctgcagggcgtgctgcccgccctgccccaggtggtgtgcaactacagagacgtgagattcgagagcatcagactgcccggctgccccagaggcgtgaaccccgtggtgagctacgccgtggccctgagctgccagtgcgccctgtgcagaagaagcaccaccgactgcggcggccccaaggaccaccccctgacctgcgacccccccctgcccggcctgctgttcctgtag

SEQ ID NO: 18421 - DNA, 492 bp, Artificial Sequence
  Description of Artificial Sequence: Synthetic coding sequence
atgttccagggcctgctgctgctgctgctgctgagcatgggcggcacctgggccagcagagagatgctgagacccagatgcagacccatcaacgccaccctggccgtggagaaggagggctgccccgtgtgcatcaccgtgaacaccaccatctgcgccggctactgccccaccatgaccagagtgctgcagggcgtgctgcccgccctgccccaggtggtgtgcaactacagagacgtgagattcgagagcatcagactgcccggctgccccagaggcgtgaaccccgtggtgagctacgccgtggccctgagctgccagtgcgccctgtgcagaagaagcaccaccgactgcggcggccccaaggaccaccccctgacctgcgacgaccccagattccaggccagcagcagcagcaaggcccccccccccagcctgcccagccccagcagactgcccggccccagcgacacccccatcctgccccagtag

SEQ ID NO: 18422 - DNA, 498 bp, Artificial Sequence
  Description of Artificial Sequence: Synthetic coding sequence
atggagatgttccagggcctgctgctgctgctgctgctgagcatgggcggcacctgggccagcagagagatgctgagacccagatgcagacccatcaacgccaccctggccgtggagaaggagggctgccccgtgtgcatcaccgtgaacaccaccatctgcgccggctactgccccaccatgaccagagtgctgcagggcgtgctgcccgccctgccccaggtggtgtgcaactacagagacgtgagattcgagagcatcagactgcccggctgccccagaggcgtgaaccccgtggtgagctacgccgtggccctgagctgccagtgcgccctgtgcagaagaagcaccaccgactgcggcggccccaaggaccaccccctgacctgcgacgaccccagattccaggccagcagcagcagcaaggcccccccccccagcctgcccagccccagcagactgcccggccccagcgacacccccatcctgccccagtag

SEQ ID NO: 18423 - DNA, 189 bp, Artificial Sequence
  Description of Artificial Sequence: Synthetic coding sequence
atggccagcaacaagaccaccctgcagaagatgggcaagaagcagaacggcaagagcaagaaggtggaggaggccgagcccgaggagttcgtggtggagaaggtgctggacagaagagtggtgaacggcaaggtggagtacttcctgaagtggaagggcttcaccgacgccgacaacacctgggagtag

SEQ ID NO: 18424 - DNA, 2082 bp, Artificial Sequence
  Description of Artificial Sequence: Synthetic coding sequence
atggagagagccggcgccaccagcagaggcggccaggcccccggcttcctgctgagactgcacaccgagggcagagccgaggccgccagagtgcaggagcaggacctgagacagtggggcctgaccgccagcgagctgcacaagctgctgcagcccttcctgctgagaagagtgaaggccgaggtggccaccgagctgcccaagaagaccgaggtggtgatctaccacggcatgagcgccctgcagaagaagtactacaaggccatcctgatgaaggacctggacgccttcgagaacgagaccgccaagaaggtgaagctgcagaacatcctgagccagctgagaaagtgcgtggaccacccctacctgttcgacggcgtggagcccgagcccttcgaggtgggcgaccacctgaccgaggccagcggcaagctgcacctgctggacaagctgctggccttcctgtacagcggcggccacagagtgctgctgttcagccagatgacccagatgctggacatcctgcaggactacatggactacagaggctacagctacgagagagtggacggcagcgtgagaggcgaggagagacacctggccatcaagaacttcggccagcagcccatcttcgtgttcctgctgagcaccagagccggcggcgtgggcatgaacctgaccgccgccgacaccgtgatcttcgtggacagcgacttcaacccccagaacgacctgcaggccgccgccagagcccacagaatcggccagaacaagagcgtgaaggtgatcagactgatcggcagagacaccgtggaggagatcgtgtacagaaaggccgccagcaagctgcagctgaccaacatgatcatcgagggcggccacttcaccctgggcgcccagaagcccgccgccgacgccgacctgcagctgagcgagatcctgaagttcggcctggacaagctgctggccagcgagggcagcaccatggacgagatcgacctggagagcatcctgggcgagaccaaggacggccagtgggtgagcgacgccctgcccgccgccgagggcggcagcagagaccaggaggagggcaagaaccacatgtacctgttcgagggcaaggactacagcaaggagcccagcaaggaggacagaaagagcttcgagcagctggtgaacctgcagaagaccctgctggagaaggccagccaggagggcagaagcctgagaaacaagggcagcgtgctgatccccggcctggtggagggcagcaccaagagaaagagagtgctgagccccgaggagctggaggacagacagaagaagagacaggaggccgccgccaagagaagaagactgatcgaggagaagaagagacagaaggaggaggccgagcacaagaagaagatggcctggtgggagagcaacaactaccagagcttctgcctgcccagcgaggagagcgagcccgaggacctggagaacggcgaggagagcagcgccgagctggactaccaggaccccgacgccaccagcctgaagtacgtgagcggcgacgtgacccacccccaggccggcgccgaggacgccctgatcgtgcactgcgtggacgacagcggccactggggcagaggcggcctgttcaccgccctggagaagagaagcgccgagcccagaaagatctacgagctggccggcaagatgaaggacctgagcctgggcggcgtgctgctgttccccgtggacgacaaggagagcagaaacaagggccaggacctgctggccctgatcgtggcccagcacagagacagaagcaacgtgctgagcggcatcaagatggccgccctggaggagggcctgaagaagatcttcctggccgccaagaagaagaaggccagcgtgcacctgcccagaatcggccacgccaccaagggcttcaactggtacggcaccgagagactgatcagaaagcacctggccgccagaggcatccccacctacatctactacttccccagaagcaagagcgccgtgctgcacagccagagcagcagcagcagcagcagacagctggtgccctag

SEQ ID NO: 18425 - DNA, 1851 bp, Artificial Sequence
  Description of Artificial Sequence: Synthetic coding sequence
atgagcgccctgcagaagaagtactacaaggccatcctgatgaaggacctggacgccttcgagaacgagaccgccaagaaggtgaagctgcagaacatcctgagccagctgagaaagtgcgtggaccacccctacctgttcgacggcgtggagcccgagcccttcgaggtgggcgaccacctgaccgaggccagcggcaagctgcacctgctggacaagctgctggccttcctgtacagcggcggccacagagtgctgctgttcagccagatgacccagatgctggacatcctgcaggactacatggactacagaggctacagctacgagagagtggacggcagcgtgagaggcgaggagagacacctggccatcaagaacttcggccagcagcccatcttcgtgttcctgctgagcaccagagccggcggcgtgggcatgaacctgaccgccgccgacaccgtgatcttcgtggacagcgacttcaacccccagaacgacctgcaggccgccgccagagcccacagaatcggccagaacaagagcgtgaaggtgatcagactgatcggcagagacaccgtggaggagatcgtgtacagaaaggccgccagcaagctgcagctgaccaacatgatcatcgagggcggccacttcaccctgggcgcccagaagcccgccgccgacgccgacctgcagctgagcgagatcctgaagttcggcctggacaagctgctggccagcgagggcagcaccatggacgagatcgacctggagagcatcctgggcgagaccaaggacggccagtgggtgagcgacgccctgcccgccgccgagggcggcagcagagaccaggaggagggcaagaaccacatgtacctgttcgagggcaaggactacagcaaggagcccagcaaggaggacagaaagagcttcgagcagctggtgaacctgcagaagaccctgctggagaaggccagccaggagggcagaagcctgagaaacaagggcagcgtgctgatccccggcctggtggagggcagcaccaagagaaagagagtgctgagccccgaggagctggaggacagacagaagaagagacaggaggccgccgccaagagaagaagactgatcgaggagaagaagagacagaaggaggaggccgagcacaagaagaagatggcctggtgggagagcaacaactaccagagcttctgcctgcccagcgaggagagcgagcccgaggacctggagaacggcgaggagagcagcgccgagctggactaccaggaccccgacgccaccagcctgaagtacgtgagcggcgacgtgacccacccccaggccggcgccgaggacgccctgatcgtgcactgcgtggacgacagcggccactggggcagaggcggcctgttcaccgccctggagaagagaagcgccgagcccagaaagatctacgagctggccggcaagatgaaggacctgagcctgggcggcgtgctgctgttccccgtggacgacaaggagagcagaaacaagggccaggacctgctggccctgatcgtggcccagcacagagacagaagcaacgtgctgagcggcatcaagatggccgccctggaggagggcctgaagaagatcttcctggccgccaagaagaagaaggccagcgtgcacctgcccagaatcggccacgccaccaagggcttcaactggtacggcaccgagagactgatcagaaagcacctggccgccagaggcatccccacctacatctactacttccccagaagcaagagcgccgtgctgcacagccagagcagcagcagcagcagcagacagctggtgccctag

SEQ ID NO: 18426 - DNA, 2694 bp, Artificial Sequence
  Description of Artificial Sequence: Synthetic coding sequence
atggagagagccggcgccaccagcagaggcggccaggcccccggcttcctgctgagactgcacaccgagggcagagccgaggccgccagagtgcaggagcaggacctgagacagtggggcctgaccggcatccacctgagaagctaccagctggagggcgtgaactggctggcccagagattccactgccagaacggctgcatcctgggcgacgagatgggcctgggcaagacctgccagaccatcgccctgttcatctacctggccggcagactgaacgacgagggccccttcctgatcctgtgccccctgagcgtgctgagcaactggaaggaggagatgcagagattcgcccccggcctgagctgcgtgacctacgccggcgacaaggaggagagagcctgcctgcagcaggacctgaagcaggagagcagattccacgtgctgctgaccacctacgagatctgcctgaaggacgccagcttcctgaagagcttcccctggagcgtgctggtggtggacgaggcccacagactgaagaaccagagcagcctgctgcacaagaccctgagcgagttcagcgtggtgttcagcctgctgctgaccggcacccccatccagaacagcctgcaggagctgtacagcctgctgagcttcgtggagcccgacctgttcagcaaggaggaggtgggcgacttcatccagagataccaggacatcgagaaggagagcgagagcgccagcgagctgcacaagctgctgcagcccttcctgctgagaagagtgaaggccgaggtggccaccgagctgcccaagaagaccgaggtggtgatctaccacggcatgagcgccctgcagaagaagtactacaaggccatcctgatgaaggacctggacgccttcgagaacgagaccgccaagaaggtgaagctgcagaacatcctgagccagctgagaaagtgcgtggaccacccctacctgttcgacggcgtggagcccgagcccttcgaggtgggcgaccacctgaccgaggccagcggcaagctgcacctgctggacaagctgctggccttcctgtacagcggcggccacagagtgctgctgttcagccagatgacccagatgctggacatcctgcaggactacatggactacagaggctacagctacgagagagtggacggcagcgtgagaggcgaggagagacacctggccatcaagaacttcggccagcagcccatcttcgtgttcctgctgagcaccagagccggcggcgtgggcatgaacctgaccgccgccgacaccgtgatcttcgtggacagcgacttcaacccccagaacgacctgcaggccgccgccagagcccacagaatcggccagaacaagagcgtgaaggtgatcagactgatcggcagagacaccgtggaggagatcgtgtacagaaaggccgccagcaagctgcagctgaccaacatgatcatcgagggcggccacttcaccctgggcgcccagaagcccgccgccgacgccgacctgcagctgagcgagatcctgaagttcggcctggacaagctgctggccagcgagggcagcaccatggacgagatcgacctggagagcatcctgggcgagaccaaggacggccagtgggtgagcgacgccctgcccgccgccgagggcggcagcagagaccaggaggagggcaagaaccacatgtacctgttcgagggcaaggactacagcaaggagcccagcaaggaggacagaaagagcttcgagcagctggtgaacctgcagaagaccctgctggagaaggccagccaggagggcagaagcctgagaaacaagggcagcgtgctgatccccggcctggtggagggcagcaccaagagaaagagagtgctgagccccgaggagctggaggacagacagaagaagagacaggaggccgccgccaagagaagaagactgatcgaggagaagaagagacagaaggaggaggccgagcacaagaagaagatggcctggtgggagagcaacaactaccagagcttctgcctgcccagcgaggagagcgagcccgaggacctggagaacggcgaggagagcagcgccgagctggactaccaggaccccgacgccaccagcctgaagtacgtgagcggcgacgtgacccacccccaggccggcgccgaggacgccctgatcgtgcactgcgtggacgacagcggccactggggcagaggcggcctgttcaccgccctggagaagagaagcgccgagcccagaaagatctacgagctggccggcaagatgaaggacctgagcctgggcggcgtgctgctgttccccgtggacgacaaggagagcagaaacaagggccaggacctgctggccctgatcgtggcccagcacagagacagaagcaacgtgctgagcggcatcaagatggccgccctggaggagggcctgaagaagatcttcctggccgccaagaagaagaaggccagcgtgcacctgcccagaatcggccacgccaccaagggcttcaactggtacggcaccgagagactgatcagaaagcacctggccgccagaggcatccccacctacatctactacttccccagaagcaagagcgccgtgctgcacagccagagcagcagcagcagcagcagacagctggtgccctag

SEQ ID NO: 18427 - DNA, 1983 bp, Artificial Sequence
  Description of Artificial Sequence: Synthetic coding sequence
atggaggccctgatggccagaggcgccctgaccggccccctgagagccctgtgcctgctgggctgcctgctgagccacgccgccgccgcccccagccccatcatcaagttccccggcgacgtggcccccaagaccgacaaggagctggccgtgcagtacctgaacaccttctacggctgccccaaggagagctgcaacctgttcgtgctgaaggacaccctgaagaagatgcagaagttcttcggcctgccccagaccggcgacctggaccagaacaccatcgagaccatgagaaagcccagatgcggcaaccccgacgtggccaactacaacttcttccccagaaagcccaagtgggacaagaaccagatcacctacagaatcatcggctacacccccgacctggaccccgagaccgtggacgacgccttcgccagagccttccaggtgtggagcgacgtgacccccctgagattcagcagaatccacgacggcgaggccgacatcatgatcaacttcggcagatgggagcacggcgacggctaccccttcgacggcaaggacggcctgctggcccacgccttcgcccccggcaccggcgtgggcggcgacagccacttcgacgacgacgagctgtggaccctgggcgagggccaggtggtgagagtgaagtacggcaacgccgacggcgagtactgcaagttccccttcctgttcaacggcaaggagtacaacagctgcaccgacaccggcagaagcgacggcttcctgtggtgcagcaccacctacaacttcgagaaggacggcaagtacggcttctgcccccacgaggccctgttcaccatgggcggcaacgccgagggccagccctgcaagttccccttcagattccagggcaccagctacgacagctgcaccaccgagggcagaaccgacggctacagatggtgcggcaccaccgaggactacgacagagacaagaagtacggcttctgccccgagaccgccatgagcaccgtgggcggcaacagcgagggcgccccctgcgtgttccccttcaccttcctgggcaacaagtacgagagctgcaccagcgccggcagaagcgacggcaagatgtggtgcgccaccaccgccaactacgacgacgacagaaagtggggcttctgccccgaccagggctacagcctgttcctggtggccgcccacgagttcggccacgccatgggcctggagcacagccaggaccccggcgccctgatggcccccatctacacctacaccaagaacttcagactgagccaggacgacatcaagggcatccaggagctgtacggcgccagccccgacatcgacctgggcaccggccccacccccaccctgggccccgtgacccccgagatctgcaagcaggacatcgtgttcgacggcatcgcccagatcagaggcgagatcttcttcttcaaggacagattcatctggagaaccgtgacccccagagacaagcccatgggccccctgctggtggccaccttctggcccgagctgcccgagaagatcgacgccgtgtacgaggccccccaggaggagaaggccgtgttcttcgccggcaacgagtactggatctacagcgccagcaccctggagagaggctaccccaagcccctgaccagcctgggcctgccccccgacgtgcagagagtggacgccgccttcaactggagcaagaacaagaagacctacatcttcgccggcgacaagttctggagatacaacgaggtgaagaagaagatggaccccggcttccccaagctgatcgccgacgcctggaacgccatccccgacaacctggacgccgtggtggacctgcagggcggcggccacagctacttcttcaagggcgcctactacctgaagctggagaaccagagcctgaagagcgtgaagttcggcagcatcaagagcgactggctgggctgctag

SEQ ID NO: 18428 - DNA, 8646 bp, Artificial Sequence
  Description of Artificial Sequence: Synthetic coding sequence
atgaccgaccccatgatggacttcttcgacgacgccaacctgttcggcgagaccctggagggcctgagcgacgacgccttcgtgcagcccggccccgtgagcctggtggacgagctgaacctgggcgccgagttcgagcccctgcacatcgacagcctgaaccacgtgcagggcacccccacccaccagaagatgaccgacttcgagcagctgaaccagttcgacagcatcaagttccaccacgtgaaccagagcttcggcagccccgccgagcacgtgctgagcccccacagccagttcaactgcagccccatccacccccagaaccagcccaacggcctgttccccgacgtgagcgacggcagccccatgtggggccaccagaccgccaccaccatcagcaaccagaacggcagccccttccaccagcagggccacagccacagcatgcaccagaacaagagcttcgtggcccaccacgacttcgccctgttccaggccaacgagcagcagacccagtgcaccagcctgagaagccagcagaacagaaacaacctgaaccccggccagaacagcctgagccagagcaagaacttcatgaacgtgagcggcccccacagagtgaacgtgaaccaccccccccagatgaccaacgccagcaacagccagcagagcatcagcatgcagcagttcagccagaccagcaaccccagcgcccacttccacaagtgcagcagccaccaggagggcaacttcaacggccccagccccaacatgaccagctgcagcgtgagcaacagccagcagttcagcagccactacagcttcagcagcaaccacatcagccccaacagcctgctgcagagcagcgccgtgctggccagcaaccacaccaaccagaccctgagcgacttcaccggcagcaacagcttcagcccccacagaggcatcaagcaggagagcacccagcacatcctgaaccccaacaccagcctgaacagcaacaacttccagatcctgcacagcagccacccccagggcaactacagcaacagcaagctgagccccgtgcacatgaacttccccgaccccgtggacagcggcacccagatgggccacttcaacgaccacgtggagaccaacggcttcagcagcctggaggagaacctgctgcaccaggtggagagccagaccgagcccttcaccggcctggaccccgaggacctgctgcaggagggcctgctgccccacttcgacgagagcaccttcggccaggacaacagcagccacatcctggaccacgacctggacagacagttcaccagccacctggtgaccagacccagcgacatggcccagacccagctgcagagccaggccagaagctggcacagcagcttcagcaaccaccagcacctgcacgacagaaaccacctgtgcctgcagagacagccccccagcagcaagaagagcgacggcagcggcacctacaccaagctgcagaacacccaggtgagagtgatgagcgagaagaagcagagaaagaaggtggagagcgagagcaagcaggagaaggccaacagaatcatcagcgaggccatcgccaaggccaaggagagaggcgagagaaacatccccagagtgatgagccccgagaacttccccaccgccagcgtggagggcaaggaggagaagaagggcagaagaatgaagagcaagcccaaggacaaggacagcaagaagaccaagacctgcagcaagctgaaggagaagaccaagatcggcaagctgatcatcaccctgggcaagaagcagaagagaaagaacgagagcagcgacgagatcagcgacgccgagcagatgccccagcacaccctgaaggaccaggacagccagaagagaagaagcaacagacagatcaagagaaagaagtacgccgaggacatcgagggcaagcagagcgaggaggaggtgaagggcagcatgaagatcaagaagaacagcgcccccctgcccggcgagcagcccctgcagctgttcgtggagaaccccagcgaggaggacgccgccatcgtggacaagatcctgagcagcagaaccgtgaagaaggagatcagccccggcgtgatgatcgacaccgaggagttcttcgtgaagtacaagaactacagctacctgcactgcgagtgggccaccgaggagcagctgctgaaggacaagagaatccagcagaagatcaagagattcaagctgagacaggcccagagagcccacttcttcgccgacatggaggaggagcccttcaaccccgactacgtggaggtggacagagtgctggaggtgagcttctgcgaggacaaggacaccggcgagcccgtgatctactacctggtgaagtggtgcagcctgccctacgaggacagcacctgggagctgaaggaggacgtggacctggccaagatcgaggagttcgagcagctgcaggccagcagacccgacaccagaagactggacagaccccccagcaacatctggaagaagatcgaccagagcagagactacaagaacggcaaccagctgagagagtaccagctggagggcctgaactggctgctgttcaactggtacaacagaagaaactgcatcctggccgacgagatgggcctgggcaagaccatccagagcatcaccttcctgtacgagatcctgctgaccggcatcagaggccccttcctgatcatcgcccccctgagcaccatcgccaactgggagagagagttcagaacctggaccgacatcaacgtggtggtgtaccacggcagcctgatcagcagacagatgatccagcagtacgagatgtacttcagagacagccagggcagaatcatcagaggcgcctacagattccaggccatcatcaccaccttcgagatgatcctgggcggctgcggcgagctgaacgccatcgagtggagatgcgtgatcatcgacgaggcccacagactgaagaacaagaactgcaagctgctggagggcctgaagctgatgaacctggagcacaaggtgctgctgaccggcacccccctgcagaacaccgtggaggagctgttcagcctgctgcacttcctggagcccctgagattccccagcgagagcaccttcatgcaggagttcggcgacctgaagaccgaggagcaggtgcagaagctgcaggccatcctgaagcccatgatgctgagaagactgaaggaggacgtggagaagaagctggcccccaaggaggagaccatcatcgaggtggagctgaccaacatccagaagaagtactacagagccatcctggagaagaacttcagcttcctgagcaagggcgccggccagaccaacgtgcccaacctggtgaacaccatgatggagctgagaaagtgctgcaaccacccctacctgatcaagggcgccgaggagaagatcctgggcgagttcagagacacctacaaccccgccgccagcgacttccacctgcaggccatgatccagagcgccggcaagctggtgctgatcgacaagctgctgcccaagatgaaggccggcggccacaaggtgctgatcttcagccagatggtgagatgcctggacatcctggaggactacctgatccacaagagatacctgtacgagagaatcgacggcagagtgagaggcaacctgagacaggccgccatcgacagattcagcaagcccgacagcgacagattcgtgttcctgctgtgcaccagagccggcggcctgggcatcaacctgaccgccgccgacacctgcatcatcttcgacagcgactggaacccccagaacgacctgcaggcccaggccagatgccacagaatcggccagaacaaggccgtgaaggtgtacagactggtgaccagaaacagctacgagagagagatgttcgacagagccagcctgaagctgggcctggacaaggccgtgctgcagagcatgagcggcagagagagcaacgtgggcggcatccagcagctgagcaagaaggagatcgaggacctgctgagaagaggcgcctacggcgccatcatggaggaggaggacgagggcagcaagttctgcgaggaggacatcgaccagatcctgctgagaagaaccaagaccatcaccatcgagagcgagggcagaggcagcaccttcgccaaggccagcttcgtggccagcggcaacagaaccgacatcagcctggacgaccccaacttctggcagaagtgggccaagaaggccgagatcgacatcgaggccatcagcggcagaaacagcctggtgatcgacacccccagaatcagaaagcagaccagacccttcagcgccaccaaggacgagctggccgagctgagcgaggccgagagcgagggcgacgagaagcccaagctgagaagaccctgcgacagaagcaacggctacggcagaaccgagtgcttcagagtggagaagaacctgctggtgtacggctggggcagatggagagagatcctgagccacggcagattcaagagacagctgaacgagcacgacgtggagatcatctgcagagccctgctggcctactgcctggtgcactacagaggcgacgagaagatcaagggcttcatctgggacctgatcacccccaccgaggacggccagaccagagagctgcagaaccacctgggcctgagcgcccccgtgcccagaggcagaaagggcaagaaggtgaagacccagaccagcagcttcgacatccagaaggccgagtggctgagaaagtacaaccccgagcagctgctgcaggacgagggctacaagaagcacatcaagcaccactgcaacaaggtgctgctgagagtgagaatgctgtactacctgaagcaggaggtgatcggcaacgagtgccagaaggtgttcgacggcgtggacgccagcgacatcgacgtgtgggtgcccgagcccgaccacagcgaggtgcccgccgagtggtgggacttcgacgccgacaagagcctgctgatcggcgtgttcaagcacggctacgagaagtacaacaccatcagagccgaccccgccctgtgcttcctggagagagtgggcaagcccgacgagaaggccgtggccgccgagcagagagccaacgactacatggacggcgacgtggaggaccccgagtacaagcccgcccccgccatcttcaaggacgacatcgaggacgacgtgagcagccccggcgacctggtgatcgccgacggcgacggccagctgatggagggcgacaaggtgtactggcccacccagagcgccctgaccaccagactgagaagactgatcaccgcctaccagagaaccaacaagaacagacagatccagcagatccagcccaccttcagcgtgcccaccagcgtgatgcagcccatctacgaggaggccaccctgaaccccaagatggccgccaagatcgagagacagcagagatggaccagaagagaggaggccgacttctacagagtggtgagcaccttcggcgtggtgttcgaccccgacagaggccagttcgactggaccaagttcagagccatggccagactgcacaagaagaccgacgacagcctggagaagtacctgtacgccttcatgagcatgtgcagaagagtgtgcagactgcccagcaaggaggagctggtggaccccaacatcttcatccagcccatcaccgaggagagagccagcagaaccctgtacagaatcgagctgctgagaaaggtgagagagcaggccctgagacacccccagctgttcgagagactgaagctgtgccaccccaaccccgacctgcccgtgtggtgggagtgcggcccccacgacagagacctgctgatcggcgccgccaagcacggcgtgagcagaaccgactaccacatcctgagagaccccgagctgagcttcatggccgcccagagaaactacagccagagcaagatggcccacagcagaaccagcacccccctgctgcagcagtaccaggtggccctgagcgccagccccctgaccagcctgcccagactgctggacgccaagggcatcatcctggaggagatgaaggtgaagagcgagaacctgaaggaggagccccagagcagcgaggaggagagcatgagcagcgtggagaccagaaccctgatcaagagcgagcccgtgagccccaagaacggcgtgctgccccaggccaccggcgaccagaagagcggcggcaagtgcgagaccgacagaagaatggtggccgccagaaccgagcccctgacccccaaccccgccagcaagaagcccagagtgcacaagagaggcagcgagagcagcagcgacagcgacagcgacagcgagagaagcagctgcagcagcagaagcagcagcagcagcagcagcagcagctgcagccacagcagaagcggcagcagcagcagcagcagcagcagctgcagcagcgccagcagcagcagcagcagcagcaccagcagcagcagcagcagcagcagcagcagcagcgaggagagcgacagcgacgaggaggaggcccagaagagagagagcaccacccacatgaaggcctacgacgaggagagcgtggccagcctgagcaccacccaggacgagacccaggacagcttccagatgaacaacggcacccccgagagcgcctacatcctgcagggcggctacatgctggccgccagctactggcccaaggacagagtgatgatcaacagactggacagcatctgccagaccgtgctgaagggcaagtggcccagcgccagaagaagctacgacgccaacaccgtggccagcttctacaccaccaagctgctggacagccccggcgccgccaccgagtacagcgaccccagcgtgcccaccccccccggcgccggcgtgaaggaggagcacgaccagagcacccagatgagcaaggagggcggcctgaagctgaccttccagaagcagggcctggcccagaagagacccttcgacggcgaggacggcgccctgggccagcagcagtacctgaccagactgagagagctgcagagcgccagcgagaccagcctggtgaacttccccaagagcatccccgtgagcggcaccagcatccagcccaccctgggcgccaacggcgtgatcctggacaaccagcccatcgtgaagaagagaagaggcagaagaaagaacgtggagggcgtggacatcttcttcttcaacagaaacaagccccccaaccacgtgagcctgggcctgaccagcagccagatcagcaccggcatcaaccccgccctgagctacacccagccccagggcatccccgacaccgagagccccgtgcccgtgatcaacctgaaggacggcaccagactggccggcgacgacgcccccaagagaaaggacctggagaagtggctgaaggagcaccccggctacgtggaggacctgggcgccttcatccccagaatgcagctgcacgagggcagacccaagcagaagagacacagatgcagaaaccccaacaagctggacgtgaacagcctgaccggcgaggagagagtgcagctgatcaacagaagaaacgccagaaaggtgggcggcgccttcgccccccccctgaaggacctgtgcagattcctgaaggagaacagcgagtacggcgtggcccccgagtggggcgacgtggtgaagcagagcggcttcctgcccgagagcatgtacgagagaatcctgaccggccccgtggtgagagaggaggtgagcagaagaggcagaagacccaagagcggcatcgccaaggccaccgccgccgccgccgccgccagcgccaccagcgtgagcggcaaccccctgctggccaacggcctgctgcccggcgtggacctgaccaccctgcaggccctgcagcagaacctgcagaacctgcagagcctgcaggtgaccgccggcctgatgggcatgcccaccggcctgcccagcggcggcgaggccaagaacatggccgccatgttccccatgctgctgagcggcatggccggcctgcccaacctgctgggcatgggcggcctgctgaccaagcccaccgagagcggcaccgaggacaagaagggcagcgacagcaaggagagcgagggcaagaccgagagaaccgagagccagagcagcgagaacggcggcgagaacagcgtgagcagcagccccagcaccagcagcaccgccgccctgaacaccgccgccgccgccaaccccctggccctgaaccccctgctgctgagcaacatcctgtaccccggcatgctgctgacccccggcctgaacctgcacatccccaccctgagccagagcaacaccttcgacgtgcagaacaagaacagcgacctgggcagcagcaagagcgtggaggtgaaggaggaggacagcagaatcaaggaccaggaggacaagggcggcaccgagcccagccccctgaacgagaacagcaccgacgagggcagcgagaaggccgacgccagcagcggcagcgacagcaccagcagcagcagcgaggacagcgacagcagcaacgaggactag

SEQ ID NO: 18429 - DNA, 8649 bp, Artificial Sequence
  Description of Artificial Sequence: Synthetic coding sequence
atgaccgaccccatgatggacttcttcgacgacgccaacctgttcggcgagaccctggagggcctgagcgacgacgccttcgtgcagcccggccccgtgagcctggtggacgagctgaacctgggcgccgagttcgagcccctgcacatcgacagcctgaaccacgtgcagggcacccccacccaccagaagatgaccgacttcgagcagctgaaccagttcgacagcatcaagttccaccacgtgaaccagagcttcggcagccccgccgagcacgtgctgagcccccacagccagttcaactgcagccccatccacccccagaaccagcccaacggcctgttccccgacgtgagcgacggcagccccatgtggggccaccagaccgccaccaccatcagcaaccagaacggcagccccttccaccagcagggccacagccacagcatgcaccagaacaagagcttcgtggcccaccacgacttcgccctgttccaggccaacgagcagcagacccagtgcaccagcctgagaagccagcagaacagaaacaacctgaaccccggccagaacagcctgagccagagcaagaacttcatgaacgtgagcggcccccacagagtgaacgtgaaccaccccccccagatgaccaacgccagcaacagccagcagagcatcagcatgcagcagttcagccagaccagcaaccccagcgcccacttccacaagtgcagcagccaccaggagggcaacttcaacggccccagccccaacatgaccagctgcagcgtgagcaacagccagcagttcagcagccactacagcttcagcagcaaccacatcagccccaacagcctgctgcagagcagcgccgtgctggccagcaaccacaccaaccagaccctgagcgacttcaccggcagcaacagcttcagcccccacagaggcatcaagcaggagagcacccagcacatcctgaaccccaacaccagcctgaacagcaacaacttccagatcctgcacagcagccacccccagggcaactacagcaacagcaagctgagccccgtgcacatgaacttccccgaccccgtggacagcggcacccagatgggccacttcaacgaccacgtggagaccaacggcttcagcagcctggaggagaacctgctgcaccaggtggagagccagaccgagcccttcaccggcctggaccccgaggacctgctgcaggagggcctgctgccccacttcgacgagagcaccttcggccaggacaacagcagccacatcctggaccacgacctggacagacagttcaccagccacctggtgaccagacccagcgacatggcccagacccagctgcagagccaggccagaagctggcacagcagcttcagcaaccaccagcacctgcacgacagaaaccacctgtgcctgcagagacagccccccagcagcaagaagagcgacggcagcggcacctacaccaagctgcagaacacccaggtgagagtgatgagcgagaagaagcagagaaagaaggtggagagcgagagcaagcaggagaaggccaacagaatcatcagcgaggccatcgccaaggccaaggagagaggcgagagaaacatccccagagtgatgagccccgagaacttccccaccgccagcgtggagggcaaggaggagaagaagggcagaagaatgaagagcaagcccaaggacaaggacagcaagaagaccaagacctgcagcaagctgaaggagaagaccaagatcggcaagctgatcatcaccctgggcaagaagcagaagagaaagaacgagagcagcgacgagatcagcgacgccgagcagatgccccagcacaccctgaaggaccaggacagccagaagagaagaagcaacagacagatcaagagaaagaagtacgccgaggacatcgagggcaagcagagcgaggaggaggtgaagggcagcatgaagatcaagaagaacagcgcccccctgcccggcgagcagcccctgcagctgttcgtggagaaccccagcgaggaggacgccgccatcgtggacaagatcctgagcagcagaaccgtgaagaaggagatcagccccggcgtgatgatcgacaccgaggagttcttcgtgaagtacaagaactacagctacctgcactgcgagtgggccaccgaggagcagctgctgaaggacaagagaatccagcagaagatcaagagattcaagctgagacaggcccagagagcccacttcttcgccgacatggaggaggagcccttcaaccccgactacgtggaggtggacagagtgctggaggtgagcttctgcgaggacaaggacaccggcgagcccgtgatctactacctggtgaagtggtgcagcctgccctacgaggacagcacctgggagctgaaggaggacgtggacctggccaagatcgaggagttcgagcagctgcaggccagcagacccgacaccagaagactggacagaccccccagcaacatctggaagaagatcgaccagagcagagactacaagaacggcaaccagctgagagagtaccagctggagggcctgaactggctgctgttcaactggtacaacagaagaaactgcatcctggccgacgagatgggcctgggcaagaccatccagagcatcaccttcctgtacgagatcctgctgaccggcatcagaggccccttcctgatcatcgcccccctgagcaccatcgccaactgggagagagagttcagaacctggaccgacatcaacgtggtggtgtaccacggcagcctgatcagcagacagatgatccagcagtacgagatgtacttcagagacagccagggcagaatcatcagaggcgcctacagattccaggccatcatcaccaccttcgagatgatcctgggcggctgcggcgagctgaacgccatcgagtggagatgcgtgatcatcgacgaggcccacagactgaagaacaagaactgcaagctgctggagggcctgaagctgatgaacctggagcacaaggtgctgctgaccggcacccccctgcagaacaccgtggaggagctgttcagcctgctgcacttcctggagcccctgagattccccagcgagagcaccttcatgcaggagttcggcgacctgaagaccgaggagcaggtgcagaagctgcaggccatcctgaagcccatgatgctgagaagactgaaggaggacgtggagaagaagctggcccccaaggaggagaccatcatcgaggtggagctgaccaacatccagaagaagtactacagagccatcctggagaagaacttcagcttcctgagcaagggcgccggccagaccaacgtgcccaacctggtgaacaccatgatggagctgagaaagtgctgcaaccacccctacctgatcaagggcgccgaggagaagatcctgggcgagttcagagacacctacaaccccgccgccagcgacttccacctgcaggccatgatccagagcgccggcaagctggtgctgatcgacaagctgctgcccaagatgaaggccggcggccacaaggtgctgatcttcagccagatggtgagatgcctggacatcctggaggactacctgatccacaagagatacctgtacgagagaatcgacggcagagtgagaggcaacctgagacaggccgccatcgacagattcagcaagcccgacagcgacagattcgtgttcctgctgtgcaccagagccggcggcctgggcatcaacctgaccgccgccgacacctgcatcatcttcgacagcgactggaacccccagaacgacctgcaggcccaggccagatgccacagaatcggccagaacaaggccgtgaaggtgtacagactggtgaccagaaacagctacgagagagagatgttcgacagagccagcctgaagctgggcctggacaaggccgtgctgcagagcatgagcggcagagagagcaacgtgggcggcatccagcagctgagcaagaaggagatcgaggacctgctgagaagaggcgcctacggcgccatcatggaggaggaggacgagggcagcaagttctgcgaggaggacatcgaccagatcctgctgagaagaaccaagaccatcaccatcgagagcgagggcagaggcagcaccttcgccaaggccagcttcgtggccagcggcaacagaaccgacatcagcctggacgaccccaacttctggcagaagtgggccaagaaggccgagatcgacatcgaggccatcagcggcagaaacagcctggtgatcgacacccccagaatcagaaagcagaccagacccttcagcgccaccaaggacgagctggccgagctgagcgaggccgagagcgagggcgacgagaagcccaagctgagaagaccctgcgacagaagcaacggctacggcagaaccgagtgcttcagagtggagaagaacctgctggtgtacggctggggcagatggagagagatcctgagccacggcagattcaagagacagctgaacgagcacgacgtggagatcatctgcagagccctgctggcctactgcctggtgcactacagaggcgacgagaagatcaagggcttcatctgggacctgatcacccccaccgaggacggccagaccagagagctgcagaaccacctgggcctgagcgcccccgtgcccagaggcagaaagggcaagaaggtgaagacccagaccagcagcttcgacatccagaaggccgagtggctgagaaagtacaaccccgagcagctgctgcaggacgagggctacaagaagcacatcaagcaccactgcaacaaggtgctgctgagagtgagaatgctgtactacctgaagcaggaggtgatcggcaacgagtgccagaaggtgttcgacggcgtggacgccagcgacatcgacgtgtgggtgcccgagcccgaccacagcgaggtgcccgccgagtggtgggacttcgacgccgacaagagcctgctgatcggcgtgttcaagcacggctacgagaagtacaacaccatcagagccgaccccgccctgtgcttcctggagagagtgggcaagcccgacgagaaggccgtggccgccgagcagagagccaacgactacatggacggcgacgtggaggaccccgagtacaagcccgcccccgccatcttcaaggacgacatcgaggacgacgtgagcagccccggcgacctggtgatcgccgacggcgacggccagctgatggagggcgacaaggtgtactggcccacccagagcgccctgaccaccagactgagaagactgatcaccgcctaccagagaaccaacaagaacagacagatccagcagatccagcccaccttcagcgtgcccaccagcgtgatgcagcccatctacgaggaggccaccctgaaccccaagatggccgccaagatcgagagacagcagagatggaccagaagagaggaggccgacttctacagagtggtgagcaccttcggcgtggtgttcgaccccgacagaggccagttcgactggaccaagttcagagccatggccagactgcacaagaagaccgacgacagcctggagaagtacctgtacgccttcatgagcatgtgcagaagagtgtgcagactgcccagcaaggaggagctggtggaccccaacatcttcatccagcccatcaccgaggagagagccagcagaaccctgtacagaatcgagctgctgagaaaggtgagagagcaggccctgagacacccccagctgttcgagagactgaagctgtgccaccccaaccccgacctgcccgtgtggtgggagtgcggcccccacgacagagacctgctgatcggcgccgccaagcacggcgtgagcagaaccgactaccacatcctgagagaccccgagctgagcttcatggccgcccagagaaactacagccagagcaagatggcccacagcagaaccagcacccccctgctgcagcagtaccaggtggccctgagcgccagccccctgaccagcctgcccagactgctggacgccaagggcatcatcctggaggagatgaaggtgaagagcgagaacctgaaggaggagccccagagcagcgaggaggagagcatgagcagcgtggagaccagaaccctgatcaagagcgagcccgtgagccccaagaacggcgtgctgccccaggccaccggcgaccagaagagcggcggcaagtgcgagaccgacagaagaatggtggccgccagaaccgagcccctgacccccaaccccgccagcaagaagcccagagtgcacaagagaggcagcgagagcagcagcgacagcgacagcgacagcgagagaagcagctgcagcagcagaagcagcagcagcagcagcagcagcagctgcagccacagcagaagcggcagcagcagcagcagcagcagcagctgcagcagcgccagcagcagcagcagcagcagcaccagcagcagcagcagcagcagcagcagcagcagcgaggagagcgacagcgacgaggaggaggcccagaagagagccgagagcaccacccacatgaaggcctacgacgaggagagcgtggccagcctgagcaccacccaggacgagacccaggacagcttccagatgaacaacggcacccccgagagcgcctacatcctgcagggcggctacatgctggccgccagctactggcccaaggacagagtgatgatcaacagactggacagcatctgccagaccgtgctgaagggcaagtggcccagcgccagaagaagctacgacgccaacaccgtggccagcttctacaccaccaagctgctggacagccccggcgccgccaccgagtacagcgaccccagcgtgcccaccccccccggcgccggcgtgaaggaggagcacgaccagagcacccagatgagcaaggagggcggcctgaagctgaccttccagaagcagggcctggcccagaagagacccttcgacggcgaggacggcgccctgggccagcagcagtacctgaccagactgagagagctgcagagcgccagcgagaccagcctggtgaacttccccaagagcatccccgtgagcggcaccagcatccagcccaccctgggcgccaacggcgtgatcctggacaaccagcccatcgtgaagaagagaagaggcagaagaaagaacgtggagggcgtggacatcttcttcttcaacagaaacaagccccccaaccacgtgagcctgggcctgaccagcagccagatcagcaccggcatcaaccccgccctgagctacacccagccccagggcatccccgacaccgagagccccgtgcccgtgatcaacctgaaggacggcaccagactggccggcgacgacgcccccaagagaaaggacctggagaagtggctgaaggagcaccccggctacgtggaggacctgggcgccttcatccccagaatgcagctgcacgagggcagacccaagcagaagagacacagatgcagaaaccccaacaagctggacgtgaacagcctgaccggcgaggagagagtgcagctgatcaacagaagaaacgccagaaaggtgggcggcgccttcgccccccccctgaaggacctgtgcagattcctgaaggagaacagcgagtacggcgtggcccccgagtggggcgacgtggtgaagcagagcggcttcctgcccgagagcatgtacgagagaatcctgaccggccccgtggtgagagaggaggtgagcagaagaggcagaagacccaagagcggcatcgccaaggccaccgccgccgccgccgccgccagcgccaccagcgtgagcggcaaccccctgctggccaacggcctgctgcccggcgtggacctgaccaccctgcaggccctgcagcagaacctgcagaacctgcagagcctgcaggtgaccgccggcctgatgggcatgcccaccggcctgcccagcggcggcgaggccaagaacatggccgccatgttccccatgctgctgagcggcatggccggcctgcccaacctgctgggcatgggcggcctgctgaccaagcccaccgagagcggcaccgaggacaagaagggcagcgacagcaaggagagcgagggcaagaccgagagaaccgagagccagagcagcgagaacggcggcgagaacagcgtgagcagcagccccagcaccagcagcaccgccgccctgaacaccgccgccgccgccaaccccctggccctgaaccccctgctgctgagcaacatcctgtaccccggcatgctgctgacccccggcctgaacctgcacatccccaccctgagccagagcaacaccttcgacgtgcagaacaagaacagcgacctgggcagcagcaagagcgtggaggtgaaggaggaggacagcagaatcaaggaccaggaggacaagggcggcaccgagcccagccccctgaacgagaacagcaccgacgagggcagcgagaaggccgacgccagcagcggcagcgacagcaccagcagcagcagcgaggacagcgacagcagcaacgaggactag

SEQ ID NO: 18430 - DNA, 2892 bp, Artificial Sequence
  Description of Artificial Sequence: Synthetic coding sequence
atgctgtactacctgaagcaggaggtgatcggcaacgagtgccagaaggtgttcgacggcgtggacgccagcgacatcgacgtgtgggtgcccgagcccgaccacagcgaggtgcccgccgagtggtgggacttcgacgccgacaagagcctgctgatcggcgtgttcaagcacggctacgagaagtacaacaccatcagagccgaccccgccctgtgcttcctggagagagtgggcaagcccgacgagaaggccgtggccgccgagcagagagccaacgactacatggacggcgacgtggaggaccccgagtacaagcccgcccccgccatcttcaaggacgacatcgaggacgacgtgagcagccccggcgacctggtgatcgccgacggcgacggccagctgatggagggcgacaaggtgtactggcccacccagagcgccctgaccaccagactgagaagactgatcaccgcctaccagagaaccaacaagaacagacagatccagcagatccagcccaccttcagcgtgcccaccagcgtgatgcagcccatctacgaggaggccaccctgaaccccaagatggccgccaagatcgagagacagcagagatggaccagaagagaggaggccgacttctacagagtggtgagcaccttcggcgtggtgttcgaccccgacagaggccagttcgactggaccaagttcagagccatggccagactgcacaagaagaccgacgacagcctggagaagtacctgtacgccttcatgagcatgtgcagaagagtgtgcagactgcccagcaaggaggagagcaccacccacatgaaggcctacgacgaggagagcgtggccagcctgagcaccacccaggacgagacccaggacagcttccagatgaacaacggcacccccgagagcgcctacatcctgcagggcggctacatgctggccgccagctactggcccaaggacagagtgatgatcaacagactggacagcatctgccagaccgtgctgaagggcaagtggcccagcgccagaagaagctacgacgccaacaccgtggccagcttctacaccaccaagctgctggacagccccggcgccgccaccgagtacagcgaccccagcgtgcccaccccccccggcgccggcgtgaaggaggagcacgaccagagcacccagatgagcaaggtgaagaagcacgtgagagagaaggagttcaccgtgaagatcaaggacgagggcggcctgaagctgaccttccagaagcagggcctggcccagaagagacccttcgacggcgaggacggcgccctgggccagcagcagtacctgaccagactgagagagctgcagagcgccagcgagaccagcctggtgaacttccccaagagcatccccgtgagcggcaccagcatccagcccaccctgggcgccaacggcgtgatcctggacaaccagcccatcgtgaagaagagaagaggcagaagaaagaacgtggagggcgtggacatcttcttcttcaacagaaacaagccccccaaccacgtgagcctgggcctgaccagcagccagatcagcaccggcatcaaccccgccctgagctacacccagccccagggcatccccgacaccgagagccccgtgcccgtgatcaacctgaaggacggcaccagactggccggcgacgacgcccccaagagaaaggacctggagaagtggctgaaggagcaccccggctacgtggaggacctgggcgccttcatccccagaatgcagctgcacgagggcagacccaagcagaagagacacagatgcagaaaccccaacaagctggacgtgaacagcctgaccggcgaggagagagtgcagctgatcaacagaagaaacgccagaaaggtgggcggcgccttcgccccccccctgaaggacctgtgcagattcctgaaggagaacagcgagtacggcgtggcccccgagtggggcgacgtggtgaagcagagcggcttcctgcccgagagcatgtacgagagaatcctgaccggccccgtggtgagagaggaggtgagcagaagaggcagaagacccaagagcggcatcgccaaggccaccgccgccgccgccgccgccagcgccaccagcgtgagcggcaaccccctgctggccaacggcctgctgcccggcgtggacctgaccaccctgcaggccctgcagcagaacctgcagaacctgcagagcctgcaggtgaccgccggcctgatgggcatgcccaccggcctgcccagcggcggcgaggccaagaacatggccgccatgttccccatgctgctgagcggcatggccggcctgcccaacctgctgggcatgggcggcctgctgaccaagcccaccgagagcggcaccgaggacaagaagggcagcgacagcaaggagagcgagggcaagaccgagagaaccgagagccagagcagcgagaacggcggcgagaacagcgtgagcagcagccccagcaccagcagcaccgccgccctgaacaccgccgccgccgccaaccccctggccctgaaccccctgctgctgagcaacatcctgtaccccggcatgctgctgacccccggcctgaacctgcacatccccaccctgagccagagcaacaccttcgacgtgcagaacaagaacagcgacctgggcagcagcaagagcgtggaggtgaaggaggaggacagcagaatcaaggaccaggaggacaagggcggcaccgagcccagccccctgaacgagaacagcaccgacgagggcagcgagaaggccgacgccagcagcggcagcgacagcaccagcagcagcagcgaggacagcgacagcagcaacgaggactag

SEQ ID NO: 18431 - DNA, 8646 bp, Artificial Sequence; identical to SEQ ID NO: 18428
  Description of Artificial Sequence: Synthetic coding sequence

SEQ ID NO: 18432 - DNA, 444 bp, Artificial Sequence
  Description of Artificial Sequence: Synthetic coding sequence
atgaccgccatcagactgagagagttcatcgagagaagacccgtgatcccccccagcatcttcatcgcccaccagggcagagacgtgcagggctactaccccggccagctggccagactgcacttcgaccacagcgccaagagagcccccagacccctgatcgacctgaccatcccccccaagaccaagtaccactaccagccccagctggaccagcagaccctgatcagatacatctgcctgagaagacacagcaagcccgccgagccctggtacaaggagaccacctacagaagagactacagcctgcccttctacgagatcgactggaaccagaagctggccaccgtgagcctgaaccccagacccctgaacagcctgcccgagctgtactgctgcgaggagagaagcagcttcgagagaaacgccttcaagctgaagtag

SEQ ID NO: 18433 - DNA, 348 bp, Artificial Sequence
  Description of Artificial Sequence: Synthetic coding sequence
atgaccgccatcagactgagagagttcatcgagagaagacccgtgatcccccccagcatcttcatcgcccaccagggcagagacgtgcagggctactaccccggccagctggccagactgcacttcgaccacagcgccaagagagcccccagacacagcaagcccgccgagccctggtacaaggagaccacctacagaagagactacagcctgcccttctacgagatcgactggaaccagaagctggccaccgtgagcctgaaccccagacccctgaacagcctgcccgagctgtactgctgcgaggagagaagcagcttcgagagaaacgccttcaagctgaagtag

SEQ ID NO: 18434 - DNA, 552 bp, Artificial Sequence
  Description of Artificial Sequence: Synthetic coding sequence
atggagaagagagagctgaaggccagcgtgcccaagttcgacaagatcccctggctgagcgaggccagcctggtgaacaagcccctggtgctgagcctgcccagaagatacccccacaccagcgccaccttcctgaccagcagcaagaagaacatgaacctgcccatcctgttccaggtgcccgacgtgctgagcaaggccagaagaaaccagtgcgacagcatgctgctgagaaaccagcagctgtgcagcacctgccaggagatgaagatggtgcagcccagaaccatgaagatccccgacgaccccaaggccagcttcgagaactgcatgagctacagaatgagcctgcaccagcccaagttccagaccacccccgagcccttccacgacgacatccccaccgagagcatccactacagactgcccatcctgggccccagaaccgccgtgttccacggcctgctgaccgaggcctacaagaccctgaaggagagacagagaagcagcctgcccagaaaggagcccatcggcaagaccaccagacagtag

SEQ ID NO: 18435 - DNA, 1992 bp, Artificial Sequence
  Description of Artificial Sequence: Synthetic coding sequence
atgctgcagatgcccaagctgaacgagatcccccccggcagagccggcagaagagaggccagaggcgagggcagatggcccggccagaccggccccgaggccgccagactggagtggagagcccagggccaggccggcggcgccagagccccctgggacagctggggcagcagcagactgcccacccagcccggccccggctggagcagatgcccccccagcctgctgtgcgccctgagcttccagaagagcaccatggagagcaaggacgaggtgagcgacaccgacagcggcatcatcctgcagagcggccccgacagccccgtgagccccatgaaggagctgacccacgccgtgcacaagcagcagagagccctggaggccagactggaggcctgcctggaggagctgagaagactgtgcctgagagaggccgagctgaccggcaccctgcccgccgagtaccccctgaagcccggcgagaaggcccccaaggtgagaagaagaatcggcgccgcctacaagctggacgactgggccctgcacagagaggaccccctgagcagcctggagagacagctggccctgcagctgcagatcaccgaggccgccagaagactgtgcctggaggagaacctgagcagacaggccagaagacagagaaagcacagcatgctgcaggaggagaagaagctgcaggagctgcagagatgcctggtggagagaagaagaaacagcgagcccccccccgccgccgccctgcccctgggcagagagctgagcgccagcgacgacagcagcctgagcgacggcctgctgctggaggaggaggagagccaggtgcccaagcccccccccgagagccccgccccccccagcagacccctgcccccccagaccctggagggcctgcagcccaccggccccgaggccggcagccccgagagagcccccgtgcagaacagcccctggaaggagaccagcctggaccacccctacgagaagcccagaaagagcagcgagccctggagcgagagcagcagccccgccaccaccccccaggacggccccagcgccagcagcctgtggctgctggagcccgccagctaccacgtggtgcccatcagaggcgtgcccggccagtggcagggcagaaccagcgcccccgccacccccgagatccagggcagaagaggccagagccagagcctgagagtggacagcttcagagccggccccgagggcagaggcagaagcgccttccccagaagaagacccacccactacaccgtgaccgtgcccgacagctgcttccccgccaccaagccccccctgccccacgccgcctgccacagctgcagcgaggacagcggcagcgacgtgagcagcatcagccaccccaccagccccggcagcagcagccccgacatcagcttcctgcagcccctgagcccccccaagacccacagacacagaggcgcctgggtgcccgccggcagcagagagctggtggcccaccaccccaagctgctgctgccccccggctacttccccgccggcagatacgtggtggtggccgagagccccctgccccccggcgagtgggagctgagaagagccgcccccggccccgcctacgaggaggagggcacccccctgagataccagagactggtgcccagcagaagcagaatcgtgagaacccccagcctgaaggacagccccgccggcagaggcctgagcaaggccgccgtgagcgaggagctgaagtggtggcacgagagagccagactgagaagcaccagaccccacagcctggacagacagggcgccttcagagtgagaagcctgcccctgggcagagagggcttcggcagagccctgggccccagagcccaggtgcccaccgtgtgcgtgctgagaagaagccccgacggcgcccccgtgcaggtgttcgtgcccgagaagggcgagatcatcagccaggtgtag

SEQ ID NO: 18436 - DNA, 1737 bp, Artificial Sequence
  Description of Artificial Sequence: Synthetic coding sequence
atggagagcaaggacgaggtgagcgacaccgacagcggcatcatcctgcagagcggccccgacagccccgtgagccccatgaaggagctgacccacgccgtgcacaagcagcagagagccctggaggccagactggaggcctgcctggaggagctgagaagactgtgcctgagagaggccgagctgaccggcaccctgcccgccgagtaccccctgaagcccggcgagaaggcccccaaggtgagaagaagaatcggcgccgcctacaagctggacgactgggccctgcacagagaggaccccctgagcagcctggagagacagctggccctgcagctgcagatcaccgaggccgccagaagactgtgcctggaggagaacctgagcagacaggccagaagacagagaaagcacagcatgctgcaggaggagaagaagctgcaggagctgcagagatgcctggtggagagaagaagaaacagcgagcccccccccgccgccgccctgcccctgggcagagagctgagcgccagcgacgacagcagcctgagcgacggcctgctgctggaggaggaggagagccaggtgcccaagcccccccccgagagccccgccccccccagcagacccctgcccccccagaccctggagggcctgcagcccaccggccccgaggccggcagccccgagagagcccccgtgcagaacagcccctggaaggagaccagcctggaccacccctacgagaagcccagaaagagcagcgagccctggagcgagagcagcagccccgccaccaccccccaggacggccccagcgccagcagcctgtggctgctggagcccgccagctaccacgtggtgcccatcagaggcgtgcccggccagtggcagggcagaaccagcgcccccgccacccccgagatccagggcagaagaggccagagccagagcctgagagtggacagcttcagagccggccccgagggcagaggcagaagcgccttccccagaagaagacccacccactacaccgtgaccgtgcccgacagctgcttccccgccaccaagccccccctgccccacgccgcctgccacagctgcagcgaggacagcggcagcgacgtgagcagcatcagccaccccaccagccccggcagcagcagccccgacatcagcttcctgcagcccctgagcccccccaagacccacagacacagaggcgcctgggtgcccgccggcagcagagagctggtggcccaccaccccaagctgctgctgccccccggctacttccccgccggcagatacgtggtggtggccgagagccccctgccccccggcgagtgggagctgagaagagccgcccccggccccgcctacgaggaggagggcacccccctgagataccagagactggtgcccagcagaagcagaatcgtgagaacccccagcctgaaggacagccccgccggcagaggcctgagcaaggccgccgtgagcgaggagctgaagtggtggcacgagagagccagactgagaagcaccagaccccacagcctggacagacagggcgccttcagagtgagaagcctgcccctgggcagagagggcttcggcagagccctgggccccagagcccaggtgcccaccgtgtgcgtgctgagaagaagccccgacggcgcccccgtgcaggtgttcgtgcccgagaagggcgagatcatcagccaggtgtag

SEQ ID NO: 18437 - DNA, 372 bp, Artificial Sequence
  Description of Artificial Sequence: Synthetic coding sequence
atggagagcaaggacgaggtgagcgacaccgacagcggcatcatcctgcagagcggccccgacagccccgtgagccccatgaaggagctgacccacgccgtgcacaagcagcagagagccctggaggccagactggaggcctgcctggaggagctgagaagactgtgcctgagagaggccgagctgaccggcaccctgcccgccgagtaccccctgaagcccggcgagaaggcccccaaggtgagaagaagaatcggcgccgcctacaagctggacgactgggccctgcacagagaggaccccctgagcagcctggagagacagctggccctgcagctgcagatcaccgaggccgccagaagactgtgctag

SEQ ID NO: 18438 - DNA, 123 bp, Artificial Sequence
  Description of Artificial Sequence: Synthetic coding sequence
atggagagcaaggacgaggtgagcgacaccgacagcggcatcatcctgcagagcggccccgacagccccgtgagccccatgaaggagctgacccacgccgtgcacaagcagcagagagcctag

SEQ ID NO: 18439 - DNA, 612 bp, Artificial Sequence
  Description of Artificial Sequence: Synthetic coding sequence
atgacccaggacagacccctgctggccgtgcaggaggccctgaagaagtgcttccccgtggtggaggagcagcagggcctgtggcagagcgccctgagagactgccagcccctgctgagcagcctgagcaacctggccgagcagctgcaggccgcccagaacctgagattcgaggacgtgcccgccctgagagccttccccgacctgaaggagagactgagaagaaagcagctggtggccggcgacatcgtgctggacaagctgggcgagagactggccatcctgctgaaggtgagagacatggtgagcagccacgtggagagagtgttccagatctacgagcagcacgccgacaccgtgggcatcgacgccgtgctgcagcccagcgccgtgagccccagcgtggccgacatgctggagtggctgcaggacatcgagagacactacagaaagagctacctgaagagaaagtacctgctgagcagcatccagtggggcgacctggccaacatccaggccctgcccaaggcctgggacagaatcagcaaggacgagcaccaggacctggtgcaggacatcctgctgaacgtgagcttcttcctggaggagtag

SEQ ID NO: 18440 - DNA, 909 bp, Artificial Sequence
  Description of Artificial Sequence: Synthetic coding sequence
atggagagacacatggtgagaggccagctgtacaagcacttcgacctggagagaaagaacgccaagcaggccgaggccagactggaccagagactgcagagactgaaggtgatctgcctgtaccacgtgaagctgctgacctgggagcagagacagctgcagaaggagctgcagagactgcagcaggccgagaccatgaagaagaagttcagcagctacctgggcaacggcttccagaagagacccgaggacgtgctggtgttcagcccccagggcagacagaagcacagagccccccaggccaagaagatgagagccctggccaccagaatggcccaggacacctgcaagagcaagagccaggtgccccccagccacgacgccggcctgaaggaccccatgaagagcaagaagcagcccctgagccagaacaacagaaccgcctgcttcatcaaggagcagccccaggcccaggagaaggacagcgtgaaccccagcaaggacgtggaccccagcaagggcatcagcgtgccctgccagaaccaggaggtgagcaccaacaccatcgagcagggccccagcagcagccccgccagcgacagcggcatggcctgcgccgacgagaccagaagcaaggacgtggccctgaagcccgacggcaacaccggcaagcagatcccccccaagcacatggagtgcgccggcagcttcgagggcgagttcaccaagcccaccttcctggagctgctgagcaaggccagaaacgcccactacctgagacacagagtgccccccgagagcgagagactgctgagcatcggcgagatcttcggccacggcgagagcagcagcagcagagccggcaaggagtgcgagaacagagtgcccagcaagttcctgcccctgtag

SEQ ID NO: 18441 - DNA, 708 bp, Artificial Sequence
  Description of Artificial Sequence: Synthetic coding sequence
atggtgagaggccagctgtacaagcacttcgacctggagagaaagaacgccaagcaggccgaggccagactggaccagagactgcagagactgaaggtgatctgcctgtaccacgtgaagctgctgacctgggagcagagacagctgcagaaggagctgcagagactgcagcaggagaccatgaagaagaagttcagcagctacctgggcaacggcttccagaagagacccgaggacgtgctggtgttcagcccccagggcagacagaagcacagagccccccaggccaagaagatgagagccctggccaccagaatggcccaggacacctgcaagagcaagagccaggtgccccccagccacgacgccggcctgaaggaccccatgaagagcaagaagcagcccctgagccagaacaacagaaccgcctgcttcatcaaggagcagccccaggcccaggagaaggacagcgtgaaccccagcaaggacgtggaccccagcaagggcatcagcgtgccctgccagaaccaggaggtgagcaccaacaccatcgagcagggccccatcagcagcgcccagcccctggccttcaacggcgagaccatcctgtacagcgagagaaacaccagaaacctgctgccccccaccctgagcagcatgaagcagagcaacagaggcagacaggccatcagcgacagaaccgactag

SEQ ID NO: 18442 - DNA, 786 bp, Artificial Sequence
  Description of Artificial Sequence: Synthetic coding sequence
atggagaacttcagcctgctgagcatcagcggcccccccatcagcagcagcgccctgagcgccttccccgacatcatgttcagcagagccaccagcctgcccgacatcgccaagaccgccgtgcccaccgaggccagcagccccgcccaggccctgcccccccagtaccagagcatcatcgtgagacagggcatccagaacaccgccctgagccccgactgcagcctgggcgacacccagcacggcgagaagctgagaagaaactgcaccatctacagaccctggttcagcccctacagctacttcgtgtgcgccgacaaggagagccagctggaggcctacgacttccccgaggtgcagcaggacgagggcaagtgggacaactgcctgagcgaggacatggccgagaacatctgcagcagcagcagcagccccgagaacacctgccccagagaggccaccaagaagagcagacacggcctggacagcatcaccagccaggacatcctgatggccagcagatggcaccccgcccagcagaacggctacaagtgcgtggcctgctgcagaatgtaccccaccctggacttcctgaagagccacatcaagagaggcttcagagagggcttcagctgcaaggtgtactacagaaagctgaaggccctgtggagcaaggagcagaaggccagactgggcgacagactgagcagcggcagctgccaggccttcaacagccccgccgagcacctgagacagatcggcggcgaggcctacctgtgcctgtag

SEQ ID NO: 18443 - DNA, 1527 bp, Artificial Sequence
  Description of Artificial Sequence: Synthetic coding sequence
atgaacgagaacaaggacaccgacagcaagaagagcgaggagtacgaggacgacttcgagaaggacctggagtggctgatcaacgagaacgagaagagcgacgccagcatcatcgagatggcctgcgagaaggaggagaacatcaaccaggacctgaaggagaacgagaccgtgatggagcacaccaagagacacagcgaccccgacaagagcctgcaggacgaggtgagccccagaagaaacgacatcatcagcgtgcccggcatccagcccctggaccccatcagcgacagcgacagcgagaacagcttccaggagagcaagctggagagccagaaggacctggaggaggaggaggacgaggaggtgagaagatacatcatggagaagatcgtgcaggccaacaagctgctgcagaaccaggagcccgtgaacgacaagagagagagaaagctgaagttcaaggaccagctggtggacctggaggtgccccccctggaggacaccaccaccttcaagaactacttcgagaacgagagaaacatgttcggcaagctgagccagctgtgcatcagcaacgacttcggccaggaggacgtgctgctgagcctgaccaacggcagctgcgaggagaacaaggacagaaccatcctggtggagagagacggcaagttcgagctgctgaacctgcaggacatcgccagccagggcttcctgccccccatcaacaacgccaacagcaccgagaacgacccccagcagctgctgcccagaagcagcaacagcagcgtgagcggcaccaagaaggaggacagcaccgccaagatccacgccgtgacccacagcagcaccggcgagcccctggcctacatcgcccagccccccctgaacagaaagacctgccccagcagcgccgtgaacagcgacagaagcaagggcaacggcaagagcaaccacagaacccagagcgcccacatcagccccgtgaccagcacctactgcctgagccccagacagaaggagctgcagaagcagctggaggagaagagagagaagctgaagagagaggaggagagaagaaagatcgaggaggagaaggagaagaagagagagaacgacatcgtgttcaaggcctggctgcagaagaagagagagcaggtgctggagatgagaagaatccagagagccaaggagatcgaggacatgaacagcagagagaacagagacccccagcaggccttcagactgtggctgaagaagaagcacgaggagcagatgaaggagagacagaccgaggagctgagaaagcaggaggagtgcctgttcttcctgaagggcaccgagggcagagagagagccttcaagcagtggctgagaagaaagagaatggagaagatggccgagcagcaggccgtgagagagagaaccagacagctgagactggaggccaagagaagcaagcagctgcagcaccacctgtacatgagcgaggccaagcccttcagattcaccgaccactacaactag

SEQ ID NO: 18444 - DNA, 1530 bp, Artificial Sequence
  Description of Artificial Sequence: Synthetic coding sequence
atgaacgagaacaaggacaccgacagcaagaagagcgaggagtacgaggacgacttcgagaaggacctggagtggctgatcaacgagaacgagaagagcgacgccagcatcatcgagatggcctgcgagaaggaggagaacatcaaccaggacctgaaggagaacgagaccgtgatggagcacaccaagagacacagcgaccccgacaagagcctgcaggacgaggtgagccccagaagaaacgacatcatcagcgtgcccggcatccagcccctggaccccatcagcgacagcgacagcgagaacagcttccaggagagcaagctggagagccagaaggacctggaggaggaggaggacgaggaggtgagaagatacatcatggagaagatcgtgcaggccaacaagctgctgcagaaccaggagcccgtgaacgacaagagagagagaaagctgaagttcaaggaccagctggtggacctggaggtgccccccctggaggacaccaccaccttcaagaactacttcgagaacgagagaaacatgttcggcaagctgagccagctgtgcatcagcaacgacttcggccaggaggacgtgctgctgagcctgaccaacggcagctgcgaggagaacaaggacagaaccatcctggtggagagagacggcaagttcgagctgctgaacctgcaggacatcgccagccagggcttcctgccccccatcaacaacgccaacagcaccgagaacgacccccagcagctgctgcccagaagcagcaacagcagcgtgagcggcaccaagaaggaggacagcaccgccaagatccacgccgtgacccacagcagcaccggcgagcccctggcctacatcgcccagccccccctgaacagaaagacctgccccagcagcgccgtgaacagcgacagaagcaagggcaacggcaagagcaaccacagaacccagagcgcccacatcagccccgtgaccagcacctactgcctgagccccagacagaaggagctgcagaagcagctggaggagaagagagagaagctgaagagagaggaggagagaagaaagatcgaggaggagaaggagaagaagagagagaacgacatcgtgttcaaggcctggctgcagaagaagagagagcaggtgctggagatgagaagaatccagagagccaaggagatcgaggacatgaacagcagacaggagaacagagacccccagcaggccttcagactgtggctgaagaagaagcacgaggagcagatgaaggagagacagaccgaggagctgagaaagcaggaggagtgcctgttcttcctgaagggcaccgagggcagagagagagccttcaagcagtggctgagaagaaagagaatggagaagatggccgagcagcaggccgtgagagagagaaccagacagctgagactggaggccaagagaagcaagcagctgcagcaccacctgtacatgagcgaggccaagcccttcagattcaccgaccactacaactag

SEQ ID NO: 18445 - DNA, 1071 bp, Artificial Sequence
  Description of Artificial Sequence: Synthetic coding sequence
atgaacgagaacaaggacaccgacagcaagaagagcgaggagtacgaggacgacttcgagaaggacctggagtggctgatcaacgagaacgagaagagcgacgccagcatcatcgagatggcctgcgagaaggaggagaacatcaaccaggacctgaaggagaacgagaccgtgatggagcacaccaagagacacagcgaccccgacaagagcctgcaggacgaggtgagccccagaagaaacgacatcatcagcgtgcccggcatccagcccctggaccccatcagcgacagcgacagcgagaacagcttccaggagagcaagctggagagccagaaggacctggaggaggaggaggacgaggaggtgagaagatacatcatggagaagatcgtgcaggccaacaagctgctgcagaaccaggagcccgtgaacgacaagagagagagaaagctgaagttcaaggaccagctggtggacctggaggtgccccccctggaggacaccaccaccttcaagaactacttcgagaacgagagaaacatgttcggcaagctgagccagctgtgcatcagcaacgacttcggccaggaggacgtgctgctgagcctgaccaacggcagctgcgaggagaacaaggacagaaccatcctggtggagagagacggcaagttcgagctgctgaacctgcaggacatcgccagccagggcttcctgccccccatcaacaacgccaacagcaccgagaacgacccccagcagctgctgcccagaagcagcaacagcagcgtgagcggcaccaagaaggaggacagcaccgccaagatccacgccgtgacccacagcagcaccggcgagcccctggcctacatcgcccagccccccctgaacagaaagacctgccccagcagcgccgtgaacagcgacagaagcaagggcaacggcaagagcaaccacagaacccagagcgcccacatcagccccgtgaccagcacctactgcctgagccccagacagaaggagctgcagaagcagctggaggagaagagagagaagctgaagagagagtag

SEQ ID NO: 18446 - DNA, 1527 bp, Artificial Sequence; identical to SEQ ID NO: 18443
  Description of Artificial Sequence: Synthetic coding sequence

SEQ ID NO: 18447 - DNA, 429 bp, Artificial Sequence
  Description of Artificial Sequence: Synthetic coding sequence
atgaccgtgggcgccagactgagaagcaaggccgagagcagcctgctgagaagaggccccagaggcagaggcagaaccgagggcgacgaggaggccgccgccatcctggagcacctggagtacgccgacgaggccgaggccgccgccgagagcggcaccagcgccgccgacgagagaggccccggcaccagaggcgccagaagagtgcacttcgccctgctgcccgagagatacgagcccctggaggagcccgcccccagcgagcagcccagaaagagatacagaagaaagctgaagaagtacggcaagaacgtgggcaaggtgatcatcaagggctgcagatacgtggtgatcggcctgcagggcttcgccgccgcctacagcgcccccttcgccgtggccaccagcgtggtgagcttcgtgagatag

SEQ ID NO: 18448 - DNA, 333 bp, Artificial Sequence
  Description of Artificial Sequence: Synthetic coding sequence
atggagtggggccccggcagcgactggagcagaggcgaggccgccggcgtggacagaggcaaggccggcctgggcctgggcggcagaccccccccccagccccccagagaggagagagcccagcagctgctggacgccgtggagcagagacagagacagctgctggacaccatcgccgcctgcgaggagatgctgagacagctgggcagaagaagacccgagcccgccggcggcggcaacgtgagcgccaagcccggcgcccccccccagcccgccgtgagcgccagaggcggcttccccaaggacgccggcgacggcgccgccgagccctag

SEQ ID NO: 18449 - DNA, 144 bp, Artificial Sequence
  Description of Artificial Sequence: Synthetic coding sequence
atgctgagacagctgggcagaagaagacccgagcccgccggcggcggcaacgtgagcgccaagcccggcgcccccccccagcccgccgtgagcgccagaggcggcttccccaaggacgccggcgacggcgccgccgagccctag

SEQ ID NO: 18450 - DNA, 480 bp, Artificial Sequence
  Description of Artificial Sequence: Synthetic coding sequence
atgggccccggcctgagactggtgaccggcgtgagaggcggccccagcggcagagaggagggcgcctggcccagagccagcgccggccccgacagactgagcctggccctgagcagagccggcagactgcccgcctggaccgccggcagaagaggctggggcagcgccggcggccacccccacagcagacccggcagaagcgcccccagcagctgctggaccagatggagcagcggcagcggcagcagctggacccccagccagcccgccagaagatgctacggcagctgggccgccggcgccagaagcagactggtggccggcaccagccagcccaacctggagagaccccccagcagactgagcccccccgaggccgccttccagagaatgctggccatggagctgagaagccccgaccaccccagagccgagtaccccgacttcagccccagccccggccccgtggccggcctgtag

SEQ ID NO: 18451 - DNA, 144 bp, Artificial Sequence; identical to SEQ ID NO: 18449
  Description of Artificial Sequence: Synthetic coding sequence

SEQ ID NO: 18452 - DNA, 483 bp, Artificial Sequence
  Description of Artificial Sequence: Synthetic coding sequence
atgggcaagatcgccctgcagctgaaggccaccctggagaacatcaccaacctgagacccgtgggcgaggacttcagatggtacctgaagatgaagtgcggcaactgcggcgagatcagcgacaagtggcagtacatcagactgatggacagcgtggccctgaagggcggcagaggcagcgccagcatggtgcagaagtgcaagctgtgcgccagagagaacagcatcgagatcctgagcagcaccatcaagccctacaacgccgaggacaacgagaacttcaagaccatcgtggagttcgagtgcagaggcctggagcccgtggacttccagccccaggccggcttcgccgccgagggcgtggagagcggcaccgccttcagcgacatcaacctgcaggagaaggactggaccgactacgacgagaaggcccaggagagcgtgggcatctacgaggtgacccaccagttcgtgaagtgctag

SEQ ID NO: 18453 - DNA, 414 bp, Artificial Sequence
  Description of Artificial Sequence: Synthetic coding sequence
atgggcaagatcgccctgcagctgaaggccaccctggagaacatcaccaacctgagacccgtgggcgaggacttcagatggtacctgaaggacagcgtggccctgaagggcggcagaggcagcgccagcatggtgcagaagtgcaagctgtgcgccagagagaacagcatcgagatcctgagcagcaccatcaagccctacaacgccgaggacaacgagaacttcaagaccatcgtggagttcgagtgcagaggcctggagcccgtggacttccagcccctgggcctgctgctgaaggtgtggagccagggccagcccagcgtgaccctgatctgcagaagaagaaccggcctgaccatgatgaagagacccagaagcctgtgggagagcatgagaagccccaccagcctgtag

SEQ ID NO: 18454 - DNA, 624 bp, Artificial Sequence
  Description of Artificial Sequence: Synthetic coding sequence
atggacgacgacctgatgctggccctgagactgcaggaggagtggaacctgcaggaggccgagagagaccacgcccaggagagcctgagcctggtggacgccagctgggagctggtggaccccacccccgacctgcaggccctgttcgtgcagttcaacgaccagttcttctggggccagctggaggccgtggaggtgaagtggagcgtgagaatgaccctgtgcgccggcatctgcagctacgagggcaagggcggcatgtgcagcatcagactgagcgagcccctgctgaagctgagacccagaaaggacctggtggaggtgtaccacaccttccacgacgaggtggacgagtacagaagacactggtggagatgcaacggcccctgccagcacagacccccctactacggctacgtgaagagagccaccaacagagagcccagcgcccacgactactggtgggccgagcaccagaagacctgcggcggcacctacatcaagatcaaggagcccgagaactacagcaagaagggcaagggcaaggccaagctgggcaaggagcccgtgctggccgccgagaacaagggcaccttcgtgtacatcctgctgatcttcatgtag

SEQ ID NO: 18455 - DNA, 1470 bp, Artificial Sequence
  Description of Artificial Sequence: Synthetic coding sequence
atggacgacgacctgatgctggccctgagactgcaggaggagtggaacctgcaggaggccgagagagaccacgcccaggagagcctgagcctggtggacgccagctgggagctggtggaccccacccccgacctgcaggccctgttcgtgcagttcaacgaccagttcttctggggccagctggaggccgtggaggtgaagtggagcgtgagaatgaccctgtgcgccggcatctgcagctacgagggcaagggcggcatgtgcagcatcagactgagcgagcccctgctgaagctgagacccagaaaggacctggtggagaccctgctgcacgagatgatccacgcctacctgttcgtgaccaacaacgacaaggacagagagggccacggccccgagttctgcaagcacatgcacagaatcaacagcctgaccggcgccaacatcaccgtgtaccacaccttccacgacgaggtggacgagtacagaagacactggtggagatgcaacggcccctgccagcacagacccccctactacggctacgtgaagagagccaccaacagagagcccagcgcccacgactactggtgggccgagcaccagaagacctgcggcggcacctacatcaagatcaaggagcccgagaactacagcaagaagggcaagggcaaggccaagctgggcaaggagcccgtgctggccgccgagaacaaggacaagcccaacagaggcgaggcccagctggtgatccccttcagcggcaagggctacgtgctgggcgagaccagcaacctgcccagccccggcaagctgatcaccagccacgccatcaacaagacccaggacctgctgaaccagaaccacagcgccaacgccgtgagacccaacagcaagatcaaggtgaagttcgagcagaacggcagcagcaagaacagccacctggtgagccccgccgtgagcaacagccaccagaacgtgctgagcaactacttccccagagtgagcttcgccaaccagaaggccttcagaggcgtgaacggcagccccagaatcagcgtgaccgtgggcaacatccccaagaacagcgtgagcagcagcagccagagaagagtgagcagcagcaagatcagcctgagaaacagcagcaaggtgaccgagagcgccagcgtgatgcccagccaggacgtgagcggcagcgaggacaccttccccaacaagagacccagactggaggacaagaccgtgttcgacaacttcttcatcaagaaggagcagatcaagagcagcggcaacgaccccaagtacagcaccaccaccgcccagaacagcagcagcagcagcagccagagcaagatggtgaactgccccgtgtgccagaacgaggtgctggagagccagatcaacgagcacctggactggtgcctggagggcgacagcatcaaggtgaagagcgaggagagcctgtag

SEQ ID NO: 18456 - DNA, 564 bp, Artificial Sequence
  Description of Artificial Sequence: Synthetic coding sequence
atgaagaagaccctgctgcacgagatgatccacgcctacctgttcgtgaccaacaacgacaaggacagagagggccacggccccgagttctgcaagcacatgcacagaatcaacagcctgaccggcgccaacatcaccgtgtaccacaccttccacgacgaggtggacgagtacagaagacactggtggagatgcaacggcccctgccagcacagacccccctactacggctacgtgaagagagccaccaacagagagcccagcgcccacgactactggtgggccgagcaccagaagacctgcggcggcacctacatcaagatcaaggagcccgagaactacagcaagaagggcaagggcaaggccaagctgggcaaggagcccgtgctggccgccgagaacaaggacaagcccaacagaggcgaggcccagctggtgatccccttcagcggcaagggctacgtgctgggcgagaccagcaacctgcccagccccggcaagctgatcaccagccacgccatcaacaagacccaggacctgctgaaccagaaccacagcgcctag

SEQ ID NO: 18457 - DNA, 753 bp, Artificial Sequence
  Description of Artificial Sequence: Synthetic coding sequence
atggacgacgacctgatgctggccctgagactgcaggaggagtggaacctgcaggaggccgagagagaccacgcccaggagagcctgagcctggtggacgccagctgggagctggtggaccccacccccgacctgcaggccctgttcgtgcagttcaacgaccagttcttctggggccagctggaggccgtggaggtgaagtggagcgtgagaatgaccctgtgcgccggcatctgcagctacgagggcaagggcggcatgtgcagcatcagactgagcgagcccctgctgaagctgagacccagaaaggacctggtggagaccctgctgcacgagatgatccacgcctacctgttcgtgaccaacaacgacaaggacagagagggccacggccccgagttctgcaagcacatgcacagaatcaacagcctgaccggcgccaacatcaccgtgtaccacaccttccacgacgaggtggacgagtacagaagacactggtggagatgcaacggcccctgccagcacagacccccctactacggctacgtgaagagagccaccaacagagagcccagcgcccacgactactggtgggccgagcaccagaagacctgcggcggcacctacatcaagatcaaggagcccgagaactacagcaagaagggcaagggcaaggccaagctgggcaaggagcccgtgctggccgccgagaacaagggcaccttcgtgtacatcctgctgatcttcatgtag

SEQ ID NO: 18458 - DNA, 585 bp, Artificial Sequence
  Description of Artificial Sequence: Synthetic coding sequence
atggacgacgacctgatgctggccctgagactgcaggaggagtggaacctgcaggaggccgagagagaccacgcccaggagagcctgagcctggtggacgccagctgggagctggtggaccccacccccgacctgcaggccctgttcgtgcagttcaacgaccagttcttctggggccagctggaggccgtggaggtgaagtggagcgtgagaatgaccctgtgcgccggcatctgcagctacgagggcaagggcggcatgtgcagcatcagactgagcgagcccctgctgaagctgagacccagaaaggacctggtggaggtgtaccacaccttccacgacgaggtggacgagtacagaagacactggtggagatgcaacggcccctgccagcacagacccccctactacggctacgtgaagagagccaccaacagagagcccagcgcccacgactactggtgggccgagcaccagaagacctgcggcggcacctacatcaagatcaaggagcccgagaactacaagaagagacagagaaagggcaagaccagaaagggcaccagcatcggcagaagagagtag

SEQ ID NO: 18459 - DNA, 2472 bp, Artificial Sequence
  Description of Artificial Sequence: Synthetic coding sequence
atgtggggcagccccgccctggcctgggccgtgtggctggcctgcgtgcagcccaccgtgttcccctggagcctgagcttcagaagcgacaccgacaagcccagcagcgccgccgaggtgctgaccgaggccagcagctgctggaccgacaccgtggagtgcttcagcgactacatgaccctgtggatccccagaagccacgtggagggcctgagaagatggctggccagaaccctgcacctgcccggcacctggagaagccccgaccacctggacagcagcctggccaagtgcggctacttcctgcacctggccagcgacggcgacttcctgttcagagtgcagtacagcgcctgcttcgtgcagaaggagaaggccaactacagactggagatcagaatcttccagaagggcgtgatgggcctggagagaagcgacagatacatcatgaagtgccccatgctgagaagcagactgggccaggagagcgtgcactgcggccccatgttcatccaggtgagcagacccctgcccctgtggagagacaacagacagaccccctggctgctgagcctgagaggcgagctggtggccagcctggaggacgccagcctgatgggcctgtacgtggacatgaacgccaccaccgtgaccgtgcagagccccagacagggcctgctgcagagatgggaggtgctgaacaccagcgccgagctgctgcccctgtggctggtgagcggccaccacgcctacagcctggaggccgcctgcccccccgtgagcttccagcccgagagcgaggtgctggtgcacatccccaagcagagactgggcctggtgaagagaggcagctacatcgaggagaccctgagcctgagattcctgagagtgcaccagagcaacatcttcatggtgaccgagaacaaggacttcgtggtggtgagcatccccgccgccggcgtgctgcaggtgcagagatgccaggaggtgggcggcacccccggcacccaggccttctacagagtggacctgagcctggagttcgccgagatggccgcccccgtgctgtggaccgtggagagcttcttccagtgcgtgggcagcggcaccgagagccccgccagcaccgccgccctgagaaccacccccagcccccccagccccggccccgagaccccccccgccggcgtgccccccgccgccagcagccaggtgtgggccgccggccccgccgcccaggagtggctgagcagagacctgctgcacagacccagcgacgccctggccaagaagggcctgggccccttcctgcagaccgccaagcccgccagaagaggccagaccagcgccagcatcctgcccagagtggtgcaggcccagagaggcccccagcccccccccggcgaggccggcatccccggccaccccaccccccccgccaccctgcccagcgagcccgtggagggcgtgcaggccagcccctggagacccagacccgtgctgcccacccaccccgccctgaccctgcccgtgagcagcgacgccagcagccccagcccccccgcccccagacccgagagacccgagagcctgctggtgagcggccccagcgtgaccctgaccgagggcctgggcaccgtgagacccgagcaggaccccgccaagagccccggcagccccctgctgctgagaggcctgagcagcggcgacgtggccgcccccgagcccatcatgggcgagcccggccaggccagcgaggagttccagcccctggccagaccctggagagccaccctggccgccgaggagctggtgagccacagaagccccggcgagccccaggagacctgcagcggcaccgaggtggagagacccagacagaccggccccggcctgcccagagagggcgccagaggccacatggacctgagcagcagcgagcccagccaggacatcgagggccccggcctgagcatcctgcccgccagagacgccaccttcagcacccccagcgtgagacagcccgaccccagcgcctggctgagcagcggccccgagctgaccggcatgcccagagtgagactggccgcccccctggccgtgctgcccatggagcccctgccccccgagcccgtgagacccgccgccctgctgacccccgaggccagcagcgtgggcggccccgaccaggccagatacctggagagcgcccccggctggcccgtgggccaggaggagtggggcgtggcccacaccagcagcccccccagcacccagaccctgagcctgtgggcccccaccggcgtgctgctgcccagcctggtggagctggagtaccccttccaggccggcagaggcgccagcctgcagcaggagctgaccgagcccaccctggccctgagcgccgagagccacagaccccccgagctgcaggacagcgtggagggcctgagcgagagacccagcagatag

SEQ ID NO: 18460 - DNA, 1971 bp, Artificial Sequence
  Description of Artificial Sequence: Synthetic coding sequence
atgaagtgccccatgctgagaagcagactgggccaggagagcgtgcactgcggccccatgttcatccaggtgagcagacccctgcccctgtggagagacaacagacagaccccctggctgctgagcctgagaggcgagctggtggccagcctggaggacgccagcctgatgggcctgtacgtggacatgaacgccaccaccgtgaccgtgcagagccccagacagggcctgctgcagagatgggaggtgagcggcggccagcaggccctgcccggcgtgagcttccagcccgagagcgaggtgctggtgcacatccccaagcagagactgggcctggtgaagagaggcagctacatcgaggagaccctgagcctgagattcctgagagtgcaccagagcaacatcttcatggtgaccgagaacaaggacttcgtggtggtgagcatccccgccgccggcgtgctgcaggtgcagagatgccaggaggtgggcggcacccccggcacccaggccttctacagagtggacctgagcctggagttcgccgagatggccgcccccgtgctgtggaccgtggagagcttcttccagtgcgtgggcagcggcaccgagagccccgccagcaccgccgccctgagaaccacccccagcccccccagccccggccccgagaccccccccgccggcgtgccccccgccgccagcagccaggtgtgggccgccggccccgccgcccaggagtggctgagcagagacctgctgcacagacccagcgacgccctggccaagaagggcctgggccccttcctgcagaccgccaagcccgccagaagaggccagaccagcgccagcatcctgcccagagtggtgcaggcccagagaggcccccagcccccccccggcgaggccggcatccccggccaccccaccccccccgccaccctgcccagcgagcccgtggagggcgtgcaggccagcccctggagacccagacccgtgctgcccacccaccccgccctgaccctgcccgtgagcagcgacgccagcagccccagcccccccgcccccagacccgagagacccgagagcctgctggtgagcggccccagcgtgaccctgaccgagggcctgggcaccgtgagacccgagcaggaccccgccaagagccccggcagccccctgctgctgagaggcctgagcagcggcgacgtggccgcccccgagcccatcatgggcgagcccggccaggccagcgaggagttccagcccctggccagaccctggagagccaccctggccgccgaggagctggtgagccacagaagccccggcgagccccaggagacctgcagcggcaccgaggtggagagacccagacagaccggccccggcctgcccagagagggcgccagaggccacatggacctgagcagcagcgagcccagccaggacatcgagggccccggcctgagcatcctgcccgccagagacgccaccttcagcacccccagcgtgagacagcccgaccccagcgcctggctgagcagcggccccgagctgaccggcatgcccagagtgagactggccgcccccctggccgtgctgcccatggagcccctgccccccgagcccgtgagacccgccgccctgctgacccccgaggccagcagcgtgggcggccccgaccaggccagatacctggagagcgcccccggctggcccgtgggccaggaggagtggggcgtggcccacaccagcagcccccccagcacccagaccctgagcctgtgggcccccaccggcgtgctgctgcccagcctggtggagctggagtaccccttccaggccggcagaggcgccagcctgcagcaggagctgaccgagcccaccctggccctgagcgccgagagccacagaccccccgagctgcaggacagcgtggagggcctgagcgagagacccagcagatag

SEQ ID NO: 18461 - DNA, 1722 bp, Artificial Sequence
  Description of Artificial Sequence: Synthetic coding sequence
atgctgaccagaaaccccaagaccaagagcagcctgcagatcctgcaggacagcgtgaagtggcaccacatggcccacaaggtgaacagcctgctggacgcctacagcggcctgctgagcaacgagagcatgatcctggccgtgaacagcagcttcgtggaccccctgctgcagttcgagagccagctgaagatcatcgagagcagcttcggcatgctggtggtgatgcccagcctggacaaggtgaaggagatgggcagcagctacgagtacatcgaggacatggagaacctgtaccacaacatcctgaacatctacgagaacatcctgaccagcctggtgagcaaggacctgtacaagctgcagatcctgaaggagatgctggtgtggatgagcaaggacagcagctacctgcaggagagaatcatggtgatcatcaacaaggtgctgagattcaccgtgaccaaggtgagaaagtacatcagcgtggacgccccctgcctgggcctgctggccgccgagctgagcctgctgtgcagccacgaggaccccagcatcgtgaagcaggccagcctgggcatgtgccacctgctgtacatcgccagatgccagaacgacatcggcaccaacaagcccaccaacggcaagagccacagcctgcagttccccagcagcgacgtggagttcctgcccaaggagttccagcaggacgagagcaagatcgcccagagagtgggccagaccctgctgccccccctgctgaccgacttcgtgcagagcctgctgatgaagctgagcagccccgacgacaagatcgccagcgacgccgccagcatcctgatcttcaccctggagttccacgccgagaaggtgaccatggtgagcaagatcgtggacgccatctacagacagctgtgcgacaacaactgcatgaaggacgtgatgctgcaggtgatcaccctgctgacctgcaccagccccaagaaggtgatcttccagctgatggactaccccgtgcccgccgacgacaccctgatccagatgtggaaggccgcctgcagccaggccagcgtggccccccacgtgctgaagaccatcctgctgatcctgaagggcaagcccggcgagatggaggacaccgtgaccgagggcaagagattcagcctggacatcaccaacctgatgcccctggccgcctgccaggccctgtgcaccttcctgcccctgggcagctacagaaaggccgtggcccagtacttcccccagctgctgaccaccctgatgttccaggtgttctacaacagcgagctgaagcccatcctgaaggacagagccctgtacgcccaggacgccctgagagtgctgctgaactgcagcggcctgcagcaggtggacatcaccctgatgaaggagaacttctgggaccagctgagcgaggacctgtgctactaccacggcgtgtgcttcatcgccaagaccctgagcgagtacaacttcccccagttccccgagaccctgagctacctgtacaagctgagcgtggagggccccagaagaagcgaggacaccgtgatcgtgctgatcttcctgaccgaggtgagcttcgtggactgcgagcagctgtgcagccacttcctgttcctgcccaagttcaagagcaagttccagttcctggtgagcctgcccctgaacgtgggcagctaccaggacctgagaagctag

SEQ ID NO: 18462 - DNA, 2586 bp, Artificial Sequence
  Description of Artificial Sequence: Synthetic coding sequence
atgctgaccagaaaccccaagaccaagagcagcctgcagatcctgcaggacagcgtgaagtggcaccacatggcccacaaggtgaacagcctgctggacgcctacagcggcctgctgagcaacgagagcatgatcctggccgtgaacagcagcttcgtggaccccctgctgcagttcgagagccagctgaagatcatcgagagcagcttcggcatgctggtggtgatgcccagcctggacaaggtgaaggagatgggcagcagctacgagtacatcgaggacatggagaacctgtaccacaacatcctgaacatctacgagaacatcctgaccagcctggtgagcaaggacctgtacaagctgcagatcctgaaggagatgctggtgtggatgagcaaggacagcagctacctgcaggagagaatcatggtgatcatcaacaaggtgctgagattcaccgtgaccaaggtgagaaagtacatcagcgtggacgccccctgcctgggcctgctggccgccgagctgagcctgctgtgcagccacgaggaccccagcatcgtgaagcaggccagcctgggcatgtgccacctgctgtacatcgccagatgccagaacgacatcggcaccaacaagcccaccaacggcaagagccacagcctgcagttccccagcagcgacgtggagttcctgcccaaggagttccagcaggacgagagcaagatcgcccagagagtgggccagaccctgctgccccccctgctgaccgacttcgtgcagagcctgctgatgaagctgagcagccccgacgacaagatcgccagcgacgccgccagcatcctgatcttcaccctggagttccacgccgagaaggtgaccatggtgagcaagatcgtggacgccatctacagacagctgtgcgacaacaactgcatgaaggacgtgatgctgcaggtgatcaccctgctgacctgcaccagccccaagaaggtgatcttccagctgatggactaccccgtgcccgccgacgacaccctgatccagatgtggaaggccgcctgcagccaggccagcgtggccccccacgtgctgaagaccatcctgctgatcctgaagggcaagcccggcgagatggaggacaccgtgaccgagggcaagagattcagcctggacatcaccaacctgatgcccctggccgcctgccaggccctgtgcaccttcctgcccctgggcagctacagaaaggccgtggcccagtacttcccccagctgctgaccaccctgatgttccaggtgttctacaacagcgagctgaagcccatcctgaaggacagagccctgtacgcccaggacgccctgagagtgctgctgaactgcagcggcctgcagcaggtggacatcaccctgatgaaggagaacttctgggaccagctgagcgaggacctgtgctactaccacggcgtgtgcttcatcgccaagaccctgagcgagtacaacttcccccagttccccgagaccctgagctacctgtacaagctgagcgtggagggccccagaagaagcgaggacaccgtgatcgtgctgatcttcctgaccgagctgctgaacaacttcttcaaggaccccctgcccgaggagttcctggtgctgttcatcaactggatcaacgacagcaaccccgtggtgagcagactgatcctgcacagaatcgtgcacatgagccccatcatcaacaagaccgagaacgtgagcagcatcctgatcgccatcctggacgccttcctgagcaaggacgacaacgtggtgctgcaggccctgctgaccctgagaagactgctgaacgagctggacaaggtgacctacagcctgggcaccagaatcggcagcagctactgcaccctgatggaccacatcaacggcggcatcagaagcatggccatcagacacttcggccagctggtgagagacatgagacagtacacctggatggtgaacgacgtggtgctggagggcctggtgcccctgatcctgttcctggaggacgacgacaagagagtggccgaggcctgcaagtacaccctgaagatctgcaccagccagctgaagtggagcaccagcagactgctgaaggacgagaactacagcttcgagatggtggtgctgaacatctgcaacaacctgatcatcagccacagaaactacatcaccgacctgaccagcgacaccctgagattcctgtggagccccagaacctacctgaagagagccagcgtgatcctgatcggctacctggccaagagcggcggccacctgctgctgagagacgagatcgaggtgatgctggacgtgatcgagagactgctgagagacgaggaccccatgatcaagcagctggccgagatcacctacgacatcttcaagaagaaggcccacaagctgaccagcgcccccctgaagcagaacttccagaagctgctgaagctgttctacatcaagaagctgaagcccctgtacaactacaacagccccaacggccagatcgacagccccaccgacagcaaggacgtgaagaacgacaaggccctgtag

SEQ ID NO: 18463 - DNA, 564 bp, Artificial Sequence
  Description of Artificial Sequence: Synthetic coding sequence
tgaatgcccctggccgcctgccaggccctgtgcaccttcctgcccctgggcagctacagaaaggccgtggcccagtacttcccccagctgctgaccaccctgatgttccaggtgttctacaacagcgagctgaagcccatcctgaaggacagagccctgtacgcccaggacgccctgagagtgctgctgaactgcagcggcctgcagcaggtggacatcaccctgatgaaggagaacttctgggaccagctgagcgaggacctgtgctactaccacggcgtgtgcttcatcgccaagaccctgagcgagtacaacttcccccagttccccgagaccctgagctacctgtacaagctgagcgtggagggccccagaagaagcgaggacaccgtgatcgtgctgatcttcctgaccgagctgctgaacaacttcttcaaggaccccctgcccgaggagttcctggtgctgttcatcaactggatcaacgacagcaaccccgtggtgagcagactgatcctgcacagaatcgtgcacatgagccccatcatcaacaaggtggactag

SEQ ID NO: 18464 - DNA, 750 bp, Artificial Sequence
  Description of Artificial Sequence: Synthetic coding sequence
atgagagtggacagcagcgccgaccccaccatgagccaggagcagggccccggcagcagcaccccccccagcagccccaccctgctggacgccctgctgcagaacctgtacgacttcggcggcaccgagggcgagaccgagcagaagaagatcatcaagaagagagagaacaagaagagagacgtgatggccagcgccgccctggccgccgagcccagccccctgcccggcagcctgatcagaggccagagaaagagcgccagcagcttcttcaaggagctgagagaggagagacactgcgcccccagcggcacccccaccggccccgagatcctggccgccgccgtgccccccagcagcctgaagaacaacagagagcaggtggaggtggtggagttccacagcaacaagaagagaaagctgacccccgaccacaacaagaacaccaagcaggccaaccccagcgtgctggagagagacgtggacacccaggagttcaacctggagaaggccagactggaggtgcacagattcggcatcaccggctacggcaagggcaaggagagaatcctggagcaggagagagccatcatgctgggcgccaagccccccaagaagagctacgtgaactacaaggtgctgcaggagcagatcaaggagaagaaggccgccaaggaggaggagaagagactggcccaggagaccgacatcttcaagaagaagaagagaaagggccaggaggacagatag

SEQ ID NO: 18465 - DNA, 792 bp, Artificial Sequence
  Description of Artificial Sequence: Synthetic coding sequence
atgagccaggagcagggccccggcagcagcaccccccccagcagccccaccctgctggacgccctgctgcagaacctgtacgacttcggcggcaccgagggcgagaccgagcagaagaagatcatcaagaagagagagaacaagaagagagacgtgatggccagcgccgccctggccgccgagcccagccccctgcccggcagcctgatcagaggccagagaaagagcgccagcagcttcttcaaggagctgagagaggagagacactgcgcccccagcggcacccccaccggccccgagatcctggccgccgccgtgccccccagcagcctgaagaacaacagagagcaggtggaggtggtggagttccacagcaacaagaagagaaagctgacccccgaccacaacaagaacaccaaggccagactggaggtgcacagattcggcatcaccggctacggcaagggcaaggagagaatcctggagcaggagagagccatcatgctgggcgccaagccccccaagaagagctacgtgaactacaaggtgctgcaggagcagatcaaggagaagaaggccgccaaggaggaggagaagagactggcccaggagaccgacatcttcaagaagaagaagagaaagggccaggaggacagaaagagcaagaagaagagcgcccccagcatcctgagcaacggcagaatcggccaggtgggcaagttcaagaacggcaccctgatcctgagccccgtggacatcaagaagatcaacagcagcagagtggccaagtag

SEQ ID NO: 18466 - DNA, 882 bp, Artificial Sequence
  Description of Artificial Sequence: Synthetic coding sequence
atgagagtggacagcagcgccgaccccaccatgagccaggagcagggccccggcagcagcaccccccccagcagccccaccctgctggacgccctgctgcagaacctgtacgacttcggcggcaccgagggcgagaccgagcagaagaagatcatcaagaagagagagaacaagaagagagacgtgatggccagcgccgccctggccgccgagcccagccccctgcccggcagcctgatcagaggccagagaaagagcgccagcagcttcttcaaggagctgagagaggagagacactgcgcccccagcggcacccccaccggccccgagatcctggccgccgccgtgccccccagcagcctgaagaacaacagagagcaggtggaggtggtggagttccacagcaacaagaagagaaagctgacccccgaccacaacaagaacaccaagcaggccaaccccagcgtgctggagagagacgtggacacccaggagttcaacctggagaaggccagactggaggtgcacagattcggcatcaccggctacggcaagggcaaggagagaatcctggagcaggagagagccatcatgctgggcgccaagccccccaagaagagctacgtgaactacaaggtgctgcaggagcagatcaaggagaagaaggccgccaaggaggaggagaagagactggcccaggagaccgacatcttcaagaagaagaagagaaagggccaggaggacagaaagagcaagaagaagagcgcccccagcatcctgagcaacggcagaatcggccaggtgggcaagttcaagaacggcaccctgatcctgagccccgtggacatcaagaagatcaacagcagcagagtggccaagtag

SEQ ID NO: 18467 - DNA, 879 bp, Artificial Sequence
  Description of Artificial Sequence: Synthetic coding sequence
atgagagtggacagcagcgccgaccccaccatgagccaggagcagggccccggcagcagcaccccccccagcagccccaccctgctggacgccctgctgcagaacctgtacgacttcggcggcaccgagggcgagaccgagcagaagaagatcatcaagaagagagagaacaagaagagagacgtgatggccagcgccgccctggccgccgagcccagccccctgcccggcagcctgatcagaggccagagaaagagcgccagcagcttcttcaaggagctgagagaggagagacactgcgcccccagcggcacccccaccggccccgagatcctggccgccgccgtgccccccagcagcctgaagaacaacagagagcaggtggaggtggtggagttccacagcaacaagaagagaaagctgacccccgaccacaacaagaacaccaaggccaaccccagcgtgctggagagagacgtggacacccaggagttcaacctggagaaggccagactggaggtgcacagattcggcatcaccggctacggcaagggcaaggagagaatcctggagcaggagagagccatcatgctgggcgccaagccccccaagaagagctacgtgaactacaaggtgctgcaggagcagatcaaggagaagaaggccgccaaggaggaggagaagagactggcccaggagaccgacatcttcaagaagaagaagagaaagggccaggaggacagaaagagcaagaagaagagcgcccccagcatcctgagcaacggcagaatcggccaggtgggcaagttcaagaacggcaccctgatcctgagccccgtggacatcaagaagatcaacagcagcagagtggccaagtag

SEQ ID NO: 18468 - DNA, 771 bp, Artificial Sequence
  Description of Artificial Sequence: Synthetic coding sequence
ggcagcagcaccccccccagcagccccaccctgctggacgccctgctgcagaacctgtacgacttcggcggcaccgagggcgagaccgagcagaagaagatcatcaagaagagagagaacaagaagagagacgtgatggccagcgccgccctggccgccgagcccagccccctgcccggcagcctgatcagaggccagagaaagagcgccagcagcttcttcaaggagctgagagaggagagacactgcgcccccagcggcacccccaccggccccgagatcctggccgccgccgtgccccccagcagcctgaagaacaacagagagcaggtggaggtggtggagttccacagcaacaagaagagaaagctgacccccgaccacaacaagaacaccaaggccagactggaggtgcacagattcggcatcaccggctacggcaagggcaaggagagaatcctggagcaggagagagccatcatgctgggcgccaagccccccaagaagagctacgtgaactacaaggtgctgcaggagcagatcaaggagaagaaggccgccaaggaggaggagaagagactggcccaggagaccgacatcttcaagaagaagaagagaaagggccaggaggacagaaagagcaagaagaagagcgcccccagcatcctgagcaacggcagaatcggccaggtgggcaagttcaagaacggcaccctgatcctgagccccgtggacatcaagaagatcaacagcagcagagtggccaagtag

SEQ ID NO: 18469 - DNA, 438 bp, Artificial Sequence
  Description of Artificial Sequence: Synthetic coding sequence
tgaagaagaggcgccggcgtgagaagcggctgcgccagcagagcctgcagcggcgccctgggcggcagaggccccggcgagagcctgttcgcccagtaccccagaagagccgagggcagaagagagaagcagcaggtgaccgagcagagaaacggctggcccagccagagctggagctgctgctgcagcacctgcagccccaacaagtgcagctacatcctgatgacccagtgcatcggcagcagagagatggagctgagcgccgagtggcccggctgcagcgtgaacatgaaggccaccaagaccgccagaggcagcgagctgatcctgagcctgggcagcttcagcggcagagccggccagagaagaagacccccccccggccaccaggacggcagcgacaccagaggcctgagaagagtgcagctggccctgtag

SEQ ID NO: 18470 - DNA, 303 bp, Artificial Sequence
  Description of Artificial Sequence: Synthetic coding sequence
atgacccacagcggctggcagggcagcggcggcgccggccccggccccagagcccccgccagaagcagatgcagacccggcctgcccagcctgccctgcagacccaaccccctggaggccagaggctgcggcagcgccctgagaccctgggacctggccgccagaacccccatcccctgcttctgcgaccacagctgggccctgggcaagctgctgggccccaagagaagagagggcagaaagggcagcgagagaagaagaagaggccccggcggccagcagccccagcccgccgaggagtag

SEQ ID NO: 18471 - DNA, 1074 bp, Artificial Sequence
  Description of Artificial Sequence: Synthetic coding sequence
atgagaagaaccggccccgaggaggaggcctgcggcgtgtggctggacgccgccgccctgaagagaagaaaggtgcagacccacctgatcaagcccggcaccaagatgctgaccctgctgcccggcgagagaaaggccaacatctacttcacccagagaagagcccccagcaccggcatccaccagagaagcatcgccagcttcttcaccctgcagcccggcaagaccaacggcagcgaccagaagagcgtgagcagccacaccgagagccagatcaacaaggagagcaagaagaacgccacccagctggaccacctgatccccggcctggcccacgactgcatggccagccccctggccaccagcaccaccgccgacatccaggaggccggcctgagcccccagagcctgcagaccagcggccaccacagaatgaagacccccttcagcaccgagctgagcctgctgcagcccgacacccccgactgcgccggcgacagccacacccccctggccttcagcttcaccgaggacctggagagcagctgcctgctggacagaaaggaggagaagggcgacagcgccagaaagtgggagtggctgcacgagagcaagaagaactaccagagcatggagaagcacaccaagctgcccggcgacaagtgctgccagcccctgggcaagaccaagctggagagaaaggtgagcgccaaggagaacagacaggcccccgtgctgctgcagacctacagagagagctggaacggcgagaacatcgagagcgtgaagcagagcagaagccccgtgagcgtgttcagctgggacaacgagaagaacgacaaggacagctggagccagctgttcaccgaggacagccagggccagagagtgatcgcccacaacaccagagcccccttccaggacgtgaccaacaactggaactgggacctgggccccttccccaacagcccctgggcccagtgccaggaggacggccccacccagaacctgaagcccgacctgctgttcacccaggacagcgagggcaaccaggtgatcagacaccagttctag

SEQ ID NO: 18472 - DNA, 1116 bp, Artificial Sequence
  Description of Artificial Sequence: Synthetic coding sequence
atgagaagaaccggccccgaggaggaggcctgcggcgtgtggctggacgccgccgccctgaagagaagaaaggtgcagacccacctgatcaagcccggcaccaagatgctgaccctgctgcccggcgagagaaaggccaacatctacttcacccagagaagagcccccagcaccggcatccaccagagaagcatcgccagcttcttcaccctgcagcccggcaagaccaacggcagcgaccagaagagcgtgagcagccacaccgagagccagatcaacaaggagagcaagaagaacgccacccagctggaccacctgatccccggcctggcccacgactgcatggccagccccctggccaccagcaccaccgccgacatccaggaggccggcctgagcccccagagcctgcagaccagcggccaccacagaatgaagacccccttcagcaccgagctgagcctgctgcagcccgacacccccgactgcgccggcgacagccacacccccctggccttcagcttcaccgaggacctggagagcagctgcctgctggacagaaaggaggagaagggcgacagcgccagaaagtgggagtggctgcacgagagcaagaagaactaccagagcatggagaagcacaccaagctgcccggcgacaagtgctgccagcccctgggcaagaccaagctggagagaaaggtgagcgccaaggagaacagacaggcccccgtgctgctgcagacctacagagagagctggaacggcgagaacatcgagagcgtgaagcagagcagaagccccgtgagcgtgttcagctgggacaacgagaagaacgacaaggacagctggagccagctgttcaccgaggacagccagggccagagagtgatcgcccacaacaccagagcccccttccaggacgtgaccaacaactggaactgggacctgggccccttccccaacagcccctgggcccagtgccaggaggacggccccacccagaacctgaagcccgacctgctgttcacccaggacagcgaggtgcaggccctggcctgccagcaggactgctgcagaagaagcatcctgaagagacagaagcacctgagatag

SEQ ID NO: 18473 - DNA, 297 bp, Artificial Sequence
  Description of Artificial Sequence: Synthetic coding sequence
atggccctgaagaccagcctgggcagcgtgcagttcatggagcagttctgctggccccacctgagaagcttctgcgagacctgcgtgggcagctggagcatccagatgagacagcaccaccaccagagcagcttccccggcagcctgccccaggagaccaacctgaccctgaaggtgtgcaagccccaggccccccagaagctggaccccaccctgagcagctgcttcttcatcgagagctgcggcgcccaggtgcccgtggagggcagcagaagagagaccagcatcaccgtgtag

SEQ ID NO: 18474 - DNA, 390 bp, Artificial Sequence
  Description of Artificial Sequence: Synthetic coding sequence
atgtggctgtggcaggacatccagtgctgccccgccccccccagcgccccccccagagccctggagcccggcagagccccccccccccccggcgagggcctgggcgccggcatccccagcctgagccccccccagaagaagccccagagcgtgggcatctgcgtgagacagaagggcagacagaaggccggcctggagaagggcaacagaaagaaggagctgagacaggccaactgccccagcctgagaccccagagaaagggcgccgacaccagaagactgcccagagagaccagacccaccaagaagagaaccgccgccgcccagcccttcctgcagctgtggaaccccgccccccacaccagcaacggcagaaccggcgacctgtag

SEQ ID NO: 18475 - DNA, 243 bp, Artificial Sequence
  Description of Artificial Sequence: Synthetic coding sequence
atggccgagaagatcctggagaagctggacgtgctggacaagcaggccgagatcatcctggccagaagaaccaagatcaacagactgcagagcgagggcagaaagaccaccatggccatccccctgaccttcgacttccagctggagttcgaggaggccctggccaccagcgccagcaaggccatcagcaagatcaaggaggacaagagctgcagcatcaccaagagcaagatcagcgagtag

SEQ ID NO: 18476 - DNA, 243 bp, Artificial Sequence
  Description of Artificial Sequence: Synthetic coding sequence
atggccgagaagatcctggagaagctggacgtgctggacaagcaggccgagatcatcctggccagaagaaccaagatcaacagactgcagagcgagggcagaaagaccaccatggccatccccctgaccttcgacttccagctggagttcgaggaggccctggccaccagcgccagcaaggccatcagcaagatcaaggaggacaagagctgcagcatcaccaagagcaagatcagcaactag

SEQ ID NO: 18477 - DNA, 846 bp, Artificial Sequence
  Description of Artificial Sequence: Synthetic coding sequence
atggccgagaagatcctggagaagctggacgtgctggacaagcaggccgagatcatcctggccagaagaaccaagatcaacagactgcagagcgagggcagaaagaccaccatggccatccccctgaccttcgacttccagctggagttcgaggaggccctggccaccagcgccagcaaggccatcagcaagatcaaggaggacaagagctgcagcatcaccaagagcaagatgcacgtgagcttcaagtgcgagcccgagcccagaaagagcaacttcgagaagagcaacctgagacccttcttcatccagaccaacgtgaagaacaaggagagcgagagcaccgagcccgtggaggagcacctgaagagcagaagcatcagaccctacctgtacctgaaggacaccaccgagatggagaacgccggccccctgaacgtgctgtacagccagcacagacaggcctgcagaagaagcctgggcagcaccgacttcagccccatgttcaacatccagagcaacgcccacaagaaggagaaggacagcaccctgttcaccgcccagatcgagaagaagcccagaaagcccctggacagcgtgggcctgctggagggcgacagaaacaagagaaagaagagcccccagatgaacgacttcaacatcaaggagaacaagagcgtgagaaactaccagctgagcaagtacagaagcgtgagaaagaagagcctgctgcccctgtgcttcgaggacgagctgaagaacccccacgccaagatcgtgaacgtgagccccaccaagaccgtgaccagccacatggagcagaaggacaccaaccccatcatctag

SEQ ID NO: 18478 - DNA, 1203 bp, Artificial Sequence
  Description of Artificial Sequence: Synthetic coding sequence
atggccgagaagatcctggagaagctggacgtgctggacaagcaggccgagatcatcctggccagaagaaccaagatcaacagactgcagagcgagggcagaaagaccaccatggccatccccctgaccttcgacttccagctggagttcgaggaggccctggccaccagcgccagcaaggccatcagcaagatcaaggaggacaagagctgcagcatcaccaagagcaagatgcacgtgagcttcaagtgcgagcccgagcccagaaagagcaacttcgagaagagcaacctgagacccttcttcatccagaccaacgtgaagaacaaggagagcgagagcaccgcccagatcgagaagaagcccagaaagcccctggacagcgtgggcctgctggagggcgacagaaacaagagaaagaagagcccccagatgaacgacttcaacatcaaggagaacaagagcgtgagaaactaccagctgagcaagtacagaagcgtgagaaagaagagcctgctgcccctgtgcttcgaggacgagctgaagaacccccacgccaagatcgtgaacgtgagccccaccaagaccgtgaccagccacatggagcagaaggacaccaaccccatcatcttccacgacaccgagtacgtgagaatgctgctgctgaccaagaacagattcagcagccaccccctggagaacgagaacatctacccccacaagagaaccaacttcatcctggagagaaactgcgagatcctgaagagcatcatcggcaaccagagcatcagcctgttcaagccccagaagaccatgcccaccgtgcagagaaaggacatccagatccccatgagcttcaaggccggccacaccaccgtggacgacaagctgaagaagaagaccaacaagcagaccctggagaacagaagctggaacaccctgtacaacttcagccagaacttcagcagcctgaccaagcagttcgtgggctacctggacaaggccgtgatccacgagatgagcgcccagaccggcaagttcgagagaatgttcagcgccggcaagcccaccagcatccccaccagcagcgccctgcccgtgaagtgctacagcaagcccttcaagtacatctacgagctgaacaacgtgacccccctggacaacctgctgaacctgagcaacgagatcctgaacgccagctag

SEQ ID NO: 18479 - DNA, 1203 bp, Artificial Sequence; identical to SEQ ID NO: 18478
  Description of Artificial Sequence: Synthetic coding sequence

SEQ ID NO: 18480 - DNA, 846 bp, Artificial Sequence; identical to SEQ ID NO: 18477
  Description of Artificial Sequence: Synthetic coding sequence

SEQ ID NO: 18481 - DNA, 1203 bp, Artificial Sequence; identical to SEQ ID NO: 18478
  Description of Artificial Sequence: Synthetic coding sequence

SEQ ID NO: 18482 - DNA, 477 bp, Artificial Sequence
  Description of Artificial Sequence: Synthetic coding sequence
atgagaagaagcctgagagccggcaagagaagacagaccgccggcaagagcaagagcccccccaaggtgcccatcgtgatccaggacgacagcctgcccgccggcccccccccccagatcagaatcctgaagagacccaccagcaacggcgtggtgagcagccccaacagcaccagcagacccaccctgcccgtgaagagcctggcccagagagaggccgagtacgccgaggccagaaagagaatcctgggcagcgccagccccgaggaggagcaggagaagcccatcctggacagacccaccagaatcagccagcccgaggacagcagactgcagaccgcccagatcaacgccggcaagaagagatgcagaagatgctgcagacacagactgctgggcagaccccccagagtggccctgccctggcagaccgccggcctggagcagagagagagacccgacctgctggccctgtag

SEQ ID NO: 18483 - DNA, 459 bp, Artificial Sequence
  Description of Artificial Sequence: Synthetic coding sequence
atggaggacgaggaggtggccgagagctgggaggaggccgccgacagcggcgagatcgacagaagactggagaagaagctgaagatcacccagaaggagagcagaaagagcaagagcccccccaaggtgcccatcgtgatccaggacgacagcctgcccgccggcccccccccccagatcagaatcctgaagagacccaccagcaacggcgtggtgagcagccccaacagcaccagcagacccaccctgcccgtgaagagcctggcccagagagaggccgagtacgccgaggccagaaagagaatcctgggcagcgccagccccgaggaggagcaggagaagcccatcctggacagacccaccagaatcagccagcccgaggacagcagacagcccaacaacgtgatcagacagcccctgggccccgacggcagccagggcttcaagcagagaagatag

SEQ ID NO: 18484 - DNA, 402 bp, Artificial Sequence
  Description of Artificial Sequence: Synthetic coding sequence
atgagaagaagcctgagagccggcaagagaagacagaccgccggcagaaagagcaagagcccccccaaggtgcccatcgtgatccaggacgacagcctgcccgccggcccccccccccagatcagaatcctgaagagacccaccagcaacggcgtggtgagcagccccaacagcaccagcagacccaccctgcccgtgaagagcctggcccagagagaggccgagtacgccgaggccagaaagagaatcctgggcagcgccagccccgaggaggagcaggagaagcccatcctggacagacccaccagaatcagccagcccgaggacagcagacagcccaacaacgtgatcagacagcccctgggccccgacggcagccagggcttcaagcagagaagatag

SEQ ID NO: 18485 - DNA, 423 bp, Artificial Sequence
  Description of Artificial Sequence: Synthetic coding sequence
atggaggacgaggaggtggccgagagctgggaggaggccgccgacagcggcgagatcgacagaagactggagaagaagctgaagatcacccagaaggagagcagaaagagcaagagcccccccaaggtgcccatcgtgatccaggacgacagcctgcccgccggcccccccccccagatcagaatcctgaagagacccaccagcaacggcgtggtgagcagccccaacagcaccagcagacccaccctgcccgtgaagagcctggcccagagagaggccgagtacgccgaggccagaaagagaatcctgggcagcgccagccccgaggaggagcaggagaagcccatcctggacagacccaccagaatcagccagcccgaggacagcagacagcccaacaacgtgatcagacagagaagatag

SEQ ID NO: 18486 - DNA, 480 bp, Artificial Sequence
  Description of Artificial Sequence: Synthetic coding sequence
atgagctacgaggtggccaccgccctggagaacagaagccacaaggtgagatacagcgacagcgtggagaacggcagcatcatcttcagcctgagcggcgtggccttcctgctgatggacaccaaggagtgcctgctgagcaccgaggagatcttcctggccaagatcgagaagttcatcaacatccaccagaacagcttcctggtgctgagcgccgccctgcacggccccgaggagtggaagctgatgttcagaatccagcagagattcctgggctgcaacctgagaatcctgcccgtgcacaacaccgtgaacgccatcaacctgatgtgcaccatcgccaagaccaccagcaagccctacatcgacagcatctgctacagaatgatcaccgccaaggcctacatcatcgagcagagccccgtgtggaagaccctgcagaagatcaagctgaacagcgacagcgtgaaccccaactag

SEQ ID NO: 18487 - DNA, 543 bp, Artificial Sequence
  Description of Artificial Sequence: Synthetic coding sequence
atggccgagagcggcaaggagaagatcaagtggaccaccaccatcatcatcagcagcagcctgaagagctacgaggtggccaccgccctggagaacagaagccacaaggtgagatacagcgacagcgtggagaacggcagcatcatcttcagcctgagcggcgtggccttcctgctgatggacaccaaggagtgcctgctgagcaccgaggagatcttcctggccaagatcgagaagttcatcaacatccaccagaacagcttcctggtgctgagcgccgccctgcacggccccgaggagtggaagctgatgttcagaatccagcagagattcctgggctgcaacctgagaatcctgcccgtgcacaacaccgtgaacgccatcaacctgatgtgcaccatcgccaagaccaccagcaagccctacatcgacagcatctgctacagaatgatcaccgccaaggcctacatcatcgagcagagccccgtgtggaagaccctgcagaagatcaagctgaacagcgacagcgtgaaccccaactag

SEQ ID NO: 18488 - DNA, 813 bp, Artificial Sequence
  Description of Artificial Sequence: Synthetic coding sequence
atgcagggcaacaacctgcagccccccagccccagacccctggagtgctggagcctgcacagagaggccccccagagaaccgaggccagcagaacccaccccagccccttcctggccctgcccggcagccacagaaccgccaaccaggcccaggtggtgcccggcctggtgcaccacccccaggagaacacccagagactgagaatcagagccggcctgagccccttccccagagccagactggccgccatcggcagcacccacggccacagatgggtgcccggcatctgcctgcccagatgcctgtgccccgccagctgcgccctgcacgcctgccccccccactgcaacaacgccgaggcccacagctggctgagactgggcggccccctgcagagcagaagcgtggagcaccagcagcacgcctgcggctggggctgggtgacccacgccacctacggcgagagaggcaccagccaggccgccgagagacagagaatcgcccacaccagagccctgagcgtgggcaactgccccagaagccacttccagtgcgagttcagcagcatcagcaagtggagcgagggcaccggcaccttcagccccagacccagagccgtgaagagcggcgtgggcggccagcccagcccccacatcagaatcacctggagaagctgcaccaccctgaccagcaagccctgcagcagagccatcacccccgagtgcgtggtgggctggagcagaagaagcagacactggtacagcgacatgagaaccggcgagtgccagggcctgagccccatcaccagatag

SEQ ID NO: 18489 - DNA, 333 bp, Artificial Sequence
  Description of Artificial Sequence: Synthetic coding sequence
atgacctaccccccccacagagccttcagcagaagcgacgtgccctaccccctgctgagcagccccgtgcagtggcccctgagcctggtggtgggcgacaccagcaccagatggccccagcagcccagcgccctggagagcgactgccccggccccagccacccctgcctggccggcctgctgggccccatgcaccccgtggacatccccctgagcaccgccctgcacagcaagcaccagagaagactgacccagtgcgtgctgatggtgcagagccccagcaagcagagaagcctgtacctgctgaacaagaagatcccccacgacgcctag

SEQ ID NO: 18490 - DNA, 408 bp, Artificial Sequence
  Description of Artificial Sequence: Synthetic coding sequence
atgggcaactacctgctgagaaagctgagctgcctgggcgagaaccagaagaagcccaagaagggcaaccccgacgaggagagaaagagacaggagatgaccaccttcgagagaaagctgcaggaccaggacaagaagagccaggaggtgagcagcaccagcaaccaggagaacgagaacggcagcggcagcgaggaggtgtgctacaccgtgatcaaccacatcccccaccagagaagcagcctgagcagcaacgacgacggctacgagaacatcgacagcctgaccagaaaggtgagacagttcagagagagaagcgagaccgagtacgccctgctgagaaccagcgtgagcagaccctgcagctgcacccacgagcacgactacgaggtggtgttcccccactag

SEQ ID NO: 18491 - DNA, 348 bp, Artificial Sequence
  Description of Artificial Sequence: Synthetic coding sequence
atgggcaactacctgctgagaaagctgagacaggagatgaccaccttcgagagaaagctgcaggaccaggacaagaagagccaggaggtgagcagcaccagcaaccaggagaacgagaacggcagcggcagcgaggaggtgtgctacaccgtgatcaaccacatcccccaccagagaagcagcctgagcagcaacgacgacggctacgagaacatcgacagcctgaccagaaaggtgagacagttcagagagagaagcgagaccgagtacgccctgctgagaaccagcgtgagcagaccctgcagctgcacccacgagcacgactacgaggtggtgttcccccactag

SEQ ID NO: 18492 - DNA, 402 bp, Artificial Sequence
  Description of Artificial Sequence: Synthetic coding sequence
atggtgatgctggaggacagcaacagcagcaccggctgcggcgccagaaactgcgtggagtgcctggtgttcctgagcgtgctgggctgccagagcgagagaaagggccagatgagaacccagcaggccggcagatggctgagagccggcagagaggccagcagcgagaccaaccccgagggcaccctgatcctggacttccagagccccgagctgcccctggccgccagaggctggcaggagcacgagcccgtggtgagatgcaacgtgctgccccacgccttcagcagctggtgcttcggccagaacttccccaagtggagcgagacccaggagctgagaaacagagtgaccgtgaagagatgggagatcatcagctgcgagaacagcggcgagagctag

SEQ ID NO: 18493 - DNA, 348 bp, Artificial Sequence; identical to SEQ ID NO: 18491
  Description of Artificial Sequence: Synthetic coding sequence

SEQ ID NO: 18494 - DNA, 243 bp, Artificial Sequence
  Description of Artificial Sequence: Synthetic coding sequence
atgggcaactacctgctgagaaagctgagctgcctgggcgagaaccagaagaagcccaagaagggcaaccccgacgaggagagaaagagacaggagatgaccaccttcgagagaaagctgcaggaccaggacaagaagagccaggaggtgagcagcaccagcaaccaggagaacgagaacggcagcggcagcgaggaggtgtgctacaccgtgatcaaccacatcccccaccagagaagctag

SEQ ID NO: 18495 - DNA, 348 bp, Artificial Sequence; identical to SEQ ID NO: 18491
  Description of Artificial Sequence: Synthetic coding sequence

SEQ ID NO: 18496 - DNA, 585 bp, Artificial Sequence
  Description of Artificial Sequence: Synthetic coding sequence
atgttcctgaccgccgtgaacccccagcccctgagcacccccagctggcagatcgagaccaagtacagcaccaaggtgctgaccggcaactggatggaggagagaagaaagttcaccagagacaccgacaagaccccccagagcatctacagaaaggagtacatccccttccccgaccacagacccgaccagatcagcagatggtacggcaagagaaaggtggagggcctgccctacaagcacctgatcacccaccaccaggagcccccccacagatacctgatcagcacctacgacgaccactacaacagacacggctacaaccccggcctgccccccctgagaacctggaacggccagaagctgctgtggctgcccgagaagagcgacttccccctgctggccccccccaccaactacggcctgtacgagcagctgaagcagagacagctgacccccaaggccggcctgaagcagagcacctacaccagcagctaccccagaccccccctgtgcgccatgagctggagagagcacgccgtgcccgtgcccccccacagactgcaccccttcccccacttctag

SEQ ID NO: 18497 - DNA, 471 bp, Artificial Sequence
  Description of Artificial Sequence: Synthetic coding sequence
atgttcctgaccgccgtgaacccccagcccctgagcacccccagctggcagatcgagaccaagtacagcaccaaggtgctgaccggcaactggatggaggagagaagaaagggcctgccctacaagcacctgatcacccaccaccaggagcccccccacagatacctgatcagcacctacgacgaccactacaacagacacggctacaaccccggcctgccccccctgagaacctggaacggccagaagctgctgtggctgcccgagaagagcgacttccccctgctggccccccccaccaactacggcctgtacgagcagctgaagcagagacagctgacccccaaggccggcctgaagcagagcacctacaccagcagctaccccagaccccccctgtgcgccatgagctggagagagcacgccgtgcccgtgcccccccacagactgcaccccttcccccacttctag

SEQ ID NO: 18498 - DNA, 4422 bp, Artificial Sequence
  Description of Artificial Sequence: Synthetic coding sequence
atgaccagaatgagctgcccctggggcagctaccagtgggagcccggcgcctgccccgccgcccccagaggcatcggcggcggcgacatggccggcggcatccccgacgtgagaggcctgcaggaggccgccctgggcgccggcagaagccaggaggaggccagactggtggaggaggcccagacccccgtgatgctgccccaggacagcggccagagagtggaggaggtgcccggcgacctgatggccaagagaatgagcctgatcctgcacgtgcagaagctgccctgggaccacgtgccctgcctgagaagaaccagacagaacctgtaccaggacgtgggcggccacgcccacggcagcggcctgggcggcgccaagagaggcgccgccagaagcgccctgagaagacccctgccccccgccacctgcagacccgccggcatcgtgagcggccccagccccagactggacagcaaccccaccggcgcccacctgatcaagcagaccagacccctgaccgtggagtggaccaaggacacccccgtgcccgagcccatggagctgagaagcgacgccagccacaaggagaacgtgagccccaagcccgccgccctgcccaagcccggcaagagactgaagcagagaagattcagaagaagcctgggcatcggcctgagcggcagacacgaccagtgggtgcccggctgccaggtggagagaggcggccccgccgccacccccagccccggcgccgtgctggaccaggagccctgcagagtgcagaccaacctggccagccccggccccagactgggcctggccctgaaggacaccaccggccagctggtgaacagcagcttctggcagcagagcaacctgcagagcctggccagaagaagacagggcaaggccagagagttcgccatccagcagagcaacctgagcatcaacgagaccagcagcccccacctgtgccccgagcccggcggcagcagcggcccccacaagctgccctggggccccctgctgagccaggagcccctggccagacccagcagctgcctgagacagagcggcctgcccgcccccggcacccccagcggcgacttcagacccaccgaggccttcgcccccctggacggccacacccagcccggcctgagaagctggggcggcctgggcagctggagaagcagactggtgggcgagcccctgaccctggaggacctggccgtgcccagccagaaccagacccaggcccccagcagagccgccgtgcaccagctgctggccagcgtgcactgcctggcccaggaggccgccagactgagatgccaggccccccaggagccccccgcctggggcgtgagccccaagcagaagggcgaggagggcgcccccagagagagagtgcacagagaggaggagagaaccgccttccacctgagcgacaccgtgcccgccagcagcgccagcaagaacaaggcccagaacatcaccgcccccgagagcgaggccatctgctggcagctgctgagcagatgcttcagaagctggagacacctggtgaagagacagagagagcccgccgccgccgccgtggccctgggcagatggcagctgctgagaaagtgcctgcaggccctgtggctgagagaggcccagctggaggccgcctggggccagtacaccaaggtgctgctggtgagaagcttcagagaggtgagcggcctgcaggtgggccccggcggcagagtgaagcagtgccccggcagcctgagagaggaggagatcgcccagagactgctgagccaccccagacagagaaccgacagcagacacgagagagtgcagatcctgcaggccctgcagctggccgtgttcttcctgtggtgccagcagaagaagagagccagacaggagagagagaccctgagaaaggccaccagagccacccagagaaccggcagcttcccccaggcctggcacagcaccgccgccggcgtggcctgggtggcccccctgagcccccagcaccagagagcctggctgtgcagatgcttcggcgcctggcagcagttcgtgcagagaggcagcagatacagagaccacctggccgacagaagaaccggcaccctgagaaagtgcctggagcagtgggtgagaatgaagcagctgagagagagcgacggcgccaaggtgacccagctgagcctgtgcagacagaaggccggcagagaggccgtgtacaccgccggccccggcgcctgcggcctgggcgccgtgggccaggcccagggccagcaggagcagggcagaggcagcctgcaggacgcctgctggaccctggccctgtgctgggccctgctgctgtggaagatgagactgttccagagacagtgggccaacagcttcttccagggcctgcagcagagaatgctgcagagaagcctgagatggtggcacctgagagccctgggccccgacgccaccagcagctgcaccaagacccccagcgccctggagcccctgagcagcagcaccctgcaggacagcctggagaaggtgcccagagcccccaccctgcccgacaccctgcagggcagcctgctgtgggccgccggccagagacagcagggccagtgcctgctgctgtggcaggccagagcccagcagttccagggcaccgccagatggtaccagcacaccagacagagaagaatcttcctgagctggagcagatgggccaccgcccagtgggcctggagagagctggccagccacagagcctgggacagaacctgcagagccgtgctgggcctgtggagacagagactgctgcagagcagactggtggagtggtgggcccaggagagaggctggagactggccagagacgccctgtgccactggcacagctgctggcagggccagcagttcctgcacgagaagtgccagacctgggtgcaggtgcacctgcagggcctgcagaaggtggtgttcagaagctggcagcaggccgccgcccaccagagatgcaccgtgaccagacccgagcagctgctgctgcagagctacttccaggcctggtgcgaggtggtgagagacaccggcgtgctgagagcccagcaccaggccttccaggacggcctgagaagaagagccctgggcgccgtgttcgccacctggagagaggcccaggaggtggccgccggcgcccaggagcagagagtggcccaggccagcctggccagatggagaagctgcggccagcagggccaggaggacggccagcagaagaaggccagagccccccaggccttccccgcctggcccgtggcccccggcatgcaccacgaggcccagcagcaggccggcgagagcgccggcgcccaggccgcccagtgctggacctggtgctgggccctgtgggtgcacgagagctgcagaggccaggtgagcagagcccacgccagctggaagcccagagcctgggtgctggaggccagcgtgcagagcgccgtgagaggcggcgtgcagagagccatcctgacccagctgagacccgccgagctgagaagattcctgagaaccgtgcagctgagagtgagactgggcctgcccggcgccggcaagaccagaagctgctggacccaggccaccgagctggtgccccccgcccccagcctgcagtgcagcctgggcggcagaagaaagcccagaggcaccgcctgggcccagagatgcagagagcacagcctgtgccccgccttccagctgtggccccagtggcccggccagagcagctgggtgcccggcctgcccctgtggaccagagaccagggccccagagcccacagcagccccgagcccagagcctgcaaggcccagagcaaggcccacaagagaagactgagagccagaagctgcagaatcctggagaagcaggcccaggcccacggcagcgccctgctgctggccctgaagggccacgacgccctgggccaccaggaggaggtgcccgccgcccccgtgcccagaggcaccgccagcagagccgccggcttccccgccggccaggtgcccggcagcggcatggccgccctgggcggctgccccagaggcagagccgccggcgccgaccccgcccagggcgtggcccccgagatgggcctggccgacgtggtggccgccgaccccgccaccgccagcggcagcgccgtgaccgccgccggcagatgggccttcaagaagtggcaccagagactggccgccagaagccccagaagaggcgccgccagcagccccagaccctggagcaagcccggccccaagggccccgagagcggccaggaggccgccagagcccccagaggctggggcctgggcgccgagcacggcgcccagctgcagctgtag

SEQ ID NO: 18499 - DNA, 732 bp, Artificial Sequence
  Description of Artificial Sequence: Synthetic coding sequence
agaagcgacgccagccacaaggagaacgtgagccccaagcccgccgccctgcccaagcccgagcagagaagattcagaagaagcctgggcatcggcctgagcggcagacacgaccagtgggtgcccggctgccaggtggagagaggcggccccgccgccacccccagccccggcgccgtgctggaccaggagccctgcagagtgcagaccaacctggccagccccggccccagactgggcctggccctgaaggacaccaccggccagctggtgaacagcagcttctggcagcagagcaacctgcagagcctggccagaagaagacagggcaaggccagagagttcgccatccagcagagcaacctgagcatcaacgagaccagcagcccccacctgtgccccgagcccggcggcagcagcggcccccacaagctgccctggggccccctgctgagccaggagcccctggccagacccagcagctgcctgagacagagcggcctgcccgcccccggcacccccagcggcgacttcagacccaccgaggccttcgcccccctggacggccacacccagcccggcctgagaagctggggcggcctgggcagctggagaagcagactggtgggcgagcccctgaccctggaggacctggccgtgcccagccagaaccagacccaggcccccagcagagccgccgtgcaccagctgctggccagcaccctgggctag

SEQ ID NO: 18500 - DNA, 2187 bp, Artificial Sequence
  Description of Artificial Sequence: Synthetic coding sequence
atggagggcgagggcgtgagaaacttcaaggagctgagagccaagttccagaacctggacgccccccccctgcccggccccatcaagttccccgccggcgtgagccccaagggcgacatcggcggcacccagagcacccagatcctggccaacggcaagcccctgagcagcaaccacaagcagagaaccccctactgcagcagcagcgagagccagcccctgcagccccagaagatcaagctggcccagaagagcgagatccccaagtgcagcaacagccccggccccctgggcaagagcaccgtgtgcagcgccaccagcagccagaaggccagcctgctgctggaggtgacccagagcaacgtggagatcatcaccaaggagaaggtgatggtggccaacagcttcagaaacaagctgtggaactgggagaaggtgagcagccagaagagcgagatgagcagcgccctgctgctggccaactacggcagcaaggccatccacctggagggccagaagggcatgggcctgacccccgaggagcccagaaagaagctggagaccaagggcgcccagaccctgcccagccagaagcacgtggtggcccccaagatcctgcacaacgtgagcgaggaccccagcttcgtgatcagccagcacatcagaaagagctgggagaaccccccccccgagagaagccccgccagcagcccctgccagcccatctacgagtgcgagctggccagccaggcccccgagaagcagcccgacgtgagacaccaccacctgcccaagaccaagcccctgcccagcatcgacagcctgggcccccccccccccaagcccagcagaccccccatcgtgaacctgcaggccttccagagacagcccgccgccgtgcccaagacccagggcgaggtgaccgtggaggagggcagcctgagccccgagagactgttcaacgccgagttcgaggagccccacaactacgaggccaccatcagctacctgagacacagcggcaacagcatcaacctgtgcaccgccaaggagatcgccgaccccacctacgaggtgggcatcgaggagctgcagaagcccggcaagaacttcccctaccccgagcccagcgccaagcacgaggacaagaagatgaaggagaagcagccctgcgagctgaagcccaagaacaccgagaaggagccctacagcaaccacgtgttcaaggtggacgcctgcgagggcacccccgagaagatccagatgaccaacgtgcacaccggcagaagaaacatgctggccggcaagcaggaggccatgatcgacatcatccagaccaacccctgccccgagggccccaagctggccagacacagccagggccactgcggccacctggaggtgctggagagcaccaaggagacccccgacctgggcgtgagcaagaccagcagcatcagcgaggagatctacgacgacgtggagtacagcagaaaggaggtgcccaagctgaactacagcagcagcctggccagcagcagcgaggagaacagagagctgtacgaggacgtgtacaagaccaagaacaactaccccaagatcgacctggacggcaaggaggccctgaagagactgcagcagttcttcaagaaggagaaggacagattcaagatcaagaagaccaagagcaaggagaacctgagcgccttcagcatcctgctgcccgacctggagctgaagagccaggaggtgatcatctacgacgacgtggacctgagcgagaaggagagcaaggacgaggacaagctgaagatgtggaagcccaagttcctgacccccaaggagaagaaggagaagaacggcgccgaggagagcgagagcttcagccccagaaacttcttcaagaccaagaagcagaacctggagaagaacagaatgaagagagaggagaagctgttcagagagagattcaagtacgacaaggagatcatcgtgatcaacaccgccgtggcctgcagcaacaacagcagaaacggcatcttcgacctgcccatcagccccggcgaggagctggaggtgatcgacaccaccgagcagaacctggtgatctgcagaaacagcaagggcaagtacggctacgtgctgatcgagcacctggacttcaagcaccagagctggagcccctag

SEQ ID NO: 18501 - DNA, 2091 bp, Artificial Sequence
  Description of Artificial Sequence: Synthetic coding sequence
atgcccacccaggacggccagctgagaagacccgccagaccccccggccccagagcctggatggagcccagaggcggcggcagcagccagttcagcagctgccccggccccgccagcagcggcgaccagatgcagagactgctgcagggccccgcccccagaccccccggcgagccccccggcagccccaagagccccggccacagcaccggcagccagagaccccccgacagccccggcgccccccccagaagccccagcagaaagaagagaagagccgtgggcgccaagggcggcggccacaccggcgccagcgccagcgcccagaccggcagccccctgctgcccgccgccagccccgagaccgccaagctgatggccaaggccggccaggaggagctgggccccggccccgccggcgcccccgagcccggccccagaagccccgtgcaggaggacagacccggccccggcctgggcctgagcacccccgtgcccgtgaccgagcagggcaccgaccagatcagaacccccagaagagccaagctgcacaccgtgagcaccaccgtgtgggaggccctgcccgacgtgagcagagccaagagcgacatggccgtgagcacccccgccagcgagccccagcccgacagagacatggccgtgagcacccccgccagcgagccccagagcgacagagacatggccgtgagcacccccgccagcgagccccagcccgacaccgacatggccgtgagcacccccgccagcgagccccagcccgacagagacatggccgtgagcatccccgccagcaagccccagagcgacaccgccgtgagcacccccgccagcgagccccagagcagcgtggccctgagcacccccatcagcaagccccagctggacaccgacgtggccgtgagcacccccgccagcaagcacggcctggacgtggccctgcccaccgccggccccgtggccaagctggaggtggccagcagcccccccgtgagcgaggccgtgcccagaatgaccgagagcagcggcctggtgagcacccccgtgcccagagccgacgccgccggcctggcctggccccccaccagaagagccggccccgacgtggtggagatggaggccgtggtgagcgagcccagcgccggcgcccccggctgctgcagcggcgcccccgccctgggcctgacccaggtgcccagaaagaagaaggtgagattcagcgtggccggccccagccccaacaagcccggcagcggccaggccagcgccagacccagcgccccccagaccgccaccggcgcccacggcggccccggcgcctgggaggccgtggccgtgggccccagaccccaccagcccagaatcctgaagcacctgcccagacccccccccagcgccgtgaccagagtgggccccggcagcagcttcgccgtgaccctgcccgaggcctacgagttcttcttctgcgacaccatcgaggagaacgaggaggccgaggccgccgccgccggccaggaccccgccggcgtgcagtggcccgacatgtgcgagttcttcttccccgacgtgggcgcccagagaagcagaagaagaggcagccccgagcccctgcccagagccgaccccgtgcccgcccccatccccggcgaccccgtgcccatcagcatccccgaggtgtacgagcacttcttcttcggcgaggacagactggagggcgtgctgggccccgccgtgcccctgcccctgcaggccctggagccccccagaagcgccagcgagggcgccggccccggcacccccctgaagcccgccgtggtggagagactgcacctggccctgagaagagccggcgagctgagaggccccgtgcccagcttcgccttcagccagaacgacatgtgcctggtgttcgtggccttcgccacctgggccgtgagaaccagcgacccccacacccccgacgcctggaagaccgccctgctggccaacgtgggcaccatcagcgccatcagatacttcagaagacaggtgggccagggcagaagaagccacagccccagccccagcagctag

SEQ ID NO: 18502 - DNA, 1197 bp, Artificial Sequence
  Description of Artificial Sequence: Synthetic coding sequence
atgcccagacccggccaccccagacccgccagcggcccccccagactgggcccctgggagagacccaccgagctgtgcctggagacctacgacaagcccccccagcccccccccagcagaagaaccagaagacccgaccccaaggaccccggccaccacggccccgagagcatcaccttcatcagcggcagcgccgagcccgccctggagagccccacctgctgcctgctgtggagaccctgggtgtgggagtggtgcagagccgccttctgcttcagaagatgcagagactgcctgcagagatgcggcgcctgcgtgagaggctgcagcccctgcctgagcaccgaggacagcaccgagggcaccgccgaggccaactgggccaaggagcacaacggcgtgccccccagccccgacagagccccccccagcagaagagacggccagagactgaagagcaccatgggcagcagcttcagctaccccgacgtgaagctgaagggcatccccgtgtacccctaccccagagccaccagccccgcccccgacgccgacagctgctgcaaggagcccctggccgaccccccccccatgagacacagcctgcccagcaccttcgccagcagccccagaggcagcgaggagtactacagcttccacgagagcgacctggacctgcccgagatgggcagcggcagcatgagcagcagagagatcgacgtgctgatcttcaagaagctgaccgagctgttcagcgtgcaccagatcgacgagctggccaagtgcaccagcgacaccgtgttcctggagaagaccagcaagatcagcgacctgatcagcagcatcacccaggactaccacctggacgagcaggacgccgagggcagactggtgagaggcatcatcagaatcagcaccagaaagagcagagccagaccccagaccagcgagggcagaagcaccagagccgccgcccccaccgccgccgcccccgacagcggccacgagaccatggtgggcagcggcctgagccaggacgagctgaccgtgcagatcagccaggagaccaccgccgacgccatcgccagaaagctgagaccctacggcgcccccggctaccccgccagccacgacagcagcttccagggcaccgacaccgacagcagcggcgcccccctgctgcaggtgtactgctag

SEQ ID NO: 18503 - DNA, 624 bp, Artificial Sequence
  Description of Artificial Sequence: Synthetic coding sequence
atgcccagacccggccaccccagacccgccagcggcccccccagactgggcccctgggagagacccaccgagctgtgcctggagacctacgacaagcccccccagcccccccccagcagaagaaccagaagacccgaccccaaggaccccggccaccacggccccgagagcatcaccttcatcagcggcagcgccgagcccgccctggagagccccacctgcctgctgagaacccccctgagaggcctgctgaagcccaccggccccagaagcaccatggagtgcccccccgccctgatcgtgcacccccccgccggcggcatggccagcggcagcagccagccctgggccgccgccagcgccacccccatgctgagcagcaaggccagcctgtgcatccccaccagaggcccccccccccagcccctgatgagaacccccgccgccagaagccactggcccatcccccacccctgcgacaccgcctgccccgcccccctgcccgtggtgctggtggcccccagaagcaccatcctgagcatgagcagaacctggacctgcagaagatgggccgtggccccctgcagagccgagaagctgatgtgcagcagcagcagaagctag

SEQ ID NO: 18504 - DNA, 4593 bp, Artificial Sequence
  Description of Artificial Sequence: Synthetic coding sequence
atgagccacagccaccccgccggcctgctggccgcctacaacagcctgatggacaagcacctggccggctacttcaacaacaccagaatcagaagacacctgctgagaagcggcctgatcaccagaagcggcagaatcctgagcgagaaggagtacaagctgaacatgatgaagagagaccaccagaagtacatcagagagtgcctggcccaggccatcttccacaaggtgctggacatggagagataccaccagctggagatcaagaagaagctggagaccctggccagaaaggagagaatccagagattcaagggcgagcacaccagaagaagcgtggagaacaacatgcccatcctgagcccccacccccccgtgggccccaagagcaacagaggccacagcgtgctggtggacgagggccacagcagccccctggccctgaccgcccccagaccctacaccgcccccggcaacatgcagccccccatcagactgcagcccctgcccagcaaccccgccgtggagaccgtgcccaaggtgaccagcagaagcagaagcaagaccagcctgctggagaacgaggccctgttccccatcggcggcaagaaggccgtgatgaagttcagaaacagcatcggcaacagccagagaatgaacagctaccagctgcccaacatcaacagctacatgatgcccatccccccccccctgccccccaccggcaagatcaccagagagaacagaagcgagacctggagaagaagaagattcagacccaccaccgcccccaacggcctggagcccctgctgaccaaggacagcagaagaatccacaagaccagcctgcacagcaacgccgccatcaccatgatctacctgggcaagaacgtgcacctgagcagcgacaaccccgacttcagagacgagatcaaggtgtaccagcagcactgcggcggcgagaacctgtgcgtgtacaagggcaagctgctggagaaggagaccttccagttcatcagcaagagacaccacggcttccccttcagcctgaccttcttcctgaacggcatgcaggtgaacagactgagcagctgctgcgagtacaagcacagaaagggcagcagactgggcggcaagagaggctacttcggcttcgtgtgcgtggagagaagcagcccctgctacaagtgcatcatcgccatgggcctggacaagaagcccagcctgcccaagagcagaaaggagaagagcaccgagaagggcgaggagctgaagaaggccgagggcaaggtgagaaaggagagagagtacgtgatccccaagagaaacgagatcaaggagaacaagaccagcgtgagcgccaagttcagcgcccaggagatcaagaccggcctgaaggaggtggtgaccgccgtggaggagatgaccagcaagggcaagcccggccaggaggtgctggaggacgaccaggagaacaccctgaagtacgagtacgaggaggacttcgaggtggacgaggagaagcagggcgagaagagcaacgaggagggccaggccgacgtgcagatgaacggcatcccccagagccccctggacgacaagaaggacaacctggaccccgagaaggagagcgagaccagcagccagaaggcccccgacgccagagacaacgtgaaggacgagaacgacggctgcagcgagagcgagctggaggaggacaagcaggacatgaagaccgccagcagcaccagcagcagaagccacccctacagcagcgacagcgaggacgagagcgccgtgggcgacagagaggcccacaccgacagcagcaccgacgagagcgccagaagaagcagcagccaggagctgagcgagaacgacaagcccagaaagagccacctgcccatcgaggagagcctggagatcgagatcgaggaccaggagatcaccaaggccgacgtggagaccaagcccatgcccatcgacgagagcttcgagaacgtgctgaaggagggcaccgagaagggcacccaggagatcgccgagggcctgagcgagaagagcggcaagcacgtgagcgccgaggagaaggagaaggacaagagcaagctgtgggaggagagcaccgcccaggtgaaggacaagaaggccggcctgcccggcctggaggagggcggcaaggacagcctgcccctggcctacgtgctggccctgggcgcccccaccatgaacttcatggtggacgagaccgccgccatcaacagcaacaaggagagccagcagctggtgcagaagacctacaccctggagaagaaggaggccatggaggaggacgaggccccccagcacagagacgccgacatcgtgcagggcaagggcgaggccgccctgtggggcgaggccggcgccgtgcacgaggcccccctgagagcctggaagcccaccgccgagcagcccgagctggccgaggagttcaccgagaagagagagatcccccccggcatcgagagaggcgccgagggcgccgccgaggccgagggcgtgagaagactgggcgagggcggcagcgaccccatcggccaggccgccgccaaggacgccgtgggcctgagcaaggacgaggcccccgagaagcaggccctgatgctgaccgtgctggagaccgacaaggccgccagcgagggcgagcagggcctggagaaggccgtgctggccaacgaggccgccgccctgaacctggagcacctgcacgaggtggccgccctgagagaggccgccaccagcgaggagggcgaggccgagggcggcgtggccgtgagcgacgtgggcgagagcgaggaggaggccagcatcgacctggaggacaccggccccatggaggacaccgccagcaagagagaggacggcagcgaggaggccatcctgggcggcgaggagcccgccaaggagagaaaggaggtgatgagaaccgagaccagactgagccccttcaccggcgaggccgaggccagcagaatgcaggtgagcgagggcagccccgaggagggcagcctggccaaggaggccttcctgtgcaaggaggacgtggagggcgaggagatggtgaccgaggccgaggccaacagagaggacgacagaaaggagatcctgcccaaggagctggacctggccagagagagaagaaaggccgagagacccaagaccagcctgagaaagaccgacagcgagagagaggaggtgaccagagccaacgccctgaaggacgaggacgccttcaaggaggagcagaagctgaaggccgaggagggcgagaccgagaccgaggtgagagccgaggaggagaccaaggccccccccaacgagatgggcagcgacgccgagaacgaggcccccgtggaggccagcgagctgagcgacaaccccggcctgctgggcgaggacagcctgaaggagaccgtggtgcccatcttcgaggccacccccggcttcgagaagagcctggagaacatcaccgccctgagaaaggagggcggcggcgagagactgagcgaggccagagacaccgagcacaaggacagagaggagctgagcagcagagagaacagagccctgaaggagggccacagacaggacggcgagggcgccctggccgcccccgaggccgagcccgccggcaaggtgcaggcccccgagggcctgatccccgccaccggccaggccgaggagctggccgccaaggaccacgacagctgcgccggcctggagggcagagccgagggccagggcggcgtggacgtggtgctgagaacccaggaggccgtggccgaggaggaccccatcatggccgagaagttcagagaggaggccgtggacgaggaccccgaggaggaggaggacaaggagtgcaccctggagaccgaggccatgcaggacagaaacagcgagggcgacggcgacatggagggcgagggcaacacccagaagaacgagggcatgggcggcggcagagtggtggccgtggaggtgctgcacggcggcggcgagaccgccgagaccgccgccgaggagagagaggtgctggccggcagcgagaccgccgaggagaagaccatcgccaacaaggccagcagcttcagcgacgtggccgaggaggagacctggcaccagcaggacgagctggtgggcaagaccgccgccgccggcaaggtggtggtggaggagctggccagaagcggcgaggaggtgcccgccgccgaggagatgaccgtgacctacaccaccgaggccggcgtgggcacccccggcgccctggagagaaagaccagcggcctgggccaggagcaggaggagggcagcgagggccaggaggccgccaccggcagcggcgacggcagacaggagaccggcgccgccgagaagttcagactgggcctgagcagagagggcgagagagagctgagccccgagagcctgcaggccatggccaccctgcccgtgaagcccgacttcaccgagaccagagagaagcagcagcacatggtgcagggcgagagcgagaccgccgacgtgagccccaacaacgtgcaggtgtag

SEQ ID NO: 18505 - DNA, 1602 bp, Artificial Sequence
  Description of Artificial Sequence: Synthetic coding sequence
atgctggccaagggcaagaaggccgtgatgaagttcagaaacagcatcggcaacagccagagaatgaacagctaccagctgcccaacatcaacagctacatgatgcccatccccccccccctgccccccaccggcaagatcaccagagagaacagaagcgagacctggagaagaagaagattcagacccaccaccgcccccaacggcctggagcccctgctgaccaaggacagcagaagaatccacaagaccagcctgcacagcaacgccgccatcaccatgatctacctgggcaagaacgtgcacctgagcagcgacaaccccgacttcagagacgagatcaaggtgtaccagcagcactgcggcggcgagaacctgtgcgtgtacaagggcaagctgctggagaaggagaccttccagttcatcagcaagagacaccacggcttccccttcagcctgaccttcttcctgaacggcatgcaggtgaacagactgagcagctgctgcgagtacaagcacagaaagggcagcagactgggcggcaagagaggctacttcggcttcgtgtgcgtggagagaagcagcccctgctacaagtgcatcatcgccatgggcctggacaagaagcccagcctgcccaagagcagaaaggagaagagcaccgagaagggcgaggagctgaagaaggccgagggcaaggtgagaaaggagagagagtacgtgatccccaagagaaacgagatcaaggagaacaagaccagcgtgagcgccaagttcagcgcccaggagatcaagaccggcctgaaggaggtggtgaccgccgtggaggagatgaccagcaagggcaagcccggccaggaggtgctggaggacgaccaggagaacaccctgaagtacgagtacgaggaggacttcgaggtggacgaggagaagcagggcgagaagagcaacgaggagggccaggccgacgtgcagatgaacggcatcccccagagccccctggacgacaagaaggacaacctggaccccgagaaggagagcgagaccagcagccagaaggcccccgacgccagagacaacgtgaaggacgagaacgacggctgcagcgagagcgagctggaggaggacaagcaggacatgaagaccgccagcagcaccagcagcagaagccacccctacagcagcgacagcgaggacgagagcgccgtgggcgacagagaggcccacaccgacagcagcaccgacgagagcgccagaagaagcagcagccaggagctgagcgagaacgacaagcccagaaagagccacctgcccatcgaggagagcctggagatcgagatcgaggaccaggagatcaccaaggccgacgtggagaccaagcccatgcccatcgacgagagcttcgagaacgtgctgaaggagggcaccgagaagggcacccaggagatcgccgagggcctgagcgagaagagcggcaagcacgtgagcgccgaggagaaggagaaggacaagagcaagctgtgggaggagagcaccgcccaggtgaaggacaagaaggccggcctgcccggcctggaggagggcggcaagtacggcagatag

SEQ ID NO: 18506 - DNA, 732 bp, Artificial Sequence
  Description of Artificial Sequence: Synthetic coding sequence
atgagaagcagaaagctgaccggcgccgtgagaagcagcgccagactgaaggccagaagctgcagcgccgccagactggccagcgcccaggaggtggccggcagcaccagcgccaagaccgcctgcctgaccagcagcagccacaaggccaccgacaccagaaccagcaagaagttcaagtgcgacaagggccacctggtgaagagcgagctgcagaagctggtgcccaagaacgacagcgccagcctgcccaaggtgacccccgagaccccctgcgagaacgagttcgccgagggcagcgccctgctgcccggcagcgaggccggcgtgagcgtgcagcagggcgccgccagcctgcccctgggcggctgcagagtggtgagcgacagcagactggccaagaccagagacggcctgagcgtgcccaagcacagcgccggcagcggcgccgaggagagcaacagcagcagcaccgtgcagaagcagaacgagcccggcctgcagaccgaggacgtgcagaagccccccctgcagatggacaacagcgtgttcctggacgacgacagcaaccagcccatgcccgtgagcagattcttcggcaacgtggagctgatgcaggacctgccccccgccagcagcagctgccccagcatgagcagaagagagttcagaaagatgcacttcagagccaaggacgacgacgacgacgacgacgacgacgccgagatgtag

SEQ ID NO: 18507 - DNA, 1245 bp, Artificial Sequence
  Description of Artificial Sequence: Synthetic coding sequence
atgagagagagccaggacgccgccggcgcccacggctggaacagagtgggcagcaccgccaccaagtggttcaccggcgcccccttcggcgtgcagagccacagattcgacatcagcgccgtgtaccccaactggaagaagttcagcaccttcaccgaggccccctacagcaccagatacagcacccaggtgagccacatcggccccggcacctacagcagcaaggagacctgcttcagcaagaagaagctgatgaaggaggtggacaccggctgggccaaggcccaggaggccaccagactgacccagctgccccacttccagtaccaggccatcatgaaggagaagagactgaaggagcagaagctgggccccggcagctacaacctgaaggacttcctggagcagctgagagagaagccctgcagcaccagaggcctgctgagcagcggcgaggtgagattcagaggcctgaccggcaactactaccccggccccggcaactacggcgagaagggcaacccctacaccaagctggaggagaacgcctggaacagaagccacagcgagggcctgatgtgcagaatgagcaacaagccccaccccagaccctaccagggcagcggcctgggccccggcacctacttcttcaagagcgacctggagacctacgtggccagaagcgtgggcaccagaggcccctacgacaccttcagcggcgacagaagcaagcccctgccctacggccactacagcatgcagaagaagaagcccagagagctgatgaacttcaagagcttcgtggaggagctgaacagccaccacaacaagaagcacggcgtgttcagcaagctgcccagaaaccccaagacccccaccgagagaatctactgggccaacctgagccagtgccccagaaccctggccaccagcggccccagcttctggctgccccaggagaagaagtgcaagcccgtgaaccagccccccttcctgctgaccagcaagggcagcggcgccaaggcctgccagatgatcatgggcagctggaaccccgtgggcgtgggcagatacctgaacacctggctgatggagaccaaggacagaagacagagatacagaagcctgttcctgagcggcagcaagagatacctgagcgacctggccagagacatgctgatgcagatcagactgttctgctggaagggcctggaggtgatcaacttcggcctgagccccatgtag

SEQ ID NO: 18508 - DNA, 1257 bp, Artificial Sequence
  Description of Artificial Sequence: Synthetic coding sequence
atgagagagagccaggacgccgccggcgcccacggctggaacagagtgggcagcaccgccaccaagtggttcaccggcgcccccttcggcgtgcagagccacagattcgacatcagcgccgtgtaccccaactggaagaagttcagcaccttcaccgaggccccctacagcaccagatacagcacccaggtgagccacatcggccccggcacctacagcagcaaggagacctgcttcagcaagaagaagctgatgaaggaggtggacaccggctgggccaaggcccaggaggccaccagactgacccagctgccccacttccagtaccaggccatcatgaaggagaagagactgaaggagcagaagctgggccccggcagctacaacctgaaggacttcctggagcagctgagagagaagccctgcagcaccagaggcctgctgagcagcggcgaggtgagattcagaggcctgaccggcaactactaccccggccccggcaactacggcgagaagggcaacccctacaccaagctggaggagaacgcctggaacagaagccacagcgagggcctgatgtgcagaatgagcaacaagccccaccccagaccctaccagggcagcggcctgggccccggcacctacttcttcaagagcgacctggagacctacgtggccagaagcgtgggcaccagaggcccctacgacaccttcagcggcgacagaagcaagcccctgccctacggccactacagcatgcagaagaagaagcccagagagctgatgaacttcaagagcttcgtggaggagctgaacagccaccacaacaagaagcacggcgtgttcagcaagctgcccagaaaccccaagacccccaccgagagaatctactgggccaacctgagccagtgccccagaaccctggccaccagcggccccagcttctggctgccccaggagaagaagtgcaagcccgtgaaccagccccccttcctgctgaccagcaagggcagcggcgccaaggcctgccagatgatcatgggcagctggaaccccgtgggcgtgggcagatacctgaacacctggctgatggagaccaaggacagaagacagagatacagaagcctgttcctgagcggcagcaagagatacctgagcgacctggccagagacatgctgatgcaggagagaatcacccccttcaccaagggcaagtgcccccccaccgtggactacaacagcgaccccaccccctag

SEQ ID NO: 18509 - DNA, 372 bp, Artificial Sequence
  Description of Artificial Sequence: Synthetic coding sequence
atgctgggccccaacgcccaggtgaccgtggtggtggcccagcccggccccgaccacctggaccacctgctgctggacacccagcactgccagcacagcagctgcggcagcgccgcctgcacccagctgacctgggtgccctgcctgggcggcagccacaaggccagcatcaagatgagcgcccaggccgtggtgagcaccgaggccccctgggagagaccctgcttccaggcccacctgggctgcctgcagaacagcgtgctgtgcagctgcagaatggagggcttcagcctgttcctggccatgctgtggggcggcgtgggcgagctgcccagcgaccccagaggccacctgcagttcctggccacctag

SEQ ID NO: 18510 - DNA, 372 bp, Artificial Sequence; identical to SEQ ID NO: 18509
  Description of Artificial Sequence: Synthetic coding sequence

SEQ ID NO: 18511 - DNA, 306 bp, Artificial Sequence
  Description of Artificial Sequence: Synthetic coding sequence
atgagcgtggagaagatgaccaaggtggaggagagcttccagaaggccatgggcctgaagaagaccgtggacagatggagaaacagccacacccactgcctgtggcagatggccctgggccagagaagaaacccctacgccaccctgagaatgcaggacaccatggtgcaggagctggccctggccaagaagcagctgctgatggtgagacaggccgccctgcaccagctgttcgagaaggagcaccagcagtaccagcaggagctgaaccagatgggcaaggccttctacgtggagagattctag

SEQ ID NO: 18512 - DNA, 534 bp, Artificial Sequence
  Description of Artificial Sequence: Synthetic coding sequence
atggccaccaactacagcgccaaccagtacgagaaggccttcagcagcaagtacctgcagaactggagccccaccaagcccaccaaggagagcatcagcagccacgagggctacacccagatcatcgccaacgacagaggccacctgctgcccagcgtgcccagaagcaaggccaacccctggggcagcttcatgggcacctggcagatgcccctgaagatcccccccgccagagtgaccctgaccagcagaaccaccgccggcgccgccagcctgaccaagtggatccagaagaaccccgacctgctgaaggccagcaacggcctgtgccccgagatcctgggcaagccccacgaccccgacagccagaagaagctgagaaagaagagcatcaccaagaccgtgcagcaggccagaagccccaccatcatccccagcagccccgccgccaacctgaacagccccgacgagctgcagagcagccaccccagcgccggccacacccccggcccccagagacccgccaagagctag

SEQ ID NO: 18513 - DNA, 510 bp, Artificial Sequence
  Description of Artificial Sequence: Synthetic coding sequence
atgccccccaccagagaccccttccagcagcccaccctggacaacgacgacagctacctgggcgagctgagagccagcaagaagctgccctacaagaaccccacccacctggcccagcagcaggagccctggagcagactgaacagcacccccaccatcaccagcatgagaagagacgcctactacttcgaccccgagatccccaaggacgacctggacttcagactggccgccctgtacaaccaccacaccggcaccttcaagaacaagagcgagatcctgctgaaccagaagaccacccaggacacctacagaaccaagatccagttccccggcgagttcctgaccccccccaccccccccatcaccttcctggccaacatcagacactggatcaaccccaagaaggagagcatccacagcatccagggcagcatcgtgagcccccacaccgccgccaccaacggcggctacagcagaaagaaggacggcggcttcttcagcacctag

SEQ ID NO: 18514 - DNA, 474 bp, Artificial Sequence
  Description of Artificial Sequence: Synthetic coding sequence
atggagagaagccccagcagaagaagaagactggaggaggcccccaagctgccctacaagaaccccacccacctggcccagcagcaggagccctggagcagactgaacagcacccccaccatcaccagcatgagaagagacgcctactacttcgaccccgagatccccaaggacgacctggacttcagactggccgccctgtacaaccaccacaccggcaccttcaagaacaagagcgagatcctgctgaaccagaagaccacccaggacacctacagaaccaagatccagttccccggcgagttcctgaccccccccaccccccccatcaccttcctggccaacatcagacactggatcaaccccaagaaggagagcatccacagcatccagggcagcatcgtgagcccccacaccgccgccaccaacggcggctacagcagaaagaaggacggcggcttcttcagcacctag

SEQ ID NO: 18515 - DNA, 381 bp, Artificial Sequence
  Description of Artificial Sequence: Synthetic coding sequence
atgcccagcagcaccctgacctgcaagcccttcgacctgaagcagagaagcagcagaagaggccccaagagcaccgccagcgccagccccagaagctgcctgaagcccagctgcggcaagcaggtgtgcctgctgctgagcgtgagaagaagccagagcctggcccaccccggcagagacagcaccagagtgctgagctaccagcagaccagcagcgacgccgtgagccagtacaagcacaccggcaaggtggaggagctgtacggcctgagactgagctggctgagccaggcccagttcctgctggcccaggacaagaccgcctacgccgtgaagagcgtggtgctgcccgccagcaaccacaagaccaagggccagtag

SEQ ID NO: 18516 - DNA, 216 bp, Artificial Sequence
  Description of Artificial Sequence: Synthetic coding sequence
atgcccagcagcaccctgacctgcaagcccttcgacctgaagcagagaagcagcagaagaggccccaagagcaccgccagcgccagccccagaagctggatcctgagccagaaccccaaggcccagagcagccacgagaagaccagcggcaagcccaagttcagagaggtgctgcagaacaccaaccagtacagcagcaagttcagcagaagctag

SEQ ID NO: 18517 - DNA, 282 bp, Artificial Sequence
  Description of Artificial Sequence: Synthetic coding sequence
atgaccaacaccaaggaccccaagagagccatggagagcaccctggccaccagcaacagcgccaccggccccgtgaccttcagccacgtgttcggccagcagtgccagctgatgcaggccgccgtgcagagcctgcacaccctgaacgaccagatcagccacttcatcgtgaccaagagcaaggccctggaggaggacaaggaccccttcctgcccaccgagaaggagaccctgaagagcagcatgatcctgatgagacacctgctgatggacgcccagtag

SEQ ID NO: 18518 - DNA, 984 bp, Artificial Sequence
  Description of Artificial Sequence: Synthetic coding sequence
atggccagcatggccgccgccatcgccgccagcagaagcgccgtgatgagcggcaacagacccctggacgacagagagagaaagagattcacctacttcagcagcctgagccccatggccagaaagatcatgcaggacaaggagaagatcagagagaagtacggccccgagtgggccagactgccccccgcccagcaggacgagatcatcgacagatgcctggtgggccccagagcccccgcccccagagaccccggcgacagcgaggagctgaccagattccccggcctgagaggccccaccggccagaaggtggtgagattcggcgacgaggacctgacctggcaggacgagcacagcgcccccttcagctgggagaccaagagccagatggagttcagcatcagcgccctgagcatccaggagcccagcaacggcaccgccgccagcgagcccagacccctgagcaaggccagccagggcagccaggccctgaagagcagccagggcagcagaagcagcagcctggacgccctgggccccaccagaaaggaggaggaggccagcttctggaagatcaacgccgagagaagcagaggcgagggccccgaggccgagttccagagcctgacccccagccagatcaagagcatggagaagggcgagaaggtgctgcccccctgctacagacaggagcccgcccccaaggacagagaggccaaggtggagagacccagcaccctgagacaggagcagagacccctgcccaacgtgagcaccgagagagagagaccccagcccgtgcaggccttcagcagcgccctgcacgaggccgcccccagccagctggagggcaagctgcccagccccgacgtgagacaggacgacggcgaggacaccctgttcagcgagcccaagttcgcccaggtgagcagcagcaacgtggtgctgaagaccggcttcgacttcctggacaactggtag

SEQ ID NO: 18519 - DNA, 870 bp, Artificial Sequence
  Description of Artificial Sequence: Synthetic coding sequence
atggccagaaagatcatgcaggacaaggagaagatcagagagaagtacggccccgagtgggccagactgccccccgcccagcaggacgagatcatcgacagatgcctggtgggccccagagcccccgcccccagagaccccggcgacagcgaggagctgaccagattccccggcctgagaggccccaccggccagaaggtggtgagattcggcgacgaggacctgacctggcaggacgagcacagcgcccccttcagctgggagaccaagagccagatggagttcagcatcagcgccctgagcatccaggagcccagcaacggcaccgccgccagcgagcccagacccctgagcaaggccagccagggcagccaggccctgaagagcagccagggcagcagaagcagcagcctggacgccctgggccccaccagaaaggaggaggaggccagcttctggaagatcaacgccgagagaagcagaggcgagggccccgaggccgagttccagagcctgacccccagccagatcaagagcatggagaagggcgagaaggtgctgcccccctgctacagacaggagcccgcccccaaggacagagaggccaaggtggagagacccagcaccctgagacaggagcagagacccctgcccaacgtgagcaccgagagagagagaccccagcccgtgcaggccttcagcagcgccctgcacgaggccgcccccagccagctggagggcaagctgcccagccccgacgtgagacaggacgacggcgaggacaccctgttcagcgagcccaagttcgcccaggtgagcagcagcaacgtggtgctgaagaccggcttcgacttcctggacaactggtag

SEQ ID NO: 18520 - DNA, 594 bp, Artificial Sequence
  Description of Artificial Sequence: Synthetic coding sequence
atggagttcagcatcagcgccctgagcatccaggagcccagcaacggcaccgccgccagcgagcccagacccctgagcaaggccagccagggcagccaggccctgaagagcagccagggcagcagaagcagcagcctggacgccctgggccccaccagaaaggaggaggaggccagcttctggaagatcaacgccgagagaagcagaggcgagggccccgaggccgagttccagagcctgacccccagccagatcaagagcatggagaagggcgagaaggtgctgcccccctgctacagacaggagcccgcccccaaggacagagaggccaaggtggagagacccagcaccctgagacaggagcagagacccctgcccaacgtgagcaccgagagagagagaccccagcccgtgcaggccttcagcagcgccctgcacgaggccgcccccagccagctggagggcaagctgcccagccccgacgtgagacaggacgacggcgaggacaccctgttcagcgagcccaagttcgcccaggtgagcagcagcaacgtggtgctgaagaccggcttcgacttcctggacaactggtag

SEQ ID NO: 18521 - DNA, 504 bp, Artificial Sequence
  Description of Artificial Sequence: Synthetic coding sequence
atgcccagccagagcgcctgccccgtgctgagcaccgcccccggcaccccctgcgacctgagaaagcacctgctgaacatggtgagcgaggagaagagaagcccccagctgagcgccaagacctggagaagaggcctgagactgcagaagagaagaaacgccctgttcctgcccgagggcgacatctgcgtggtgggcagcaccagcggcgccagagccctgatccccgagaccagcaagctggagagaagcggcaccgtgatcgcctactgcaacctggagctgctggccagcagcgacccccccgtgtgggccagccagagcaccggcatgaccggcatgagctacagaagccagccccagctgggcttcaagagcaccccccccgcccacagcagcgtgttccaccacagcgtgaaggcccccaaggaggaccaggcccaggaggccgccagcagacccctgaccagccaggacggctggaaccccaacatcaagaagtag

SEQ ID NO: 18522 - DNA, 864 bp, Artificial Sequence
  Description of Artificial Sequence: Synthetic coding sequence
atgaacgccctggccaacatccccgacgtgcccgtgaagtacagaaagaacgacatccccggccccggcttctacaacgtgatccaccagagccccgtgagcaacagcgtgagcctgagcaagaagggcacctgcatgttccccagcatgtgcgccagactggacaccatcatcagcaagtaccccgccgccaacgcctacaccatccccagcgacttcatcagcaagagagacttcagcaacagctgcagcagcatgttccagctgcccagcttcatgaaggccctgaagttcgagacccccgcccccaactactacaacgccagcgtgagctgctgcaagcagagaaacaacgtgtgcaccagagccggcttcatgagcaagacccagagaggcagcttcgccttcgccgacaagggccccccccccggccactacgacatcaacgagagcctggtgaagcagagccccaacaccctgatgagctgcttcaagagcaagaccaacagaggcctgaagctgaccagcaccggccccggccccggctactacaaccccagcgactgcaccaaggtgcccaagaagaccctgttccccaagaaccccatcctgaacttcagcgcccagcccagccccctgccccccaagccccccttccccggccccggccagtacgagatcgtggactacctgggccccagaaagcacttcatcagcagcgccagcttcgtgagcaacaccagcagatggaccgccgcccccccccagcccggcctgcccggccccgccacctacaagcccgagctgcccggcaagcagagcttcctgtacaacgaggacaagaagtggatccccgtgctgtag

SEQ ID NO: 18523 - DNA, 1005 bp, Artificial Sequence
  Description of Artificial Sequence: Synthetic coding sequence
atggacaacagcgcccagaagaacgagagaaccggcaagcaccccagaagagccagcgaggtgcagaagggcttcaccgccgcctaccccacccagagcagcatccccttcaagagccaggccagcgtgatccccgagagcgagaagaagggcttcaacagccaggccaagagattcccccacaagaagaacgacatccccggccccggcttctacaacgtgatccaccagagccccgtgagcaacagcgtgagcctgagcaagaagggcacctgcatgttccccagcatgtgcgccagactggacaccatcatcagcaagtaccccgccgccaacgcctacaccatccccagcgacttcatcagcaagagagacttcagcaacagctgcagcagcatgttccagctgcccagcttcatgaaggccctgaagttcgagacccccgcccccaactactacaacgccagcgtgagctgctgcaagcagagaaacaacgtgtgcaccagagccggcttcatgagcaagacccagagaggcagcttcgccttcgccgacaagggccccccccccggccactacgacatcaacgagagcctggtgaagcagagccccaacaccctgatgagctgcttcaagagcaagaccaacagaggcctgaagctgaccagcaccggccccggccccggctactacaaccccagcgactgcaccaaggtgcccaagaagaccctgttccccaagaaccccatcctgaacttcagcgcccagcccagccccctgccccccaagccccccttccccggccccggccagtacgagatcgtggactacctgggccccagaaagcacttcatcagcagcgccagcttcgtgagcaacaccagcagatggaccgccgcccccccccagcccggcctgcccggccccgccacctacaagcccgagctgcccggcaagcagagcttcctgtacaacgaggacaagaagtggatccccgtgctgtag

SEQ ID NO: 18524 - DNA, 510 bp, Artificial Sequence
  Description of Artificial Sequence: Synthetic coding sequence
atgtgcgccagactggacaccatcatcagcaagtaccccgccgccaacgcctacaccatccccagcgacttcatcagcaagagagacttcagcaacagctgcagcagcatgttccagctgcccagcttcatgaaggccctgaagttcgagacccccgcccccaactactacaacgccagcgtgagctgctgcaagcagagaaacaacgtgtgcaccagagccggcttcatgagcaagacccagagaggcagcttcgccttcgccgacaagggccccccccccggccactacgacatcaacgagagcctggtgaagcagagccccaacaccctgatgagctgcttcaagagcaagaccaacagaggcctgaagctgaccagcaccggccccggccccggctactacaaccccagcgactgcaccaaggtgcccaagaagaccctgttccccggcggcagcaaggccagcgacctggccggccacctgcccaagagcacccagcccacctag

SEQ ID NO: 18525 - DNA, 1005 bp, Artificial Sequence; identical to SEQ ID NO: 18523
  Description of Artificial Sequence: Synthetic coding sequence

SEQ ID NO: 18526 - DNA, 435 bp, Artificial Sequence
  Description of Artificial Sequence: Synthetic coding sequence
tgattcaccgccgcctaccccacccagagcagcatccccttcaagagccaggccagcgtgatccccgagagcgagaagaagggcttcaacagccaggccaagagattcccccacaagaagaacgacatccccggccccggcttctacaacgtgatccaccagagccccgtgagcaacagcgtgagcctgagcaagaagggcacctgcatgttccccagcatgtgcgccagactggacaccatcatcagcaagtaccccgccgccaacgcctacaccatccccagcgacttcatcagcaagagagacttcagcaacagctgcagcagcatgttccagctgcccagcttcatgaaggccctgaagttcgagacccccgcccccaactactacaacgtgagaaccctgcccatgctggccaagtacagaagcaactag

SEQ ID NO: 18527 - DNA, 1152 bp, Artificial Sequence
  Description of Artificial Sequence: Synthetic coding sequence
atggacaacagcgcccagaagaacgagagaaccggcaagcaccccagaagagccagcgaggtgcagaagggcttcaccgccgcctaccccacccagagcagcatccccttcaagagccaggccagcgtgatccccgagagcgagaagaagggcttcaacagccaggccaagagattcccccacaagaagaacgacatccccggccccggcttctacaacgtgatccaccagagccccgtgagcaacagcgtgagcctgagcaagaagggcacctgcatgttccccagcatgtgcgccagactggacaccatcatcagcaagtaccccgccgccaacgcctacaccatccccagcgacttcatcagcaagagagacttcagcaacagctgcagcagcatgttccagctgcccagcttcatgagcaagacccagagaggcagcttcgccttcgccgacaagggccccccccccggccactacgacatcaacgagagcctggtgaagcagagccccaacaccctgatgagctgcttcaagagcaagaccaacagaggcctgaagctgaccagcaccggccccggccccggctactacaaccccagcgactgcaccaaggtgcccaagaagaccctgttccccaagaaccccatcctgaacttcagcgcccagcccagccccctgccccccaagcccgcctggcccagctacgtgcaggccagagccagcagaaaggccgtgctgcccctgcagagaggccaggagatggaccccggcagcgtgggcatgagccacaaggtgaaggagaacagcagccaccagcccaccctgcccagcgtgcccagaaccttcctgagaagaagacccatcatgagcgtggccgccgacaacctgggcggcggcagcaccaccctggcctggcaccccagcagaaccgccgccatcgccttcgtgctgagctggagacactgcagcctggagaccagcccccagccccacagactgcagtggctgcccgagcagaagggcggcgtggacagagccccctggctgctgccccacgcccccatccaggccgccttcagacacgacagcctgccccagaccgagggcacccccgaggcccagaccagcagaagaatcagccccccctag

SEQ ID NO: 18528 - DNA, 507 bp, Artificial Sequence
  Description of Artificial Sequence: Synthetic coding sequence
tgcgccagactggacaccatcatcagcaagtaccccgccgccaacgcctacaccatccccagcgacttcatcagcaagagagacttcagcaacagctgcagcagcatgttccagctgcccagcttcatgaaggccctgaagttcgagacccccgcccccaactactacaacgccagcgtgagctgctgcaagcagagaaacaacgtgtgcaccagagccggcttcatgagcaagacccagagaggcagcttcgccttcgccgacaagggccccccccccggccactacgacatcaacgagagcctggtgaagcagagccccaacaccctgatgagctgcttcaagagcaagaccaacagaggcctgaagctgaccagcaccggccccggccccggctactacaaccccagcgactgcaccaaggtgcccaagaagaccctgttccccggcggcagcaaggccagcgacctggccggccacctgcccaagagcacccagcccacctag

SEQ ID NO: 18529 - DNA, 864 bp, Artificial Sequence; identical to SEQ ID NO: 18522
  Description of Artificial Sequence: Synthetic coding sequence

SEQ ID NO: 18530 - DNA, 708 bp, Artificial Sequence
  Description of Artificial Sequence: Synthetic coding sequence
atgggcatgctggcccccggccccctgcagggcagaagacccagaaagggccacaagggccaggaggacgccgtggcccccggctgcaaggccagcggcagaggcagcagagtgacccacctgctgggctaccccacccagaacgtgagcagaagcctgagaagaaagtacgccccccccccctgcggcggccccgaggacgtggccctggccccctgcaccgccgccgccgcctgcgaggccggccccagccccgtgtacgtgaaggtgaagagcgccgagcccgccgactgcgccgagggccccgtgcagtgcaagaacggcctgctggtgagcagcccccactgcgaggagccctgcgcccacagctgcgcccaccccggcctgcccccccacctggtgcacaagctgcccctgagctacctgcagacccaggacaccgacgccgccagcagaagaatcaacgcccccctggccgccggctggagctggctgagactgtggctggtgaccctggccagcggcgtggacttcccccaggtgagcgcctggatgagagccctgcccagccccgactgccccggcctgagaaccaccggcgagcagatgcagaagctgctgctgaaggagaacaaggtgaagaccagaaagagcaagagaagaagcggcgagggcagccacctgaccaccagcatcctggagcagtag

SEQ ID NO: 18531 - DNA, 366 bp, Artificial Sequence
  Description of Artificial Sequence: Synthetic coding sequence
atgggctgcgccagcgccaagcacgtggccaccgtgcagaacgaggaggaggcccagaagggcaagaactaccagaacggcgacgtgttcggcgacgagtacagaatcaagcccgtggaggaggtgaagtacatgaagaacggcgccgaggaggagcagaagatcgccgccagaaaccaggagaacctggagaagagcgccagcagcaacgtgagactgaagaccaacaaggaggtgcccggcctggtgcaccagcccagagccaacatgcacatcagcgagagccagcaggagttcttcagaatgctggacgagaagatcgagaagggcagagactactgcagcgaggaggaggacatcacctag

SEQ ID NO: 18532 - DNA, 264 bp, Artificial Sequence
  Description of Artificial Sequence: Synthetic coding sequence
accggcaaccaccacagcaccttctgcctgcacgagttcgactacagcagactgctgtgcatcctggagaagttcctgtgcgacaccgagaagagcgccagcagcaacgtgagactgaagaccaacaaggaggtgcccggcctggtgcaccagcccagagccaacatgcacatcagcgagagccagcaggagttcttcagaatgctggacgagaagatcgagaagggcagagactactgcagcgaggaggaggacatcacctag

SEQ ID NO: 18533 - DNA, 279 bp, Artificial Sequence
  Description of Artificial Sequence: Synthetic coding sequence
atgtggcccgtgttctggaccgtggtgagaacctacgccccctacgtgaccttccccgtggccttcgtggtgggcgccgtgggctaccacctggagtggttcatcagaggcaaggacccccagcccgtggaggaggagaagagcatcagcgagagaagagaggacagaaagctggacgagctgctgggcaaggaccacacccaggtggtgagcctgaaggacaagctggagttcgcccccaaggccgtgctgaacagaaacagacccgagaagaactag

SEQ ID NO: 18534 - DNA, 279 bp, Artificial Sequence; identical to SEQ ID NO: 18533
  Description of Artificial Sequence: Synthetic coding sequence

SEQ ID NO: 18535 - DNA, 279 bp, Artificial Sequence; identical to SEQ ID NO: 18533
  Description of Artificial Sequence: Synthetic coding sequence

SEQ ID NO: 18536 - DNA, 279 bp, Artificial Sequence; identical to SEQ ID NO: 18533
  Description of Artificial Sequence: Synthetic coding sequence

SEQ ID NO: 18537 - DNA, 279 bp, Artificial Sequence; identical to SEQ ID NO: 18533
  Description of Artificial Sequence: Synthetic coding sequence

SEQ ID NO: 18538 - DNA, 381 bp, Artificial Sequence
  Description of Artificial Sequence: Synthetic coding sequence
atgctggccgtgcccgtgagactgaaggtgggcagcagaaagcccgagtggggcaccaacagactgaccagctgccccgccaaggaccccctggacagaagactgcagaacctgagagacagagagagagtgcccgagccccagagaagcctgagacccggcgtgcaggaggacagcagagagcacggccaggtgcccgaggtgagcgacccccaggtggacctggagttcgtggacctgcaggccaagcccagatacagaagactgatcctgaagacccagatccccgaggccagcgacagccaggccgcccagaagccccaggcccacagacagatccccgagaccaccgaggccggcagagagaccaccagcaactag

SEQ ID NO: 18539 - DNA, 690 bp, Artificial Sequence
  Description of Artificial Sequence: Synthetic coding sequence
atgttcgccatccagcccggcctggccgagggcggccagttcctgggcgaccccccccccggcctgtgccagcccgagctgcagcccgacagcaacagcaacttcatggccagcgccaaggacgccaacgagaactggcacggcatgcccggcagagtggagcccatcctgagaagaagcagcagcgagagccccagcgacaaccaggccttccaggcccccggcagccccgaggagggcgtgagaagcccccccgagggcgccgagatccccggcgccgagcccgagaagatgggcggcgccggcaccgtgtgcagccccctggaggacaacggctacgccagcagcagcctgagcatcgacagcagaagcagcagccccgagcccgcctgcggcacccccagaggccccggcccccccgaccccctgctgcccagcgtggcccaggccgtgcagcacctgcaggtgcaggagagatacaaggagcaggagaaggagaagcaccacgtgcacctggtgatgtacagaagactggccctgctgcagtggatcagaggcctgcagcaccagctgatcgaccagcaggccagactgcaggagagcttcgacaccatcctggacaacagaaaggagctgatcagatgcctgcagcagagagccgcccccagcagaccccaggaccaggcctag

SEQ ID NO: 18540 - DNA, 600 bp, Artificial Sequence
  Description of Artificial Sequence: Synthetic coding sequence
atgttcgccatccagcccggcctggccgagggcggccagttcctgggcgaccccccccccggcctgtgccagcccgagctgcagcccgacagcaacagcaacttcatggccagcgccaaggacgccaacgagaactggcacggcatgcccggcagagtggagcccatcctgagaagaagcagcagcgagagccccagcgacaaccaggccttccaggcccccggcagccccctggaggacaacggctacgccagcagcagcctgagcatcgacagcagaagcagcagccccgagcccgcctgcggcacccccagaggccccggcccccccgaccccctgctgcccagcgtggcccaggccgtgcagcacctgcaggtgcaggagagatacaaggagcaggagaaggagaagcaccacgtgcacctggtgatgtacagaagactggccctgctgcagtggatcagaggcctgcagcaccagctgatcgaccagcaggccagactgcaggagagcttcgacaccatcctggacaacagaaaggagctgatcagatgcctgcagcagagagccgcccccagcagaccccaggaccaggcctag

SEQ ID NO: 18541 - DNA, 321 bp, Artificial Sequence
  Description of Artificial Sequence: Synthetic coding sequence
atgcccgacgcccagttccacagaatcatggccagcgagaagctgagcttcatcagagtgcaggagaacgagtacagcctgaacagcgtgagagccagcggcttccagagagtgctgaacctgctggagagcagcctgctgtggctgtacctgcccaccaccgagaacctgctgtgcagcagccccagactgagcggcgaccccaccggctacgccgacccccccccccagaaccacagaagaagacagagcagaagcacccccagactgcccggccccggccagctgctgagcagcagaaccagaaccctggagggctag

SEQ ID NO: 18542 - DNA, 2289 bp, Artificial Sequence
  Description of Artificial Sequence: Synthetic coding sequence
atggaggacgacggcagcctgctgcccgaggacgagctgctggccgacgccctgctgctggaggacgagagagacgagctggaggaccccgagttcgacatcaagtgcctgctgcaggaggccgaggacgacgtggaccccggccacagcagcagcgtgaaggagctggacaccgacgccgacaagctgaagaagaagaccgccgaggacagaacccaggccttccacctgagacagaacctgagcgccctggacaagatgcacgaggagcaggagctgttcaccgagaagatgagaggcgagctgagagcctgcagacagagaagagacctgatcgacaagcagcaggaggccgtggccgccgagatcgccaccgaggaggaggccggcaacatggccgccgtgggcagactgcaggccgtgagcagaagactgttcgccgagctggagaacgagagagacctgcagagcagaaccgaggccgtgctgaaggagagcgagaacaccatgtggcacatcgagatccaggagggcagactggaggccttcagaaccgccgacagagaggaggtggaggccaccggcagaagactgcaggtgagagccgccgagcagctgtgcagagagcaggaggccctgggcaaggtggagagaaacagactgctgagaatcagaaagagcctgaacacccagaaggagctgggcctgagacaccagaagctgctggaggacgccagaaagaaccacaaggtggccgtgagattcctgaaggccagcctgggcagaatcagagagcaggagaagaaggaggagatggagtgccacgagtacatgagaagaagaatggacgccgtggtggccctgaagggcagcatcagcgccaacagagacaccctgagaaagttccaggcctgggacagagccaaggccgagctggccgagcagagagtgcaggccgagaagaaggccatcctggcccagggcagagacgccttcagacacctggtgcaccagagaagaagacaggagctggaggcccagaagagagccttcgaggaggagcagaagctgagaaagcaggagatcatcagcagaatcctgaaggaggaggccgaggaggagaagagaaagaagcagcacccccccaccagcgccagacacagactgaccctgagagacaagacctggaactacatcagcgacttctgcaagaagaccaccgtgcccaccaacacctacaccctggactacgaggccgccgccggccccggccccagcagactgctggaggtggtgagcagcgagctgatccagggcgaccccggcgccagcagcgaggaggagaccctggccgagcccgagatcagcggcctgtggaacgaggactacaagccctaccaggtgcccaaggaggacgtggacagaaagcccgtgggcggcaccaagatggacaaggacatcctggagagaaccgtggagagactgagaagcagagtggtgcacaagcaggtggtgtggggcagagagttccagggcagacccttcaacagcaagcccgagctgctgcacttccaggacttcgacatcggcaaggtgtacaagaagaagatcaccctggtgaacaccacctacaccatcaactactgcaagctggtgggcgtggaggagcacctgagagacttcatccacgtggacttcgacccccccggccccctgagcgccggcatgagctgcgaggtgctggtgaccttcaagcccatgatcaacaaggacctggagggcaacatcagcttcctggcccagaccggcgagttcagcgtgcccctgaagtgcagcaccaagaagtgcagcctgagcctggacaaggagctgatcgacttcggcagctacgtggtgggcgagaccaccagcagaaccatcaccctgaccaacgtgggcggcctgggcaccaccttcaagttcctgcccgccagcgagccctgcgagatggacgacagccagagcgccctgaagctgagcagcctgctgacctacgaggacaagagcctgtacgacaaggccgccaccagcttcagcgagcagcagctggagggcaccgagagcagccaggccgacatgcagagcagaaaggagctggagaagctggacaaggagcaggaggaggagcagcccgccggcgagcccggctgccaggccaagcccggctgggccggcggcgagggcctgagagccgccttccagggcgccgagggccccagaggcggcctggagagcagagagttcagctag

SEQ ID NO: 18543 - DNA, 306 bp, Artificial Sequence
  Description of Artificial Sequence: Synthetic coding sequence
atggaggacgacggcagcctgctgcccgaggacgagctgctggccgacgccctgctgctggaggacgagagagacgagctggaggaccccgagttcgacatcaagtgcctgctgcaggaggccgaggacgacgtggaccccggccacagcagcagcgtgaaggagctggacaccgacgccgacaagctgaagaagaagaccgccgaggacagaacccaggccttccacctgagacagaacctgagcgccctggacaagatgcacgaggagcaggagctgttcaccgagaagatgagcgtgagctag

SEQ ID NO: 18544 - DNA, 516 bp, Artificial Sequence
  Description of Artificial Sequence: Synthetic coding sequence
atgttcgagaacctgaacaccgccctgacccccaagctgcaggccagcagaagcttcccccacctgagcaagcccgtggcccccggcagcgcccccctgggcagcggcgagcccggcggccccggcctgtgggtgggcagcagccagcacctgaagaacctgggcaaggccatgggcgccaaggtgaacgacttcctgagaagaaaggagcccagcagcctgggcagcgtgggcgtgaccgagatcaacaagaccgccggcgcccagctggccagcggcaccgacgccgcccccgaggcctggctggaggacgagagaagcgtgctgcaggagaccttccccagactggacccccccccccccatcaccagaaagagaacccccagagccctgaagaccacccaggacatgctgatcagcagccagcccgtgctgagcagcctggagtacggcaccgagcccagccccggccaggcccaggacagcgcccccaccgcccagcccgacgtgccctag

SEQ ID NO: 18545 - DNA, 948 bp, Artificial Sequence
  Description of Artificial Sequence: Synthetic coding sequence
atgctggtgctggtggcccaggccggcggcgacaccctgaaggtgaccggccactacgtgaagtgcgtgttcctgctgttcgtgagccacctgctgagcgagcccctgagcagaaccgtggaccacggcatgttcgagaacctgaacaccgccctgacccccaagctgcaggccagcagaagcttcccccacctgagcaagcccgtggcccccggcagcgcccccctgggcagcggcgagcccggcggccccggcctgtgggtgggcagcagccagcacctgaagaacctgggcaaggccatgggcgccaaggtgaacgacttcctgagaagaaaggagcccagcagcctgggcagcgtgggcgtgaccgagatcaacaagaccgccggcgcccagctggccagcggcaccgacgccgcccccgaggcctggctggaggacgagagaagcgtgctgcaggagaccttccccagactggacccccccccccccatcaccagaaagagaacccccagagccctgaagaccacccaggacatgctgatcagcagccagcccgtgctgagcagcctggagtacggcaccgagcccagccccggccaggcccaggacagcgcccccaccgcccagcccgacgtgcccgccgacgccagccagcccgaggccaccatggagagagaggagagaggcaaggtgctgcccaacggcgaggtgagcctgagcgtgcccgacctgatccacaaggacagccaggacgagagcaagctgaagatgaccgagtgcagaagagccagcagccccagcctgatcgagagaaacggcttcaagctgagcctgagccccatcagcctggccgagagctgggaggacggcagcccccccccccaggccagaaccagcagcctggacaacgagggcccccaccccgacctgctgagcttcgagtag

SEQ ID NO: 18546 - DNA, 819 bp, Artificial Sequence
  Description of Artificial Sequence: Synthetic coding sequence
atgttcgagaacctgaacaccgccctgacccccaagctgcaggccagcagaagcttcccccacctgagcaagcccgtggcccccggcagcgcccccctgggcagcggcgagcccggcggccccggcctgtgggtgggcagcagccagcacctgaagaacctgggcaaggccatgggcgccaaggtgaacgacttcctgagaagaaaggagcccagcagcctgggcagcgtgggcgtgaccgagatcaacaagaccgccggcgcccagctggccagcggcaccgacgccgcccccgaggcctggctggaggacgagagaagcgtgctgcaggagaccttccccagactggacccccccccccccatcaccagaaagagaacccccagagccctgaagaccacccaggacatgctgatcagcagccagcccgtgctgagcagcctggagtacggcaccgagcccagccccggccaggcccaggacagcgcccccaccgcccagcccgacgtgcccgccgacgccagccagcccgaggccaccatggagagagaggagagaggcaaggtgctgcccaacggcgaggtgagcctgagcgtgcccgacctgatccacaaggacagccaggacgagagcaagctgaagatgaccgagtgcagaagagccagcagccccagcctgatcgagagaaacggcttcaagctgagcctgagccccatcagcctggccgagagctgggaggacggcagcccccccccccaggccagaaccagcagcctggacaacgagggcccccaccccgacctgctgagcttcgagtag

SEQ ID NO: 18547 - DNA, 297 bp, Artificial Sequence
  Description of Artificial Sequence: Synthetic coding sequence
atggccagcatcaacagaaccatcgagatcatgaagaagcacggcgtgagcaagcagcacctgctggaggagatcaacaagaagagagagagcaactgcctggtggagagaagcaaccaggtgagcctgctgagagtgcagaagagacacttccccgacgcctaccagagcttcaccgacaccaccaccaaggagcccgtgcccaacagcggcagaagcagctggatcaagctgagcctgctggcccacatggagagaaagcacttcccccccaagaacaacgccatcttcggctag

SEQ ID NO: 18548 - DNA, 1323 bp, Artificial Sequence
  Description of Artificial Sequence: Synthetic coding sequence
atgaccagcatcaaggagcaggccgccatcagcagactgctgagcttcctgcaggagtgggacaacgccggcaaggtggccagaagccacatcctggacaagttcatcgagaccaaccagggcaagaccgcccccgagctggagcaggagttcagccagggcgccagcctgttcctggtgagactgaccaccagcctgagaatcacctacatgaccgacagctgcctggagaagctgctgagaagcatcggcatcttcctgagcgccgtgagcagcaacagatacctgatcgagttcctggaggtgggcggcgtgctgaccctgctggagatcctgggcctggagaagatcaaggaggaggccaagaaggagagcgtgaagctgctgcaggtgatcgccaacagcggcagaacctacaaggagctgatctgcgagagctacggcgtgagaagcatcgccgagttcctggccaagagcaagagcgaggagacccaggaggaggtgcaggtgctgctggacagcctggtgcacggcaaccccaagtaccagaaccaggtgtacaagggcctgatcgccctgctgccctgcgagagccccaaggcccagcagctgagcctgcagaccctgagaaccgcccagcccatcatcggcaccacccaccccagcatcgtggactgcgtgctgaaggtgctgggcaccatgcacctggaggtgcagtacgaggccatcgagctgatcaaggacctggtgggctacgacgtgagacaggccctgctgaagggcctggtggccctgctgatccccagcgtgaaggagatcagcaagctgcaggccaagatcctgagcgaccccagcgtgctgcagctgacccccagcctgcccatgttcctgcagcaggccgccgccgccaaggccatcggcgtgctggccagaaacgacatgagcatcgccgaggagctgctgtacctgagagtggtgagaggcctgatggccgccatgggcaacaccgaccacagcaacagccagagactggccagcctgaccctggagtgcttcgtgcagatgttccccctggtggccgagcacgtgagaaagtgcatgggcgaggagctgtaccagctgttcctgagcaacgccgaggacctgtacatgaagatcgacagcatccaggccgacatcctggccgccaacaccgtgaacgtgaccaaggccctgtgcctgcacggcagcagctacagcatgaacaccctgtacggcagcagagacagcgcccagatggcctacctgacccacttcgaggaggacgtggagagcaaggagtag

SEQ ID NO: 18549 - DNA, 1323 bp, Artificial Sequence; identical to SEQ ID NO: 18548
  Description of Artificial Sequence: Synthetic coding sequence

SEQ ID NO: 18550 - DNA, 714 bp, Artificial Sequence
  Description of Artificial Sequence: Synthetic coding sequence
atgggcctgtgcaccctgcagcccctgggcccccccagaaagagcagcaccagctgcggcacctggaccgccagcggcctgcccagcctgggccacctgcccagaagactgagactggccttcgacttcctggagcccagagccagaggccagagaggcggcagcggcggctgccagagcaccagagccgccgagagaaccagacccccccacccccccaacgccgtgctgctgctgcagcccgagcccagcctgacctgggcccagggcagaggctgcagaggccacttcagaagcctgcccgccgccgccagcagaagcggcagcagaaccctgagatgcgccagcagcgacagaagcctgagagagcagaagcagagaagagccggccccgaccccacccccagccccgcccccccccccgccggccccagacccagccccggcagcctgggccccagcgcccccgccgcccccagaaccgccagaggcgcctacgagctgcagggcggcgccagccaggacggccccggccaggccgccgtgggcgccacccccaccaccggccccggcaccggcggcgagggcgccctgctgggctgcggcagcggcagaaccccccccaccagcgccacctggagaagaagactgctgcccgccgaggtgccccccggcgccgccgccgccaacttccccgagagagagagactgtag

SEQ ID NO: 18551 - DNA, 681 bp, Artificial Sequence
  Description of Artificial Sequence: Synthetic coding sequence
atgagagccccccccctgctgctgctgctggccgcctgcgccccccccccctgcgccgccgccgcccccaccccccccggctgggagcccacccccgacgccccctggtgcccctacaaggtgctgcccgagggccccgaggccggcggcggcagactgtgcttcagaagccccgccagaggcttcagatgccaggcccccggctgcgtgctgcacgcccccgccggcagaagcctgagagccagcgtgctgagaaacagaagcgtgctgctgcagtggagactggcccccgccgccgccagaagagtgagagccttcgccctgaactgcagctggagaggcgcctacaccagattcccctgcgagagagtgctgctgggcgccagctgcagagactacctgctgcccgacgtgcacgacagcgtgctgtacagactgtgcctgcagcccctgcccctgagagccggccccgccgccgccgcccccgagacccccgagcccgccgagtgcgtggagttcaccgccgagcccgccggcatgcaggacatcgtggtggccatgaccgccgtgggcggcagcatctgcgtgatgctggtggtgatctgcctgctggtggcctacatcaccgagaacctgatgagacccgccctggccagacccggcctgagaagacacccctag

SEQ ID NO: 18552 - DNA, 792 bp, Artificial Sequence
  Description of Artificial Sequence: Synthetic coding sequence
atgttcggcagcagcagaggcggcgtgagaggcggccaggaccagttcaactgggaggacgtgaagaccgacaagcagagagagaactacctgggcaacagcctgatggcccccgtgggcagatggcagaagggcagagacctgacctggtacgccaagggcagagccccctgcgccggccccagcagagaggaggagctggccgccgtgagagaggccgagagagaggccctgctggccgccctgggctacaagaacgtgaagaagcagcccaccggcctgagcaaggaggacttcgccgaggtgtgcaagagagagggcggcgaccccgaggagaagggcgtggacagactgctgggcctgggcagcgccagcggcagcgtgggcagagtggccatgagcagagaggacaaggaggccgccaagctgggcctgagcgtgttcacccaccacagagtggagagcggcggccccggcaccagcgccgccagcgccagaagaaagcccagagccgaggaccagaccgagagcagctgcgagagccacagaaagagcaagaaggagaagaagaagaagaagaagagaaagcacaagaaggagaagaagaagaaggacaaggagcacagaagacccgccgaggccaccagcagccccaccagccccgagagacccagacaccaccaccacgacagcgacagcaacagcccctgctgcaagagaagaaagagaggccacagcggcgacagaagaagccccagcagaagatggcacgacagaggcagcgaggcctag

SEQ ID NO: 18553 - DNA, 1545 bp, Artificial Sequence
  Description of Artificial Sequence: Synthetic coding sequence
atggagcccgtgcccctgcaggacttcgtgagagccctggaccccgccagcctgcccagagtgctgagagtgtgcagcggcgtgtacttcgagggcagcatctacgagatcagcggcaacgagtgctgcctgagcaccggcgacctgatcaaggtgacccaggtgagactgcagaaggtggtgtgcgagaaccccaagaccagccagaccatggagctggcccccaacttccagggctacttcacccccctgaacaccccccagagctacgagaccctggaggagctggtgagcgccaccacccagagcagcaagcagctgcccacctgcttcatgagcacccacagaatcgtgaccgagggcagagtggtgaccgaggaccagctgctgatgctggaggccgtggtgatgcacctgggcatcagaagcgccagatgcgtgctgggcatggagggccagcaggtgatcctgcacctgcccctgagccagaagggccccttctggacctgggagcccagcgcccccagaaccctgctgcaggtgctgcaggaccccgccctgaaggacctggtgctgacctgccccaccctgccctggcacagcctgatcctgagaccccagtacgagatccaggccatcatgcacatgagaagaaccatcgtgaagatccccagcaccctggaggtggacgtggaggacgtgaccgccagcagcagacacgtgcacttcatcaagcccctgctgctgagcgaggtgctggcctgggagggccccttccccctgagcatggagatcctggagagactgagcgaccaggccggcgaggacgaggaggaggagtgcaaggaggaggccgagagccccgagagagtgctgctgcccttccacttccccggcagcttcgtggaggagatgagcgacagcagaagatacagcctggccgacctgaccgcccagttcagcctgccctgcgaggtgaaggtggtggccaaggacaccagccaccccaccgaccccctgaccagcttcctgggcctgagactggaggagaagatcaccgagcccttcctggtggtgagcctggacagcgagcccggcatgtgcttcgagatcccccccagatggctggacctgaccgtggtgaaggccaagggccagcccgacctgcccgagggcagcctgcccatcgccaccgtggaggagctgaccgacaccttctactacagactgagaaagctgcccgcctgcgagatccaggcccccccccccagaccccccaagaaccagggcctgagcaagcagagaagacacagcagcgagggcggcgtgaagagcagccaggtgctgggcctgcagcagcacgccagactgcccaagcccaaggccaagaccctgcccgagttcatcaaggacggcagcagcacctacagcaagatccccgcccacagaaagggccacagacccgccaagccccagagacaggacctggacgacgacgagcacgactacgaggagatcctggagcagttccagaagaccatctag

SEQ ID NO: 18554 - DNA, 1932 bp, Artificial Sequence
  Description of Artificial Sequence: Synthetic coding sequence
atggagcccgtgcccctgcaggacttcgtgagagccctggaccccgccagcctgcccagagtgctgagagtgtgcagcggcgtgtacttcgagggcagcatctacgagatcagcggcaacgagtgctgcctgagcaccggcgacctgatcaaggtgacccaggtgagactgcagaaggtggtgtgcgagaaccccaagaccagccagaccatggagctggcccccaacttccagggctacttcacccccctgaacaccccccagagctacgagaccctggaggagctggtgagcgccaccacccagagcagcaagcagctgcccacctgcttcatgagcacccacagaatcgtgaccgagggcagagtggtgaccgaggaccagctgctgatgctggaggccgtggtgatgcacctgggcatcagaagcgccagatgcgtgctgggcatggagggccagcaggtgatcctgcacctgcccctgagccagaagggccccttctggacctgggagcccagcgcccccagaaccctgctgcaggtgctgcaggaccccgccctgaaggacctggtgctgacctgccccaccctgccctggcacagcctgatcctgagaccccagtacgagatccaggccatcatgcacatgagaagaaccatcgtgaagatccccagcaccctggaggtggacgtggaggacgtgaccgccagcagcagacacgtgcacttcatcaagcccctgctgctgagcgaggtgctggcctgggagggccccttccccctgagcatggagatcctggaggtgcccgagggcagacccatcttcctgagcccctgggtgggcagcctgcagaagggccagagactgtgcgtgtacggcctggccagccccccctggagagtgctggccagcagcaagggcagaaaggtgcccagacacttcctggtgagcggcggctaccagggcaagctgagaagaagacccagagagttccccaccgcctacgacctgctgggcgccttccagcccggcagacccctgagagtggtggccaccaaggactgcgagggcgagagagaggagaaccccgagttcaccagcctggccgtgggcgacagactggaggtgctgggccccggccaggcccacggcgcccagggcagcgacgtggacgtgctggtgtgccagagactgagcgaccaggccggcgaggacgaggaggaggagtgcaaggaggaggccgagagccccgagagagtgctgctgcccttccacttccccggcagcttcgtggaggagatgagcgacagcagaagatacagcctggccgacctgaccgcccagttcagcctgccctgcgaggtgaaggtggtggccaaggacaccagccaccccaccgaccccctgaccagcttcctgggcctgagactggaggagaagatcaccgagcccttcctggtggtgagcctggacagcgagcccggcatgtgcttcgagatcccccccagatggctggacctgaccgtggtgaaggccaagggccagcccgacctgcccgagggcagcctgcccatcgccaccgtggaggagctgaccgacaccttctactacagactgagaaagctgcccgcctgcgagatccaggcccccccccccagaccccccaagaaccagggcctgagcaagcagagaagacacagcagcgagggcggcgtgaagagcagccaggtgctgggcctgcagcagcacgccagactgcccaagcccaaggccaagaccctgcccgagttcatcaaggacggcagcagcacctacagcaagatccccgcccacagaaagggccacagacccgccaagccccagagacaggacctggacgacgacgagcacgactacgaggagatcctggagcagttccagaagaccatctag

SEQ ID NO: 18555 - DNA, 783 bp, Artificial Sequence
  Description of Artificial Sequence: Synthetic coding sequence
atggagcccgtgcccctgcaggacttcgtgagagccctggaccccgccagcctgcccagagtgctgagagtgtgcagcggcgtgtacttcgagggcagcatctacgagatcagcggcaacgagtgctgcctgagcaccggcgacctgatcaaggtgacccaggtgagactgcagaaggtggtgtgcgagaaccccaagaccagccagaccatggagctggcccccaacttccagggctacttcacccccctgaacaccccccagagctacgagaccctggaggagctggtgagcgccaccacccagagcagcaagcagctgcccacctgcttcatgagcacccacagaatcgtgaccgagggcagagtggtgaccgaggaccagctgctgatgctggaggccgtggtgatgcacctgggcatcagaagcgccagatgcgtgctgggcatggagggccagcaggtgatcctgcacctgcccctgagccagaagggccccttctggacctgggagcccagcgcccccagaaccctgctgcaggtgctgcaggaccccgccctgaaggacctggtgctgacctgccccaccctgccctggcacagcctgatcctgagaccccagtacgagatccaggccatcatgcacatcttcagcagcctgagaatcgccgccaccagaagcgccgcccagacccagggcgaggacctggccagagtgcaccagggctggctgcagtacgtgcagcaggacagctgcccccaggagggcccccaggccagatag

SEQ ID NO: 18556 - DNA, 372 bp, Artificial Sequence
  Description of Artificial Sequence: Synthetic coding sequence
atggagcccgtgcccctgcaggacttcgtgagagccctggaccccgccagcctgcccagagtgctgagagtgtgcagcggcgtgtacttcgagggcagcatctacgagatcagcggcaacgagtgctgcctgagcaccggcgacctgatcaaggtgacccaggtgagactgcagaaggtggtgtgcgagaaccccaagaccagccagaccatggagctggcccccaacttccaggtgttcagcagcctgagaatcgccgccaccagaagcgccgcccagacccagggcgaggacctggccagagtgcaccagggctggctgcagtacgtgcagcaggacagctgcccccaggagggcccccaggccagatag

SEQ ID NO: 18557 - DNA, 402 bp, Artificial Sequence
  Description of Artificial Sequence: Synthetic coding sequence
atggagcccgtgcccctgcaggacttcgtgagagccctggaccccgccagcctgcccagagtgctgagagtgtgcagcggcgtgtacttcgagggctacttcacccccctgaacaccccccagagctacgagaccctggaggagctggtgagcgccaccacccagagcagcaagcagctgcccacctgcttcatgagcacccacagaatcgtgaccgagggcagagtggtgaccgaggaccagctgctgatgctggaggccgtggtgatgcacctgggcatcagaagcgccagatgcgtgctgggcatggagggccagcaggtgatcctgcacctgcccctgagccagaagggccccttctggacctgggagcccagcgcccccagaaccctgctgcagtag

SEQ ID NO: 18558 - DNA, 744 bp, Artificial Sequence
  Description of Artificial Sequence: Synthetic coding sequence
atggagcccgtgcccctgcaggacttcgtgagagccctggaccccgccagcctgcccagagtgctgagagtgtgcagcggcgtgtacttcgagggcagcatctacgagatcagcggcaacgagtgctgcctgagcaccggcgacctgatcaaggtgacccaggtgagactgcagaaggtggtgtgcgagaaccccaagaccagccagaccatggagctggcccccaacttccaggtgagaagaaccatcgtgaagatccccagcaccctggaggtggacgtggaggacgtgaccgccagcagcagacacgtgcacttcatcaagcccctgctgctgagcgaggtgctggcctgggagggccccttccccctgagcatggagatcctggaggtgcccgagggcagacccatcttcctgagcccctgggtgggcagcctgcagaagggccagagactgtgcgtgtacggcctggccagccccccctggagagtgctggccagcagcaagggcagaaaggtgcccagacacttcctggtgagcggcggctaccagggcaagctgagaagaagacccagagagttccccaccgcctacgacctgctgggcgccttccagcccggcagacccctgagagtggtggccaccaaggactgcgagggcgagagagaggagaaccccgagttcaccagcctggccgtgggcgacagactggaggtgctgggccccggccaggcccacggctag

SEQ ID NO: 18559 - DNA, 1176 bp, Artificial Sequence
  Description of Artificial Sequence: Synthetic coding sequence
tgaacctgcttcatgagcacccacagaatcgtgaccgagggcagagtggtgaccgaggaccagctgctgatgctggaggccgtggtgatgcacctgggcatcagaagcgccagatgcgtgctgggcatggagggccagcaggtgatcctgcacctgcccctgagccagaagggccccttctggacctgggagcccagcgcccccagaaccctgctgcaggtgctgcaggaccccgccctgaaggacctggtgctgacctgccccaccctgccctggcacagcctgatcctgagaccccagtacgagatccaggccatcatgcacatgagaagaaccatcgtgaagatccccagcaccctggaggtggacgtggaggacgtgaccgccagcagcagacacgtgcacttcatcaagcccctgctgctgagcgagagactgagcgaccaggccggcgaggacgaggaggaggagtgcaaggaggaggccgagagccccgagagagtgctgctgcccttccacttccccggcagcttcgtggaggagatgagcgacagcagaagatacagcctggccgacctgaccgcccagttcagcctgccctgcgaggtgaaggtggtggccaaggacaccagccaccccaccgaccccctgaccagcttcctgggcctgagactggaggagaagatcaccgagcccttcctggtggtgagcctggacagcgagcccggcatgtgcttcgagatcccccccagatggctggacctgaccgtggtgaaggccaagggccagcccgacctgcccgagggcagcctgcccatcgccaccgtggaggagctgaccgacaccttctactacagactgagaaagctgcccgcctgcgagatccaggcccccccccccagaccccccaagaaccagggcctgagcaagcagagaagacacagcagcgagggcggcgtgaagagcagccaggtgctgggcctgcagcagcacgccagactgcccaagcccaaggccaagaccctgcccgagttcatcaaggacggcagcagcacctacagcaagatccccgcccacagaaagggccacagacccgccaagccccagagacaggacctggacgacgacgagcacgactacgaggagatcctggagcagttccagaagaccatctag

SEQ ID NO: 18560 - DNA, 600 bp, Artificial Sequence
  Description of Artificial Sequence: Synthetic coding sequence
atggaggacgccgccgcccccggcagaaccgagggcgtgctggagagacagggcgccccccccgccgccggccagggcggcgccctggtggagctgacccccacccccggcggcctggccctggtgagcccctaccacacccacagagccggcgaccccctggacctggtggccctggccgagcaggtgcagaaggccgacgagttcatcagagccaacgccaccaacaagctgaccgtgatcgccgagcagatccagcacctgcaggagcaggccagaaaggtgctggaggacgcccacagagacgccaacctgcaccacgtggcctgcaacatcgtgaagaagcccggcaacatctactacctgtacaagagagagagcggccagcagtacttcagcatcatcagccccaaggagtggggcaccagctgcccccacgacttcctgggcgcctacaagctgcagcacgacctgagctggaccccctacgaggacatcgagaagcaggacgccaagatcagcatgatggacaccctgctgagccagagcgtggccctgcccccctgcaccgagcccaacttccagggcctgacccactag

SEQ ID NO: 18561 - DNA, 336 bp, Artificial Sequence
  Description of Artificial Sequence: Synthetic coding sequence
tgaagcgccctgctgctgggcgtggacggcctgctgagcggcatcctggccatcatctacgtgagcgccgccagcttccacctgtgcttctacagccccggcgtgcccagcacctacaagggcctgccctgcccctacgccagctgcatcctggccagcaccagcctgctgaccaagggcaacagattcatcctgtgctgcatggccagcctgatgatcctgttcatgatggaccagagctactacccctacgacaagatcctggagagcgagaactggaagaagctggtgtacatcggcggccagttcagattcatcatcggctggaacttctag

SEQ ID NO: 18562 - DNA, 690 bp, Artificial Sequence
  Description of Artificial Sequence: Synthetic coding sequence
aagggcaccagcttcttcctgagccacgaccagagccacagccagatcaacgaggtgagctggaaggacgtgaccagcgccctgagcctggccaacatggtgctgggcctgttcagcatcatcttcagcttcagcagaaagtgccactacgccagcagaatgctgctggtgagcttcctgctggacatggccgtgagagccatgaccagccacatcaacatctgcagcaagctgggcgccgagctgaacgacttcgccgtgttcaccaccttcggcctggccagcgccctgctgctgggcgtggacggcctgctgagcggcatcctggccatcatctacgtgagcgccgccagcttccacctgtgcttctacagccccggcgtgcccagcacctacaagggcctgccctgcccctacgccagctgcatcctggccagcaccagcctgctgaccaagggcaacagattcatcctgtgctgcatggccagcctgatgatcctgttcatgatggaccagagctactacccctacgacaagatcctggagagcgagaactggaagaagctggtgtacatcggcggcgtgatcatgctgttcttcagccccctgagcctgagcgccttctactgcctgatgtggagcctgagctacatcttcttccccgacgccctgtggggcaaggccgcctag

SEQ ID NO: 18563 - DNA, 699 bp, Artificial Sequence
  Description of Artificial Sequence: Synthetic coding sequence
tgattcttcctgagccacgaccagagccacagccagatcaacgaggtgagctggaaggacgtgaccagcgccctgagcctggccaacatggtgctgggcctgttcagcatcatcttcagcttcagcagaaagtgccactacgccagcagaatgctgctggtgagcttcctgctggacatggccgtgagagccatgaccagccacatcaacatctgcagcaagctgggcgccgagctgaacgacttcgccgtgttcaccaccttcggcctggccagcgccctgctgctgggcgtggacggcctgctgagcggcatcctggccatcatctacgtgagcgccgccagcttccacctgtgcttctacagccccggcgtgcccagcacctacaagggcctgccctgcccctacgccagctgcatcctggccagcaccagcctgctgaccaagggcaacagattcatcctgtgctgcatggccagcctgatgatcctgttcatgatggaccagagctactacccctacgacaagatcctggagagcgagaactggaagaagctggtgtacatcggcggcgtgatcatgctgttcttcagccccctgagcctgagcgccttctactgcctgatgtggagcctgagctacatcttcttccccgacgccctgtggggcaaggccgcctgcctgagcccccagcactag

SEQ ID NO: 18564 - DNA, 1158 bp, Artificial Sequence
  Description of Artificial Sequence: Synthetic coding sequence
atggacagccccagcagcgtgagcagctacagcagctacagcctgagcagcagcttccccaccagccccgtgaacagcgacttcggcttccccagcgacagcgagagagaggacaagggcgcccacggccccagacccgacaccgtgggccagagaggcggcagcagacccagccccggccccatcagatgcagacacagaagcaaggtgagcggcaaccagcacacccccagccaccccaagcagagaggcagcgccagccccatggccggcagcggcgccaagagaagcagagacggcgagctggagaccagcctgaacacccagggctgcaccaccgagggcgacctgctgttcgcccagaagtgcaaggagctgcagggcttcatcccccccctgaccgacctgctgaacggcctgaagatgggcagattcgagagaggcctgagcagcttccagcagagcgtggccatggacagaatccagagaatcgtgggcgtgctgcagaagccccagatgggcgagagatacctgggcaccctgctgcaggtggagggcatgctgaagacctggttcccccagatcgccgcccagaagagcagcctgggcggcggcaagcaccagctgaccaagcacttccccagccaccacagcgacagcgccgccagcagccccgccagccccatggagaagatggaccagacccagctgggccacctggccctgaagcccaagcagccctggcacctgacccagtggcccgccatgaacctgacctggatccacaccacccccatctgcaacccccccctgagcagccccggcaccatcagcttcagccacggccccctgggcaccggcaccggcatcggcgtgatcctgttcctgcagcacggcgtgcagcccttcacccacagcgcccccaccacccccgtgccccccaccaccgccagccccgtgatccccggcgagcccatgaagctgagcggcgagggccccagatgctacagcctgcccgtgaccctgcccagcgactggagctacaccctgagcccccccagcctgcccaccctggccagaaagatgaccatcggccacagagagcagcagagaagccacccccccgtggccgccgacgcccacctgctgaacctgtag

SEQ ID NO: 18565 - DNA, 1158 bp, Artificial Sequence; identical to SEQ ID NO: 18564
  Description of Artificial Sequence: Synthetic coding sequence

SEQ ID NO: 18566 - DNA, 1158 bp, Artificial Sequence; identical to SEQ ID NO: 18564
  Description of Artificial Sequence: Synthetic coding sequence

SEQ ID NO: 18567 - DNA, 504 bp, Artificial Sequence
  Description of Artificial Sequence: Synthetic coding sequence
atggccgccgaggagaaggaccccctgagctacttcgccgcctacggcagcagcagcagcggcagcagcgacgaggaggacaacatcgagcccgaggagaccagcagaagaacccccgaccccgccaagagcgccggcggctgcagaaacaaggccgagaagagactgcccggccccgacgagctgttcagaagcgtgaccagacccgccttcctgtacaaccccctgaacaagcagatcgactgggagagacacgtggtgaaggcccccgaggagccccccaaggagttcaagatctggaagagcaactacgtgcccccccccgagacctacaccaccgagaagaagccccccccccccgagctggacatggccatcaagtggagcaacatctacgaggacaacggcgacgacgccccccagaacgccaagaaggccagactgctgcccgagggcgaggagaccctggagagcgccctggaggacctggagatccagaactag

SEQ ID NO: 18568 - DNA, 549 bp, Artificial Sequence
  Description of Artificial Sequence: Synthetic coding sequence
atggccgccgaggagaaggaccccctgagctacttcgccgcctacggcagcagcagcagcggcagcagcgacgaggaggacaacatcgagcccgaggagaccagcagaagaacccccgaccccgccaagagcgccggcggctgcagaaacaaggccgagaagagactgcccggccccgacgagctgttcagaagcgtgaccagacccgccttcctgtacaaccccctgaacaagcagatcgactgggagagacacgtggtgaaggcccccgaggagccccccaaggagttcaagatctggaagagcaactacgtgcccccccccgagacctacaccaccgagaagaagccccccccccccgagctggacatggccatcaagtggagcaacatctacgaggacaacggcgacgacgccccccagaacgccaagaaggccagactgctgcccgagggcgaggagaccctggagagcgacgacgagaaggacgagcacaccagcaagaagagaaaggtggagcccggcgagcccgccaagaagaagaagtag

SEQ ID NO: 18569 - DNA, 438 bp, Artificial Sequence
  Description of Artificial Sequence: Synthetic coding sequence
atggccgccagacagatctgggccagaaccggcgccgccctgtgcagacagcccagcgccgcccccccccccgcccccctgtgggtgagagccggcttcagacagcagctgagcctgaccctgtgccccgccaacgagggcaactgcggcggcagcgcccccagcacccccggcagacccgagagagccgccagacccagcgtgagcgaggagctgaccgccgccgagagacagatcgccgagctgcacgccgccgcctgcgccgccggccagctgaactacgtggaccccgccaccggctacgtggtgctgacccagatcgcccacctgcagagaggcgagtgctgcggcagcgcctgcagacactgcccctacggccaggtgaacgtgaaggaccccagcaagaagaagcagttcaacagctacttctacgtgtag

SEQ ID NO: 18570 - DNA, 396 bp, Artificial Sequence
  Description of Artificial Sequence: Synthetic coding sequence
atggacgtgctgttcgtggccatcttcgccgtgcccctgatcctgggccaggagtacgaggacgaggagagactgggcgaggacgagtactaccaggtggtgtactactacaccgtgacccccagctacgacgacttcagcgccgacttcaccatcgactacagcatcttcgagagcgaggacagactgaacagactggacaaggacatcaccgaggccatcgagaccaccatcagcctggagaccgccagagccgaccaccccaagcccgtgaccgtgaagcccgtgaccaccgagcccagccccgacctgaacgacgccgtgagcagcctgagaagccccatccccctgctgctgagctgcgccttcgtgcaggtgggcatgtacttcatgtag

SEQ ID NO: 18571 - DNA, 1356 bp, Artificial Sequence
  Description of Artificial Sequence: Synthetic coding sequence
atggccgaggccgccgccctggtgtggatcagaggccccggcttcggctgcaaggccgtgagatgcgccagcggcagatgcaccgtgagagacttcatccacagacactgccaggaccagaacgtgcccgtggagaacttcttcgtgaagtgcaacggcgccctgatcaacaccagcgacaccgtgcagcacggcgccgtgtacagcctggagcccagactgtgcggcggcaagggcggcttcggcagcatgctgagagccctgggcgcccagatcgagaagaccaccaacagagaggcctgcagagacctgagcggcagaagactgagagacgtgaaccacgagaaggccatggccgagtgggtgaagcagcaggccgagagagaggccgagaaggagcagaagagactggagagactgcagagaaagctggtggagcccaagcactgcttcaccagccccgactaccagcagcagtgccacgagatggccgagagactggaggacagcgtgctgaagggcatgcaggccgccagcagcaagatggtgagcgccgagatcagcgagaacagaaagagacagtggcccaccaagagccagaccgacagaggcgccagcgccggcaagagaagatgcttctggctgggcatggagggcctggagaccgccgagggcagcaacagcgagagcagcgacgacgacagcgaggaggcccccagcaccagcggcatgggcttccacgcccccaagatcggcagcaacggcgtggagatggccgccaagttccccagcggcagccagagagccagagtggtgaacaccgaccacggcagccccgagcagctgcagatccccgtgaccgacagcggcagacacatcctggaggacagctgcgccgagctgggcgagagcaaggagcacatggagagcagaatggtgaccgagaccgaggagacccaggagaagaaggccgagagcaaggagcccatcgaggaggagcccaccggcgccggcctgaacaaggacaaggagaccgaggagagaaccgacggcgagagagtggccgaggtggcccccgaggagagagagaacgtggccgtggccaagctgcaggagagccagcccggcaacgccgtgatcgacaaggagaccatcgacctgctggccttcaccagcgtggccgagctggagctgctgggcctggagaagctgaagtgcgagctgatggccctgggcctgaagtgcggcggcaccctgcaggagagagccgccagactgttcagcgtgagaggcctggccaaggagcagatcgaccccgccctgttcgccaagcccctgaagggcaagaagaagtag

SEQ ID NO: 18572 - DNA, 1071 bp, Artificial Sequence
  Description of Artificial Sequence: Synthetic coding sequence
atggagcacagcctgacccccgtgacccagtgcagcatggagctgttcatcgtgtggaaccccgacttcgccgtggagaaggaggtgctggacctgtgcagcgagcacctggtgctgagactgagaagacagcccatcgagaagctggtggagcccaagcactgcttcaccagccccgactaccagcagcagtgccacgagatggccgagagactggaggacagcgtgctgaagggcatgcaggccgccagcagcaagatggtgagcgccgagatcagcgagaacagaaagagacagtggcccaccaagagccagaccgacagaggcgccagcgccggcaagagaagatgcttctggctgggcatggagggcctggagaccgccgagggcagcaacagcgagagcagcgacgacgacagcgaggaggcccccagcaccagcggcatgggcttccacgcccccaagatcggcagcaacggcgtggagatggccgccaagttccccagcggcagccagagagccagagtggtgaacaccgaccacggcagccccgagcagctgcagatccccgtgaccgacagcggcagacacatcctggaggacagctgcgccgagctgggcgagagcaaggagcacatggagagcagaatggtgaccgagaccgaggagacccaggagaagaaggccgagagcaaggagcccatcgaggaggagcccaccggcgccggcctgaacaaggacaaggagaccgaggagagaaccgacggcgagagagtggccgaggtggcccccgaggagagagagaacgtggccgtggccaagctgcaggagagccagcccggcaacgccgtgatcgacaaggagaccatcgacctgctggccttcaccagcgtggccgagctggagctgctgggcctggagaagctgaagtgcgagctgatggccctgggcctgaagtgcggcggcaccctgcaggagagagccgccagactgttcagcgtgagaggcctggccaaggagcagatcgaccccgccctgttcgccaagcccctgaagggcaagaagaagtag

SEQ ID NO: 18573 - DNA, 1320 bp, Artificial Sequence
  Description of Artificial Sequence: Synthetic coding sequence
atggccgaggccgccgccctggtgtggatcagaggccccggcttcggctgcaaggccgtgagatgcgccagcggcagatgcaccgtgagagacttcatccacagacactgccaggaccagaacgtgcccgtggagaacttcttcgtgaagtgccacggcgccgtgtacagcctggagcccagactgtgcggcggcaagggcggcttcggcagcatgctgagagccctgggcgcccagatcgagaagaccaccaacagagaggcctgcagagacctgagcggcagaagactgagagacgtgaaccacgagaaggccatggccgagtgggtgaagcagcaggccgagagagaggccgagaaggagcagaagagactggagagactgcagagaaagctggtggagcccaagcactgcttcaccagccccgactaccagcagcagtgccacgagatggccgagagactggaggacagcgtgctgaagggcatgcaggccgccagcagcaagatggtgagcgccgagatcagcgagaacagaaagagacagtggcccaccaagagccagaccgacagaggcgccagcgccggcaagagaagatgcttctggctgggcatggagggcctggagaccgccgagggcagcaacagcgagagcagcgacgacgacagcgaggaggcccccagcaccagcggcatgggcttccacgcccccaagatcggcagcaacggcgtggagatggccgccaagttccccagcggcagccagagagccagagtggtgaacaccgaccacggcagccccgagcagctgcagatccccgtgaccgacagcggcagacacatcctggaggacagctgcgccgagctgggcgagagcaaggagcacatggagagcagaatggtgaccgagaccgaggagacccaggagaagaaggccgagagcaaggagcccatcgaggaggagcccaccggcgccggcctgaacaaggacaaggagaccgaggagagaaccgacggcgagagagtggccgaggtggcccccgaggagagagagaacgtggccgtggccaagctgcaggagagccagcccggcaacgccgtgatcgacaaggagaccatcgacctgctggccttcaccagcgtggccgagctggagctgctgggcctggagaagctgaagtgcgagctgatggccctgggcctgaagtgcggcggcaccctgcaggagagagccgccagactgttcagcgtgagaggcctggccaaggagcagatcgaccccgccctgttcgccaagcccctgaagggcaagaagaagtag

SEQ ID NO: 18574 - DNA, 873 bp, Artificial Sequence
  Description of Artificial Sequence: Synthetic coding sequence
atgagcaactacgtgaacgacatgtggcccggcagcccccaggagaaggacagccccagcaccagcagaagcggcggcagcagcagactgagcagcagaagcagaagcagaagcttcagcagaagcagcagaagccacagcagagtgagcagcagattcagcagcagaagcagaagaagcaagagcagaagcagaagcagaagaagacaccagagaaagtacagaagatacagcagaagctacagcagaagcagaagcagaagcagaagcagaagatacagagagagaagatacggcttcaccagaagatactacagaagccccagcagatacagaagcagaagcagaagcagaagcagaagcagaggcagaagctactgcggcagagcctacgccatcgccagaggccagagatactacggcttcggcagaaccgtgtaccccgaggagcacagcagatggagagacagaagcagaaccagaagcagaagcagaacccccttcagactgagcgagaaggacagaatggagctgctggagatcgccaagaccaacgccgccaaggccctgggcaccaccaacatcgacctgcccgccagcctgagaaccgtgcccagcgccaaggagaccagcagaggcatcggcgtgagcagcaacggcgccaagcccgagctgagcgagaaggtgaccgaggacggcaccagaaaccccaacgagaagcccacccagcagagaagcatcgccttcagcagcaacaacagcgtggccaagcccatccagaagagcgccaaggccgccaccgaggaggccagcagcagaagccccaagatcgaccagaagaagagcccctacggcctgtggatccccatctag

SEQ ID NO: 18575 - DNA, 876 bp, Artificial Sequence
  Description of Artificial Sequence: Synthetic coding sequence
atgtggcccggcagcccccaggagaaggacagccccagcaccagcagaagcggcggcagcagcagactgagcagcagaagcagaagcagaagcttcagcagaagcagcagaagccacagcagagtgagcagcagattcagcagcagaagcagaagaagcaagagcagaagcagaagcagaagaagacaccagagaaagtacagaagatacagcagaagctacagcagaagcagaagcagaagcagaagcagaagatacagagagagaagatacggcttcaccagaagatactacagaagccccagcagatacagaagcagaagcagaagcagaagcagaagcagaggcagaagctactgcggcagagcctacgccatcgccagaggccagagatactacggcttcggcagaaccgtgtaccccgaggagcacagcagatggagagacagaagcagaaccagaagcagaagcagaacccccttcagactgagcgagaaggacagaatggagctgctggagatcgccaagaccaacgccgccaaggccctgggcaccaccaacatcgacctgcccgccagcctgagaaccgtgcccagcgccaaggagaccagcagaggcatcgacatcgacgaggagaacctgctggtgatcgacacctgggccaaggccagcgagctgagcgagaaggtgaccgaggacggcaccagaaaccccaacgagaagcccacccagcagagaagcatcgccttcagcagcaacaacagcgtggccaagcccatccagaagagcgccaaggccgccaccgaggaggccagcagcagaagccccaagatcgaccagaagaagagcccctacggcctgtggatccccatctag

SEQ ID NO: 18576 - DNA, 681 bp, Artificial Sequence
  Description of Artificial Sequence: Synthetic coding sequence
atgagcaactacgtgaacgacatgtggcccggcagcccccaggagaaggacagccccagcaccagcagaagcggcggcagcagcagactgagcagcagaagcagaagcagaagcttcagcagaagcagcagaagccacagcagagtgagcagcagattcagcagcagaagcagaagaagcaagagcagaagcagaagcagaagaagacaccagagaaagtacagaagatacagcagaagctacagcagaagcagaagcagaagcagaagcagaagatacagagagagaagatacggcttcaccagaagatactacagaagccccagcagatacagaagcagaagcagaagcagaagcagaagcagaggcagaagctactgcggcagagcctacgccatcgccagaggccagagatactacggcttcggcagaaccgtgtaccccgaggagcacagcagatggagagacagaagcagaaccagaagcagaagcagaacccccttcagactgagcgagaaggacagaatggagctgctggagatcgccaagaccaacgccgccaaggccctgggcaccaccaacatcgacctgcccgccagcctgagaaccgtgcccagcgccaaggagaccagcagaggcatcggcgtgagcagcaacggcgccaagcccgagaagagctag

SEQ ID NO: 18577 - DNA, 525 bp, Artificial Sequence
  Description of Artificial Sequence: Synthetic coding sequence
atgagcaactacgtgaacgacatgtggcccggcagcccccaggagaaggacagccccagcaccagcagaagcggcggcagcagcagactgagcagcagaagcagaagcagaagcttcagcagaagcagcagaagccacagcagagtgagcagcagattcagcagcagaagcagaagaagcaagagcagaagcagaagcagaagaagacaccagagaaagtacagaagaaccgtgtaccccgaggagcacagcagatggagagacagaagcagaaccagaagcagaagcagaacccccttcagactgagcgagaaggacagaatggagctgctggagatcgccaagaccaacgccgccaaggccctgggcaccaccaacatcgacctgcccgccagcctgagaaccgtgcccagcgccaaggagaccagcagaggcatcggcgtgagcagcaacggcgccaagcccgaggtgagcatcctgggcctgagcgagcagaacttccagaaggccaactgccagatctag

SEQ ID NO: 18578 - DNA, 510 bp, Artificial Sequence
  Description of Artificial Sequence: Synthetic coding sequence
atggcccccagcgaggaccccagagactggagagccaacctgaagggcaccatcagagagaccggcctggagaccagcagcggcggcaagctggccggccaccagaagaccgtgcccaccgcccacctgaccttcgtgatcgactgcacccacggcaagcagctgagcctggccgccaccgccagccccccccaggcccccagccccaacagaggcctggtgaccccccccatgaagacctacatcgtgttctgcggcgagaactggccccacctgaccagagtgacccccatgggcggcggctgcctggcccaggccagagccaccctgcccctgtgcagaggcagcgtggccagcgccagcttccccgtgagccccctgtgcccccaggaggtgcccgaggccaagggcaagcccgtgaaggccgcccccgtgagaagcagcacctggggcaccgtgaaggacagcctgaaggccctgagcagctgcgtgtgcggccaggccgactag

SEQ ID NO: 18579 - DNA, 1872 bp, Artificial Sequence
  Description of Artificial Sequence: Synthetic coding sequence
atggccggcttcagccacttcagccagcccccctacagagacctgtgggagccccccagacccggcggcgagagagagagcacccagagactgggcggccagagaagcggcgccgacagcaccgcctgcagcagagccggcacccccggcgccgagagcgaggccggcgcctgctggctgcacccccactgcagcttcacccccagacccagaagaagaggctgcagcgacagcctgagaggcagcagaagcctgagcgacgtggccagaagacccctggagagaagcagaaagcacagacccagaagcagaagactggaggacgcctggggcgagaccggcaccaagcccagacccgcctggcagccccagacccagctgcccccccagagaccccagccctgcccccactaccccctggcccagggcgacagcccccccccctgccccggcggcgccggcacccccctgagcggcaccttcagagtggagaaggcccagggcggcgaccagtgggccgtgcccctgggcagacacctgggcagatggagccccagcagcgtgcccagcgagagaagcagcgtgcccagccagaagttcaagagacacagcgcctgcgtgtgcgcccagaagagagacagcagcgaccaggtggagagcctggccagcagagacagccagcccctggccagcagcaaggagatgagaagcccccacacccaggtgctgaagagcaagctggaggaggtggtggtgagcagccaggaccagcagatcgtggccctggtgctgaccagactgaagaaggcccagagaatcagagagctgcagcagcaggccgccaaggcctgggaggagctgaagagaagcgaccagaaggtgcagatgaccctggagagagagagaagactgctgctgagacagagccaggagcagtggcaggagaaggagcagagaaagaccctgcagagccccgagcagagaggcctgagaagagacagccagagaaagaacgtgccccccggcgagagcagatggaaggagcagcccgaggaccaggagagccccagacaggagaagctggagaaggccagagcccaggccgagcacagaaagcagtgccaggtgagaagactgagagagcaggagaagatgctgagaaacctgagagagcagcacagcctgcagctgcagagaagactggtggaggcctgcagaaagagacacctgcacgccgtggagggccagaagaaggtgcaggacaccaacctgagcagcctgatcaactaccaggccagaaaggtgctgatggactgccaggccaaggccgaggagctgctgagacagctgagcctggagcagagcttccagagaagccaggagatccaccagggcctgagaaaggagagacagagagagctgagagagaaggcccagaaggaggaggagcagctgcagcaggccagatggagagccggcgagagcgaggagcagagaaagatgagaaagagaatcctggtggagctggccgacgagaagatcagacaggccagaagccacgtgcacaagaccaccagagacaaggtgcagcacctgagagagctgaaccacctgagagagaagaaccaccacatcctgaagctgaaggccgagaaggaggagaagtgccacatcgagggcatcaaggaggccatcaagaagaaggagcagagagtgcagcacatcagccagggcaaggaccccaacttccaggagttccagaagctgccccaggccagcagaagagaggagagagccccccccaacagcagcctggaccagatggtgctggaggcccagctgagagcctgccagcagaacagaggctactag

SEQ ID NO: 18580 - DNA, 753 bp, Artificial Sequence
  Description of Artificial Sequence: Synthetic coding sequence
atgtgcgaccagcagaagcagccccagttcccccccagctgcgtgaagggcagcggcctgggcgccggccagggcagcaacggcgccagcgtgaagtgccccgtgccctgccagacccagaccgtgtgcgtgaccggccccgccccctgccccacccagacctacgtgaagtaccaggtgccctgccagacccagacctacgtgaagtgccccgccccctgccagagaacctacgtgaagtaccccaccccctgccagacctacgtgaagtgccccgccccctgccagaccacctacgtgaagtgccccaccccctgccagacctacgtgaagtgccccgccccctgccagatgacctacatcaagagccccgccccctgccagacccagacctgctacgtgcagggcgccagcccctgccagagctactacgtgcaggcccccgccagcggcagcaccagccagtactgcgtgaccgacccctgcagcgccccctgcagcaccagctactgctgcctggcccccagaaccttcggcgtgagccccctgagaagatggatccagagaccccagaactgcaacaccggcagcagcggctgctgcgagaacagcggcagcagcggctgctgcggcagcggcggctgcggctgcagctgcggctgcggcagcagcggctgctgctgcctgggcatcatccccatgagaagcagaggccccgcctgctgcgaccacgaggacgactgctgctgctag

SEQ ID NO: 18581 - DNA, 753 bp, Artificial Sequence; identical to SEQ ID NO: 18580
  Description of Artificial Sequence: Synthetic coding sequence

SEQ ID NO: 18582 - DNA, 810 bp, Artificial Sequence
  Description of Artificial Sequence: Synthetic coding sequence
atgctgctgctggacctgatgagcagccccagcccccagctgctggtggccgccgcccagcagaccctgggcatgggcaagagaagaagccccccccaggccatctgcctgcacctggccggcgaggtgctggccgtggccagaggcctgaagcccgccgtgctgtacgactgcaactgcgccggcgccagcgagctgcagagctacctggaggagctgaagggcctgggcttcctgaccttcggcctgcacatcctggagatcggcgagaacagcctgatcgtgagccccgagcacgtgtgccagcacctggagcaggtgctgctgggcaccatcgccttcgtggacgtgagcagctgccagagacaccccagcgtgtgcagcctggaccagctgcaggacctgaaggccctggtggccgagatcatcacccacctgcagggcctgcagagagacctgagcctggccgtgagctacagcagactgcacagcagcgactggaacctgtgcaccgtgttcggcatcctgctgggctaccccgtgccctacaccttccacctgaaccagggcgacgacaactgcctggccctgacccccctgagagtgttcaccgccagaatcagctggctgctgggccagccccccatcctgctgtacagcttcagcgtgcccgagagcctgttccccggcctgagagacatcctgaacacctgggagaaggacctgagaaccagattcagaacccagaacgacttcgccgacctgagcatcagcagcgagatcgtgaccctgcccgccgtggccctgtag

SEQ ID NO: 18583 - DNA, 552 bp, Artificial Sequence
  Description of Artificial Sequence: Synthetic coding sequence
atgagaggcagcgtggagtgcacctggggctggggccactgcgcccccagccccctgctgctgtggaccctgctgctgttcgccgcccccttcggcctgctgggcgagaagaccagacagctgctggagttcgacagcaccaacgtgagcgacaccgccgccaagcccctgggcagaccctaccccccctacagcctggccgacttcagctggaacaacatcaccgacagcctggaccccgccaccctgagcgccaccttccagggccaccccatgaacgaccccaccagaaccttcgccaacggcagcctggccttcagagtgcaggccttcagcagaagcagcagacccgcccagccccccagactgctgcacaccgccgacacctgccagctggaggtggccctgatcggcgccagccccagaggcaacagaagcctgttcggcctggaggtggccaccctgggccagggccccgactgccccagcatgcaggagcagcacagcatcgacgacgagtacgcccccgccgtgttccagagaagagactag

SEQ ID NO: 18584 - DNA, 852 bp, Artificial Sequence
  Description of Artificial Sequence: Synthetic coding sequence
atgtgcggccccgagcacctgctgtgctgccccaaggacctggccatgttccccagacagctgagcctgaccgcctgcctgcccggcacccccgtgagccacaagtgccaccacatctggctgtgggtgggcgtgcccgcctggcaccccagagccagcagatgcggcggcgcccagcccagcagctggctgagacagaaggccgccagagccttctggctgagcctgcccgccgccaagctgagacaccacagcagcagatggctgagaagaagcggcgccttcagcagcggcagcaccctgaagcccccccccagccccagccccgcccccctgtgccacgccgacaacctgagaaccggcagaaccagacccagcggcggcagaccctggttcctgctgggcggcgacgagagagagagactgtgggccgagctgctgagaaccgtgagccccgagctgatcctggaccacgaggtgcccagcctgcccgccttccccggccaggagcccagatgcggccccgagcccaccgaggtgttcaccgtgggccccaagaccttcagctggacccccttcccccccgacctgtggggccccggcagaagctacagactgctgcacggcgccggcggccacctggagagccccgccagaagcctgccccagagacccgcccccgacccctgcagagcccccagagtggagcagcagcccagcgtggagggcgccgccgccctgagaagctgccccatgtgccagaaggagttcgcccccagactgacccagctggacgtggacagccacctggcccagtgcctggccgagagcaccgaggacgtgacctggtag

SEQ ID NO: 18585 - DNA, 543 bp, Artificial Sequence
  Description of Artificial Sequence: Synthetic coding sequence
atggaggccgccagaagacccagactgggcctgagcagaagaagacccagacccgccggcggccccagcggcggcagaccctggttcctgctgggcggcgacgagagagagagactgtgggccgagctgctgagaaccgtgagccccgagctgatcctggaccacgaggtgcccagcctgcccgccttccccggccaggagcccagatgcggccccgagcccaccgaggtgttcaccgtgggccccaagaccttcagctggacccccttcccccccgacctgtggggccccggcagaagctacagactgctgcacggcgccggcggccacctggagagccccgccagaagcctgccccagagacccgcccccgacccctgcagagcccccagagtggagcagcagcccagcgtggagggcgccgccgccctgagaagctgccccatgtgccagaaggagttcgcccccagactgacccagctggacgtggacagccacctggcccagtgcctggccgagagcaccgaggacgtgacctggtag

SEQ ID NO: 18586 - DNA, 444 bp, Artificial Sequence
  Description of Artificial Sequence: Synthetic coding sequence
atggaggcctggggcctgtgcgcctggcccagaggcctgagaggcaacttccacacctgcgcccccggcctgacccagagacacgaggtggccagaccccccctgcccggcagcagcgaggacggcagcgccacccccgacacctggcagctggccgccctgcccctgggcagcctgagcagcggccagctgtgcctgcacctgagaggcaccagcacccccgcccccacctgcgtgcccctggcccccaagctgcccccctacgtgtgggtggccagcgagatgtggggcagaagacacagcagaaagaagggcatcagaggcgccagcaccagcagcgagcacttcatcccccaggacgccaccagaagcctgagctggagaagcagaagcgtgcacagagtgctgttcccctggaagatgtgcaccctggagaccgcctag

SEQ ID NO: 18587 - DNA, 339 bp, Artificial Sequence
  Description of Artificial Sequence: Synthetic coding sequence
atggaggccgccagaagacccagactgggcctgagcagaagaagacccagacccgccggcggcagccccggcgccgccagaagccccctgaagagcagcctgagcgaccccagacccttccccggccaccccttcagaagaacctgcggcgccagagccgtgcccaccggctgcttcaccggccaggagggcacctggaaccccccccccggcccctgccccagcgccagacacctgatccccgccggcccccccggctggagcagcagcagactgtggagagtgcccagaccctgcgccgccgccccctgcgccagaagaagcagcccccccggctag

SEQ ID NO: 18588 - DNA, 588 bp, Artificial Sequence
  Description of Artificial Sequence: Synthetic coding sequence
tgagaggccgccagaagacccagactgggcctgagcagaagaagacccagacccgccggcggccccagcggcggcagaccctggttcctgctgggcggcgacgagagagagagactgtgggccgagctgctgagaaccgtgagccccgagctgatcctggaccacgaggtgcccagcctgcccgccttccccggccaggagcccagatgcggccccgagcccaccgaggtgttcaccgtgggccccaagaccttcagctggacccccttcccccccgacctgtggggccccggcagaagctacagactgctgcacggcgccggcggccacctggagagccccgccagaagcctgccccagagacccgcccccgacccctgcagagcccccagagtggagcagcagcccagcgtggagggcgccgccgccctgagaagctgccccatgtgccagaaggagttcgcccccagaagcaagaacagcagcggcatgagaagacacagaagccccaagctggccgccaacaacaacaacaacaagagaaagggcagagccagatggctgacccccgtgatccccgccctgtag

SEQ ID NO: 18589 - DNA, 1641 bp, Artificial Sequence
  Description of Artificial Sequence: Synthetic coding sequence
atgagcagcgcctggaagacccccagaggcagcgacgccatgcccgagatcatggtgaagatcatcggcagcaagcacttccagtacctggtggagaagcccaagatcaaggagaacgacagcctgaagaccgagacccagaccatgcaccagaagcccatgaccgacaacgccagacagatgagcagagacacccccgtgcccatcaacttcaccgaccagcagaccaccgacaaccccgacgacgtgaaggagaagaagcaccccgagaacaaccagaagagcgagaacaaccagaagctgctgaccggcgccaacagcagcagattcctggacggcaacatccccagccaggccaacgtgcactgcagcagcgtgcccaccggcgaccagagcctgagctacgtgcacggcatccccagaagaaagctgagagactggagcctggagcagatggtgagaggcagcagcgaccagcccgaggacatcggccagagccccagcggcaccaccaacgaggacgccttcctgctggccctggtgagaagagagctgaagagcagacccctgagcagcaacctgctggagaagctgcagaaggagctgaagatcctggaccccatcagcagcggcttcctgctgcagagccagctgagcagactgttcctgaagcacgaggtgcccctgcagctgcccaccgtgaagatcctgtgccagagattcagcaagagaggcagccccgagatggtgaactacgagaagctgctgtggttcctgaacagcgccgccagcgactacccccagcagaacaaggccgccgccgacctgagaaagaccgagagccacggcacccacagccagagcacccccccccagcacagcagcagccagcccgaggtgaacagaagcctgctggagatcctgaagatggccctgagaaccaccaacggcagactgaacatcgacaacctgaacctgagcttcagaaaggaggacagaagcttcagcggctgcctgcccctgcccaaggtgagagccatctgcggcaagcacggcctgtacctgaccctgagcctgctggagaccctgctgaaccaccaggacctgggctaccagaacgagatcaagtggcagaacttcgtggagatgctgaccagagccagcagcgacctgctgagcgacctgcccaccggcaagaacgagaagaaggcccccgccccccccatggagcccgaggtgcccgagatgagccagagcaagaccgagcacatgaagacccccgaggaggagctgcagcccgagagcagccccgccgagaccagcgcctgcaaggaccccctgaagcccctgaagatcagacccgtgagccagcccttcgtgaaccccgccgtgaagaacaaggccgaggagtgcgagacctggatcgacagattcagaaagctggagaacgccctgtacctgtgcgacctgagcaacaccggcgtgctggagaaggagagagccagaagactgatccacaactacaacctgatctacaacctgagcctgagcccccagaagatcgaccaggccctgagaagattcagaagcggcgagaacatgctgctggagcccgccctgagatacctgaaggagctgtag

SEQ ID NO: 18590 - DNA, 543 bp, Artificial Sequence
  Description of Artificial Sequence: Synthetic coding sequence
atgagcagaggctgcagcagcgacctgagattccacacctggctgggcctgagaatgctgaagaacatcatcgccgtggccctgctgatgctgggcaagaacgagaagaaggcccccgccccccccatggagcccgaggtgcccgagatgagccagagcaagaccgagcacatgaagacccccgaggaggagctgcagcccgagagcagccccgccgagaccagcgcctgcaaggaccccctgaagcccctgaagatcagacccgtgagccagcccttcgtgaaccccgccgtgaagaacaaggccgaggagtgcgagacctggatcgacagattcagaaagctggagaacgccctgtacctgtgcgacctgagcaacaccggcgtgctggagaaggagagagccagaagactgatccacaactacaacctgatctacaacctgagcctgagcccccagaagatcgaccaggccctgagaagattcagaagcggcgagaacatgctgctggagcccgccctgagatacctgaaggagctgtag

SEQ ID NO: 18591 - DNA, 714 bp, Artificial Sequence
  Description of Artificial Sequence: Synthetic coding sequence
atgagcagcgcctggaagacccccagaggcagcgacgccatgcccgagatcatggtgaagatcatcggcagcaagcacttccagtacctggtggagaagcccaagatcaaggagaacgacagcctgaagaccgagacccagaccatgcaccagaagcccatgaccgacaacgccagacagatgagcagagacacccccgtgcccatcaacttcaccgaccagcagaccaccgacaaccccgacgacgtgaaggagaagaagcaccccgagaacaaccagaagagcgagaacaaccagaagctgctgaccggcgccaacagcagcagattcctggacggcaacgtgagagccatctgcggcaagcacggcctgtacctgaccctgagcctgctggagaccctgctgaaccaccaggacctgggctaccagaacgagatcaagtggcagaacttcgtggagatgctgaccagagccagcagcgacctgctgagcgacctgcccaccggcaagaacgagaagaaggcccccgccccccccatggagcccgaggtgcccgagatgagccagagcaagaccgagcacatgaagacccccgaggaggagctgcagcccgagagcagccccgccgagaccagcgcctgcaaggaccccctgaagcccctgaagatcagacccgtgagccagcccttcgtgaaccccgccgtgaagaactag

SEQ ID NO: 18592 - DNA, 276 bp, Artificial Sequence
  Description of Artificial Sequence: Synthetic coding sequence
atggtgtgctacctgtactgggagaccttccccagcatcagccacctgctgaagatcaccctgagcgccagagactgccacgtgtgcggcctgaacctgttcatcttcatggaccccgtggagaaccaggccctgcaccccgtgatcatggccctgatcctgatgcccagcctgcactgcttcggcaacatcctgatcctgctgttcctgaagagccccgcccagctgttctgcagaatgagcgtggacctggccctgctgttcccccacaagtag

SEQ ID NO: 18593 - DNA, 264 bp, Artificial Sequence
  Description of Artificial Sequence: Synthetic coding sequence
atggagagaaacaccatctacaccggctggctgcagagcaacctgatcctggaccccgtggagaaccaggccctgcaccccgtgatcatggccctgatcctgatgcccagcctgcactgcttcggcaacatcctgatcctgctgttcctgaagagccccgcccagctgttctgcagaatcggcagattcgagaccggcgaggagaagaccagaagaagagagggcagcgacgtgaccaccgaggccgccatcggcgtgatgtag

SEQ ID NO: 18594 - DNA, 447 bp, Artificial Sequence
  Description of Artificial Sequence: Synthetic coding sequence
atgcccggcggcgacaccacccccgaggaggccgccgcccccagctgcgccggctacaaccccggcctgctgctgttcagagcccagaaggcccagggcgcctgcgtgaccagcaccgagggcgcctggcccagaagagccagcgccctgtacggcggcagaaagatgagatgcggcgagagcggcgccggccccgaccccagaagcaacagcgccgaggtgagcagcagccagcccgccctggccagcaagagccagagcaagtggggccccaccagcaacaaccccagaggcgccctgaccaccaccgagttcgagatggccggcaacagaagccagaacatcaagcacaagcagaccgccctgatcgccatccccatgagcagccagacccccagaatgctgggcagacccagaaaccagggccagctgtacccccagccctag

SEQ ID NO: 18595 - DNA, 627 bp, Artificial Sequence
  Description of Artificial Sequence: Synthetic coding sequence
atggacttcagcatcatccagtacagcaagttcatgaccctgctggccatgagcctgcagaacctgaagaccctgcacatgagcctggaggagagcatcaagtggctgggcgaggtgatggccgagatcggccccacccacagccagaagagcgaggactggaacatcttcgacgtgaagcaggccaacgccatcatcgactacctgaagatcagcctgttccagcactacaagctgtacgagttcatgttctacagcgccagagaggagatcgtgatcggcaccgagcaggtgatcgaggtggtgaagagcgcctgcggccccttccccaaccccctggaggagggcatcagcttcgacatctacagcaccttcatcgagccccccaccatcctggacaccgagatgaagagactggaccaggagcagggccccgaggagagccagcccgagaccgacaccagcgacatggaccccctggtgggcttcaccatcgaggacgtgaagagcgtgctggaccaggtgaccgacgacatcctgatcggcatccagaccgagatcaacgagaagctgcagatccaggaggaggccttcaacgccagaatcgagaagctgaagaaggcctag

SEQ ID NO: 18596 - DNA, 255 bp, Artificial Sequence
  Description of Artificial Sequence: Synthetic coding sequence
tgagccgaccccggcggcaaccacgccagaatcggcgccctgcacatgagcctggaggagagcatcaagtggctgggcgaggtgatggccgagatcggccccacccacagccagaagagcgaggactggaacatcttcgacgtgaagcaggccaacgccatcatcgactacctgaagatcagcctgttccagcactacaagctgtacgagttcatgttctacagcgccagagaggagatcgtgatcggcacctag

SEQ ID NO: 18597 - DNA, 597 bp, Artificial Sequence
  Description of Artificial Sequence: Synthetic coding sequence
atggagagcagcagatgggacaaggacccccccggcgagagaagaccccagcagagccagcactggagaagctgcggcgtgggcggcgccggcgaggccaccagaggcggcctgttccccgtgcccttccccagcggcgacagctggcccgaggtgacccagcactggatgagattccagggccagggcccctggtgccccggcctgtggaccacccccgcccacagccactgcaagccccagaccggcgccgtggacaacgccagccccagacagccccacgcccccgaccagcacgagaagaacgccggcagacagcacctgcacctgtggagcctggcctgccccccctggctgcacagcatcccccacatcaagggcaccatcctgagcgaggccctgagcggcttcctggtgagcgacagaagaaccaagaccgtggccggcctgagatggctgtggctgagaaaggaggccacccccaccgccagcagaaccaccctgagcagcagcctggcccccagaggcagaggcgtgaacaccctgggcagaggcggctgcaccctgatggtgctgagcagcgacctgtgcgactag

SEQ ID NO: 18598 - DNA, 666 bp, Artificial Sequence
  Description of Artificial Sequence: Synthetic coding sequence
atggagagcagcagatgggacaaggacccccccggcgagagaagaccccagcagagccagcactggagagccagagaccacggcgccagaggctgcggccccagacagcccaccgccaccgccagccccagacccggcctgtggatcacccccgcccacggcagccacaccccccagaccaacaccagaagaacccaggccgacaacatcttcatctacgagagctggctgatccaccacggcacccagatgagcagcgtgctgccccagccccccctggtgagaggcccctggcacaacaccaacagcccctgggacagctgggccagcagaggcaagctgagagtgtgcccctgcagaacccccagactgcacagcagcggctgcttcagcagcaaggccggcaccgccctgagccccagcctgcccgtgcccggcctgagaccccagccccccttcctgcagaagcccctgagcatcctggcccccgccaccccccccgccctggtgagccccaccccccccaagctgagccccggccagctgagcccccacagcgtgaacgtgcactggggcccccagggccacctgcacctgcccagaagcggcaccaccgtgctgcacgcctacctgcagaccctgagcagccccgccagccaccagtag

SEQ ID NO: 18599 - DNA, 681 bp, Artificial Sequence
  Description of Artificial Sequence: Synthetic coding sequence
atggccggcctggtggtgagaggcacccaggtgagctacatcggccaggactgcagagagatccccgagcacctgggcagagactgcggccacttcgccaagagactggacctgagcttcaacctgctgagaagcctggagggcctgagcgccttcagaagcctggaggagctgatcctggacaacaaccagctgggcgacgacctggtgctgcccggcctgcccagactgcacaccctgaccctgaacaagaacagaatcaccgacctggagaacctgctggaccacctggccgaggtgacccccgccctggagtacctgagcctgctgggcaacgtggcctgccccaacgagctggtgagcctggagaaggacgaggaggactacaagagatacagatgcttcgtgctgtacaagctgcccaacctgaagttcctggacgcccagaaggtgaccagacaggagagagaggaggccctggtgagaggcgtgttcatgaaggtggtgaagcccaaggccagcagcgaggacgtggccagcagccccgagagacactacacccccctgcccagcgccagcagagagctgaccagccaccagggcgtgctgggcaagtgcagatacgtgtactacggcaagaacagcgagggcaacagattcatcagagacgaccagctgtag

SEQ ID NO: 18600 - DNA, 597 bp, Artificial Sequence
  Description of Artificial Sequence: Synthetic coding sequence
atggagaagtacctgagcctgagcggcaaccacagcagcaacaagagaagcctggagggcctgagcgccttcagaagcctggaggagctgatcctggacaacaaccagctgggcgacgacctggtgctgcccggcctgcccagactgcacaccctgaccctgaacaagaacagaatcaccgacctggagaacctgctggaccacctggccgaggtgacccccgccctggagtacctgagcctgctgggcaacgtggcctgccccaacgagctggtgagcctggagaaggacgaggaggactacaagagatacagatgcttcgtgctgtacaagctgcccaacctgaagttcctggacgcccagaaggtgaccagacaggagagagaggaggccctggtgagaggcgtgttcatgaaggtggtgaagcccaaggccagcagcgaggacgtggccagcagccccgagagacactacacccccctgcccagcgccagcagagagctgaccagccaccagggcgtgctgggcaagtgcagatacgtgtactacggcaagaacagcgagggcaacagattcatcagagacgaccagctgtag

SEQ ID NO: 18601 - DNA, 438 bp, Artificial Sequence
  Description of Artificial Sequence: Synthetic coding sequence
atggagagcatggcccccgagatcagcgaggacatcggctgccccctggcctacatgagagagagcgtgtgcgccctgctgatcaaccagagcttcttcagctgcgtggccgagatgtacatccccgacatgaacagacccggcaaggccgagagaagagccgagaagggcctgagaccccccagaaagctggtgggcgagaccagaagactgcagagctggcccaccctggccagatggctgagaagagtgagcttcagcctgtacaagccccccatccaggccgcccccgagcccgaccccggcaactgggccaagagccccagactgagcctgggccccgagggcatcaccaagggcaagcacggcttcaagttccagggcatcaaggagaagttcaacgtgagcaagaaggtgctgaagatgaccttcctgtag

SEQ ID NO: 18602 - DNA, 240 bp, Artificial Sequence
  Description of Artificial Sequence: Synthetic coding sequence
atggccaagagcgagagaagaatctacagcatggagagcatggcccccgagatcagcgaggacatcggctgccccctggcctacatgagagagagcgtgtgcgccctgctgatcaaccagagcttcttcagctgcgtggccgagatgtacatccccgacatgaacagactggaggagagaaccgccgccctgtaccccatcggcctggtgagacagaacggcgagcccagaagagcctag

SEQ ID NO: 18603 - DNA, 468 bp, Artificial Sequence
  Description of Artificial Sequence: Synthetic coding sequence
atggccaagagcgagagaagaatctacagcatggagagcatggcccccgagatcagcgaggacatcggctgccccctggcctacatgagagagagcgtgtgcgccctgctgatcaaccagagcttcttcagctgcgtggccgagatgtacatccccgacatgaacagacccggcaaggccgagagaagagccgagaagggcctgagaccccccagaaagctggtgggcgagaccagaagactgcagagctggcccaccctggccagatggctgagaagagtgagcttcagcctgtacaagccccccatccaggccgcccccgagcccgaccccggcaactgggccaagagccccagactgagcctgggccccgagggcatcaccaagggcaagcacggcttcaagttccagggcatcaaggagaagttcaacgtgagcaagaaggtgctgaagatgaccttcctgtag

SEQ ID NO: 18604 - DNA, 411 bp, Artificial Sequence
  Description of Artificial Sequence: Synthetic coding sequence
atgcagagcagagagcccagcggctggagaaccgccgagagaagaagaggctggagatgcagaggcgtgcccacccccagcggcgacagaggccccggcgccgccagacccgccgccagaggcggcgccggcgagaccaccggccagcagagacccctgcaggtgcccggcgccagcgccgccgccgccagaaccagactgctgagatggcaccacagagtgcccagccccagagccaccagaagccccggcagcatcagaagaaccagcccctgcagcggcggccccgacagacccgagagacccgagtgcgccgacgcctgctgctacctgctggaccccttcaccctgcccctgatccaggacttcttcagaggctgcgccgccagcgacttcgacagaagagactag

SEQ ID NO: 18605 - DNA, 285 bp, Artificial Sequence
  Description of Artificial Sequence: Synthetic coding sequence
atgttcaccagacacaccctgttcagacagttcgccgtgctggccgacaccagcttcaactacatcaaggtgaagcccctgctggtgcagagcagaaccaccatgaccgccatcagcagcagcagccactgcaccagcagcatcgacggcaagcacgtggacgtggtgagcgaccaggccgccctgcagctgagccccaagggcaagctgagcgagagccccaaggaggagagcctggaggagcccagcatgagacagagcagccccgccgagaccgtggactag

SEQ ID NO: 18606 - DNA, 285 bp, Artificial Sequence; identical to SEQ ID NO: 18605
  Description of Artificial Sequence: Synthetic coding sequence

SEQ ID NO: 18607 - DNA, 168 bp, Artificial Sequence
  Description of Artificial Sequence: Synthetic coding sequence
atggccagcaagggcctgcaggacctgaagcagcaggtggagggcaccgcccaggaggccgccatggaccagctggccaagaccacccaggagaccatcgacaagaccgccaaccaggccagcgacaccttcagcggcatcggcaagaagttcggcctgctgaagtag

SEQ ID NO: 18608 - DNA, 231 bp, Artificial Sequence
  Description of Artificial Sequence: Synthetic coding sequence
atggccagcaagggcctgcaggacctgaagcagcaggtggagggcaccgcccaggaggccgtgagcgccgccggcgccgccgcccagcaggtggtggaccaggccaccgaggccggccagaaggccatggaccagctggccaagaccacccaggagaccatcgacaagaccgccaaccaggccagcgacaccttcagcggcatcggcaagaagttcggcctgctgaagtag

SEQ ID NO: 18609 - DNA, 117 bp, Artificial Sequence
  Description of Artificial Sequence: Synthetic coding sequence
atggccagcaagggcctgcaggacctgaagcagcaggtggagggcaccgcccaggaggccgccatggaccagctggccaagaccacccaggagaccatcgacaagaccgccaactag

SEQ ID NO: 18610 - DNA, 636 bp, Artificial Sequence
  Description of Artificial Sequence: Synthetic coding sequence
atgagcgagaccgaccacatcgccagcaccagcagcgacaagaacgtgggcaagacccccgagctgaaggaggacagctgcaacctgttcagcggcaacgagagcagcaagctggagaacgagagcaagctgctgagcctgaacaccgacaagaccctgtgccagcccaacgagcacaacaacagaatcgaggcccaggagaactacatccccgaccacggcggcggcgaggacagctgcgccaagaccgacaccggcagcgagaacagcgagcagatcgccaacttccccagcggcaacttcgccaagcacatcagcaagaccaacgagaccgagcagaaggtgacccagatcctggtggagctgagaagcagcaccttccccgagagcgccaacgagaagacctacagcgagagcccctacgacaccgactgcaccaagaagttcatcagcaagatcaagagcgtgagcgccagcgaggacctgctggaggagatcgagagcgagctgctgagcaccgagttcgccgagcacagagtgcccaacggcatgaacaagggcgagcacgccctggtgctgttcgagaagtgcgtgcaggacaagtacctgcagcaggagcacatcatcaagaagtag

SEQ ID NO: 18611 - DNA, 636 bp, Artificial Sequence; identical to SEQ ID NO: 18610
  Description of Artificial Sequence: Synthetic coding sequence

SEQ ID NO: 18612 - DNA, 2697 bp, Artificial Sequence
  Description of Artificial Sequence: Synthetic coding sequence
atgagcgagaccgaccacatcgccagcaccagcagcgacaagaacgtgggcaagacccccgagctgaaggaggacagctgcaacctgttcagcggcaacgagagcagcaagctggagaacgagagcaagctgctgagcctgaacaccgacaagaccctgtgccagcccaacgagcacaacaacagaatcgaggcccaggagaactacatccccgaccacggcggcggcgaggacagctgcgccaagaccgacaccggcagcgagaacagcgagcagatcgccaacttccccagcggcaacttcgccaagcacatcagcaagaccaacgagaccgagcagaaggtgacccagatcctggtggagctgagaagcagcaccttccccgagagcgccaacgagaagacctacagcgagagcccctacgacaccgactgcaccaagaagttcatcagcaagatcaagagcgtgagcgccagcgaggacctgctggaggagatcgagagcgagctgctgagcaccgagttcgccgagcacagagtgcccaacggcatgaacaagggcgagcacgccctggtgctgttcgagaagtgcgtgcaggacaagtacctgcagcaggagcacatcatcaagaagctgatcaaggagaacaagaagcaccaggagctgttcgtggacatctgcagcgagaaggacaacctgagagaggagctgaagaagagaaccgagaccgagaagcagcacatgaacaccatcaagcagctggagagcagaatcgaggagctgaacaaggaggtgaaggccagcagagaccagctgatcgcccaggacgtgaccgccaagaacgccgtgcagcagctgcacaaggagatggcccagagaatggagcaggccaacaagaagtgcgaggaggccagacaggagaaggaggccatggtgatgaagtacgtgagaggcgagaaggagagcctggacctgagaaaggagaaggagaccctggagaagaagctgagagacgccaacaaggagctggagaagaacaccaacaagatcaagcagctgagccaggagaagggcagactgcaccagctgtacgagaccaaggagggcgagaccaccagactgatcagagagatcgacaagctgaaggaggacatcaacagccacgtgatcaaggtgaagtgggcccagaacaagctgaaggccgagatggacagccacaaggagaccaaggacaagctgaaggagaccaccaccaagctgacccaggccaaggaggaggccgaccagatcagaaagaactgccaggacatgatcaagacctaccaggagagcgaggagatcaagagcaacgagctggacgccaagctgagagtgaccaagggcgagctggagaagcagatgcaggagaagagcgaccagctggagatgcaccacgccaagatcaaggagctggaggacctgaagagaaccttcaaggagggcatggacgagctgagaaccctgagaaccaaggtgaagtgcctggaggacgagagactgagaaccgaggacgagctgagcaagtacaaggagatcatcaacagacagaaggccgagatccagaacctgctggacaaggtgaagaccgccgaccagctgcaggagcagctgcagagaggcaagcaggagatcgagaacctgaaggaggaggtggagagcctgaacagcctgatcaacgacctgcagaaggacatcgagggcagcagaaagagagagagcgagctgctgctgttcaccgagagactgaccagcaagaacgcccagctgcagagcgagagcaacagcctgcagagccagttcgacaaggtgagctgcagcgagagccagctgcagagccagtgcgagcagatgaagcagaccaacatcaacctggagagcagactgctgaaggaggaggagctgagaaaggaggaggtgcagaccctgcaggccgagctggcctgcagacagaccgaggtgaaggccctgagcacccaggtggaggagctgaaggacgagctggtgacccagagaagaaagcacgccagcagcatcaaggacctgaccaagcagctgcagcaggccagaagaaagctggaccaggtggagagcggcagctacgacaaggaggtgagcagcatgggcagcagaagcagcagcagcggcagcctgaacgccagaagcagcgccgaggacagaagccccgagaacaccggcagcagcgtggccgtggacaacttcccccaggtggacaaggccatgctgatcgagagaatcgtgagactgcagaaggcccacgccagaaagaacgagaagatcgagttcatggaggaccacatcaagcagctggtggaggagatcagaaagaagaccaagatcatccagagctacatcctgagagaggagagcggcaccctgagcagcgaggccagcgacttcaacaaggtgcacctgagcagaagaggcggcatcatggccagcctgtacaccagccaccccgccgacaacggcctgaccctggagctgagcctggagatcaacagaaagctgcaggccgtgctggaggacaccctgctgaagaacatcaccctgaaggagaacctgcagaccctgggcaccgagatcgagagactgatcaagcaccagcacgagctggagcagagaaccaagaagacctag

SEQ ID NO: 18613 - DNA, 1311 bp, Artificial Sequence
  Description of Artificial Sequence: Synthetic coding sequence
tgaagactgatcagagagatcgacaagctgaaggaggacatcaacagccacgtgatcaaggtgaagtgggcccagaacaagctgaaggccgagatggacagccacaaggagaccaaggacaagctgaaggagaccaccaccaagctgacccaggccaaggaggaggccgaccagatcagaaagaactgccaggacatgatcaagacctaccaggagagcgaggagatcaagagcaacgagctggacgccaagctgagagtgaccaagggcgagctggagaagcagatgcaggagaagagcgaccagctggagatgcaccacgccaagatcaaggagctggaggacctgaagagaaccttcaaggagggcatggacgagctgagaaccctgagaaccaaggtgaagtgcctggaggacgagagactgagaaccgaggacgagctgagcaagtacaaggagatcatcaacagacagaaggccgagatccagaacctgctggacaaggtgaagaccgccgaccagctgcaggagcagctgcagagaggcaagcaggagatcgagaacctgaaggaggaggtggagagcctgaacagcctgatcaacgacctgcagaaggacatcgagggcagcagaaagagagagagcgagctgctgctgttcaccgagagactgaccagcaagaacgcccagctgcagagcgagagcaacagcctgcagagccagttcgacaaggtgagctgcagcgagagccagctgcagagccagtgcgagcagatgaagcagaccaacatcaacctggagagcagactgctgaaggaggaggagctgagaaaggaggaggtgcagaccctgcaggccgagctggcctgcagacagaccgaggtgaaggccctgagcacccaggtggaggagctgaaggacgagctggtgacccagagaagaaagcacgccagcagcatcaaggacctgaccaagcagctgcagcaggccagaagaaagctggaccaggtggagagcggcagctacgacaaggaggtgagcagcatgggcagcagaagcagcagcagcggcagcctgaacgccagaagcagcgccgaggacagaagccccgagaacaccggcagcagcgtggccgtggacaacttcccccaggtggacaaggccatgctgatcgagagaatcgtgagactgcagaaggcccacgccagaaagaacgagaagatcgagttcatggaggaccacatcaagcagctggtggaggagatcagaaagaagaccaagaagatctacaagcacctggagcagaagtag

SEQ ID NO: 18614 - DNA, 3015 bp, Artificial Sequence
  Description of Artificial Sequence: Synthetic coding sequence
gtgggctgcgtgagccacagaggcctgttcctgcccctgctggccggctggacccccctgtggaagagctggcccctgagccagagcagcagcagcctggtgagagcctggcccgaggcctggatcagcggcagaaagaagagctggatcagcagccagaacatctggatcagaatcctgctgctgagcctggacaacctggtgacctgcggcaaccagaagagagagtacagcaagaacacccagtacagccccagatgcaagaccaagatcagaagcagattcgaggagctgcagagcgagctggtgcccgtgagcatgagcgagaccgaccacatcgccagcaccagcagcgacaagaacgtgggcaagacccccgagctgaaggaggacagctgcaacctgttcagcggcaacgagagcagcaagctggagaacgagagcaagctgctgagcctgaacaccgacaagaccctgtgccagcccaacgagcacaacaacagaatcgaggcccaggagaactacatccccgaccacggcggcggcgaggacagctgcgccaagaccgacaccggcagcgagaacagcgagcagatcgccaacttccccagcggcaacttcgccaagcacatcagcaagaccaacgagaccgagcagaaggtgacccagatcctggtggagctgagaagcagcaccttccccgagagcgccaacgagaagacctacagcgagagcccctacgacaccgactgcaccaagaagttcatcagcaagatcaagagcgtgagcgccagcgaggacctgctggaggagatcgagagcgagctgctgagcaccgagttcgccgagcacagagtgcccaacggcatgaacaagggcgagcacgccctggtgctgttcgagaagtgcgtgcaggacaagtacctgcagcaggagcacatcatcaagaagctgatcaaggagaacaagaagcaccaggagctgttcgtggacatctgcagcgagaaggacaacctgagagaggagctgaagaagagaaccgagaccgagaagcagcacatgaacaccatcaagcagctggagagcagaatcgaggagctgaacaaggaggtgaaggccagcagagaccagctgatcgcccaggacgtgaccgccaagaacgccgtgcagcagctgcacaaggagatggcccagagaatggagcaggccaacaagaagtgcgaggaggccagacaggagaaggaggccatggtgatgaagtacgtgagaggcgagaaggagagcctggacctgagaaaggagaaggagaccctggagaagaagctgagagacgccaacaaggagctggagaagaacaccaacaagatcaagcagctgagccaggagaagggcagactgcaccagctgtacgagaccaaggagggcgagaccaccagactgatcagagagatcgacaagctgaaggaggacatcaacagccacgtgatcaaggtgaagtgggcccagaacaagctgaaggccgagatggacagccacaaggagaccaaggacaagctgaaggagaccaccaccaagctgacccaggccaaggaggaggccgaccagatcagaaagaactgccaggacatgatcaagacctaccaggagagcgaggagatcaagagcaacgagctggacgccaagctgagagtgaccaagggcgagctggagaagcagatgcaggagaagagcgaccagctggagatgcaccacgccaagatcaaggagctggaggacctgaagagaaccttcaaggagggcatggacgagctgagaaccctgagaaccaaggtgaagtgcctggaggacgagagactgagaaccgaggacgagctgagcaagtacaaggagatcatcaacagacagaaggccgagatccagaacctgctggacaaggtgaagaccgccgaccagctgcaggagcagctgcagagaggcaagcaggagatcgagaacctgaaggaggaggtggagagcctgaacagcctgatcaacgacctgcagaaggacatcgagggcagcagaaagagagagagcgagctgctgctgttcaccgagagactgaccagcaagaacgcccagctgcagagcgagagcaacagcctgcagagccagttcgacaaggtgagctgcagcgagagccagctgcagagccagtgcgagcagatgaagcagaccaacatcaacctggagagcagactgctgaaggaggaggagctgagaaaggaggaggtgcagaccctgcaggccgagctggcctgcagacagaccgaggtgaaggccctgagcacccaggtggaggagctgaaggacgagctggtgacccagagaagaaagcacgccagcagcatcaaggacctgaccaagcagctgcagcaggccagaagaaagctggaccaggtggagagcggcagctacgacaaggaggtgagcagcatgggcagcagaagcagcagcagcggcagcctgaacgccagaagcagcgccgaggacagaagccccgagaacaccggcagcagcgtggccgtggacaacttcccccaggtggacaaggccatgctgatcgagagaatcgtgagactgcagaaggcccacgccagaaagaacgagaagatcgagttcatggaggaccacatcaagcagctggtggaggagatcagaaagaagaccaagatcatccagagctacatcctgagagaggagagcggcaccctgagcagcgaggccagcgacttcaacaaggtgcacctgagcagaagaggcggcatcatggccagcctgtacaccagccaccccgccgacaacggcctgaccctggagctgagcctggagatcaacagaaagctgcaggccgtgctggaggacaccctgctgaagaacatcaccctgaaggagaacctgcagaccctgggcaccgagatcgagagactgatcaagcaccagcacgagctggagcagagaaccaagaagacctag

SEQ ID NO: 18615 - DNA, 1218 bp, Artificial Sequence
  Description of Artificial Sequence: Synthetic coding sequence
atggacagccacaaggagaccaaggacaagctgaaggagaccaccaccaagctgacccaggccaaggaggaggccgaccagatcagaaagaactgccaggacatgatcaagacctaccaggagagcgaggagatcaagagcaacgagctggacgccaagctgagagtgaccaagggcgagctggagaagcagatgcaggagaagagcgaccagctggagatgcaccacgccaagatcaaggagctggaggacctgaagagaaccttcaaggagggcatggacgagctgagaaccctgagaaccaaggtgaagtgcctggaggacgagagactgagaaccgaggacgagctgagcaagtacaaggagatcatcaacagacagaaggccgagatccagaacctgctggacaaggtgaagaccgccgaccagctgcaggagcagctgcagagaggcaagcaggagatcgagaacctgaaggaggaggtggagagcctgaacagcctgatcaacgacctgcagaaggacatcgagggcagcagaaagagagagagcgagctgctgctgttcaccgagagactgaccagcaagaacgcccagctgcagagcgagagcaacagcctgcagagccagttcgacaaggtgagctgcagcgagagccagctgcagagccagtgcgagcagatgaagcagaccaacatcaacctggagagcagactgctgaaggaggaggagctgagaaaggaggaggtgcagaccctgcaggccgagctggcctgcagacagaccgaggtgaaggccctgagcacccaggtggaggagctgaaggacgagctggtgacccagagaagaaagcacgccagcagcatcaaggacctgaccaagcagctgcagcaggccagaagaaagctggaccaggtggagagcggcagctacgacaaggaggtgagcagcatgggcagcagaagcagcagcagcggcagcctgaacgccagaagcagcgccgaggacagaagccccgagaacaccggcagcagcgtggccgtggacaacttcccccaggtggacaaggccatgctgatcgagagaatcgtgagactgcagaaggcccacgccagaaagaacgagaagatcgagttcatggaggaccacatcaagcagctggtggaggagatcagaaagaagaccaagaagatctacaagcacctggagcagaagtag

SEQ ID NO: 18616 - DNA, 3744 bp, Artificial Sequence
  Description of Artificial Sequence: Synthetic coding sequence
atgcagagcagcgccctggtggagagcctgatcaccgtgaagatggccgccgagaacagcgaggagggcaacacctgcatcatcccccagagaaacctgttcaaggccctgagcgaggaggcctggaacagcggcttcatgggcaacagcagcagaaccgccgacaaggagaacaccctgcagtgccccaagacccccctgagacaggacctggaggccaacgagcaggacgccagacccaagcaggagaaccacctgcacagcctgggcagaaacaaggtgggctaccacctgcaccccagcgacaagggccagttcgaccacagcaaggacggctggctgggccccggccccatgcccgccgtgcacaaggccgccaacggccacagcagaaccaagatgatcagcaccagcatcaagaccgccagaaagagcaagagagccagcggcctgagaatcaacgactacgacaaccagtgcgacgtggtgtacatcagccagcccatcaccgagtgccacttcgagaaccagaagagcatcctgagcagcagaaagaccgccagaaagagcaccagaggctacttcttcaacggcgactgctgcgagctgcccaccgtgagaaccctggccagaaacctgcacagccaggagaaggccagctgcagcgccctggccagcgaggccgtgttcacccccaagcagaccctgaccatccccgcccccagacacaccgtggacgtgcagctgcccagagaggacaaccccgaggagcccagcaaggagatcaccagccacgaggagggcggcggcgacgtgagccccagaaaggagccccaggagcccgaggtgtgccccaccaagatcaagcccaacctgagcagcagccccagaagcgaggagaccaccgccagcagcctggtgtggcccctgcccgcccacctgcccgaggaggacctgcccgagggcggcagcaccgtgagcgcccccaccgccagcggcatgagcagccccgagcacaaccagccccccgtggccctgctggacaccgaggagatgagcgtgccccaggactgccacctgctgcccagcaccgagagcttcagcggcggcgtgagcgaggacgtgatcagcagaccccacagcccccccgagatcgtgagcagagaggagagcccccagtgcagcgagaaccagagcagccccatgggcctggagccccccatgagcctgggcaaggccgaggacaaccagagcatcagcgccgaggtggagagcggcgacacccaggagctgaacgtggaccccctgctgaaggagagcagcaccttcaccgacgagaaccccagcgagaccgaggagagcgaggccgccggcggcatcggcaagctggagggcgaggacggcgacgtgaagtgcctgagcgagaaggacacctacgacaccagcatcgacagcctggaggagaacctggacaagaagaagaagggcaagaagttccccgaggccagcgacagatgcctgagaagccagctgagcgacagcagcagcgccgacagatgcctgagaaaccagagcagcgacagcagcagcgcctgcctggagatcaaggtgcccaagaaccccagcgccaagagaagcaagaaggagggccaccccggcggcaccacccccaagggcctgctgcccgacagcttccacaccgagaccctggaggacaccgagaagcccagcgtgaacgagagacccagcgagaaggacgccgagcaggagggcgagggcggcggcatcatcaccagacagaccctgaagaacatgctggacaaggaggtgaaggagctgagaggcgagatcttccccagcagagaccccatcaccaccgccggccagcccctgcccggcgagagactggagatctacgtgcagagcaagatggacgagaagaacgcccacatccccagcgagagcatcgcctgcaagagagaccccgagcaggccaaggaggagcccggccacatccccacccagcacgtggaggaggccgtgaacgaggtggacaacgagaacacccagcagaaggacgacgagagcgacgccccctgcagcagcctgggcctgagcagcagcggcagcggcgacgccgccagagcccccaagagcgtgcccagacccaagagactgaccagcagcacctacaacctgagacacgcccacagcctgggcagcctggacgccagcaaggtgaccagcgagaaggaggccgcccaggtgaaccccatcatgcccaaggagaacggcgccagcgagagcggcgaccccctggacgaggacgacgtggacaccgtggtggacgagcagcccaagttcatggagtggtgcgccgaggaggagaaccaggagctgatcgccaacttcaacgcccagtacatgaaggtgcagaagggctggatccagctggagaaggagggccagcccacccccagagccagaaacaagagcgacaagctgaaggagatctggaagagcaagaagagaagcagaaagtgcagaagcagcctggagagccagaagtgcagccccgtgcagatgctgttcatgaccaacttcaagctgagcaacgtgtgcaagtggttcctggagaccaccgagaccagaagcctggtgatcgtgaagaagctgaacaccagactgcccggcgacgtgccccccgtgaagcaccccctgcagaagtacgcccccagcagcctgtaccccagcagcctgcaggccgagagactgaagaagcacctgaagaagttccccggcgccacccccgccaagaacaactggaagatgcagaagctgtgggccaagttcagagagaaccccgaccaggtggagcccgaggacggcagcgacgtgagccccggccccaacagcgaggacagcatcgaggaggtgaaggaggacagaaacagccacccccccgccaacctgcccacccccgccagcaccagaatcctgagaaagtacagcaacatcagaggcaagctgagagcccagcagagactgatcaagaacgagaagatggagtgccccgacgccctggccgtggagagcaagcccagcagaaagagcgtgtgcatcaaccccctgatgagccccaagctggccctgcaggtggacgccgacggcttccccgtgaagcccaagagcaccgagggcatgaagggcagaaagggcaagcaggtgagcgagatcctgcccaaggccgaggtgcagagcaagagaaagagaaccgagggcagcagcccccccgacagcaagaacaagggccccaccgtgaaggccagcaaggagaagcacgccgacggcgccaccaagacccccgccgccaagagacccgccgccagagacagaagcagccagccccccaagaagaccagcctgaaggagaacaaggtgaagatccccaagaagagcgccggcaagagctgcccccccagcagaaaggagaaggagaacaccaacaagagacccagccagagcatcgccagcgagaccctgaccaagcccgccaagcagaagggcgccggcgagagcagcagcagaccccagaaggccaccaacagaaagcagagcagcggcaagaccagagccagacccagcaccaagacccccgagagcagcgccgcccagagaaagagaaagctgaaggccaagctggactgcagccacagcaagagaagaagactggacgccaagtag

SEQ ID NO: 18617 - DNA, 2970 bp, Artificial Sequence
  Description of Artificial Sequence: Synthetic coding sequence
cagcccatcaccgagtgccacttcgagaaccagaagagcatcctgagcagcagaaagaccgccagaaagagcaccagaggctacttcttcaacggcgactgctgcgagctgcccaccgtgagaaccctggccagaaacctgcacagccaggagaaggccagctgcagcgccctggccagcgaggccgtgttcacccccaagcagaccctgaccatccccgcccccagacacaccgtggacgtgcagctgcccagagaggacaaccccgaggagcccagcaaggagatcaccagccacgaggagggcggcggcgacgtgagccccagaaaggagccccaggagcccgaggtgtgccccaccaagatcaagcccaacctgagcagcagccccagaagcgaggagaccaccgccagcagcctggtgtggcccctgcccgcccacctgcccgaggaggacctgcccgagggcggcagcaccgtgagcgcccccaccgccagcggcatgagcagccccgagcacaaccagccccccgtggccctgctggacaccgaggagatgagcgtgccccaggactgccacctgctgcccagcaccgagagcttcagcggcggcgtgagcgaggacgtgatcagcagaccccacagcccccccgagatcgtgagcagagaggagagcccccagtgcagcgagaaccagagcagccccatgggcctggagccccccatgagcctgggcaaggccgaggacaaccagagcatcagcgccgaggtggagagcggcgacacccaggagctgaacgtggaccccctgctgaaggagagcagcaccttcaccgacgagaaccccagcgagaccgaggagagcgaggccgccggcggcatcggcaagctggagggcgaggacggcgacgtgaagtgcctgagcgagaaggacacctacgacaccagcatcgacagcctggaggagaacctggacaagaagaagaagggcaagaagttccccgaggccagcgacagatgcctgagaagccagctgagcgacagcagcagcgccgacagatgcctgagaaaccagagcagcgacagcagcagcgcctgcctggagatcaaggtgcccaagaaccccagcgccaagagaagcaagaaggagggccaccccggcggcaccacccccaagggcctgctgcccgacagcttccacaccgagaccctggaggacaccgagaagcccagcgtgaacgagagacccagcgagaaggacgccgagcaggagggcgagggcggcggcatcatcaccagacagaccctgaagaacatgctggacaaggaggtgaaggagctgagaggcgagatcttccccagcagagaccccatcaccaccgccggccagcccctgcccggcgagagactggagatctacgtgcagagcaagatggacgagaagaacgcccacatccccagcgagagcatcgcctgcaagagagaccccgagcaggccaaggaggagcccggccacatccccacccagcacgtggaggaggccgtgaacgaggtggacaacgagaacacccagcagaaggacgacgagagcgacgccccctgcagcagcctgggcctgagcagcagcggcagcggcgacgccgccagagcccccaagagcgtgcccagacccaagagactgaccagcagcacctacaacctgagacacgcccacagcctgggcagcctggacgccagcaaggtgaccagcgagaaggaggccgcccaggtgaaccccatcatgcccaaggagaacggcgccagcgagagcggcgaccccctggacgaggacgacgtggacaccgtggtggacgagcagcccaagttcatggagtggtgcgccgaggaggagaaccaggagctgatcgccaacttcaacgcccagtacatgaaggtgcagaagggctggatccagctggagaaggagggccagcccacccccagagccagaaacaagagcgacaagctgaaggagatctggaagagcaagaagagaagcagaaagtgcagaagcagcctggagagccagaagtgcagccccgtgcagatgctgttcatgaccaacttcaagctgagcaacgtgtgcaagtggttcctggagaccaccgagaccagaagcctggtgatcgtgaagaagctgaacaccagactgcccggcgacgtgccccccgtgaagcaccccctgcagaagtacgcccccagcagcctgtaccccagcagcctgcaggccgagagactgaagaagcacctgaagaagttccccggcgccacccccgccaagaacaactggaagatgcagaagctgtgggccaagttcagagagaaccccgaccaggtggagcccgaggacggcagcgacgtgagccccggccccaacagcgaggacagcatcgaggaggtgaaggaggacagaaacagccacccccccgccaacctgcccacccccgccagcaccagaatcctgagaaagtacagcaacatcagaggcaagctgagagcccagcagagactgatcaagaacgagaagatggagtgccccgacgccctggccgtggagagcaagcccagcagaaagagcgtgtgcatcaaccccctgatgagccccaagctggccctgcaggtggacgccgacggcttccccgtgaagcccaagagcaccgagggcatgaagggcagaaagggcaagcaggtgagcgagatcctgcccaaggccgaggtgcagagcaagagaaagagaaccgagggcagcagcccccccgacagcaagaacaagggccccaccgtgaaggccagcaaggagaagcacgccgacggcgccaccaagacccccgccgccaagagacccgccgccagagacagaagcagccagccccccaagaagaccagcctgaaggagaacaaggtgaagatccccaagaagaaggagaagtag

SEQ ID NO: 18618 - DNA, 1008 bp, Artificial Sequence
  Description of Artificial Sequence: Synthetic coding sequence
atgatcagagagtggaagaacgactgccagagaatcgagaagcagagagccagcgacaccatggtgcaggagagaaagaacgagaagcccgtgagaatcttcaacaccaacagcagcttccaggaccaggcccccacctgctgccaggaggacctgagcagcgccagccccctgagaatctggagcaagttctacagaagcgaccccagaatcgccctgggcaagtacagccccctggagaaggagatcctgagactgggcggcatccacaccatcgccgccagaagactgctggcctacaagcaggaggaggagtgcagaatgctgaaggagctgcagctgctgagccccgactacaagcaggccatggagtacaagaagaagcacagcagcccctgcgccatctgcgtgcccctggagaagatctggaccgccaaggtgatcgcccccctggaggccttcaagatgccccagagagagcaggtgaacgtgagcaagcacatcgagagaatgagactggccagagccctgggcaaccaccagcccctgccctacatcgagagattcaccagaagcagcttcctgagcggcgtgggcctgggccccatggccaagaacaaggccagaagaaaggaggacaactacgacacccacaactgcgacgacgccaaccaggacaagaaggaggaggccgagggcaagaacaccaagagaagagagatcaagatgaacgtggtgttcaagagcaaggagcccaagaagtgcctgacctaccacggcaacgacagaaagagcttcctgcccgccaagaagcccgagagaagcatcgccggcctgaccaacagaaacctgttctgcatcagcgagttccccggcgacctgatgctgatgaaccaggacttcatcagcagaagagaccacttcagcgacctggtgaagacctacagcctggaggaggagagcatctggaaggagagaatgagaaaggccaccccctaccactactag

SEQ ID NO: 18619 - DNA, 480 bp, Artificial Sequence
  Description of Artificial Sequence: Synthetic coding sequence
tgatgccagagaatcgagaagcagagagccagcgacaccatggtgcaggagagaaagaacgagaagcccgtgagaatcttcaacaccaacagcagcttccaggaccaggcccccacctgctgccaggaggacctgagcagcgccagccccctgagaatctggagcaagttctacagaagcgaccccagaatcgccctgggcaagtacagccccctggagaaggagatcctgagactgggcggcatccacaccatcgccgccagaagactgctggcctacaagcaggaggaggagtgcagaatgctgaaggagctgcagctgctgagccccgactacaagcaggccatggagtacaagaagaagcacagcagcccctgcgccatctgcgtgcccctggagaagatctggaccgccaaggtgatcgcccccctggaggccttcaagatgccccagagagagcagaacagcctggtgacctag

SEQ ID NO: 18620 - DNA, 561 bp, Artificial Sequence
  Description of Artificial Sequence: Synthetic coding sequence
atgaccaagggcagaagattcaacccccccagcgacaaggacggcagatggttcccccacatcggcctgacccagaagacccccgagagcatcaccagcgccaccagcaaggagccccagagcccccacctgcccagacaggccgagggcaagctgccccccatctacaaggtgagagagaagcaggccgtgaacaaccagttccccttcagcgtgcacgacaacagacacagcctggagaacagcggctgctacctggacagcggcctgggcagaaagaagatcagccccgacaagagacagcacgtgagcagaaacttcaacctgtgggcctgcgactacgtgcccagctgcctggacggcttcagcaacaaccagatcagctacgtgtacaaggaggccatggtggtgagcagcttcagaagattccccagatgctacaaggagatctggaacgccttcaccttcctgcccgagagaagctacaccgaggtgctgaagaagaagcccaaggtgagattcaccgtggacaagaaggtggtgagcagcctggagagctag

SEQ ID NO: 18621 - DNA, 405 bp, Artificial Sequence
  Description of Artificial Sequence: Synthetic coding sequence
atggtggccctgaagggcgtgcccgccctgctgagccccgagctgctgtacgccctggccagaatgggccacggcgacgagatcgtgctggccgacctgaacttccccgccagcagcatctgccagtgcggccccatggagatcagagccgacggcctgggcatcccccagctgctggaggccgtgctgaagctgctgcccctggacacctacgtggagagccccgccgccgtgatggagctggtgcccagcgacaaggagagaggcctgcagacccccgtgtggaccgagtacgagagcatcctgagaagagccggctgcgtgagagccctggccaagatcgagagattcgagttctacgagagagccaagaaggccttcgccgtggtggccaccggctgctag

SEQ ID NO: 18622 - DNA, 330 bp, Artificial Sequence
  Description of Artificial Sequence: Synthetic coding sequence
atggagatcagagccgacggcctgggcatcccccagctgctggaggccgtgctgaagctgctgcccctggacacctacgtggagagccccgccgccgtgatggagctggtgcccagcgacaaggagagaggcctgcagacccccgtgtggaccgagtacgagagcatcctgagaagagccggctgcgtgagagccctggccaagatcgagagattcgagttctacgagagagccaagaaggccttcgccgtggtggccaccggcgagaccgccctgtacggcaacctgatcctgagaaagggcgtgctggccctgaaccccctgctgtag

SEQ ID NO: 18623 - DNA, 465 bp, Artificial Sequence
  Description of Artificial Sequence: Synthetic coding sequence
atggtggccctgaagggcgtgcccgccctgctgagccccgagctgctgtacgccctggccagaatgggccacggcgacgagatcgtgctggccgacctgaacttccccgccagcagcatctgccagtgcggccccatggagatcagagccgacggcctgggcatcccccagctgctggaggccgtgctgaagctgctgcccctggacacctacgtggagagccccgccgccgtgatggagctggtgcccagcgacaaggagagaggcctgcagacccccgtgtggaccgagtacgagagcatcctgagaagagccggctgcgtgagagccctggccaagatcgagagattcgagttctacgagagagccaagaaggccttcgccgtggtggccaccggcgagaccgccctgtacggcaacctgatcctgagaaagggcgtgctggccctgaaccccctgctgtag

SEQ ID NO: 18624 - DNA, 333 bp, Artificial Sequence
  Description of Artificial Sequence: Synthetic coding sequence
atgggccacggcgacgagatcggcctgggcatcccccagctgctggaggccgtgctgaagctgctgcccctggacacctacgtggagagccccgccgccgtgatggagctggtgcccagcgacaaggagagaggcctgcagacccccgtgtggaccgagtacgagagcatcctgagaagagccggctgcgtgagagccctggccaagatcgagagattcgagttctacgagagagccaagaaggccttcgccgtggtggccaccggcgagaccgccctgtacggcaacctgatcctgagaaagggcgtgctggccctgaaccccctgctgtag

SEQ ID NO: 18625 - DNA, 519 bp, Artificial Sequence
  Description of Artificial Sequence: Synthetic coding sequence
atgaaccactgcatccagttcagcccccagagcctgcagagatggctgatcctgccctgctacgacctgaagctgcccatctgggccaacaccaccgagttctgcccccacggccccagaagagccagccaggacccccagctgctggcctggctgcccgaccagagcctggaggtgagcctggagctgtacgactggaacagcatgaccttcaccctgttcctggagaccgtggagcccgtggccgtggagagcgagggcagcggcatcttcagcttcgtgtggcagcagctgatcttccccgccgaggccagatggtgcttcagctgggcccaggactgcggcctggacggcagcttccccggcagcgcccacaccgagcccttcggcaaggccgccgccggccagggcagcgtggccggcaaggaggccaagaaggccggccccggcttccacagacagctgctgtacctgcagttccagaagagatgcctgttcaactaccccgagctgctgtag

SEQ ID NO: 18626 - DNA, 480 bp, Artificial Sequence
  Description of Artificial Sequence: Synthetic coding sequence
atgaacctgggcgtgagcatgctgagaatcctgttcctgctggacgtgggcggcgcccaggtgctggccaccggcaagacccccggcgccgagatcgacttcaagtacgccctgatcggcaccgccgtgggcgtggccatcagcgccggcttcctggccctgaagatctgcatgatcagaagacacctgttcgacgacgacagcagcgacctgaagagcacccccggcggcctgagcgacaccatccccctgaagaagagagcccccagagcccacgtgctgagagacggccccgccctgggccccctgcacctgctgttcagcgtgatcggcatgctgttcgccagaaagctgcaggccagcaccctgttcagcttcaagagcctgctgcagtgccaccactgcatcatggagggcctgttcaaggccaagccccagttcctgcagaaggtgagctgcaagagcgaccacctgagctag

SEQ ID NO: 18627 - DNA, 354 bp, Artificial Sequence
  Description of Artificial Sequence: Synthetic coding sequence
atgctgagaatcctgttcctgctggacgtgggcggcgcccaggtgctggccaccggcaagacccccggcgccgagatcgacttcaagtacgccctgatcggcaccgccgtgggcgtggccatcagcgccggcttcctggccctgaagatctgcatgatcagaagacacctgttcgacgacgacagcagcgacctgaagagcacccccggcggcctgagcggcgagaccaccatcagccccaaggccagcggccagatctgcgccaacagccccaccaccgagagcgagaagttccccaagatctgcctgctgaccagcagaaacgacttcagcttctgccaccagagcggctag

SEQ ID NO: 18628 - DNA, 519 bp, Artificial Sequence
  Description of Artificial Sequence: Synthetic coding sequence
atgaacctgggcgtgagcatgctgagaatcctgttcctgctggacgtgggcggcgcccaggtgctggccaccggcaagacccccggcgccgagatcgacttcaagtacgccctgatcggcaccgccgtgggcgtggccatcagcgccggcttcctggccctgaagatctgcatgatcagaagacacctgttcgacgacgacagcagcgacctgaagagcacccccggcggcctgagcgacaccatccccctgaagaagagagcccccagagcccacgtgctgagagacggccccgccctgggccccctgcacctgctgttcagcgtgatcggcatgctgttcgccagaaagctgcaggccagcaccctgttcagcttcaagagcctgctgcagtgccaccactgcatcatggagggcctgttcaaggccaagccccagttcctgcagaagcacctggccagaagcgtgcagatccaccagctgcagaaggtgaagagcttccccaagtacgcctactag

SEQ ID NO: 18629 - DNA, 390 bp, Artificial Sequence
  Description of Artificial Sequence: Synthetic coding sequence
atgaacctgggcgtgagcatgctgagaatcctgttcctgctggacgtgggcggcgcccaggtgctggccaccggcaagacccccggcgccgagatcgacttcaagtacgccctgatcggcaccgccgtgggcgtggccatcagcgccggcttcctggccctgaagatctgcatgatcagaagacacctgttcgacgacgacagcagcgacctgaagagcacccccggcggcctgagcgacaccatccccctgaagaagagagcccccagaaagctgcaggccagcaccctgttcagcttcaagagcctgctgcagtgccaccactgcatcatggagggcctgttcaaggccaagccccagttcctgcagaagagatgcaccggcgactag

SEQ ID NO: 18630 - DNA, 348 bp, Artificial Sequence
  Description of Artificial Sequence: Synthetic coding sequence
agaatcctgttcctgctggacgtgggcggcgcccaggtgctggccaccggcaagacccccggcgccgagatcgacttcaagtacgccctgatcggcaccgccgtgggcgtggccatcagcgccggcttcctggccctgaagatctgcatgatcagaagacacctgttcgacgacgacagcagcgacctgaagagcacccccggcggcctgagcggcgagaccaccatcagccccaaggccagcggccagatctgcgccaacagccccaccaccgagagcgagaagttccccaagatctgcctgctgaccagcagaaacgacttcagcttctgccaccagagcggctag

SEQ ID NO: 18631 - DNA, 771 bp, Artificial Sequence
  Description of Artificial Sequence: Synthetic coding sequence
atgagcgaggagatggacaacatcaccgccgaggagatcatcgacaagcacctgcagaaggacctggacgccgaggagaaccagaacgtggccaagaccctgagaggcaaggtgagagagaagctgaagatcagcaagatcaacaagggcgagaagagcagcaccgagcagctgatcgacagcgagatccaccagagaagcaagctgagcccccagaccgaggtgagcctggacgagagcctgagcttcttcatcctgagcggcgaggagggcagcgccctgggcaagagcagcgagcagagacccgtgaacagaagctaccccaagtgcttcagcctgggcgtgaacctgcagaacgtggccgagagcgaggaggaggagttcatgaaggagttcatcctgaccgacatcctgaaggtgaaggccgccgactacgaggacgaccaggagcagatcaagaagcagaaggccaacatcttcgtgcccagcagcagccccgtggtgaaccagagaaagctgcccaaggacatgatgcccagaatcctggaggacgagggcttctacatccagagaaagcccgagatctacaagaagacctgcaacaagatggagaacagactgctgaagctggaggaggccaagtgctggttcggcgagagcggcgagatcatgagcctgcccacccccatcaagcagagctggaacttcagactgaacgtgagaaaggagcccctgaaccccctgctgaagaccatctacagaaagctgtag

SEQ ID NO: 18632 - DNA, 531 bp, Artificial Sequence
  Description of Artificial Sequence: Synthetic coding sequence
atgggcgtgcagatgagcgaggagatggacaacatcaccgccgaggagatcatcgacaagcacctgcagaaggacctggacgccgaggagaaccagaacgtggccaagaccctgagaggcaaggtgagagagaagctgaagatcagcaagatcaacaagggcgagaagagcagcaccgagcagctgatcgacagcgagatccaccagagaagcaagctgagcccccagaccgaggtgagcctggacgagagcctgagcttcttcatcctgagcggcgaggagggcagcgccctgggcaagagcagcgagcagagacccgtgaacagaagctaccccaagtgcttcagcctgggcgtgaacctgcagaacgtggccgagagcgaggaggaggagttcatgaaggagttcatcctgaccgacatcctgaaggtgaaggccgccgactacgaggacgaccaggagcagatcaagaagcagaaggccaacatcttcgtgcccagcagcagccccggcaacatcctgagccagtag

SEQ ID NO: 18633 - DNA, 2337 bp, Artificial Sequence
  Description of Artificial Sequence: Synthetic coding sequence
atgcagcaggagagcgagagatgcagagtgagagccagaagacccgacatggccctgtacgtgcccaaggccagaagaggcgccgtgctgctgaagaccggcgacgaggaggagagctgcggcagccccaacagcgtggtgaaggagaagcagaaggagagcagcctgagccagaaggaggtgttcaaggacaagcccgaggccagaagactgaacatcaaccccgacagaaaggagcacaactgcagagaggagaagaagagcagcaccaagctgagaatggacacctgcctgcagaagaccaacagagtgtgcagcaagagaggcaccaccgagagcaaggaggtgctgagccagggccagcagcagggcgcccccaacgccggcgtgatcaccaacgcccccctgcagagacacttcaagcccaagaaggtggagtgcctggaggtggagaccaccgacgtgaccggccacgagagaatcctgctgagccaggcctgcctggagatcagcgaggcccaggtgcccagcaagcccttccagaacgtggagttctgcgacttcagcagacacgagcccgacggcgaggccttcgaggacaaggacctggagggcagaatcgagaccgacaccaaggtgctggagatcctgtacgagttccccagagtgttcagcagcgtgatgaagcccgagaacatgatcgtgcccatcaagctgagcagcgacagcgagatcgtgcagcagagcatgcagaccagcgacggcatcctgaaccccagcagcggcggcatcaccaccaccagcgtgcccggcagccccgacggcgtgttcgaccagacctgcgtggacttcgaggtggagagcgtgggcggcatcgccaacagcaccggcttcatcctggaccagaaggacaccgacagcatccccgccaccatgggccacatcagcctgagcgagagcaccaacgacaccgtgagccccgtgatgatcagagagtgcgagaagaacgacagcaccgccgacgagctgcacgtgaagcacgagccccccgacaccgccgtgctggcccacgagacccacagagacagcggcttcaagaacgtgggcgacatcaccaacaaggcctgcatgatggacaccaccggcatgagctgcagcgaccacgtgaccgtggacagcccctacgtggtggccgtgagaatcgccgacgagaccagcatcaacaccagaagcttcagcaagttcgtgggcatgagcgccgacgccacccccctgcacgtggccagaagcggcaacgacaccgaggacttcagcaaccccagcgcctgcagcgacatctacggcgagagcatcagcagccacttcaccgagagcaccggcaagctgatcgagagcctgagcgactgcgccagcagcctgcccatcaagaagatcgccggcagcaactacaacaccttcctggacagcgagctgagcatgctgaacggcaccaaggtgctgagcgacagcgccgtgggcatcgacctgggcagcaccggcgacaccaccgaggccctgcacgagctgagaaccgccgaggagttcaagaccgaggagcaggacgacagcggcagcatcgagttcggcgtgagcttccccgacagagagagcagcagcatggagaccagcatcgagcccaaggccaccgagaccagccacaccgagggcatcaccgccatcgaggagagctgggagagcatgttcaacgacgacggcgactgcctggaccccagactgctgcaggagctgagcggcaacaccaagagcagagagagcatccaggagcccagaagcgactactacaaccacgaggtgcccgacatcgacctgagcgactgcgagttcccccacgtgatcgagatctacgacttcccccaggagttccacaccgaggacctgctgagagtgttctgcagctaccagaagaagggcttcgacatcaagtgggtggacgacacccacgccctgggcgtgttcagcagccccatcaccgccagagacgccctgggcatcaagcacaccatggtgaagatcagacccctgagccaggccaccagagccgccaaggccaaggccagagcctacgccgagttcctgcagcccgccaaggagagacccgagaccagcgccgccctggccagaagactggtgatcagcgccctgggcgtgagaagcaagcagagcaagaccgagagagaggccgagctgaagaagctgcaggaggccagagagagaaagagactggaggccaagcagagagaggacatctgggagggcagagaccagagcaccgtgtag

SEQ ID NO: 18634 - DNA, 585 bp, Artificial Sequence
  Description of Artificial Sequence: Synthetic coding sequence
atgcacatcaagcccgagaaccactgcagcaagctgagcggcaacaccaagagcagagagagcatccaggagcccagaagcgactactacaaccacgaggtgcccgacatcgacctgagcgactgcgagttcccccacgtgatcgagatctacgacttcccccaggagttccacaccgaggacctgctgagagtgttctgcagctaccagaagaagggcttcgacatcaagtgggtggacgacacccacgccctgggcgtgttcagcagccccatcaccgccagagacgccctgggcatcaagcacaccatggtgaagatcagacccctgagccaggccaccagagccgccaaggccaaggccagagcctacgccgagttcctgcagcccgccaaggagagacccgagaccagcgccgccctggccagaagactggtgatcagcgccctgggcgtgagaagcaagcagagcaagaccgagagagaggccgagctgaagaagctgcaggaggccagagagagaaagagactggaggccaagcagagagaggacatctgggagggcagagaccagagcaccgtgtag

SEQ ID NO: 18635 - DNA, 2337 bp, Artificial Sequence; identical to SEQ ID NO: 18633
  Description of Artificial Sequence: Synthetic coding sequence

SEQ ID NO: 18636 - DNA, 555 bp, Artificial Sequence
  Description of Artificial Sequence: Synthetic coding sequence
atgctgagcggcaacaccaagagcagagagagcatccaggagcccagaagcgactactacaaccacgaggtgcccgacatcgacctgagcgactgcgagttcccccacgtgatcgagatctacgacttcccccaggagttccacaccgaggacctgctgagagtgttctgcagctaccagaagaagggcttcgacatcaagtgggtggacgacacccacgccctgggcgtgttcagcagccccatcaccgccagagacgccctgggcatcaagcacaccatggtgaagatcagacccctgagccaggccaccagagccgccaaggccaaggccagagcctacgccgagttcctgcagcccgccaaggagagacccgagaccagcgccgccctggccagaagactggtgatcagcgccctgggcgtgagaagcaagcagagcaagaccgagagagaggccgagctgaagaagctgcaggaggccagagagagaaagagactggaggccaagcagagagaggacatctgggagggcagagaccagagcaccgtgtag

SEQ ID NO: 18637 - DNA, 984 bp, Artificial Sequence
  Description of Artificial Sequence: Synthetic coding sequence
atgcagcaggagagcgagagatgcagagtgagagccagaagacccgacatggccctgtacgtgcccaaggccagaagaggcgccgtgctgctgaagaccggcgacgaggaggagagctgcggcagccccaacagcgtggtgaaggagaagcagaaggagagcagcctgagccagaaggaggtgttcaaggacaagcccgaggccagaagactgaacatcaaccccgacagaaaggagcacaactgcagagaggagaagaagagcagcaccaagctgagaatggacacctgcctgcagaagaccaacagagtgtgcagcaagagaggcaccaccgagagcaaggaggtgctgagccagggccagcagcagggcgcccccaacgccggcgtgatcaccaacgcccccctgcagagacacttcaagcccaagaaggtggagtgcctggaggtggagaccaccgacgtgaccggccacgagagaatcctgctgagccaggcctgcctggagatcagcgaggcccaggtgcccagcaagcccttccagaacgtggagttctgcgacttcagcagacacgagcccgacggcgaggccttcgaggacaaggacctggagggcagaatcgagaccgacaccaaggtgctggagatcctgtacgagttccccagagtgttcagcagcgtgatgaagcccgagaacatgatcgtgcccatcaagctgagcagcgacagcgagatcgtgcagcagagcatgcagaccagcgacggcatcctgaaccccagcagcggcggcatcaccaccaccagcgtgcccggcagccccgacggcgtgttcgaccagacctgcgtggacttcgaggtggagagcgtgggcggcatcgccaacagcaccggcttcatcctggaccagaagatccagatccccttcctgcagctgtgggtgaccagcctgtgccagagagcccagatgaccctgctggtgcagtag

SEQ ID NO: 18638 - DNA, 558 bp, Artificial Sequence
  Description of Artificial Sequence: Synthetic coding sequence
cagaagctgagcggcaacaccaagagcagagagagcatccaggagcccagaagcgactactacaaccacgaggtgcccgacatcgacctgagcgactgcgagttcccccacgtgatcgagatctacgacttcccccaggagttccacaccgaggacctgctgagagtgttctgcagctaccagaagaagggcttcgacatcaagtgggtggacgacacccacgccctgggcgtgttcagcagccccatcaccgccagagacgccctgggcatcaagcacaccatggtgaagatcagacccctgagccaggccaccagagccgccaaggccaaggccagagcctacgccgagttcctgcagcccgccaaggagagacccgagaccagcgccgccctggccagaagactggtgatcagcgccctgggcgtgagaagcaagcagagcaagaccgagagagaggccgagctgaagaagctgcaggaggccagagagagaaagagactggaggccaagcagagagaggacatctgggagggcagagaccagagcaccgtgtag

SEQ ID NO: 18639 - DNA, 321 bp, Artificial Sequence
  Description of Artificial Sequence: Synthetic coding sequence
atgatggccaccggcacccccgagagccaggccagattcggccagagcgtgaagggcctgctgaccgagaaggtgaccacctgcggcaccgacgtgatcgccctgaccaagcaggtgctgaagggcagcagaagcagcgagctgctgggccaggccgccagaaacatggtgctgcaggaggacgccatcctgcacagcgaggacagcctgagaaagatggccatcatcaccacccacctgcagtaccagcaggaggccatccagaagaacgtggagcagagcagcgacctgcaggaccagctgaaccacctgctgaagtag

SEQ ID NO: 18640 - DNA, 321 bp, Artificial Sequence; identical to SEQ ID NO: 18639
  Description of Artificial Sequence: Synthetic coding sequence

SEQ ID NO: 18641 - DNA, 387 bp, Artificial Sequence
  Description of Artificial Sequence: Synthetic coding sequence
atgaagcacaagtacaacaccctgagctggtacaagaaggagagaagcacccagctgagaagattcatcgtgcaccagcccgaggtgggcctgttcttcttcctgagagacgtggtgtacaactacatcaccgagaagaccacctgcagatgccccctgacccaggagagaccctgcgacaccggcggcaagttcggcagaatctggatctgccagcccgaggagctgggcaagatgcagatctggatctgccagcccgaggagctgggcaagatgcagatcgacaagaacagaaccatggtgcagcagatgtggtacatctggtacggcggcctggacaccagcaccaacagcctgctgcccatcctggtgagaggcatggcctag

SEQ ID NO: 18642 - DNA, 387 bp, Artificial Sequence; identical to SEQ ID NO: 18641
  Description of Artificial Sequence: Synthetic coding sequence

SEQ ID NO: 18643 - DNA, 387 bp, Artificial Sequence; identical to SEQ ID NO: 18641
  Description of Artificial Sequence: Synthetic coding sequence

SEQ ID NO: 18644 - DNA, 912 bp, Artificial Sequence
  Description of Artificial Sequence: Synthetic coding sequence
atggaggagagcatggaggaggaggagggcggcagctacgaggccatgatggacgaccagaaccacaacaactgggaggccgccgtggacggcttcagacagcccctgccccccccccccccccccagcagcatccccgcccccgccagagagccccccggcggccagctgctggccgtgcccgccgtgagcgtggacagaaagggccccaaggagggcctgcccatgggcccccagcccccccccgaggccaacggcgtgatcatgatgctgaagagctgcgacgccgccgccgccgtggccaaggccgcccccgcccccaccgccagcagcaccatcaacatcaacaccagcaccagcaagttcctgatgaacgtgatcaccatcgaggactacaagagcacctactggcccaagctggacggcgccatcgaccagctgctgacccagagccccggcgactacatccccatcagctacgagcagatctacagctgcgtgtacaagtgcgtgtgccagcagcacagcgagcagatgtacagcgacctgatcaagaagatcaccaaccacctggagagagtgagcaaggagctgcaggccagcccccccgacctgtacatcgagagattcaacatcgccctgggccagtacatgggcgccctgcagagcatcgtgcccctgttcatctacatgaacaagttctacatcgagaccaagctgaacagagacctgaaggacgacctgatcaagctgttcaccgagcacgtggccgagaagcacatctacagcctgatgcccctgctgctggaggcccagagcacccccttccaggtgacccccagcaccatggccaacatcgtgaagggcctgtacaccctgagacccgtgagccagaacttcaccgccgtgtag

SEQ ID NO: 18645 - DNA, 1110 bp, Artificial Sequence
  Description of Artificial Sequence: Synthetic coding sequence
atggaggagagcatggaggaggaggagggcggcagctacgaggccatgatggacgaccagaaccacaacaactgggaggccgccgtggacggcttcagacagcccctgccccccccccccccccccagcagcatccccgcccccgccagagagccccccggcggccagctgctggccgtgcccgccgtgagcgtggacagaaagggccccaaggagggcctgcccatgggcccccagcccccccccgaggccaacggcgtgatcatgatgctgaagagctgcgacgccgccgccgccgtggccaaggccgcccccgcccccaccgccagcagcaccatcaacatcaacaccagcaccagcaagttcctgatgaacgtgatcaccatcgaggactacaagagcacctactggcccaagctggacggcgccatcgaccagctgctgacccagagccccggcgactacatccccatcagctacgagcagatctacagctgcgtgtacaagtgcgtgtgccagcagcacagcgagcagatgtacagcgacctgatcaagaagatcaccaaccacctggagagagtgagcaaggagctgcaggccagcccccccgacctgtacatcgagagattcaacatcgccctgggccagtacatgggcgccctgcagagcatcgtgcccctgttcatctacatgaacaagttctacatcgagaccaagctgaacagagacctgaaggacgacctgatcaagctgttcaccgagcacgtggccgagaagcacatctacagcctgatgcccctgctgctggaggcccagagcacccccttccaggtgacccccagcaccatggccaacatcgtgaagggcctgtacaccctgagacccgagtgggtgcagatggcccccaccctgttcagcaagttcatccccaacatcctgccccccgccgtggagagcgagctgagcgagtacgccgcccaggaccagaagttccagagagagctgatccagaacggcttcaccagaggcgaccagagcagaaagagagccggcgacgagctggcctacaacagcagcagcgcctgcgccagcagcagaggctacagatag

SEQ ID NO: 18646 - DNA, 741 bp, Artificial Sequence
  Description of Artificial Sequence: Synthetic coding sequence
atgaacgtgatcaccatcgaggactacaagagcacctactggcccaagctggacggcgccatcgaccagctgctgacccagagccccggcgactacatccccatcagctacgagcagatctacagctgcgtgtacaagtgcgtgtgccagcagcacagcgagcagatgtacagcgacctgatcaagaagatcaccaaccacctggagagagtgagcaaggagctgcaggccagcccccccgacctgtacatcgagagattcaacatcgccctgggccagtacatgggcgccctgcagagcatcgtgcccctgttcatctacatgaacaagttctacatcgagaccaagctgaacagagacctgaaggacgacctgatcaagctgttcaccgagcacgtggccgagaagcacatctacagcctgatgcccctgctgctggaggcccagagcacccccttccaggtgacccccagcaccatggccaacatcgtgaagggcctgtacaccctgagacccgagtgggtgcagatggcccccaccctgttcagcaagttcatccccaacatcctgccccccgccgtggagagcgagctgagcgagtacgccgcccaggaccagaagttccagagagagctgatccagaacggcttcaccagaggcgaccagagcagaaagagagccggcgacgagctggcctacaacagcagcagcgcctgcgccagcagcagaggctacagatag

SEQ ID NO: 18647 - DNA, 543 bp, Artificial Sequence
  Description of Artificial Sequence: Synthetic coding sequence
atgaccaccacccccgtgctgagcagattcgccagcccccccgacctgtacatcgagagattcaacatcgccctgggccagtacatgggcgccctgcagagcatcgtgcccctgttcatctacatgaacaagttctacatcgagaccaagctgaacagagacctgaaggacgacctgatcaagctgttcaccgagcacgtggccgagaagcacatctacagcctgatgcccctgctgctggaggcccagagcacccccttccaggtgacccccagcaccatggccaacatcgtgaagggcctgtacaccctgagacccgagtgggtgcagatggcccccaccctgttcagcaagttcatccccaacatcctgccccccgccgtggagagcgagctgagcgagtacgccgcccaggaccagaagttccagagagagctgatccagaacggcttcaccagaggcgaccagagcagaaagagagccggcgacgagctggcctacaacagcagcagcgcctgcgccagcagcagaggctacagatag

SEQ ID NO: 18648 - DNA, 1308 bp, Artificial Sequence
  Description of Artificial Sequence: Synthetic coding sequence
atgcccgtgacccacagaaagagcgacgccagcgacatgaacagcgacaccagccccagctgcagactgagagccttcagcagaggcggcagcctggagagcagaagcagcagcagcagaagcagaagcttcaccctggacgacgagagcctgaagtacctgacccacgaggagaaggacgtgctgctgttcttcgaggagaccatcgacagcctggacgaggacttcgaggagcccgtgctgtgcgacggcggcgtgtgctgcctgtgcagccccagcctggaggagagcaccagcagccccagcgagcccgaggacgtgatcgacctggtgcagcccgcccccggcgccggcgaggccgagggcctgcccgagggcacccaggccgccggccccgcccccgccggcaaggagcacagaaagcaggacgccgagaccccccccccccccgacccccccgcccccgagaccctgctggcccccccccccctgcccagcacccccgacccccccagaagagagctgagagcccccagcccccccgtggagcaccccagactgctgagaagcgtgcccacccccctggtgatggcccagaagatcagcgagagaatggccggcaacgaggccctgagccccaccagccccttcagagagggcagacccggcgagtggagaacccccgccgccagaggccccagaagcggcgaccccggccccggccccagccaccccgcccagcccaaggcccccagattccccagcaacatcatcgtgaccaacggcgccgccagagagcccagaagaaccctgagcagagccgccgtgagcgtgcaggagagaagagcccaggtgctggccaccatccacggccacgccggcgccttccccgccgccggcgacgccggcgagggcgcccccggcggcggcagcagccccgagagagtggccagaggcagaggcctgcccggccccgccgagagcctgagagccggcggccaggcccccagaggccccgccctggccaacggcttccccagcgcccacgaggccctgaagagcgcccccagcagcttcgcccccgccggcaagagcctgtgcttcagacccggccccgccctgcccagcaccagagccagacagagcttccccggccccagacagcccaacggcgcccaggactggagaagagccgacagcctgcccagaccccagggcatcaccgtgcagttcgccggcagaggcagcagcgaggaggccagaagagaggccctgagaaagctgggcctgctgagagagagcagctag

SEQ ID NO: 18649 - DNA, 720 bp, Artificial Sequence
  Description of Artificial Sequence: Synthetic coding sequence
atggcccagaagatcagcgagagaatggccggcaacgaggccctgagccccaccagccccttcagagagggcagacccggcgagtggagaacccccgccgccagaggccccagaagcggcgaccccggccccggccccagccaccccgcccagcccaaggcccccagattccccagcaacatcatcgtgaccaacggcgccgccagagagcccagaagaaccctgagcagagccgccgtgagcgtgcaggagagaagagcccaggtgctggccaccatccacggccacgccggcgccttccccgccgccggcgacgccggcgagggcgcccccggcggcggcagcagccccgagagagtggccagaggcagaggcctgcccggccccgccgagagcctgagagccggcggccaggcccccagaggccccgccctggccaacggcttccccagcgcccacgaggccctgaagagcgcccccagcagcttcgcccccgccggcaagagcctgtgcttcagacccggccccgccctgcccagcaccagagccagacagagcttccccggccccagacagcccaacggcgcccaggactggagaagagccgacagcctgcccagaccccagggcatcaccgtgcagttcgccggcagaggcagcagcgaggaggccagaagagaggccctgagaaagctgggcctgctgagagagagcagctag

SEQ ID NO: 18650 - DNA, 1029 bp, Artificial Sequence
  Description of Artificial Sequence: Synthetic coding sequence
atgcccgtgacccacagaaagagcgacgccagcgacatgaacagcgacaccagccccagctgcagactgagagccttcagcagaggcggcagcctggagagcagaagcagcagcagcagaagcagaagcttcaccctggacgacgagagcctgaagtacctgacccacgaggagaaggacgtgctgctgttcttcgaggagaccatcgacagcctggacgaggacttcgaggagcccgtgctgtgcgacggcggcgtgtgctgcctgtgcagccccagcctggaggagagcaccagcagccccagcgagcccgaggacgtgatcgacctggtgcagcccgcccccggcgccggcgaggccgagggcctgcccgagggcacccaggccgccggccccgcccccgccggcaaggagcacagaaagcaggacgccgagaccccccccccccccgacccccccgcccccgagaccctgctggcccccccccccctgcccagcacccccgacccccccagaagagagctgagagcccccagcccccccgtggagcaccccagactgctgagaagcgtgcccacccccctggtgatggcccagaagatcagcgagagaatggccggcaacgaggccctgagccccaccagccccttcagagagggcagacccggcgagtggagaacccccgccgccagaggccccagaagcggcgaccccggccccggccccagccacccccccgccctggccaacggcttccccagcgcccacgaggccctgaagagcgcccccagcagcttcgcccccgccggcaagagcctgtgcttcagacccggccccgccctgcccagcaccagagccagacagagcttccccggccccagacagcccaacggcgcccaggactggagaagagccgacagcctgcccagaccccagggcatcaccgtgcagttcgccggcagaggcagcagcgaggaggccagaagagaggccctgagaaagctgggcctgctgagagagagcagctag

SEQ ID NO: 18651 - DNA, 1026 bp, Artificial Sequence
  Description of Artificial Sequence: Synthetic coding sequence
atgcccgtgacccacagaaagagcgacgccagcgacatgaacagcgacaccagccccagctgcagactgagagccttcagcagaggcggcagcctggagagcagaagcagcagcagcagaagcagaagcttcaccctggacgacgagagcctgaagtacctgacccacgaggagaaggacgtgctgctgttcttcgaggagaccatcgacagcctggacgaggacttcgaggagcccgtgctgtgcgacggcggcgtgtgctgcctgtgcagccccagcctggaggagagcaccagcagccccagcgagcccgaggacgtgatcgacctggtgcagcccgcccccggcgccggcgaggccgagggcctgcccgagggcacccaggccgccggccccgcccccgccggcaaggagcacagaaagcaggacgccgagaccccccccccccccgacccccccgcccccgagaccctgctggcccccccccccctgcccagcacccccgacccccccagaagagagctgagagcccccagcccccccgtggagcaccccagactgctgagaagcgtgcccacccccctggtgatggcccagaagatcagcgagagaatggccggcaacgaggccctgagccccaccagccccttcagagagggcagacccggcgagtggagaacccccgccgccagaggccccagaagcggcgaccccggccccggccccagccaccccgccctggccaacggcttccccagcgcccacgaggccctgaagagcgcccccagcagcttcgcccccgccggcaagagcctgtgcttcagacccggccccgccctgcccagcaccagagccagacagagcttccccggccccagacagcccaacggcgcccaggactggagaagagccgacagcctgcccagaccccagggcatcaccgtgcagttcgccggcagaggcagcagcgaggaggccagaagagaggccctgagaaagctgggcctgctgagagagagcagctag

SEQ ID NO: 18652 - DNA, 258 bp, Artificial Sequence
  Description of Artificial Sequence: Synthetic coding sequence
atgcccgtgacccacagaaagagcgacgccagcgacatgaacagcgacaccagccccagctgcagactgagagccttcagcagaggcggcagcctggagagcagaagcagcagcagcagaagcagaagcttcaccctggacgacgagagcctgaagtacctgacccacgaggagaaggacgtgctgctgttcttcgaggagaccatcgacagcctggacgaggacttcgaggagcccgtgctgtgcgacggcggctag

SEQ ID NO: 18653 - DNA, 282 bp, Artificial Sequence
  Description of Artificial Sequence: Synthetic coding sequence
atgcccaagaacgccgtggtgatcctgagatacggcccctacagcgccgccggcctgcccgtggagcaccacaccttcagactgcagggcctgcaggccgtgctggccatcgacggccacgaggtgatcctggagaagatcgaggactggaacgtggtggagctgatggtgaacgaggaggtgatcttccactgcaacatcaaggacctggagttcggcggcgacggcaagctggaccccctgtgcgagaaggccagaatcgccgtgctgaacgcctactag

SEQ ID NO: 18654 - DNA, 474 bp, Artificial Sequence
  Description of Artificial Sequence: Synthetic coding sequence
atgcccaagaacgccgtggtgatcctgagatacggcccctacagcgccgccggcctgcccgtggagcaccacaccttcagactgcagggcctgcaggccgtgctggccatcgacggccacgaggtgatcctggagaagatcgaggactggaacgtggtggagctgatggtgaacgaggaggtgatcttccactgcaacatcaaggacctggagttcggcaagctgacccccagcagcgacaagagaaccaccagcagcagcagactgaccttccaccagctgagcagcccctgcagaatgaaggtgagccccctgcagcagttcccccagaagacccaggacctgacctgcaccgtgctggcccagatcggcagctgcatccacttccagaccaacctgtgcgacctgggctggcccggcctggaccacatgctgatcagcggcctggagaagagaggcacccagccctactag

SEQ ID NO: 18655 - DNA, 282 bp, Artificial Sequence
  Description of Artificial Sequence: Synthetic coding sequence
atgcccaagaacgccgtggtgatcctgagatacggcccctacagcgccgccggcctgcccgtggagcaccacaccttcagactgcagggcctgcaggccgtgctggccatcgacggccacgaggtgatcctggagaagatcgaggactggaacgtggtggagctgatggtgaacgaggaggtgatcttccactgcaacatcaaggacctggagttcggcaagcccttcggcgacgccagcagccagcagttcgccagcagcgaggagagcctgaacttctag

SEQ ID NO: 18656 - DNA, 474 bp, Artificial Sequence; identical to SEQ ID NO: 18654
  Description of Artificial Sequence: Synthetic coding sequence

SEQ ID NO: 18657 - DNA, 456 bp, Artificial Sequence
  Description of Artificial Sequence: Synthetic coding sequence
atgttcctgcacctggacagccacagcagcctggagagaaccaagcccaccgtggtgggcgtggacacccacatggagctggacgaggtgcactgctgccccggcagagacagcggcggcggcttcatcaagggccccatgctgcagggcctgcagggcgagggcaagctggcccccatccccaagcccaccctgcccagccccagcagactgaccctgttcgtgagcagcagccagatggaggaccacggcttccccgccagaagaaacggcctgacccaggccagcttcatctaccagatgcccgccggctggggcagccccggcggcctgttcctgccctgccagcccgtgcccacccccgtggtgctgaagccccccctgcccccctgccccatcagctggggcgagagcggccccgccgtggacggcatcagaagaacccccgccccctag

SEQ ID NO: 18658 - DNA, 456 bp, Artificial Sequence; identical to SEQ ID NO: 18657
  Description of Artificial Sequence: Synthetic coding sequence

SEQ ID NO: 18659 - DNA, 558 bp, Artificial Sequence
  Description of Artificial Sequence: Synthetic coding sequence
atgatggccctggtgagagacagaagagcccactacgtgatgagcatcgtgatcagatgggtgcactgcttcagcagcagcctgagaggcaccttcggcaccagatgggaggccatgaaggccaaggccaccgagctgagagtgtgctgcgccagaagaaagagagaggccagagagttcaagcccccccagatgagaggcagcaccagactgaacatcagcgacgacctgaagatcggcttcttcagcaccgaccacgccacccagaccgacagcagcgagatcctgagcgtgaaggagctgagcagcagcacccagaagctggcccagatgatgaagagcctgcaggtggacttcggcttcctgaagcagctgctgcagctgaagttcgaggacagactgaaggaggagagcctgagcctgttcaccatcctgcacgacagaatcctggagatcgagaagcactaccagcagaacgaggacaagatgagaaagagcttcaaccagcagctggccgacgccatcgccgtgatcaagggcatgtaccagcccctgtag

SEQ ID NO: 18660 - DNA, 891 bp, Artificial Sequence
  Description of Artificial Sequence: Synthetic coding sequence
ggcagaaagatcatggagggcctggaggccagcatcgagcagttccagttcaaccccagactgaacatcagcgacgacctgaagatcggcttcttcagcaccgaccacgccacccagaccgacagcagcgagatcctgagcgtgaaggagctgagcagcagcacccagaagctggcccagatgatgaagagcctgcaggtggacttcggcttcctgaagcagctgctgcagctgaagttcgaggacagactgaaggaggagagcctgagcctgttcaccatcctgcacgacagaatcctggagatcgagaagcactaccagcagaacgaggacaagatgagaaagagcttcaaccagcagctggccgacgccatcgccgtgatcaagggcatgtaccagcagttcttcgaggtggaggaggagaacgtgagcctgcaggacgccagcaccgtgaagaccaacatcctgctgagaaagctgaaggagaaggaggaggtgatcaaggagctgaaggaggagctggaccagtacaaggacttcggcttccacaagatggagagcttcgccaaggagaccagcagccccaagagcaacctggagaaggagaacctggagtacaaggtggagaacgagagactgctgcagatcatcagcgagctggaggaggagatccagatcaacctgaaggagaacagcggcctggaggacgagctgatcagcatgaaggagatggccgagaaggaccacaagaccatccagaagctgatggacagcagagacagactgagagaggagctgcactacgagaagagcctggtgcaggacgtgatcaacaagcagaaggaggacaaggagatgagaaagaagtacggcagcctgagcgtgaagtag

SEQ ID NO: 18661 - DNA, 1887 bp, Artificial Sequence
  Description of Artificial Sequence: Synthetic coding sequence
atgaccgaggagcagacctaccaggccgccgagaagagccaggcccacaacgaggtgcccaacgagagactggtggtggagcaccaggagagcctgagcaagaccaagctgcagatcaagaagcaggagaccagcaccgagcagcccctgaccacccccgacaaggagcccaacgagaacctgatcctgagacaccaggacagcatgagcaagagcgagatgcaggtgaaggagcagagaaccctgaagggccagagaatcatcacccacgacgaggagcccggcaagaacctggtgctggagcaccaggacagcgtgagcaagctggagatgcagatcgagaagaccaagaagctgcccagagagaagagacacagcacccacgacgaggagagcggcgagaaccccatgctgaagcaccaggacagcgtgagcaagatccaggtgcagctggagatccaggagaccagcgagggcgagggcagaagcatccccgacaagaacagcatgttcgtgcaccaggacagcgtgagcaagctgcagatgcaggagaagaagaagatcacccccggcagagagagaagaaacaccagaatcgtggtgcccaacgagaacgtgatcagcgtgcaccaggacagcaagagcaagctgcagatgcaggagaagaagcagatcaacagcggcgtggagagacacaagaccttccccctggagatcaagaagaaggacatcagcctggagcacctgctgcccgaggagaaggtgctgctgagcagaagcgagagccagaccaagaagctgcaggccaaggtgaccagcagaaagaagaccgacatcgagagcctgagaggcgccctgggcagaagactgctgaacgacgagttcaagacccagagcaagagcttccccggccccgacatcgagcagctgaccgacgccttcggcagagacatcctgaaggacgagttcaagaccagaagcaagagcctgcccgagaccgacgagagactgcacagcaccaccgagagaggcaccatcaacgacgccatcaagacccagctgaagagaaagagctaccccgagaccgtgctgaagcacctgaagggcgtgaacggcaaggacatcatcaagcacctgatcaacatccagagcaagagccacggcgagaccgacaagaacttcttcgcctacgccaccggcagaggcctgatgaaggagagcaccaccacccagctgaagagccaccccgagaccgacaaggagttcctggccgacgccatcggcagaggcatcatcatcggccccatcaccacccagctgaagagccacagagagaccgacaaggagctgctgaaggacgccatcggcagagacatcatcaagggccccatcagcgcccagctgaagagccaccaggagaccgacgtggagcccctgaccaacgccatcggcagcagcaagaccatcggcgagatcaagacccagctgagaacccactacgacgtgaacctgttcaagaacaaggacatgagcgtgcagagacaggagggcatcttcaccagaagcatcacccccagcaagttccccaccaaggtgatcaacctgagccccttcgagaacaaggaggagacctacgagtacagcagcccctacgtgaccgcccccagcaaggccatctacagaacctacagagccggccccagcttcagcaaggacatccacctgcccctgctgaaccagctgcccagcggccacagcaaggtggtgaccctgagccagaagaccatcgagttcaccctgcccaccgtgaccaacaccgtgggcaagcccacctacaaggtgctgcacgccgccgccagaaagagcgtgccccacccctacttctag

SEQ ID NO: 18662 - DNA, 2079 bp, Artificial Sequence
  Description of Artificial Sequence: Synthetic coding sequence
atgaccgaggagcagacctaccaggccgccgagaagagccaggcccacaacgaggtgcccaacgagagactggtggtggagcaccaggagagcctgagcaagaccaagctgcagatcaagaagcaggagaccagcaccgagcagcccctgaccacccccgacaaggagcccaacgagaacctgatcctgagacaccaggacagcatgagcaagagcgagatgcaggtgaaggagcagagaaccctgaagggccagagaatcatcacccacgacgaggagcccggcaagaacctggtgctggagcaccaggacagcgtgagcaagctggagatgcagatcgagaagaccaagaagctgcccagagagaagagacacagcacccacgacgaggagagcggcgagaaccccatgctgaagcaccaggacagcgtgagcaagatccaggtgcagctggagatccaggagaccagcgagggcgagggcagaagcatccccgacaagaacagcatgttcgtgcaccaggacagcgtgagcaagctgcagatgcaggagaagaagaagatcacccccggcagagagagaagaaacaccagaatcgtggtgcccaacgagaacgtgatcagcgtgcaccaggacagcaagagcaagctgcagatgcaggagaagaagcagatcaacagcggcgtggagagacacaagaccttccccctggagatcaagaagaaggacatcagcctggagcacctgctgcccgaggagaaggtgctgctgagcagaagcgagagccagaccaagaagctgcaggccaaggtgaccagcagaaagatcaagaacgaggccgccagcgagctgcccgacaccgccgagaacctgcccgccatgtaccccagcatcagcgacctgatcatccagttcgacctgaacaaggtggtggagaccgacatcgagagcctgagaggcgccctgggcagaagactgctgaacgacgagttcaagacccagagcaagagcttccccggccccgacatcgagcagctgaccgacgccttcggcagagacatcctgaaggacgagttcaagaccagaagcaagagcctgcccgagaccgacgagagactgcacagcaccaccgagagaggcaccatcaacgacgccatcaagacccagctgaagagaaagagctaccccgagaccgtgctgaagcacctgaagggcgtgaacggcaaggacatcatcaagcacctgatcaacatccagagcaagagccacggcgagaccgacaaggagcacctggccgacgacaccggcagaggcatcatcaagggcagcatcaacgcccagctgaagggccaccagaagaccgacaagaacttcttcgcctacgccaccggcagaggcctgatgaaggagagcaccaccacccagctgaagagccaccccgagaccgacaaggagttcctggccgacgccatcggcagaggcatcatcatcggccccatcaccacccagctgaagagccacagagagaccgacaaggagctgctgaaggacgccatcggcagagacatcatcaagggccccatcagcgcccagctgaagagccaccaggagaccgacgtggagcccctgaccaacgccatcggcagcagcaagaccatcggcgagatcaagacccagctgagaacccactacgacgtgaacctgttcaagaacaaggacatgagcgtgcagagacaggagggcatcttcaccagaagcatcacccccagcaagttccccaccaaggtgatcaacctgagccccttcgagaacaaggaggagacctacgagtacagcagcccctacgtgaccgcccccagcaaggccatctacagaacctacagagccggccccagcttcagcaaggacatccacctgcccctgctgaaccagctgcccagcggccacagcaaggtggtgaccctgagccagaagaccatcgagttcaccctgcccaccgtgaccaacaccgtgggcaagcccacctacaaggtgctgcacgccgccgccagaaagagcgtgccccacccctacttctag

SEQ ID NO: 18663 - DNA, 1815 bp, Artificial Sequence
  Description of Artificial Sequence: Synthetic coding sequence
gcccacaacgaggtgcccaacgagagactggtggtggagcaccaggagagcctgagcaagaccaagctgcagatcaagaagcaggagaccagcaccgagcagcccctgaccacccccgacaaggagcccaacgagaacctgatcctgagacaccaggacagcatgagcaagagcgagatgcaggtgaaggagcagagaaccctgaagggccagagaatcatcacccacgacgaggagagcggcgagaaccccatgctgaagcaccaggacagcgtgagcaagatccaggtgcagctggagatccaggagaccagcgagggcgagggcagaagcatccccgacaagaacagcatgttcgtgcaccaggacagcgtgagcaagctgcagatgcaggagaagaagaagatcacccccggcagagagagaagaaacaccagaatcgtggtgcccaacgagaacgtgatcagcgtgcaccaggacagcaagagcaagctgcagatgcaggagaagaagcagatcaacagcggcgtggagagacacaagaccttccccctggagatcaagaagaaggacatcagcctggagcacctgctgcccgaggagaaggtgctgctgagcagaagcgagagccagaccaagaagctgcaggccaaggtgaccagcagaaagaagaccgacatcgagagcctgagaggcgccctgggcagaagactgctgaacgacgagttcaagacccagagcaagagcttccccggccccgacatcgagcagctgaccgacgccttcggcagagacatcctgaaggacgagttcaagaccagaagcaagagcctgcccgagaccgacgagagactgcacagcaccaccgagagaggcaccatcaacgacgccatcaagacccagctgaagagaaagagctaccccgagaccgtgctgaagcacctgaagggcgtgaacggcaaggacatcatcaagcacctgatcaacatccagagcaagagccacggcgagaccgacaaggagcacctggccgacgacaccggcagaggcatcatcaagggcagcatcaacgcccagctgaagggccaccagaagaccgacaagaacttcttcgcctacgccaccggcagaggcctgatgaaggagagcaccaccacccagctgaagagccaccccgagaccgacaaggagttcctggccgacgccatcggcagaggcatcatcatcggccccatcaccacccagctgaagagccacagagagaccgacaaggagctgctgaaggacgccatcggcagagacatcatcaagggccccatcagcgcccagctgaagagccaccaggagaccgacgtggagcccctgaccaacgccatcggcagcagcaagaccatcggcgagatcaagacccagctgagaacccactacgacgtgaacctgttcaagaacaaggacatgagcgtgcagagacaggagggcatcttcaccagaagcatcacccccagcaagttccccaccaaggtgatcaacctgagccccttcgagaacaaggaggagacctacgagtacagcagcccctacgtgaccgcccccagcaaggccatctacagaacctacagagccggccccagcttcagcaaggacatccacctgcccctgctgaaccagctgcccagcggccacagcaaggtggtgaccctgagccagaagaccatcgagttcaccctgcccaccgtgaccaacaccgtgggcaagcccacctacaaggtgctgcacgccgccgccagaaagagcgtgccccacccctacttctag

SEQ ID NO: 18664 - DNA, 2160 bp, Artificial Sequence
  Description of Artificial Sequence: Synthetic coding sequence
atgatgcagggcaacaagaagtgcaccgacgccttcagcgacagcagcagcatcggcagcgtgctggacgacgccgacagagaggtgagcagcctgaccgacagagccttcagaagcctgtgcatcagcgaggacaccagcttccacgacagctacctggccgtgagccccgacatcaccagacaggtgttcggcaccttccaccagagaaccgtgggccacacccagagaaagagcggcatctggagccagctgcccagccagggcaccgagcacagcggctgggccgccaccttccagcagctgcccaagtacgtgcagggcgaggagaagtaccccaagaccagccccccccccacccccgtgcagagaagactggaggtgcccgtgagcggcctgagaagcagcaacaagcccgtgagcaaggtgagcaccctgatcaagagcttcgacagaaccgagagccagagatgcgagagcagacccaccgccagcaagccccccgccctgaagaacccccccaagttcgcccccctgcccgagaacagcgtgaacttctgcttcgacagcgccttcctgaccgtgagaagagtgcccgccgaggtgagcaacacccaccagaacagctaccagcccggcagaaagcacggcgagcaggagagcagcaagaaccccgagatggcctgccacggcagcagcagcttcctgcccgccgccaacgacaccgccaccctgtgcgagagcaagttccccagcccccaccacaagcccgtgaccggcgagcccggcagaggcaagggcaccttcctgcacagcgagaacagcgccttcgagagctggaacgcccaccagcccaagctgctggagagaaaggacaccgccggcaccgtgcccgagagcaaggcccccaagcactacggcgacaccaccctgctgagagagccctgcccccccgagagaaccgtgagcccctgccaggtgcaggccagctgcagccaggaggagaacagactggccgccggcgccctgagcaccagcatcccctggggctgcagagaccccggcgcccaggtgttcgccgtggagggcaaggcccccagcagccagcccgacagccaggagaagcccgcccagcccccctggagaaagcccaagaccggcaagaagggcaaggagagcctgcaggacaccctggaggagaagacccagaccaaccagagaggcccccccctgtacaccaagcacaacccccaggagcagttcagcgagaacaacgccctggacctgcccgtggagcccaacgagcactacgacccccccttcaacatcagcaagctgctgacccccatcatccccagcaagcacgccctggacagcgccgacagccagcccgccgagagaacccccagcccccccggccagctgaacggctaccaggagaaggagcccagcgagtgccagagcagagacagctacaagagcaaggcccccagcctgctgttcaacctgaaggacgtgagaaagagagtgaagagcacctacagcagcagccccctgctgaaggtgctggacgagaagaccagaggcaaggtggacggcaagcaggagcccgtgagcaacggcgtgatcctgcccaacggcctggaggagagcccccccaacgagctgagcaaggagagacccgccgacgaccccaccgccagccacatcaacccccagaaggaccccaccgccgaccccagcgagcccagcgccgacagctacctgaccctgagcaccgcccccaccatcgccaaggcccccttctacgtgaacggcgaggccgccgagagaagcagctacgagaacaaggaggtggagggcgagctggagatgggccccgccggcagcagctggtgccccgacagcagagagcacagacccagaaagcacctgagcctgagactgtgcaacagagaccccgagcccggcggcgccaccgagaagatgaagacccaccagctggagaacggcctgagcagaagcgtgagccaggagaccgagcccgagagagaggccggcctgcagaacacccacacccacacccacacccacacccacacccacgaccaccagcacatcctgagcctgttcagaagcatcaagagcagaagacagtag

SEQ ID NO: 18665 - DNA, 4308 bp, Artificial Sequence
  Description of Artificial Sequence: Synthetic coding sequence
atgatgcagggcaacaagaagtgcaccgacgccttcagcgacagcagcagcatcggcagcgtgctggacgacgccgacagagaggtgagcagcctgaccgacagagccttcagaagcctgtgcatcagcgaggacaccagcttccacgacagctacctggccgtgagccccgacatcaccagacaggtgttcggcaccttccaccagagaaccgtgggccacacccagagaaagagcggcatctggagccagctgcccagccagggcaccgagcacagcggctgggccgccaccttccagcagctgcccaagtacgtgcagggcgaggagaagtaccccaagaccagccccccccccacccccgtgcagagaagactggaggtgcccgtgagcggcctgagaagcagcaacaagcccgtgagcaaggtgagcaccctgatcaagagcttcgacagaaccgagagccagagatgcgagagcagacccaccgccagcaagccccccgccctgaagaacccccccaagttcgcccccctgcccgagaacagcgtgaacttctgcttcgacagcgccttcctgaccgtgagaagagtgcccgccgaggtgagcaacacccaccagaacagctaccagcccggcagaaagcacggcgagcaggagagcagcaagaaccccgagatggcctgccacggcagcagcagcttcctgcccgccgccaacgacaccgccaccctgtgcgagagcaagttccccagcccccaccacaagcccgtgaccggcgagcccggcagaggcaagggcaccttcctgcacagcgagaacagcgccttcgagagctggaacgcccaccagcccaagctgctggagagaaaggacaccgccggcaccgtgcccgagagcaaggcccccaagcactacggcgacaccaccctgctgagagagccctgcccccccgagagaaccgtgagcccctgccaggtgcaggccagctgcagccaggaggagaacagactggccgccggcgccctgagcaccagcatcccctggggctgcagagaccccggcgcccaggtgttcgccgtggagggcaaggcccccagcagccagcccgacagccaggagaagcccgcccagcccccctggagaaagcccaagaccggcaagaagggcaaggagagcctgcaggacaccctggaggagaagacccagaccaaccagagaggcccccccctgtacaccaagcacaacccccaggagcagttcagcgagaacaacgccctggacctgcccgtggagcccaacgagcactacgacccccccttcaacatcagcaagctgctgacccccatcatccccagcaagcacgccctggacagcgccgacagccagcccgccgagagaacccccagcccccccggccagctgaacggctaccaggagaaggagcccagcgagtgccagagcagagacagctacaagagcaaggcccccagcctgctgttcaacctgaaggacgtgagaaagagagtgaagagcacctacagcagcagccccctgctgaaggtgctggacgagaagaccagaggcaaggtggacggcaagcaggagcccgtgagcaacggcgtgatcctgcccaacggcctggaggagagcccccccaacgagctgagcaaggagagacccgccgacgaccccaccgccagccacatcaacccccagaaggaccccaccgccgaccccagcgagcccagcgccgacagctacctgaccctgagcaccgcccccaccatcgccaaggcccccttctacgtgaacggcgaggccgccgagagaagcagctacgagaacaaggaggtggagggcgagctggagatgggccccgccggcagcagctggtgccccgacagcagagagcacagacccagaaagcacctgagcctgagactgtgcaacagagaccccgagcccggcggcgccaccgagaagatgaagacccaccagctggagaacggcctgagcagaagcgtgagccaggagaccgagcccgagagagaggccggcctgcagaacacccacctgaaccagaagttcttccccggccccctgagccccgaggaggaggacgtgttctacagcgacagccagagcgacttcatgcccagcctgaagggcaaggccaagttcagcaccagcagcagcgaccagagcttcgccagcttcgacgaccagcagaagatgtggttcaccgagaaccagagagaggacagaagaaaggacgtgagcgccggcgacagccagaaggacgagaaggagaacgtgatgagaaaggacgagctgcagtactgcgccctgagcaacggccacgcctgcctggagaacagaagccagggcgaggccctgcagagagagagagagagcgtgagcggcggcagaaccagaaaggccagcgccgaggaggccaacttcagaggcagctggatcggcgagaacaagggcaccaccttcagccaggccaaggacctgacccccagccccagcagcgccagcaacagacacatgctgttcaccatcaaggacaacaccctgagagccacccccgtgatcaagcccatcatgctgcccctgctgagaaccatgagcctggaggacagcctgagcagcggccacaaggaggaggagctgcccagacccgagtggggcgaggaccccggcttctgcgcccccgagaaccaggacatcctgggcaccagcacccccaccaacaccagaggcaccagagtgaagtgcatggccaacgaggtgatggaggaccccggccagggcagcagcatggccagaatggaggccagccagcccgcccccaagggcaacttccccagcatgcccctggtgggcgagggcgacagagtgaaggccccccccgacgccgcccccggcctggtggccagcaactgcaagagcggcagcgccgacagcggcaagctggccgccccctggcacatccccaccatcgccctgcccgagggcgacatcgaggaccagccccccccctggcagcccgagaactgctgggaggagcagacccccggcttcaagagccacttcctgagcacccccagagccggcccccccggcagaagactggtgcccagcgagagagccaacagccccaaccccggcagccccggcgagagcagcgcctgcagccccgccgccagcaacatctgggaggagagcagccaggcccccggcggccccgagctgctgcccgaggagcccaaccaggccagcccctgggccagcagcagccccgccagagtgaccagaagagaggacctgacccacgccctggtgtgggagggcggcagcgaccccctgctggagctgagcgccgaggacctgagaaccctgagccccagaggcagcctgctggacgtggccaccagccccgccggcaccagcggcagactggagctgcccgcccagctggagagaaccgccagcaagccccccgccgtgccccccaagaccgagaaggccctgagaagagccaagaagctggccagcaagagaagaaagaccgaccaggcccaggagaagcacggcgagagccaggagggcaagccctgccccgaggacctggagcagacccagcagagacccctgtgccccagagagagacccagacacaacttccccgtggtgagaagcctgcccccccccgtgcacagacacagcgtgagcggcttcagcgagcccgtgggcagaagacccggcggcccccagagcctgacccccctgcccgcctaccccgccacccagaaggtgctgcaggacccccagagcggcgagtacttcgtgttcgacctgcccctgcaggtgaagatcaagaccttctacgaccccgagaccggcaagtacgtgaaggtgagcatccccagcagcgagggcgccagccccgagccccccccccccgacgccctggccgccccctacgtgctgtaccccggcttccagcccgtgcccgtgaccgccctgatgcccctgagatgcagcagccagctgagcgcccccaccttcctgagacagggccccagagccagcgccgccagagccagaacccagagcgtgcacgagagcggcctgcagctggaccccggcccccacggcgactgcaccccccacagcgccggccagagaccccacggccccccccagagccccggcgaggagggcgtggaggcccccggcctgggcatcatcagcaccgacgacctggaggacttcgccaccgagggcatcagctag

SEQ ID NO: 18666 - DNA, 480 bp, Artificial Sequence
  Description of Artificial Sequence: Synthetic coding sequence
cccatgagacacagaaagaaggccgccgacaagaacctgccctgcagacccctggtgtgcgccgtgctggacctgatggtggagttcatcgtgacccacatgatgaaggagttccccatggacctgtacatcagatgcatccaggtggtgcacaagctgctgtgctaccagaagaagtgcagagtgagactgcactacacctggagagagctgtggagcgccctgatcaacctgctgaagttcctgatgagcaacgagaccgtgctgctggccaagcacaacatcttcaccctggccctgatgatcgtgaacctgttcaacatgttcatcacctacggcgacaccttcctgcccacccccagcagctacgacgagctgtactacgagatcatcagaatgcaccagagcttcgacaacctgtacagcatggagcccagcagcaccaccctgacccccaagctgagccccaccctgctgtag

SEQ ID NO: 18667 - DNA, 597 bp, Artificial Sequence
  Description of Artificial Sequence: Synthetic coding sequence
atggagagctacttcttcaaggagaccagccacgagagcgtggacagcagcaaggaggagccccagaccctgcccgagacccaggacggcgacctgcacctgcaggagcagggcagcggcatcgactggtgcctgagccccgccgacgtggaggcccagaccaccaacgaccagaagggcaacatccccgacgagagccaggtggagaagctgaacgtgttcctgagcccccccgacgtgatcaactacctggccctgaccgaggccaccggcagaatctgcgtgagccagtgggagggcccccccagactgggctgcatcttctgccacggcgaccacctgctggccgtgaacgacctgaagccccagagcctggaggaggtgagcctgttcctgaccagaagcatccagaaggagaagctgaagctgaccatcggcagaatccccaacagcgagaccttccacgccgccagctgcatgtgccccagcaagtgccagagcgccgcccccagccagctggacaagcccagactgaacagagcccccaagagaagccccgccatcaagaagagccagcagaagggcgccagagagtag

SEQ ID NO: 18668 - DNA, 1092 bp, Artificial Sequence
  Description of Artificial Sequence: Synthetic coding sequence
atggagcccaagccccagaagagccccggcaagcagttcaccttcagctacgagaacgaggtgtgcaagcaggactacttcatcaagagcccccccagccagctgttcagcagcgtgaccagctggaagaagagattcttcatcctgagcaaggccggcgagaagagcttcagcctgagctactacaaggaccaccaccacagaggcagcatcgagatcgaccagaacagcagcgtggaggtgggcatcagcagccaggagaagatgcagagcgtgcagaagatgttcaagtgccaccccgacgaggtgatgagcatcagaaccaccaacagagagtacttcctgatcggccacgacagagagaagatcaaggactgggtgagcttcatgagcagcttcagacaggacatcaaggccacccagcagaacaccgaggaggagctgagcctgggcaacaagagaaccctgttctacagcagccccctgctgggccccagcagcaccagcgaggccgtgggcagcagcagccccagaaacggcctgcaggacaagcacctgatggagcagagcagccccggcttcagacagacccacctgcaggacctgagcgaggccacccaggacgtgaaggaggagaaccactacctgacccccagaagcgtgctgctggagctggacaacatcatcgccagcagcgacagcggcgagagcatcgagaccgacggccccgaccaggtgagcggcagaatcgagtgccactacgagcccatggagagctacttcttcaaggagaccagccacgagagcgtggacagcagcaaggaggagccccagaccctgcccgagacccaggacggcgacctgcacctgcaggagcagggcagcggcatcgactggtgcctgagccccgccgacgtggaggcccagaccaccaacgaccagaagggcagcgccagcctgaccgtggtgcagctgagcatcctgatcaacaacatccccgacgagagccaggtggagaagctgaacgtgttcctgagcccccccgacgtgatcaactacctggccctgaccgaggccaccggcagaatctag

SEQ ID NO: 18669 - DNA, 849 bp, Artificial Sequence
  Description of Artificial Sequence: Synthetic coding sequence
atggagcagagcagccccggcttcagacagacccacctgcaggacctgagcgaggccacccaggacgtgaaggaggagaaccactacctgacccccagaagcgtgctgctggagctggacaacatcatcgccagcagcgacagcggcgagagcatcgagaccgacggccccgaccaggtgagcggcagaatcgagtgccactacgagcccatggagagctacttcttcaaggagaccagccacgagagcgtggacagcagcaaggaggagccccagaccctgcccgagacccaggacggcgacctgcacctgcaggagcagggcagcggcatcgactggtgcctgagccccgccgacgtggaggcccagaccaccaacgaccagaagggcagcgccagcctgaccgtggtgcagctgagcatcctgatcaacaacatccccgacgagagccaggtggagaagctgaacgtgttcctgagcccccccgacgtgatcaactacctggccctgaccgaggccaccggcagaatctgcgtgagccagtgggagggcccccccagactgggctgcatcttctgccacggcgaccacctgctggccgtgaacgacctgaagccccagagcctggaggaggtgagcctgttcctgaccagaagcatccagaaggagaagctgaagctgaccatcggcagaatccccaacagcgagaccttccacgccgccagctgcatgtgccccagcaagtgccagagcgccgcccccagccagctggacaagcccagactgaacagagcccccaagagaagccccgccatcaagaagagccagcagaagggcgccagagagtag

SEQ ID NO: 18670 - DNA, 1398 bp, Artificial Sequence
  Description of Artificial Sequence: Synthetic coding sequence
atggccggcggcaagcagttcaccttcagctacgagaacgaggtgtgcaagcaggactacttcatcaagagcccccccagccagctgttcagcagcgtgaccagctggaagaagagattcttcatcctgagcaaggccggcgagaagagcttcagcctgagctactacaaggaccaccaccacagaggcagcatcgagatcgaccagaacagcagcgtggaggtgggcatcagcagccaggagaagatgcagagcgtgcagaagatgttcaagtgccaccccgacgaggtgatgagcatcagaaccaccaacagagagtacttcctgatcggccacgacagagagaagatcaaggactgggtgagcttcatgagcagcttcagacaggacatcaaggccacccagcagaacaccgaggaggagctgagcctgggcaacaagagaaccctgttctacagcagccccctgctgggccccagcagcaccagcgaggccgtgggcagcagcagccccagaaacggcctgcaggacaagcacctgatggagcagagcagccccggcttcagacagacccacctgcaggacctgagcgaggccacccaggacgtgaaggaggagaaccactacctgacccccagaagcgtgctgctggagctggacaacatcatcgccagcagcgacagcggcgagagcatcgagaccgacggccccgaccaggtgagcggcagaatcgagtgccactacgagcccatggagagctacttcttcaaggagaccagccacgagagcgtggacagcagcaaggaggagccccagaccctgcccgagacccaggacggcgacctgcacctgcaggagcagggcagcggcatcgactggtgcctgagccccgccgacgtggaggcccagaccaccaacgaccagaagggcaacatccccgacgagagccaggtggagaagctgaacgtgttcctgagcccccccgacgtgatcaactacctggccctgaccgaggccaccggcagaatctgcgtgagccagtgggagggcccccccagactgggctgcatcttctgccacggcgaccacctgctggccgtgaacgacctgaagccccagagcctggaggaggtgagcctgttcctgaccagaagcatccagaaggaggacagcttcagaatcctgagctaccaggtggccttcggcgagggcaccgagctgagagacagagcccccggcttcagaaccagcgacagacacgacgtggccaagagagcctgcatggagagcgactggtgcagagacagcaagaccgcccccagcaccaacctgtgcctgagcttcctgttctgcaagatcatgaccaacgacggcgccggctgctggatcatcaagtag

SEQ ID NO: 18671 - DNA, 1101 bp, Artificial Sequence
  Description of Artificial Sequence: Synthetic coding sequence
atgcagagcgtgcagaagatgttcaagtgccaccccgacgaggtgatgagcatcagaaccaccaacagagagtacttcctgatcggccacgacagagagaagatcaaggactgggtgagcttcatgagcagcttcagacaggacatcaaggccacccagcagaacaccgaggaggagctgagcctgggcaacaagagaaccctgttctacagcagccccctgctgggccccagcagcaccagcgaggccgtgggcagcagcagccccagaaacggcctgcaggacaagcacctgatggagcagagcagccccggcttcagacagacccacctgcaggacctgagcgaggccacccaggacgtgaaggaggagaaccactacctgacccccagaagcgtgctgctggagctggacaacatcatcgccagcagcgacagcggcgagagcatcgagaccgacggccccgaccaggtgagcggcagaatcgagtgccactacgagcccatggagagctacttcttcaaggagaccagccacgagagcgtggacagcagcaaggaggagccccagaccctgcccgagacccaggacggcgacctgcacctgcaggagcagggcagcggcatcgactggtgcctgagccccgccgacgtggaggcccagaccaccaacgaccagaagggcaacatccccgacgagagccaggtggagaagctgaacgtgttcctgagcccccccgacgtgatcaactacctggccctgaccgaggccaccggcagaatctgcgtgagccagtgggagggcccccccagactgggctgcatcttctgccacggcgaccacctgctggccgtgaacgacctgaagccccagagcctggaggaggtgagcctgttcctgaccagaagcatccagaaggagaagctgaagctgaccatcggcagaatccccaacagcgagaccttccacgccgccagctgcatgtgccccagcaagtgccagagcgccgcccccagccagctggacaagcccagactgaacagagcccccaagagaagccccgccatcaagaagagccagcagaagggcgccagagagtag

SEQ ID NO: 18672 - DNA, 591 bp, Artificial Sequence
  Description of Artificial Sequence: Synthetic coding sequence
tgacaggagcagggcagcggcatcgactggtgcctgagccccgccgacgtggaggcccagaccaccaacgaccagaagggcagcgccagcctgaccgtggtgcagctgagcatcctgatcaacaacatccccgacgagagccaggtggagaagctgaacgtgttcctgagcccccccgacgtgatcaactacctggccctgaccgaggccaccggcagaatctgcgtgagccagtgggagggcccccccagactgggctgcatcttctgccacggcgaccacctgctggccgtgaacgacctgaagccccagagcctggaggaggtgagcctgttcctgaccagaagcatccagaaggaggacagcttcagaatcctgagctaccaggtggccttcggcgagggcaccgagctgagagacagagcccccggcttcagaaccagcgacagacacgacgtggccaagagagcctgcatggagagcgactggtgcagagacagcaagaccgcccccagcaccaacctgtgcctgagcttcctgttctgcaagatcatgaccaacgacggcgccggctgctggatcatcaagtag

SEQ ID NO: 18673 - DNA, 465 bp, Artificial Sequence
  Description of Artificial Sequence: Synthetic coding sequence
atggagcccagcaagaccttcatgagaaacctgcccatcacccccggctacagcggcttcgtgcccttcctgagctgccagggcatgagcaaggaggacgacatgaaccactgcgtgaagaccttccaggagaagacccagagatacaaggagcagctgagagagctgtgctgcgccgtggccaccgcccccaagctgaagcccgtgaacagcgaggagaccgtgctgcaggccctgcaccagtacaacctgcagtaccaccccctgatcctggagtgcaagtacgtgaagaagcccctgcaggagccccccatccccggctgggccggctacctgcccagagccaaggtgaccgagttcggctgcggcaccagatacaccgtgatggccaagaactgctacaaggacttcctggagatcaccgagagagccaagaaggcccacctgaagccctacgaggagtag

SEQ ID NO: 18674 - DNA, 693 bp, Artificial Sequence
  Description of Artificial Sequence: Synthetic coding sequence
atggagcccagcaagaccttcatgagaaacctgcccatcacccccggctacagcggcttcgtgcccttcctgagctgccagggcatgagcaaggaggacgacatgaaccactgcgtgaagaccttccaggagaagacccagagatacaaggagcagctgagagagctgtgctgcgccgtggccaccgcccccaagctgaagcccgtgaacagcgaggagaccgtgctgcaggccctgcaccagtacaacctgcagtaccaccccctgatcctggagtgcaagtacgtgaagaagcccctgcaggagccccccatccccggctgggccggctacctgcccagagccaaggtgaccgagttcggctgcggcaccagatacaccgtgatggccaagaactgctacaaggacttcctggagatcaccgagagagccaagaaggcccacctgaagccctacgaggagatctacggcgtgagcagcaccaagaccagcgcccccagccccaaggtgctgcagcacgaggagctgctgcccaagtaccccgacttcagcatccccgacggcagctgccccgccctgggcagacccctgagagaggaccccaagacccccctgacctgcggctgcgcccagagacccagcatcccctgcagcggcaagatgtacctggagcccctgagcagcgccaagtag

SEQ ID NO: 18675 - DNA, 387 bp, Artificial Sequence
  Description of Artificial Sequence: Synthetic coding sequence
atggcctggagagtgcccggcgtgagacccgccagcaccttcttcccccaggtgctgagagccagcagcgagctgcccaacagactgcccgagggcagcaccgtgggccccaagcccgacagcagctgggaggccggcagccagggcaactggggcctgaccagcagcggcgccggccaggacagcagcgcccagaagctgggcatcctgagcgtgcagatcagcctgaagatctggacctgggagaagcccagcggctggggccacctgcacgccgccgtgaccggcgccagctgctgcagccccctgagccagggcggcgccatctgcctggtgaccgccccccaggacaagcccgactgcagcccctgcaccagcggccactag

SEQ ID NO: 18676 - DNA, 1338 bp, Artificial Sequence
  Description of Artificial Sequence: Synthetic coding sequence
atggagaccagaaccgaggacggcggcctgaccagaagacccaccctggccagcagctgggacgtggccggcggcgccctgacccacagcctgctgctgaccagagccggcctgggccccggcgacttcgactgggaggagctgctggccccccccgcccccggccaggacctggtgatcctgaagagaaaccacaacaacaaggacgagaacccctgcttcctgtacctgagatgcggccccgacggcggcgaggagatcgccagcatcggcatcctgagcagcgccagaaacatggaggtgtacctgggcgaggagtactgcggcaccagcagaggcaagaacgtgtgcaccgtgctggacgacagcgagcacgagaagatcatcctgtacaagaagaacctgaagctggagagcagcacccacgcctgcaagatcaagctgctgagcttcggcgagagacagtgcgtgttcatcagcaaggtggtggtgcacatgagaagcgtgttcgccaacagcagcaccagcagccccgccctgggcagcagaatcgacctggacaaggtgcagaccatcatggagagcatgggcagcaagctgagccccggcgcccagcagctgatggacatggtgagatgccagcagagaaactgcatccccatcggcgagcagctgcagagcgtgctgggcaacagcggctacaagcacatgatcggcctgcagagcagcagcaccctgggcaccctgaacaagagcagcagcacccccttccccttcagaaccggcctgaccagcggcaacgtgaccgagaacctgcagacctacatcgacaagagcacccagctgcccggcggcgagaacagcaccaagctggacgagtgcaaggtgatgccccagaaccacagcttcctggagaacgacctgaagaacgccatggccagcttcctgcccaagaaggtgagcgacaacagcaacatccccaacagcgagctgctgcccttcctgcagaacctgtgcagccaggtgaaccacctgcacgtgggcaacaagaccgagtgccaggagaacatcaccaagcacggcgagagaatcctgggcgtgggcatggaggagcagagcatctgcagctacctggagaagatcctgagcaagaacatggagctgatggagaagaagctgatggactacatcgaccagagaatccacgagctgcaggagcacatcgacgacaagatcgccctgctgctggacctgctgcagaaccccaacagcccccccaccggcatccccctgagacactacgacagcggcgagagactgagcaacggcgagagatag

SEQ ID NO: 18677 - DNA, 438 bp, Artificial Sequence
  Description of Artificial Sequence: Synthetic coding sequence
atgtggagcttcctgcccggcgccgagagcgtgagcatgggccccgtgcccggcgtgagcagcctgggcgcctgctggacccacgaccaggacagcggcagagccgaggacagaccccaggcccccagaatcacccagtacacctgggtgctgagcttcctgttcaccgagaagccccagaccagaagcaccagccccatcagccaccagggccagccccagaccaccagagccctgagcctgagacagccccagcaccccagcgcccccgccagcggcagacccagacccccccacagcagcggccccgacctggccgaggccgcccccgtggtggaccaggccagccaggccgccggcagagccagcagcggcctgggcctgtgggagcaggccagcgtgagccagggcttcagaaacgccgccttcgaggcctag

SEQ ID NO: 18678 - DNA, 438 bp, Artificial Sequence; identical to SEQ ID NO: 18677
  Description of Artificial Sequence: Synthetic coding sequence

SEQ ID NO: 18679 - DNA, 774 bp, Artificial Sequence
  Description of Artificial Sequence: Synthetic coding sequence
atggagagaagcaacgccgccaccaagtgcggcgaggagcccagaagcggcagcagaagactgcccaaggccgagggcgacaagagcggcagcgccggcgcccccagcaagaacagcagcagactgggcggcagaccctgcatgtgcaccgccggcagaagacccaacagagccagcggcagaagaagaagaagctgcagccccgcccccacctggccccccctgtgctgctacccccagagcagacccaccgccagcgccgccggccccggcgcctgcatgagagccagcggcagaccccacggcaacaccaccgccagcaccgccccccccagacaccccagacccagaagacccggcggccccgccctgagacccacccccagaccctgcgccggccccgcccccccccccgccagcagagactgcagatgcagaagacccagaagatggcccagagccggcagaagaggcagaagagccggcgcctgcaagcccagctgcgccggcgccgcctggagcgccagaggcgcccccctgtgcagctacagaaccagctgcgccggcagctgcggcgccagaaccgcccccacccccgcccccacctgcgccagccccagcgccgccgccagcagctgctgcagaagaagaagagcctgcagcagccccaccaccgcctggagcggcgcctgcggcgccggccccaccgccgccaccgccgcccagcccggcaagcccagaagcgccgccgcccccggcagagccagagcctag

SEQ ID NO: 18680 - DNA, 777 bp, Artificial Sequence
  Description of Artificial Sequence: Synthetic coding sequence
atgagcctggagagcctgttccagcacatcatcttcaccgagcaccaggccgaggagagcagaagactgatgagagaggtgagaagcgagatcaccagatgcagagagaagatcaagaaggccaccgaggagctgaacgaggagaagatcaagctggagagcaaggtgcagcagttcttcgagaagagcttcttcctgcagctgctgaaggcccacgagaacgccctggagaagcagtacagcgagatcaccaaccacagaaacatgctgctgcagaccttcgaggccatcaagaagcagatgatcgaggaggaggacaagttcatcaaggagatcaccgacttcaacaacgactacgagatcaccaagaagagagagctgctgatgaaggagaacgtgaagatcgagatcagcgacctggagaaccaggccaacatgctgaagagcgagatgaagagcatggagcacgacagcagccagctgaacgagctgcagaagcagaagagcgagctgatccaggagctgttcaccctgcagagaaagctgaaggtgttcgaggacgaggagaacgagagcatctgcaccaccaagtacctggaggccgagaagatcaagatcagcgagaagccccagaacgacaccgagtgcctgagactgaagaaggagctggagctgtacaaggaggacgacatggagagcgtgtacgaggccctgcagaccgagatcgagttcctggagctgaccctggcccagaaggacctgcaggagagcaagtag

SEQ ID NO: 18681 - DNA, 543 bp, Artificial Sequence
  Description of Artificial Sequence: Synthetic coding sequence
atgagcctggagagcctgttccagcacatcatcttcaccgagcaccaggccgaggagagcagaagactgatgagagaggtgagaagcgagatcaccagatgcagagagaagatcaagaaggccaccgaggagctgaacgaggagaagatcaagctggagagcaaggtgcagcagttcttcgagaagagcttcttcctgcagctgctgaaggcccacgagaacgccctggagaagcagtacagcgagatcaccaaccacagaaacatgctgctgcagaccttcgaggccatcaagaagcagatgatcgaggaggaggacaagttcatcaaggagatcaccgacttcaacaacgactacgagatcaccaagaagagagagctgctgatgaaggagaacgtgaagatcgagatcagcgacctggagaaccaggccaacatgctgaagagcgacagactgaagaaggagctggagctgtacaaggaggacgacatggagagcgtgtacgaggccctgcagaccgagatcgagttcctggagctgtag

SEQ ID NO: 18682 - DNA, 1404 bp, Artificial Sequence
  Description of Artificial Sequence: Synthetic coding sequence
atggagagcagcaccggccccagaatgcccctgctgaagtactgcagcgtggccaccagcctgaaggcccccggctgggacggcgccgcccccccctgggacctgagcttcacctaccccttcgccctgcaggccccctggctgaccggccacaagcccctggccagacacgccagcagctgcccctgcctgcacgtggccgaccccgcctggcagggccccggctggctgggcagagccggcgacgccgccaacacctgggtgctggccagaagagaggccgacggcttctactacagagcccagatcaaggccacccccgagctggagagacagggcgtgctgctggtggagttcgaggcccccctggtggccggccccaagctgcccgcccagcagcagagagtggtgctggaggaggacgtgatccccctgagccccagcgtgggctacagcctgagacccggcgacaaggtgctggccctgtgggagcccggccagcagcagtacggccccggcaccgtgctgctgggcctggagatgagagacccccagagagccagcaaggagaaggagatcaccgtgcacttctggaacggcaaggccgccaaggtgcccctgggcggcgtgcagagcgtgagcctgaccatctggaagaaggccgtggagagactgcacaagagcttcaccagagagcaccccagacccctgcactgggccccctgctgcagcctgctgggccccatcaccggcagaatcaccaacgagctgccccccgacgcccccttcctgtgccccctgtgccaccaccacgcctgctgccagctgctgtgccagggctgcctgtgcggctgccccccctgcggcaccacctggtggcccctgaccagaaccagcgaggtgatggccagagagctgcccgagctggagcccaccgcccagctgctgcccctggagggccccaaggaggagaaggtggccatgcacgcccccctggccgtgagcagcagcagcagcagcagctgcgagcaggacggcgtggagaacgacctggagatgggccccccccagagactgatggtgaacagcgccgtgaacaccgaccccatcttcctggagatgcccctgagacagagcggcctgtgccagcccgagtggagatactggaagagaaacggccccgagccctgcctgggcaagcccggcaccagatacagcaacatctgcaaggaggagaaggaccacaagcagcagagagcccagaccgccgtggtgggcaccaccaaggagctggtgagcaaggccacccacatgaagccccccagaaccccccccggcgaggccgagcacagaaagagaagccagagcctggccatctgccagtggaacaagaacagcagatag

SEQ ID NO: 18683 - DNA, 1215 bp, Artificial Sequence
  Description of Artificial Sequence: Synthetic coding sequence
atggagagcagcaccggccccagaatgcccctgctgaagtactgcagcgtggccaccagcctgaaggcccccggctgggacggcgccgcccccccctgggacctgagcttcacctaccccttcgccctgcaggccccctggctgaccggccacaagcccctggccagacacgccagcagctgcccctgcctgcacgtggccgaccccgcctggcagggccccggctggctgggcagagccggcgacgccgccaacacctgggtgctggccagaagagaggccgacggcttctactacagagcccagatcaaggccacccccgagctggagagacagggcgtgctgctggtggagttcgaggcccccctggtggccggccccaagctgcccgcccagcagcagagagtggtgctggaggaggacgtgatccccctgagccccagcgtgggctacagcctgagacccggcgacaaggtgctggccctgtgggagcccggccagcagcagtacggccccggcaccgtgctgctgggcctggagatgagagacccccagagagccagcaaggagaaggagatcaccgtgcacttctggaacggcaaggccgccaaggtgcccctgggcggcgtgcagagcgtgagcctgaccatctggaagaaggccgtggagagactgcacaagagcttcaccagagagcaccccagacccctgcactgggccccctgctgcagcctgctgggccccatcaccggcagaatcaccaacgagctgccccccgacgcccccttcctgtgccccctgtgccaccaccacgcctgctgccagctgctgtgccagggctgcctgtgcggctgccccccctgcggcaccacctggtggcccctgaccagaaccagcgaggtgatggccagagagctgcccgagctggagcccaccgcccagctgctgcccctggagggccccaaggaggagaaggtggccatgcacgcccccctggccgtgagcagcagcagcagcagcagctgcgagcaggacggcgtggagaacgacctggagatgggccccccccagagactgatggtgaacagcgccgtgaacaccgaccccatcttcctggagatgcccctgagacagagcggcctgtgccagcccgagtggagatactggaagagaaacggccccgagccctgcctgggcaagcccggcaaggagtag

SEQ ID NO: 18684 - DNA, 369 bp, Artificial Sequence
  Description of Artificial Sequence: Synthetic coding sequence
  Description of Combined DNA/RNA Molecule: Synthetic coding sequence
atggcccccagaggcagaaagagaaaggccgaggccgccgtggtggccgtggccgagaagagagagaagctggccaacggcggcgagggcatggaggaggccaccgtggtgatcgagcactgcaccagcugaagagtgtacggcagaaacgccgccgccctgagccaggccctgagactggaggcccccgagctgcccgtgaaggtgaaccccaccaagcccagaagaggcagcttcgaggtgaccctgctgagacccgacggcagcagcgccgagctgtggaccggcatcaagaagggcccccccagaaagctgaagttccccgagccccaggaggtggtggaggagctgaagaagtacctgagctag

SEQ ID NO: 18685 - DNA, 285 bp, Artificial Sequence
  Description of Artificial Sequence: Synthetic coding sequence
  Description of Combined DNA/RNA Molecule: Synthetic coding sequence
tgaggcatggaggaggccaccgtggtgatcgagcactgcaccagcugaagagtgtacggcagaaacgccgccgccctgagccaggccctgagactggaggcccccgagctgcccgtgaaggtgaaccccaccaagcccagaagaggcagcttcgaggtgaccctgctgagacccgacggcagcagcgccgagctgtggaccggcatcaagaagggcccccccagaaagctgaagttccccgagccccaggaggtggtggaggagctgaagaagtacctgagctag

SEQ ID NO: 18686 - DNA, 369 bp, Artificial Sequence; identical to SEQ ID NO: 18684
  Description of Artificial Sequence: Synthetic coding sequence
  Description of Combined DNA/RNA Molecule: Synthetic coding sequence

SEQ ID NO: 18687 - DNA, 1905 bp, Artificial Sequence
  Description of Artificial Sequence: Synthetic coding sequence
atgagatggctgagacccgccggcagaagaagagagcaggagagcgtgagcggccacctgggcccccccgccggcgcccccgccgcccccgagacccccacctgcctgcccgacaccaccccccaccccgcccccgtggtgtgcagcgccgacccccagctggccctggagagcctggaccccagaaccctgagactgctgtggagacagagagagctggagatccaggccctgagatgggccatccagaacggcgaggacgccagactgtgccacatcctggaggaggtggccggcctgccccccaagagaagcagccacagccaggagaagctgctgcagaaccaggtgcagaagctgatccaggagctgaaggagcagaaggagagagcccagtgggagaaggagcacctggaggagagactgctgcagaccaccagaaccctgcaggagatggaggccgagctgcagaacctgcagaagagctgcctgctgcagctggccagaagcagctgggtgggcagaatgctgagaagccagaccggcagcgtggaggtggtgaccgccgagaccctgatggaccccagcgacctgagcgagaacatccaggcccccaccggcgagggcttcagactggaggacgtggactggaacagcgtggccagaagataccccaacctgttcaccaacatggagcccagcagcaagcagaagcagcccagaccctggccccagctggacaccggcagccccgagagcagcggcaagcacagcgagagacaccacaagaccgtggagtggggcagcctgccctgcctgaacaccagcagcagcggcggcgccgacagcgacagcagcagctgcagacccggcctgcccagcttcgtgcaggtgatcggccacccccccagagaccacagagccagcagcgagcaggccctggtgcaggccggcagctacagcagagacagcgaggacctgcagaagacccacagccccagacacggcgagcccgtgctgagcccccagccctgcaccgaccccgaccactggagccccgagctgctgcagagccccaccggcctgaagatcgtggccgtgagctgcagagagaagttcgtgagaatcttcaaccccagccaggagagcaccgccgacctgagcggcatggtgctgaagcagctggtgagaggcttccccgagagactgtacagattcccccccggcaccctgctggcccccagacaccacgtgaccgtgtggggcgaggccaccagaagcgccaagaagcccctgagagccagcagcagcagagagcccgtgcccctgctgagcatcagaggctgcgccaccctgctgctgagccccaagggcgaggtgctgagcgagcacagaatccccagaagagagacccccgcccccagagtgttcgccgacggcaccgacctgagcatcgacagattccccctgcccgaggccggccccggcgccgacaccagaaagccccccagaccccccagacccctgagaaagggcagagtgagagagcccagagtgagcagaagaagacccggcaccagaggcctgctgccccccgtgagcagcggcaagctgttccacgccagagagggccccgccagacccgagaaccccgagatccccgccccccagcacctgcccgccatccccggcgaccccaccctgcccagcccccccgccgaggccggcctgggcctggaggactgcagactgcagaaggagcacagagtgagagtgtgcagaaagagcgtggacagaagctgccccctggtggccctgagcgtgcagaacaccgccgagagcagattcggcttcagattcctgagctgcctgcccgtgaccgccgacacctgcagaggcgcctag

SEQ ID NO: 18688 - DNA, 477 bp, Artificial Sequence
  Description of Artificial Sequence: Synthetic coding sequence
atggacctggccagcgagatcaccagcgccacccagaccagcagcctgtgcagcagcggcagaggccacgccggctaccccgcccccggcatcgtggcccacggcttcgagacccacggcaccgccagagtggcccagggccacctgctgcccccctgcctgctgccccccccccagatgcccgtgctggccgccctgagagacctgagcagaagaggcagcaccagcagcagcagaagccccagcagacccgtgagcaccagcgccagcaagccctgcctgcccgccagctgcctgggcgagacctggagcatcagcatcaacctggtgggcagcagcggccacctgcagagccccggcgcccagagagacgcccagagagagaccggctgcctgggccccagctggctgccccaccaccagggcagagacgaggagctgagcctgagccacagcgcccagggcgaggagttctag

SEQ ID NO: 18689 - DNA, 477 bp, Artificial Sequence; identical to SEQ ID NO: 18688
  Description of Artificial Sequence: Synthetic coding sequence

SEQ ID NO: 18690 - DNA, 87 bp, Artificial Sequence
  Description of Artificial Sequence: Synthetic coding sequence
atggacctggccagcgagatcaccagcgccacccagaccagcagcctgtgcagcagcggcagaggccacgccggctaccccgcctag

SEQ ID NO: 18691 - DNA, 477 bp, Artificial Sequence; identical to SEQ ID NO: 18688
  Description of Artificial Sequence: Synthetic coding sequence

SEQ ID NO: 18692 - DNA, 423 bp, Artificial Sequence
  Description of Artificial Sequence: Synthetic coding sequence
atgaagggccaggagggcatcagaggcgagggctgcaccgaccccgagatcaaggccagcccccagatgtgggccgccagattcagaggcatgagaagcagattcagccccctgttcagccaggccaccgagatgggccccagagtgagcgccggctggtgcctgagcggcggcggcagaaaggtgagcagcctgcagggcgacttcccccccggcggcttctgggccctgagcaacgacagcgccctgagcctgccccccctgagcctgccccacccccaccccctgagaccccccggcctgggcgtgaacgagttcacccagggcctgcacccccccctgcaccccgccgccagcgtgttccagacctgcttctacagaaagccccactactgcagcaccctgagacccaccaccacctag

SEQ ID NO: 18693 - DNA, 654 bp, Artificial Sequence
  Description of Artificial Sequence: Synthetic coding sequence
atggccctggtgcaggccctggtgcccagagagagagagcccaagctgagcatcctgcagatggacagaggcgacccccagcacagcagccactggtgccccgagagagagaaggtgaagctgctgaccctgaagcccagagagaccagcaagaacatcctgatcaacttctacagagccttcaacctggacaaggacgtgttcatccaccaggccaaccaccccctgaccgtgcccagcagcgtggtgatgggcgacaacggccacaccctggccgaggacgacaagagaccctgcttcagagtgctgccctgctacctggagagagtgagcagcggcatcagcatcagctggatcagcgcccccctgcccgtgggcgccatgaagcaccagctgctgtgcgacctgatggacctgatcaccctgagcttctggctggccggccagtgcatgagcctgaaggccaccaacatgcagcactgcaagtgcagcatcgccaccagcgactgggccatcgagctggacagaaccgactacaagaccctgcccagcgagtacagcatcctggccctgctgcaggtgttcgccggcaagaactgcatggacagagtgctgctgcacgtggacgtgaactacctgaagagcctgccctag

SEQ ID NO: 18694 - DNA, 1002 bp, Artificial Sequence
  Description of Artificial Sequence: Synthetic coding sequence
atgctggtgggcacccccaacctgctgaccctggacgaggccgacgccacctggaccctgatcaaggacaaggtgatcgaggagcacttcggccccaacgccgtggccgtgcccttcctgagcgacgccgcctgctacgacctgctgggcgtgctggtgaagcagagcagacccgcccacaccagactggccctgcccggcagacagggcagaagagccctgaagcccgtgggccccctgcccagcctgctggagcaggccggcagcgagggcgccttcgcccactgcaccagagagtacagccccaacggcagagccgagagagcctacgaggagaccagaatgctggacggccagccctgcaagatcagactgcacatgggcgacctgagaaagaaggtggccttcctgctgctgccccccggccaggtgagcctgcagcagaccctgccctggctgagaagcacccacagcatctacgtgatctaccaggtgttcagctgcagctggctgcagctgggcctgaccagcaccgccagagagccccagctgctgagactgctgagaagcctgcccgtggccttcagctgcctgaagttcagcctgcagagcaagggcgtgctgggcccccagaagcccctgaccaaggaccccctgccccacggcgccaactgggtgagacccaacctgagcatcatgccccccctggcccccaccagcgcccccgccgacaccaccgaggccgccgacgtgcccccccccgtgcccgccccccccaccccccccccccaggagggccccgaggacaagcccaccagattcagctacaagggcagaaaccccttctggagaggcccccagatcctgagcgagaactggctgttcagccccagaagccccccccccggcgcccagggcggcggccccagagaccccgacggccacagcatgagcctgcccctgctgcagggcctgagcagcgagttcgacagcgacgactag

SEQ ID NO: 18695 - DNA, 792 bp, Artificial Sequence
  Description of Artificial Sequence: Synthetic coding sequence
atggccctggtgcccggcagaagcaaggaggacggcctgtggaccagaaacagccccggcagcagccagcaccccgagagccccagactgcccaaccccctgtgggacagaggcaagatcggcaaggtggagggccaccagcacatccaggacttcagccagaagagccacctgcccagcatcgtggtggagagcagcgaggtgaacgaggagagcggcgacctgcacctgccccacgaggagctgctgctgctgaccgacggcgaggaggaggacgccgaggccttcttccaggaccagagcgaggagcccggctgggcctggagcccccaggaccccagaagccccctgagaaccttcaacgccggcctgagctggggccaggaccaggacgaggaggacgcctgctggatcctggaggacaccgcctgcctggaggccaccaaccactgccccttctgggacagcaccggcagcagagtgtgcagaagcggcttcgtggagtacagccacctgctgccccccaacagcttcgagggcgccgaggaggaggccgtgcagacccccgccggcgtggagagcggcgccgccagcgaggcccccggcggcagaggctgcgacagacccagagccgaccacgccgcccccccccaggaggccggcgtgcagtgcacctgccagcactacaccgtgagagaggaggcccagaagaccccccccgccgaccccgcctgccccgagagagaggacagccacggcagcggcagccccttcaaggccagccaggactag

SEQ ID NO: 18696 - DNA, 870 bp, Artificial Sequence
  Description of Artificial Sequence: Synthetic coding sequence
atggccctggtgcccggcagaagcaaggaggacggcctgtggaccagaaacagccccggcagcagccagcaccccgagagccccagactgcccaaccccctgtgggacagaggcaagatcggcaaggtggagggccaccagcacatccaggtgagcaccagcagcgcctgcgtgtggcagctggcctacccccccgtgtggcccaacctgcccgccgtgcccatccaggacttcagccagaagagccacctgcccagcatcgtggtggagagcagcgaggtgaacgaggagagcggcgacctgcacctgccccacgaggagctgctgctgctgaccgacggcgaggaggaggacgccgaggccttcttccaggaccagagcgaggagcccggctgggcctggagcccccaggaccccagaagccccctgagaaccttcaacgccggcctgagctggggccaggaccaggacgaggaggacgcctgctggatcctggaggacaccgcctgcctggaggccaccaaccactgccccttctgggacagcaccggcagcagagtgtgcagaagcggcttcgtggagtacagccacctgctgccccccaacagcttcgagggcgccgaggaggaggccgtgcagacccccgccggcgtggagagcggcgccgccagcgaggcccccggcggcagaggctgcgacagacccagagccgaccacgccgcccccccccaggaggccggcgtgcagtgcacctgccagcactacaccgtgagagaggaggcccagaagaccccccccgccgaccccgcctgccccgagagagaggacagccacggcagcggcagccccttcaaggccagccaggactag

SEQ ID NO: 18697 - DNA, 249 bp, Artificial Sequence
  Description of Artificial Sequence: Synthetic coding sequence
atggccctggtgcccggcagaagcaaggaggacggcctgtggaccagaaacagccccggcagcagccagcaccccgagagccccagactgcccaaccccctgtgggacagaggcaagatcggcaaggtggagggccaccagcacatccaggacttcagccagaagagccacctgcccagcatcgtggtggagagcagcgaggtgaacgaggagagcggcgacctgcacctgccccacgaggagctgtag

SEQ ID NO: 18698 - DNA, 792 bp, Artificial Sequence; identical to SEQ ID NO: 18695
  Description of Artificial Sequence: Synthetic coding sequence

SEQ ID NO: 18699 - DNA, 996 bp, Artificial Sequence
  Description of Artificial Sequence: Synthetic coding sequence
atgctgagccccgagagactggccctgcccgactacgagtacctggcccagagacacgtgctgacctacatggaggacgccgtgtgccagctgctggagaacagagaggacatcagccagtacggcatcgccagattcttcaccgagtacttcaacagcgtgtgccagggcacccacatcctgttcagagagttcagcttcgtgcaggccaccccccacaacagagtgagcttcctgagagccttctggagatgcttcagaaccgtgggcaagaacggcgacctgctgaccatgaaggagtaccactgcctgctgcagctgctgtgccccgacttccccctggagctgacccagaaggccgccagaatcgtgctgatggacgacgccatggactgcctgatgagcttcagcgacttcctgttcgccttccagatccagttctactacagcgagttcctggacagcgtggccgccatctacgaggacctgctgagcggcaagaaccccaacaccgtgatcgtgcccaccagcagcagcggccagcacagacagagacccgccctgggcggcgccggcaccctggagggcgtggaggccagcctgttctaccagtgcctggagaacctgtgcgacagacacaagtacagctgccccccccccgccctggtgaaggaggccctgagcaacgtgcagagactgaccttctacggcttcctgatggccctgagcaagcacagaggcatcaaccaggccctgggcgccctgcccgacaagggcgacctgatgcacgaccccgccatggacgaggagctggagagactgctggcccaggtgcccggcctggtgaacagcgtgaccgccagccccgaggccagctgcctgcccagcagaaccccccccagagtgggcagcccctggagacccctgcaccacagcagaaaggtggacggcgagagcgacggcagcaccgaggagaccgacgagagcgagacctag

SEQ ID NO: 18700 - DNA, 1014 bp, Artificial Sequence
  Description of Artificial Sequence: Synthetic coding sequence
atgctgagccccgagagactggccctgcccgactacgagtacctggcccagagacacgtgctgacctacatggaggacgccgtgtgccagctgctggagaacagagaggacatcagccagtacggcatcgccagattcttcaccgagtacttcaacagcgtgtgccagggcacccacatcctgttcagagagttcagcttcgtgcaggccaccccccacaacagagtgagcttcctgagagccttctggagatgcttcagaaccgtgggcaagaacggcgacctgctgaccatgaaggagtaccactgcctgctgcagctgctgtgccccgacttccccctggagctgacccagaaggccgccagaatcgtgctgatggacgacgccatggactgcctgatgagcttcagcgacttcctgttcgccttccagatccagttctactacagcgagttcctggacagcgtggccgccatctacgaggacctgctgagcggcaagaaccccaacaccgtgatcgtgcccaccagcagcagcggccagcacagacagagacccgccctgggcggcgccggcaccctggagggcgtggaggccagcctgttctaccagtgcctggagaacctgtgcgacagacacaagtacagctgccccccccccgccctggtgaaggaggccctgagcaacgtgcagagactgaccttctacggcttcctgatggccctgagcaagcacagaggcatcaaccaggccctgggcgccctgcccgacaagggcgacctgatgcacgaccccgccatggacgaggagctggagagactgctgctgcccttcttcagactggcccaggtgcccggcctggtgaacagcgtgaccgccagccccgaggccagctgcctgcccagcagaaccccccccagagtgggcagcccctggagacccctgcaccacagcagaaaggtggacggcgagagcgacggcagcaccgaggagaccgacgagagcgagacctag

SEQ ID NO: 18701 - DNA, 825 bp, Artificial Sequence
  Description of Artificial Sequence: Synthetic coding sequence
atgctgagccccgagagactggccctgcccgactacgagtacctggcccagagacacgtgctgacctacatggaggacgccgtgtgccagctgctggagaacagagaggacatcagccagtacggcatcgccagattcttcaccgagtacttcaacagcgtgtgccagggcacccacatcctgttcagagagttcagcttcgtgcaggccaccccccacaacagagtgagcttcctgagagccttctggagatgcttcagaaccgtgggcaagaacggcgacctgctgaccatgaaggagtaccactgcctgctgcagctgctgtgccccgacttccccctggagctgacccagaaggccgccagaatcgtgctgatggacgacgccatggactgcctgatgagcttcagcgacttcctgttcgccttccagatccagttctactacagcgagttcctggacagcgtggccgccatctacgaggacctgctgagcggcaagaaccccaacaccgtgatcgtgcccaccagcagcagcggccagcacagacagagacccgccctgggcggcgccggcaccctggagggcgtggaggccagcctgttctaccagtgcctggagaacctgtgcgacagacacaagtacagctgccccccccccgccctggtgaaggaggccctgagcaacgtgcagagactgaccttctacggcttcctgatggccctgagcaagcacagaggcatcaaccaggccctgggcgccctgcccgacaagggcgacctgatgcacgaccccgccatggacgaggagctggagagactgtag

SEQ ID NO: 18702 - DNA, 705 bp, Artificial Sequence
  Description of Artificial Sequence: Synthetic coding sequence
atgaaggagtaccactgcctgctgcagctgctgtgccccgacttccccctggagctgacccagaaggccgccagaatcgtgctgatggacgacgccatggactgcctgatgagcttcagcgacttcctgttcgccttccagatccagttctactacagcgagttcctggacagcgtggccgccatctacgaggacctgctgagcggcaagaaccccaacaccgtgatcgtgcccaccagcagcagcggccagcacagacagagacccgccctgggcggcgccggcaccctggagggcgtggaggccagcctgttctaccagtgcctggagaacctgtgcgacagacacaagtacagctgccccccccccgccctggtgaaggaggccctgagcaacgtgcagagactgaccttctacggcttcctgatggccctgagcaagcacagaggcatcaaccaggccctgggcgccctgcccgacaagggcgacctgatgcacgaccccgccatggacgaggagctggagagactgctggcccaggtgcccggcctggtgaacagcgtgaccgccagccccgaggccagctgcctgcccagcagaaccccccccagagtgggcagcccctggagacccctgcaccacagcagaaaggtggacggcgagagcgacggcagcaccgaggagaccgacgagagcgagacctag

SEQ ID NO: 18703 - DNA, 744 bp, Artificial Sequence
  Description of Artificial Sequence: Synthetic coding sequence
atggagctgcccggcagcagcctgaacaacctgctgaccatgaaggagtaccactgcctgctgcagctgctgtgccccgacttccccctggagctgacccagaaggccgccagaatcgtgctgatggacgacgccatggactgcctgatgagcttcagcgacttcctgttcgccttccagatccagttctactacagcgagttcctggacagcgtggccgccatctacgaggacctgctgagcggcaagaaccccaacaccgtgatcgtgcccaccagcagcagcggccagcacagacagagacccgccctgggcggcgccggcaccctggagggcgtggaggccagcctgttctaccagtgcctggagaacctgtgcgacagacacaagtacagctgccccccccccgccctggtgaaggaggccctgagcaacgtgcagagactgaccttctacggcttcctgatggccctgagcaagcacagaggcatcaaccaggccctgggcgccctgcccgacaagggcgacctgatgcacgaccccgccatggacgaggagctggagagactgctggcccaggtgcccggcctggtgaacagcgtgaccgccagccccgaggccagctgcctgcccagcagaaccccccccagagtgggcagcccctggagacccctgcaccacagcagaaaggtggacggcgagagcgacggcagcaccgaggagaccgacgagagcgagacctag

SEQ ID NO: 18704 - DNA, 981 bp, Artificial Sequence
  Description of Artificial Sequence: Synthetic coding sequence
atgctgagccccgagagactggccctgcccgactacgagtacctggcccagagacacgtgctgacctacatggaggacgccgtgtgccagctgctggagaacagagaggacatcagccagtacggcatcgccagattcttcaccgagtacttcaacagcgtgtgccagggcacccacatcctgttcagagagttcagcttcgtgcaggccaccccccacaacagagtgagcttcctgagagccttctggagatgcttcagaaccgtgggcaagaacggcgacctgctgaccatgaaggagtaccactgcctgctgcagctgctgtgccccgacttccccctggagctgacccagaaggccgccagaatcgtgctgatggacgacgccatggactgcctgatgagcttcagcgacttcctgttcgccttccagatccagttctactacagcgagttcctggacagcgtggccgccatctacgaggacctgctgagcggcaagaaccccaacaccgtgatcgtgcccaccagcagcagcggccagcacagacagagacccgccctgggcggcgccggcaccctggagggcgtggaggccagcctgttctaccagtgcctggagaacctgtgcgacagacacaagtacagctgccccccccccgccctggtgaaggaggccctgagcaacgtgcagagactgaccttctacggcttcctgatggccctgagcaagcacagaggcatcaaccaggccctgggcgccctgcccgacaagggcgacctgatgcacgaccccgccatggacgaggagctggagagactggtggtgagaagcaagctgcacagaaccagcagacagcacagagccaaggagcccggcgccttcggcttccagagaagagagaagcaggaggccctggagagagtgagcagcgccagcgtgcccaccccctaccactacagatgggagcccagagagtag

SEQ ID NO: 18705 - DNA, 732 bp, Artificial Sequence
  Description of Artificial Sequence: Synthetic coding sequence
atggccgccagcagcatcagcagcccctggggcaagcacgtgttcaaggccatcctgatggtgctggtggccctgatcctgctgcacagcgccctggcccagagcagaagagacttcgccccccccggccagcagaagagagaggcccccgtggacgtgctgacccagatcggcagaagcgtgagaggcaccctggacgcctggatcggccccgagaccatgcacctggtgagcgagagcagcagccaggtgctgtgggccatcagcagcgccatcagcgtggccttcttcgccctgagcggcatcgccgcccagctgctgaacgccctgggcctggccggcgactacctggcccagggcctgaagctgagccccggccaggtgcagaccttcctgctgtggggcgccggcgccctggtggtgtactggctgctgagcctgctgctgggcctggtgctggccctgctgggcagaatcctgtggggcctgaagctggtgatcttcctggccggcttcgtggccctgatgagaagcgtgcccgaccccagcaccagagccctgctgctgctggccctgctgatcctgtacgccctgctgagcagactgaccggcagcagagccagcggcgcccagctggaggccaaggtgagaggcctggagagacaggtggaggagctgagatggagacagagaagagccgccaagggcgccagaagcgtggaggaggagtag

SEQ ID NO: 18706 - DNA, 366 bp, Artificial Sequence
  Description of Artificial Sequence: Synthetic coding sequence
atgagcaccctgttccccagcctgttccccagagtgaccgagaccctgtggttcaacctggacagaccctgcgtggaggagaccgagctgcagcagcaggagcagcagcaccaggcctggctgcagagcatcgccgagaaggacaacaacctggtgcccatcggcaagcccgccagcgagcactacgacgacgaggaggaggaggacgacgaggacgacgaggacagcgaggaggacagcgaggacgacgaggacatgcaggacatggacgagatgaacgactacaacgagagccccgacgacggcgaggtgaacgaggtggacatggagggcaacgagcaggaccaggaccagtggatgatctag

SEQ ID NO: 18707 - DNA, 366 bp, Artificial Sequence; identical to SEQ ID NO: 18706
  Description of Artificial Sequence: Synthetic coding sequence

SEQ ID NO: 18708 - DNA, 366 bp, Artificial Sequence; identical to SEQ ID NO: 18706
  Description of Artificial Sequence: Synthetic coding sequence

SEQ ID NO: 18709 - DNA, 366 bp, Artificial Sequence; identical to SEQ ID NO: 18706
  Description of Artificial Sequence: Synthetic coding sequence

SEQ ID NO: 18710 - DNA, 138 bp, Artificial Sequence
  Description of Artificial Sequence: Synthetic coding sequence
atgagcaccctgttccccagcctgttccccagagtgaccgagaccctgtggttcaacctggacagaccctgcgtggaggagaccgagctgcagcagcaggagcagcagcaccaggcctggctgcagagcatcgcctag

SEQ ID NO: 18711 - DNA, 366 bp, Artificial Sequence; identical to SEQ ID NO: 18706
  Description of Artificial Sequence: Synthetic coding sequence

SEQ ID NO: 18712 - DNA, 198 bp, Artificial Sequence
  Description of Artificial Sequence: Synthetic coding sequence
atgagcaccctgttccccagcctgttccccagagtgaccgagaccctgtggttcaacctggacagaccctgcgtggaggagaccgagctgcagcagcaggagcagcagcaccaggcctggctgcagagcatcgccgagaaggacaacaacctggtgcccatcggcaagcccgccagcgagcactacgacgacgagtag

SEQ ID NO: 18713 - DNA, 366 bp, Artificial Sequence; identical to SEQ ID NO: 18706
  Description of Artificial Sequence: Synthetic coding sequence

SEQ ID NO: 18714 - DNA, 372 bp, Artificial Sequence
  Description of Artificial Sequence: Synthetic coding sequence
atgggcaacagagtgtgctgcggcggcagctggagctgccccagcaccttccagaagaagaagaagaccggcagccagaccagaagaaccctgaagccccagccccagcagctgcagcagaacctgcccaagggccacgagaccaccggccacacctacgagagagtgctgcagcagcagggcagccaggagagaagccccggcctgatgagcgaggacagcaacctgcactacgccgacatccaggtgtgcagcagaccccacgccagagaggtgaagcacgtgcacctggagaacgccaccgagtacgccaccctgagattcccccaggccacccccagatacgacagcaagaacggcaccctggtgtag

SEQ ID NO: 18715 - DNA, 135 bp, Artificial Sequence
  Description of Artificial Sequence: Synthetic coding sequence
atgggcaacagagtgtgctgcggcggcagctggagctgccccagcaccttccagaagaagaagaagaccggcagccagaccagaagaaccctgaagccccagccccagcagctgcagcagaacctgcccaagtag

SEQ ID NO: 18716 - DNA, 711 bp, Artificial Sequence
  Description of Artificial Sequence: Synthetic coding sequence
atgcccggcagccccgtgaccagcggctactacggcgtgagaagaagcttcctgagcgacagcgacttccacaacagcaagcagttcagcaacgacgtgtacaccagcagcgtgggcaagcccttcccctgcgagagcagcgccggccagagccacgccgccctgctggagccctacttcccccaggagccctacggcgactacagaccccccgccctgacccccaacgccggcagcctgttcagcgccagccccctgccccccctgctgcccccccccttccccggcgaccccgcccacttcctgttcagagacagctgggagcagaccctgcccgacggcctgagccagcccgaccccgtgagcgccgacgccctgctgaccctgccccccagcaccagctgcctgagccagctggagagcggcagcatcgcccagcacagaggcagcagctggggcagcagcctggccggcgcccagagctacagcctgcacgccctggaggacctgcaccacacccccggctaccccaccccccccccctaccccttcacccccttcatgaccgtgagcaacgacctgccccccaaggtgggccccctgagccccgacgaggaggccgacaccggcagcctgcacgaccccagcccctgggtgaaggaggacggcagcatcgcctggggcagctacgagtgcagaagagcctactag

SEQ ID NO: 18717 - DNA, 366 bp, Artificial Sequence
  Description of Artificial Sequence: Synthetic coding sequence
atgatgagaagcatcttcctgccccacagaaagctgatctgcagcagaagaggccacctggaccccagaggctgggaggaggacgagaagatcctggtgcccgacgccatccccaccctgcccccctacgtgttcatcagaaccgaccaggcctgcgtgaaggtgtaccccggcttcgtgctgatcagaaacggcaagacccacagacacagaggcgactgccacgaggaggaggtgtgcgcccacagaaccctggagaccggcggcatggcctgccacgtgggcccccacggcgagggccccagcctgtggggcttctggggcagctggaagcaggtgctgttcttcctgcccgtggaccactag

SEQ ID NO: 18718 - DNA, 879 bp, Artificial Sequence
  Description of Artificial Sequence: Synthetic coding sequence
atgagcagaatccccctgggcaaggtgctgctgagaaacgtgatcagacacaccgacgcccacaacaagatccaggaggagagcgacatgtggaagatcagagagctggagaagcagatggaggacgcctacagaggcaccaagagaaagatgctgcccagcagcagcagcagaatgagaagcgacggcttcgacgaggagagccagagatactactggagacccaagaacgagatcagcggcaccctggaggacgacttcctgaaggccaagagctggaacaagaagttctacgactacgaggccaacatgcccgacagatggggccacagcggctacaaggagctgtaccccgaggagttcgagaccgacagcgaccagcaggacatcaccaacggcaagaagaccagcccccaggtgaagagcagcacccacgagagcagaaagcacaagaagagcaagaagagccacaagaagaagcagaagaagagaagccacaagaagcagaagaagagcaagaaggaggccaccgacatcaccgccgacagcagcagcgagttcagcgaggagaccggcgccagcggcaccagaaagggcaagcagccccacaagagaaagaagaagagcagaaagaagagcctgaagaagcccgccctgttcctggaggccgagagcaacaccagccacagcgacgacagcgccagcagcagcagcgaggagagcgaggagagagacaccaagaagaccaagagaaagaagagagagaagaaggcccacaccagcgtggccaacaacgagatccaggagagaaccaacaagagaaccaactggaaggtggccaccgacgagagaagcgccgagagcagcgaggacgactag

SEQ ID NO: 18719 - DNA, 882 bp, Artificial Sequence
  Description of Artificial Sequence: Synthetic coding sequence
atgagcagaatccccctgggcaaggtgctgctgagaaacgtgatcagacacaccgacgcccacaacaagatccaggaggagagcgacatgtggaagatcagagagctggagaagcagatggaggacgcctacagaggcaccaagagaaagatgctgcccagcagcagcagcagaatgagaagcgacggcttcgacgaggagagccagagatactactggagacccaagaacgagatcagcggcaccctggaggacgacttcctgaaggccaagagctggaacaagaagttctacgactacgaggccaacatgcccgacagatggggccacagcggctacaaggagctgtaccccgaggagttcgagaccgacagcagcgaccagcaggacatcaccaacggcaagaagaccagcccccaggtgaagagcagcacccacgagagcagaaagcacaagaagagcaagaagagccacaagaagaagcagaagaagagaagccacaagaagcagaagaagagcaagaaggaggccaccgacatcaccgccgacagcagcagcgagttcagcgaggagaccggcgccagcggcaccagaaagggcaagcagccccacaagagaaagaagaagagcagaaagaagagcctgaagaagcccgccctgttcctggaggccgagagcaacaccagccacagcgacgacagcgccagcagcagcagcgaggagagcgaggagagagacaccaagaagaccaagagaaagaagagagagaagaaggcccacaccagcgtggccaacaacgagatccaggagagaaccaacaagagaaccaactggaaggtggccaccgacgagagaagcgccgagagcagcgaggacgactag

SEQ ID NO: 18720 - DNA, 444 bp, Artificial Sequence
  Description of Artificial Sequence: Synthetic coding sequence
atgaaccccgccaacaccagaagccagagaaaccccaccaagaagcagaagaagagaagccacaagaagcagaagaagagcaagaaggaggccaccgacatcaccgccgacagcagcagcgagttcagcgaggagaccggcgccagcggcaccagaaagggcaagcagccccacaagagaaagaagaagagcagaaagaagagcctgaagaagcccgccctgttcctggaggccgagagcaacaccagccacagcgacgacagcgccagcagcagcagcgaggagagcgaggagagagacaccaagaagaccaagagaaagaagagagagaagaaggcccacaccagcgtggccaacaacgagatccaggagagaaccaacaagagaaccaactggaaggtggccaccgacgagagaagcgccgagagcagcgaggacgactag

SEQ ID NO: 18721 - DNA, 879 bp, Artificial Sequence; identical to SEQ ID NO: 18718
  Description of Artificial Sequence: Synthetic coding sequence

SEQ ID NO: 18722 - DNA, 648 bp, Artificial Sequence
  Description of Artificial Sequence: Synthetic coding sequence
atgtggaagatcagagagctggagaagcagatggaggacgcctacagaggcaccaagagaaagatgctgcccagcagcagcagcagaatgagaagcgacggcttcgacgaggagagccagagatactactggagacccaagaacgagatcagcggcaccctggaggacgacttcctgaaggccaagagctggaacaagaagttctacgactacgaggccaacatgcccgacagatggggccacagcggctacaaggagctgtaccccgaggagttcgagaccgacagcagcgaccagcaggacatcaccaacggcaagaagaccagcccccaggtgaagagcagcacccacgagagcagaaagcacaagaagagcaagaagagccacaagaagaagcagaagaagagaagccacaagaagcagaagaagagcaagaaggaggccaccgacatcaccgccgacagcagcagcgagttcagcgaggagaccggcgccagcggcaccagaaagggcaagcagccccacaagagaaagaagaagagcagaaagaagagcctgaagaagcccgccctgttcctggaggccgagagcaacaccagccacagcgacgacagcgccagcagcagcagcgaggagagcgaggagtag

SEQ ID NO: 18723 - DNA, 276 bp, Artificial Sequence
  Description of Artificial Sequence: Synthetic coding sequence
atgagcagaatccccctgggcaaggtgctgctgagaaacgtgatcagacacaccgacgcccacaacaagatccaggaggagagcgacatgtggaagatcagagagctggagaagcagatggaggacgcctacagaggcaccaagagaaagatgctgcccagcagcagcagcagaatgagaagcgacggcttcgacgaggagagccagagatactactggagacccaagaacgagatcagcggcaccctggaggacgacttcctgaaggccaagtag

SEQ ID NO: 18724 - DNA, 795 bp, Artificial Sequence
  Description of Artificial Sequence: Synthetic coding sequence
atgtggaagatcagagagctggagaagcagatggaggacgcctacagaggcaccaagagaaagatgctgcccagcagcagcagcagaatgagaagcgacggcttcgacgaggagagccagagatactactggagacccaagaacgagatcagcggcaccctggaggacgacttcctgaaggccaagagctggaacaagaagttctacgactacgaggccaacatgcccgacagatggggccacagcggctacaaggagctgtaccccgaggagttcgagaccgacagcagcgaccagcaggacatcaccaacggcaagaagaccagcccccaggtgaagagcagcacccacgagagcagaaagcacaagaagagcaagaagagccacaagaagaagcagaagaagagaagccacaagaagcagaagaagagcaagaaggaggccaccgacatcaccgccgacagcagcagcgagttcagcgaggagaccggcgccagcggcaccagaaagggcaagcagccccacaagagaaagaagaagagcagaaagaagagcctgaagaagcccgccctgttcctggaggccgagagcaacaccagccacagcgacgacagcgccagcagcagcagcgaggagagcgaggagagagacaccaagaagaccaagagaaagaagagagagaagaaggcccacaccagcgtggccaacaacgagatccaggagagaaccaacaagagaaccaactggaaggtggccaccgacgagagaagcgccgagagcagcgaggacgactag

SEQ ID NO: 18725 - DNA, 879 bp, Artificial Sequence; identical to SEQ ID NO: 18718
  Description of Artificial Sequence: Synthetic coding sequence

SEQ ID NO: 18726 - DNA, 1167 bp, Artificial Sequence
  Description of Artificial Sequence: Synthetic coding sequence
atgaagaccctgatcgccgcctacagcggcgtgctgagaggcgagagacaggccgaggccgacagaagccagagaagccacggcggccccgccctgagcagagagggcagcggcagatggggcaccggcagcagcatcctgagcgccctgcaggacctgttcagcgtgacctggctgaacagaagcaaggtggagaagcagctgcaggtgatcagcgtgctgcagtgggtgctgagcttcctggtgctgggcgtggcctgcagcgccatcctgatgtacatcttctgcaccgactgctggctgatcgccgtgctgtacttcacctggctggtgttcgactggaacacccccaagaagggcggcagaagaagccagtgggtgagaaactgggccgtgtggagatacttcagagactacttccccatccagctggtgaagacccacaacctgctgaccaccagaaactacatcttcggctaccacccccacggcatcatgggcctgggcgccttctgcaacttcagcaccgaggccaccgaggtgagcaagaagttccccggcatcagaccctacctggccaccctggccggcaacttcagaatgcccgtgctgagagagtacctgatgagcggcggcatctgccccgtgagcagagacaccatcgactacctgctgagcaagaacggcagcggcaacgccatcatcatcgtggtgggcggcgccgccgagagcctgagcagcatgcccggcaagaacgccgtgaccctgagaaacagaaagggcttcgtgaagctggccctgagacacggcgccgacctggtgcccatctacagcttcggcgagaacgaggtgtacaagcaggtgatcttcgaggagggcagctggggcagatgggtgcagaagaagttccagaagtacatcggcttcgccccctgcatcttccacggcagaggcctgttcagcagcgacacctggggcctggtgccctacagcaagcccatcaccaccgtggtgggcgagcccatcaccatccccaagctggagcaccccacccagcaggacatcgacctgtaccacaccatgtacatggaggccctggtgaagctgttcgacaagcacaagaccaagttcggcctgcccgagaccgaggtgctggaggtgaactag

SEQ ID NO: 18727 - DNA, 420 bp, Artificial Sequence
  Description of Artificial Sequence: Synthetic coding sequence
atgggcgccggcaagaaggagcacaccggcagactggtgatcggcgaccacaagagcaccagccacttcagaaccggcgaggaggacaagaagatcaacgaggagctggagagccagtaccagcagagcatggacagcaagctgagcggcagatacagaagacactgcggcctgggcttcagcgaggtggaggaccacgacggcgagggcgacgtggccggcgacgacgacgacgacgacgacgacagccccgaccccgagagccccgacgacagcgagagcgacagcgagagcgagaaggaggagagcgccgaggagctgcaggccgccgagcaccccgacgaggtggaggaccccaagaacaagaaggacgccaagagcaactacaagatgatgttcgtgaagagcagcggcagctag

SEQ ID NO: 18728 - DNA, 1524 bp, Artificial Sequence
  Description of Artificial Sequence: Synthetic coding sequence
atggccgccccctgcggcagcgagctgcccgccaacagccccctgaagatccccaagatggaggtgctgagccccgccagccccggcggcctgagcgacggcaaccccagcctgagcgaccccagcacccccagaggcgccagccccctgggccccggcagcgccgccggcagcggcgccgccgccagcggcggcctgggcctgggcctgggcggcagaagcgccgccagcagcagcgtgagcttcagccccggcggcggcggcggcggcgccgccgccgccgccgccgccgcctgcagaggcatgagctggacccccgccgagaccaacgccctgatcgccgtgtggggcaacgagagactggtggaggccagataccagcagctggagggcgccggcaccgtgttcggcagcaaggcccccggccccgccatgtacgagagagtgagcagagccctggccgagctgggctacgagagaacccccagccagtgcagagagagaatcaaggagctggagagcgacggcagcaccatggaggactacagccaggaggactggggcaaccacagccaggacctgcacggctaccccaccgaccaggagctggacgagatccccgtgaccaagagaaccctgaagatcaagcaggagagcagcgaggaggcccagaagagagacatcatgcagaacatcgtgcagatcctggagagcgtgcagctgaagtgggagctgttccagagctggaccgacttcagcagactgcacctgagcaacaagctggccatcttcggcatcggctacaacaccagatggaaggaggacatcagataccactacgccgagatcagcagccaggtgcccctgggcaagagactgagagagtacttcaacagcgagaagcccgagggcagaatcatcatgaccagagtgcagaagatgaactggaagaacgtgtactacaagttcctggagatcaccatcagcgaggccagatgcctggagctgcacatggagatcgactggatccccatcgcccacagcaagcccaccggcggcaacgtggtgcagtacctgctgcccggcggcatccccaagagccccggcctgtacgccatcggctacgaggagtgcatcgagagacccctgagcccccacatggagcagagcagcctggaccccggcaaggagggcagagtggacctggagaccctgagcgcccaggccagcctgcaggtggagatcgagcccaccagaatcatctactgctacctgggcatcgccgaggtgagaaccctgcagcagtgcctgttcctgcacttccaggccaacaccaagaccttcagcaaggactgggtgggcatcaacggcttcctgagccagaactgcatcgtggaccccggcgtgagccccaagagcatctacatcaagttcgtggaggtggagagagacttcctgagcgccggcagcctggtggagtgcctggagaaggccatcggctaccccctgaagttcaacaactag

SEQ ID NO: 18729 - DNA, 1680 bp, Artificial Sequence
  Description of Artificial Sequence: Synthetic coding sequence
atggccgccccctgcggcagcgagctgcccgccaacagccccctgaagatccccaagatggaggtgctgagccccgccagccccggcggcctgagcgacggcaaccccagcctgagcgaccccagcacccccagaggcgccagccccctgggccccggcagcgccgccggcagcggcgccgccgccagcggcggcctgggcctgggcctgggcggcagaagcgccgccagcagcagcgtgagcttcagccccggcggcggcggcggcggcgccgccgccgccgccgccgccgcctgcagaggcatgagctggacccccgccgagaccaacgccctgatcgccgtgtggggcaacgagagactggtggaggccagataccagcagctggagggcgccggcaccgtgttcggcagcaaggcccccggccccgccatgtacgagagagtgagcagagccctggccgagctgggctacgagagaacccccagccagtgcagagagagaatcaagaccctgagaagatgctacagcagagtgaaggagcacggcgtgggcaagagaaagagcagctacaccttcgagcagctggagcaggtgttcggccagggcggctgggacgcccagccctgccagcccgtgctgatcaacagcagcggcctgtaccaggagctggagagcgacggcagcaccatggaggactacagccaggaggactggggcaaccacagccaggacctgcacggctaccccaccgaccaggagctggacgagatccccgtgaccaagagaaccctgaagatcaagcaggagagcagcgaggaggcccagaagagagacatcatgcagaacatcgtgcagatcctggagagcgtgcagctgaagtgggagctgttccagagctggaccgacttcagcagactgcacctgagcaacaagctggccatcttcggcatcggctacaacaccagatggaaggaggacatcagataccactacgccgagatcagcagccaggtgcccctgggcaagagactgagagagtacttcaacagcgagaagcccgagggcagaatcatcatgaccagagtgcagaagatgaactggaagaacgtgtactacaagttcctggagatcaccatcagcgaggccagatgcctggagctgcacatggagatcgactggatccccatcgcccacagcaagcccaccggcggcaacgtggtgcagtacctgctgcccggcggcatccccaagagccccggcctgtacgccatcggctacgaggagtgcatcgagagacccctgagcccccacatggagcagagcagcctggaccccggcaaggagggcagagtggacctggagaccctgagcgcccaggccagcctgcaggtggagatcgagcccaccagaatcatctactgctacctgggcatcgccgaggtgagaaccctgcagcagtgcctgttcctgcacttccaggccaacaccaagaccttcagcaaggactgggtgggcatcaacggcttcctgagccagaactgcatcgtggaccccggcgtgagccccaagagcatctacatcaagttcgtggaggtggagagagacttcctgagcgccggcagcctggtggagtgcctggagaaggccatcggctaccccctgaagttcaacaactag

SEQ ID NO: 18730 - DNA, 990 bp, Artificial Sequence
  Description of Artificial Sequence: Synthetic coding sequence
atggaggactacagccaggaggactggggcaaccacagccaggacctgcacggctaccccaccgaccaggagctggacgagatccccgtgaccaagagaaccctgaagatcaagcaggagagcagcgaggaggcccagaagagagacatcatgcagaacatcgtgcagatcctggagagcgtgcagctgaagtgggagctgttccagagctggaccgacttcagcagactgcacctgagcaacaagctggccatcttcggcatcggctacaacaccagatggaaggaggacatcagataccactacgccgagatcagcagccaggtgcccctgggcaagagactgagagagtacttcaacagcgagaagcccgagggcagaatcatcatgaccagagtgcagaagatgaactggaagaacgtgtactacaagttcctggagatcaccatcagcgaggccagatgcctggagctgcacatggagatcgactggatccccatcgcccacagcaagcccaccggcggcaacgtggtgcagtacctgctgcccggcggcatccccaagagccccggcctgtacgccatcggctacgaggagtgcatcgagagacccctgagcccccacatggagcagagcagcctggaccccggcaaggagggcagagtggacctggagaccctgagcgcccaggccagcctgcaggtggagatcgagcccaccagaatcatctactgctacctgggcatcgccgaggtgagaaccctgcagcagtgcctgttcctgcacttccaggccaacaccaagaccttcagcaaggactgggtgggcatcaacggcttcctgagccagaactgcatcgtggaccccggcgtgagccccaagagcatctacatcaagttcgtggaggtggagagagacttcctgagcgccggcagcctggtggagtgcctggagaaggccatcggctaccccctgaagttcaacaactag

SEQ ID NO: 18731 - DNA, 1182 bp, Artificial Sequence
  Description of Artificial Sequence: Synthetic coding sequence
atgtggtggagagtgctgagcctgctggcctggttccccctgcaggaggccagcctgaccaaccacaccgagaccatcaccgtggaggagggccagaccctgaccctgaagtgcgtgaccagcctgagaaagaacagcagcctgcagtggctgacccccagcggcttcaccatcttcctgaacgagtaccccgccctgaagaacagcaagtaccagctgctgcaccacagcgccaaccagctgagcatcaccgtgcccaacgtgaccctgcaggacgagggcgtgtacaagtgcctgcactacagcgacagcgtgagcaccaaggaggtgaaggtgatcgtgctggccacccccttcaagcccatcctggaggccagcgtgatcagaaagcagaacggcgaggagcacgtggtgctgatgtgcagcaccatgagaagcaagccccccccccagatcacctggctgctgggcaacagcatggaggtgagcggcggcaccctgcacgagttcgagaccgacggcaagaagtgcaacaccaccagcaccctgatcatccacacctacggcaagaacagcaccgtggactgcatcatcagacacagaggcctgcagggcagaaagctggtggcccccttcagattcgaggacctggtgaccgacgaggagaccgccagcgacgccctggagagaaacagcctgagcagccaggacccccagcagcccaccagcaccgtgagcgtgaccgaggacagcagcaccagcgagatcgacaaggaggagaaggagcagaccacccaggaccccgacctgaccaccgaggccaacccccagtacctgggcctggccagaaagaagagcggcatcctgctgctgaccctggtgagcttcctgatcttcatcctgttcatcatcgtgcagctgttcatcatgaagctgagaaaggcccacgtgatctggaagaaggagaacgaggtgagcgagcacaccctggagagctacagaagcagaagcaacaacgaggagaccagcagcgaggagaagaacggccagagcagccaccccatgagatgcatgaactacatcaccaagctgtacagcgaggccaagaccaagagaaaggagaacgtgcagcacagcaagctggaggagaagcacatccaggtgcccgagagcatcgtgtag

SEQ ID NO: 18732 - DNA, 924 bp, Artificial Sequence
  Description of Artificial Sequence: Synthetic coding sequence
atgagcaagagaaagctgatccccaagctgagcatccagagccccgtgctgcacaccaacctgaacgtgcagagcacccacccccccctgaagaaggaggacctgcacagaatcagcaaggacagcctggagagcgacagcgagagcctgacccaggagatcatgtgccacagcgagttcgacgacagaatcagaggcaacggcatggagcccgacagcctggacgaggaggagagccccagatggggcagcctgcacgagatggaggaggaggccagcggcaaggccgcccagatggccagagagcagaaccaccacacctgggaccagggcgccaacaacagacagcagcccatcgaggacaagtacagcgacctgagatacgaccccaactggaagagcaagaaggaggagggccagctgctgagcgtggaggccctgcccgagagcaccgacagcagcctggagaacctgcccctggcccccctgtaccccagccaggagaccagcatggagctgagcggcggcaagggcgagcagaaggagagcccccagagcgccgccagcctgctgggcagcgagttcctgagccccaactacgagcacggcgccagaagaagcaagcccttcagcgagctgagcgacagcgacctggaggagaagagcagcagcctgagcccctacgtgaagagcagcagcagccacaacgaggtgttcctgcccggcagcagaggccccagaagaagaaagagcaagcagcacttcgtggagaagaacaagctgaccctgggcctgcccacccccaagaccgacagctacctgcagctgcacaacaagaagagaggcgagagccaccccgagcaggtgatcctgagagtgaacagcctgcccagagacggcttcaagaccttctggagccagtag

SEQ ID NO: 18733 - DNA, 2337 bp, Artificial Sequence
  Description of Artificial Sequence: Synthetic coding sequence
atgagcaagagaaagctgatccccaagctgagcatccagagccccgtgctgcacaccaacctgaacgtgcagagcacccacccccccctgaagaaggaggacctgcacagaatcagcaaggacagcctggagagcgacagcgagagcctgacccaggagatcatgtgccacagcgagttcgacgacagaatcagaggcaacggcatggagcccgacagcctggacgaggaggagagccccagatggggcagcctgcacgagatggaggaggaggccagcggcaaggccgcccagatggccagagagcagaaccaccacacctgggaccagggcgccaacaacagacagcagcccatcgaggacaagtacagcgacctgagatacgaccccaactggaagagcaagaaggaggagggccagctgctgagcgtggaggccctgcccgagagcaccgacagcagcctggagaacctgcccctggcccccctgtaccccagccaggagaccagcatggagctgagcggcggcaagggcgagcagaaggagagcccccagagcgccgccagcctgctgggcagcgagttcctgagccccaactacgagcacggcgccagaagaagcaagcccttcagcgagctgagcgacagcgacctggaggagaagagcagcagcctgagcccctacgtgaagagcagcagcagccacaacgaggtgttcctgcccggcagcagaggccccagaagaagaaagagcaagcagcacttcgtggagaagaacaagctgaccctgggcctgcccacccccaagaccgacagctacctgcagctgcacaacaagaagagaggcgagagccaccccgagcagatcagctaccccgtgagagtgaccgacaagaccagcatccagaacgccaaggagatggagaacgccgccatcgaccccgaggacaagtggcaccagagagcccagcagctgaagaactaccaggagcactggagccagtacgagagcaccaagagcagcaacgtgcccagaggccagcccagcgacatggtgaacgaccaccagcccagcagaagacccgccaagctgaagatcagaaagcagtgcaagcaccagaacggcctgaagagcagcaccaccgaggaggtgaccgccagccagggcaaccagaacaacccccccagacagcagcagaaccagaacaagcccctggacaccagcaccaagcccgagagcatcgtgatcatgcacgccagcaacaacgacgtgcaggccagcagagccctgagaagccacaacctgaaggagaccagcaacaccttcgccccccccaagcaggccttcgacaaggtgctgagcaagaacagcaccggctgcgacagcggcctgaacgtgaacaaggagagaggccacaaggaccaggaggagaagagattcagctaccagcagctgcacaccctgagcgacatggacctgaacaacctgaacgagctgagcaagagacacgtgctgctgagccagaagggcagccagttcgtgtaccacatcaacacccacggcagcaccaagaacaagaagcagctgaagcagccctacaccgagaccaagtacagaaacctggagatgctgtggaagttccacagcagcagcgacagccagaccgtgagagccagccccgacagctggctgacccagatcatggagcagcaccagcaggccctggtgcagctgaccgacgtgcagcccagcgagggcgccctgagcagcgtgaccctgccccccatcctgagcagagtggagagcgagagccagctgagcagcgagagaagccagagaaaccaggtgaagatcagcagaagcaacagcgagggctacctgttccagctggagaagggcaagaagcacaagaagagaagcagcagcaagaacaccaagctgaagggctaccagaagagagacgtgaagctgggcggcctgggccccgacttcgagagcatcagagacaagacccagaagctgatccagcagaaggagtacgccaagcaggtgaaggagtacaacatgaagaccctgagcatcctgagcaagccccagaccgagaagacccagaagaagagcgccatccccagacagaaggccctggagtacgccaagaccatccccaagcccaagcccagcaacctgacccaccaggccagcaaggagcagaagaaccccacctacgccggcaaggaggagagcctgcccgagatcagcctgctggagatcctgcagaacagacacgagagagagaagcaggccgtggccgccttcaaggtgctgcacatcgtgtag

SEQ ID NO: 18734 - DNA, 942 bp, Artificial Sequence
  Description of Artificial Sequence: Synthetic coding sequence
atgccctggaaggaggagagcgagttcaccaagcaggacaaggccgccagagtgatccagcaggcctggaagagcttcctgaacgtggccatcttccagcacttcaagagcctgatcgacctgagaagacagggcgagcccagacagatcgtgaagtacatcaaccccaaggaggccgagctgctggacgccgccgccggcatccacgtgagattcagactgggcggcgtgaagttcccccccgacatctactacaagatcttcacccacagacccatcgaggacctgtgcgccaacagccccagaaactacgccaagctgcccgccaagcacaccagccacaacaagaacgaccacctgcaggaggaggaccacagcggctggtaccacagaatcgagaacaacggctggagacccgtgagcgacaccttctggctgagcaccgacggcatggtggtggaggacaagaaggagagcgagttccacttcagcaagctgaagagaagacaggacctggagaagaagagaaagctgagaaagatcgagtggatgagacagatgtactacagcggcagcctggaggccaagagcacccaccacgagaccctgggcctgatccacaccgccaccaagggcctgatcagagccttcgaggacggcggcatcgacagcgtgatggagtgggaggtggacgaggtgctgaactggaccaacaccctgaacttcgacgagtacatcgccagctggaaggagatcgccaccagcaacagcagcgccaacttcaagggcttcagattcaaccaggcccagaagaacatctacaactacggcggcgacatcagcaagatgcagatgggcatccccgacgacacctactacgagaacgtgtaccaggagcccaacgtgaccagactgacccccgacagcacctacggcctgtag

SEQ ID NO: 18735 - DNA, 942 bp, Artificial Sequence; identical to SEQ ID NO: 18734
  Description of Artificial Sequence: Synthetic coding sequence

SEQ ID NO: 18736 - DNA, 369 bp, Artificial Sequence
  Description of Artificial Sequence: Synthetic coding sequence
atgaccagccccgagatcgccagcctgagctggggccagatgaaggtgaagggcagcaacaccacctacaaggactgcaaggtgtggcccggcggcagcagaacctgggactggagagagaccggcaccgagcacagccccggcgtgcagcccgccgacgtgaaggaggtggtggagaagggcgtgcagaccctggtgatcggcagaggcatgagcgaggccctgaaggtgcccagcagcaccgtggagtacctgaagaagcacggcatcgacgtgagagtgctgcagaccgagcaggccgtgaaggagtacaacgccctggtggcccagggcgtgagagtgggcggcgtgttccacagcacctgctag

SEQ ID NO: 18737 - DNA, 369 bp, Artificial Sequence; identical to SEQ ID NO: 18736
  Description of Artificial Sequence: Synthetic coding sequence

SEQ ID NO: 18738 - DNA, 882 bp, Artificial Sequence
  Description of Artificial Sequence: Synthetic coding sequence
atggccgccgccgccgccgccgccgtggccggcgtgggcagaggcggcggcggcgccgagcccagacaggagagaagcagagccagaggctgggccggcgtggagagaagcgagggcagaagcagaatggagcccggcgaggagctggaggaggagggcagccccggcggcagagaggacggcttcaccgccgagcacctggccgccgaggccatggccgccgacatggacccctggctggtgttcgacgccagaaccacccccgccaccgagctggacgcctggctggccaagtacccccccagccaggtgaccagatacggcgaccccggcagccccaacagcgagcccgtgggctggatcgccgtgtacggccagggctacagccccaacagcggcgacgtgcagggcctgcaggccgcctgggaggccctgcagaccagcggcagacccatcacccccggcaccctgagacagctggccatcacccaccacgtgctgagcggcaagtggctgatgcacctggcccccggcttcaagctggaccacgcctgggccggcatcgccagagccgtggtggagggccagctgcaggtggccaaggtgagccccagagccaaggagggcggcagacaggtgatctgcgtgtacaccgacgacttcaccgacagactgggcgtgctggaggccgacagcgccatcagagccgccggcatcaagtgcctgctgacctacaagcccgacgtgtacacctacctgggcatctacagagccaacagatggcacctgtgccccaccctgtacgagagcagattccagctgggcggcagcgccagaggcagcagagtgctggacagagccaacaacgtggagctgacctag

SEQ ID NO: 18739 - DNA, 879 bp, Artificial Sequence
  Description of Artificial Sequence: Synthetic coding sequence
atggccgccgccgccgccgccgccgtggccggcgtgggcagaggcggcggcggcgccgagcccagacaggagagaagcagagccagaggctgggccggcgtggagagaagcgagggcagaagaatggagcccggcgaggagctggaggaggagggcagccccggcggcagagaggacggcttcaccgccgagcacctggccgccgaggccatggccgccgacatggacccctggctggtgttcgacgccagaaccacccccgccaccgagctggacgcctggctggccaagtacccccccagccaggtgaccagatacggcgaccccggcagccccaacagcgagcccgtgggctggatcgccgtgtacggccagggctacagccccaacagcggcgacgtgcagggcctgcaggccgcctgggaggccctgcagaccagcggcagacccatcacccccggcaccctgagacagctggccatcacccaccacgtgctgagcggcaagtggctgatgcacctggcccccggcttcaagctggaccacgcctgggccggcatcgccagagccgtggtggagggccagctgcaggtggccaaggtgagccccagagccaaggagggcggcagacaggtgatctgcgtgtacaccgacgacttcaccgacagactgggcgtgctggaggccgacagcgccatcagagccgccggcatcaagtgcctgctgacctacaagcccgacgtgtacacctacctgggcatctacagagccaacagatggcacctgtgccccaccctgtacgagagcagattccagctgggcggcagcgccagaggcagcagagtgctggacagagccaacaacgtggagctgacctag

SEQ ID NO: 18740 - DNA, 165 bp, Artificial Sequence
  Description of Artificial Sequence: Synthetic coding sequence
atgctgggcagaatcaaggcccaggccttcggcttcgaccagaccttccagagctacagaaaggacgacttcgtgatgggcttcttccagagacccaagtgctacagccagttcgaggtgaccttcagattcttctggaccatggaccacatcagattctgctag

SEQ ID NO: 18741 - DNA, 804 bp, Artificial Sequence
  Description of Artificial Sequence: Synthetic coding sequence
atggccaccggcgagctgggcgacctgggcggctactacttcagattcctgccccagaagaccttccagagcctgagcagcaaggagatcaccagcagactgagacagtggagcatgctgggcagaatcaaggcccaggccttcggcttcgaccagaccttccagagctacagaaaggacgacttcgtgatggccttcttcaaggaccccaacgtgatccccaacctgaagctgctgagcgacagcagcggccagtggatcatcctgggcaccgaggtgaagaagatcgaggccatcaacgtgccctgcacccagctgagcatgagcttcttccacagactgtacgacgaggacatcgtgagagacagcggccacatcgtgaagtgcctggacagcttctgcgaccccttcctgatcagcgacgagctgagaagagtgctgctggtggaggacagcgagaagtacgagatcttcagccagcccgacagagaggagttcctgttctgcctgttcaagcacctgtgcctgggcggcgccctgtgccagtacgaggacgtgatcagcccctacctggagaccaccaagctgatctacaaggacctggtgagcgtgagaaagaacccccagaccaagaagatccagatcaccagcagcgtgttcaaggtgagcgcctacgacagcgccggcatgtgctaccccagcgccaagaaccacgagcagaccttcagctacttcatcgtggaccccatcagaagacacctgcacgtgctgtaccactgctacggcgtgggcgacatgagctag

SEQ ID NO: 18742 - DNA, 300 bp, Artificial Sequence
  Description of Artificial Sequence: Synthetic coding sequence
atggccaccggcgagctgggcgacctgggcggctactacttcagattcctgccccagaagaccttccagagcctgagcagcaaggagatcaccagcagactgagacagtggagcatgctgggcagaatcaaggcccaggccttcggcttcgaccagaccttccagagctacagaaaggacgacttcgtgatggccttcttcaaggaccccaacgtgatccccaacctgaagctgctgagcgacagcagcggccagtggatcatcctgggcttcgccagcggcagactgagaaagatctag

SEQ ID NO: 18743 - DNA, 444 bp, Artificial Sequence
  Description of Artificial Sequence: Synthetic coding sequence
atggccctgaacaacgtgagcctgagcagcggcgaccagagaagcagagtggcctacagaagcagccacggcgacctgagacccagagccagcgccctggccatggtgagcggcgacggcttcctggtgagcagacccgaggccatccacctgggccccagacaggccgtgagacccagcgtgagagccgagagcagaagagtggacggcggcggcagaagccccagagagcccgacggcagaggcagaagcagacaggccagattcagcccctaccccatccccgccgtggagcccgacctgctgagaagcgtgctgcagcagagactgatcgccctgggcgtgaccacctggaccctgaagctgagcgagagcgccacccccgacctgagatggtgcagcacctgcagccacagcaacatcttcgagatcctggtgatctag

SEQ ID NO: 18744 - DNA, 756 bp, Artificial Sequence
  Description of Artificial Sequence: Synthetic coding sequence
atgacccagctgcccgagctgggcctgagaagccccaacaacaagagccccaccggcccccaccccctggagcacctgctggccagactgctgaagagaagaagaagaagcaccctgatgagcagccccagaagcctgctgtgcagcatcagcggccccggcagccacctgctgagcacccaccccatcctgtgccacagcgtgtaccagcccccccagcccgccagcagaccccaggccaagagataccagggcctgctgcccgtgcccctggccccccaccccctgtgcctgagcggccagctgtacctgcccaacatcccctgcaccgtgatcgacggctgcggccccgtgatcagccacctgaagctgaccatgtacccctggggcctgccccccagccacctgggcagcagcagccccttcagcgccaacatggagcagtgggactactacaagagccagaccagattcgcccccttcctgcccgagagcttctgcggcagccccctgcccagcgagcagagcagcagacccttcggcctggccttcaaggtgctgtgcgccgccacctgccagcccccccagttccagctgctgtggctgtgcccctacaagctggacctgcaccagagaatctgcctgccccccaacctggccctggtgctgctgggcgccctgtggaccagccccccccccggcagcttcctgcagcccccctacaacagaccctacaagctgtacaagaccaactag

SEQ ID NO: 18745 - DNA, 756 bp, Artificial Sequence; identical to SEQ ID NO: 18744
  Description of Artificial Sequence: Synthetic coding sequence

SEQ ID NO: 18746 - DNA, 666 bp, Artificial Sequence
  Description of Artificial Sequence: Synthetic coding sequence
atgagcgcccacatgagcggcctggagatcatggacgaggaccagctgatcaaggacgtgctggacaagttcctgaactgccacgagcagacctacgacgaggagttcctgaacaccttcacccacctgagccaggaggaccacgtgagcaagagaggcgtgttcggcaccgacagcagcgagaacatcttcaccagcgccaaggtgacccacaagaacgaggccgacgactaccacctgagaaacaagaccatcttcctgagaaccagcagccagtgcctggaggagcaggtggacaacttcctggacctggaggacctggacatggacgaggagatcaagccccagatgagcgaggacctgctgctgctgcccggcgaggtggagcaggacgtgagcaccagcatccccagctgcatccccttcgtggcccagccccccacctgcgaggtgaagcccaagcccagcgtgaagagaatggacaagcagaccgaggagatcctgggcgacgaggtgcagctgttcagcctggacgaggagttcgactacgacaacgtgatgctgaccagcaagttcagccccgccgagatcgagaacatcaaggagctgtgcaagcagcagaagagaaaggacaccagccccgacctggagaagagctgcgactag

SEQ ID NO: 18747 - DNA, 444 bp, Artificial Sequence
  Description of Artificial Sequence: Synthetic coding sequence
atgagcgcccacatgagcggcctggagatcatggacgaggaccagctgatcaaggacgtgctggacaagttcctgaactgccacgagcagacctacgacgaggagttcctgaacaccttcacccacctgagccaggacctgctgctgctgcccggcgaggtggagcaggacgtgagcaccagcatccccagctgcatccccttcgtggcccagccccccacctgcgaggtgaagcccaagcccagcgtgaagagaatggacaagcagaccgaggagatcctgggcgacgaggtgcagctgttcagcctggacgaggagttcgactacgacaacgtgatgctgaccagcaagttcagccccgccgagatcgagaacatcaaggagctgtgcaagcagcagaagagaaaggacaccagccccgacctggagaagagctgcgactag

SEQ ID NO: 18748 - DNA, 504 bp, Artificial Sequence
  Description of Artificial Sequence: Synthetic coding sequence
atgagcgcccacatgagcggcctggagatcatggacgaggaccagctgatcaaggacgtgctggacaagttcctgaactgccacgagcagacctacgacgaggagttcctgaacaccttcacccacctgagccaggaggaccacgtgagcaagagaggcgtgttcggcaccgacagcagcgagaacatcttcaccagcgccaaggtgacccacaagaacgaggccgacgactaccacctgagaaacaagaccatcttcctgagaaccagcagccagtgcctggaggagcaggtggacaacttcctggacctggaggacctggacatggacgaggagatcaagccccagatgagcgaggacctgctgctgctgcccggcgaggtggagcaggacgtgagcaccagcatccccagctgcatccccttcgtggcccagccccccacctgcgaggtgaagcccaagcccagcgtgaagagaatggacaagcagaccgaggagagctag

SEQ ID NO: 18749 - DNA, 273 bp, Artificial Sequence
  Description of Artificial Sequence: Synthetic coding sequence
atgagcgcccacatgagcggcctggagatcatggacgaggaccagctgatcaaggacgtgctggacaagttcctgaactgccacgagcagacctacgacgaggagttcctgaacaccttcacccacctgagccaggacctgctgctgctgcccggcgaggtggagcaggacgtgagcaccagcatccccagctgcatccccttcgtggcccagccccccacctgcgaggtgaagcccaagcccagcgtgaagagaatggacaagcagacctag

SEQ ID NO: 18750 - DNA, 252 bp, Artificial Sequence
  Description of Artificial Sequence: Synthetic coding sequence
atgagcgcccacatgagcggcctggagatcatggacgaggaccagctgatcaaggacgtgctggacaagttcctgaactgccacgagcagacctacgacgaggagttcctgaacaccttcacccacctgagccaggaggaccacgtgagcaagagaggcgtgttcggcaccgacagcagcgagaacatcttcaccagcgccaaggtgacccacaagaacgaggccgacgactaccacctgagaaacaagtag

SEQ ID NO: 18751 - DNA, 543 bp, Artificial Sequence
  Description of Artificial Sequence: Synthetic coding sequence
atgagcgcccacatgagcggcctggagatcatggacgaggaccagctgatcaaggacgtgctggacaagttcctgaactgccacgagcagacctacgacgaggagttcctgaacaccttcacccacctgagccaggaggaccacgtgagcaagagaggcgtgttcggcaccgacagcagcgagaacatcttcaccagcgccaaggtgacccacaagaacgaggccgacgactaccacctgagaaacaagaccatcttcctgagaaccagcagccagtgcctggaggagcaggtggacaacttcctggacctggaggacctggacatggacgaggagatcaagccccagatgagcgaggacctgctgctgctgcccggcgaggtggagcaggacgtgagcaccagcatccccagctgcatccccttcgtggcccagccccccacctgcgaggtgaagcccaagcccagcgtgaagagaatggacaagcagaccgaggagatcctgggcgacgaggtgcagctgttcagcctggacgaggagtag

SEQ ID NO: 18752 - DNA, 360 bp, Artificial Sequence
  Description of Artificial Sequence: Synthetic coding sequence
atgagcgcccacatgagcggcctggagatcatggacgaggaccagctgatcaaggacgtgctggacaagttcctgaactgccacgagcagacctacgacgaggagttcctgaacaccttcacccacctgagccaggaggaccacgtgagcaagagaggcgtgttcggcaccgacagcagcgagaacatcttcaccagcgccaaggtgacccacaagaacgaggccgacgactaccacctgagaaacaagaccatcttcctgagaaccagcagccagtgcctggaggagcaggtggacaacttcctggacctggaggacctggacatggacgaggagatcaagccccagatgagcgagtag

SEQ ID NO: 18753 - DNA, 444 bp, Artificial Sequence; identical to SEQ ID NO: 18747
  Description of Artificial Sequence: Synthetic coding sequence

SEQ ID NO: 18754 - DNA, 1461 bp, Artificial Sequence
  Description of Artificial Sequence: Synthetic coding sequence
atggtggccagcgccggcagcctgttcggcggcatggtgctgaagaagttcctgaaggagatccagagcatcctgcccggcatcagcgccaagctgacctggaccagcgaggagggcagctacagccaggacatgaccggcgtgacccccttccagatgatcttcgaggtggacgagaagcccagaaccctgatgaccgactgcctggtgatcaagcacttcctgagaaagatcatcatggtgcaccccaaggtgagattccacttcagcgtgaaggtgaacggcatcctgagcaccgagatcttcggcgtggagaacgagcccaccctgaacctgggcaacggcatcgccctgctggtggacagccagcactacgtgagcagacccaacttcggcaccatcgagagccactgcagcagaatccaccccgtgctgggccaccccgtgatgctgttcatccccgaggacgtggccggcatggacctgctgggcgagctgatcctgacccccgccgccgccctgtgccccagccccaaggtgagcagcaaccagctgaacagaatcagcagcgtgagcatcttcctgtacggccccctgggcctgcccctgatcctgagcacctgggagcagcccatgaccaccttcttcaaggacaccagcagcctggtggactggaagaagtaccacctgtgcatgatccccaacctggacctgaacctggacagagacctggtgctgcccgacgtgagctaccaggtggagagcagcgaggaggaccagagccagaccatggacccccagggccagaccctgctgctgttcctgttcgtggacttccacagcgccttccccgtgcagcagatggagatctggggcgtgtacaccctgctgaccacccacctgaacgccatcctggtggagagccacagcgtggtgcagggcagcatccagttcaccgtggacaaggtgctggagcagcaccaccaggccgccaaggccgccgacacccaggagttcagaaccaagctgcacaaggtgttcagagagatcacccagcaccagttcctgcaccactgcagctgcgaggtgaagcagcagctgaccctggagaagaaggacagcgcccagggcaccgaggacgcccccgacaacagcagcctggagctgctggccgacaccagcggccaggccgagaacaagagactgaagagaggcagccccagaatcgaggagatgagagccctgagaagcgccagagcccccagccccagcgaggccgcccccagaagacccgaggccaccgccgcccccctgacccccagaggcagagagcacagagaggcccacggcagagccctggcccccggcagagccagcctgggcagcagactggaggacgtgctgtggctgcaggaggtgagcaacctgagcgagtggctgagccccagccccggcccctag

SEQ ID NO: 18755 - DNA, 2034 bp, Artificial Sequence
  Description of Artificial Sequence: Synthetic coding sequence
atgggcagcagatgcagagcctgggcctggaccagagcctgggccctggccgagttccaggccagagccgaggagggcgccgccgccgccgccgccgccgccggcggctaccccagcaccggcagatgcagatgcagcctgagaggcatggagggcaccgccgtggccgtgttcgagatcctgagattcctgatcatccactggaagtgcgacatcgacgtgagcaagggcgccctgctggagggccagctggtgatcagcatcgagggcctgaacagcaagcaccaggccaacgccctgcactgcgtgaccaccagatggagcctgaccctgctgcccagacccgagtgcagcggcgccgtgagcgcccactgcaacctgcacctgcccggcagcagcgacagccacgccagcgtgcccagagtggccggcatcaccgacgcccaccaccacgcctggctgatcatggtggccagcgccggcagcctgttcggcggcatggtgctgaagaagttcctgaaggagatccagagcatcctgcccggcatcagcgccaagctgacctggaccagcgaggagggcagctacagccaggacatgaccggcgtgacccccttccagatgatcttcgaggtggacgagaagcccagaaccctgatgaccgactgcctggtgatcaagcacttcctgagaaagatcatcatggtgcaccccaaggtgagattccacttcagcgtgaaggtgaacggcatcctgagcaccgagatcttcggcgtggagaacgagcccaccctgaacctgggcaacggcatcgccctgctggtggacagccagcactacgtgagacccaacttcggcaccatcgagagccactgcagcagaatccaccccgtgctgggccaccccgtgatgctgttcatccccgaggacgtggccggcatggacctgctgggcgagctgatcctgacccccgccgccgccctgtgccccagccccaaggtgagcagcaaccagctgaacagaatcagcagcgtgagcatcttcctgtacggccccctgggcctgcccctgatcctgagcacctgggagcagcccatgaccaccttcttcaaggacaccagcagcctggtggactggaagaagtaccacctgtgcatgatccccaacctggacctgaacctggacagagacctggtgctgcccgacgtgagctaccaggtggagagcagcgaggaggaccagagccagaccatggacccccagggccagaccctgctgctgttcctgttcgtggacttccacagcgccttccccgtgcagcagatggagatctggggcgtgtacaccctgctgaccacccacctgaacgccatcctggtggagagccacagcgtggtgcagggcagcatccagttcaccgtggacaaggtgctggagcagcaccaccaggccgccaaggcccagcagaagctgcaggccagcctgagcgtggccgtgaacagcatcatgagcatcctgaccggcagcaccagaagcagcttcagaaagatgtgcctgcagaccctgcaggccgccgacacccaggagttcagaaccaagctgcacaaggtgttcagagagatcacccagcaccagttcctgcaccactgcagctgcgaggtgaagcagcagctgaccctggagaagaaggacagcgcccagggcaccgaggacgcccccgacaacagcagcctggagctgctggccgacaccagcggccaggccgagaacaagagactgaagagaggcagccccagaatcgaggagatgagagccctgagaagcgccagagcccccagccccagcgaggccgcccccagaagacccgaggccaccgccgcccccctgacccccagaggcagagagcacagagaggcccacggcagagccctggcccccggcagagccagcctgggcagcagactggaggacgtgctgtggctgcaggaggtgagcaacctgagcgagtggctgagccccagccccggcccctag

SEQ ID NO: 18756 - DNA, 1536 bp, Artificial Sequence
  Description of Artificial Sequence: Synthetic coding sequence
atggtgctgaagaagttcctgaaggagatccagagcatcctgcccggcatcagcgccaagctgacctggaccagcgaggagggcagctacagccaggacatgaccggcgtgacccccttccagatgatcttcgaggtggacgagaagcccagaaccctgatgaccgactgcctggtgatcaagcacttcctgagaaagatcatcatggtgcaccccaaggtgagattccacttcagcgtgaaggtgaacggcatcctgagcaccgagatcttcggcgtggagaacgagcccaccctgaacctgggcaacggcatcgccctgctggtggacagccagcactacgtgagcagacccaacttcggcaccatcgagagccactgcagcagaatccaccccgtgctgggccaccccgtgatgctgttcatccccgaggacgtggccggcatggacctgctgggcgagctgatcctgacccccgccgccgccctgtgccccagccccaaggtgagcagcaaccagctgaacagaatcagcagcgtgagcatcttcctgtacggccccctgggcctgcccctgatcctgagcacctgggagcagcccatgaccaccttcttcaaggacaccagcagcctggtggactggaagaagtaccacctgtgcatgatccccaacctggacctgaacctggacagagacctggtgctgcccgacgtgagctaccaggtggagagcagcgaggaggaccagagccagaccatggacccccagggccagaccctgctgctgttcctgttcgtggacttccacagcgccttccccgtgcagcagatggagatctggggcgtgtacaccctgctgaccacccacctgaacgccatcctggtggagagccacagcgtggtgcagggcagcatccagttcaccgtggacaaggtgctggagcagcaccaccaggccgccaaggcccagcagaagctgcaggccagcctgagcgtggccgtgaacagcatcatgagcatcctgaccggcagcaccagaagcagcttcagaaagatgtgcctgcagaccctgcaggccgccgacacccaggagttcagaaccaagctgcacaaggtgttcagagagatcacccagcaccagttcctgcaccactgcagctgcgaggtgaagcagctgaccctggagaagaaggacagcgcccagggcaccgaggacgcccccgacaacagcagcctggagctgctggccgacaccagcggccaggccgagaacaagagactgaagagaggcagccccagaatcgaggagatgagagccctgagaagcgccagagcccccagccccagcgaggccgcccccagaagacccgaggccaccgccgcccccctgacccccagaggcagagagcacagagaggcccacggcagagccctggcccccggcagagccagcctgggcagcagactggaggacgtgctgtggctgcaggaggtgagcaacctgagcgagtggctgagccccagccccggcccctag

SEQ ID NO: 18757 - DNA, 1146 bp, Artificial Sequence
  Description of Artificial Sequence: Synthetic coding sequence
atggccctgaaggccgagggcgccgccctggactgcttcgaggtgaccctgaagtgcgaggagggcgaggacgaggaggaggccatggtggtggccgtgatccccagacccgagcccatgctgagagtgacccagcaggagaagacccccccccccagacccagccccctggaggccggcagcgacggctgcgaggagcccaagcagcaggtgagctgggagcaggagttcctggtgggcagcagccccggcggcagcggcagagccctgtgcatggtgtgcggcgccgagatcagagcccccagcgccgacaccgccagaagccacatcctggagcagcacccccacaccctggacctgagccccagcgagaagagcaacatcctggaggcctggagcgagggcgtggccctgctgcaggacgtgagagccgagcagcccagcccccccaacagcgacagcggccaggacgcccaccccgaccccgacgccaaccccgacgccgccagaatgcccgccgagatcgtggtgctgctggacagcgaggacaaccccagcctgcccaagagaagcagacccagaggcctgagacccctggagctgcccgccgtgcccgccaccgagcccggcaacaagaagcccagaggccagagatggaaggagccccccggcgaggagcccgtgagaaagaagagaggcagacccatgaccaagaacctggaccccgaccccgagccccccagccccgacagccccaccgagaccttcgccgcccccgccgaggtgagacacttcaccgacggcagcttccccgccggcttcgtgctgcagctgttcagccacacccagctgagaggccccgacagcaaggacagccccaaggacagagaggtggccgagggcggcctgcccagagccgagagccccagccccgcccccccccccggcctgagaggcaccctggacctgcaggtgatcagagtgagaatggaggagccccccgccgtgagcctgctgcaggactggagcagacacccccagggcaccaagagagtgggcgccggcgacaccagcgactggcccaccgtgctgagcgagagcagcaccaccgtggccggcaagcccgagaagggcaacggcgtgtag

SEQ ID NO: 18758 - DNA, 651 bp, Artificial Sequence
  Description of Artificial Sequence: Synthetic coding sequence
atgagcctgaagcccttcacctaccccttccccgagaccagattcctgcacgccggccccaacgtgtacaagttcaagatcagatacggcaagagcatcagaggcgaggagatcgagaacaaggaggtgatcacccaggagctggaggacagcgtgagagtggtgctgggcaacctggacaacctgcagcccttcgccaccgagcacttcatcgtgttcccctacaagagcaagtgggagagagtgagccacctgaagttcaagcacggcgagatcatcctgatcccctaccccttcgtgttcaccctgtacgtggagatgaagtggttccacgagaacctgagccccggcaagcccatcagcgacagccccctgggcctggtgcccgtggagaagaaggccgtgggcgccgtgatgagaaagagaaagcacatggacgagcccagcagccccagcagacccggcctggacagaatcggcaaggagaagcccaacaaggactgcagaagactgtggcccctgatcagcctgatgagcagaaacaagatcctgagcggcgacaccgcctgccagggcgagctgagccacccctgcagcaccacccacctgcacctgagaagcgagcagccccccgccagcctgggcttctag

SEQ ID NO: 18759 - DNA, 651 bp, Artificial Sequence; identical to SEQ ID NO: 18758
  Description of Artificial Sequence: Synthetic coding sequence

SEQ ID NO: 18760 - DNA, 447 bp, Artificial Sequence
  Description of Artificial Sequence: Synthetic coding sequence
atgaagtggttccacgagaacctgagccccggcaagcccatcagcgacagccccctgggcctggtgcccgtggagaagaaggccgtgggcgccgtgatgagaaagagaaagcacatggacgagcccagcagccccagcagacccggcctggacagagccaagatcggcaccagcagccagggccccagcaagaagaagccccccgtggagaccagaagaaacagagagagaaagacccagcagggcctgcaggagaccctggccagcgacatcaccgacgtgcagaagcaggacagcgagtggggccacagcctgcccggcagaatcgtgccccccctgcagcacaacagccccccccccaaggagagagccgccaccggcttcttcggcttcctgagcagcctgttccccttcagatacttcttcagaaagagcagccacagctag

SEQ ID NO: 18761 - DNA, 348 bp, Artificial Sequence
  Description of Artificial Sequence: Synthetic coding sequence
atgggcaccggcctgagaagccagagcctgagagagcccagacccagctacggcaagctgcaggagccctggggcagaccccaggagggccagctgagaagagccctgagcctgagacagggccaggagaagagcagaagccagggcctggagagaggcaccgagggccccgacgccaccgcccaggagagagtgcccggcagcctgggcgacaccgagcagctgatccaggcccagagaagaggcagcagatggtggctgagaagataccagcaggtgagaagaagatgggagagcttcgtggccatcttccccagcgtgaccctgagccagcccgccagcccctag

SEQ ID NO: 18762 - DNA, 510 bp, Artificial Sequence
  Description of Artificial Sequence: Synthetic coding sequence
atggagaccggccccagcgaggagcccagcggcagaaaggagagccaggagatgtgcccccccggcctgctggtgttcgccggcagcagcgagcaggacgccaacctggccaagcagttctggatcagcgccagcatgtacccccccagcgagagccagctggtgctgagaagagacagcagccagagactgcccgtggccagacccagaagaagcagaggcagcgagaacagccacagcagccagagcttccacctggccagcaacaagaacagagacatcttcgccgaggccctgaagatccaggagagcgaggagaaggtgaagtacctgcagaaggccaagaccagagaggagatcctgcagctgctgagaaagcagagagaggagagaatcagcaaggagctgatcagcctgccctacaagcccaaggccaaggagcacaaggccaagaaggtggtgagcgagagcgacaaggaggaccaggaggaggtgaagaccctggactag

SEQ ID NO: 18763 - DNA, 537 bp, Artificial Sequence
  Description of Artificial Sequence: Synthetic coding sequence
atggagaccggccccagcgaggagcccagcggcagaaaggagagccaggagatgtgcccccccggcctgctggtgttcgccggcagcagcgagcaggacgccaacctggccaagcagttctggatcagcgccagcatgtacccccccagcgagagccagctggtgctgagaagagacagcagccagagactgcccgtggccagacccagaagaagcagaggcagcgagaacagccacagcagccagagcttccacctggccagcaacaagaacagagacatcttcgccgaggccctgaagatccaggagagcgaggagaaggtgaagtacctgcagaagaccagaagccacagcgtgacccagaacgaggtgcagtggcacgaccacggcagcctgcagccccagctgagcagaatccaggccaagaccagagaggagatcctgcagctgctgagaaagcagagagaggagagaatcagcaaggagctgatcagcctgccctacaagcccaaggccaaggagcacaaggccaagtag

SEQ ID NO: 18764 - DNA, 1440 bp, Artificial Sequence
  Description of Artificial Sequence: Synthetic coding sequence
atgctgatcagcgccgccagcatggcccccgaggtgtgcggccccagcctgcagggcacccccggcccccccccccccctgctgcccaagcccggcaaggacaacctgagactgcagaagctgctgagaaaggccgccagaaagaagatgatgggcggcacccacctggccccccccagagccttcagaaccagcctgagccccgtgagcgaggccagccacgaccaggaggtgaccgccccccacgccgccgagggcccccaccccgccgaggcccccagactgcccgaggcccccagacccgccgaggcccccagaatggtggccgccctgcccagaagcccccacacccccatcatccaccacgtggccagccccctgcagaagagcaccttcagcatcggcctgacccagagaagaatcctggccgcccagttcagagccatgggcccccaggtggtggccagcgcccccgagcccaccagaccccccagcggcttcgtgcccgtgagcggcggcggcggcacccacgtgacccaggtgcacatccagctggcccccagcccccacaacggcacccccgagccccccagaaccgcccccgaggtgggcagcaacagccaggacggcgacgccacccccagcccccccagagcccagcccctggtgcccgtggcccacatcagacccctgcccaccaccgtgcaggccgccagccccctgcccgaggagccccccgtgcccagacccccccccggcttccaggccagcgtgcccagagaggccagcgccagagtggtggtgcccatcgcccccacctgcagaagcctggagagcagcccccacagcctggtgcccatgggccccggcagagagcacctggaggagccccccatggccggccccgccgccgaggccgagagagtgagcagccccgcctgggccagcagccccaccccccccagcggcccccacccctgccccgtgcccaaggtggcccccaagcccagactgagcggctggacctggctgaagaagcagctgctggaggaggcccccgagcccccctgccccgagcccagacagagcctggagcccgaggtgcccacccccaccgagcaggaggtgcccgcccccaccgagcaggaggtgcccgccctgaccgcccccagagcccccgccagcagaaccagcagaatgtgggacgccgtgctgtacagaatgagcgtggccgaggcccagggcagactggccggccccagcggcggcgagcacacccccgccagcctgaccagactgcccttcctgtacagacccagattcaacgccagaaagctgcaggaggccaccagacccccccccaccgtgagaagcatcctggagctgagcccccagcccaagaacttcaacagaaccgccaccggctggagactgcagtag

SEQ ID NO: 18765 - DNA, 582 bp, Artificial Sequence
  Description of Artificial Sequence: Synthetic coding sequence
atgcccaagggcagaagaggcagccacagccccaccatgagccagagaagcgccccccccctgtacttccccagcctgtacgacagaggcatcagcagcagccccctgagcgacttcaacatctggaagaagctgttcgtgcccctgaaggccggcggcgcccccgtgggcggcgccgccggcgccagaagcctgagccaggccctgcccgcccccgcccccccccccccccccccccccggcctgggccccagcagcgagagaccctggcccagcccctggcccagcggcctggccagcatcccctacgagcccctgagattcttctacagccccccccccggccccgaggtggtggccagccccctggtgccctgccccagcacccccagactggccagcgccagccaccccgaggagctgtgcgagctggagatcagaatcaaggagctggagctgctgaccatcaccggcgacggcttcgacagccagagctacaccttcctgaaggccctgaaggacgagaagctgcagggcctgaagaccaagcagcccggcaagaagagcgccagcctgagctag

SEQ ID NO: 18766 - DNA, 555 bp, Artificial Sequence
  Description of Artificial Sequence: Synthetic coding sequence
atgcccaagggcagaagaggcagccacagccccaccatgagccagagaagcgccccccccctgtacttccccagcctgtacgacagaggcatcagcagcagccccctgagcgacttcaacatctggaagaagctgttcgtgcccctgaaggccggcggcgcccccgtgggcggcgccgccggcgccagaagcctgagccaggccctgcccgcccccgcccccccccccccccccccccccggcctgggccccagcagcgagagaccctggcccagcccctggcccagcggcctggccagcatcccctacgagcccctgagattcttctacagccccccccccggccccgaggtggtggccagccccctggtgccctgccccagcacccccagactggccagcgccagccaccccgaggagctgtgcgagctggagatcagaatcaaggagctggagctgctgaccatcaccggcgacggcttcgacagccagagcttcctgggcctgtggaccacctgcgccgacgccggcagaatcccccagcccaccagctag

SEQ ID NO: 18767 - DNA, 375 bp, Artificial Sequence
  Description of Artificial Sequence: Synthetic coding sequence
atggagagctgcagcgtggcccaggccggcgtgctgaccagccccttcatgtggagatggaccggcatggccggcgccctgagcgccctggacaacaccatcgaggacgacgccgacgaccagctgccctgcggcgagggcagacccggctgggtgagaggcgagctgctgggcagccagggcgtgtgcaaggacagcaaggacctgttcgtgcccaccagcagcagcctgtacggctgcttctgcgtgggcctggtgagcggcatggccatcagcgtgctgctgctggccagcgacttcagaaagctggacttcagcagacccgagccctgcttcgagaaggaggccagcctgtggttcgtggcccagcactag

SEQ ID NO: 18768 - DNA, 375 bp, Artificial Sequence; identical to SEQ ID NO: 18767
  Description of Artificial Sequence: Synthetic coding sequence

SEQ ID NO: 18769 - DNA, 375 bp, Artificial Sequence; identical to SEQ ID NO: 18767
  Description of Artificial Sequence: Synthetic coding sequence

SEQ ID NO: 18770 - DNA, 465 bp, Artificial Sequence
  Description of Artificial Sequence: Synthetic coding sequence
atgcaccccgagcccctgctgaacagcacccagagcgccccccaccacttccccgacagcttccaggccacccccttctgcttcaaccagagcctgatccccggcagccccagcaacagcagcatcctgagcggcagcctggactacagctacagccccgtgcagctgcccagctacgcccccgagaactacaacagccccgccagcctggacaccagaacctgcggctacccccccgaggaccacagctaccagcacctgagcagccacgcccagtacagctgcttcagcagcgccaccaccagcatctgctactgcgccagctgcgaggccgaggacctggacgccctgcaggccgccgagtacttctaccccagcaccgactgcgtggacttcgcccccagcgccgccgccaccagcgacttctacaagagagagaccaactgcgacatctgctacagctag

SEQ ID NO: 18771 - DNA, 465 bp, Artificial Sequence; identical to SEQ ID NO: 18770
  Description of Artificial Sequence: Synthetic coding sequence

SEQ ID NO: 18772 - DNA, 324 bp, Artificial Sequence
  Description of Artificial Sequence: Synthetic coding sequence
atgcaccccgagcccctgctgaacagcacccagagcgccccccaccacttccccgacagcttccaggccacccccttctgcttcaaccagagcctgatccccggcagccccagcaacagcagcatcctgagcggcagcctggactacagctacagccccgtgcagctgcccagctacgcccccgagaactacaacagccccgccagcctggacaccagaacctgcggctacccccccgaggaccacagctaccagcacctgagcagccacgcccagtacagctgcttcagcagcgccaccaccagcatctgctactgcgcctag

SEQ ID NO: 18773 - DNA, 1308 bp, Artificial Sequence
  Description of Artificial Sequence: Synthetic coding sequence
atgggcaacaagcagccccagaaggtgaccgtgcccaccggcaccgccctgcagggcgtggtgctgatcgtgagcaccctgcaccagcccggcggctggatctgcggcaaggacccctgctgcagcctgagacccctgagcaacagcgtgcagaacgccctggcctgcaagagcaagcaggactaccaggccggcatcctgttcaagaccagagccttcatcagcagagactgcggcagcgacgccgccgaggacagcgccagcaagggcgagacctacaccctgaccctggagcacaagggcgccggcgagggcgacctgagacccagaggccagcccggctggtgcagactgggcgaccccagaagagacagcgccagacccgtggccgccatcgagggcccctgccccggcgccgccagagccagcagagtgctgagaggcagaggcttcagcagaaaccccagaggcagaggcctgcccagcggcgccggctggagaggcgccggcggcgccggcgagggcgccgtgaccttccccgagagaagaggcgacgtgagaagaaagggcgccggcagagccagattcaagtggcacagcctgagcagcgagctgagagccgtgtgggccgccgccggctacatcagcagagagcccggcagaagaggcgccgacggcgacagcagcggcggcgagagactgggcgccagaagaaacagcgcccccagagccccctgcccccccaccggcccccccgccagaccccccagcagaggcgcccccgccagagccagagagggcagaagacaccccgccgccgacctggaccccccccccggcgagccccccgccgccgccagcagaggcgcccccgcccagagaccccccagcgagagccccggcgcccccccccccggccccgccgacgccggcggcgccatggccgccaagcccggcgagctgatgggcatctgcagcagctaccaggccgtgatgccccacttcgtgtgcctggccgacgagttcccccagcccgtgagacccgccaagctgcccaagggcagaggcagactgagaagacccagacagagcagattcaagacccagcccgtgaccttcgacgagatccaggaggtggaggaggagggcgtgagccccatggaggaggagaaggccaagaagagcttcctgcagagcctggagtgcctgagaagaagcacccagagcctgagcctgcagagagagcagctgagcagctgcaagctgagaaacagcctggacagcagcgacagcgacagcgccctgtag

SEQ ID NO: 18774 - DNA, 1254 bp, Artificial Sequence
  Description of Artificial Sequence: Synthetic coding sequence
atggccttcgccgtgatcagagcccagagcagagtgggcagcagaggcctgtacaagcccagagcctggccccccagaggcagaagaagacagcagagaagaagagcccccagaagcgccgccgagcagagaccccccagccccgtgccccccgacggcagcgccagaccccccgccctgcccagaagcgccggccccggccccagaggcccccccccccccagaagcagattcggcagccccgccagaagagcccccggctgctgcctgcccggcggccccggcgccgccgccgccctgggcgagcccagaagacccgccgccagacccagaagaagaagaagaagacacggcagacaggccagaagagccgacggccacctgctgcagctgcccggcggcgacgccgccctgagagtgcccggcagaagagtgcccgccgccagagccgccagacaggccgcccagggccccggccccgccgccgccgccgcccccgtgagcctgcaggacgccgccggcgacctgagaagagaccccggcggcggcggcggcggcggcgtgccccacggcggcggcgagggccaggaggtggtgcccgccgagcccggcgtgcccgccccccagcacgccgagcccgtggccgccgccggcgccgcccagcagctgcagaccgaggagcagcccggcctgcagagactgagactgggccccgtgagaggcgccgccagaggcggcgacgccagagtgagaggccccagaggcgacagaagagtgaaccccgagagcgccagagccctgctgcccggcgacccccagggccccggcaccgccgcccccagagccctgggcctgccccccagatgcgagcccgtgggcgcccccctggccgccctggccctggccagagagagaagagagagaggcagattccccagaccctgcaagtgcctgttcttcaacagcagccagtgcgagctgtgctgcgagtgcgtgagaggcggcgcccccgccctgagcagaagaagagtggccaccccctgcccctgccccatggtgtgcaacagcgacttcgcccacagaagcaccgtgccccccagcgcccaccccttcaccctgacccccaccctgagcctgaacaccttcatcatcgtgagaagaggcagatgggacttcggcagaagcgccgccgccaccgccagcggcggcctgatcttcatcttcgccctgagatggctgaaggccttcatctag

SEQ ID NO: 18775 - DNA, 822 bp, Artificial Sequence
  Description of Artificial Sequence: Synthetic coding sequence
atgctgggccagctgctgccccacaccgccagaggcctgggcgccgccgagatgcccggccagggccccggcagcgactggaccgagagaagcagcagcgccgagccccccgccgtggccggcaccgagggcggcggcggcggcagcgccggctacagctgctaccagaacagcaagggcagcgacagaatcaaggacggctacaaggtgaacagccacatcgccaagctgcaggagctgtggaagaccccccagaaccagaccatccacctgagcaagagcatgatggaggccagcttcttcaagcaccccgacctgaccaccggccagaagagatacctgtgcagcatcgccaagatctacaacgccaactacctgaagatgctgatgaagagacagtacatgcacgtgctgcagcacagcagccagaagcccggcgtgctgacccaccacagaagcagactgagcagcagatacagccagaagcagcactacccctgcaccacctggagacaccagctggagagagaggacagcggcagcagcgacatcgccgccgccagcgcccccgagatgctgatccagcacagcctgtggagacccgtgagaaacaaggagggcatcaagaccggctacgccagcaagaccagatgcaagagcctgaagatcttcagaagacccagaaagctgttcatgcagaccgtgagcagcgacgacagcgagagccacatgagcgaggagaagaaggaggaggacctgctgaacaacttcatgcagagcatgagcatcgaggagcagggcgagcacctgatgctgacctag

SEQ ID NO: 18776 - DNA, 1812 bp, Artificial Sequence
  Description of Artificial Sequence: Synthetic coding sequence
atggccgccagctgccccctgcccgtgacccccgacctgcccaccctgagagccaagctgcagggcctgctgcagttcctgagagacgccctgagcatcagcaacgcccacaccgtggacttctacaccgagagcgtgtgggaggagctggtggacctgccccccgagaccgtgctggccgccctgagaaagagcgccagcgagaccgaggccctgcccagcgagaccagacccctggtggaggccgagtgggaggccggcatgaccgacttccccaagatcttctgcgagaccagccagaagctggtgagcgtggaggccttcgccctggccgccaagtactacagcgtgcagaacctgggcatctgcacccccttcgagcagctgctggtggccctgagaggcaaccagaaccagagaatcggcgagaaccagaaggccgtggagttcatgaacatgaagaagagccacgaggtgcaggccatgagcgagctgatcagcagcatcgccgactactacggcatcaagcaggtgatcgacctgggcagcggcaagggctacctgagcagcttcctgagcctgaagtacggcctgaaggtgtacggcatcgacagcagcaacaccaacacccacggcgccgaggagagaaacagaaagctgaagaagcactggaagctgtgccacgcccagagcagactggacgtgaacggcctggccctgaagatggccaaggagagaaaggtgcagaacaaggtgaagaacaaggccgacaccgaggaggtgttcaacaacagccccaccaaccaggagaagatgcccaccagcgccatcctgcccgacttcagcggcagcgtgatcagcaacatcagaaaccagatggagaccctgcacagccagccccaccaggaggagaacctgtgcttcgagaacagcttcagcctgatcaacctgctgcccatcaacgccgtggagcccaccagcagccagcagatccccaacagagagaccagcgaggccaacaaggagagaagaaagatgaccagcaagagcagcgagagcaacatctacagccccctgaccagcttcatcaccgccgacagcgagctgcacgacatcatcaaggacctggaggactgcctgatggtgggcctgcacacctgcggcgacctggcccccaacaccctgagaatcttcaccagcaacagcgagatcaagggcgtgtgcagcgtgggctgctgctaccacctgctgagcgaggagttcgagaaccagcacaaggagagaacccaggagaagtggggcttccccatgtgccactacctgaaggaggagagatggtgctgcggcagaaacgccagaatgagcgcctgcctggccctggagagagtggccgccggccagggcctgcccaccgagagcctgttctacagagccgtgctgcaggacatcatcaaggactgctacggcatcaccaagtgcgacagacacgtgggcaagatctacagcaagtgcagcagcttcctggactacgtgagaagaagcctgaagaagctgggcctggacgagagcaagctgcccgagaagatcatcatgaactactacgagaagtacaagcccagaatgaacgagctggaggccttcaacatgctgaaggtggtgctggccccctgcatcgagaccctgatcctgctggacagactgtgctacctgaaggagcaggaggacatcgcctggagcgccctggtgaagctgttcgaccccgtgaagagccccagatgctacgccgtgatcgccctgaagaagcagcagtag

SEQ ID NO: 18777 - DNA, 828 bp, Artificial Sequence
  Description of Artificial Sequence: Synthetic coding sequence
atggccttctgcgccctgaccatcgtggccctgtacatcctgagcctgaaggaccaggacagaagagtgcccaacctgccccccagcaacatcaccagcagccaggagcccgccctgctgcccaccgccagcagcagcgcccccaacaccagcctggtgaccacccccgccagcctgcaggtgcccgagatcaccttctgcgagatcctgccctgccaggagacctactgctgccccatcagaggcatgaaggaggtgagcagcagccccgtgcagagacagagcgaggagaaggagttccaccagagaagatggagcgaggacaagagcaagagcgtgctggccagaaacgccctgagcggccccgactgggagagcgactggatcgacaccaccatcagcagcatccagatcatggagatccagcagatcatcgaccaccagtactgcatccagagcctgcagtgcggcagcggcaactacaactacaacatccccgtgaacaagcacacccccaccaacgtgaagttcagcctggagatcaacaccaccgagcccctgatcgtgttccagtgcaagttcaccctgggcaacatctgcttccacagcaagagaggcaccaagggcctggagagccacagagagatcagccaggagatgacccagggctaccagcacatctggagcctgcccgtggcccccttcagcgacagcatgttccacttcagagtggccgcccccgacctggccgactgcagcaccgacccctacttcgccggcatcttcttcaccgactacttcttctacttctacagaagatgcgcctag

SEQ ID NO: 18778 - DNA, 978 bp, Artificial Sequence
  Description of Artificial Sequence: Synthetic coding sequence
atgaagagactgggcagcgtgcagagaaagatgccctgcgtgttcgtgaccgaggtgaaggaggagcccagcagcaagagagagcaccagcccttcaaggtgctggccaccgagaccgtgagccacaaggccctggacgccgacatctacagcgccatccccaccgagaaggtggacggcacctgctgctacgtgaccacctacaaggaccagccctacctgtgggccagactggacagaaagcccaacaagcaggccgagaagagattcaagaacttcctgcacagcaaggagaaccccaaggagttcttctggaacgtggaggaggacttcaagcccgcccccgagtgctggatccccgccaaggagaccgagcagatcaacggcaaccccgtgcccgacgagaacggccacatccccggctgggtgcccgtggagaagaacaacaagcagtactgctggcacagcagcgtggtgaactacgagttcgagatcgccctggtgctgaagcaccaccccgacgacagcggcctgctggagatcagcgccgtgcccctgagcgacctgctggagcagaccctggagctgatcggcaccaacatcaacggcaacccctacggcctgggcagcaagaagcaccccctgcacctgctgatcccccacggcgccttccagatcagaaacctgcccagcctgaagcacaacgacctggtgagctggttcgaggactgcaaggagggcaagatcgagggcatcgtgtggcactgcagcgacggctgcctgatcaaggtgcacagacaccacctgggcctgtgctggcccatccccgacacctacatgaacagcagacccgtgatcatcaacatgaacctgaacaagtgcgacagcgccttcgacatcaagtgcctgttcaaccacttcctgaagatcgacaaccagaagttcgtgagactgaaggacatcatcttcgacgtgtag

SEQ ID NO: 18779 - DNA, 1359 bp, Artificial Sequence
  Description of Artificial Sequence: Synthetic coding sequence
atgctggcctgcctgcagagaacccagaacgcccccggccagcacctggcctgccccagcaagagcctggagctgagaaagtgcgaggccgtggccagcgccatgcacagcagcagataccccagccccgccgagctggacgcctacgccgagaaggtggccaacagccccctgagcatcaagatcttccccaccaacatcagagtgccccagcacaagcacctgagcagaaccgtgaacggctacgacaccagcggccagagatacagcccctacccccagcacaccgccggctaccagggcctgctggccatcgtgaaggccgccgtgagcagcagcagcaccgccgcccccgccggccccgccaagagcgtgctgaagagcgccgagggcaagagaaccaagctgagccccgccgccgtgcaggtgggcatcgccccctaccccgtgcccagcaccctgggccccctggcctaccccaagccccccgaggcccccgcccccccccccggcctgcccgccgccgccaccgccgccagcgtgatccccctgcccggcagaggcctgcccctgccccccagcaacctgcccagcatccacagcctgctgtaccagctgaaccagcagtgccaggcccccggcgccgccccccccgcctgccagggcatggccatcccccaccccagccccgccaagcacggccccgtgcccagcttccccagcatggcctacagcgccgccgccggcctgcccgactgcagaaagggcaccgagctgggccagggcgccacccaggccctgaccctggccggcgccgccaagcccgccggctacgccgacagcggcctggactacctgctgtggccccagaagcccccccccccccccccccagcccctgagagcctacagcggcagcaccgtggccagcaagagccccgaggcctgcggcggcagagcctacgagagagccagcggcagccccctgaactgcggcgtgggcctgcccaccagcttcaccgtgggccagtacttcgccgccccctggaacagcgtgctggtgacccccaccagcgactgctacaaccccgccgccgccgtggtggtgaccgagctgggccccggcgccgccagagagctggccggcccccccgccgacgccctgagcggcctgcccagcaagagcgtgtgcaacaccagcgtgctgagcagcagcctgcagagcctggagtacctgatcaacgacatcagacccccctgcatcaaggagcagatgctgggcaagggctacgagaccgtggccgtgcccagactgctggaccaccagcacgcccacatcagactgcccgtgtacagatag

SEQ ID NO: 18780 - DNA, 1359 bp, Artificial Sequence; identical to SEQ ID NO: 18779
  Description of Artificial Sequence: Synthetic coding sequence

SEQ ID NO: 18781 - DNA, 5244 bp, Artificial Sequence
  Description of Artificial Sequence: Synthetic coding sequence
atgaactggaacgagaagcccaagagcgccaccctgccccccctgtaccccaagagccagccccccttcctgcaccagagcctgatcaaccagatcaccaccaccagccagagcagcttcagctaccccggcagcaaccaggaggcctgcatgtaccccggcaacagcaaccccatcagccagcccctgctgaacatccagaactacccccagcagatcagcgtgagcgacatgcacaacggcaccgtggtggccagccacaccagcgtggagagaatcacctacgccaacgtgaacggccccaagcagctgacccacaacctgcagatgagcagcggcgtgacccagaacgtgtggctgaacagccccatgagaaaccccgtgcacagccacatcggcgccaccgtgagccaccagaccgacttcggcgccaacgtgcccaacatgcccgccctgcagagccagctgatcaccagcgacacctacagcatgcagatgcagatgatccccagcaacagcaccagactgcccgtggcctaccagggcaaccagggcctgaaccagagcttcagcgagcagcaggtggactggacccagcagtgcatcagcaagggcctgacctaccccgactacagacccccccccaagctgtacagatacagcccccagagcttcctgcccgacagcaccatccagaagcagaacttcatcccccacaccagcctgcaggtgaagaacagccagctgctgaacagcgtgctgaccctgcccagcagacagaccagcgccgtgcccagccagcagtacgccacccagaccgacaagagaccccccccccccccctacaactgcagatacggcagccagcccctgcagagcacccagcacatcaccaagcacctgagcatggaggtgccccagagcagagagatgctgagcagcgagatcagaaccagcttccagcagcagtggcagaaccccaacgagaacgtgagcaccatcggcaacttcaccaacctgaaggtgaacaccaacagcaagcagcccttcaacagccccatcagaagcagcgtggacggcgtgcagaccctggcccagaccaacgaggagaagatcatggacagctgcaaccccaccagcaaccaggtgctggacaccagcgtggccaaggagaagctggtgagagacatcaagaccctggtggagatcaagcagaagttcagcgagctggccagaaagatcaagatcaacaaggacctgctgatggccgccggctgcatcaagatgaccaacaccagctacagcgagcccgcccagaacagcaagctgagcctgaagcagaccgccaagatccagagcggcccccagatcacccccgtgatgcccgagaacgccgagagacagacccccaccgtggtggagagcgccgagaccaacaagacccagtgcatgctgaacagcgacatccaggaggtgaactgcagaagattcaaccaggtggacagcgtgctgcccaaccccgtgtacagcgagaagagacccatgcccgacagcagccacgacgtgaaggtgctgaccagcaagaccagcgccgtggagatgacccaggccgtgctgaacacccagctgagcagcgagaacgtgaccaaggtggagcagaacagccccgccgtgtgcgagaccatcagcgtgcccaagagcatgagcaccgaggagtacaagagcaagatccagaacgagaacatgctgctgctggccctgctgagccaggccagaaagacccagaagaccgtgctgaaggacgccaaccagaccatccaggacagcaagcccgacagctgcgagatgaaccccaacacccagatgaccggcaaccagctgaacctgaagaacatggagacccccagcaccagcaacgtgagcggcagagtgctggacaacagcttctgcagcggccaggagagcagcaccaagggcatgcccgccaagagcgacagcagctgcagcatggaggtgctggccacctgcctgagcctgtggaagaagcagcccagcgacaccgccaaggagaaggagtgcgacaagctgagaaccaacaccaccgccgtgggcatcagcaagcccgccaacatccacgtgaagagcccctgcagcgtggtgggcaacagcaacagccagaacaagatcagcaaccccagccagcagaccgccctgagcatggtgatgcacaactacgagagcagcggcatcaacatcaccaagggcaccgagctgcagatcgccgtggtgagccccctggtgctgagcgaggtgaagaccctgagcgtgaagggcatcacccccgccgtgctgcccgagaccgtgtaccccgtgatcaaggagggcagcgtgtgcagcctgcagaaccagctggccgagaacgccaaggccaccgccgccctgaaggtggacgtgagcggccccgtggccagcaccgccaccagcaccaagatcttccccctgacccagaaggagaagcagaacgagagcaccaacggcaacagcgaggtgacccccaacgtgaaccagggcaagcacaacaagctggagagcgccatccacagccccatgaacgaccagcagatcagccaggagagcagaaacagcaccgtggtgagcagcgacaccctgcagatcgacaacatctgcagcctggtggagggcgacaccagctacaacagccagatcgccaagatcttcagcagcctgcccctgaagatggtggagccccagaagcccagcctgcccaaccagcagggcatcggcagcagagagcccgagaagcagctggacaacaccaccgagaacaaggacttcggcttccagaaggacaagcccgtgcagtgcaccgacgtgagccacaagatctgcgaccagagcaagagcgagccccccctggagagcagcttcaacaacctggagaccaacagagtgatcctggagaagagcagcctggagcacgccaccgagaagagcaccgccaacgacacctgcagcagcgccgccatccaggaggacatctacccccaggagatcgacgccagcagcaactacaccccccaggaccccgccagaaacgagatccacagcgacaaggcccccgtgctgtacctgcacgaccagctgagcgagctgctgaaggagttcccctacggcatcgaggccgtgaacaccagagagggcagcgtgggccagcagaccacctaccagaccagcgaggaccagaccgccgacaagaccagcagcgacagcaaggaccccgccgaccagatccagatcaccatcctgagcagcgagcagatgaaggagatcttccccgagcaggacgaccagccctacgtggtggacaagctggccgagccccagaaggaggagcccatcaccgaggtggtgagccagtgcgacctgcaggcccccgccgccggccagagcagagacagcgtgatcctggacagcgagaaggacgacatccactgctgcgccctgggctggctgagcatggtgtacgagggcgtgccccagtgccagtgcaacagcatcaagaacagcagcagcgaggaggagaagcagaaggagcagtgcagccccctggacaccaacagctgcaagcagggcgagagaaccagcgacagagacgtgaccgtggtgcagttcaagagcctggtgaacaaccccaagaccccccccgacggcaagagccacttccccgagctgcaggacgacagcagaaaggacacccccaagaccaagcacaagagcctgcccagaaccgagcaggagctggtggccggccagttcagcagcaagtgcgacaagctgaaccccctgcagaaccacaagagaaagaagctgagattccacgaggtgaccttccacagcagcaacaagatgaccgccagctacgagcaggccagccaggagaccagacagaagaagcacgtgacccagaacagcagacccctgaagaccaagaccgccttcctgcccaacaaggacgtgtacaagaagcacagcagcctgggccagagcctgagccccgagaagatcaagctgaagctgaagagcgtgagcttcaagcagaagagaaagctggaccagggcaacgtgctggacatggaggtgaagaagaagaagcacgacaagcaggagcagaagggcagcgtgggcgccaccttcaagctgggcgacagcctgagcaaccccaacgagagagccatcgtgaaggagaagatggtgagcaacaccaagagcgtggacaccaaggccagcagcagcaagttcagcagaatcctgacccccaaggagtacctgcagagacagaagcacaaggaggccctgagcaacaaggccagcaagaagatctgcgtgaagaacgtgccctgcgacagcgagcacatgagacccagcaagctggccgtgcaggtggagagctgcggcaagagcaacgagaagcacagcagcggcgtgcagaccagcaaggagagcctgaacggcctgaccagccacggcaagaacctgaagatccaccacagccaggagagcaagacctacaacatcctgagaaacgtgaaggagaaggtgggcggcaagcagcccgacaagatctggatcgacaagaccaagctggacaagctgaccaacatcagcaacgaggcccagttcagccagatgcccccccaggtgaaggaccagaagaagctgtacctgaacagagtgggcttcaagtgcaccgagagagagagcatcagcctgaccaagctggagagcagccccagaaagctgcacaaggacaagagacaggagaacaagcacaagaccttcctgcccgtgaagggcaacaccgagaagagcaacatgctggagttcaagctgtgccccgacatcctgctgaagaacaccaacagcgtggaggagagaaaggacgtgaagccccaccccagaaaggagcaggcccccctgcaggtgagcggcatcaagagcaccaaggaggactggctgaagttcgtggccaccaagaagagaacccagaaggacagccaggagagagacaacgtgaacagcagactgagcaagagaagcttcagcgccgacggcttcgagatgctgcagaaccccgtgaaggacagcaaggagatgttccagacctacaagcagatgtacctggagaagagaagcagaagcctgggcagcagccccgtgaagtag

SEQ ID NO: 18782 - DNA, 2028 bp, Artificial Sequence
  Description of Artificial Sequence: Synthetic coding sequence
atgaactggaacgagaagcccaagagcgccaccctgccccccctgtaccccaagagccagccccccttcctgcaccagagcctgatcaaccagatcaccaccaccagccagagcagcttcagctaccccggcagcaaccaggaggcctgcatgtaccccggcaacagcaaccccatcagccagcccctgctgaacatccagaactacccccagcagatcagcgtgagcgacatgcacaacggcaccgtggtggccagccacaccagcgtggagagaatcacctacgccaacgtgaacggccccaagcagctgacccacaacctgcagatgagcagcggcgtgacccagaacgtgtggctgaacagccccatgagaaaccccgtgcacagccacatcggcgccaccgtgagccaccagaccgacttcggcgccaacgtgcccaacatgcccgccctgcagagccagctgatcaccagcgacacctacagcatgcagatgcagatgatccccagcaacagcaccagactgcccgtggcctaccagggcaaccagggcctgaaccagagcttcagcgagcagcaggtggactggacccagcagtgcatcagcaagggcctgacctaccccgactacagacccccccccaagctgtacagatacagcccccagagcttcctgcccgacagcaccatccagaagcagaacttcatcccccacaccagcctgcaggtgaagaacagccagctgctgaacagcgtgctgaccctgcccagcagacagaccagcgccgtgcccagccagcagtacgccacccagaccgacaagagaccccccccccccccctacaactgcagatacggcagccagcccctgcagagcacccagcacatcaccaagcacctgagcatggaggtgccccagagcagagagatgctgagcagcgagatcagaaccagcttccagcagcagtggcagaaccccaacgagaacgtgagcaccatcggcaacttcaccaacctgaaggtgaacaccaacagcaagcagcccttcaacagccccatcagaagcagcgtggacggcgtgcagaccctggcccagaccaacgaggagaagatcatggacagctgcaaccccaccagcaaccaggtgctggacaccagcgtggccaaggagaagctggtgagagacatcaagaccctggtggagatcaagcagaagttcagcgagctggccagaaagatcaagatcaacaaggacctgctgatggccgccggctgcatcaagatgaccaacaccagctacagcgagcccgcccagaacagcaagctgagcctgaagcagaccgccaagatccagagcggcccccagatcacccccgtgatgcccgagaacgccgagagacagacccccaccgtggtggagagcgccgagaccaacaagacccagtgcatgctgaacagcgacatccaggaggtgaactgcagaagattcaaccaggtggacagcgtgctgcccaaccccgtgtacagcgagaagagacccatgcccgacagcagccacgacgtgaaggtgctgaccagcaagaccagcgccgtggagatgacccaggccgtgctgaacacccagctgagcagcgagaacgtgaccaaggtggagcagaacagccccgccgtgtgcgagaccatcagcgtgcccaagagcatgagcaccgaggagtacaagagcaagatccagaacgagaacatgctgctgctggccctgctgagccaggccagaaagacccagaagaccgtgctgaaggacgccaaccagaccatccaggacagcaagcccgacagctgcgagatgaaccccaacacccagatgaccggcaaccagctgaacctgaagaacatggagacccccagcaccagcaacgtgagcggcagagtgctggacaacagcttctgcagcggccaggagagcagcaccaagggcatgcccgccaagagcgacagcagctgcagcatggaggtgctggccacctag

SEQ ID NO: 18783 - DNA, 108 bp, Artificial Sequence
  Description of Artificial Sequence: Synthetic coding sequence
atgaactggaacgagaagcccaagagcgccaccctgccccccctgtaccccaagagccagccccccttcctgcaccagagcctgatcaaccagatcaccaccacctag

SEQ ID NO: 18784 - DNA, 417 bp, Artificial Sequence
  Description of Artificial Sequence: Synthetic coding sequence
atggagagattcctgaacagcaaggccagaagactgggcagctgcagccaccccgccttctacctgctgtgcgtgcccgacgaggacaccagctgcagcaccatctacctgcccctgaagagaagagccgaccccgaccagctgttcagcgacctgctgggcggcacccagagactgtggagcaacagattcggcaacgaggagagcttccccggcagagtgagagccctggtggacaccttctgctggatcgccagagccccccccctgggcaaccccctgagactggaggagagaatcgcctggagaatccagagactgaagagcggccagaccgccctgatcgagaagaagaagcagaagatcgaggaggacgtgagacaccagtgccagcagaccacctgcgacagatgctag

SEQ ID NO: 18785 - DNA, 417 bp, Artificial Sequence; identical to SEQ ID NO: 18784
  Description of Artificial Sequence: Synthetic coding sequence

SEQ ID NO: 18786 - DNA, 1659 bp, Artificial Sequence
  Description of Artificial Sequence: Synthetic coding sequence
atgaagaagaacagagagagattctgcaacagagagagagagttcgtgtacaagttcaaggtgggcagccagtgcctggagctgagagtgcccctgaagttccccgtgcaggagaacgccagccacctgcacggcagactgatgctgctgcacagcctgccctgcttcatcgagaaggacctgaaggaggccctgacccagttcatcgaggaggagagcctgagcgactacgacagagacgccgaggccagcctggccgccgtgaagagcggcgaggtggacctgcaccagctggccagcacctgggccaaggcctacgccgagaccaccctggagcacgccagacccgaggagcccagctgggacgaggacttcgccgacgtgtaccacgacctgatccacagccccgccagcgagaccctgctgaacctggagcacaactacttcgtgagcatcagcgagctgatcggcgagagagacgtggagctgaagaagctgagagagagacagggcatcgagatggagaaggtgatgcaggagctgggcaagagcctgaccgaccaggacgtgaacagcctggccgcccagcacttcgagagccagcaggacctggagaacaagtggagcaacgagctgaagcagagcaccgccatccagaagcaggagtaccaggagtgggtgatcaagctgcaccaggacctgaagaaccccaacaacagcagcctgagcgaggagatcaaggtgcagcccagccagttcagagagagcgtggaggccatcggcagaatctacgaggagcagagaaagctggaggagagcttcaccatccacctgggcgcccagctgaagaccatgcacaacctgagactgctgagagccgacatgctggacttctgcaagcacaagagaaaccacagaagcggcgtgaagctgcacagactgcagaccgccctgagcctgtacagcaccagcctgtgcggcctggtgctgctggtggacaacagaatcaacagctacagcggcatcaagagagacttcgccaccgtgtgccaggagtgcaccgacttccacttccccagaatcgaggagcagctggaggtggtgcagcaggtggtgctgtacgccagaacccagagaagaagcaagctgaaggagagcctggacagcggcaaccagaacggcggcaacgacgacaagaccaagaacgccgagagaaactacctgaacgtgctgcccggcgagttctacatcaccagacacagcaacctgagcgagatccacgtggccttccacctgtgcgtggacgaccacgtgaagagcggcaacatcaccgccagagaccccgccatcatgggcctgagaaacatcctgaaggtgtgctgcacccacgacatcaccaccatcagcatccccctgctgctggtgcacgacatgagcgaggagatgaccatcccctggtgcctgagaagagccgagctggtgttcaagtgcgtgaagggcttcatgatggagatggccagctgggacggcggcatcagcagaaccgtgcagttcctggtgccccagagcatcagcgaggagatgttctaccagctgagcaacatgctgccccagatcttcagagtgagcagcaccctgaccctgaccagcaagcactag

SEQ ID NO: 18787 - DNA, 1659 bp, Artificial Sequence; identical to SEQ ID NO: 18786
  Description of Artificial Sequence: Synthetic coding sequence

SEQ ID NO: 18788 - DNA, 1959 bp, Artificial Sequence
  Description of Artificial Sequence: Synthetic coding sequence
atgaactgggtgggcggcagcagaagcagagtgctgatcaagcaggagagaagaaagcagaaggagtacttcgagaagcacagactgaagagcaagatgaagagcctgggcgtgctgagccccgtgaagaacagcgccgtgagcctggacatcctgaacctgtacatggtgaaccagatcagctgcaagaagaagatccccgagaccgtgagaaagcccacccacgtgaacatgaacagagacatcaagatgcccctgagaaagcacaacctggagctgaccatgagcccccactgcgtgcccagcaagctgtgcctggacgacaccgagaccaacgtgaactgccagagactgagcagcaaggaggacctgggccccgtgcagagccagggcatggacagctacagcatgctgcacccccagttcagcaagatcgagaactgcagcttcacccccagcagcttcagcgtggagctgcccagcaacagacacatcagcaagctgaacttcaccagcggcatcgcccccaccccccagaagctggcctacgagaagaagcagaacgaccagagaagcaccgtgaactgcagcgacagcctgctgagcaagctgaacaagagccaggacgtgttcagccccagccacaagaccaccagattcggcaccctgttcgagagactgaacagcctgggcaacagaaacctgctgaccaagagccccgccgtgatcatggacgaggactgcagaagcaccgacgagatcagacagagcgactacatcaccgagaagcacagcatccagcacatctggggcaagaacggcaaggaggtgagcaacttcctggaggacgtgaaccagagcacccccaacctgctgagcgagaactgcgacagcttcgtgagccagaacatgatcaacgtgctgaacatcgacgagcagagaatcaagaagaccttcaacaagtgcgactacgacagcatgggcgacacctgcgtggtgaccagcagcgacaagaaccacgtgaccgacagatgcatcagaaacatcttcaccgtgcccgagctgaccttcagcaacagcaccctgaacaagaccagctaccccgagaagtgccagcccaacaagaagtaccagagagagtacaacaagaacgagagaaacgacctgagcaccagcttcgagaacgactactaccccagcagcagcgagagaaaggagaagttcgagaacgactaccaggagaagaccccccagaagagcatccagaagtaccccgccaacagcatgggcaacatccccagcgaggagctgcacagcaagcagagctgggacttcggcctggacgagatcctgatggaggagggcggcatctacagcctgaagagcaagagaatcagcaccaagaagatcagcctggacagcgcccagagcagcagaagcaccagctacagccccagacccaccgacagctgcttcagcagcagcagcgacctgcccagcgaggacgaggaccagatcagccagcagatcgaggacagcaacagaatgaccatcaagaccaaggagaagatgaacaacttctacgtggagagaatggccaagctgagcggcgacagaatcgtgaagaacgacgacaagatccacaagcagaacgagaacttctaccagttcagcgtgaagaacaacaccgaccagttcccccagctgcagtgcaacagcgcccacatcctgcagaacaagaccaacgacaactgcgtgctgcaggccgccagatgcgacgccggcatccagaccgagagcgagagcgtgatggaggagaagctggacgtggccatccagtgcgacctgatcagcaagtgcacctgcagaagcgacgtgagcctgtgcaacctggagagatgcagcggcaacatcaaggccgacaccaccggcggccaggagatccacaagaacaactag

SEQ ID NO: 18789 - DNA, 1185 bp, Artificial Sequence
  Description of Artificial Sequence: Synthetic coding sequence
atgaacagagacatcaagatgcccctgagaaagcacaacctggagctgaccatgagcccccactgcgtgcccagcaagctgtgcctggacgacaccgagaccaacgtgaactgccagagactgagcagcaaggaggacctgggccccgtgcagagccagggcatggacagctacagcatgctgcacccccagttcagcaagatcgagaactgcagcttcacccccagcagcttcagcgtggagctgcccagcaacagacacatcagcaagctgaacttcaccagcggcatcgcccccaccccccagaagctggcctacgagaagaagcagaacgaccagagaagcaccgtgaactgcagcgacagcctgctgagcaagctgaacaagagccaggacgtgttcagccccagccacaagaccaccagattcggcaccctgttcgagagactgaacagcctgggcaacagaaacctgctgaccaagagccccgccgtgatcatggacgaggactgcagaagcaccgacgagatcagacagagcgactacatcaccgagaagcacagcatccagcacatctggggcaagaacggcaaggaggtgagcaacttcctggaggacgtgaaccagagcacccccaacctgctgagcgagaactgcgacagcttcgtgagccagaacatgatcaacgtgctgaacatcgacgagcagagaatcaagaagaccttcaacaagtgcgactacgacagcatgggcgacacctgcgtggtgaccagcagcgacaagaaccacgtgaccgacagatgcatcagaaacatcttcaccgtgcccgagctgaccttcagcaacagcaccctgaacaagaccagctaccccgagaagtgccagcccaacaagaagtaccagagagagtacaacaagaacgagagaaacgacctgagcaccagcttcgagaacgactactaccccagcagcagcgagagaaaggagaagttcgagaacgactaccaggagaagaccccccagaagagcatccagaagtaccccgccaacagcatctggtgcaccaagtgcagcgagttcaaggtgatcttcaccctgatccactacgtgctgatgctgaacctgttcctgaagagcctgagaaccgccttccaggccttcctgaacaacgacctgcagctgtag

SEQ ID NO: 18790 - DNA, 324 bp, Artificial Sequence
  Description of Artificial Sequence: Synthetic coding sequence
atgagcaccgtgatctgcatgaagcagagagaggaggagttcctgctgaccatcagacccttcgccaacagaatgcagaagagcccctgctacatccccatcgtgagcagcgccaccctgtgggacagaagcacccccagcgccaagcacatcccctgctacgagagaaccagcgtgccctgcagcagattcatcaaccacatgaagaacttcagcgagagccccaagttcagaagcctgcacttcctgaacttccccggcagccaccacggccaggccacccagaagctgcagggcgccatggtgctgcacctggaggagtag

SEQ ID NO: 18791 - DNA, 1083 bp, Artificial Sequence
  Description of Artificial Sequence: Synthetic coding sequence
atgagcaccgtgatctgcatgaagcagagagaggaggagttcctgctgaccatcagacccttcgccaacagaatgcagaagagcccctgctacatccccatcgtgagcagcgccaccctgtgggacagaagcacccccagcgccaagcacatcccctgctacgagagaaccagcgtgccctgcagcagattcatcaaccacatgaagaacttcagcgagagccccaagttcagaagcctgcacttcctgaacttccccgtgttccccgagagaacccagaacagcatggcctgcaagagactgctgcacacctgccagtacatcgtgcccagatgcagcgtgagcaccgtgagcttcgacgaggagagctacgaggagttcagaagcagccccgcccccagcagcgagaccgacgaggcccccctgatcttcaccgccagaggcgagaccgaggagagagccagaggcgcccccaagcaggcctggaacagcagcttcctggagcagctggtgaagaagcccaactgggcccacagcgtgaaccccgtgcacctggaggcccagggcatccacatcagcagacacaccagacccaagggccagcccctgagcagccccaagaagaacagcggcagcgccgccagacccagcaccgccatcggcctgtgcagaagaagccagacccccggcgccctgcagagcaccggccccagcaacaccgagctggagcccgaggagagaatggccgtgcccgccggcgcccaggcccaccccgacgacatccagagcagactgctgggcgccagcggcaaccccgtgggcaagggcgccgtggccatggcccccgagatgctgcccaagcacccccacacccccagagacagaagaccccaggccgacaccagcctgcacggcaacctggccggcgcccccctgcccctgctggccggcgccagcacccacttccccagcaagagactgatcaaggtgtgcagcagcgccccccccagacccaccagaagattccacaccgtgtgcagccaggccctgagcagacccgtggtgaacgcccacctgcactag

SEQ ID NO: 18792 - DNA, 1083 bp, Artificial Sequence; identical to SEQ ID NO: 18791
  Description of Artificial Sequence: Synthetic coding sequence

SEQ ID NO: 18793 - DNA, 624 bp, Artificial Sequence
  Description of Artificial Sequence: Synthetic coding sequence
atgagcaccgtgatctgcatgaagcagagagaggaggagttcctgctgaccatcagacccttcgccaacagaatgcagaagagcccctgctacatccccatcgtgagcagcgccaccctgtgggacagaagcacccccagcgccaagcacatcccctgctacgagagaaccagcgtgccctgcagcagattcatcaaccacatgaagaacttcagcgagagccccaagttcagaagcctgcacttcctgaacttccccgtgttccccgagagaacccagaacagcatggcctgcaagagactgctgcacacctgccagtacatcgtgcccagatgcagcgtgagcaccgtgagcttcgacgaggagagctacgaggagttcagaagcagccccgcccccagcagcgagaccgacgaggcccccctgatcttcaccgccagaggcgagaccgaggagagagccagaggcgcccccaagcaggcctggaacagcagcttcctggagcagctggtgaagaagcccaactgggcccacagcgtgaaccccgtgcacctggaggcccagggcatccacatcagcagacacaccagacccaagggccagcccctgagcagccccaagtag

SEQ ID NO: 18794 - DNA, 558 bp, Artificial Sequence
  Description of Artificial Sequence: Synthetic coding sequence
atggaggtgcacggcaagcccaaggccagccccagctgcagcagccccaccagagacagcagcggcgtgcccgtgagcaaggagctgctgaccgccggcagcgacggcagaggcggcatctgggacagactgctgatcaacagccagcccaagagcagaaagaccagcaccctgcagaccgtgagaatcgagagaagccccctgctggaccaggtgcagaccttcctgccccagatggccagagccaacgagaagctgagaaaggagatggccgccgccccccccggcagattcaacatcgagaacatcgacggcccccacagcaaggtgatccagatggacgtggccctgttcgagatgaaccagagcgacagcaaggaggtggacagcagcgaggagagcagccaggacagcagcgagaacagcagcgagagcgaggacgaggacgacagcatccccagcgaggtgaccatcgacaacatcaagctgcccaacagcgagggcggcaagggcaagatcgaggtgctggacagccccgccagcaagaagaagaagtag

SEQ ID NO: 18795 - DNA, 1245 bp, Artificial Sequence
  Description of Artificial Sequence: Synthetic coding sequence
atggagatgcagcagaactgcagcatcagctgcttctgggagacccagcccctgggctgcgtgaagatcagctgcatcttctaccacagcaagcccagaaacatcaacggcctgttcctgccccccagcagcaacatcaccctgcagaaggagatccaggagggcatccccctgcagagccagagccaggagcccctgaagccccaggagaacatcagcagacccatccaccaccccctggtgctgaagaccaacttcgaggaggaggaggaggtggacgagcagaacgacgccagcagcctgtggaccaagacccccgaggagatcgaggagaagagagccatcaaggagatgtgctacaagagcggcgagtactacagattccacaccccccccgacatcctgagcagcaagagcatgacccccaccgccgagaagcagctggagaagcccctggagaacggcagcgagctgcaggagggcgacagcctgaccgtgcccaccaagctgagccagtacgagagacagggcgagatcaagaccagcctgcacggcaagcccaagaccgacatcgccgccttcgagaacggcggcggcgactgctacgtgccccagagagtgatcttcctgggcgtggacgagagcgaggccctgaccgaggagaaggagatcaccatcagcaagtgcagcaacaccaaggacaacaaggacagcccccaccccaagcacagcctgaccaccagactggtgcccaccacccacgtgctgaacgccaccgagaacatcagcatgaagtgcagagaggaccccagcagcatgaacgacgtgcagcccgtgaagaagccccacttcaagggcgtgaagaagagaaagtggatctacgacgagccccagaacttccccaacagcggcatgcagagagccgtgcaggcccccagaccccagaacaagatgagctaccacagaaacaacaagaacagaaacgccgagaacgccagctacatccacgtgcagagagacgccgtgagaaccgtggccctgaacgcccccagcagaagcagacccacccacggcagctacaacaaggtgcacgccaacagagagcccaagcccaacctgagccccgacaagtacaccagcaccagctacaacgacagcgcctggagaaagagaatccccttcagcaagacctacagcaagagcgagaagatctaccccgagcccagaagaaacggcagcaagtag

SEQ ID NO: 18796 - DNA, 294 bp, Artificial Sequence
  Description of Artificial Sequence: Synthetic coding sequence
atggagatgcagcagaactgcagcatcagctgcttctgggagacccagcccctgggctgcgtgaagatcagctgcatcttctaccacagcaagcccagaaacatcaacggcctgttcctgccccccagcagcaacatcaccctgcagaaggagatccaggagggcatccccctgcagagccagagccaggagcccctgaagccccaggagaacatcagcagacccatccaccaccccctggtgctgaagaccaacttcgaggaggaggaggaggtggacgagcagaacggctag

SEQ ID NO: 18797 - DNA, 384 bp, Artificial Sequence
  Description of Artificial Sequence: Synthetic coding sequence
atggcccagcacccctgccaggaccaggagcagaaggtggagatgaccagcaagcagcagagaagcaccagcatcgaggagaccatgagaccccaggagaagcaggtgaccatcaccgagaccctgtgggaccaggtgctgaccgtgttcaaggacatccagaaggagctgcaggaggacgccagaatcagaggcatgagcaactgcagcatgacccccatgaccagcgcccccagaaccggcagcatcagaccccccgacagcctgatgacccccaagctgagaagactgcagttcagcagcggcgagcagcccagcggcggcagaatccacaacctgaagacccagctgttcagccagagcgcctactaccccggcccctag

SEQ ID NO: 18798 - DNA, 384 bp, Artificial Sequence; identical to SEQ ID NO: 18797
  Description of Artificial Sequence: Synthetic coding sequence

SEQ ID NO: 18799 - DNA, 1389 bp, Artificial Sequence
  Description of Artificial Sequence: Synthetic coding sequence
atggccagccccctgcccagcggcttccccgccagaagaaacagcagactggacgtgttcctgagaagacacctgccccccgaggtgtacgacgccgtgagagcctacgagccctgcatcgtggtgagcaacagcgagaaccacatcctgaagtacgtggtgctgagcgacagactggtgtacctgaccgagaacccccccaagagcatcagaagagtggtggccctgagagacgtggtggccatcgacctgatcgacgactaccccgagttcctgagcagccccgacagagagatcagccagcacatcagaatcatctacagcagcaccgtgctgaagaaggagtgcaagaagagcaacagcgtgagaaagttcctgttccccttccaccacaccaaggccaacaacaagaaggtgaaggaggagaagaacggcctggccttctggagaagcaaggagagcagaagcctgaaggagagccccctgagaagcgaggagaagatcaagcacttcagccagctgaagagcgagctgttcctgaaggacaacagcctgagaagaatcctgagcctgctgatggagctgaaggtggccgcccagaagaacttcatcctgaagagactgttctggaagaccagcgacctgttctacttcatcgtgaacaagctgcacgagtacctgcccgagagcagagacaagaacgccctgcagaaccagagccagagagtggacgagctggtggcctgcatcgagatcatccagaccctggtgctgatgttcagagagaccgagaccgagagcagcagactgaacaccctggccgccaagaagggcgccctgttcaacctgctggtgatcctgatcagcgagccccagatccccaagagctgccccgtgttcgacatccagctggtggccgacagcgccctggtgagaatgagcttcgacgccgagctgcagaagctgatcctggagtacaccaacaccgccaccgccctgctgtacgagatcctgctggtgttccagcagggcaacctgggcctgggcagcaccaagttcgccatcagctggatcatgagcttcctgcagagctgcccccccatcatcaccttcgtggccagcatcgtgaagcaggtggtgagaggcctgagcgccagcttccagctgctgagcccctgccaggccgtgctgctgtaccagcagttctacatcctgaagagctgcctgagacacagcagaaccctggccgagtacatcagaaacaactacagagaggagttcagatacttcatccacatgcccgccctgcagaagagactgcccctgtgctaccccatcacccagcccaccatccagctgttccacgaggtgctgaagctggtggagtag

SEQ ID NO: 18800 - DNA, 1878 bp, Artificial Sequence
  Description of Artificial Sequence: Synthetic coding sequence
atggccagccccctgcccagcggcttccccgccagaagaaacagcagactggacgtgttcctgagaagacacctgccccccgaggtgtacgacgccgtgagagcctacgagccctgcatcgtggtgagcaacagcgagaaccacatcctgaagtacgtggtgctgagcgacagactggtgtacctgaccgagaacccccccaagagcatcagaagagtggtggccctgagagacgtggtggccatcgacctgatcgacgactaccccgagttcctgagcagccccgacagagagatcagccagcacatcagaatcatctacagcagcaccgtgctgaagaaggagtgcaagaagagcaacagcgtgagaaagttcctgttccccttccaccacaccaaggccaacaacaagaaggtgaaggaggagaagaacggcctggccttctggagaagcaaggagagcagaagcctgaaggagagcatcctgcccgacagagaccagcaggagagcagcacccccagcaaggacagcaccctgtgccccagacccggcctgaagaagctgagcctgcacggccagggcgccttcagacccctgcccagccccagcagaagaagcagccagagcgcccccaccaccggcaaggccgtgagcgagcccagctgcaccaccaacaccaaggagccccagggcctgcccgaccacaacagcatcagcgagatccccttcaagtgcaacggcaacggcaacgagttctacctgggcaacagcctgctggacagccccagccagagcaacagcaacctggagaagaaggagagcgagctgcacctgtacgtgatcagcaccaccagcagcatcttcctgcacctgaagagcagctggaacaactacatcatcgtgaaggccaccctgctgcaggaccccttctacgccagcgagttcagccccgccatcggcagccagaagccctacagaagcgaggagaagatcaagcacttcagccagctgaagagcgagctgttcctgaaggacaacagcctgagaagaatcctgagcctgctgatggagctgaaggtggccgcccagaagaacttcatcctgaagagactgttctggaagaccagcgacctgttctacttcatcgtgaacaagctgcacgagtacctgcccgagagcagagacaagaacgccctgcagaaccagagccagagagtggacgagctggtggcctgcatcgagatcatccagaccctggtgctgatgttcagagagaccgagaccgagagcagcagactgaacaccctggccgccaagaagggcgccctgttcaacctgctggtgatcctgatcagcgagccccagatccccaagagctgccccgtgttcgacatccagctggtggccgacagcgccctggtgagaatgagcttcgacgccgagctgcagaagctgatcctggagtacaccaacaccgccaccgccctgctgtacgagatcctgctggtgttccagcagggcaacctgggcctgggcagcaccaagttcgccatcagctggatcatgagcttcctgcagagctgcccccccatcatcaccttcgtggccagcatcgtgaagcaggtggtgagaggcctgagcgccagcttccagctgctgagcccctgccaggccgtgctgctgtaccagcagttctacatcctgaagagctgcctgagacacagcagaaccctggccgagtacatcagaaacaactacagagaggagttcagatacttcatccacatgcccgccctgcagaagagactgcccctgtgctaccccatcacccagcccaccatccagctgttccacgaggtgctgaagctggtggagtag

SEQ ID NO: 18801 - DNA, 2328 bp, Artificial Sequence
  Description of Artificial Sequence: Synthetic coding sequence
ggcttcctgatccaccccctggtggtggccctgcagcagccccccctgcccgtgctgccccccctgcccctgcccccccccccccccccccccccctacggcagactgctggccaacagcaacgcccaccccggccccttcccccccagcaccggcgcccagagcaccgcccacccccccgtgagcacccaccaccaccaccaccagcagcagcagcagcagcagcagcagcagcagcagcagcagcagcagcagcagcagcaccacggcaacagcggcccccccccccccggcgccttcccccaccccctggagggcggcagcagccaccacgcccacccctacgccatgagccccagcctgggcagcctgagaccctacccccccggccccgcccacctgccccccccccacagccaggtgagctacagccaggccggccccaacggcccccccgtgagcagcagcagcaacagcagcagcagcaccagccagggcagctacccctgcagccaccccagccccagccagggcccccagggcgccccctaccccttcccccccgtgcccaccgtgaccaccagcagcgccaccctgagcaccgtgatcgccaccgtggccagcagccccgccggctacaagaccgccagcccccccggcccccccccctacggcaagagagcccccagccccggcgcctacaagaccgccaccccccccggctacaagcccggcagcccccccagcttcagaaccggcaccccccccggctacagaggcaccagcccccccgccggccccggcaccttcaagcccggcagccccaccgtgggccccggccccctgccccccgccggccccagcggcctgcccagcctgccccccccccccgccgcccccgccagcggcccccccctgagcgccacccagatcaagcaggagcccgccgaggagtacgagacccccgagagccccgtgccccccgccagaagccccagccccccccccaaggtggtggacgtgcccagccacgccagccagagcgccagattcaacaagcacctggacagaggcttcaacagctgcgccagaagcgacctgtacttcgtgcccctggagggcagcaagctggccaagaagagagccgacctggtggagaaggtgagaagagaggccgagcagagagccagagaggagaaggagagagagagagagagagagagagagaaggagagagagagagagaaggagagagagctggagagaagcgtgaagctggcccaggagggcagagcccccgtggagtgccccagcctgggccccgtgccccacagaccccccttcgagcccggcagcgccgtggccaccgtgcccccctacctgggccccgacacccccgccctgagaaccctgagcgagtacgccagaccccacgtgatgagccccggcaacagaaaccaccccttctacgtgcccctgggcgccgtggaccccggcctgctgggctacaacgtgcccgccctgtacagcagcgaccccgccgccagagagagagagagagaggccagagagagagacctgagagacagactgaagcccggcttcgaggtgaagcccagcgagctggagcccctgcacggcgtgcccggccccggcctggaccccttccccagacacggcggcctggccctgcagcccggcccccccggcctgcaccccttccccttccaccccagcctgggccccctggagagagagagactggccctggccgccggccccgccctgagacccgacatgagctacgccgagagactggccgccgagagacagcacgccgagagagtggccgccctgggcaacgaccccctggccagactgcagatgctgaacgtgaccccccaccaccaccagcacagccacatccacagccacctgcacctgcaccagcaggacgccatccacgccgccagcgccagcgtgcaccccctgatcgaccccctggccagcggcagccacctgaccagaatcccctaccccgccggcaccctgcccaaccccctgctgccccaccccctgcacgagaacgaggtgctgagacaccagctgttcgccgccccctacagagacctgcccgccagcctgagcgcccccatgagcgccgcccaccagctgcaggccatgcacgcccagagcgccgagctgcagagactggccctggagcagcagcagtggctgcacgcccaccaccccctgcacagcgtgcccctgcccgcccaggaggactactacagccacctgaagaaggagagcgacaagcccctgtag

SEQ ID NO: 18802 - DNA, 738 bp, Artificial Sequence
  Description of Artificial Sequence: Synthetic coding sequence
atgagcagcgagagcgagaaggacaaggagagactgatccaggccgccaagatgttcttcttccacgtgcaggacctggccagcgtgatcaacaccctgaccgagctgttcagcagaagcatgaacacccagatcctgctgatggccgtgaagaacaacagctacatcaaggacttcttcgagcagatgctgaagatcttcaaggagatgcagagcgtggtggacgccagacacgacaagatccagaaggagagcctgtgcagcaaggtggccatggccatgtgcagcgtggtgcagaagagcaccaacgtggaggagctgcaccagagcgccaaggaggtgttcaagagcgcccacacccccgtgatcatcagcgtgctgaacagcagcaacatcctgggcagcctggagagcagcctgagccacctgatgaagttccccatcatgaacctgcagctgagcgacttctacaccgaggacaccaaggagcagagcgacgtgaccaccagcgagagaaccagaagcccccccggcagcagcaagaccaccatgatcgacaccctgaagaagctgcaggacgtgctgaagaccgaggacagcaagaaccccaccaagagcgccgccgacctgctggagcagatcgtgaaggccatgggccccatcctggagatcctgcagaaggccatcaagaccatggagatgaacatcagcgtgttcaagaaggccagcgacaagtag

SEQ ID NO: 18803 - DNA, 396 bp, Artificial Sequence
  Description of Artificial Sequence: Synthetic coding sequence
atgggcggcaagagcgccgtgagacaccagctggtgctggactgccccagagaggccgccagcagcgcccccgccctgagacccctgggcgccgccgccaccagcagagccgcccccctggcccccctgcccgcccccagccccagatggggcctgggctgcggcagagtgagataccccggcccccaccccagaagagccgtggagcccgccgccggccccctgagcgcccccatcatcgccggcggccaccccgccgaggccgccgccggcagcgccaagcagcagcccagacacagcagagaggtgcccagaccccccgtgccccagcaccccagcggcaacagcagaagcgccctgcaggaggccaagaccgagcagaccaagaccccctag

SEQ ID NO: 18804 - DNA, 2418 bp, Artificial Sequence
  Description of Artificial Sequence: Synthetic coding sequence
atggccgcccagggcagccccagcagcagccccagcgacgacagcaccaccagcggcagcctgcccgagctgccccccaccagcaccgccaccagcagaagcccccccgagagcaagggcagcagcagaagcagcctgctgcagtggacctgccccgaggacagcctgcccctggccgtgttctacggccccctggacgccaagaaccccctgctggccagctgcgagaaggagatccaggagctgctgggcttcatgagaaagaagaaggccctggccaccaccgaggaggagaagcacgagttcagaagaagatgcgccaccagcctgttcaacatctggaccaagtacgcccccagactgcccgccgactactacaacgagaagctgctgaaggtgggcgacagcctgtgccagatgaaggagtacaagctggccctgctgcagtgctacggcagatacctgcagcagttcaacaccaacttcgacgagaacaaggtggacgtgacccagttcaaggccaccttcttccccaagggcttcaaggacaagaccgccggcctgaccttccacgccctgagcggcaagaacatgtgcaactaccagctggtgtgcgacagcgacgagaacctgaagaacaaggagagcgtggtgcagtgcctgcacatcctgagcagcctgagactgatcatgcaggtggccctgccccaggagcacctgtgctggatcatcttcaacggcaccatctacatctacaccatctgcagaaagctgatggtgatcggccagagcagcaaggccctggagtacctgctgtgggccagcatgtgcatggagagcctggtgcccctgctgagcctgagatacctgacctggagagccaccctgtacaccgccgtgtgccagtgctgctacgactgccacgccggcatccacggcgaggccttcgccagaagagccctggccaagatcgacgagctgagacagctggagctgatgagcagcagcaagagccaggaggagagcagaagatacttcagagaggccaccatgaagatggccgtgatgatcttcaagagaggcgtgttcgagagcagaagaaagaacaaggccgtgttcagacccaagatcagaatcaacctgagagaggtgcagaccctgagctggcccagaaccgtgaccgagagactgctggacgagatgttcgacagcaccgccagccagttcctggccgtgctggaggccctgagcgacagcaacagaagaatcctgcagaccggccccatcgtgaccgacgaggtggagatccacgacgtggtgagcgagctgttcatggccggcaaggagctgctgatcatgagcaacatcggcgccgacggcatgctggacttccccaagaccagcctgctggagctgatgatcggcagaaaggacgtgatcagcgtggacgccgccgtgaagttcatcaagctggccttcacctacgaggagtggagcctgttcgagagcagcgccgtgcacctgatctacttcctgcagagacaggacgaccccgagagcaagaaggccgagaaggacctgaccctgctgatcgccatggagcccctgatcaacgtgaagagaaacaagggcctgatcttccccctggagaactacaaggagggccagagcacccagatctacctgaagaagatcgccgtgcacgacacctgcctgaagacctgcggctacagcgaggacatcttccacctggccgccaccctgtacgtgtgcgtgtgcaccgccccccaggacgtgcagcccgacaaggagatcgtggtggacaccatcatgttcctgtggcagaagtgcaagctgggcatccagagactgaacatcagcagaaacgactacgccaagttcacccagaagatcagcaccaacaagtggatctacctgctgtggcagatcaacgaggtgatccactgctacaagatggaggacatcgacatcgtggtggtggccgaggtgaccctgagactgagcgagatcctggagagcctgggcagccccggcagaaagttcaagcagagcctggacgtgcccctgagagagggcaccaacaagttccccggcgcccccaagggcatcaccgagatcctgcccatcctgcagaagaaccccgtggagcagctgctgttcgcctacaagctgctggacagagccatcggcggcatcaacctgaactgcatgctgaccagcctgcccaacggcagcagcgtgatcgaccactgctacgccaagagaacccaccacatcgacggcgacacctacaagcccctggccagcaacagcttcatgatggacctgcacctggagctgatccaggcccagcacagaatcgccgtggtgctgctggacaagctgcagggcagctag

SEQ ID NO: 18805 - DNA, 3594 bp, Artificial Sequence
  Description of Artificial Sequence: Synthetic coding sequence
atgagcgacgagaacatgagcaagacccagaccgtgtacgacagcgacagccagagcggcagcagcgccaaggagaaggacagaggcgccaacctgtgcgtgatggaccacttcatgaagatcttcctgtactgcagaagagccatggtgctggcccacagaggcggctactggaccctgctgcagaactgctgcagagccctgtggaacttcacccaggagctgcagatcctgctgaagcaggccgtggacctggacaagaccttccccatcagccaggacggcttcctgtgcaccagcgtgctgcccttctacctgggcgccgagctgctgatcgacatgctgatccagctgcagaacaccagcagcatcaagcccatcgaggacaagggcgagttcagcgtgcccagctgctacggcaacatcaagaacgacaacggcggcagcagcctgaccttcgagcaccccctggacgacgtgaacgtggtggacctgaagtggatccacgacttcgtgctgaagagcctggaggtgctgtaccaggtggagaagtgggagaccctggtgagcctggccatccagttcaacaccgtgagccacgagagatacaccgagcaggtgacccccctgctggtgtacgcccagagacagctgctgctgagaatccagaagttcaagggccccgacatcacccagcagccctgcgccagatacgaggccgagtacggcgagaagatcacctgcagaaacttcatcggcaagcagctgaagatcaacagcagcaccatcgaggccaccagcaactgcaccgacctgctgaagatgctgatcagcagcgagtacagcagagccaaggccctggtgtgcgtgcccgtggacgtgaccgacaccctgagatgcttcagagagaccctggagaagagcaagtaccacaacagaagcatcagacacagcagaaagctgctgagcctgttcctggcccagacccaggacgtgctgcaggccagcaaccagagaagcctgaaggtgcaggccctgcacagcctgggcagcctgctgatcttcgccgagaagaagagagccgccttcaagtgctggtgccaggccctggacgacatcttcagaaagcccgacgtgctgcacacctggaaggagttcggccccagcctgaccaacgtgaccaacagccacagcccccccggcttcaaggactacagcgaggagttcctgagcagagtgggcatctggggctgcctgcagggcgccgtgatcagcgccaagatcgcccagttcatcaagagcctgaacgtggagaagaagaccgactgctgcatcctgagcgccctgctgttccagggcctgctgagaaccaccctgccccaccccaaggccgagagatgctacgcccagtacgagatcacccagctgctgcccggcatcgagctgttcagcgacagatacagagccgacatctgcagcgtgatcgccagcctgtactacatcatcagagagctgcacttcgtgagacagaacctgatcgtgctgcccctgctggccctgtaccagtacttcgtgagcggcatctgccaggacatcaccagaaacctggaggccagaatcctgaagatcgaggtgctgatcgacctgagattcttcagcgaggccttctacgagatcagccagatcttctacggcaagaacatgccctgccccatccccgccggctacaaggccaccggcaagatgaagatcttccagagcttcgacagcggcaagctgctgaccagcaaggagaacatccaggccatcgacgagctgagaaacaagggcctgcccgccgtgctggtgaccatcggccagccccacctgctgaacaagttcaacttcgtgaaggcctacttcttcctgagcgtggccgccaccatcaactgcgtgcccgagaacaagttcaagaccgtgatcaccaacaagagcaagcccaacctgcccaacctggaggagatctacagcaaggacgacggcagcagcttctacaacctgaccaagctgaaggacgagatcaccctgagcatgctgaagagcatgctgctgatggaggccgaggacagactgaacttcctgctgagcgaggtggagcagaagaccctgagccagtgcagcgccggcgagctggagatcgtggtggaggccagactgcagctggccgccgtggccctgcagagacacagagccgcctacagcgccgccatcgtgttcagcaccctgaccctgctgcaggacagcaagctgttcgagaagaaggtggtgcaggacgacaccgagaaccccgtgagccccggcaccagcgtgaccgagaacaaggacgacagcgagttcctggaccccatcagcctgaacgccagagagtacttcaacatccacctgtggctgagatgcagactggccctggtgaccgccttcgtggcccagatccacggcatcggcatcgtgaaggaggacgacatgaccgactgcctgagcctgatcaacgaggtgtgcatggaggccaagagcgccggcgacaccgagctgcaggccgagttcctgacccaggccgtgatcctgggcctgcaggagaagcacctgaaggccgacatcatgaccaacctgcaggacatcatccacctgctggagggcaacgagttcatcagcccccagagcagactgaccctggccagaagcctggtgctgctggacgacctgaccaaggccgagaagttcaaggagagccccagcagcaagaccggcaagctgaacctgctgaccagagcccacagcatcctgaccgagcagatgctggccttcggcgagaccatcgagttcagaagcagcaacaccaagtacgccaaccccctgcagcccctgaagaacatctacctgccccacgtgatgctgctggccaagatcaagatgagaatcggccacaccgtggccaagcaggtgtactacaagaacaagagaaaggaccccagcaagtggctgcccgccctgcacctgttcgacgtggccctgaagctgtgcagaaccaccgccgtggaggagcacgaggtggaggccgagatcctgttccagaagggcaagatcgagagacagatcctgatggaggagaagagccccagcttccagctggagagcctgtacgaggccatccagctgagcctgaagaacgaccagaacagcggcctgatcagagacagctacctggagatggccctgctgtacttccacctgaagaagcccaagatcaagatcagcggcagccccctgaccctgaagccccccctgagaagaagcagcagcgtgaaggagaccagcgccaacaagttcgagatgtacagcagcctggcctggatcgccatcagagccgccgcccaggtgagcgaggccgtgctggccatcaacctgctgatcggcaagaagaacaccagaatgcacaaggtgaaccaggtggccctgcccaacatccccgagttcgccgccctggacctgctgagcagctacaccgactacctgctgggcatgttcggctgcctgcacatcatgcagaagaactag

SEQ ID NO: 18806 - DNA, 1338 bp, Artificial Sequence
  Description of Artificial Sequence: Synthetic coding sequence
atgggcgagagcatccccctggccgcccccgtgcccgtggagcaggccgtgctggagaccttcttcagccacctgggcatcttcagctacgacaaggccaaggacaacgtggagaaggagagagaggccaacaagagcgccggcggcagctggctgagcctgctggccgccctggcccacctggccgccgccgagaaggtgtaccacagcctgacctacctgggccagaagctgggcggccagagcttcttcagcagaaaggacagcatcagaaccatctacaccagcctgcacaacgagctgaagaaggtggtgaccggcagaggcgccctgggcggcaccgccccccacgtggaggagctgctgagccacctgagcgagcagctgtgcttcttcgtgcaggccagaatggagatggccgacttctacgagaagatgtacaccctgagcacccagaagttcatcaacgccgaggagctggtgggcctgctggacgccatcatgaagaagtacagcagcagattccaccaccccatcctgagccccctggagagcagcttccagctggaggtggacgtgctgtgccacctgctgaaggcccaggcccaggtgagcgagtggaagttcctgcccagcctggtgaacctgcacagcgcccacaccaagctgcagacctggggccagatcttcgagaagcagagagagaccaagaagcacctgttcggcggccagagccagaaggccgtgcagcccccccacctgttcctgtggctgatgaagctgaagaacatgctgctggccaagttcagcttctacttccacgaggccctgagcagacagaccaccgccagcgagatgaagaccctgaccgccaaggccaaccccgacttcttcggcaagatcagcagcttcatcagaaagtacgacgccgccaacgtgagcctgatcttcgacaacagaggcagcgagagcttccagggccacggctaccaccacccccacagctacagagaggcccccaagggcgtggaccagtaccccgccgtggtgagcctgcccagcgacagacccgtgatgcactggcccaacgtgatcatgatcatgaccgacagaaccagcgacctgaacagcctggagaaggtggtgcacttctacgacgacaaggtgcagagcacctacttcctgaccagacccgagccccacttcaccatcgtgatcatcttcgagagcaagaagagcgagagagacagccacttcatcagcttcctgaacgaggtgagcctggccctgaagaaccccaaggtgttcgccagcctgaagcccggcgccaagggctag

SEQ ID NO: 18807 - DNA, 1032 bp, Artificial Sequence
  Description of Artificial Sequence: Synthetic coding sequence
atggccctgacccccaccaacctgaacaacaagatgagcctgcagatgaagatggactgccaggagcagcagctgaccaagaagaacaacggcttcttccagaagctgaacgtgaccgagggcgccatgcaggacctgctgaaggagatcatcaaggtggaccacatcctggacagaagcgacgacgaggacgacatcagcagcgagaacccccagaccgacttcctgcacaagggcatgctggagctggaggccgagcacgaccaggacctgagcaagcaggacaagcaggagaccgacgtggacgaggacccccaggccagcaccagcctgcagttcagcaagaagaacctgctggagctgtgcctgaagggcatgttcctgaagctgaactactggaacaccaagatcggcctgcaggtgaaggagctgggcgccgactacatcgacggcaccgagaagatcgacaacatcatcaagaagatcaacgtgaccgagaacaccgtgaagagcctgctgaaggacatgctgaccctgaagggccagatcgagaagctggaggacagaggcctggacctggaccagggcaccagcaccgaggtgaacacctgcaacgaggtgtacgagctgaagaagaaggtgatcgagagactggaggacctgtgcaagaacgtggagctgctgagcgccaagctgagaatgtaccagatggaggccgaggacaccgacagccacagcagcgaggagatcgacaccgaggagatggaggccctgctgccccaggcccccgccagcttcctggtgcagaagagcccccccagaaacaccgcctggaagagagccctgagaatcttcatcatgttcgacgtgctgaccgtgaccggcctgctgtgctacatcctgttcttcggcgccaccttcctgttcgagagagtgctgctgagaatgctgggctgcagaaccacctgggacctgagagagatgagagagcccttcctgaacctggaggtggaggccctgctgcccagctag

SEQ ID NO: 18808 - DNA, 1032 bp, Artificial Sequence; identical to SEQ ID NO: 18807
  Description of Artificial Sequence: Synthetic coding sequence

SEQ ID NO: 18809 - DNA, 906 bp, Artificial Sequence
  Description of Artificial Sequence: Synthetic coding sequence
atggcctacagcagcagcaacagcgacatcgaggacgacagcagcaagagcaacagcaacctgagcctgagcgtgggctacttcccctgcgaggacaccccctgcgaggacaccaccagctgggaggacgcccccagcaagggccccagcatccacttcctgccccccgtgcagggcgcctggggcaccgagagaatcggcagaagaatgaagagacaggaccagatccaggacgagcccgagcagttctgcaagctgagcatcttcctggcctgggacgtggacatcggcagcgacaacaccgacagcagagccaacagactgctgaacggcgacaacctgtggatcgacaagctgcccaaggagagaaccaagctgagcgtgggcaagctgaacaacctggtgcaggagttccagatcttcctggagaacctgaaggacgacgacgccgtgttccccgagaccgcccagcaggacttccagctgagcagcggcagcccccccgagatggtgcaggtgagccaccaggagtacgacgcctgccaggacctgcccaagtgcaagccccccgagaacaaggacgtgatgctgaagggccacgagctggccgagatgatcagccaggccaccgccagccagagaaccagcgcccccgagatcagcagcatcctgagcgagcagcccgagaaggacgacacccccagccacacccaggcccagtgctgcctgaacttcggctgggccttcagctggctgagacagagaatcctgcccagcctgctgagaagagaccaccccgtgaacgccaccaagagcccccacagaagcgcccccaccaagagactgttccacagaggcaagagaatccagccccaggagaccctggagctgggccaccccatctag

SEQ ID NO: 18810 - DNA, 810 bp, Artificial Sequence
  Description of Artificial Sequence: Synthetic coding sequence
atggcctacagcagcagcaacagcgacatcgaggacgacagcagcaagagcaacagcaacctgagcctgagcgtgggctacttcccctgcgaggacaccccctgcgaggacaccaccagctgggaggacgcccccagcaagggccccagcatccacttcctgccccccgtgcagggcgcctggggcaccgagagaatcggcagaagaatgaagagacaggaccagatccaggacgagcccgagcagttctgcaagctgagcatcttcctggcctgggacgtggacatcggcagcgacaacaccgacagcagagccaacagactgctgaacggcgacaacctgtggatcgacaagctgcccaaggagagaaccaagctgagcgtgggcaagctgaacaacctggtgcaggagttccagatcttcctggagaacctgaaggacgacgacgccgtgttccccgagaccgcccagcaggacttccagctgagcagcggcagcccccccgagatggtgcagatgatcagccaggccaccgccagccagagaaccagcgcccccgagatcagcagcatcctgagcgagcagcccgagaaggacgacacccccagccacacccaggcccagtgctgcctgaacttcggctgggccttcagctggctgagacagagaatcctgcccagcctgctgagaagagaccaccccgtgaacgccaccaagagcccccacagaagcgcccccaccaagagactgttccacagaggcaagagaatccagccccaggagaccctggagctgggccaccccatctag

SEQ ID NO: 18811 - DNA, 573 bp, Artificial Sequence
  Description of Artificial Sequence: Synthetic coding sequence
atggagaagaccgagagcttctgccccgaggtgcccccccaggactgcggcgccagccccagacccagcctgagaagcctgcccaagaaccagggcagcctgctgcagttcgacagacaggcccccggcagaatcagcaccagccccaccctgagaagactgagaaccagaggctgcggcaccagacaggacgcctggcaggtgaccacctggggcagctggggcgcccccgtgggcttcccctgctacctgagcaagagcctgcccggcagccccaaggacagcagccacctgctgagccccctgagactgcacagcagactgaccagcgagcccgagagagccctgaacgccgccgacagcctggagccccagaccagacccaccgacaagtacctgccccccgagctgcagcccgtgaacgagggcagcctgcaccaggccagcctgagacagcaggagggccacttcctgcccagccccaccctgagacaccccagcccccagggcgaggagctgcaccccagcagatgcgtgtgcatctacttcctgagatgctacgacatctgctag

SEQ ID NO: 18812 - DNA, 522 bp, Artificial Sequence
  Description of Artificial Sequence: Synthetic coding sequence
atggagaagaccgagagcttctgccccgaggtgcccccccaggactgcggcgccagccccagacccagcctgagaagcctgcccaagaaccagggcagcctgctgcagttcgacagacaggcccccggcagaatcagcaccagccccaccctgagaagactgagaaccagaggctgcggcaccagacaggacgcctggcaggtgaccacctggggcagctggggcgcccccgtgggcttcccctgctacctgagcaagagcctgcccggcagccccaaggacagcagccacctgctgagccccctgagactgcacagcagactgaccagcgagcccgagagagccctgaacgccgccgacagcctggagccccagaccagacccaccgacaagtacctgccccccgagctgcagcccgtgaacgagggcagcctgcaccaggccagcctgagacagcaggagggccacttcctgcccagccccaccctgagacaccccagcccccaggtgacccagctgtag

SEQ ID NO: 18813 - DNA, 192 bp, Artificial Sequence
  Description of Artificial Sequence: Synthetic coding sequence
atgggctgcggcaacagcaccgccaccagcgccggcgccggccagggccccgccggcgccgccaaggacgtgaccgaggagagcgtgaccgaggacgacaagagaagaaactacggcggcgtgtacgtgggcctgcccagcgaggccgtgaacatggtgagcagccagaccaagaccgtgagaaagaactag

SEQ ID NO: 18814 - DNA, 408 bp, Artificial Sequence
  Description of Artificial Sequence: Synthetic coding sequence
atgttccagaacctgcagggcaccttcgagaaggagatcggcaagatcatccccttcaccatcgccttcaagagagccgaggccgtggagcccgacggctgcgtgcagagctggagatgctgcctgccctgcgacctgggccaggccagcagattcatccacaccaccgtgtgcagcgccatcagatggagaagctgcaagggcgagagaaacttcgccgagagacacatcctgcccgccgagctggaggagcagagcaaccacgccggcatgggccccatcctgcccgccatgcccagcgtggacggcaaccacttccagcaccccgccggcgactgccacccctacggcatcctgtgcctgcaggcccacagcgccagcgtgaccgccagacaggtgctgcagtag

SEQ ID NO: 18815 - DNA, 438 bp, Artificial Sequence
  Description of Artificial Sequence: Synthetic coding sequence
atgatccccaagctggccacccccagagacatcagcctgctggtgatcaaggaggccagcagcagagccagaaacaacatccagatcctggaccccctggaccacatcgccagactgaccaactacaccctgaccagctgcttcagcagcaacaaggtgcccaccatgcccggcagcctgcccaccggcagcaagcagggcaacgtgcagaccctggacagcatcagatggatgcccgccacccccgtgcccgcccccgagtgccaccagaagtacgccatcagcaccgagaccgccttccccaccctgagcaccttcatgaacaccgagaagagcgtgaagggcagcaacgccgacttcaccaagagaaaccccagatggagattcctgctgggcatctactgcagcctgcaccacgccatgaccatcttcatctag

SEQ ID NO: 18816 - DNA, 870 bp, Artificial Sequence
  Description of Artificial Sequence: Synthetic coding sequence
atggagcagcccggccccagagcccccgaccccagcctgtgccaccacaacctgcagcccaccgacgaccccaactgggacagctacgccaccaccatgagaaccgccttcacccccaagaccggcgccgtgcccgccctgatcagacagaacggcatcagaagactgggctacacctacagcctgagcgaccccatcctgaaccagacccagtacagcgacgagtacacctggaagagccacagcaaggaggacctgatcaagaccgagaccagcagaggcatcaagagccacaagagccacctgaacgaggacatcttcctgtggaccctgccccactgccagcagaccggcaccctgaagaactgcctgccctggaagatccccgccagcatgaaggaggtgaacaaggccctgagcaaccagttcatcagcctgaccaagagagacttcgtggacagaagcaaggcccagaagatcaagaagagcagccacctgagcctggagtggaagaagctgctgccccagccccccgacaccgagttcagaagaaactaccagatccccgccaagatccccgagctgcaggacttcagcttcaagtacggctgctacagcagcctgcccgtggccagccagggcctggtgcccagcgtgctgcacagctacctgagaaaccaggagcacaccaagaagcagaccacctaccagagcgactacgacaagacctaccccgacttcctgatgctgctgaacagcttcaccagcagccaggtgaaggagtacctgcagagcctgagctacaaggacagacagatcatcgacagattcatcagaacccactgcgacaccaacaagaagaagaagtag

SEQ ID NO: 18817 - DNA, 561 bp, Artificial Sequence
  Description of Artificial Sequence: Synthetic coding sequence
atgaacctgccccacctgatgagcctggccagccacctggccagccacggcttcttctgcctgagattcacctgcaagggcctgaacatcgtgcacagaatcaaggcctacaagagcgtgctgaactacctgaagaccagcggcgagtacaagctggccggcgtgttcctgggcggcagaagcatgggcagcagagccgccgccagcgtgatgtgccacatcgagcccgacgacggcgacgacttcgtgagaggcctgatctgcatcagctaccccctgcaccaccccaagcagcagcacaagctgagagacgaggacctgttcagactgaaggagcccgtgctgttcgtgagcggcagcgccgacgagatgtgcgagaagaacctgctggagaaggtggcccagaagatgcaggccccccacaagatccactggatcgagaaggccaaccacagcatggccgtgaagggcagaagcaccaacgacgtgttcaaggagatcaacacccagatcctgttctggatccaggagatcaccgagatggacaagaagtgccactag

SEQ ID NO: 18818 - DNA, 561 bp, Artificial Sequence; identical to SEQ ID NO: 18817
  Description of Artificial Sequence: Synthetic coding sequence

SEQ ID NO: 18819 - DNA, 684 bp, Artificial Sequence
  Description of Artificial Sequence: Synthetic coding sequence
atgagccacaccgaggtgaagctgaagatccccttcggcaacaagctgctggacgccgtgtgcctggtgcccaacaagagcctgacctacggcatcatcctgacccacggcgccagcggcgacatgaacctgccccacctgatgagcctggccagccacctggccagccacggcttcttctgcctgagattcacctgcaagggcctgaacatcgtgcacagaatcaaggcctacaagagcgtgctgaactacctgaagaccagcggcgagtacaagctggccggcgtgttcctgggcggcagaagcatgggcagcagagccgccgccagcgtgatgtgccacatcgagcccgacgacggcgacgacttcgtgagaggcctgatctgcatcagctaccccctgcaccaccccaagcagcagcacaagctgagagacgaggacctgttcagactgaaggagcccgtgctgttcgtgagcggcagcgccgacgagatgtgcgagaagaacctgctggagaaggtggcccagaagatgcaggccccccacaagatccactggatcgagaaggccaaccacagcatggccgtgaagggcagaagcaccaacgacgtgttcaaggagatcaacacccagatcctgttctggatccaggagatcaccgagatggacaagaagtgccactag

SEQ ID NO: 18820 - DNA, 420 bp, Artificial Sequence
  Description of Artificial Sequence: Synthetic coding sequence
atgggccagaactggaagagacagcagaagctgtggaacgtgccccagctgcccttcatcagagtgccccccagcatctacgacaccagcctgctgaaggccctgaaccagggccagcagagatacttctacagcatcatgagaatctacaacagcagaccccagtgggaggccctgcagaccagatacatccacagcctgcagcaccagcagctgctgggctacatcacccagagagaggccctgagctacgccctggtgctgagagacagcaccaagagagccagcgccaaggtggccccccagagaaccatccccagaaagaccagcgccatgaccagaagatgccccagcgtgctgcccgtgagcgtggtgctgcccagagcccagagcaagagaagacaggtgctgagaaactag

SEQ ID NO: 18821 - DNA, 420 bp, Artificial Sequence; identical to SEQ ID NO: 18820
  Description of Artificial Sequence: Synthetic coding sequence

SEQ ID NO: 18822 - DNA, 912 bp, Artificial Sequence
  Description of Artificial Sequence: Synthetic coding sequence
atggccggcgccgcctgcgagcccgtggccagacccagcctgaccagcatcagcagcggcgagctgagaagcctgtggacctgcgactgcgagctggccctgctgcccctggcccagctgctgagactgcagcccggcgccttccagctgagcggcgaccagctggtggtggccagacccggcgagcccgccgccgccagaggcggcttcaacgtgttcggcgacggcctggtgagactggacggccagctgtacagactgagcagctacatcaagagatacgtggagctgaccaactactgcgactacaaggactacagagagaccatcctgagcaagcccatgctgttcttcatcaacgtgcagaccaagaaggacaccagcaaggagagaacctacgccttcctggtgaacaccagacaccccaagatcagaagacagatcgagcagggcatggacatggtgatcagcagcgtgatcggcgagagctacagactgcagttcgacttccaggaggccgtgaagaacttcttcccccccggcaacgaggtggtgaacggcgagaacctgagcttcgcctacgagttcaaggccgacgccctgttcgacttcttctactggttcggcctgagcaacagcgtggtgaaggtgaacggcaaggtgctgaacctgagcagcaccagccccgagaagaaggagaccatcaagctgttcctggagaagatgagcgagcccctgatcagaagaagcagcttcagcgacagaaagttcagcgtgaccagcagaggcagcatcgacgacgtgttcaactgcaacctgagccccagaagcagcctgaccgagcccctgctggccgagctgcccttccccagcgtgctggagagcgaggagacccccaaccagttcatctag

SEQ ID NO: 18823 - DNA, 366 bp, Artificial Sequence
  Description of Artificial Sequence: Synthetic coding sequence
atgaacagccccgaggccagactgtgcgtggcccagtgcagagacagctaccccggctgccagcccctgaaggacaccagagcctgggccagcagcctgaagatggaccccgccggcctggagggcggccccagagacgagagcagagacgagccccccatcagagcccaggccgccagctgggaccagccccagggctgcctgacctacaagggcagaagaagcgccagcggcacccagaagcagctgcagctgcccgacaccctgagcagcctgctgtgctggagaggcgccatcatggtgtacatcaaggtgaccgtgcagaccgacgacagcaacaagctgctgagcctgctgtacagatag

SEQ ID NO: 18824 - DNA, 3495 bp, Artificial Sequence
  Description of Artificial Sequence: Synthetic coding sequence
atggccctgttccccgccttcgccggcctgagcgaggcccccgacggcggcagcagcagaaaggagctggactggctgagcaaccccagcttctgcgtgggcagcatcaccagcctgagccagcagaccgaggccgcccccgcccacgtgagcgagggcctgcccctgaccagaagccacctgaagagcgagagcagcgacgagagcgacaccaacaagaagctgaagcagaccagcagaaagaagaagaaggagaagaagaagaagagaaagcaccagcaccacaagaagaccaagagaaagcacggccccagcagcagcagcagaagcgagaccgacaccgacagcgagaaggacaagcccagcagaggcgtgggcggcagcaagaaggagagcgaggagcccaaccagggcaacaacgccgccgccgacaccggccacagattcgtgtggctggaggacatccaggccgtgaccggcgagaccttcagaaccgacaagaagcccgaccccgccaactgggagtacaagagcctgtacagaggcgacatcgccagatacaagagaaagggcgacagctgcctgggcatcaaccccaagaagcagtgcatcagctgggagggcaccagcaccgagaagaagcacagcagaaagcaggtggagagatacttcaccaagaagagcgtgggcctgatgaacatcgacggcgtggccatcagcagcaagaccgagccccccagcagcgagcccatcagcttcatccccgtgaaggacctggaggacgccgcccccgtgaccacctggctgaaccccctgggcatctacgaccagagcaccacccactggctgcagggccagggcccccccgagcaggagagcaagcagcccgacgcccagcccgacagcgagagcgccgccctgaaggccaaggtggaggagttcaacagaagagtgagagagaaccccagagacacccagctgtggatggccttcgtggccttccaggacgaggtgatgaagagccccggcctgtacgccatcgaggagggcgagcaggagaagagaaagagaagcctgaagctgatcctggagaagaagctggccatcctggagagagccatcgagagcaaccagagcagcgtggacctgaagctggccaagctgaagctgtgcaccgagttctgggagcccagcaccctggtgaaggagtggcagaagctgatcttcctgcaccccaacaacaccgccctgtggcagaagtacctgctgttctgccagagccagttcagcaccttcagcatcagcaagatccacagcctgtacggcaagtgcctgagcaccctgagcgccgtgaaggacggcagcatcctgagccaccccgccctgcccggcaccgaggaggccatgttcgccctgttcctgcagcagtgccacttcctgagacaggccggccacagcgagaaggccatcagcctgttccaggccatggtggacttcaccttcttcaagcccgacagcgtgaaggacctgcccaccaagggccaggtggagttcttcgagcccttctgggacagcggcgagcccagagccggcgagaagggcgccagaggctggaaggcctggatgcaccagcaggagagaggcggctgggtggtgatcaaccccgacgaggacgacgacgagcccgaggaggacgaccaggagatcaaggacaagaccctgcccagatggcagatctggctggccgccgagagaagcagagaccagagacactggagaccctggagacccgacaagaccaagaagcagaccgaggaggactgcgaggaccccgagagacaggtgctgttcgacgacatcggccagagcctgatcagactgagcagccacgacctgcagttccagctggtggaggccttcctgcagttcctgggcgtgcccagcggcttcaccccccccgccagctgcctgtacctggccatggacgagaacagcatcttcgacaacggcctgtacgacgagaagcccctgaccttcttcaaccccctgttcagcggcgccagctgcgtgggcagaatggacagactgggctaccccagatggaccagaggccagaacagagagggcgaggagttcatcagaaacgtgttccacctggtgatgcccctgttcagcggcaaggagaagagccagctgtgcttcagctggctgcagtacgagatcgccaaggtgatctggtgcctgcacaccaagaacaagaagagactgaagagccagggcaagaactgcaagaagctggccaagaacctgctgaaggagcccgagaactgcaacaacttctgcctgtggaagcagtacgcccacctggagtggctgctgggcaacaccgaggacgccagaaaggtgttcgacaccgccctgggcatggccggcagcagagagctgaaggacagcgacctgtgcgagctgagcctgctgtacgccgagctggaggtggagctgagccccgaggtgagaagagccgccaccgccagagccgtgcacatcctgaccaagctgaccgagagcagcccctacggcccctacaccggccaggtgctggccgtgcacatcctgaaggccagaaaggcctacgagcacgccctgcaggactgcctgggcgacagctgcgtgagcaaccccgcccccaccgacagctgcagcagactgatcagcctggccaagtgcttcatgctgttccagtacctgaccatcggcatcgacgccgccgtgcagatctacgagcaggtgttcgccaagctgaacagcagcgtgttccccgagggcagcggcgagggcgacagcgccagcagccagagctggaccagcgtgctggaggccatcaccctgatgcacaccagcctgctgagattccacatgaaggtgagcgtgtaccccctggcccccctgagagaggccctgagccaggccctgaagctgtaccccggcaaccaggtgctgtggagaagctacgtgcagatccagaacaagagccacagcgccagcaagaccagaagattcttcgacaccatcaccagaagcgccaagcccctggagccctggctgttcgccatcgaggccgagaagctgagaaagagactggtggagaccgtgcagagactggacggcagagagatccacgccaccatccccgagaccggcctgatgcacagaatccaggccctgttcgagaacgccatgagaagcgacagcggcagccagtgccccctgctgtggagaatgtacctgaacttcctggtgagcctgggcaacaaggagagaagcaagggcgtgttctacaaggccctgcagaactgcccctgggccaaggtgctgtacctggacgccgtggagtacttccccgacgagatgcaggagatcctggacctgatgaccgagaaggagctgagagtgagactgcccctggaggagctggagctgctgctggaggactag

SEQ ID NO: 18825 - DNA, 2802 bp, Artificial Sequence
  Description of Artificial Sequence: Synthetic coding sequence
atgaacatcgacggcgtggccatcagcagcaagaccgagccccccagcagcgagcccatcagcttcatccccgtgaaggacctggaggacgccgcccccgtgaccacctggctgaaccccctgggcatctacgaccagagcaccacccactggctgcagggccagggcccccccgagcaggagagcaagcagcccgacgcccagcccgacagcgagagcgccgccctgaaggccaaggtggaggagttcaacagaagagtgagagagaaccccagagacacccagctgtggatggccttcgtggccttccaggacgaggtgatgaagagccccggcctgtacgccatcgaggagggcgagcaggagaagagaaagagaagcctgaagctgatcctggagaagaagctggccatcctggagagagccatcgagagcaaccagagcagcgtggacctgaagctggccaagctgaagctgtgcaccgagttctgggagcccagcaccctggtgaaggagtggcagaagctgatcttcctgcaccccaacaacaccgccctgtggcagaagtacctgctgttctgccagagccagttcagcaccttcagcatcagcaagatccacagcctgtacggcaagtgcctgagcaccctgagcgccgtgaaggacggcagcatcctgagccaccccgccctgcccggcaccgaggaggccatgttcgccctgttcctgcagcagtgccacttcctgagacaggccggccacagcgagaaggccatcagcctgttccaggccatggtggacttcaccttcttcaagcccgacagcgtgaaggacctgcccaccaagggccaggtggagttcttcgagcccttctgggacagcggcgagcccagagccggcgagaagggcgccagaggctggaaggcctggatgcaccagcaggagagaggcggctgggtggtgatcaaccccgacgaggacgacgacgagcccgaggaggacgaccaggagatcaaggacaagaccctgcccagatggcagatctggctggccgccgagagaagcagagaccagagacactggagaccctggagacccgacaagaccaagaagcagaccgaggaggactgcgaggaccccgagagacaggtgctgttcgacgacatcggccagagcctgatcagactgagcagccacgacctgcagttccagctggtggaggccttcctgcagttcctgggcgtgcccagcggcttcaccccccccgccagctgcctgtacctggccatggacgagaacagcatcttcgacaacggcctgtacgacgagaagcccctgaccttcttcaaccccctgttcagcggcgccagctgcgtgggcagaatggacagactgggctaccccagatggaccagaggccagaacagagagggcgaggagttcatcagaaacgtgttccacctggtgatgcccctgttcagcggcaaggagaagagccagctgtgcttcagctggctgcagtacgagatcgccaaggtgatctggtgcctgcacaccaagaacaagaagagactgaagagccagggcaagaactgcaagaagctggccaagaacctgctgaaggagcccgagaactgcaacaacttctgcctgtggaagcagtacgcccacctggagtggctgctgggcaacaccgaggacgccagaaaggtgttcgacaccgccctgggcatggccggcagcagagagctgaaggacagcgacctgtgcgagctgagcctgctgtacgccgagctggaggtggagctgagccccgaggtgagaagagccgccaccgccagagccgtgcacatcctgaccaagctgaccgagagcagcccctacggcccctacaccggccaggtgctggccgtgcacatcctgaaggccagaaaggcctacgagcacgccctgcaggactgcctgggcgacagctgcgtgagcaaccccgcccccaccgacagctgcagcagactgatcagcctggccaagtgcttcatgctgttccagtacctgaccatcggcatcgacgccgccgtgcagatctacgagcaggtgttcgccaagctgaacagcagcgtgttccccgagggcagcggcgagggcgacagcgccagcagccagagctggaccagcgtgctggaggccatcaccctgatgcacaccagcctgctgagattccacatgaaggtgagcgtgtaccccctggcccccctgagagaggccctgagccaggccctgaagctgtaccccggcaaccaggtgctgtggagaagctacgtgcagatccagaacaagagccacagcgccagcaagaccagaagattcttcgacaccatcaccagaagcgccaagcccctggagccctggctgttcgccatcgaggccgagaagctgagaaagagactggtggagaccgtgcagagactggacggcagagagatccacgccaccatccccgagaccggcctgatgcacagaatccaggccctgttcgagaacgccatgagaagcgacagcggcagccagtgccccctgctgtggagaatgtacctgaacttcctggtgagcctgggcaacaaggagagaagcaagggcgtgttctacaaggccctgcagaactgcccctgggccaaggtgctgtacctggacgccgtggagtacttccccgacgagatgcaggagatcctggacctgatgaccgagaaggagctgagagtgagactgcccctggaggagctggagctgctgctggaggactag

SEQ ID NO: 18826 - DNA, 744 bp, Artificial Sequence
  Description of Artificial Sequence: Synthetic coding sequence
atgagcggcaaggacagaatcgagatcttccccagcagaatggcccagaccatcatgaaggccagactgaagggcgcccagaccggcagaaacctgctgaagaagaagagcgacgccctgaccctgagattcagacagatcctgaagaagatcatcgagaccaagatgctgatgggcgaggtgatgagagaggccgccttcagcctggccgaggccaagttcaccgccggcgacttcagcaccaccgtgatccagaacgtgaacaaggcccaggtgaagatcagagccaagaaggacaacgtggccggcgtgaccctgcccgtgttcgagcactaccacgagggcaccgacagctacgagctgaccggcctggccagaggcggcgagcagctggccaagctgaagagaaactacgccaaggccgtggagctgctggtggagctggccagcctgcagaccagcttcgtgaccctggacgaggccatcaagatcaccaacagaagagtgaacgccatcgagcacgtgatcatccccagaatcgagagaaccctggcctacatcatcaccgagctggacgagagagagagagaggagttctacagactgaagaagatccaggagaagaagaagatcctgaaggagaagagcgagaaggacctggagcagagaagagccgccggcgaggtgctggagcccgccaacctgctggccgaggagaaggacgaggacctgctgttcgagtag

SEQ ID NO: 18827 - DNA, 1449 bp, Artificial Sequence
  Description of Artificial Sequence: Synthetic coding sequence
atggacgagctggtgcacgacctggccagcgccctggagcagaccagcgagcagaacaagctgggcgagctgtgggaggagatggccctgagccccagacagcagagaagacagctgagaaagagaagaggcagaaagagaagaagcgacttcacccacctggccgagcacacctgctgctacagcgaggccagcgagagcagcctggacgaggccaccaaggactgcagagaggtggcccccgtgaccaacttcagcgacagcgacgacaccatggtggccaagagacaccccgccctgaacgccatcgtgaagagcaagcagcacagctggcacgagagcgacagcttcaccgagaacgccccctgcagacccctgagaagaagaagaaaggtgaagagagtgaccagcgaggtggccgccagcctgcagcagaagctgaaggtgagcgactggagctacgagagaggctgcagattcaagagcgccaagaagcagagactgagcagatggaaggagaacaccccctggaccagcagcggccacggcctgtgcgagagcgccgagaacagaaccttcctgagcaagaccggcagaaaggagagaatggagtgcgagaccgacgagcagaagcagggcagcgacgagaacatgagcgagtgcgagaccagcagcgtgtgcagcagcagcgacaccggcctgttcaccaacgacgagggcagacagggcgacgacgagcagagcgactggttctacgagggcgagtgcgtgcccggcttcaccgtgcccaacctgctgcccaagtgggcccccgaccactgcagcgaggtggagagaatggacagcggcctggacaagttcagcgacagcaccttcctgctgcccagcagacccgcccagagaggctaccacaccagactgaacagactgcccggcgccgccgccagatgcctgagaaagggcagaagaagactggtgggcaaggagaccagcatcaacaccctgggcaccgagagaatcagccacatcatcagcgaccccagacagaaggagaagaacaaggccctggccagcgacttcccccacatcagcgcctgcgcccacgagttcaaccccctgagccccctgtacagcctggacgtgctggccgacgccagccacagaagatgcagccccgcccactgcagcgccagacaggccaacgtgcactggggccccccctgcagcagagacatcaagagaaagagaaagcccgtggccaccgccagcctgagcagccccagcgccgtgcacatggacgccgtggagcccaccacccccgccagccaggcccccaagagccccagcagcgagtggctggtgagaaccagcgccgccgagaaggccaccgacgccaccaccgccaccttcttcaagatgccccaggagaagagccccggctacagctag

SEQ ID NO: 18828 - DNA, 1434 bp, Artificial Sequence
  Description of Artificial Sequence: Synthetic coding sequence
atggacgagctggtgcacgacctggccagcgccctggagcagaccagcgagcagaacaagctgggcgagctgtgggaggagatggccctgagccccagacagcagagaagacagctgagaaagagaagaggcagaaagagaagaagcgacttcacccacctggccgagcacacctgctgctacagcgaggccagcgagagcagcctggacgaggccaccaaggactgcagagaggtggcccccgtgaccaacttcagcgacagcgacgacaccatggtggccaagagacaccccgccctgaacgccatcgtgaagagcaagcagcacagctggcacgagagcgacagcttcaccgagaacgccccctgcagacccctgagaagaagaagaaaggtgaagagagtgaccagcgaggtggccgccagcctgcagcagaagctgaaggtgagcgactggagctacgagagaggctgcagattcaagagcgccaagaagcagagactgagcagatggaaggagaacaccccctggaccagcagcggccacggcctgtgcgagagcgccgagaacagaaccttcctgagcaagaccggcagaaaggagagaatggagtgcgagaccgacgagcagaagcagggcagcgacgagaacatgagcgagtgcgagaccagcagcgtgtgcagcagcagcgacaccggcctgttcaccaacgacgagggcagacagggcgacgacgagcagagcgactggttctacgagggcgagtgcgtgcccggcttcaccgtgcccaacctgctgcccaagtgggcccccgaccactgcagcgaggtggagagaatggacagcggcctggacaagttcagcgacagcaccttcctgctgcccagcagacccgcccagagaggctaccacaccagactgaacagactgcccggcgccgccgccagatgcctgagaaagggcagaagaagactggtgggcaaggagaccagcatcaacaccctgggcaccgagagaatcagccacatcatcagcgaccccagacagaaggacttctggctgcccagcgccggcaagagagagagaaaccagttcaaccccctgagccccctgtacagcctggacgtgctggccgacgccagccacagaagatgcagccccgcccactgcagcgccagacaggccaacgtgcactggggccccccctgcagcagagacatcaagagaaagagaaagcccgtggccaccgccagcctgagcagccccagcgccgtgcacatggacgccgtggagcccaccacccccgccagccaggcccccaagagccccagcagcgagtggctggtgagaaccagcgccgccgagaaggccaccgacgccaccaccgccaccttcttcaagatgccccaggagaagagccccggctacagctag

SEQ ID NO: 18829 - DNA, 1344 bp, Artificial Sequence
  Description of Artificial Sequence: Synthetic coding sequence
atggacgagctggtgcacgacctggccagcgccctggagcagaccagcgagcagaacaagctgggcgagctgtgggaggagatggccctgagccccagacagcagagaagacagctgagaaagagaagaggcagaaagagaagaagcgacttcacccacctggccgagcacacctgctgctacagcgaggccagcgagagcagcctggacgaggccaccaaggactgcagagaggtggcccccgtgaccaacttcagcgacagcgacgacaccatggtggccaagagacaccccgccctgaacgccatcgtgaagagcaagcagcacagctggcacgagagcgacagcttcaccgagaacgccccctgcagacccctgagaagaagaagaaaggtgaagagagtgaccagcgaggtggccgccagcctgcagcagaagctgaaggtgagcgactggagctacgagagaggctgcagattcaagagcgccaagaagcagagactgagcagatggaaggagaacaccccctggaccagcagcggccacggcctgtgcgagagcgccgagaacagaaccttcctgagcaagaccggcagaaaggagagaatggagtgcgagaccgacgagcagaagcagggcagcgacgagaacatgagcgagtgcgagaccagcagcgtgtgcagcagcagcgacaccggcctgttcaccaacgacgagggcagacagggcgacgacgagcagagcgactggttctacgagggcgagtgcgtgcccggcttcaccgtgcccaacctgctgcccaagtgggcccccgaccactgcagcgaggtggagagaatggacagcggcctggacaagttcagcgacagcaccttcctgctgcccagcagacccgcccagagaggctaccacaccagactgaacagactgcccggcgccgccgccagatgcctgagaaagggcagaagaagactggtgggcaaggagaccagcatcaacaccctgggcaccgagagaatcagccacatcatcaccctgggcagaaagatcagcggctaccaccagctgggcaaggagaacgagatcagcagcatcccctgcctgcccttcaccccctggatgttcctgcccatgctgctgaccgagggcgtgcaccagcacaccgccctgcccgacagacagatgtacaccggcgaccaccacgtgcacgtgaccagcagaggcagcggcaaccagtggccccagcacctgtgcctggcccccgtgcagttcacctggatgcagtggagccagccccaccagcaccacaagccccccaaccaccccgccctgagcggctggtag

SEQ ID NO: 18830 - DNA, 1056 bp, Artificial Sequence
  Description of Artificial Sequence: Synthetic coding sequence
atggacgagctggtgcacgacctggccagcgccctggagcagaccagcgagcagaacaagctgggcgagctgtgggaggagatggccctgagccccagacagcagagaagacagctgagaaagagaagaggcagaaagagaagaagcgacttcacccacctggccgagcacacctgctgctacagcgaggccagcgagagcagcctggacgaggccaccaaggactgcagagaggtggcccccgtgaccaacttcagcgacagcgacgacaccatggtggccaagagacaccccgccctgaacgccatcgtgaagagcaagcagcacagctggcacgagagcgacagcttcaccgagaacgccccctgcagacccctgagaagaagaagaaaggtgaagagagtgaccagcgaggtggccgccagcctgcagcagaagctgaaggtgagcgactggagctacgagagaggctgcagattcaagagcgccaagaagcagagactgagcagatggaaggagaacaccccctggaccagcagcggccacggcctgtgcgagagcgccgagaacagaaccttcctgagcaagaccggcagaaaggagagaatggagtgcgagaccgacgagcagaagcagggcagcgacgagaacatgagcgagtgcgagaccagcagcgtgtgcagcagcagcgacaccggcctgttcaccaacgacgagggcagacagggcgacgacgagcagagcgactggttctacgagggcgagtgcgtgcccggcttcaccgtgcccaacctgctgcccaagtgggcccccgaccactgcagcgaggtggagagaatggacagcggcctggacaagttcagcgacagcaccttcctgctgcccagcagacccgcccagagaggctaccacaccagactgaacagactgcccggcgccgccgccagatgcctgagaaagggcagaagaagactggtgggcaaggtgatccccctgaccgtgagcctggcccagtggggcgacaacatcccctacggcagctgcgtgagctactag

SEQ ID NO: 18831 - DNA, 1056 bp, Artificial Sequence; identical to SEQ ID NO: 18830
  Description of Artificial Sequence: Synthetic coding sequence

SEQ ID NO: 18832 - DNA, 423 bp, Artificial Sequence
  Description of Artificial Sequence: Synthetic coding sequence
atgcccctggagagcagcagcagcatgcccctgagcttccccagcctgctgcccagcgtgccccacaacaccaaccccagcccccccctgatgagctacatcaccagccaggagatgaagtgcatcctgcactggttcgccaactggagcggcccccagagagagagattcctggaggacctggtggccaaggccgtgcccgagaagctgcagcccctgctggacagcctggagcagctgagcgtgagcggcgccgacagaccccccagcatcttcgagtgccagctgcacctgtgggaccagtggttcagaggctgggccgagcaggagagaaacgagttcgtgagacagctggagttcagcgagcccgacttcgtggccaagttctaccaggccgtggccgccaccgccggcaaggactag

SEQ ID NO: 18833 - DNA, 423 bp, Artificial Sequence; identical to SEQ ID NO: 18832
  Description of Artificial Sequence: Synthetic coding sequence

SEQ ID NO: 18834 - DNA, 303 bp, Artificial Sequence
  Description of Artificial Sequence: Synthetic coding sequence
atggagctgctgggcgagtacgtgggccaggagggcaagccccagaagctgagagtgagctgcgaggcccccggcgacggcgaccccttccagggcctgctgagcggcgtggcccagatgaaggacatggtgaccgagctgttcgaccccctggtgcagggcgaggtgcagcacagagtggccgccgcccccgacgaggacctggacggcgacgacgaggacgacgccgaggacgagaacaacatcgacaacagaaccaacttcgacggccccagcgccaagagacccaagacccccagctag

SEQ ID NO: 18835 - DNA, 1065 bp, Artificial Sequence
  Description of Artificial Sequence: Synthetic coding sequence
atggagagcgccctggccgtgcccagactgcccccccacgaccccggcacccccgtgctgagcgtggtggacatgcacaccggcggcgagcccctgagaatcgtgctggccggctgccccgaggtgagcggccccaccctgctggccaagagaagatacatgagacagcacctggaccacgtgagaagaagactgatgttcgagcccagaggccacagagacatgtacggcgccgtgctggtgcccagcgagctgcccgacgcccacctgggcgtgctgttcctgcacaacgagggctacagcagcatgtgcggccacgccgtgctggccctgggcagattcgccctggacttcggcctggtgcccgccccccccgccggcaccagagaggccagagtgaacatccactgcccctgcggcctggtgaccgccttcgtggcctgcgaggacggcagaagccacggccccgtgagattccacagcgtgcccgccttcgtgctggccaccgacctgatggtggacgtgcccggccacggcaaggtgatggtggacatcgcctacggcggcgccttctacgccttcgtgaccgccgagaagctgggcctggacatctgcagcgccaagaccagagacctggtggacgccgccagcgccgtgaccgaggccgtgaaggcccagttcaagatcaaccaccccgacagcgaggacctggccttcctgtacggcaccatcctgaccgacggcaaggacgcctacaccaaggagcccaccaccaacatctgcgtgttcgccgacgagcaggtggacagaagccccaccggcagcggcgtgaccgccagaatcgccctgcagtaccacaagggcctgctggagctgaaccagatgagagccttcaagagcagcgccaccggcagcgtgttcaccggcaaggccgtgagagaggccaagtgcggcgacttcaaggccgtgatcgtggaggtgagcggccaggcccactacaccggcaccgccagcttcatcatcgaggacgacgaccccctgagagacggcttcctgctgaagtag

SEQ ID NO: 18836 - DNA, 267 bp, Artificial Sequence
  Description of Artificial Sequence: Synthetic coding sequence
atggccagctgcaccaacagaggcggcctgcccgagaagcacagcagcagcaaggtgagcagccacgcccagatgatccagaaggccgtggacttcctggacctgctgatcggccacctgagcaagttcagccccgtgctgatcgtgttccagttcagccccctgggcttcctggtgagacagagcagcgccgacaacgtgcagttcctgagcttcgcccccagcctgatcctgcccagcggcaccggcaactggctggtgtggtag

SEQ ID NO: 18837 - DNA, 903 bp, Artificial Sequence
  Description of Artificial Sequence: Synthetic coding sequence
atggactggttccactgcaaccagtgcttcagaaaggacggcgcccacttcttcgtgaccagctgcggccacatcttctgcaagaagtgcgtgaccctggagaagtgcgccgtgtgcggcaccgcctgcaagcacctggccctgagcgacaacctgaagccccaggagaagatgttcttcaagagccccgtggagaccgccctgcagtacttcagccacatcagccaggtgtggagcttccagaagaagcagaccgacctgctgatcgccttctacaagcacagaatcaccaagctggagaccgccatgcaggaggcccagcaggccctggtgagccaggacaaggagctgagcgtgctgagaaaggagaacggcgagctgaagaagttcctggccatcctgaaggagagccccagcagataccagggcagcagaagcatcacccccagacccgtgggcatcaccagccccagccagagcgtgacccccagacccagcttccagcacagcagccaggtggtgagcagaagcagcagcgccgagagcatcccctacagagaggccggcttcggcagcctgggccagggcggcagaggcctgcagggcagaagaacccccagagacagctacaacgagacccccagccccgccagcacccacagcctgagctacagaaccagcagcgccagcagcggccagggcatcttcagcttcagacccagccccaacggccacagcggccacaccagagtgctgacccccaacaacttcgcccagagagagagcaccaccaccctggagagcctgcccagcttccagctgcccgtgctgcagaccctgtaccagcagagaagacacatgggcctgcccagcggcagagaggcctggaccaccagcagatag

SEQ ID NO: 18838 - DNA, 567 bp, Artificial Sequence
  Description of Artificial Sequence: Synthetic coding sequence
atggaggacgagagaagcttcagcgacatctgcggcggcagactggccctgcagagaagatactacagccccagctgcagagagttctgcctgagctgccccagactgagcctgagaagcctgaccgccgtgacctgcaccgtgtggctggccgcctacggcctgttcaccctgtgcgagaacagcatgatcctgagcgccgccatcttcatcaccctgctgggcctgctgggctacctgcacttcgtgaagatcgaccaggagaccctgctgatcatcgacagcctgggcatccagatgaccagcagctacgccagcggcaaggagagcaccaccttcatcgagatgggcaaggtgaaggacatcgtgatcaacgaggccatctacatgcagaaggtgatctactacctgtgcatcctgctgaaggaccccgtggagccccacggcatcagccaggtggtgcccgtgttccagagcgccaagcccagactggactgcctgatcgaggtgtacagaagctgccaggagatcctggcccaccagaaggccaccagcaccagcccctag

SEQ ID NO: 18839 - DNA, 1467 bp, Artificial Sequence
  Description of Artificial Sequence: Synthetic coding sequence
atgcacatccagttccccagcaagcccaccctgcccagagcctgctgggagggcagaatcaccgccggcagccccggcatgccccccgacgagatcgagatcgagcccgtgagacagagcagcgacaagatgctgtactgcgaggccgagagcccccccaccgtggagaaggtgaagcccgccagagagaacagcgagaccgacctggagatcgaggacgacgagaagttcttcaccaccggccagaaggagctgtacctggaggcctgcaagctgatgggcgtggtgcccgtgagctacttcatcagaaacatggaggagagctacgtgaacctgaaccaccacggcctgggccccagaggcaccaaggccatcgccatcgccctggtgagcaacatggccgtgaccaagctggagctggaggacaactgcatcatggaggagggcgtgctgagcctggtggagatgctgcaggagaactactacctgcaggagatgaacatcagcaacaaccacctgggcctggagggcgccagaatcatcagcgacttcttcgagagaaacagcagcagcatctggagcctggagctgagcggcaacgacttcaaggaggacagcgccgccctgctgtgccaggccctgagcaccaactaccagatcaagaagctggacctgagccacaaccagttcagcgacgtgggcggcgagcacctgggccagatgctggccatcaacgtgggcctgaccagcctggacctgagctggaacaacttccacaccagaggcgccgtggccctgtgcaacggcctgagaggcaacgtgaccctgaccaagctggacctgagcatgaacggcttcggcaacgaggtggccctggccctgggcgaggtgctgagactgaacagatgcctggtgtacctggacatcggcggcaacgacatcggcaacgagggcgccagcaagatcagcaagggcctggagagcaacgagagcctgagagtgctgaagctgttcctgaaccccatcaacatggacggcgccatcctgctgatcctggccatcaagagaaaccccaagagcagaatggaggagctggacatcagcaacgtgctggtgagcgagcagttcatgaagaccctggacggcgtgtacgccgtgcacccccagctggacgtggtgttcaaggccgtgcagggcctgagccccaagaagaccatcttcctgctgaccaaccccatgaagctgatccagagctacgccgaccagcacaagatcaccatcgtggacttcttcaagagcctgaaccccaccggcaccatgaagatgagcgtggacgagttccagaaggtgatgatcgagcagaacaaggtgcccctgaaccagtaccaggtgagagaggtgatcaagaagctggacgagaagaccggcatggtgaacttcagcttcctgaacaccatgaagccctag

SEQ ID NO: 18840 - DNA, 561 bp, Artificial Sequence
  Description of Artificial Sequence: Synthetic coding sequence
atggacaacgacaagcccctgcagcccgagaccgaggacgagatcgagatcgagcccgtgagacagagcagcgacaagatgctgtactgcgaggccgagagcccccccaccgtggagaaggtgaagcccgccagagagaacagcgagaccgacctggagatcgaggacgacgagaagttcttcaccaccggccagaaggagctgtacctggaggcctgcaagctgatgggcgtggtgcccgtgagctacttcatcagaaacatggaggagagctacgtgaacctgaaccaccacggcctgggccccagaggcaccaaggccatcgccatcgccctggtgagcaacatggccgtgaccaagctggagctggaggacaactgcatcatggaggagggcgtgctgagcctggtggagatgctgcaggagaactactacctgcaggagatgaacatcagcaacaaccacctgggcctggagggcgccagaatcatcagcgacttcttcgagagaaacagcagcagcatctggagcctggagctgagcgaccagctgcccaactag

SEQ ID NO: 18841 - DNA, 654 bp, Artificial Sequence
  Description of Artificial Sequence: Synthetic coding sequence
atggaggacagagccggcgagcaggagcaggagagacacagcctgagactggagaagctgcagcactgggccagacacagacagagcggccacctgctggtgctggccgtgagccagctgtggctggccgtggtggtggtgcccctggccgtgagcgtggcctgcctgaacagcgactgccacatggccaccgccctgcccctgggccccggcgccagcggcctgctgaccggcaccgtgaccctggagctgagaagagcccccagactgtggaaggtgagagccatgatgatcttcaacaccttcaacctgatcctgggcttcatcgtggtggtggtggaggtgatgaagaccgccctgggccccgcccccaccgccagcagccagcacgccggcctgctggtgctggagctgagcgccgaggccttcaccctgggcggcgtgctggtgagcgtgcacgccctgttcctgctgagccagagaaagcccggctgctgcagaagccagagcctgcactaccaggagctgcaggagggcttcagcgagctggaggaggtgcccggcctggagaacggccccaccgtggccagcaccggcgccaacgagagagtgggccagagagagcagaccagagccgccctgctgcccccctag

SEQ ID NO: 18842 - DNA, 654 bp, Artificial Sequence; identical to SEQ ID NO: 18841
  Description of Artificial Sequence: Synthetic coding sequence

SEQ ID NO: 18843 - DNA, 378 bp, Artificial Sequence
  Description of Artificial Sequence: Synthetic coding sequence
atgcacagaaaggagcccggcgccagactggaggccaccagaggcgccgccagaccccacaagcagggcaccaagcccatgatcaccagacccagcgtgagccagctgggcgagggcaagtgccccagcagccagcacctgcagagcctgagacacaacaagcagcacgccctgaccctgaccaaggccagatgctgcggcgagtgcagcacctgcttctgcaccgaggagaagagcgagtgccagagacacgaggagaccagccccggcagctgcaaccaccagatcatgagcgccagcaccatcagcgccttctgcgccacccccagattcaagcagctgttcaagggcaccgtggagcagatgagccagatgtag

SEQ ID NO: 18844 - DNA, 228 bp, Artificial Sequence
  Description of Artificial Sequence: Synthetic coding sequence
atgcacagaaaggagcccggcgccagactggaggccaccagaggcgccgccagaccccacaagcagggcaccaagcccatgatcaccagacccagcgtgagccagctgggcgagggcaagtgccccagcagccagcacctgcagagcctgagacacaacaagcagcacgccctgaccctgaccaaggccagatgctgcggcgagtgcagcacctgcttctgcacctag

SEQ ID NO: 18845 - DNA, 369 bp, Artificial Sequence
  Description of Artificial Sequence: Synthetic coding sequence
atgggcagagagatgaagaagaccggcacccccagacccttcagaatcgaggaccccaaccagcagcccacctggcacgaccagcccgagatgggcagccactacttcgcccaggccggcctggagctgctgggcagcagcaacccccccgccagcgccagccagagcgccggcatcaccggcgtgagccactgcgccagacccggcgagcacgacctgaaccacaccgtgttccaggtgaaggacagcaccttcctgagacacctggagagcgacagacccgagttcaagagctgcctgcccccccacttcaccgagcccagcgtgagcctgagcaccagcgagggctgcgaggacgccatgggctag

SEQ ID NO: 18846 - DNA, 279 bp, Artificial Sequence
  Description of Artificial Sequence: Synthetic coding sequence
atgggcagccactacttcgcccaggccggcctggagctgctgggcagcagcaacccccccgccagcgccagccagagcgccggcatcaccggcgtgagccactgcgccagacccggcgagcacgacctgaaccacaccgtgttccaggtgaaggacagcaccttcctgagacacctggagagcgacagacccgagttcaagagctgcctgcccccccacttcaccgagcccagcgtgagcctgagcaccagcgagggctgcgaggacgccatgggctag

SEQ ID NO: 18847 - DNA, 114 bp, Artificial Sequence
  Description of Artificial Sequence: Synthetic coding sequence
atgggcagagagatgaagaagaccggcacccccagacccttcagaatcgaggaccccaaccagcagcccacctggcacgaccagcccggcaccgagagcgtgttctggctgtag

SEQ ID NO: 18848 - DNA, 324 bp, Artificial Sequence
  Description of Artificial Sequence: Synthetic coding sequence
atgaccggcagaatggccaccctggagaagagccacagcagcgcctgctggagaaagagaagcagcagaacctgcgtggagcccgacagaacccaggacgccatccacgagcccagaggcctgagcagaagccacaccgtgctgagacacagacacttcgtgttcctgcccctgagcagcggcgcccaccccagcgtgccccccagaagaaagaactgcgccatgaagaacggcaagctgctgagaagctgcagcagcgtgagaagagccgccgacaagctggactggggcagattcttcctgcaggacctgcagagcgtgtag

SEQ ID NO: 18849 - DNA, 1911 bp, Artificial Sequence
  Description of Artificial Sequence: Synthetic coding sequence
atgggccagggccccagaagcccccacaaggtgggcagaagattccccgccggcggcaagagaggcagaggcgccaagggcagcggcagacccctgcccggcagaaagagacagccctggcccccccccgacggcagaagcgagcccgcccccgacagccacccccacctgagccccgaggccctgggctacttcagaagagccctgagcgccctgaaggaggcccccgagaccggcgaggagagagacctgatggtgcacaacatcatgaaggaggtggagacccaggccctggccctgagcaccaacagaaccggcagcgagatgctgcaggagctgctgggcttcagccccctgaagcccctgtgcagagtgtgggccgccctgagaagcaacctgagaaccgtggcctgccacagatgcggcgtgcacgtgctgcagagcgccctgctgcagctgcccagactgctgggcagcgccgccgaggaggaggaggaggaggaggaggacggcaaggacggccccaccgagaccctggaggagctggtgctgggcctggccgccgaggtgtgcgacgacttcctggtgtactgcggcgacacccacggcagcttcgtggtgagaaccctgctgcaggtgctgggcggcaccatcctggagagcgagagagccagacccagaggcagccagagcagcgaggcccagaagacccccgcccaggagtgcaagcccgccgacttcgaggtgcccgagaccttcctgaacagactgcaggacctgagcagcagcttcctgaaggacatcgccgtgttcatcaccgacaagatcagcagcttctgcctgcaggtggccctgcaggtgctgcacagaaagctgccccagttctgcgcccacctgtgcaacgccgtgatcggctacctgagcaccagaggcagcagcgtggacggcagccccctgctgctgttcctgagagaccagaccagcagcagactgctggagcaggtgctgctggtgctggagccccccagactgcagagcctgttcgaggagcacctgcagggccagctgcagaccctggccgcccaccccatcgccaacttccccctgcagagactgctggacgccgtgaccacccccgagctgctgagccccgtgttcgaggagctgagccccgtgctggaggccgtgctggcccagggccaccccggcgtggtgatcgccctggtgggcgcctgcagaagagtgggcgcctaccaggccaaggtgctgcagctgctgctggaggccttccactgcgccgagcccagcagcagacaggtggcctgcgtgcccctgttcgccaccctgatggcctacgaggtgtactacggcctgaccgaggaggagggcgccgtgcccgccgagcaccaggtggccatggccgccgccagagccctgggcgacgtgaccgtgctgggcagcctgctgctgcagcacctgctgcacttcagcacccccggcctggtgctgagaagcctgggcgccctgaccggcccccagctgctgagcctggcccagagccccgccggcagccacgtgctggacgccatcctgaccagccccagcgtgaccagaaagctgagaagaagagtgctgcagaacctgaagggccagtacgtggccctggcctgcagcagacacggcagcagagtgctggacgccatctggagcggcgccgccctgagagccagaaaggagatcgccgccgagctgggcgagcagaaccaggagctgatcagagaccccttcggccaccacgtggccagaaacgtggccctgaccaccttcctgaagagaagagaggcctgggagcagcagcagggcgccgtggccaagagaagaagagccctgaacagcatcctggaggactag

SEQ ID NO: 18850 - DNA, 564 bp, Artificial Sequence
  Description of Artificial Sequence: Synthetic coding sequence
atggcctacgaggtgtactacggcctgaccgaggaggagggcgccgtgcccgccgagcaccaggtggccatggccgccgccagagccctgggcgacgtgaccgtgctgggcagcctgctgctgcagcacctgctgcacttcagcacccccggcctggtgctgagaagcctgggcgccctgaccggcccccagctgctgagcctggcccagagccccgccggcagccacgtgctggacgccatcctgaccagccccagcgtgaccagaaagctgagaagaagagtgctgcagaacctgaagggccagtacgtggccctggcctgcagcagacacggcagcagagtgctggacgccatctggagcggcgccgccctgagagccagaaaggagatcgccgccgagctgggcgagcagaaccaggagctgatcagagaccccttcggccaccacgtggccagaaacgtggccctgaccaccttcctgaagagaagagaggcctgggagcagcagcagggcgccgtggccaagagaagaagagccctgaacagcatcctggaggactag

SEQ ID NO: 18851 - DNA, 504 bp, Artificial Sequence
  Description of Artificial Sequence: Synthetic coding sequence
atggagctgagcagcatgaagatctgcgccgccatccccaccagcagagccctgcccgaggtggtgagaagaatgcccagaaagagaatcagcggcctggagtggctgctgcagcaggaccccggcttcagcctggtgaacaccgtgaaggccggcatgatcatcagcttccccagcaacaacatctacagcagcgtgtgctgctgccagagcgagatcttcaagtacgagttcagcaacagcaagaagagcagctggatccaggaggagagacacctgggcaagaacaacgtgctgtacagcgcccacgacgtgagccccgagaaggtgaccagcgccctgaagaagaccaacaagcagaccaccaccatcaacaacttccccctgcagtacctgcccggcagcaagctgctggacagattcctgagcctgagcagaagcctgctgtgcctgaacagctggagcagcagcctgcccctggccccccaggtgaagaagaagtag

SEQ ID NO: 18852 - DNA, 933 bp, Artificial Sequence
  Description of Artificial Sequence: Synthetic coding sequence
atgaagaccctgttcgaggagatcaaggccagcatcaagaacaactacaaccaggacagaagcttctgcagacccgtgctgccctggggcggcgtgttcaccatcaaggccggcagaaaggccgtgagctgcacccccctgtacgtggagatcagactgaagaacacctgcaccatcgacggcttcctgatgctgctgtacgtgatcctgaacgagaacgagaacttccccagagagctgagcctgcacttcggcagagagttcgtggactgcttcctgtacctgatggacacctacagcttcaccaccgtgaagctgctgtggatctgggacaagatggagaagcagcagtacaagagcgaggtgcacaaggccagcctgatcatcgacctgttcggcaacgagcacgacaacttcaccaagaacctggagaacctgatgagcaccatccaggagagctactgcagcaactggagatgccccaccagagtgcaggaggaccagcagagaaccatcaacatcaaccccccccaggagatcccccacggcaacctgatcagactggccgtgaacgagctgttctgcagcaagatcgagctgtgcgaggagcacggctgcggcggcctgagagagttcagccagagaatcttctgccacggcgccccccccttcgtggtgctgaacatgcagcactggaagagcgaggacctggcctacgtgccctactacctggacctgagcgaccacaagtacctgctggagggcgccaccctgttcaacaaggaggagcaccactacagcgccgccttccagatcggcggccactggatgcactacgacggcctgagaaacgtgaacctgatcctgctgaacaagccccccgagttcctgctgctgagcagcctggtgtacatcagagccaccgagaagtag

SEQ ID NO: 18853 - DNA, 2487 bp, Artificial Sequence
  Description of Artificial Sequence: Synthetic coding sequence
atggccctgagcccctggacccccggcctgggcgccggcgagaagctggtgcaggccgccgccgtgagcaccggccccagcctggagctgtgcaccctgcccagcaccctgggcagcagcgtggccgtggaggccctggagcagctgttcgtggtggagcagagcctgcagagcgactacttcaagtgcaacgaggaggccaagatcttcctgaaggacatcgccgtggccgtgaagaagctggaggagatgagaaaggccaccatcgacctgctggagatcgagagcatggagctgaacaagctgtactacctgctggagaccctgcccaacagcatcaagagagagctggaggagtgcgtgagagacgccagaagactgaacctgttcgagatcaacaccatcaagatgagaatcaccagaaccgagaacgagatcgagctgctgaagaagaagatcaccgacctgaccaagtacaacgaggccctgggcgagaagcaggaggagctggccagaaagcacgccagattcgtgctgagcctgaaccagaccatggagaagaaggccaccaccaccgtgtacatcaacgagacctacaccaagatcaacctgaagagagaggacatcgccctgcagaagaagtgcatccaggaggccgaggagctgatggagaaggagagagccgagtacctgatcagaaagcaggagctgaccgcccagatcaacgagttcgagaacaccagagaggtgaagagaatggagacctaccagaagaagaaggagctggacaagctgcagaccaagatgagcaagatcaaggagaccgtgaccgtgagcgccgccgtgctgagcgaccacaacctggagatcgccagactgcacgagagcatcagatactgggagcaggaggtgagcgagctgaagaaggacctggccatcctggaggccaagctgtgcttcttcaccgacaacaaggagaagctggacgacatcagcaacgacgagaagaacgagttcctgaacaagatcaagcagctggtggagaccctgcacgccgccagaatggagtacaaggacctgagagagaagatgaagaccctggccagacagtacaagatcgtgctgagcgaggaggagaaggccttcctgcagaagcagaagatccacgacgagaaccagaagcagctgaccttcatcagccagaaggagtacttcctgagccagaagagagtggacatcaagaacatggaggagggcctgatcaccctgcaggagctgcagcaggccaccaagaccgtgtaccagcagcagatcaagatcctgagcgccaacctggagagagagagccagagatgcgtgatcacccagtggaagatggcctgcctgagaaagaagcacgccagatggaccgccaagatcaaggccgagatccaggccatcaccgagaagatccagaacgccgaggtgagaagaatcgagctgctgaacgagaccagcttcagacagcaggagatcagcggcttcgtggcccagatcgagaagctgaccaccgagctgaaggaggaggagaaggccttcgtgaacaaggagaagatgctgatgaaggagctgagcaagtacgaggagatcttcgtgaaggagacccagatcaacaaggagaaggaggaggagctggtggagtacctgccccagctgcaggtggccgagcaggagtacaaggagaagagaagaaagctggaggagctgagcaacatcatcaccgcccagagacaggaggaggacctgctgaacaaccacatcttcctgttcaccagagacttcagcagatacatcagcaacatggaggacgtgaagcaggagctgcagcagctgagagaccaggagagcaagaagaacaaggaccacttcgagaccctgaagaacctggagaacggcttctacatcaacgaccagaaggccgacctgctgctgctggagaacaagaagctgaaggagtacatcctgtacctgaagaacaacatcgagaagtacagagagggccaggaggccctgatgcacaccagcagcgacctgagcagacagctgatcgcccaggaggcccagtacaaggacctgtgggccgagttccagaccaccgtgaagatcctggtggacaacggcgaggagaccctgcaggacatcaacaacctgaccgacaagctgagagagagagacgagaagatgcagcacgtgagcacctggctgagaggcagcctggagggcctgagactgctggtggagcaggagagccccatggacctgctgagcaagcagcagctgagagccctgctggtgaccagcaaggaggagaagacctgccagctgagcgacctggtgatccccaactacgccaccaacatccagctgaacatcgacacctacctgggcctgaacaccctggtggtgctgagcaacagcgccttccacctgagagagttcagcagatag

SEQ ID NO: 18854 - DNA, 2382 bp, Artificial Sequence
  Description of Artificial Sequence: Synthetic coding sequence
atggccctgagcccctggacccccggcctgggcgccggcgagaagctggtgcaggccgccgccgtgagcaccggccccagcctggagctgtgcaccctgcccagcaccctgggcagcagcgtggccgtggaggccctggagcagctgttcgtggtggagcagagcctgcagagcgactacttcaagtgcaacgaggaggccaagatcttcctgaaggacatcgccgtggccgtgaagaagctggaggagatgagaaaggccaccatcgacctgctggagatcgagagcatggagctgaacaagctgtactacctgctggagaccctgcccaacagcatcaagagagagctggaggagtgcgtgagagacgccagaagactgaacctgttcgagatcaacaccatcaagatgagaatcaccagaaccgagaacgagatcgagctgctgaagaagaagatcaccgacctgaccaagtacaacgaggccctgggcgagaagcaggaggagctggccagaaagcacgccagattcgtgctgagcctgaaccagaccatggagaagaaggccaccaccaccgtgtacatcaacgagacctacaccaagatcaacctgaagagagaggacatcgccctgcagaagaagtgcatccaggaggccgaggagctgatggagaaggagagagccgagtacctgatcagaaagcaggagctgaccgcccagatcaacgagttcgagaacaccagagaggtgaagagaatggagacctaccagaagaagaaggagctggacaagctgcagaccaagatgagcaagatcaaggagaccgtgaccgtgagcgccgccgtgctgagcgaccacaacctggagatcgccagactgcacgagagcatcagatactgggagcaggaggtgagcgagctgaagaaggacctggccatcctggaggccaagctgtgcttcttcaccgacaacaaggagaagctggacgacatcagcaacgacgagaagaacgagttcctgaacaagatcaagcagctggtggagaccctgcacgccgccagaatggagtacaaggacctgagagagaagatgaagaccctggccagacagtacaagatcgtgctgagcgaggaggagaaggccttcctgcagaagcagaagatccacgacgagaaccagaagcagctgaccttcatcagccagaaggagtacttcctgagccagaagagagtggacatcaagaacatggaggagggcctgatcaccctgcaggagctgcagcaggccaccaagaccgtgtaccagcagcagatcaagatcctgagcgccaacctggagagagagagccagagatgcgtgatcacccagtggaagatggcctgcctgagaaagaagcacgccagatggaccgccaagatcaaggccgagatccaggccatcaccgagaagatccagaacgccgaggtgagaagaatcgagctgctgaacgagaccagcttcagacagcaggagatcagcggcttcgtggcccagatcgagaagctgaccaccgagctgaaggaggaggagaaggccttcgtgaacaaggagaagatgctgatgaaggagctgagcaagtacgaggagatcttcgtgaaggagacccagatcaacaaggagaaggaggaggagctggtggagtacctgccccagctgcaggtggccgagcaggagtacaaggagaagagaagaaagctggaggagctgagcaacatcatcaccgcccagagacaggaggaggacctgctgaacaaccacatcttcctgttcaccagagacttcagcagatacatcagcaacatggaggacgtgaagcaggagctgcagcagctgagagaccaggagagcaagaagaacaaggaccacttcgagaccctgaagaacctggagaacggcttctacatcaacgaccagaaggccgacctgctgctgctggagaacaagaagctgaaggagtacatcctgtacctgaagaacaacatcgagaagtacagagagggccaggaggccctgatgcacaccagcagcgacctgagcagacagctgatcgcccaggaggcccagtacaaggacctgtgggccgagttccagaccaccgtgaagatcctggtggacaacggcgaggagaccctgcaggacatcaacaacctgaccgacaagctgagagagagagacgagaagatgcagcacgtgagcacctggctgagaggcagcctggagggcctgagactgctggtggagcaggagagccccatggacctgctgaagaagaagaagcacatcagaaccagagtgcacttccccgtggtgaagtgcaccgagaagaacaccctgaccaagtag

SEQ ID NO: 18855 - DNA, 1764 bp, Artificial Sequence
  Description of Artificial Sequence: Synthetic coding sequence
atgaacgacagcctgttcgtgagcctggacagactgctgctggagttcgtgttccagtacgagcaggacatcagcaccaaggaggagatgatccagagaatcaacaagtgctgcgaggacatcaaggagaacaaggtgaccatctgcagaatccacgagaccatcaacgccaccgacgaggagatcgaccactactgcaagcacagcgaggagatcaaggacaactgcagaaactggaagcccacctgcgacgtgttcagaaagcacgaggactacatgcaggaccagttcaccgtgtaccagggcaccgtggagaaggacaaggagatgtaccacgactacatctgccagtacaaggaggtgctgaagcagtaccagctgaagtacagcgagacccccttcagcagagagtactacgagaagaagagagagcacgaggagatccagagcagagtgctggcctgcaccgagcagctgaagatgaacgagaccatcttcatgaagttcagagtgcccgcccccttccccagcctgaccaagtggaccctgaacatcgtgaacctgagatgcgagacccaggacatcctgaagcacgccagcaacctgaccaagagcagcagcgagctgaagaaggaggtggacgagatggagatcgagatcaactacctgaaccagcagatcagcagacacaacgagaccaaggccctgagcgagaccctggaggagaagaacaagaacaccgagaacagaaaggagctgaaggagagaatcttcggcaaggacgagcacgtgctgaccctgaacaagacccagagcagccagctgttcctgccctacgagagccagaagctggtgagacccatcaagatgcacagcagcgagcccagagtggccgacatcaaggaggagagcagcgccaagcagagcaagctggccaacatcgacttcagacagaaggagaacgacacccagatcttcaacgacagcgccgtggacaaccacagcaagtgcagccacatcaccaccatcaccagcagccagaagttcatgcaggtgagactgctgaccccccagaagcagagcaacagcaaccagtggagcgagaagggcgacaaggacgccgagtacggcgacaagggcaccgtgagacaggtgagagagagcaagtgcaccagccaggccatctacaccgagcacttcggcaagagcgtggagaacgacagcgacgaggtggaggagagagccgagaacttccccagaaccagcgagatccccatcttcctgggcacccccaaggccgtgaaggcccccgagagcctggagaagatcaagttccccaagaccccccccttcgagatcaacagaaacagaaacgccgtgcccgaggtgcagaccgagaaggagagccccggcctgagcttcctgatgagctacaccagcagaagccccggcctgaacctgttcgacagcagcgtgttcgacaccgagatcagcagcgaccagttcaacgagcactacagcgccagaaacctgaaccccctgagcagcgagcaggagatcggcaacctgctggagaagcccgagggcgaggacggcttcaccttcagcttccccagcgacaccagcacccacaccttcggcgccggcaaggacgacttcagcttccccttcagcttcggccagggccagaacagcatccccagcagcagcctgaagggcttcagcagcagcagccagaacaccacccagttcaccttcttctag

SEQ ID NO: 18856 - DNA, 267 bp, Artificial Sequence
  Description of Artificial Sequence: Synthetic coding sequence
atgaacgacagcctgttcgtgagcctggacagactgctgctggagttcgtgttccagtacgagcaggacatcagcaccaaggaggagatgatccagagaatcaacaagtgctgcgaggacatcaaggagaacaaggtgaccatctgcagaatccacgagaccatcaacgccaccgacgaggagatcgaccactactgcaagcacagcgaggagatcaaggacaactgcagaaactggaagcccacctgcgacgtgttcagaaagtag

SEQ ID NO: 18857 - DNA, 1590 bp, Artificial Sequence
  Description of Artificial Sequence: Synthetic coding sequence
atgcccagcaagggcaaggacaagaagaagggcaagagcaagggcaaggacaccaagaagctgatcaagaccgacgagagcgtggtggacagagccaaggccaacgccagcctgtgggaggccagactggaggtgaccgagctgagcagaatcaagtacagagacaccagcagaatcctggccaagagcaacgaggacctgaagaagaagcagtgcaagatggagaaggacatcatgagcgtgctgagctacctgaagaagcaggaccaggagaaggacaacatgatcgagaagctgaagcagcagctgaacgagaccaaggagaaggcccaggaggagaaggacaagctggagcagaagtacaccagacagatcaacgagctggagggccagttccaccagaaggccaaggagatcggcatgatccacaccgagctgaaggccgtgagacagttccagaagagaaagatccaggtggagagagagctggacgacctgaaggagaacctgagaaacaccgagagaatccaccaggagaccctgagaagactggagagcagattcttcgaggagaagcacagactggagcaggaggccgagaagaagatcatcatgctggccgagagagcccaccacgaggccatcgtgcagctgaacgacgccggcagaaacgtgttcaaggagaacgactacctgcagaaggccctggcctaccacctgaaggagaccgacgccctgcagaagaacagccagaagctgcaggagagccacaccctgctgctgcaccagaaggagatcaacgacctgctggtgaaggagaagatcatgcagctggtgcagcagagaagccagatccagaccctgcagaagaaggtggtgaacctggagaccgccctgagctacatgaccaaggagttcgagagcgaggtgctgaagctgcagcagcacgccatgatcgagaaccaggccggccaggtggagatcgacaagctgcagcacctgctgcagatgaaggacagagagatgaacagagtgaagaagctggccaagaacatcctggacgagagaaccgaggtggagagattcttcctggacgccctgcaccaggtgaagcagcagatcctgatcagcagaaagcactacaagcagatcgcccaggccgccttcaacctgaagatgagagccgcctgcaccggcagaaccgagtaccccaagatcagaaccttcgacggcagagagcacagcaccaacagcgtgaaccaggacctgctggaggccgagaagtggacccacatcgagggcaacgtggacatcggcgacctgacctgggagcagaaggagaaggtgctgagactgctgttcgccaagatgaacggctgccccagcagaaagtacaaccagagcagcagaccccccgtgcccgactacgtggtgagcgacagcggcgagaccaaggagttcggcgacgagagcaagctgcaggacaagatcttcatcacccagcagatcgccatcagcgacagcagcggcgaggtggtgctgcccaccatccccaaggagccccaggagagcgacaccggcaccttctag

SEQ ID NO: 18858 - DNA, 798 bp, Artificial Sequence
  Description of Artificial Sequence: Synthetic coding sequence
atgcagctggtgcagcagagaagccagatccagaccctgcagaagaaggtggtgaacctggagaccgccctgagctacatgaccaaggagttcgagagcgaggtgctgaagctgcagcagcacgccatgatcgagaaccaggccggccaggtggagatcgacaagctgcagcacctgctgcagatgaaggacagagagatgaacagagtgaagaagctggccaagaacatcctggacgagagaaccgaggtggagagattcttcctggacgccctgcaccaggtgaagcagcagatcctgatcagcagaaagcactacaagcagatcgcccaggccgccttcaacctgaagatgagagccgcctgcaccggcagaaccgagtaccccaagatcagaaccttcgacggcagagagcacagcaccaacagcgtgaaccaggacctgctggaggccgagaagtggacccacatcgagggcaacgtggacatcggcgacctgacctgggagcagaaggagaaggtgctgagactgctgttcgccaagatgaacggctgccccagcagaaagtacaaccagagcagcagaccccccgtgcccgactacgtggtgagcgacagcggcgagaccaaggagttcggcgacgagagcaagctgcaggacaagatcttcatcacccagcagatcgccatcagcgacagcagcggcgaggtggtgctgcccaccatccccaaggagccccaggagagcgacaccagcacccagaagcccagcgacgagaacttcagcaccagctactag

SEQ ID NO: 18859 - DNA, 384 bp, Artificial Sequence
  Description of Artificial Sequence: Synthetic coding sequence
atgcccaccatgtggagaatgctgcaccaggccctgaagctgagaagaagaaccgtgctggccggccaggagatcagctacgtgctgcccgtgatgttcgtggtgagcgaggaggacagcaacagagacgtgttcctggtggccggctacagacacctggagttcggcgagagaatcgccatctggggcagcagcatgcagcacgtggagagaagaagatggcccctggacagcatccagaagagaatgggccagagcttcaccggctgggccgaggaggccgcccccggcatgaagaccaagaaggagtacgccgagatcggcgtgaagcccagacagaacgcctgcgagatgtgccccggcatgatcctgagcaccacctag

SEQ ID NO: 18860 - DNA, 978 bp, Artificial Sequence
  Description of Artificial Sequence: Synthetic coding sequence
atgcagggcagaagagagctgggcggcgagcccctgagcgacctgcaggaggaggccgccagcgccagcctgagagtggcccccgagagactgagcgacgacagcctggagtggagaagaacctgccccgacctgctgctgagcgacggcaaggccagcatcagcatgcccagagagggcggcagcacctgcaccgccagatgccccgaccccggcgagcacagcagcacctggggcgagttcgagggcttcagagagagcagcgccaagagcggccagttcagccagagcctggagctgctggagggccccaccgagccccagccccccagaaccaccagcgcccccaaggagtgcagcagccaccagccctgccagggcggcccctgggtgaccggcaccagcgccgtgccccccagcgagcccatcctgagctacgagaacatcctgaagtgcgccttccaggagatcaccgtgcagcaggccgccgaggacgtgagcaccatcgaccacttcctggagatcagcagcgaggagaagcccggcgtggagagagtgcacaagctgtgcaacgagagcagaaagctgtggagagccctgcagagcatccacaccaccagcaccagccagagactgtggagcgagagcagatgccaggagaacttcttcctggtgctgggcatcgacgccgcccagaagaacctgagcggcggccagggccacatcatggaggactgcgacctgaaggagcccgagggcctgctgaccgtgagcagcttctgcctgcagcactgcaaggccctgatccagaccaagctgagcggcccccccggcagcaagcagggcagactgatgacctgcagcagattcctgaagacccccagctgcggcggcggccagcacatcaccatccccagaaagagaatgttcacccccagaaagctgaagctgaccctgttcaacagcgacgtgtgctag

SEQ ID NO: 18861 - DNA, 1065 bp, Artificial Sequence
  Description of Artificial Sequence: Synthetic coding sequence
atgagcggccagagaggcgactgggtgcagaccagcgccctgtggcagctgctgttcagagtgctgagccccctgcccgccggcaacgccctggccagcctggccctggaggtgcaggccagactggtgaagagcgccctgtgcagccagggctaccccagactggccctggcccagctgcccgaggacggcagccagggcagcagagagctgctgctggccctgagctggctgctggccagaggccccgtgcccgagcagatgctggcccaggccagagtgcccctgggcgacgagatgaccgtgtgccagtgcgaggccctggccagccccggcccccccgccccccacatggaggccgagggccccgtggacgtgagacacgtgcagtggctgatgggcaagctgagattcagatggagacagctggtgagcagccagcaggagcagtgcgccctgctgagcaagctgctgagaaccctggagagagagaaccagagactggaggccgtgctggcctggagaagaagcgagctggtgttctggagatggatggacaccgtgctgggcacctgcgcccccgaggtgcccgccgccgccagccagcccaccttcctgccctgggtgcccgagagaggcggcggcgagctggacctggtggtgagagagctgcaggccctggaggaggagctgagagaggccgccgagagaagaagagccgcctgggaggccaaggccggcggctgcggcagaggccccgagtggagcgccgccagaagagccagcagagaggccgtggagaaggagctgggcgccctgcagcagtgctgggagagagacggcggccccgcccagccccacggcccccacagactggtgagaagagaggacggcgccgccggcgacagagacctgagagccgccgtggtgatcagaaccctgagaagccaggaggcctgcctggaggccgtgctgagaagactgcagggccagtgcagacaggagctggccagactggtgggcgccagacccggcctgatctggatccccccccccggcagatag

SEQ ID NO: 18862 - DNA, 1059 bp, Artificial Sequence
  Description of Artificial Sequence: Synthetic coding sequence
atgagcggccagagaggcgactggaccagcgccctgtggcagctgctgttcagagtgctgagccccctgcccgccggcaacgccctggccagcctggccctggaggtgcaggccagactggtgaagagcgccctgtgcagccagggctaccccagactggccctggcccagctgcccgaggacggcagccagggcagcagagagctgctgctggccctgagctggctgctggccagaggccccgtgcccgagcagatgctggcccaggccagagtgcccctgggcgacgagatgaccgtgtgccagtgcgaggccctggccagccccggcccccccgccccccacatggaggccgagggccccgtggacgtgagacacgtgcagtggctgatgggcaagctgagattcagatggagacagctggtgagcagccagcaggagcagtgcgccctgctgagcaagctgctgagaaccctggagagagagaaccagagactggaggccgtgctggcctggagaagaagcgagctggtgttctggagatggatggacaccgtgctgggcacctgcgcccccgaggtgcccgccgccgccagccagcccaccttcctgccctgggtgcccgagagaggcggcggcgagctggacctggtggtgagagagctgcaggccctggaggaggagctgagagaggccgccgagagaagaagagccgcctgggaggccaaggccggcggctgcggcagaggccccgagtggagcgccgccagaagagccagcagagaggccgtggagaaggagctgggcgccctgcagcagtgctgggagagagacggcggccccgcccagccccacggcccccacagactggtgagaagagaggacggcgccgccggcgacagagacctgagagccgccgtggtgatcagaaccctgagaagccaggaggcctgcctggaggccgtgctgagaagactgcagggccagtgcagacaggagctggccagactggtgggcgccagacccggcctgatctggatccccccccccggcagatag

SEQ ID NO: 18863 - DNA, 1182 bp, Artificial Sequence
  Description of Artificial Sequence: Synthetic coding sequence
atgggcagaagaagacagagagtggaccccgccgccggcgccagagccggcgccctgcccgaggccatcgccgccctgagcagaagcctgcccagcggccccagccccgagatcttcagaagagccaagttcgacagacccgaggccaccagcgccctgtggcagctgctgttcagagtgctgagccccctgcccgccggcaacgccctggccagcctggccctggaggtgcaggccagactggtgaagagcgccctgtgcagccagggctaccccagactggccctggcccagctgcccgaggacggcagccagggcagcagagagctgctgctggccctgagctggctgctggccagaggccccgtgcccgagcagatgctggcccaggccagagtgcccctgggcgacgagatgaccgtgtgccagtgcgaggccctggccagccccggcccccccgccccccacatggaggccgagggccccgtggacgtgagacacgtgcagtggctgatgggcaagctgagattcagatggagacagctggtgagcagccagcaggagcagtgcgccctgctgagcaagctgctgagaaccctggagagagagaaccagagactggaggccgtgctggcctggagaagaagcgagctggtgttctggagatggatggacaccgtgctgggcacctgcgcccccgaggtgcccgccgccgccagccagcccaccttcctgccctgggtgcccgagagaggcggcggcgagctggacctggtggtgagagagctgcaggccctggaggaggagctgagagaggccgccgagagaagaagagccgcctgggaggccaaggccggcggctgcggcagaggccccgagtggagcgccgccagaagagccagcagagaggccgtggagaaggagctgggcgccctgcagcagtgctgggagagagacggcggccccgcccagccccacggcccccacagactggtgagaagagaggacggcgccgccggcgacagagacctgagagccgccgtggtgatcagaaccctgagaagccaggaggcctgcctggaggccgtgctgagaagactgcagggccagtgcagacaggagctggccagactggtgggcgccagacccggcctgatctggatccccccccccggcagatag

SEQ ID NO: 18864 - DNA, 1281 bp, Artificial Sequence
  Description of Artificial Sequence: Synthetic coding sequence
atgggcagaagaagacagagagtggaccccgccgccggcgccagagccggcgccctgcccgaggccatcgccgccctgagcagaagcctgcccagcggccccagccccgagatcttcagaagagccaagttcgacagacccgaggccaccagcgccctgtggcagctgctgttcagagtgctgagccccctgcccgccggcaacgccctggccagcctggccctggaggtgcaggccagactggtgaagagcgccctgtgcagccagggctaccccagactggccctggcccagctgcccgaggacggcagccagggcagcagagagctgctgctggccctgagctggctgctggccagaggccccgtgcccgagcagatgctggcccaggccagagtgcccctgggcgacgagatgaccgtgtgccagtgcgaggccctggccagccccggcccccccgccccccacatggaggccgagggccccgtggacgtgagacacgtgcagtggctgatgggcaagctgagattcagatggagacagctggtgagcagccagcaggagcagtgcgccctgctgagcaagatccacctgtacaccagaggctgccacagcgaccagagcctgagccacctgagcgtgaccgaggccgagatgctgagagaccccgagggcggccagcagctgctgagaaccctggagagagagaaccagagactggaggccgtgctggcctggagaagaagcgagctggtgttctggagatggatggacaccgtgctgggcacctgcgcccccgaggtgcccgccgccgccagccagcccaccttcctgccctgggtgcccgagagaggcggcggcgagctggacctggtggtgagagagctgcaggccctggaggaggagctgagagaggccgccgagagaagaagagccgcctgggaggccaaggccggcggctgcggcagaggccccgagtggagcgccgccagaagagccagcagagaggccgtggagaaggagctgggcgccctgcagcagtgctgggagagagacggcggccccgcccagccccacggcccccacagactggtgagaagagaggacggcgccgccggcgacagagacctgagagccgccgtggtgatcagaaccctgagaagccaggaggcctgcctggaggccgtgctgagaagactgcagggccagtgcagacaggagctggccagactggtgggcgccagacccggcctgatctggatccccccccccggcagatag

SEQ ID NO: 18865 - DNA, 1488 bp, Artificial Sequence
  Description of Artificial Sequence: Synthetic coding sequence
atgggcagaagaagacagagagtggaccccgccgccggcgccagagccggcgccctgcccgaggccatcgccgccctgagcagaagcctgcccagcggccccagccccgagatcttcagaagagccaagttcgacagacccgaggccaccagcgccctgtggcagctgctgttcagagtgctgagccccctgcccgccggcaacgccctggccagcctggccctggaggtgcaggccagactggtgaagagcgccctgtgcagccagggctaccccagactggccctggcccagctgcccgaggacggcagccagggcagcagagagctgctgctggccctgagctggctgctggccagaggccccgtgcccgagcagatgctggcccaggccagagtgcccctgggcgacgagatgaccgtgtgccagtgcgaggccctggccagccccggcccccccgccccccacatggaggccgagggccccgtggacgtgagacacgtgcagtggctgatgggcaagctgagattcagatggagacagctggtgagcagccagcaggagcagtgcgccctgctgagcaagatccacctgtacaccagaggctgccacagcgaccagagcctgagccacctgagcgtgaccgaggccgagatgctgagagaccccgagggcggccagcaggtgagcggcgccggcgccgcccagaacctggacctggcctaccccaagtgcctgcacagcttctgcacccccggcatgggccccagaaccttctggaacgacctgtggctggtgtgcgagcagcccggcctgctgcccggcgactgggccgcccccctggaccccggcggcgccagcgcctgcagcctgctgagccccttcagagccctgctgagaaccctggagagagagaaccagagactggaggccgtgctggcctggagaagaagcgagctggtgttctggagatggatggacaccgtgctgggcacctgcgcccccgaggtgcccgccgccgccagccagcccaccttcctgccctgggtgcccgagagaggcggcggcgagctggacctggtggtgagagagctgcaggccctggaggaggagctgagagaggccgccgagagaagaagagccgcctgggaggccaaggccggcggctgcggcagaggccccgagtggagcgccgccagaagagccagcagagaggccgtggagaaggagctgggcgccctgcagcagtgctgggagagagacggcggccccgcccagccccacggcccccacagactggtgagaagagaggacggcgccgccggcgacagagacctgagagccgccgtggtgatcagaaccctgagaagccaggaggcctgcctggaggccgtgctgagaagactgcagggccagtgcagacaggagctggccagactggtgggcgccagacccggcctgatctggatccccccccccggcagatag

SEQ ID NO: 18866 - DNA, 1059 bp, Artificial Sequence; identical to SEQ ID NO: 18862
  Description of Artificial Sequence: Synthetic coding sequence

SEQ ID NO: 18867 - DNA, 474 bp, Artificial Sequence
  Description of Artificial Sequence: Synthetic coding sequence
atgctggcccaggccagagtgcccctgggcgacgagatgaccgtgtgccagtgcgaggccctggccagccccggcccccccgccccccacatggaggccgagggccccgtggacgtgagacacgtgcagtggctgatgggcaagctgagattcagatggagacagctggtgagcagccagcaggagcagtgcgccctgctgagcaagatccacctgtacaccagaggctgccacagcgaccagagcctgagccacctgagcgtgaccgaggccgagatgctgagagaccccgagggcggccagcagctgctgagaaccctggagagagagaaccagagactggaggccgtgctggcctggagaagaagcgagctggtgttctggagatggatggacaccgtgctgggcacctgcgcccccgaggtgcccgccgccgccagccagcccaccttcctgccctgggtgcccgagtag

SEQ ID NO: 18868 - DNA, 243 bp, Artificial Sequence
  Description of Artificial Sequence: Synthetic coding sequence
atgagcggccagagaggcgactggaccagcgccctgtggcagctgctgttcagagtgctgagccccctgcccgccggcaacgccctggccagcctggccctggaggtgcaggccagactggtgaagagcgccctgtgcagccagggctaccccagactggccctggcccagctgcccgaggacggcagccagggcagcagagagctgctgctggccctgagctggctgctggccagaggctag

SEQ ID NO: 18869 - DNA, 333 bp, Artificial Sequence
  Description of Artificial Sequence: Synthetic coding sequence
atgagcggccagagaggcgactggaccagcgccctgtggcagctgctgttcagagtgctgagccccctgcccgccggcaacgccctggccagcctggccctggaggtgcaggccagactggtgaagagcgccctgtgcagccagggctaccccagactggccctggcccagctgcccgaggacggcagccagggcagcagagagctgctgctggccctgagctggctgctggccagaggccccgtgcccgagcagatgctggcccaggccagagtgcccctgggcgacgagatgaccgtgtgccagtgcgaggccctggccagccccggctag

SEQ ID NO: 18870 - DNA, 747 bp, Artificial Sequence
  Description of Artificial Sequence: Synthetic coding sequence
atgctggcccaggccagagtgcccctgggcgacgagatgaccgtgtgccagatccacctgtacaccagaggctgccacagcgaccagagcctgagccacctgagcgtgaccgaggccgagatgctgagagaccccgagggcggccagcagctgctgagaaccctggagagagagaaccagagactggaggccgtgctggcctggagaagaagcgagctggtgttctggagatggatggacaccgtgctgggcacctgcgcccccgaggtgcccgccgccgccagccagcccaccttcctgccctgggtgcccgagagaggcggcggcgagctggacctggtggtgagagagctgcaggccctggaggaggagctgagagaggccgccgagagaagaagagccgcctgggaggccaaggccggcggctgcggcagaggccccgagtggagcgccgccagaagagccagcagagaggccgtggagaaggagctgggcgccctgcagcagtgctgggagagagacggcggccccgcccagccccacggcccccacagactggtgagaagagaggacggcgccgccggcgacagagacctgagagccgccgtggtgatcagaaccctgagaagccaggaggcctgcctggaggccgtgctgagaagactgcagggccagtgcagacaggagctggccagactggtgggcgccagacccggcctgatctggatccccccccccggcagatag

SEQ ID NO: 18871 - DNA, 165 bp, Artificial Sequence
  Description of Artificial Sequence: Synthetic coding sequence
atgctggcccaggccagagtgcccctgggcgacgagatgaccgtgtgccagtgcgaggccctggccagccccggcccccccgccccccacatggaggccgagggccccgtggacgtgagacacgtgcagtggctgatgggcaagctgagattcagatggagatag

SEQ ID NO: 18872 - DNA, 597 bp, Artificial Sequence
  Description of Artificial Sequence: Synthetic coding sequence
atggccaccgccgagcccagcggcagagccctgagactgagcacccccggccccagacccagcggcgccagagacagagcccccggcgccgccggcccccccagcggccagatcggcaacagagccctgagactgggcgagagaacccccgccgccgtggagaagagaggcccctacatggtgaccagagcccccagcatccaggccaagctgcagaagcacagagacctggccaaggccgtgctgagaagaaagggcatgctgggcgccagccccaacagacccgacagcagcggcaagagaagcgtgaagttcaacaagggctacaccgccctgagccagagccccgacgagaacctggtgagcctggacagcgacagcgacggcgagctgggcagcagatacagcagcggctacagcagcgccgagcaggtgaaccaggacgtgagcagacagctgctgcaggacggctaccacctggacgagatccccgacgacgaggacctggacctgatcccccccaagcccatggccagcagcacctgcagctgctgctggtgctgcctgggcgacagcagcagctgcaccctgcagtag

SEQ ID NO: 18873 - DNA, 447 bp, Artificial Sequence
  Description of Artificial Sequence: Synthetic coding sequence
atggccaccgccgagcccagcggcagagccctgagactgagcacccccggccccagacccagcggcgccagagacagagcccccggcgccgccggcccccccagcggccagatcggcaacagagccctgagactgggcgagagaacccccgccgccgtggagaagagaggcccctacatggtgaccagagcccccagcatccaggccaagctgcagaagcacagagacctggccaaggccgtgctgagaagaaagggcatgctgggcgccagccccaacagacccgacagcagcggcaagagaagcgtgaagttcaacaagggctacaccgccctgagccagagccccgacgagaacctggtgagcctggacagcgacagacccttcatgtacatccccggccccttcagcagcgagcagtaccccttccccggctggctgggctag

SEQ ID NO: 18874 - DNA, 906 bp, Artificial Sequence
  Description of Artificial Sequence: Synthetic coding sequence
atggcccagaacgtgtacggccccggcgtgagaatcggcaactggaacgaggacgtgtacctggaggaggagctgatgaaggacttcctggagaagagagacaagggcaagctgctgatccagagaagcagaagactgaagcagaacctgctgagacccatgcagctgagcgtgaccgaggacggctacatccactacggcgacaaggtgatgctggtgaaccccgacgaccccgacaccgaggccgacgtgttcctgagaggcgacctgagcctgtgcatgacccccgacgagatccagagccacctgaaggacgagctggaggtgccctgcggcctgagcgccgtgcaggccaagacccccatcggcagaaacaccttcatcatcctgagcgtgcacagagacgccaccggccaggtgctgagatacggccaggacttctgcctgggcatcaccggcggcttcgacaacaagatgctgtacctgagcagcgaccacagaaccctgctgaagagcagcaagagaagctggctgcaggaggtgtacctgaccgacgaggtgagccacgtgaactgctggcaggccgccttccccgacccccagctgagactggagtacgagggcttccccgtgcccgccaacgccaagatcctgatcaaccactgccacaccaacagaggcctggccgcccacagacacctgttcctgagcacctacttcggcaaggaggccgaggtggtggcccacacctacctggacagccacagagtggagaagcccagaaaccactggatgctggtgaccggcaaccccagagacgccagcagcagcatgctggacctgcccaagccccccaccgaggacaccagagccatggagcaggccatgggcctggacacccagtag

SEQ ID NO: 18875 - DNA, 600 bp, Artificial Sequence
  Description of Artificial Sequence: Synthetic coding sequence
atgaaggacttcctggagaagagagacaagggcaagctgctgatccagagaagcagaagactgaagcagaacctgctgagacccatgcagctgagcgtgaccgaggacggctacatccactacggcgacaaggtgatgctggtgaaccccgacgaccccgacaccgaggccgacgtgttcctgagaggcgacctgagcctgtgcatgacccccgacgagatccagagccacctgaaggacgagctggaggtgccctgcggcctgagcgccgtgcaggccaagacccccatcggcagaaacaccttcatcatcctgagcgtgcacagagacgccaccggccaggtgctgagatacggccaggacttctgcctgggcatcaccggcggcttcgacaacaagatgctgtacctgagcagcgaccacagaaccctgctgaagagcagcaagagaagctggctgcaggaggtgtacctgaccgacgaggtgagccacgtgaactgctggaacatgaaggccagccccagcagacagatgctgaagttcagcagcatcaccgtgacccagatcggcgactggcagcccaccggcatcttcagctag

SEQ ID NO: 18876 - DNA, 537 bp, Artificial Sequence
  Description of Artificial Sequence: Synthetic coding sequence
atgaacaagagaaccagcgtggacgccagcaaggaggacctgcaccccgccgacccccagagcggcgagggcgtgccccccaacagaaagaacaccaagaccagccccagaggcgagggcaccgccccccccttcagcgccagaccctgcgtgtggaccctgtgcgagatgctgagcatcctggccctggtgggcgtgctgcaccccttctacagaagcaacaaccaggtgtaccagaagctgaagacccacctgagatgccagagcagcagagtggacggcctgatgctgaagcccaccctgctgacccccagccagctgaagagccccgagggccacctgatcctgcccaccttcaaccacctggtgatcagacacatcctggaccccaagcagatcttctgcgtggccgacgtgtgcaccgactgcaagttcaactgcggcagcatcgagagacaccagaagagacacctgatgagagtgagccaggactgggagcacctgatcagatacagaaaccagatctgcctgagctag

SEQ ID NO: 18877 - DNA, 1527 bp, Artificial Sequence
  Description of Artificial Sequence: Synthetic coding sequence
atggccggccagagaacctgccagagaagaagcagcagagccggccccggcaagatgcaggagccccccaagagcatcgaggagttcctgaagttccagaactgggactactggcccagagagatccacttcagagacgacgacaagtggagctgcaccctgaagaagatcaaggaggacagcagcttcgtgagcatctacacccacctgtgggagaacgtgcccagaatcttcgaggccctgctgatcatggagagcaagctgaaggagtacagcctgatcctgcagaaccacaccagcgagatcttcaagtggaagagcatgatcagcgagaccagcagctacagaaagctggagagatacggcgagttcctgaagaagtaccacaagaagaagaagatcatgctgagcgacgagatggagaccgagaagaacatcgagggctgcagcttcaccggcttcaaggccaacgagctgacccagctgcccagacacctggacgccgagcagatctacctgttcatcctgaaggcccacaacttcgacgagagagtgttcaagatctggaagacccacttcctgagcgaggccagcatcgccctgctgcacgacagcttctggtggtggttcctgcacaagttcagacccgacagagagaaccaggactgcctgttcgacagaatcagcgagagctacgtgaccctgttcatgagcatccccctgagcagaaaggacgccttcttccagatctaccccgactgcctggcccaggccatctacgccaccttccacgaggccttccccgagagcagctacctgttcaacgacgagttcaaggaggacctgggcaacaacatcttcctgtggtgcagcggcctgaagccccagaagggcttctggatccactggaagctgaaggagctgagcaccaccaccatccacggcagcaagaaggcccccgccaagagcgtgaaggagagaatcgccgacagccaggagcacatcagcaccagcatcgacttcaacatcatcaagatcctgaacaaccccagagcctacaccctgcccatcagcaaggaggagagcagactgagcagactggccaccaagagccactacagcagcaccggccccgagttcaacagagtgctgttcaacttcggcggccagagccccctgatcctgtactacctgaagatgcacgagctggccggcatcagcaaggcccccaagaagaccaagatcaagctgaccaagatcttccaggagcccctgcccgcccccacctacagagacgtgatcaaggaggccaagagacagttcgccagaaaccagaaggacttcagaatcctgcaggccaaggccaccaagaagccccacgaggtgaagcaggacttcgagaagttcctgcacaagctgagaagcgaggccgagatcgagagagagtgcgtggccagcctgagcagcagcagcagcagcagccccagcagcaccgacaactacaacttcgaggaggaggagtactag

SEQ ID NO: 18878 - DNA, 912 bp, Artificial Sequence
  Description of Artificial Sequence: Synthetic coding sequence
atggccggccagagaacctgccagagaagaagcagcagagccggccccggcaagatgcaggagccccccaagagcatcgaggagttcctgaagttccagaactgggactactggcccagagagatccacttcagagacgacgacaagtggagctgcaccctgaagaagatcaaggaggacagcagcttcgtgagcatctacacccacctgtgggagaacgtgcccagaatcttcgaggccctgctgatcatggagagcaagctgaaggagtacagcctgatcctgcagaaccacaccagcgagatcttcaagtggaagagcatgatcagcgagaccagcagctacagaaagctggagagatacggcgagttcctgaagaagtaccacaagaagaagaagatcatgctgagcgacgagatggagaccgagaagaacatcgagggctgcagcttcaccggcttcaaggccaacgagctgacccagctgcccagacacctggacgccgagcagatctacctgttcatcctgaaggcccacaacttcgacgagagagtgttcaagatctggaagacccacttcctgagcgaggccagcatcgccctgctgcacgacagcttctggtggtggttcctgcacaagttcagaatctaccccgactgcctggcccaggccatctacgccaccttccacgaggccttccccgagagcagctacctgttcaacgacgagttcaaggaggacctgggcaacaacatcttcctgtggtgcagcggcctgaagccccagaagggcttctggatccactggaagctgaaggagctgagcaccaccaccatccacggcagcaagaaggcccccgccaagagcgtgaaggagagaatcgccgacagccaggagcacatcagcacctag

SEQ ID NO: 18879 - DNA, 549 bp, Artificial Sequence
  Description of Artificial Sequence: Synthetic coding sequence
atggccggccagagaacctgccagagaagaagcagcagagccggccccggcaagatgcaggagccccccaagagcatcgaggagttcctgaagttccagaactgggactactggcccagagagatccacttcagagacgacgacaagtggagctgcaccctgaagaagatcaaggaggacagcagcttcgtgagcatctacacccacctgtgggagaacgtgcccagaatcttcgaggccctgctgatcatggagagcaagctgaaggagtacagcctgatcctgcagaaccacaccagcgagatcttcaagtggaagagcatgatcagcgagaccagcagctacagaaagctggagagatacggcgagttcctgaagaagtaccacaagaagaagaagatcatgctgagcgacgagatggagaccgagaagaacatcgagggctgcagcttcaccggcttcaaggccaacgagctgacccagctgcccagacacctggacgccgagcagatctacctgttcatcctgaaggcccacaacttcgactag

SEQ ID NO: 18880 - DNA, 915 bp, Artificial Sequence
  Description of Artificial Sequence: Synthetic coding sequence
atggccggccagagaacctgccagagaagaagcagcagagccggccccggcaagatgcaggagccccccaagagcatcgaggagttcctgaagttccagaactgggactactggcccagagagatccacttcagagacgacgacaagtggagctgcaccctgaagaagatcaaggaggacagcagcttcgtgagcatctacacccacctgtgggagaacgtgcccagaatcttcgaggccctgctgatcatggagagcaagctgaaggagtacagcctgatcctgcagaaccacaccagcgagatcttcaagtggaagagcatgatcagcgagaccagcagctacagaaagctggagagatacggcgagttcctgaagaagtaccacaagaagaagaagatcatgctgagcgacgagatggagaccgagaagaacatcgagggctgcagcttcaccggcttcaaggccaacgagctgacccagctgcccagacacctggacgccgagcagatctacctgttcatcctgaaggcccacaacttcgacgagagagtgttcaagatctggaagacccacttcctgagcgaggccagcatcgccctgctgcacgacagcttctggtggtggttcctgcacaagttcagaatctaccccgactgcctggcccaggccatctacgccaccttccacgaggccttccccgagagcagctacctgttcaacgacgagttcaaggaggacctgggcaacaacatcttcctgtggtgcagcggcctgaagccccagaagggcttctggatccactggaagctgaaggagctgagcaccaccaccatccacggcagcaagaaggcccccgccaagagcgtgaaggagagaatcgccgacagccaggagcacatcagcaccagctag

SEQ ID NO: 18881 - DNA, 393 bp, Artificial Sequence
  Description of Artificial Sequence: Synthetic coding sequence
atgcccagacccgccagcgagagctggagccccatccagagcagaatccccgcctacaaggccgtgagccacctgagactgctgcccaccgccaacagccccagcggcagcaaccagcccaccaaccccaacagagcccagcaccccgagggcccccagagcagagagggcgccaccagccccgtgctggccagcctggagccccccacccccaccgacctgcccagcgccagagccagacccagagtgcccgccgagagcggccccggctggctgcacaaggccagaagacccaccagaggcatcctgagagacgtgctgagacacagaggcgtgcccgcccagcccagacccgcccccggcgcccaccagctgagcagccccagcagctag

SEQ ID NO: 18882 - DNA, 681 bp, Artificial Sequence
  Description of Artificial Sequence: Synthetic coding sequence
atgagcagaatctaccacgacggcgccctgagaaacaaggccgtgcagagcgtgagactgcccggcgcctgggaccccgccgcccaccagggcggcaacggcgtgctgctggagggcgagctgatcgacgtgagcagacacagcatcctggacacccacggcagaaaggagagatactacgtgctgtacatcagacccagccacatccacagaagaaagttcgacgccaagggcaacgagatcgagcccaacttcagcgccaccagaaaggtgaacaccggcttcctgatgagcagctacaaggtggaggccaagggcgacaccgacagactgacccccgaggccctgaagggcctggtgaacaagcccgagctgctggccctgaccgagagcctgacccccgaccacaccgtggccttctggatgcccgagagcgagatggaggtgatggagctggagctgggcgccggcgtgagactgaagaccagaggcgacggccccttcctggacagcctggccaagctggaggccggcaccgtgaccaagtgcaacttcaccggcgacggcaagaccggcgccagctggaccgacaacatcatggcccagaagtgcagcaagggcgccgccgccgagatcagagagcagggcgacggcgccgaggacgaggagtgggacgactag

SEQ ID NO: 18883 - DNA, 3144 bp, Artificial Sequence
  Description of Artificial Sequence: Synthetic coding sequence
atggccgagaagagacccctgagaaccctgggccccgtgatgtacggcaagctgcccagactggagaccgacagcggcctggagcacagcctgccccacagcgtgggcaaccaggacccctgcacctacaagggcagctacttcagctgccccatggccggcacccccaaggccgagagcgagcagctggccagctggaccccctacccccccctgtacagcaccggcatggccggcccccccctgcaggccgacaacctgctgaccaactgcctgttctacagaagccccgccgagggccccgagaagatgcaggacagcagccccgtggagctgctgcccttcagcccccaggcccacagctaccccggcccccccctggccgcccccaagcccgtgtacagaaaccccctgtgctacggcctgagcacctgcctgggcgagggcgccgtgaagagacccctggacgtggactggaccctggccaccggccccctgctgcccagcgccgaccccccctgcagcctggcccccgcccccagcaagggccagaccctggacggcaccttcctgagaggcgtgcccgccgagggcagcagcaaggacagcagcggcagcttcagcccctgccagcccttcctggagaagtaccagaccatccacagcaccggcttcctggccagcagatacaccggcccctaccccagaaacagcaagcaggccatgagcgagggccccagcagcccctggacccagctggcccagcccctgggccccccctgccaggacaccggccccacccactacccccccccccaccacccccccccccaccccccccaggccctgccctgcccccccgcctgcagacaccccgagaagcagggcagctacagccccgccctgcccctgcagcccctgggcggccacaagggcaccggctaccaggccggcggcctgggcagcccctacctgagacagcaggccgcccaggccccctacatcccccccctgggcctggacgcctacccctaccccagcgcccccctgcccgcccccagccccggcctgaagctggagccccccctgacccccagatgccccctggacttcgccccccagaccctgagcttcccctacgccagagacgacctgagcctgtacggcgccagccccggcctgggcggcaccccccccagccagaacaacgtgagagccgtgccccagcccggcgccttccagagagcctgccagcccctgcccgccagccagccctgcagcgagcccgtgagacccgcccaggaggccgaggagaagacctggctgcccagctgcagaaaggagaagctgcagcccagactgagcgagcacagcggcccccccatcgtgatcagagacagccccgtgccctgcaccccccccgccctgcccccctgcgccagagagtgccagagcctgccccagaaggagggcgccagaccccccagcagcccccccatgcccgtgatcgacaacgtgttcagcctggccccctacagagactacctggacgtgcccgcccccgaggccaccaccgagcccgacagcgccaccgccgagcccgacagcgcccccgccaccagcgagggccaggacaagggctgcagaggcaccctgcccgcccaggagggccccagcggcagcaagcccctgagaggcagcctgaaggaggaggtggccctggacctgagcgtgagaaagcccaccgccgaggccagccccgtgaaggccagcagaagcgtggagcacgccaagcccaccgccgccatggacgtgcccgacgtgggcaacatggtgagcgacctgcccggcctgaagaagatcgacaccgaggcccccggcctgcccggcgtgcccgtgaccaccgacgccatgcccagaaccaacttccacagcagcgtggccttcatgttcagaaagttcaagatcctgagacccgcccccctgcccgccgccgtggtgcccagcacccccaccagcgcccccgcccccacccagcccgcccccacccccaccagcggccccatcggcctgagaatcctggcccagcagcccctgagcgtgacctgcttcagcctggccctgcccagcccccccgccgtggccgtggccagccccgcccccgcccccgcccccagccccgcccccgccagagcccaggcccccgccagcgccagagaccccgcccccgcccccgcccccgtggccggccccgcccccgccagcaccagcgcccccggcgacagcctggagcagcacttcaccggcctgcacgccagcctgtgcgacgccatcagcggcagcgtggcccacagcccccccgagaagctgagagagtggctggagaccgccggcccctggggccaggccgcctggcaggactgccagggcgtgcagggcctgctggccaagctgctgagccagctgcagagattcgacagaacccacagatgccccttcccccacgtggtgagagccggcgccatcttcgtgcccatccacctggtgaaggagagactgttccccagactgccccccgccagcgtggaccacgtgctgcaggagcacagagtggagctgagacccaccaccctgagcgaggagagagccctgagagagctggccctgcccggctgcaccagcagaatgctgaagctgctggccctgagacagctgcccgacatctaccccgacctgctgggcctgcagtggagagactgcgtgagaagacagctgggcgacttcgacaccgaggccggcgccgtgagcagcagcgagcccaccgtggccagaggcgagcccgagagcctggccctggcccagaagagccccgcccccaaggtgagaaagcccggcagaaagccccccacccccggccccgagaaggccgaggccgccgccggcgaggagagctgcggcgccagccccacccccgccaccagcgccagcccccccggccccaccctgaaggccagattcagaagcctgctggagaccgcctggctgaacggcctggccctgcccacctggggccacaagagcagcagacccgaccagcccagcccctgcccccagctgctggacagccagagccaccacctgtag

SEQ ID NO: 18884 - DNA, 3144 bp, Artificial Sequence; identical to SEQ ID NO: 18883
  Description of Artificial Sequence: Synthetic coding sequence

SEQ ID NO: 18885 - DNA, 1338 bp, Artificial Sequence
  Description of Artificial Sequence: Synthetic coding sequence
atggacgtgcccgacgtgggcaacatggtgagcgacctgcccggcctgaagaagatcgacaccgaggcccccggcctgcccggcgtgcccgtgaccaccgacgccatgcccagaaccaacttccacagcagcgtggccttcatgttcagaaagttcaagatcctgagacccgcccccctgcccgccgccgtggtgcccagcacccccaccagcgcccccgcccccacccagcccgcccccacccccaccagcggccccatcggcctgagaatcctggcccagcagcccctgagcgtgacctgcttcagcctggccctgcccagcccccccgccgtggccgtggccagccccgcccccgcccccgcccccagccccgcccccgccagagcccaggcccccgccagcgccagagaccccgcccccgcccccgcccccgtggccggccccgcccccgccagcaccagcgcccccggcgacagcctggagcagcacttcaccggcctgcacgccagcctgtgcgacgccatcagcggcagcgtggcccacagcccccccgagaagctgagagagtggctggagaccgccggcccctggggccaggccgcctggcaggactgccagggcgtgcagggcctgctggccaagctgctgagccagctgcagagattcgacagaacccacagatgccccttcccccacgtggtgagagccggcgccatcttcgtgcccatccacctggtgaaggagagactgttccccagactgccccccgccagcgtggaccacgtgctgcaggagcacagagtggagctgagacccaccaccctgagcgaggagagagccctgagagagctggccctgcccggctgcaccagcagaatgctgaagctgctggccctgagacagctgcccgacatctaccccgacctgctgggcctgcagtggagagactgcgtgagaagacagctgggcgacttcgacaccgaggccggcgccgtgagcagcagcgagcccaccgtggccagaggcgagcccgagagcctggccctggcccagaagagccccgcccccaaggtgagaaagcccggcagaaagccccccacccccggccccgagaaggccgaggccgccgccggcgaggagagctgcggcgccagccccacccccgccaccagcgccagcccccccggccccaccctgaaggccagattcagaagcctgctggagaccgcctggctgaacggcctggccctgcccacctggggccacaagagcagcagacccgaccagcccagcccctgcccccagctgctggacagccagagccaccacctgtag

SEQ ID NO: 18886 - DNA, 381 bp, Artificial Sequence
  Description of Artificial Sequence: Synthetic coding sequence
atgcccaagaaggccggcgccaccaccaagggcaagagccagagcaaggagcccgagagacccctgccccccctgggccccgtggccgtggaccccaagggctgcgtgaccatcgccatccacgccaagcccggcagcaagcagaacgccgtgaccgacctgaccgccgaggccgtgaacgtggccatcgccgccccccccagcgagggcgaggccaacgccgagctgtgcagatacctgagcaaggtgctggagctgagaaagagcgacgtggtgctggacaagggcggcaagagcagagagaaggtggtgaagctgctggccagcaccacccccgaggagatcctggagaagctgaagaaggaggccaagaagacctag

SEQ ID NO: 18887 - DNA, 504 bp, Artificial Sequence
  Description of Artificial Sequence: Synthetic coding sequence
atgctgagactgagaagcggcctgagacacctgagagccacccccaacaccagaggcagcgccagactgctgtgcgccgagatgcccaagaaggccggcgccaccaccaagggcaagagccagagcaaggagcccgagagacccctgccccccctgggccccgtggccgtggaccccaagggctgcgtgaccatcgccatccacgccaagcccggcagcaagcagaacgccgtgaccgacctgaccgccgaggccgtgaacgtggccatcgccgccccccccagcgagggcgaggccaacgccgagctgtgcagatacctgagcaaggtgctggagctgagaaagagcgacgtggtgctggacaagaccggcagctgctacatcgcccaggccggcctggagctgctggccagcagcgacctgcccgccagcgccagccagagcgccggcatcaccggcgtgagccaccacacccagcccgccctgctgctgatcagcctgtag

SEQ ID NO: 18888 - DNA, 462 bp, Artificial Sequence
  Description of Artificial Sequence: Synthetic coding sequence
atgctgagactgagaagcggcctgagacacctgagagccacccccaacaccagaggcagcgccagactgctgtgcgccgagatgcccaagaaggccggcgccaccaccaagggcaagagccagagcaaggagcccgagagacccctgccccccctgggccccgtggccgtggaccccaagggctgcgtgaccatcgccatccacgccaagcccggcagcaagcagaacgccgtgaccgacctgaccgccgaggccgtgaacgtggccatcgccgccccccccagcgagggcgaggccaacgccgagctgtgcagatacctgagcaaggtgctggagctgagaaagagcgacgtggtgctggacaagggcggcaagagcagagagaaggtggtgaagctgctggccagcaccacccccgaggagatcctggagaagctgaagaaggaggccaagaagacctag

SEQ ID NO: 18889 - DNA, 450 bp, Artificial Sequence
  Description of Artificial Sequence: Synthetic coding sequence
atgctgagactgagaagcggcctgagacacctgagagccacccccaacaccagaggcagcgccagactgctgtgcgccgagatgcccaagaaggccggcgccaccaccaagggcaagagccagagcaaggagcccgagagacccctgccccccctgggccccgtggccgtggaccccaagggctgcgtgaccatcgccatccacgccaagcccggcagcaagcagaacgccgtgaccgacctgaccgccgaggccgtgaacgtggccatcgccgccccccccagcgagggcgaggccaacgccgagctgtgcagatacctgagcaaggtgctggagctgagaaagagcgacgtggtgctggacaagctgtgctacagcatcccccagcagctggaggagacccaggagggcgtgagcggcatccccgacaccccctgccacttcctgtag

SEQ ID NO: 18890 - DNA, 552 bp, Artificial Sequence
  Description of Artificial Sequence: Synthetic coding sequence
atggccagactgatcctggagagattcctgcaggagcacgaggagaccccccccagcaagagcatcatcaacagcatgctgagagaccccagccagatccccgacggcgtgctggccaaccaggtgtaccagtgcatcgtgaacgactgctgctacggccccctggtggactgcatcaagcacgccatcggccacgagcacgaggtgctgctgagagacctgctgctggagaagaacctgagcttcctggacgaggaccagctgagagccaagggctacgacaagacccccgacttcatcctgcaggtgcccgtggccgtggagggccacatcatccactggatcgagagcaaggccagcttcggcgacgagtgcagccaccacgcctacctgcacgaccagttctggagctactggaacagattcggccccggcctggtgatctactggtacggcttcatccaggagctggactgcaacagagagagaggcatcctgctgaaggcctgcttccccaccaacatcgtgaccctgtgccacagcatcgcctag

SEQ ID NO: 18891 - DNA, 846 bp, Artificial Sequence
  Description of Artificial Sequence: Synthetic coding sequence
atgatcctgaccaaggcccagtacgacgagatcgcccagtgcctggtgagcgtgccccccaccagacagagcctgagaaagctgaagcagagattccccagccagagccaggccaccctgctgagcatcttcagccaggagtaccagaagcacatcaagagaacccacgccaagcaccacaccagcgaggccatcgagagctactaccagagatacctgaacggcgtggtgaagaacggcgccgcccccgtgctgctggacctggccaacgaggtggactacgcccccagcctgatggccagactgatcctggagagattcctgcaggagcacgaggagaccccccccagcaagagcatcatcaacagcatgctgagagaccccagccagatccccgacggcgtgctggccaaccaggtgtaccagtgcatcgtgaacgactgctgctacggccccctggtggactgcatcaagcacgccatcggccacgagcacgaggtgctgctgagagacctgctgctggagaagaacctgagcttcctggacgaggaccagctgagagccaagggctacgacaagacccccgacttcatcctgcaggtgcccgtggccgtggagggccacatcatccactggatcgagagcaaggccagcttcggcgacgagtgcagccaccacgcctacctgcacgaccagttctggagctactggaacagattcggccccggcctggtgatctactggtacggcttcatccaggagctggactgcaacagagagagaggcatcctgctgaaggcctgcttccccaccaacatcgtgaccctgtgccacagcatcgcctag

SEQ ID NO: 18892 - DNA, 552 bp, Artificial Sequence; identical to SEQ ID NO: 18890
  Description of Artificial Sequence: Synthetic coding sequence

SEQ ID NO: 18893 - DNA, 663 bp, Artificial Sequence
  Description of Artificial Sequence: Synthetic coding sequence
atgttccagggccagagaggctggttctgcggcagcgtgagccaggacctgagacagttctgggtggccgagggcggcaccatcagcgaccccagagccgccgacttcctgttcagctgcgacgccagccaccccgacaccctgagaatctaccagagcctggactacatcgaggacaacgccaccgtgttccacgcctactacctgagcgccgtggccaacgccaagatcaagaacagcgtggccctgggccacttcatcctgccccccgcctgcctgcagaaggagatcagaagaaagatcggcagcttcatctgggagcaggaccagcacttcctgatcgagaagcacgacgaggtgacccccaacgagatcaagaccctgagagagaacagcgagctggccaccgagcacaagaaggagctgagcaagagccccgagaagcacttcatcagaacccccgtggtggagaagcagatgtacttccccctgcagaactaccccgtgaacaacatggtgaccggctacatcagcatcgacgccatgaagaagttcctgggcgagctgcacgacttcatccccggcaccagcggctacctggcctaccacgtgcagaacgagatcaacatgagcgccatcaagaacaagctgaagagaaagtag

SEQ ID NO: 18894 - DNA, 1557 bp, Artificial Sequence
  Description of Artificial Sequence: Synthetic coding sequence
atgcccaccgtggtggtgatggacgtgagcctgagcatgaccagacccgtgagcatcgagggcagcgaggagtaccagagaaagcacctggccgcccacggcctgaccatgctgttcgagcacatggccaccaactacaagctggagttcaccgccctggtggtgttcagcagcctgtgggagctgatggtgcccttcaccagagactacaacaccctgcaggaggccctgagcaacatggacgactacgacaagacctgcctggagagcgccctggtgggcgtgtgcaacatcgtgcagcaggagtggggcggcgccatcccctgccaggtggtgctggtgaccgacggctgcctgggcatcggcagaggcagcctgagacacagcctggccacccagaaccagagaagcgagagcaacagattccccctgcccttccccttccccagcaagctgtacatcatgtgcatggccaacctggaggagctgcagagcaccgacagcctggagtgcctggagagactgatcgacctgaacaacggcgagggccagatcttcaccatcgacggccccctgtgcctgaagaacgtgcagagcatgttcggcaagctgatcgacctggcctacacccccttccacgccgtgctgaagtgcggccacctgaccgccgacgtgcaggtgttccccagacccgagcccttcgtggtggacgaggagatcgaccccatccccaaggtgatcaacaccgacctggagatcgtgggcttcatcgacatcgccgacatcagcagcccccccgtgctgagcagacacctggtgctgcccatcgccctgaacaaggagggcgacgaggtgggcaccggcatcaccgacgacaacgaggacgagaacagcgccaaccagatcgccggcaagatccccaacttctgcgtgctgctgcacggcagcctgaaggtggagggcatggtggccatcgtgcagctgggccccgagtggcacggcatgctgtacagccaggccgacagcaagaagaagagcaacctgatgatgagcctgttcgagcccggccccgagcccctgccctggctgggcaagatggcccagctgggccccatcagcgacgccaaggagaacccctacggcgaggacgacaacaagagccccttccccctgcagcccaagaacaagagaagctacgcccagaacgtgaccgtgtggatcaagcccagcggcctgcagaccgacgtgcagaagatcctgagaaacgccagaaagctgcccgagaagacccagaccttctacaaggagctgaacagactgagaaaggccgccctggccttcggcttcctggacctgctgaagggcgtggccgacatgctggagagagagtgcaccctgctgcccgagaccgcccaccccgacgccgccttccagctgacccacgccgcccagcagctgaagctggccagcaccggcaccagcgagtacgccgcctacgaccagaacatcacccccctgcacaccgacttcagcggcagcagcaccgagagaatctag

SEQ ID NO: 18895 - DNA, 1557 bp, Artificial Sequence; identical to SEQ ID NO: 18894
  Description of Artificial Sequence: Synthetic coding sequence

SEQ ID NO: 18896 - DNA, 1386 bp, Artificial Sequence
  Description of Artificial Sequence: Synthetic coding sequence
atgcccaccgagagcctgtgcagaagaaccgtgagcggcgacggccacggcgaggccctgagcaacatggacgactacgacaagacctgcctggagagcgccctggtgggcgtgtgcaacatcgtgcagcaggagtggggcggcgccatcccctgccaggtggtgctggtgaccgacggctgcctgggcatcggcagaggcagcctgagacacagcctggccacccagaaccagagaagcgagagcaacagattccccctgcccttccccttccccagcaagctgtacatcatgtgcatggccaacctggaggagctgcagagcaccgacagcctggagtgcctggagagactgatcgacctgaacaacggcgagggccagatcttcaccatcgacggccccctgtgcctgaagaacgtgcagagcatgttcggcaagctgatcgacctggcctacacccccttccacgccgtgctgaagtgcggccacctgaccgccgacgtgcaggtgttccccagacccgagcccttcgtggtggacgaggagatcgaccccatccccaaggtgatcaacaccgacctggagatcgtgggcttcatcgacatcgccgacatcagcagcccccccgtgctgagcagacacctggtgctgcccatcgccctgaacaaggagggcgacgaggtgggcaccggcatcaccgacgacaacgaggacgagaacagcgccaaccagatcgccggcaagatccccaacttctgcgtgctgctgcacggcagcctgaaggtggagggcatggtggccatcgtgcagctgggccccgagtggcacggcatgctgtacagccaggccgacagcaagaagaagagcaacctgatgatgagcctgttcgagcccggccccgagcccctgccctggctgggcaagatggcccagctgggccccatcagcgacgccaaggagaacccctacggcgaggacgacaacaagagccccttccccctgcagcccaagaacaagagaagctacgcccagaacgtgaccgtgtggatcaagcccagcggcctgcagaccgacgtgcagaagatcctgagaaacgccagaaagctgcccgagaagacccagaccttctacaaggagctgaacagactgagaaaggccgccctggccttcggcttcctggacctgctgaagggcgtggccgacatgctggagagagagtgcaccctgctgcccgagaccgcccaccccgacgccgccttccagctgacccacgccgcccagcagctgaagctggccagcaccggcaccagcgagtacgccgcctacgaccagaacatcacccccctgcacaccgacttcagcggcagcagcaccgagagaatctag

SEQ ID NO: 18897 - DNA, 1320 bp, Artificial Sequence
  Description of Artificial Sequence: Synthetic coding sequence
atggacgactacgacaagacctgcctggagagcgccctggtgggcgtgtgcaacatcgtgcagcaggagtggggcggcgccatcccctgccaggtggtgctggtgaccgacggctgcctgggcatcggcagaggcagcctgagacacagcctggccacccagaaccagagaagcgagagcaacagattccccctgcccttccccttccccagcaagctgtacatcatgtgcatggccaacctggaggagctgcagagcaccgacagcctggagtgcctggagagactgatcgacctgaacaacggcgagggccagatcttcaccatcgacggccccctgtgcctgaagaacgtgcagagcatgttcggcaagctgatcgacctggcctacacccccttccacgccgtgctgaagtgcggccacctgaccgccgacgtgcaggtgttccccagacccgagcccttcgtggtggacgaggagatcgaccccatccccaaggtgatcaacaccgacctggagatcgtgggcttcatcgacatcgccgacatcagcagcccccccgtgctgagcagacacctggtgctgcccatcgccctgaacaaggagggcgacgaggtgggcaccggcatcaccgacgacaacgaggacgagaacagcgccaaccagatcgccggcaagatccccaacttctgcgtgctgctgcacggcagcctgaaggtggagggcatggtggccatcgtgcagctgggccccgagtggcacggcatgctgtacagccaggccgacagcaagaagaagagcaacctgatgatgagcctgttcgagcccggccccgagcccctgccctggctgggcaagatggcccagctgggccccatcagcgacgccaaggagaacccctacggcgaggacgacaacaagagccccttccccctgcagcccaagaacaagagaagctacgcccagaacgtgaccgtgtggatcaagcccagcggcctgcagaccgacgtgcagaagatcctgagaaacgccagaaagctgcccgagaagacccagaccttctacaaggagctgaacagactgagaaaggccgccctggccttcggcttcctggacctgctgaagggcgtggccgacatgctggagagagagtgcaccctgctgcccgagaccgcccaccccgacgccgccttccagctgacccacgccgcccagcagctgaagctggccagcaccggcaccagcgagtacgccgcctacgaccagaacatcacccccctgcacaccgacttcagcggcagcagcaccgagagaatctag

SEQ ID NO: 18898 - DNA, 1449 bp, Artificial Sequence
  Description of Artificial Sequence: Synthetic coding sequence
atgcccaccgtggtggtgatggacgtgagcctgagcatgaccagacccgtgagcatcgagggcagcgaggagtaccagagaaagcacctggccgcccacggcctgaccatgctgttcgagcacatggccaccaactacaagctggagttcaccgccctggtggtgttcagcagcctgtgggagctgatggtgcccttcaccagagactacaacaccctgcaggtggtgctggtgaccgacggctgcctgggcatcggcagaggcagcctgagacacagcctggccacccagaaccagagaagcgagagcaacagattccccctgcccttccccttccccagcaagctgtacatcatgtgcatggccaacctggaggagctgcagagcaccgacagcctggagtgcctggagagactgatcgacctgaacaacggcgagggccagatcttcaccatcgacggccccctgtgcctgaagaacgtgcagagcatgttcggcaagctgatcgacctggcctacacccccttccacgccgtgctgaagtgcggccacctgaccgccgacgtgcaggtgttccccagacccgagcccttcgtggtggacgaggagatcgaccccatccccaaggtgatcaacaccgacctggagatcgtgggcttcatcgacatcgccgacatcagcagcccccccgtgctgagcagacacctggtgctgcccatcgccctgaacaaggagggcgacgaggtgggcaccggcatcaccgacgacaacgaggacgagaacagcgccaaccagatcgccggcaagatccccaacttctgcgtgctgctgcacggcagcctgaaggtggagggcatggtggccatcgtgcagctgggccccgagtggcacggcatgctgtacagccaggccgacagcaagaagaagagcaacctgatgatgagcctgttcgagcccggccccgagcccctgccctggctgggcaagatggcccagctgggccccatcagcgacgccaaggagaacccctacggcgaggacgacaacaagagccccttccccctgcagcccaagaacaagagaagctacgcccagaacgtgaccgtgtggatcaagcccagcggcctgcagaccgacgtgcagaagatcctgagaaacgccagaaagctgcccgagaagacccagaccttctacaaggagctgaacagactgagaaaggccgccctggccttcggcttcctggacctgctgaagggcgtggccgacatgctggagagagagtgcaccctgctgcccgagaccgcccaccccgacgccgccttccagctgacccacgccgcccagcagctgaagctggccagcaccggcaccagcgagtacgccgcctacgaccagaacatcacccccctgcacaccgacttcagcggcagcagcaccgagagaatctag

SEQ ID NO: 18899 - DNA, 774 bp, Artificial Sequence
  Description of Artificial Sequence: Synthetic coding sequence
atgcccctggcctgcgagcaccccgtgggcgtgagcagcagcgtgggcaacgccggcagagccggcgtgggcacccaggcctggggcaccaccgagagaacccagcaccccggccccgcccagcactgcccctgcggcctgagagtgttcgtgctgcaggagaagagagtggtgagcagaaactgggccagaggcacctgcggccccagagtgaccaacgagatgctggaggacgaggacgccgaggaccacggcggcaccttctgcctgggcgagctggtggagctggccgtgaccatggagaacaaggccgagggcaagagaatcgtgagcgagaagcccaccagagccagaaaccagggcatcgagggcagccccggcggcagagtgaccagaagcccccccacccaggtggccatcagcagcgacagcgccagaaagggcagctgggagccctggagcagacccgtgggcgagccccccgaggccggctgggactacgcccagtggaagcaggagagagagcagatcgacctggccagactggccagacacagagacgcccagggcgactggagaagaccctgggacctggacaaggccaagagcaccctgcaggactgcagccagctgagaggcgagggccccgccagagccggcagcagaagaggcgagcccacccccaccagcagcctgcccagcctggccctgttcatcttccaccccctggtgctgagcttcctgtgcctgctggtgagctacttccagagctag

SEQ ID NO: 18900 - DNA, 975 bp, Artificial Sequence
  Description of Artificial Sequence: Synthetic coding sequence
atgagacacagagagggcagctgggagccctggagcagacccgtgggcgagccccccgaggccggctgggactacgcccagtggaagcaggagagagagcagatcgacctggccagactggccagacacagagacgcccagggcgactggagaagaccctgggacctggacaaggccaagagcaccctgcaggactgcagccagctgagaggcgagggccccgccagagccggcagcagaagaggccccagaagccaccagaagctgcagcccccccccctgctgcccgacggcaagggcagaggcggccaggccagcagacccagcgtggcccccgccaccggcagcaaggccagaggcaaggagagactgaccggcagagccagaagatgggacatgaaggaggacaaggaggagctggagggccaggagggcagccagagcaccagagagacccccagcgaggaggagcaggcccagaagcagagcggcatggagcagggcagactgggcagcgcccccgccgccagccccgccctggccagccccgagggccccaagggcgagagcgtggccagcaccgccagcagcgtgccctgcagcccccaggagcccgacctggcccccctggacctgagcctgggcggcgccggcatccccggccccagagagagcggctgcgtgctgggcctgagacccggcgcccaggagagccccgtgagctggcccgagggcagcaagcagcagcccctgggctggagcaaccaccaggccgagctggaggtgcagacctgccccgagccccagagaggcgccggcctgcccgagcccggcgaggacagaagcggcaagagcggcgcccagcagggcctggcccccagaagcagacccaccagaggcggcagccagagaagcagaggcaccgccggcgtgagaagaagaaccggcagacccggccccgccggcagatgctag

SEQ ID NO: 18901 - DNA, 1605 bp, Artificial Sequence
  Description of Artificial Sequence: Synthetic coding sequence
atgatcagctgcgccgagcagagaagcagacagggcgaggccggcagaggccccgcccccgtggcccccgccttcctgcccctgtggctgcccagaggctgcagcggcatcctgagcgtgcccgccgtggccatgcacagcgccggcacccccagagccgagagccccatgagcagacaggagaaggacgccgagctggacagaagaatcgtggccctgagaaagaagaaccaggccctgctgagaagataccaggagatccaggaggacagaagacaggccgagcagggcggcatggccgtgaccacccccgccctgctgcagcccgacggcctgaccgtgaccatcagccaggtgcccggcgagaagagagtggtgagcagaaactgggccagaggcacctgcggccccagagtgaccaacgagatgctggaggacgaggacgccgaggaccacggcggcaccttctgcctgggcgagctggtggagctggccgtgaccatggagaacaaggccgagggcaagagaatcgtgagcgagaagcccaccagagccagaaaccagggcatcgagggcagccccggcggcagagtgaccagaagcccccccacccaggtggccatcagcagcgacagcgccagaaagggcagctgggagccctggagcagacccgtgggcgagccccccgaggccggctgggactacgcccagtggaagcaggagagagagcagatcgacctggccagactggccagacacagagacgcccagggcgactggagaagaccctgggacctggacaaggccaagagcaccctgcaggactgcagccagctgagaggcgagggccccgccagagccggcagcagaagaggccccagaagccaccagaagctgcagcccccccccctgctgcccgacggcaagggcagaggcggccaggccagcagacccagcgtggcccccgccaccggcagcaaggccagaggcaaggagagactgaccggcagagccagaagatgggacatgaaggaggacaaggaggagctggagggccaggagggcagccagagcaccagagagacccccagcgaggaggagcaggcccagaagcagagcggcatggagcagggcagactgggcagcgcccccgccgccagccccgccctggccagccccgagggccccaagggcgagagcgtggccagcaccgccagcagcgtgccctgcagcccccaggagcccgacctggcccccctggacctgagcctgggcggcgccggcatccccggccccagagagagcggctgcgtgctgggcctgagacccggcgcccaggagagccccgtgagctggcccgagggcagcaagcagcagcccctgggctggagcaaccaccaggccgagctggaggtgcagacctgccccgagccccagagaggcgccggcctgcccgagcccggcgaggacagaagcggcaagagcggcgcccagcagggcctggcccccagaagcagacccaccagaggcggcagccagagaagcagaggcaccgccggcgtgagaagaagaaccggcagacccggccccgccggcagatgctag

SEQ ID NO: 18902 - DNA, 540 bp, Artificial Sequence
  Description of Artificial Sequence: Synthetic coding sequence
atggagctgcagggcgcccaggaggacctgggcatcagcctgagcagccccagaagaaaccacgagaccagacccggcagcaaggccaagggcagaagcagcatctgcctgcaggccagcgtgtggatggccggcggcaagctgagactgagagccagcgagcacctgacccagggccaccagcaggagctgagagactggaacctgggcgaggacgccagcctgctgttcagcaagagccccttcggcgccggcaagctgatccaggcccccgcccacgtgttcagacagtgctgggtgcagggcaacgcctggatcagctgcatcaccaagttcgacagcaagagaagccccgaggtggccagcagccccagctacctgaccgtgcccagaagaagccccctgcccgtgttcctgagacccagcgacagatgcgtgtgcggcggctgctacctgggcaagagcaccagaagaagagcctgccagagcctgctgagcgaccccctgggcgtgaccttccccacccagaccagaccctag

SEQ ID NO: 18903 - DNA, 552 bp, Artificial Sequence
  Description of Artificial Sequence: Synthetic coding sequence
atggaggtgaagttcatcaccggcaagcacggcggcagaagaccccagagagccgagccccagagaatctgcagagccctgtggctgaccccctggcccagcctgatcctgaagctgctgagctggatcatcctgagcaacctgttcctgcacctgagagccacccaccacatgaccgagctgcccctgagattcctgtacatcgccctgagcgagatgaccttcagagagcagaccagccaccagatcatccagcagatgagcctgagcaacaagctggagcagaaccagctgtacggcgaggtgatcaacaaggagaccgacaaccccgtgatcagcagcggcctgaccctgctgttcgcccagaagccccagagccccggctggaagaacatgagcagcaccaagagagtgtgcaccatcctggccgacagctgcagagcccaggcccacgccgccgacagaggcgagagaggccacttcggcgtgcagatcctgcaccacttcatcgaggtgttcaacgtgatggccgtgagaagcaaccccttctag

SEQ ID NO: 18904 - DNA, 552 bp, Artificial Sequence; identical to SEQ ID NO: 18903
  Description of Artificial Sequence: Synthetic coding sequence

SEQ ID NO: 18905 - DNA, 486 bp, Artificial Sequence
  Description of Artificial Sequence: Synthetic coding sequence
atgcccagagccggcagagcccccgccgagggcggccccgcccccggcaccagaagcagcagatgcctgagacccagacccctggcctggagaagactggtgcccaacttcggcgcctgggcccccagaaagggcgccgccagagtgggcagacccgtgctgagccccagaaccagcggcgccgccggcgagcccacctgcggcgccggcagccccggcaccctggaggagggcgtggccagcggcagaaccagaagaagaacccagagcgccggcgaggtggccaagtgcagatggggcctgggccaggagcccctgtgccccagaggcgccgtgctgctgaacagcttcagcccccccgcctggccccagttcccccccgccctgagactgagagccctggcctggccccagcccagaggccccgcctgcggcagcaccgcccagtggccccccagaggcgaccccacctggagaatcagctag

SEQ ID NO: 18906 - DNA, 558 bp, Artificial Sequence
  Description of Artificial Sequence: Synthetic coding sequence
atgaagatgttcgagagcgccgacagcaccgccaccagaagcggccaggacctgtgggccgagatctgcagctgcctgcccaaccccgagcaggaggacggcgccaacaacgccttcagcgacagcttcgtggacagctgccccgagggcgagggccagagagaggtggccgacttcgccgtgcagcccgccgtgaagccctgggcccccctgcaggacagcgaggtgtacctggccagcctggagaagaagctgagaagaatcaagggcctgaaccaggaggtgaccagcaaggacatgctgagaaccctggcccaggccaagaaggagtgctgggacagattcctgcaggagaagctggccagcgagttcttcgtggacggcctggacagcgacgagagcaccctggagcacttcaagagatggctgcagcccgacaaggtggccgtgagcaccgaggaggtgcagtacctgatcccccccgagagccaggtggagaagcccgtggccgaggacgagcccgccgccggcgacaagcccgccgccgccgagcagtag

SEQ ID NO: 18907 - DNA, 558 bp, Artificial Sequence; identical to SEQ ID NO: 18906
  Description of Artificial Sequence: Synthetic coding sequence

SEQ ID NO: 18908 - DNA, 585 bp, Artificial Sequence
  Description of Artificial Sequence: Synthetic coding sequence
atgagaggcagcggcctgagattccagatgaagatgttcgagagcgccgacagcaccgccaccagaagcggccaggacctgtgggccgagatctgcagctgcctgcccaaccccgagcaggaggacggcgccaacaacgccttcagcgacagcttcgtggacagctgccccgagggcgagggccagagagaggtggccgacttcgccgtgcagcccgccgtgaagccctgggcccccctgcaggacagcgaggtgtacctggccagcctggagaagaagctgagaagaatcaagggcctgaaccaggaggtgaccagcaaggacatgctgagaaccctggcccaggccaagaaggagtgctgggacagattcctgcaggagaagctggccagcgagttcttcgtggacggcctggacagcgacgagagcaccctggagcacttcaagagatggctgcagcccgacaaggtggccgtgagcaccgaggaggtgcagtacctgatcccccccgagagccaggtggagaagcccgtggccgaggacgagcccgccgccggcgacaagcccgccgccgccgagcagtag

SEQ ID NO: 18909 - DNA, 405 bp, Artificial Sequence
  Description of Artificial Sequence: Synthetic coding sequence
atgaagatgttcgagagcgccgacagcaccgccaccagaagcggccaggacctgtgggccgagatctgcagctgcctgcccaaccccgagcaggaggacggcgccaacaacgccttcagcgacagcttcgtggacagctgccccgagggcgagggccagagagaggtggccgacttcgccgtgcagcccgccgtgaagccctgggcccccctgcaggacagcgaggtgtacctggccagcctggagaagaagctgagaagaatcaagggcctgaaccaggaggtgaccagcaaggacatgctgagaaccctggcccaggccaagaaggagtgctgggacagattcctgcaggagaagctggccagcgagttcttcgtggacggcctggacagcgacgagagatag

SEQ ID NO: 18910 - DNA, 513 bp, Artificial Sequence
  Description of Artificial Sequence: Synthetic coding sequence
atgaagatgttcgagagcgccgacagcaccgccaccagaagcggccaggacctgtgggccgagatctgcagctgcctgcccaaccccgagcaggaggacggcgccaacaacgccttcagcgacagcttcgtggacagctgccccgagggcgagggccagagagaggtggccgacttcgccgtgcagcccgccgtgaagccctgggcccccctgcaggacagcgaggtgtacctggccagcctggagaagaagctgagaagaatcaagggcctgaaccaggaggtgaccagcaaggacatgctgagaaccctggcccaggccaagaaggagtgctgggacagattcctgcaggagaagctggccagcgagttcttcgtggacggcctggacagcgacgagagcaccctggagcacttcaagagatggctgcagcccgacaaggtggccgtgagcaccgaggaggtgcagtacctgatcccccccgagagccaggtggagaagcccgtggcctag

SEQ ID NO: 18911 - DNA, 882 bp, Artificial Sequence
  Description of Artificial Sequence: Synthetic coding sequence
atgaacatcagaggcgcccccgacctgggccagcccagcgacgaccccagcagcggcggcgagagagagagaatcagacagagaatgaagatggtgatcggccagctggagggcatcctgagagagctgaaggaggtggccaaggagctgagagaggtggtgagccagatcgacaagctgaccagcgacttcgacttcgagctggagcccgacgactggaccaccgccaccgtgagcagcaccagcagcagcgacaaggccggcatgggcggccccttcgacctgggccacctggacttcatgaccgccgacatcctgagcgacagctgggagttctgcagcttcctggacgtgagcacccccagcgacagcgtggacggccccgagagcaccagacccggcgccggccccgactacagactgatgaacggcggcacccccatccccaacggccccagagtggagacccccgacagcagcagcgaggaggccttcggcgccggccccaccgtgaagagccagctgccccagagaacccccggcaccagagagagagtgagattcagcgacaaggtgctgtaccacgccctgtgctgcgacgacgaggagggcgacggcgagcaggaggtggaggaggaggaggtgggcctgccccccgagcccgcccacaccgaggcccacgccggcccccacaagcccagccccgccccctacaagagcagaagaagccccctgaccagcagacacagcggcagcaccctggcccccgagcagaccagaagagtgaccagaaacagcagcacccagaccgtgagcgacaagagcacccagaccgtgctgccctacaccgccaccagacagaaggccagaggcaagaactag

SEQ ID NO: 18912 - DNA, 882 bp, Artificial Sequence; identical to SEQ ID NO: 18911
  Description of Artificial Sequence: Synthetic coding sequence

SEQ ID NO: 18913 - DNA, 801 bp, Artificial Sequence
  Description of Artificial Sequence: Synthetic coding sequence
atggccgaggccggcaaggtgcccctgagcctgggcctgaccggcggcgaggccgccgagtggcccctgcagagatacgccagatgcatccccagcaacaccagagacccccccggcccctgcctggaggccggcaccgccccctgccccacctggaaggtgttcgacagcaacgaggagagcggctacctggtgctgaccatcgtgatcagcggccacttcttcatcttccagggccagaccctgctggagggcttcagcctgatcggcagcaaggactggctgaagatcgtgagaagagtggactgcctgctgttcggcaccaccatcaaggacaagagcagactgttcagagtgcagttcagcggcgagagcaaggagcaggccctggagcactgctgcagctgcgtgcagaagctggcccagtacatcaccgtgcaggtgcccgacggcaacatccaggagctgcagctgatccccggcccccccagagccaccgagagccagggcaaggacagcgccaagagcgtgcccagacagcccggcagccaccagcacagcgagcagcagcaggtgtgcgtgaccgccggcaccggcgcccccgacggcagaaccagcctgacccagctggcccagaccctgctggccagcgaggagctgccccacgtgtacgagcagagcgcctggggcgccgaggagctgggccccttcctgagactgtgcctgatggaccagaacttccccgccttcgtggaggaggtggagaaggagctgaagaagctggccggcctgagaaactag

SEQ ID NO: 18914 - DNA, 390 bp, Artificial Sequence
  Description of Artificial Sequence: Synthetic coding sequence
atgagaagaagaggcgagatcgacatggccaccgagggcgacgtggagctggagctggagaccgagaccagcggccccgagagaccccccgagaagcccagaaagcacgacagcggcgccgccgacctggagagagtgaccgactacgccgaggagaaggagatccagagcagcaacctggagaccgccatgagcgtgatcggcgacagaagaagcagagagcagaaggccaagcaggagagagagaaggagctggccaaggtgaccatcaagaaggaggacctggagctgatcatgaccgagatggagatcagcagagccgccgccgagagaagcctgagagagcacatgggcaacgtggtggaggccctgatcgccctgaccaactag

SEQ ID NO: 18915 - DNA, 390 bp, Artificial Sequence; identical to SEQ ID NO: 18914
  Description of Artificial Sequence: Synthetic coding sequence

SEQ ID NO: 18916 - DNA, 1716 bp, Artificial Sequence
  Description of Artificial Sequence: Synthetic coding sequence
atgagcagagaggccggcagctgcagagtgggcaccggcgccagagccagaagcagaaagcccaagaagccccactacatccccagaccctggggcaagccctacaactacaagtgcttccagtgccccttcacctgcctggagaagagccacctgtacaaccacatgaagtacagcctgtgcaaggacagcctgagcctgctgctggacagccccgactgggcctgcagaagaggcagcaccacccccagaccccacgcccccacccccgacagacccggcgagagcgaccccggcagacagccccagggcgccagacccaccggcgccgcccccgcccccgacctggtggtggccgacatccacagcctgcactgcggcggcggccccaagagcagagccaagggcagccccggcccccccccccccgtggccagagccaccagaaagggccccggccccagcggcctgctgcccgagagctggaagcccggcatgggcggcgaccccagaggcgtgggcgccggcgacatggccagcgccggccccgagggcagcgtgccctgctaccccccccccgcccccggcgagttccccgaggcccacagcctgcacctgagcctgctgggcgtgaactaccccctgagccccggcctgttcagctacctgggccccagcctggccgccgccgcccacgtgcccttcctggccagcgccagccccctgctgccccccgccaccgccttccccgccgtgcagcccccccagagacccacccccgcccccagactgtactaccccctgctgctggagcacaccctgggcctgcccgccggcaaggccgccctggccaaggcccccgtgagccccagaagccccagcggcacccccgcccccggcctgctgaaggtgcccgtgcccggcctgggcccctggcccagagtgacccccagagaccccggccaggagggcgagctggagagagccgcccagagcgaccccagaagaagactgagcctgggcagcagactggagctgcccaaggccagccccagcctgaccagattctgcagcagaagcagcctgcccaccggcagcagcgtgatgctgtggcccgaggacggcgaccccggcggccccgagacccccggccccgagggccccctgcccctgcagcccagaggccccgtgcccggcagccccgagcacgtgggcgaggacctgaccagagccctgggcgactacgccagagtggagcagagactgggccagctgggccccgccggcggcctggcccccagacccctgagagagcagctgggcaagatcagactggagctgctgaccatccaccaggccctggagcaggccgtgagaccccccgacgcccccctggacctgagcgtgaagagagcccccgccaagggcccccaggccctgggcgaggcctggggcagacccgagctgggccccgtgctgaccggcggcacccccgagccccccggcatgctgggccccgccgccccccagcccttcagcggccacaccaccaagtgcgaggccgacagcagcgtgcccccccccggcctgcccctggccgcccccgacgaccccgtgatccccggcagcggctggggcacctgcgtggccaccagaagcagccagacccccgaggccgtgtgcggcctgcagagcccccagggcgccgaggtgtag

SEQ ID NO: 18917 - DNA, 615 bp, Artificial Sequence
  Description of Artificial Sequence: Synthetic coding sequence
atgctggtggccgccgccgccgagagaaacaaggaccccatcctgcacgtgctgagacagtacctggaccccgcccagagaggcgtgagagtgctggaggtggccagcggcagcggccagcacgccgcccacttcgccagagccttccccctggccgagtggcagcccagcgacgtggaccagagatgcctggacagcatcgccgccaccacccaggcccagggcctgaccaacgtgaaggcccccctgcacctggacgtgacctggggctgggagcactggggcggcatcctgccccagagcctggacctgctgctgtgcatcaacatggcccacgtgagccccctgagatgcaccgagggcctgttcagagccgccggccacctgctgaagcccagagccctgctgatcacctacggcccctacgccatcaacggcaagatcagcccccagagcaacgtggacttcgacctgatgctgagatgcagaaaccccgagtggggcctgagagacaccgccctgctggaggacctgggcaaggccagcggcctgctgctggagagaatggtggacatgcccgccaacaacaagtgcctgatcttcagaaagaactag

SEQ ID NO: 18918 - DNA, 324 bp, Artificial Sequence
  Description of Artificial Sequence: Synthetic coding sequence
atgctggtggccgccgccgccgagagaaacaaggaccccatcctgcacgtgctgagacagtacctggaccccgcccagagaggcgtgagagtgctggaggtggccagcggcagcggccagcacgccgcccacttcgccagagccttccccctggccgagtggcagcccagcgacgtggaccagagatgcctggacagaaaccccgagtggggcctgagagacaccgccctgctggaggacctgggcaaggccagcggcctgctgctggagagaatggtggacatgcccgccaacaacaagtgcctgatcttcagaaagaactag

SEQ ID NO: 18919 - DNA, 384 bp, Artificial Sequence
  Description of Artificial Sequence: Synthetic coding sequence
atgctggtggccgccgccgccgagagaaacaaggaccccatcctgcacgtgctgagacagtacctggaccccgcccagagaggcgtgagagtgctggaggtggccagcggcagcggccagcacgccgcccacttcgccagagccttccccctggccgagtggcagcccagcgacgtggaccagagatgcctggacagaggcagcagcgagcagcaggacacctgcagcaaccccggcccctgcagcagccccaccggcaaccccgagtggggcctgagagacaccgccctgctggaggacctgggcaaggccagcggcctgctgctggagagaatggtggacatgcccgccaacaacaagtgcctgatcttcagaaagaactag

SEQ ID NO: 18920 - DNA, 558 bp, Artificial Sequence
  Description of Artificial Sequence: Synthetic coding sequence
atgctggtggccgccgccgccgagagaaacaaggaccccatcctgcacgtgctgagacagtacctggaccccgcccagagaggcgtgagagtgctggaggtggccagcggcagcggccagcacgccgcccacttcgccagagccttccccctggccgagtggcagcccagcgacgtggaccagagatgcctggacagcatcgccgccaccacccaggcccagggcctgaccaacgtgaaggcccccctgcacctggacgtgacctggggctgggagcactggggcggcatcctgccccagagcctggacctgctgctgtgcatcaacatggcccacgtgagccccctgagatgcaccgaggagcccagaatgggcgccagcggccacagcccccccggcggccccggcaagggccagtggcccgcccccggcgaggacggcggccacgccagccagcagcagatgcccgacctgcccgagaagctgagccccagcttcacccccgcccacctgcacccctgcagaagactgtgcgaggccagaaccctgcccccctag

SEQ ID NO: 18921 - DNA, 618 bp, Artificial Sequence
  Description of Artificial Sequence: Synthetic coding sequence
atgctggtggccgccgccgccgagagaaacaaggaccccatcctgcacgtgctgagacagtacctggaccccgcccagagaggcgtgagagtgctggaggtggccagcggcagcggccagcacgccgcccacttcgccagagccttccccctggccgagtggcagcccagcgacgtggaccagagatgcctggacagcatcgccgccaccacccaggcccagggcctgaccaacgtgaaggcccccctgcacctggacgtgacctggggctgggagcactggggcggcatcctgccccagagcctggacctgctgctgtgcatcaacatggcccacgtgagccccctgagatgcaccgagggcctgttcagagccgccggccacctgctgaagcccagagccctgctgatcacctacggcgagcccagaatgggcgccagcggccacagcccccccggcggccccggcaagggccagtggcccgcccccggcgaggacggcggccacgccagccagcagcagatgcccgacctgcccgagaagctgagccccagcttcacccccgcccacctgcacccctgcagaagactgtgcgaggccagaaccctgcccccctag

SEQ ID NO: 18922 - DNA, 939 bp, Artificial Sequence
  Description of Artificial Sequence: Synthetic coding sequence
atgggcagaagaagagccgccagaggccccggcgccgagggcggcagacccagacacctgcccaccagaagcctggaggccttcgccgaggaggtgggcgccgccctgcaggccagcgtggagcccggcgccgccgacggcgagggcggccccggccccgccgccctgccctgcaccctggccatgtgggagctgggccactgcgaccccagaagatgcaccggcagaaagctggccagactgggcctggtgagatgcctgagactgggccacagattcggcggcctggtgctgagccccgtgggcaagcagtacgccagccccgccgacagacagctggtggcccagagcggcgtggccgtgatcgactgcagctgggccagactggacgagacccccttcggcaagatgagaggcagccacctgagactgctgccctacctggtggccgccaaccccgtgaactacggcagaccctacagactgagctgcgtggaggccttcgccgccaccttctgcatcgtgggcttccccgacctggccgtgatcctgctgagaaagttcaagtggggcaagggcttcctggacctgaacagacagctgctggacaagtacgccgcctgcggcagccccgaggaggtgctgcaggccgagcaggagttcctggccaacgccaaggagagcccccaggaggaggagatcgaccccttcgacgtggacagcggcagagagttcggcaaccccaacagacccgtggccagcaccagactgcccagcgacaccgacgacagcgacgccagcgaggaccccggccccggcgccgagagaggcggcgccagcagcagctgctgcgaggaggagcagacccagggcagaggcgccgaggccagagcccccgccgaggtgtggaagggcatcaagaagagacagagagactag

SEQ ID NO: 18923 - DNA, 615 bp, Artificial Sequence
  Description of Artificial Sequence: Synthetic coding sequence
atggagctgaagcagagcctgagcacccacctggaggccgagaagcccctgagaagatacggcgccgtggaggagaccgcctggaagaccgagagactgggcagaaaccagctggacatcatcagcatggccgagaccaccatgatgcccgaggagatcgagctggagatggccaagatccagagactgagagaggtgctggtgagaagagagagcgagctgagattcatgatggacgacatccagctgtgcaaggacatcatggacctgaagcaggagctgcagaacctggtggccatccccgagaaggagaagaccaagctgcagaagcagagagaggacgagctgatccagaagatccacaagctggtgcagaagagagacttcctggtggacgacgccgaggtggagagactgagagagcaggaggaggacaaggagatggccgacttcctgagaatcaagctgaagcccctggacaaggtgaccaagagccccgccagcagcagagccgagaagaaggccgagcccccccccagcaagcccaccgtggccaagaccggcctggccctgatcaaggactgctgcggcgccacccagtgcaacatcatgtag

SEQ ID NO: 18924 - DNA, 564 bp, Artificial Sequence
  Description of Artificial Sequence: Synthetic coding sequence
atgtggggcgacctgaccgagaccggctgcatgggcagaagaagcgccaagaaggaccagctggacatcatcagcatggccgagaccaccatgatgcccgaggagatcgagctggagatggccaagatccagagactgagagaggtgctggtgagaagagagagcgagctgagattcatgatggacgacatccagctgtgcaaggacatcatggacctgaagcaggagctgcagaacctggtggccatccccgagaaggagaagaccaagctgcagaagcagagagaggacgagctgatccagaagatccacaagctggtgcagaagagagacttcctggtggacgacgccgaggtggagagactgagagagcaggaggaggacaaggagatggccgacttcctgagaatcaagctgaagcccctggacaaggtgaccaagagccccgccagcagcagagccgagaagaaggccgagcccccccccagcaagcccaccgtggccaagaccggcctggccctgatcaaggactgctgcggcgccacccagtgcaacatcatgtag

SEQ ID NO: 18925 - DNA, 1188 bp, Artificial Sequence
  Description of Artificial Sequence: Synthetic coding sequence
atggacctgtgccagaagaacgagaccgacctggagaacgccgagaacaacgagatccagttcaccgaggagaccgagcccacctacacctgccccgacggcaagagcgagaagaaccacgtgtactgcctgctggacgtgagcgacatcaccctggagcaggacgagaaggccaaggagttcatcatcggcaccggctgggaggaggccgtgcagggctggggcagaaccagccccgccgcctgcatctggcccagaaagatccccaagaaggccagagtgggcgagggcgcctgcagcgactgcctggtgtgcgtgaacctgagccactggagcctgcagaccaagccccccaccgagggcggccccgagaaggaccagagcagccccagccagacccaggccgccccccagggccccagcaccgccagcagagccatcagcgacatctgcttccccacctacttcagagccgagaagaagagcctgcagatcaaggagttcatctggtgcaacaaggactgggccatccccggcaccaacagaggcaaggccagcggcaaccccagcggcggcgcccacagaggcctgagcatccccggccccctgaccagcagagccctgctggtgctgccccccctgaaggccagcctgagcaacgccctggacgtgctgggcaagaagagcaagaacagcttcctgcagagcgaggagaaggtgctggacgtggagaaggacggctgcgtggcctacgcctacggcctgaagaccgccgacggcaagggcgagaagagagccagcgagctggccaagcaccccatggtgaacgacacccccagcagccccagccccgccgcccagatcagcctgctgaccgaccccgagcagagatgcctgcactggagcctgctgagcgagaagaacctggcctgcccccccgaccccagcaacgtgagatacctggccgccctgcagctgctgcagaagagaggcgtgcagagctacaagagcaagttcaaggccaaggagcccagaagccccgtgatcaccagaaagcacgtgctgcccaaggccaagcaggagaacagaccccagatgctggagaccaaggtgttccccagacccgtgctgcccagcctgaccgtgagcagagtgatcatccccgtgagcacccacagaatcctgtag

SEQ ID NO: 18926 - DNA, 1167 bp, Artificial Sequence
  Description of Artificial Sequence: Synthetic coding sequence
atggacctgtgccagaagaacgagaccgacctggagaacgccgagaacaacgagatccagttcaccgaggagaccgagcccacctacacctgccccgacggcaagagcgagaagaaccacgtgtactgcctgctggacgtgagcgacatcaccctggagcaggacgagaaggccaaggagttcatcatcggcaccggctgggaggaggccgtgcagggctggggcagaaccagccccgccgcctgcatctggcccagaaagatccccaagaaggccagagtgggcgagggcgcctgcagcgactgcctggtgtgcgtgaacctgagccactggagcctgcagaccaagccccccaccgagggcggccccgagaaggaccagagcagccccagccagacccaggccgccccccagggccccagcaccgccagcagagccatcagcgacatctgcttccccacctacttcagagccgagaagaagagcctgcagatcaaggagttcatctggtgcaacaaggactgggccatccccggcaccaacagaggcaaggccagcggcaaccccagcggcggcgcccacagaggcctgagcatccccggccccctgaccagcagagccctgctggtgctgccccccctgaaggccagcctgagcaacgccctggacgtgctgggcaagaagagcaagaacagcttcctgcagagcgaggagaaggtgctggacgtggagaaggacggctgcgtggcctacgcctacggcctgaagaccgccgacggcaagggcgagaagagagccagcgagctggccaagcaccccatggtgaacgacacccccagcagccccagccccgccgcccagatcagcctgctgaccgaccccgagcagagatgcctgcactggagcctgctgagcgagaagaacctggcctgcccccccgaccccagcaacgtgagatacctggccgccctgcagctgctgcagaagagaggcgtgcagagctacaagagcaagttcaaggccaaggagcccagaagccccgtgatcaccagaaagcacgtgctgcccaaggccaagcaggagaacagaccccagatgctggagaccaaggtgttccccagacccgtgctgcccagcctgacccacagaaagaagaagatcaagtag

SEQ ID NO: 18927 - DNA, 369 bp, Artificial Sequence
  Description of Artificial Sequence: Synthetic coding sequence
atggtgaacgacacccccagcagccccagccccgccgcccagatcagcctgctgaccgaccccgagcagagatgcctgcactggagcctgctgagcgagaagaacctggcctgcccccccgaccccagcaacgtgagatacctggccgccctgcagctgctgcagaagagaggcgtgcagagctacaagagcaagttcaaggccaaggagcccagaagccccgtgatcaccagaaagcacgtgctgcccaaggccaagcaggagaacagaccccagatgctggagaccaaggtgttccccagacccgtgctgcccagcctgaccgtgagcagagtgatcatccccgtgagcacccacagaatcctgtag

SEQ ID NO: 18928 - DNA, 504 bp, Artificial Sequence
  Description of Artificial Sequence: Synthetic coding sequence
atggacaagctgaccatcatcagcggctgcctgttcctggccgccgacatcttcgccatcgccagcatcgccaaccccgactggatcaacaccggcgagagcgccggcgccctgaccgtgggcctggtgagacagtgccagaccatccacggcagagacagaacctgcatcccccccagactgccccccgagtgggtgaccaccctgttcttcatcatcatgggcatcatcagcctgaccgtgacctgcggcctgctggtggccagccactggagaagagaggccaccaagtacgccagatggatcgccttcaccggcatgatcctgttctgcatggccgccctgatcttccccatcggcttctacatcaacgaggtgggcggccagccctacaagctgcccaacaacaccgtggtgggcagcagctacgtgctgttcgtgctgagcatcttcttcaccatcgtgggcctgctgttcgccggcaaggtgtgcctgcccggctag

SEQ ID NO: 18929 - DNA, 420 bp, Artificial Sequence
  Description of Artificial Sequence: Synthetic coding sequence
atggtgacccacgccgccggcgccagaaccttctgcgaggagcagaagaagggcagcacctacagcgtgcccaagagcaaggagaagctgatggagaagcacagccaggaggccagacaggccgacagagagagcgagaagcccgtggacagcctgcaccccggcgccggcaccgccaagcaccccccccccgccgccagcctggaggagaagcccgacgtgaagcagaagagcagcagaaagaaggtggtggtgccccagatcatcatcaccagagccagcaacgagaccctggtgagctgcagcagcagcggcagcgaccagcagagaaccatcagagagcccgaggactggggcccctacagaagacacagaaaccccagcaccgccgacgcctacaacagccacctgaaggagtag

SEQ ID NO: 18930 - DNA, 423 bp, Artificial Sequence
  Description of Artificial Sequence: Synthetic coding sequence
atgggcctgagcaagagcaaggagaagcccagaaagggcgaggagcagaagaagggcagcacctacagcgtgcccaagagcaaggagaagctgatggagaagcacagccaggaggccagacaggccgacagagagagcgagaagcccgtggacagcctgcaccccggcgccggcaccgccaagcaccccccccccgccgccagcctggaggagaagcccgacgtgaagcagaagagcagcagaaagaaggtggtggtgccccagatcatcatcaccagagccagcaacgagaccctggtgagctgcagcagcagcggcagcgaccagcagagaaccatcagagagcccgaggactggggcccctacagaagacacagaaaccccagcaccgccgacgcctacaacagccacctgaaggagtag

SEQ ID NO: 18931 - DNA, 1302 bp, Artificial Sequence
  Description of Artificial Sequence: Synthetic coding sequence
atgctgcccgccggctgcagcagaagactggtggccgagctgcagggcgccctggacgcctgcgcccagagacagctgcagctggagcagagcctgagagtgtgcagaagactgctgcacgcctgggagcccaccggcaccagagccctgaagcccccccccggccccgagaccaacggcgaggaccccctgcccgcctgcacccccagcccccaggacctgaaggagctggagttcctgacccaggccctggagaaggccgtgagagtgagaagaggcatcaccaaggccggcgagagagacaaggcccccagcctgaagagcagaagcatcgtgaccagcagcggcaccaccgccagcgcccccccccacagccccggccaggccggcggccacgccagcgacaccagacccaccaagggcctgagacagaccaccgtgcccgccaagggccaccccgagagaagactgctgagcgtgggcgacggcaccagagtgggcatgggcgccagaacccccagacccggcgccggcctgagagaccagcagatggcccccagcgccgccccccaggcccccgaggccttcaccctgaaggagaagggccacctgctgagactgcccgccgccttcagaaaggccgccagccagaacagcagcctgtgggcccagctgagcagcacccagaccagcgacagcaccgacgccgccgccgccaagacccagttcctgcagaacatgcagaccgccagcggcggcccccagcccagactgagcgccgtggaggtggaggccgaggccggcagactgagaaaggcctgcagcctgctgagactgagaatgagagaggagctgagcgccgcccccatggactggatgcaggagtacagatgcctgctgaccctggagggcctgcaggccatggtgggccagtgcctgcacagactgcaggagctgagagccgccgtggccgagcagccccccagaccctgccccgtgggcagaccccccggcgccagccccagctgcggcggcagagccgagcccgcctggagcccccagctgctggtgtacagcagcacccaggagctgcagaccctggccgccctgaagctgagagtggccgtgctggaccagcagatccacctggagaaggtgctgatggccgagctgctgcccctggtgagcgccgcccagccccagggccccccctggctggccctgtgcagagccgtgcacagcctgctgtgcgagggcggcgccagagtgctgaccatcctgagagacgagcccgccgtgtag

SEQ ID NO: 18932 - DNA, 1119 bp, Artificial Sequence
  Description of Artificial Sequence: Synthetic coding sequence
atggcccccgcccccccccccgccgccagcttcagccccagcgaggtgcagagaagactggccgccggcgcctgctgggtgagaagaggcgccagactgtacgacctgagcagcttcgtgagacaccaccccggcggcgagcagctgctgagagccagagccggccaggacatcagcgccgacctggacggccccccccacagacacagcgccaacgccagaagatggctggagcagtactacgtgggcgagctgagaggcgagcagcagggcagcatggagaacgagcccgtggccctggaggagacccagaagaccgaccccgccatggagcccagattcaaggtggtggactgggacaaggacctggtggactggagaaagcccctgctgtggcaggtgggccacctgggcgagaagtacgacgagtgggtgcaccagcccgtgaccagacccatcagactgttccacagcgacctgatcgagggcctgagcaagaccgtgtggtacagcgtgcccatcatctgggtgcccctggtgctgtacctgagctggagctactacagaaccttcgcccagggcaacgtgagactgttcaccagcttcaccaccgagtacaccgtggccgtgcccaagagcatgttccccggcctgttcatgctgggcaccttcctgtggagcctgatcgagtacctgatccacagattcctgttccacatgaagccccccagcgacagctactacctgatcatgctgcacttcgtgatgcacggccagcaccacaaggcccccttcgacggcagcagactggtgttcccccccgtgcccgccagcctggtgatcggcgtgttctacctgtgcatgcagctgatcctgcccgaggccgtgggcggcaccgtgttcgccggcggcctgctgggctacgtgctgtacgacatgacccactactacctgcacttcggcagcccccacaagggcagctacctgtacagcctgaaggcccaccacgtgaagcaccacttcgcccaccagaagagcggcttcggcatcagcaccaagctgtgggactactgcttccacaccctgacccccgagaagccccacctgaagacccagtag

SEQ ID NO: 18933 - DNA, 1317 bp, Artificial Sequence
  Description of Artificial Sequence: Synthetic coding sequence
atgctgctgtgccccgcccagaagaccgtgttcagactgcagctgaccaccgccgcccagtgcctgtgggtgtacctgagagacaagcaggtggtggtgttcctggcctaccccaccagagcccccggcagaaacaacggcgtgaccagcctgcactggcccgaccccaccctgagcctgagctggacccaggaggcctacaccgagtacctgagaagcatccactacatcagccaggtgctgctggaggaggtggagaccaccaaggaggccggcgagaccgtgccccccgacaccagcaagatgctgaagctggcccagcagtgcctggagagagcccagagcaccgccgccaagctgggcaagaccagactgaagcccaccatgcccgccgccgcccccatcccccagcccgccggcagacacagaagagtgtacagcgacgagggcggcaagctgagccccttcctgccccccgagatcttccagaagctgcagggcgccgagagccagagctgcaagaaggagctgacccccctggaggaggccagcctgcagaaccagaagctgaaggccgcctacgaggccagaatggccagactggaccccagccaggccatgcagaagaccagcctgaccctgagcctgcagagacagatgatggagaacctggtgatcgccaaggccagagaggagaccctgcagagaaagatggaggagagaagactgagactgcaggaggccgccaacagaagattctgcagccaggtggccctgacccccgaggagagagagcagagagccctgtacgccgccatcctggagtacgagcaggaccacgactggcccaagcactggaaggccaagctgaagagaaaccccggcgacctgagcctggtgaccagcctggtgagccacctgctgagcctgcccgaccaccccatcgcccagctgctgagaagactgcagtgcagcgtgtacagcgccctgtaccccgccgtgagcagagccgccgcccccgcccccggctgctgcccccccacccccaaccccggcagcagaagactgagacccagccagagcctgcactgcatgctgagcccccccgagcccagcgccgcccccagaccccaggacagcccccccaccccccccctgcagcccggcccctggggcctgccccacccctggggcaccccccacctggactgccagaccagaaccgccagaagcagaacctggagcagcagctggggcagactgagcggcagagccggcgccgtgggctacagcagaagccccagctgcagcagctag

SEQ ID NO: 18934 - DNA, 1896 bp, Artificial Sequence
  Description of Artificial Sequence: Synthetic coding sequence
atggccgccgccgccggcgacggcaccgtgaagcccctgcagagcgccatgaagctggccaacggcgccatcgagctggacaccggcaacagacccagagaggcctacaccgagtacctgagaagcatccactacatcagccaggtgctgctggaggaggtggagaccaccaaggaggccggcgagaccgtgccccccgacaccagcaagatgctgaagctggcccagcagtgcctggagagagcccagagcaccgccgccaagctgggcaagaccagactgaagcccaccatgcccgccgccgcccccatcccccagcccgccggcagacacagaagagtgtacagcgacgagggcggcaagctgagccccttcctgccccccgagatcttccagaagctgcagggcgccgagagccagagctgcaagaaggagctgacccccctggaggaggccagcctgcagaaccagaagctgaaggccgcctacgaggccagaatggccagactggaccccagccaggccatgcagaagaccagcctgaccctgagcctgcagagacagatgatggagaacctggtgatcgccaaggccagagaggagaccctgcagagaaagatggaggagagaagactgagactgcaggaggccgccaacagaagattctgcagccaggtggccctgacccccgaggagagagagcagagagccctgtacgccgccatcctggagtacgagcaggaccacgactggcccaagcactggaaggccaagctgaagagaaaccccggcgacctgagcctggtgaccagcctggtgagccacctgctgagcctgcccgaccaccccatcgcccagctgctgagaagactgcagtgcagcgtgtacagcgccctgtaccccgccgtgagcagagccgccgcccccgcccccggctgctgcccccccacccccaaccccggcagcagaagactgagacccagccagagcctgcactgcatgctgagcccccccgagcccagcgccgcccccagaccccaggacagcccccccaccccccccctgcagcccggccccgtgggcagccccagccccctgggcgacaccgccagcggcctgcccgacaaggacagcagcttcgaggacctggagcagttcctgggcaccagcgagagacagggcagaggcagaggcgtgcagcccgagccccagctgcagcagctgaagaccgccgtggaggagatccacaacgccgtggacagactgctgagcctgaccctgctggccttcgagggcctgaacaccgccgccagcaaggacagatgcctggcctgcatcgaggagcccttcttcagccccctgtggcccctgctgctggccctgtacagaagcgtgcacagagccagagaggccgccctgagcagaagcatggagctgtacagaaacgccccccccaccgccatcggcatccccaccaagctgctgccccagaaccccgaggccaagggcgccaccggctacccctactgcgccgccgcccaggagctgggcctgctggtgctggagagctgcccccagaagaagctggagtgcatcgtgagaaccctgagaatcatctgcgtgtgcgccgaggactactgccccacccccgaggccaccccccaggccggccccccccccatcgccgccgccgccatcggcgccgacgacctgctgcccatcctgagcttcgtggtgctgagaagcggcctgccccagctggtgagcgagtgcgccgccctggaggagttcatccacgagggctacctgatcggcgaggagggctactgcctgaccagcctgcagagcgccctgagctacgtggagctgctgcccagaggcggcctggccaagtag

SEQ ID NO: 18935 - DNA, 1563 bp, Artificial Sequence
  Description of Artificial Sequence: Synthetic coding sequence
atggccagcaacgacaagggcatggcccccagcctgggcagcccctgggccagccagatgggcccctgggacgccatcctgaaggccgtgaaggaccagctgcccagcctggacagcgacagccccctgagcgactacggcgaggaggagctgttcatcttccagagaaaccagaccagcctgatccccgacctgagcgaggagctggccgaggaccccgccgacggcgacaagagcagagcctgggtggccgccgccgaggagagcctgcccgagcccgtgctggtgcccgccgagctggccaccgagcccggctgcagacagaacaccagaaccaaggacgccagcagccaggagggcagagaccccggcagacccttcgagagcagcggcgaggtgagcgccctgctgggcatggccgaggagccccccagatggctggagggcgacctgggcagcctgagcttcaacaccaagggcagccagggccccccctgggacccccaggccgaggccaccctgagctgccacgagggcgaccccaaggccgagcccctgagcaccgccagccaggagagcgtgaacagaagagccctgagacaggagagaagaaagatgatcgagaccgacatcctgcagaaggtgaccagagacgcctgcggccccaccagcagcgacaagggcggcgtgaaggaggccccctgccacgccgccgagagcgcccccagaagcaagatgcccctggtggagccccccgagggcccccccgtgctgagcctgcagcagctggaggcctgggacctggacgacatcctgcagagcctggccggccaggaggacaaccagggcaacagagcccccggcaccgtgtggtgggccgccgaccacagacaggtgcaggacagaatggtgcccagcgcccacaacagactgatggagcagctggccctgctgtgcaccacccagagcaaggccagcgcctgcgccagaaaggtgcccgccgacaccccccaggacaccaaggaggccgacagcggcagcagatgcgccagcagaaagcagggcagccaggccggccccggcccccagctggcccagggcatgagactgaacgccgagagccccaccatcttcatcgacctgagacagatggagctgcccgaccacctgagccccgagagcagcagccacagcagcagcgacagcgaggaggaggaggaggaggagatggccgccctgggcgacgccgagggcgccagccccagcagcctgggcctgagaacctgcaccggcaagagccagctgctgcagcagctgagagccttccagaagggcaccgcccagcccgagctgcccgccagcaagggccccgccggcggcagagcccaggcccccgaggacaccgccggcagcagaaccggcagaaagcagcacatgaagctgtgcgccaagggccagagcgcccaggccagactgcccagaggcagacccagagccctgggcgacgtgcccgagcccggcgccgccagagaggccctgatgccccccctggagcagctgtag

SEQ ID NO: 18936 - DNA, 828 bp, Artificial Sequence
  Description of Artificial Sequence: Synthetic coding sequence
atgcccctggtggagccccccgagggcccccccgtgctgagcctgcagcagctggaggcctgggacctggacgacatcctgcagagcctggccggccaggaggacaaccagggcaacagagcccccggcaccgtgtggtgggccgccgaccacagacaggtgcaggacagaatggtgcccagcgcccacaacagactgatggagcagctggccctgctgtgcaccacccagagcaaggccagcgcctgcgccagaaaggtgcccgccgacaccccccaggacaccaaggaggccgacagcggcagcagatgcgccagcagaaagcagggcagccaggccggccccggcccccagctggcccagggcatgagactgaacgccgagagccccaccatcttcatcgacctgagacagatggagctgcccgaccacctgagccccgagagcagcagccacagcagcagcgacagcgaggaggaggaggaggaggagatggccgccctgggcgacgccgagggcgccagccccagcagcctgggcctgagaacctgcaccggcaagagccagctgctgcagcagctgagagccttccagaagggcaccgcccagcccgagctgcccgccagcaagggccccgccggcggcagagcccaggcccccgaggacaccgccggcagcagaaccggcagaaagcagcacatgaagctgtgcgccaagggccagagcgcccaggccagactgcccagaggcagacccagagccctgggcgacgtgcccgagcccggcgccgccagagaggccctgatgccccccctggagcagctgtag

SEQ ID NO: 18937 - DNA, 828 bp, Artificial Sequence
  Description of Artificial Sequence: Synthetic coding sequence
atggaggagagaaaggaggagggcgaggccgagatccaggagcacggccccgagcactggttcagcaagtgggagagacagtgcctggccgaggccgagcaggacgagcagctgccccccgagctgcaggaggaggccgccgccgccgcccagcccgagcacaagcagcagaagctgtggcacctgttccagaacagcgccaccgccgtggcccagctgtacaaggacagagtgtgccagcagcccggcctgagcctgtgggtgcccttccagaacgccgccaccgccgtgaccaacctgtacaaggagagcgtggacacccaccagagaagcttcgacatcggcatccagatcggctaccagagaagaaacaaggacgtgctggcctgggtgaagaagagaagaagaaccatcagaagagaggacctgatcagcttcctgtgcggcaaggtgcccccccccagaaacagcagagccccccccagactgaccgtggtgagccccaacagagccaccagcaccgagaccagcagcagcgtggagaccgacctgcagcccttcagagaggccatcgccctgcacggcctgagcggcgccatggccagcatcagcgtgagaagcagcacccccggcagccccacccacgtgagcagcggcagcaacgccagcagaagaagaaacggcctgcacgacgtggacctgaacaccttcatcagcgaggagatggccctgcacctggacaacggcggcaccagaaagagaaccagcgcccagtgcggcgacgtgatcaccgacagccccacccacaagagaaacagaatgatctag

SEQ ID NO: 18938 - DNA, 798 bp, Artificial Sequence
  Description of Artificial Sequence: Synthetic coding sequence
atgagcgagcagcagatggacctgaaggacctgatgcccaccaagagaaagtacatgtggaagaccgccgaggacagaagaatgagcgacctgacctgcgtgctggagtggctggagagaagacagggcaagaagaagcaggcccccgagaagcagaagcccaaggtggtgaccgtgctgaagagaaacaagaagaaggaggagaagaagggcaagggcctgatgaccgccagaggcggcaacagaagagacaccgagaccagccagcaggccctgggcaagagattcagaaaggacgccgccagctacagaagcctgtacggcgtggagcagaagggcaagcacctgagcatggtgcccggcagctacatcaaggacggccccaagaagagcgacaccgacatcaaggacgccgtggaccccgagagcacccagagacccaaccccttcagaagacagagcatcgtgctggaccccatgctgcaggagggcaccttcaacagccagagagccaccttcatcagagactggagcaacaagatgcccgacatggcctacgagagaaagctgaagagcctgatggagaagagcaccgagcccaagatggagaccatgagaatgctgaagcccgaggaggtgctgagctgcagatacctgagactgagcaaggagaacatcagaaccctgctgaagctgtgcaaggacgccggcatgaacgtggacatccacccccacatggtggaggaggacatcgacgccaagaaggtgttcaccggcatccccagcatggccctgtag

SEQ ID NO: 18939 - DNA, 687 bp, Artificial Sequence
  Description of Artificial Sequence: Synthetic coding sequence
atggagcccgccagctgctgcgccgagagacccaagcccggccccaccggcgtgaagaccaagcccagctgcggcggctggagagccgtgagcctgctgctgctgctgctgctgctggtgctggccgccgtgggcgtggtggccggcggcctgctgggcagcgcccagggcccccccaagcccagactgcagaccctgagaatgaccctgcccagcccccacatgcccagacccaaccagaccatcctggtggacgtggccagaaacgccgccaccatcaccgtgacccccccccagagcaaccacagctgggccgtgctgttcgacggccagagcggctgcatctgctacagacccgaggagcaccaggtgtgcttcctgagactgatggaggacagcgacagagagaccctgagactgctggtggacaccagcaaggtgcaggaggcctgggtgcccagccaggacacccaccacacccaggagctgctggccgtgcagggcagcctggaggtggaccccgcccaggccggcgccctggtgcagagactgtgcatgagaacccccatctactgggccagaagagccgagggccccagaagacagagactgatctacctgtgcatcgacatctgcttccccagcaacatctgcgtgagcgtgtgcttctactacctgcccgactag

SEQ ID NO: 18940 - DNA, 582 bp, Artificial Sequence
  Description of Artificial Sequence: Synthetic coding sequence
atgttcaagaacaccttccagagcggcttcctgagcatcctgtacagcatcggcagcaagcccctgcagatctgggacaagaaggtgagaaacggccacatcaagagaatcaccgacaacgacatccagagcctggtgctggagatcgagggcaccaacgtgagcaccacctacatcacctgccccgccgaccccaagaagaccctgggcatcaagctgcccttcctggtgatgatcatcaagaacctgaagaagtacttcaccttcgaggtgcaggtgctggacgacaagaacgtgagaagaagattcagagccagcaactaccagagcaccaccagagtgaagcccttcatctgcaccatgcccatgagactggacgacggctggaaccagatccagttcaacctgctggacttcaccagaagagcctacggcaccaactacatcgagaccctgagagtgcagatccacgccaactgcagaatcagaagagtgtacttcagcgacagactgtacagcgaggacgagctgcccgccgagttcaagctgtacctgcccgtgcagaacaaggccaagcagtag

SEQ ID NO: 18941 - DNA, 444 bp, Artificial Sequence
  Description of Artificial Sequence: Synthetic coding sequence
atgatcgtgagcagatacggcctggtgggctgcgacgccggccaggtgagacccaaggtggagctgagcctgcccgccttcctggccctgcccaagaaggagttcaaggacaagcccgaggtggaggagaacaacctgatcgaggaggccgtgtggcagaccagcctgaagatccccctgccccaggcccaggtgagagagagaggcggcggcagcgccggcatcagcgccgcccaccccagccagctgtgcaccgccggcgtgagacccagcagcgccctgagagccagcagacccggctggagcctgcagaccgccgccctgcaggagcccaccggcgccgacagcttcctgcccagaagccacaagaccgccgtggacctgcacagcgccagaatccccctgtacatccacaccaagtgcctgctgatggagagcgtgtag

SEQ ID NO: 18942 - DNA, 954 bp, Artificial Sequence
  Description of Artificial Sequence: Synthetic coding sequence
atggccagcgccggcgccgagagaagacccggcgtgcaggaggccaccgtggtgggccagggccagctgaccgaggagcccggcagcgcccagaccagcgagtgccccgtggccggcgaccagttcctggtgcccgcccacgaggccagaggcacccagagcgaggaccagagacccgccggcgccgccagcgagagcgagctgcaggaggagggccccaagctgggcgaggagagacccaagccccacgccggcgccctggaggagagaggccccagacccgtggtgagcatcgtgagacccagacacggccccaagagaaagcccgtgaagagcctgagcctgcccggcctgagagcccacctgaaggccgaggccgagctgccccccaagctgcccctgcaggaggaggagcccgaggacagccagagcgagcccagccccagcgccaagcagcacaagaaggccaagaagagaaagagcctgggcgcccccgtgctgcacgccgtggccagcatggtgagcgcccccctggagaccctgagactggagagaaaggcccagagactgagacccctgtaccagtacgtgaactactgcaaccccgagctgaaccaggccggcaagggcgacggcgaggccgaggtggaggccgaggccgagctggcccccgtgcccgaggagggcggcgtggagcagctgcaggccctgctgcccctggccggcgagctgggccccggcctggccctgccctgccccagccccctggtgacccccacccacgccctggcccccctgggcgaggaggccggcgaggagcccggcggcctgcccagcctgggcgtgagcgaccacaaggccgaggtggacaagagcacccaggtggacatcgacaagatgctgagcgtgtgcaccgcccccctggtgccccccctgagcccccagtacaagtag

SEQ ID NO: 18943 - DNA, 465 bp, Artificial Sequence
  Description of Artificial Sequence: Synthetic coding sequence
atgagcgccaccagagccaagaaggtgaagatggccaccaagagctgccccgagtgcgaccagcaggtgcccgtggcctgcaagagctgcccctgcggctacatcttcatcagcagaaagctgctgaacgccaagcacagcgagaagagcccccccagcaccgagaacaagcacgaggccaagagaagaagaaccgagagagtgagaagagagaagatcaacagcaccgtgaacaaggacctggagaacagaaagagaagcagaagcaacagccacagcgaccacatcagaagaggcagaggcagacccaagagcgccagcgccaagaagcacgaggaggagagagagaagcaggagaaggagatcgacatctacgccaacctgagcgacgagaaggccttcgtgttcagcgtggccctggccgagatcaacagaaagatcatcaaccagagactgatcctgtag

SEQ ID NO: 18944 - DNA, 282 bp, Artificial Sequence
  Description of Artificial Sequence: Synthetic coding sequence
atgagcgccaccagagccaagaaggtgaagatggccaccaagagctgccccgagtgcgaccagcaggtgcccgtggcctgcaagagctgcccctgcggctacatcttcatcagcagaaagctgctgaacgccaagcacagcgagaagagcccccccagcaccgagaagcaggagaaggagatcgacatctacgccaacctgagcgacgagaaggccttcgtgttcagcgtggccctggccgagatcaacagaaagatcatcaaccagagactgatcctgtag

SEQ ID NO: 18945 - DNA, 576 bp, Artificial Sequence
  Description of Artificial Sequence: Synthetic coding sequence
tgagagcagggccccgccgcccccaagagctggctgctgctgcccaccaccctggccctgcacggcagcctggacgccgtgagccaggcccagggcagacccggccaccccgacgccccccccaacatctacgagggcggcctgggcagcccccagccccagtgccccagcgcccagggcagcaagcccaagaacttcagactgagacacctgagaggcctgggcctgtacctggagagccaccccccccccaccggccagtgcgagagccactggctgggcagactgatggccggcggctgcctgccccagcccgagggcaccgcctgggccctggacctgccccagggcaccctgggccccagaaacagcctgtgcagcgccctgctggaggccagactgcccagagacagcctgggcagcagcgccagcagcagcagcatggaccccgacaagggcgccctgccccagcccagccccagcagactgagacccaagagaagctggggcacctgggaggaggccatgtgccccctgtgcaagagaaccagaagcggcgccctggagagaccctag

SEQ ID NO: 18946 - DNA, 996 bp, Artificial Sequence
  Description of Artificial Sequence: Synthetic coding sequence
atgctgaacagaaagaccagccacttcctgggcatgagagtgcagagcgagctggagcacctgagcgagctgagaagagaggccggcaaggacagaagcagcgtgcacggcagcgccgccagaaccagagccagcgtgagaacccagtggaccaccgccgccgccgccaaggccgacgaggaccccggcgccaacctgttccccccccccctgcccagacccagaatctgcatgtggaagtacctggacgtgcacagcatgcaccagctggagaagaccaccaacgccgagatgagagaggtgctggccgagctgctggagctgggctgccccgagcagagcctgagagacgccatcaccctggacctgttctgccacgccctgatcttctgcagacagcagggcttcagcctggagcagaccagcgccgcctgcgccctgctgcaggacctgcacaaggcctgcatcgccacccccctgggcaacgtggaggagtgctacagatacttcaccagcgtgctgttctgccacggcgtgagaagaccccccttcagcatcgacctgttcaaggaggagcagctgctggccctggaggactacgtggtgaacacctacttcagacacttcaagctgtacaagtacgtgttcaccccccaggtgagactggacctgagcctgacctacatgggcctgcagccccccaagctgtggcccgagagcgagaccgagaaggaggagagcaaggagatggaggagcaggccgtgaccccccagaaggaggagctggagaccgtggccccccccgagcccgagcccagccacatccacgtgctgagagcctacatcaagacccaggtgaacaaggagctggagcagctgcagggcctggtggaggagagactgaaggccagcgaggagagactgagcagcaagctgaccgccctggagagacccttccagctgccccccggcaagggcaagagcaagaccaagtag

SEQ ID NO: 18947 - DNA, 534 bp, Artificial Sequence
  Description of Artificial Sequence: Synthetic coding sequence
atgctgaacagaaagaccagccacttcctgggcatgagagtgcagagcgagctggagcacctgagcgagctgagaagagaggccggcaaggacagaagcagcgtgcacggcagcgccgccagaaccagagccagcgtgagaacccagtggaccaccgccgccgccgccaaggccgacgaggaccccggcgccaacctgttccccccccccctgcccagacccagaatctgcatgtggaagtacctggacgtgcacagcatgcaccagctggagaagaccaccaacgccgagatgagagaggtgctggccgagctgctggagctgggctgccccgagcagagcctgagagacgccatcaccctggacctgttctgccacgccctgatcttctgcagacagcagggcttcagcctggagcagaccagcgccgcctgcgccctgctgcaggacctgcacaaggcctgcatcggcgagagaggccagctgcccggcctgagccccagagagaagagaaacagagcctggcacaagtag

SEQ ID NO: 18948 - DNA, 720 bp, Artificial Sequence
  Description of Artificial Sequence: Synthetic coding sequence
atgagagccagcagaagcccccccagccccagaagatgccaccaccaccacgaggccaccggcgccgccagcggcgccgccgccggcggccccggcgccggctgcgtgggcctgtgcagactggccctgacccccagcgcccaggacggcagaaacagcaccttccagacctacaagaaggaggtgtgcctgcccagacacagcatgcaccccggcccctgggccatctgctgcgagtgccagaccagattcggcggcagactgcccgtgagcagagtggaggccgccctgccctactgggtgcccctgagcctgagacccagaaagcagagccagaagaccgtgcagttccccatcccccagaccgccaagatgtgcccctgcctgtgccacagattcggcggcagactgcccatgcccagagaccaggccgtgatgccctactgggtgccccaggtgctgagaagccagcagcagatcgtgagaagacagcagagcctgaagggcatccaggcccccctgctggacgcctgctgctggcacaactgctggagaatctgcggcgacgagtgcctgctgagcaagttccagcagctgcaggccccctaccaggaccagctgcccgcccccgccgccagactgctgcccctgggcctgctgaccctgctgcaggccatccccagagtgatcatggccatcagacagtgcttcggcgtgtag

SEQ ID NO: 18949 - DNA, 3426 bp, Artificial Sequence
  Description of Artificial Sequence: Synthetic coding sequence
atgagcttcagcctgaccttcaccgagctggccaacatcgccatcccccagtgcggcgtgctgaacttcaaggccctgcacctgctgctgcacggcatcctggagcacatccacatggccgagctgaagaaggtgctgagcggcgacgaggacttcctgcagaccagccaggtggtgatcatgcccagagagggcgacgcccagcccatcctgaaccccatgaagagactgagcaacgtgttcgaccacgtggtgagcagactggacaagctggagaaccagctggccctgctgcaggacctgcccagcaccgcccagctgctggaggccagccagggcaccgccagacccgtgcaggacctgtggcacctgatcaagctgagaaagatggtggagggccacgacgaggtgatggccaagagcatgcagaccctgcaggacctgctgaccgacctgcacgccctgcaggtgaccatcaccgccctgagaaaggaggtggacatgctgaagaacatgctggacaaggtgcaccccgagagaatggacatcttcgccgaggacttcaagatccagaactggaagatggtggccctgcagagagaggtggccagcctgcagaacaagttcaagaccatccccaagaccgaggacatggtgctgtggagcggcctgcacgacgccatgttcaccagcgagatcggcagcagccccctggacctgtggcagagcgtggagcagctgcccgaggccgccctggcccagaccaccaagtacctggaggccaccagagccatccaggtgagcgagcccgtgcagaacccccagctgctgcagaccgtgtggcactacgaggtgcccgagctgctgcccgagggcagcagcgcccaggccgtgagcctgagcagagcccaggagcccgcccagccccccgccctgacccccgagagcgcccccggctgcaccaccgagttcgcccccggccccgcccccggcaccgagcccgtgcccggcctggagctgggcctggagctggagcccgtgcccgccctgggccccgtgcccggccccagcgtgacccccggcagcctgcccgccccctggcccgtgctgggccccgtgcccgcccccggcgcccagcccccccccctgggcgactggcccgccctgcccagaagatggcccctgccccagggctggcccagagtgggcagctggcccctgtgggacctgggcgtgctgagacccacccagccccagcccagcagagcccccccccccgccaccgagttcggcagcctgtggcccagacccctgcagccctaccagagcagacagggcgaggccctgcagctggccgccgtgcaggtgaagggcgaggagaacgacgtgcccagcctgagaggcctgagagagagagccagaaaggacggcgcccccaaggacagaaccagaaaggacggcgtgcccaaggacagaggcggcaaggacgtggaccccaaggacagagcccacaaggacgacgtgcccaaggacagaggcggcaaggacgtggaccccaaggacagagcccacaaggacgacgtgcccaaggacagaggcggcaaggacggcgaccccaaggacagagtgggcaaggacggcgcccccaaggaggcccagcccaaggccccccagagcgccctgcacagactgaagaccaccgccgccatcgccgccgccgccgccgccgcctacgccgccgccaccagcagcgccgcccaggccgccaaggtggccgccaagttcgtgaaggacgcccccgccaccaagatggccgccatcgccaccgacaccgccgccgccggccccctgggcgtgttcgccgacgtgctgggcgccggccccagcagaggcgccaccgagagccagatcctgggcgacgacagcgagatctacgagatcctgagccccagctacagcgccgccagcatcggccccgaccccgccctgagccaggccatggtggccaccaagcaggccatgagccccgaggacaagaagagagccgtgaagtacagcatgagccacatcgcccagatccccgtgaagcacgacagcctgaaggaggagttcgcccagctgagctgcaacctgaaccagagactgagctacctggccaacatgggcggccccagcagcctgggcaccaccgtggacatcctgcagaagaagatcggcagcctgcagaagagcagactgaaggaggaggagctggagagaatctggggcaaccagatcgagatgatgaaggacagatacatcaccctggacaaggccgtggagaacctgcagatcagaatggacgagttcaagaccctgcaggcccagatcaagagactggagatgaacaaggtgaacaagagcaccatggaggaggagctgagagagaaggccgacagaagcgccctggccggcaaggccagcagagtggacctggagaccgtggccctggagctgaacgagatgatccagggcatcctgttcaaggtgaccatccacgaggacagctggaagaaggccatggaggagctgagcaaggacgtgaacaccaagctggtgcacagcgacctggaccccctgaagaaggagatggaggaggtgtggaagatcgtgagaaagctgctgatcgagggcctgagactggaccccgacagcgccgccggcttcagaagaaagctgttcaagagagtgaagtgcatcagctgcgacagacccgtggagatgatgaccggcccccagctgatcaccatcagaaaggcccacctgctgagcagactgagacccgccagcgccaacagctgcgagtacctgcagagacagcagatgagagagcagcagtggctgcagctgcaggacctgggcatccaggaggactgccagcaggactggggcgacggcccccagaacgccaccagcctgaagtgcaagagctgcaacctgctgaccctgtacccctacggcgacccccacgtgatcgactacgacagcgccgaggtggacatcctgggcgtggacggcatcctgtacaagggcagagtgaacagccagagaggcgcccagcccctggccgtggccaaggagctggccgccgtgaaggcccccagcccccccagccagagcctgtacgacagagtgcacagcagcgccctgttcggcgccatctgcccccccctgtgccccagaagcagcgcctgcagcgccgccagcggcccccacctgaccatgcccgccagaccccccagcctgccccccctgctgctgctgccccccctgatccccagcctgagagacccccagcaggcccccggcagcaccagactgagcagagccccccacatcgagagcagagtgggcagaaagccccccgaggagcccgccaacccctag

SEQ ID NO: 18950 - DNA, 495 bp, Artificial Sequence
  Description of Artificial Sequence: Synthetic coding sequence
atggccagcgccagaggcgccaagcagagcagccccagagtgggcaccaccagatacaccgagaccagcaccgtgagagtggagaccagcagccacagagtggagaccagcagcagaagagtggagaccagccagagaagaagcgagggccccagcctgagccccagcggcaagagactgcccagaatcctggaggccagcagcagacacgtggagagcagcagccagagaaccgagaccaccagcagacacgtgagagccagcagcctgagagtggagaccagcctgcactgcgccgagagccccacccccagacccagcagaccccccgccagaaccaagaagagacccgacgagatgctgctgcccaagggccaccagggcgccagagccctgagccaggacagaaaggccagcagctgccagcccgccagccagctgcccggcggccccatcatcttcggcttcatggagaccaaccacaagagcatgtag

SEQ ID NO: 18951 - DNA, 504 bp, Artificial Sequence
  Description of Artificial Sequence: Synthetic coding sequence
atgttcgacttcagcttccccacccccgccagcgccggcaccagaatgggccccgccagctgcggcggcagaagcctgcacctgccccagctgagattcagcagagtggacgccaccgccgtgaccgacgtgcccttccagagaatgcacgccccccacagagcccccgaggtgttctgcagcagaagcagcagaggcgccggcagaggccaccccacccccacccccagagtgagatgggccctggccggcaaccagcccagatgctgcgcccagctgctgagcggcagaggcggcagcggcgcccagctgagagccggctgggtgagaggcgccgccgtgggcaacctgttcatcctgctgctgggcaaggaggacggcgaggaggagggcaccgtgctgagctacagcagcatggtgcacatcagcaacatcaccggcatcgtgggcaccaccgtgagcagaaccaagcccgccctggtgctgatggagctgaccttctag

SEQ ID NO: 18952 - DNA, 339 bp, Artificial Sequence
  Description of Artificial Sequence: Synthetic coding sequence
atggcccacagcgccgccgccgtgcccctgggcgccctggagcagtgccccatcagagtggagcacgacagaagaagaagacagttcaccgtgagactgaacggctgccacgacagagccgtgctgctgtacgagtacgtgggcaagagaatcgtggacctgcagcacaccgaggtgcccgacgcctacagaggcagaggcatcgccaagcacctggccaaggccgccctggacttcgtggtggaggaggacctgaaggcccacctgacctgctggtacatccagaagtacgtgaaggagaaccccctgccccagtacctggagagactgcagccctag

SEQ ID NO: 18953 - DNA, 2478 bp, Artificial Sequence
  Description of Artificial Sequence: Synthetic coding sequence
atggaggtgagaagaggcgacacctgccccagaccccaccccagcggcctgagagaggagggcctggagcccaaggtggccttccccggcggcgccaacagatgctggaacctgggcgccgacgccggcagcagactgaccgacgtgttcggcagcgtgatgctgaccggcagcgccagcttctacgactgctacaccagccagagcgaggacaacgtggacctgagacagacctacacccccttcagcagcaccgagtacagcagcagcgtggacagcagcctgttctgcgccccctggagcacctacggcgacgacatcaagcagcccagcaacagccagatcagcatcaagaacagaatccagaccgagagaaacgactacggcagcgagaccgacctgtacggcctggtgagcaacatcctggaggagcaggacaagagccagccctacttcgccgagggcacctgcagcagcaacctgaagagcgtgtggcccatgaacaccagcagattcgccgaccaccacgacctgctgaccgagaccaagagacccatcgacaccgtgatcagccagcaggccttctacagcgacgagagcgtgagcgccatggagaagcagtacctgagaaacagcaacctgaccccccagcagaagatcgacgagctgcaccacggcttcaccggcctggacctggaggagcagtggatgtaccccagcagaagcgaccacagcaactgccacaacatccagaccaacgacaccgccaagaccaccttccaggagtaccccctgatcaagaactgcttcaccccccagaccggcctgagcgacatcatgaaggagagcggcgtggacatctaccactacggcagagacagaatctgcaccaagggcctggaggcccccctgcagcagaagagagccgagatgttcctgagccagttcaacagatacaacgagaacgtggactactgcagataccccgagtacgtgcaccccaacaaggccaagctgaacaagtgcagcaacttcagcgtgcaggacagcaagaagctggccaacggcacccccgagacccccaccgtggaggccgacacctacaccaagctgttccaggtgaagcccgccaaccagaagaagatggaggagaccatccccgaccagcagaacttcaccttccccaagaccaccccccacctgaccgagaagcagttcgccaaggaggccgtgttcaccgccgacttcggcctgaccagcgagtacggcctgaagccccacaccgcctgccccgccaacgacttcgccaacgtgaccgagaagcagcagttcgccaagcccgaccccccccacagcgagtacttcaagagcgtgaacctgctgagcaacagcgccaccagcagcggcggcatcaacctgaacagacccacctggatgaacgtgcagaccaagaacaacacccccatcccctacagaaaccagggcaacctgatgaagctgaacagccacctgagcgccgccagcaagggcagcaaccacagcagcgacttcccccagctgagcagcaccaacctgacccccaacagcaacctgttccagaagtactgccaggagaaccccagcgccttcagcagcttcgacttcagctacagcggcgccgagagaatccagagcgtgaaccacatcgagggcctgaccaagcccggcgaggagaacctgttcaagctggtgaccgacaagaagatcaagcagcccaacggcttctgcgacaactacagcgcccagaagtacggcatcatcgagaacgtgaacaagcacaacttccaggccaagccccagagcggccactacgaccccgaggagggccccaagcacctggacggcctgagccagaacacctaccaggacctgctggagagccagggccacagcaacagccacagaaccagaggcggcgacaacagcagagtgaacagaacccaggtgagctgcttcagcaacaactacatgatgggcgacctgagacacaaccagtgcttccagcagctgggcagcaacggcttccccctgagaagcacccaccccttcggccacagcgtggtgcccctgctggacagctacgacctgctgagctacgacgacctgagccacctgtacccctacttcaacatgatgtacggcgacaacagcttcagcggcctgatgcccaccttcggcttccagagacccatcaagaccagaagcggccccgccagcgagctgcacatcagactggaggagtgctgcgagcagtggagagccctggagaaggagagaaagaagaccgagctggccctggccaagaactaccccggcaagaaggtgagcagcaccaacaacacccccgtgcccagactgaccagcaaccccagcagagtggacagactgatcgtggacgagctgagagagctggccagagtgagctgcaagaacagatag

SEQ ID NO: 18954 - DNA, 2859 bp, Artificial Sequence
  Description of Artificial Sequence: Synthetic coding sequence
atggaggtgagaagaggcgacacctgccccagaccccaccccagcggcctgagagaggagggcctggagcccaaggtggccttccccggcggcgccaacagatgctggaacctgggcgccgacgccggcagcagactgaccgacgtgttcggcagcgtgatgctgaccggcagcgccagcttctacgactgctacaccagccagagcgaggacaacgtggacctgagacagacctacacccccttcagcagcaccgagtacagcagcagcgtggacagcagcctgttctgcgccccctggagcacctacggcgacgacatcaagcagcccagcaacagccagatcagcatcaagaacagaatccagaccgagagaaacgactacggcagcgagaccgacctgtacggcctggtgagcaacatcctggaggagcaggacaagagccagccctacttcgccgagggcacctgcagcagcaacctgaagagcgtgtggcccatgaacaccagcagattcgccgaccaccacgacctgctgaccgagaccaagagacccatcgacaccgtgatcagccagcaggccttctacagcgacgagagcgtgagcgccatggagaagcagtacctgagaaacagcaacctgaccccccagcagaagatcgacgagctgcaccacggcttcaccggcctggacctggaggagcagtggatgtaccccagcagaagcgaccacagcaactgccacaacatccagaccaacgacaccgccaagaccaccttccaggagtaccccctgatcaagaactgcttcaccccccagaccggcctgagcgacatcatgaaggagagcggcgtggacatctaccactacggcagagacagaatctgcaccaagggcctggaggcccccctgcagcagaagagagccgagatgttcctgagccagttcaacagatacaacgagaacgtggactactgcagataccccgagtacgtgcaccccaacaaggccaagctgaacaagtgcagcaacttcagcgtgcaggacagcaagaagctggccaacggcacccccgagacccccaccgtggaggccgacacctacaccaagctgttccaggtgaagcccgccaaccagaagaagatggaggagaccatccccgaccagcagaacttcaccttccccaagaccaccccccacctgaccgagaagcagttcgccaaggaggccgtgttcaccgccgacttcggcctgaccagcgagtacggcctgaagccccacaccgcctgccccgccaacgacttcgccaacgtgaccgagaagcagcagttcgccaagcccgaccccccccacagcgagtacttcaagagcgtgaacctgctgagcaacagcgccaccagcagcggcggcatcaacctgaacagacccacctggatgaacgtgcagaccaagaacaacacccccatcccctacagaaaccagggcaacctgatgaagctgaacagccacctgagcgccgccagcaagggcagcaaccacagcagcgacttcccccagctgagcagcaccaacctgacccccaacagcaacctgttccagaagtactgccaggagaaccccagcgccttcagcagcttcgacttcagctacagcggcgccgagagaatccagagcgtgaaccacatcgagggcctgaccaagcccggcgaggagaacctgttcaagctggtgaccgacaagaagatcaagcagcccaacggcttctgcgacaactacagcgcccagaagtacggcatcatcgagaacgtgaacaagcacaacttccaggccaagccccagagcggccactacgaccccgaggagggccccaagcacctggacggcctgagccagaacacctaccaggacctgctggagagccagggccacagcaacagccacagaaccagaggcggcgacaacagcagagtgaacagaacccaggtgagctgcttcagcaacaactacatgatgggcgacctgagacacaaccagtgcttccagcagctgggcagcaacggcttccccctgagaagcacccaccccttcggccacagcgtggtgcccctgctggacagctacgacctgctgagctacgacgacctgagccacctgtacccctacttcaacatgatgtacggcgacaacagcttcagcggcctgatgcccaccttcggcttccagagacccatcaagaccagaagcggccccgccagcgagctgcacatcagactggaggagtgctgcgagcagtggagagccctggagaaggagagaaagaagaccgagctggccctggccaagaactaccccggcaagaaggtgagcagcaccaacaacacccccgtgcccagactgaccagcaaccccagcagagtggacagactgatcgtggacgagctgagagagctggccagagtggtgaccctgctgggcaagatggagagactgagaagcagcctgctgcacgccagcatcagcaccgccctggacagacacctggagagcatccacatcgtgcagagcagaagaaaggacgagatcgtgaacgccagcaacagacagagacagggcgtgcccagatgccaggacgacagagacgtgttcgccctggccagcgccatcaaggagatgtgcgtggccaccagaaagaccagaaccgccctgtggtgcgccctgcagatgaccctgcccaagaccgccagcaccgccgacgtggtgaagcccctgcaggacaccgtgaactgcgaggacaaggtgcacgagagcatcaacagcagcaaccccatgaaccagagaggcgagaccaacaagcactag

SEQ ID NO: 18955 - DNA, 1980 bp, Artificial Sequence
  Description of Artificial Sequence: Synthetic coding sequence
atgaacaccagcagattcgccgaccaccacgacctgctgaccgagaccaagagacccatcgacaccgtgatcagccagcaggccttctacagcgacgagagcgtgagcgccatggagaagcagtacctgagaaacagcaacctgaccccccagcagaagatcgacgagctgcaccacggcttcaccggcctggacctggaggagcagtggatgtaccccagcagaagcgaccacagcaactgccacaacatccagaccaacgacaccgccaagaccaccttccaggagtaccccctgatcaagaactgcttcaccccccagaccggcctgagcgacatcatgaaggagagcggcgtggacatctaccactacggcagagacagaatctgcaccaagggcctggaggcccccctgcagcagaagagagccgagatgttcctgagccagttcaacagatacaacgagaacgtggactactgcagataccccgagtacgtgcaccccaacaaggccaagctgaacaagtgcagcaacttcagcgtgcaggacagcaagaagctggccaacggcacccccgagacccccaccgtggaggccgacacctacaccaagctgttccaggtgaagcccgccaaccagaagaagatggaggagaccatccccgaccagcagaacttcaccttccccaagaccaccccccacctgaccgagaagcagttcgccaaggaggccgtgttcaccgccgacttcggcctgaccagcgagtacggcctgaagccccacaccgcctgccccgccaacgacttcgccaacgtgaccgagaagcagcagttcgccaagcccgaccccccccacagcgagtacttcaagagcgtgaacctgctgagcaacagcgccaccagcagcggcggcatcaacctgaacagacccacctggatgaacgtgcagaccaagaacaacacccccatcccctacagaaaccagggcaacctgatgaagctgaacagccacctgagcgccgccagcaagggcagcaaccacagcagcgacttcccccagctgagcagcaccaacctgacccccaacagcaacctgttccagaagtactgccaggagaaccccagcgccttcagcagcttcgacttcagctacagcggcgccgagagaatccagagcgtgaaccacatcgagggcctgaccaagcccggcgaggagaacctgttcaagctggtgaccgacaagaagatcaagcagcccaacggcttctgcgacaactacagcgcccagaagtacggcatcatcgagaacgtgaacaagcacaacttccaggccaagccccagagcggccactacgaccccgaggagggccccaagcacctggacggcctgagccagaacacctaccaggacctgctggagagccagggccacagcaacagccacagaaccagaggcggcgacaacagcagagtgaacagaacccaggtgagctgcttcagcaacaactacatgatgggcgacctgagacacaaccagtgcttccagcagctgggcagcaacggcttccccctgagaagcacccaccccttcggccacagcgtggtgcccctgctggacagctacgacctgctgagctacgacgacctgagccacctgtacccctacttcaacatgatgtacggcgacaacagcttcagcggcctgatgcccaccttcggcttccagagacccatcaagaccagaagcggccccgccagcgagctgcacatcagactggaggagtgctgcgagcagtggagagccctggagaaggagagaaagaagaccgagctggccctggccaagaactaccccggcaagaaggtgagcagcaccaacaacacccccgtgcccagactgaccagcaaccccagcagagtggacagactgatcgtggacgagctgagagagctggccagagtgagctgcaagaacagatag

SEQ ID NO: 18956 - DNA, 492 bp, Artificial Sequence
  Description of Artificial Sequence: Synthetic coding sequence
atgaacaccagcagattcgccgaccaccacgacctgctgaccgagaccaagagacccatcgacaccgtgatcagccagcaggccttctacagcgacgagagcgtgagcgccatggagaagcagtacctgagaaacagcaacctgaccccccagcagaagatcgacgagctgcaccacggcttcaccggcctggacctggaggagcagtggatgtaccccagcagaagcgaccacagcaactgccacaacatccagaccaacgacaccgccaagaccaccttccaggagtaccccctgatcaagaactgcttcaccccccagaccggcctgagcgacatcatgaaggagagcggcgtggacatctaccactacggcagagacagaatctgcaccaagggcctggaggcccccctgcagcagaagagagccgagatgttcctgagccagttcaacagatacaacgagaacgtggactactgcagatacccctag

SEQ ID NO: 18957 - DNA, 390 bp, Artificial Sequence
  Description of Artificial Sequence: Synthetic coding sequence
atgaacaccagcagattcgccgaccaccacgacctgctgaccgagaccaagagacccatcgacaccgtgatcagccagcaggccttctacagcgacgagagcgtgagcgccatggagaagcagtacctgagaaacagcaacctgaccccccagcagaagatcgacgagctgcaccacggcttcaccggcctggacctggaggagcagtggatgtaccccagcagaagcgaccacagcaactgccacaacatccagaccaacgacaccgccaagaccaccttccaggagtaccccctgatcaagaactgcttcaccccccagaccggcctgagcgacatcatgaaggagagcggcgtggacatctaccactacggcagagacagaatctag

SEQ ID NO: 18958 - DNA, 495 bp, Artificial Sequence
  Description of Artificial Sequence: Synthetic coding sequence
atgaacaacagcctggactacctggcctaccccgtgatcgtgagcaaccacagacagagcaccaccttcagaaagaagctggacttcggccactacgtgagccacaagaacagaatccagatcgccaagcccaccgtggacaccaagccccccgtggcccacaccaaccacatcctgaagctgagcaagctgcagggcgagcagaagaagatcaacaagatcgagtacgagaacaagcagctgtgccagaagatcgccaacgcccacagaggccccgccaaggtggactgctggaacgagtacttcagcaagagcctgaacagagagaccagaaacagagagctggtgagaatcaccatggagaaccagggcatcctgaagagactggtggacagaaagccccactacgacagaagagccagcgagatcgactggcagaacagcagaagatacatcagaaacaccaccagatacctgctgagccagaacgagtag

SEQ ID NO: 18959 - DNA, 573 bp, Artificial Sequence
  Description of Artificial Sequence: Synthetic coding sequence
atgaagggcacccccagcagcctggacaccctgatgtggatctaccacttccacagcagcaccgaggtggccctgcagccccccctgctgagcagcctggagctgagcgtggccgccgcccacgagtacctggagcagagattcagagagctgaagagcctggagccccccgagcccaagatgcagggcatgctgcccgcccccaagcccaccctgggcctggtgctgagagaggccaccgccagcctggtgagcttcggcaccaccctgctggagatcagcgccctgtggctgcagcaggaggccagaagactggacggcagcgccggccccgcccccgacggcagagaccccggcgccgccctgagcagagtggcccaggccgccggccagggcgtgagacaggccggcgccgccgtgggcgccagcgccagactgctggtgcagggcgcctggctgtgcctgtgcggcagaggcctgcagggcagcgccagcttcctgagacagagccagcagcagctgggcctgggcatccccggcgagcccgtgagcagcggccacggcgtgagctag

SEQ ID NO: 18960 - DNA, 237 bp, Artificial Sequence
  Description of Artificial Sequence: Synthetic coding sequence
atggcccccctgcccggcgccgagctggtgagaagacccctgcagctgtacagatacctgctgagatgctgccagcagctgcccaccaagggcatccagcagcactacaagcacgccgtgagacagagcttcagagtgcacagcgacgaggacaaccccgagagaatccagcagatcatcaagagagccatcgaggacgccgactggatcatgaacaagtacaagaagcagaactag

SEQ ID NO: 18961 - DNA, 189 bp, Artificial Sequence
  Description of Artificial Sequence: Synthetic coding sequence
atggaccagctggtgttcaaggagaccatctggaacgacgccttctggcagaacccctgggaccagggcggcctggccgtgatcatcctgttcatcaccgccgtgctgctgctgatcctgttcgccatcgtgttcggcctgctgaccagcaccgagaacacccagtgcgaggccggcgaggaggagtag

SEQ ID NO: 18962 - DNA, 903 bp, Artificial Sequence
  Description of Artificial Sequence: Synthetic coding sequence
atgtgcgccagaggccaggtgggcagaggcacccagctgagaaccggcagaccctgcagccaggtgcccggcagcagatggagacccgagagactgctgagaagacagagagccggcggcagacccagcagaccccaccccgccagagccagacccggcctgagcctgcccgccaccctgctgggcagcagagccgccgccgccgtgcccctgcccctgccccccgccctggcccccggcgaccccgccatgcccgtgagaaccgagtgccccccccccgccggcgccagcgccgccagcgccgccagcctgatcccccccccccccatcaacacccagcagcccggcgtggccaccagcctgctgtacagcggcagcaagttcagaggccaccagaagagcaagggcaacagctacgacgtggaggtggtgctgcagcacgtggacaccggcaacagctacctgtgcggctacctgaagatcaagggcctgaccgaggagtaccccaccctgaccaccttcttcgagggcgagatcatcagcaagaagcaccccttcctgaccagaaagtgggacgccgacgaggacgtggacagaaagcactggggcaagttcctggccttctaccagtacgccaagagcttcaacagcgacgacttcgactacgaggagctgaagaacggcgactacgtgttcatgagatggaaggagcagttcctggtgcccgaccacaccatcaaggacatcagcggcgccagcttcgccggcttctactacatctgcttccagaagagcgccgccagcatcgagggctactactaccacagaagcagcgagtggtaccagagcctgaacctgacccacgtgcccgagcacagcgcccccatctacgagttcagatag

SEQ ID NO: 18963 - DNA, 681 bp, Artificial Sequence
  Description of Artificial Sequence: Synthetic coding sequence
atgcccgtgagaaccgagtgccccccccccgccggcgccagcgccgccagcgccgccagcctgatcccccccccccccatcaacacccagcagcccggcgtggccaccagcctgctgtacagcggcagcaagttcagaggccaccagaagagcaagggcaacagctacgacgtggaggtggtgctgcagcacgtggacaccggcaacagctacctgtgcggctacctgaagatcaagggcctgaccgaggagtaccccaccctgaccaccttcttcgagggcgagatcatcagcaagaagcaccccttcctgaccagaaagtgggacgccgacgaggacgtggacagaaagcactggaacatcggcagatacctggacctgcagaccctgctggactggaccgagaccttctgggtgagagaggagctgagaagaccccccctggtgctggcctgcgaggtgtggctgagccagggcgccgagcccatggagtgcttcctgctgcagcagttcgtggccgccttcgtggtgctgagcatcagccccaacttccaccacagctggagaacccccagattccccagaggcacccccggcgccctgtactgcacctgggtgtgcctgagattcaccatgagcaacaccctgcacctgggctgccacttcttcatcatcaactag

SEQ ID NO: 18964 - DNA, 1155 bp, Artificial Sequence
  Description of Artificial Sequence: Synthetic coding sequence
atgggcgtgaccggcgcccacggcttcccctgctgcggcaagggcagcgtggaggtggccgagatgagagacgacctgagccagcaccagatccaggaggagcaggagctggaggccgacatgctggagcagaagccccagctgcaggtggacctggacctggaccccgaccccgaccccgaccccgagctggagatcggccaggtgcccgccctgctggagagcgagctgtaccccgccctgaagctggaggccgagctggacaccgaggccaacagcaacgaggagagcgacttcgaggagcccatgcagctggtgtgcaagatcgagagcgtgcacagcaacatgggcctgcccaccccccagaccttcagaccctggagcctgaacagcaactgcagaagcttcaccgaggagaaccacgtgagcgcctgccaccacagcatcagcgcccagaccagcaagcacctgttctgggccaacaagctgatccaggccagcgagcacagcctgcagagagccatcaacatgcagctgaacaacggcagcgccggccagcccatcagaagccccctgagagaggccatccccaccaacgccctgtgcagcgaggagcagctgcagatccccgacgcccacagcgccccccccaccaccagcagccaggcccccagccccctgctgagcagcgacctgcccccccccatcgacctgaccgagctgatcaccttcgccagcagcctggccatggccagcagcagcagaatggacctgcccagcctggagcacatgatgaaggcccccccccaggaggccctggagcccagcaccgagcccctgctgaccaccgtggaggagagagagcccgagaaccacgccgagaccctgcccgagaagcccagagaggccagagcccccctgaagagctggagccaggaggacaagaacttcgcccagagctacttcgacttcagcaagcccggcatcaagagagccaccatcaagggccagatccagctgctgcagccccccgccaccagccccctgctgcagggcagcaaggaggacagcgtgccccccggcaaggagaaggagaaccccctgctggtgaagatccacttcaagctgagcgcccccaccatccccgagaagtag

SEQ ID NO: 18965 - DNA, 1092 bp, Artificial Sequence
  Description of Artificial Sequence: Synthetic coding sequence
atgagagacgacctgagccagcaccagatccaggaggagcaggagctggaggccgacatgctggagcagaagccccagctgcaggtggacctggacctggaccccgaccccgaccccgaccccgagctggagatcggccaggtgcccgccctgctggagagcgagctgtaccccgccctgaagctggaggccgagctggacaccgaggccaacagcaacgaggagagcgacttcgaggagcccatgcagctggtgtgcaagatcgagagcgtgcacagcaacatgggcctgcccaccccccagaccttcagaccctggagcctgaacagcaactgcagaagcttcaccgaggagaaccacgtgagcgcctgccaccacagcatcagcgcccagaccagcaagcacctgttctgggccaacaagctgatccaggccagcgagcacagcctgcagagagccatcaacatgcagctgaacaacggcagcgccggccagcccatcagaagccccctgagagaggccatccccaccaacgccctgtgcagcgaggagcagctgcagatccccgacgcccacagcgccccccccaccaccagcagccaggcccccagccccctgctgagcagcgacctgcccccccccatcgacctgaccgagctgatcaccttcgccagcagcctggccatggccagcagcagcagaatggacctgcccagcctggagcacatgatgaaggcccccccccaggaggccctggagcccagcaccgagcccctgctgaccaccgtggaggagagagagcccgagaaccacgccgagaccctgcccgagaagcccagagaggccagagcccccctgaagagctggagccaggaggacaagaacttcgcccagagctacttcgacttcagcaagcccggcatcaagagagccaccatcaagggccagatccagctgctgcagccccccgccaccagccccctgctgcagggcagcaaggaggacagcgtgccccccggcaaggagaaggagaaccccctgctggtgaagatccacttcaagctgagcgcccccaccatccccgagaagtag

SEQ ID NO: 18966 - DNA, 1713 bp, Artificial Sequence
  Description of Artificial Sequence: Synthetic coding sequence
atggtgaagaccaacaagcccggcgccaaggtggccgtgagcgcccagagaggcagcgaggtgaccaccaacaccagcccccagcagggccacggctacgtgctggccagcagccacagaagcgccgccgtgagcctgaaccccagccacagaagaagcgaggccgcccaccccaccaccccccacagcgccagcgactaccccagaagcgtgagcctgcagagcggccccggccactacgccgtgcccacccccagaggccccgagaccggccccagaaccgagagcagcagacacagcagcccccacctgaagagccagaagacccagaccctggccagccacgccagcagcagacagtggaaggtgagcccccccagagaggaggccgccagaagaggcagcgagagcaagagcggcagagaggtgggccaccacgccagcagcatccccgacgccaagagcacccaccagctgagcttccaggaccagaagaacaacctgcagagccagatcctggaggacgacccccccagcaaggtgcagaacccccagggcgtgagagtgcccagaagaatcctgagctaccccaaggacgaggccgtgcagaccgagcccatccagagaatcaccaccaccagcgagatcagaagccccagaagccccagcctgctggagcacggcagcagctgcgtgagcgccgactaccagaccgcccagagaagagtgcccgtggaggagagcgagaccggcccctacggccccatccccagcaagcccaaggccctgtacagaaacatgaacctggacagcctgctgaagctgagcgtgctgaaggacagcgacggcgtgcacagagtgagcgccagagtggaccccgagagcctgcacaagtacagcgcctaccccgagaccaagcccagcgccaaggtgctggtgagcagccaggtggagagcaacgtgagaacccccatcagaggcaacagcgaggtgggcagaagagtgaccatcagccccggcgtgcagagcgtggagcccacccaccacgtgaccgtgcccagcgtgagcgagggcagccacaagagcagcatgttcgtgacccccgagcccatctacaagcagcagacccagaagccccccgagatcacctacatgagccagggccccacccccagataccccgagctgagccagaagcccagcatccacgccgagctggagctgacccccagacccctgccccccagaagcctgcccagatacggccccgacagcagctggtggcccctgctgaaccccgaggtggagaccccccagagccagctgaccacccccgacttcgagcccaagtgcagccccagcctggacctgctgctgagcggcttcaagatcgacagcagccccttctgcgaggacctgaagttccagagagagaaggccagcctgagcccccccagcccccccaaggagttccccagctgggcccccctgagcgaggtgccccagacccccaagcacacctgcaagcagcccatccagagattcaccgccttcttcctggacgtgagcgaggagatgtacaacagagtgatctggtggctgaagggcctgtgcttcagcctgctgtgggcccactgcggcagcctgggcgacggcagaaccggcgaggagtggcacctgtgcatctacagagccggcagcttcagaagatag

SEQ ID NO: 18967 - DNA, 1029 bp, Artificial Sequence
  Description of Artificial Sequence: Synthetic coding sequence
atggacgacaagcccaaccccgaggccctgagcgacagcagcgagagactgttcagcttcggcgtgatcgccgacgtgcagttcgccgacctggaggacggcttcaacttccagggcaccagaagaagatactacagacacagcctgctgcacctgcagggcgccatcgaggactggaacaacgagagcagcatgccctgctgcgtgctgcagctgggcgacatcatcgacggctacaacgcccagtacaacgccagcaagaagagcctggagctggtgatggacatgttcaagagactgaaggtgcccgtgcaccacacctggggcaaccacgagttctacaacttcagcagagagtacctgacccacagcaagctgaacaccaagttcctggaggaccagatcgtgcaccaccccgagaccatgcccagcgaggactactacgcctaccacttcgtgcccttccccaagttcagattcatcctgctggacgcctacgacctgagcgtgctgggcgtggaccagagcagccccaagtacgagcagtgcatgaagatcctgagagagcacaaccccaacaccgagctgaacagcccccagggcctgagcgagccccagttcgtgcagttcaacggcggcttcagccaggagcagctgaactggctgaacgaggtgctgaccttcagcgacaccaaccaggagaaggtggtgatcgtgagccacctgcccatctaccccgacgccagcgacaacgtgtgcctggcctggaactacagagacgccctggccgtgatctggagccacgagtgcgtggtgtgcttcttcgccggccacacccacgacggcggctacagcgaggaccccttcggcgtgtaccacgtgaacctggagggcgtgatcgagaccgcccccgacagccaggccttcggcaccgtgcacgtgtaccccgacaagatgatgctgaagggcagaggcagagtgcccgacagaatcatgaactacaagaaggagagagccttccactgctag

SEQ ID NO: 18968 - DNA, 525 bp, Artificial Sequence
  Description of Artificial Sequence: Synthetic coding sequence
atggacaagcacggcgtgaagacccccctgtggaagaaggagaccgaggagctgagagccgaggacgccgagcaggaggagggcaaggagggcagcgaggacgaggacgaggacaaccagagacccctggaggacagcgccaccgagggcgaggagccccccagagtggccgaggagggcgagggcagagagagaagaagcgtgagctactgccccctgagacaggagagcagcacccagcaggtggccctgctgagaagagccgacagcggcttctggggctggctgggccccctggccctgctgggcggcctgaccgcccccaccgacagaaagagaagcctgcccgaggagccctgcgtgctggagatcagaagaagaccccccagaagaggcggctgcgcctgctgcgagctgctgttctgcaagaagtgcagaagcctgcacagccaccccgcctacgtggcccactgcgtgctggaccaccccgacctgggcaaggccggcgccgccggcaacagctag

SEQ ID NO: 18969 - DNA, 666 bp, Artificial Sequence
  Description of Artificial Sequence: Synthetic coding sequence
atgggcgagaagagcagaagaaagggccccgcccccagacacgccgacggcaagctgggcagaacctgcgaccacccctacgccccctggagcttcacccccagcagcagagcccccaccgcctgggtgagacccccctgccccgtgtgggccagcagactgcaggagcacagccccgagcccagaagagccagagccccccccaccagaagagcccaggccgccctgtacgcccccgccctgagactgagagaccacctggacagattcagcatcctgatgaccagctgcaccagctggctgcaggccccccaggcccccggcctgtgcagagacgagcagagcagcagaatcagcgtgccccagctgagcggcgcccccatcctgctgcccgacctggagggcaccaagctgagcaacttccaggagagcagccccctgccccacaagcacgagagaaaggacaagagaagcacccccgaggaggagggcagaagcgcccccgagaagatcatccagagcctgaagctgtgccccggcggccacagacccgccagcctgagcagcggctgccccgccggctgcagactgagcttcaacctgccccccagcatgctgctgagcgtgcagaagtgctgcatgcccagcagcctgaagacctgctag

SEQ ID NO: 18970 - DNA, 1566 bp, Artificial Sequence
  Description of Artificial Sequence: Synthetic coding sequence
atggcctgcagcctgcagaagctgttcgccgtggaggaggagttcgaggacgaggacttcctgagcgccgtggaggacgccgagaacagattcaccggcagcctgcccgtgaacgccggcagactgagacccgtgagcagcagaccccaggagaccgtgcaggcccagagcagcagactgctgctgctgcaccccaccgcccccagcgaggccctgggcctgcccgacctggacctgtgcctgcccgccagcagcacccccagcgccgacagcagacccagctgcatcggcgccgcccccctgagacccgtgagcaccagcagcagctggatcggcaaccagagaagagtgaccgtgaccgaggtgctgagagagaccgccagaccccagagcagcgccctgcaccccctgctgaccttcgagagccagcagcagcaggtgggcggcttcgagggccccgagcaggacgagttcgacaaggtgctggccagcatggagctggaggagcccggcatggagctggagtgcggcgtgagcagcgaggccatccccatcctgcccgcccagcagagagagggcagcgtgctggccaagaaggccagagtggtggacctgagcggcagctgccagaagggccccgtgcccgccatccacaaggccggcatcatgagcgcccaggacgagagcctggaccccgtgatccagtgcagaacccccagaccccccctgagacccggcgccgtgggccacctgcccgtgcccaccgccctgaccgtgcccacccagcagctgcactgggaggtgtgcccccagagaagccccgtgcaggccctgcagcccctgcaggccgccagaggcaccatccagagcagcccccagaacagattcccctgccagcccttccagagccccagcagctggctgagcggcaaggcccacctgcccagacccagaacccccaacagcagctgcagcacccccagcagaaccagcagcggcctgttccccagaatccccctgcagccccaggcccccgtgagcagcatcggcagccccgtgggcacccccaagggcccccagggcgccctgcagacccccatcgtgaccaaccacctggtgcagctggtgaccgccgccagcagaaccccccagcagcccacccaccccagcaccagagccaagaccagaagattccccggccccgccggcatcctgccccaccaggccgccctgaagcagctgcccagaaacaaggtgcccaacatggccgtgatgatcaagagcctgaccagaagcaccatggacgccagcgtggtgttcaaggaccccaccggcgagatgcagggcaccgtgcacagactgctgctggagacctgccagaacgagctgaagcccggcagcgtgctgctgctgaagcagatcggcgtgttcagccccagcctgagaaaccactacctgaacgtgacccccaacaacctggtgcacatctacagccccgacagcggcgacggcagcttcctgaagcccagccagcccttccccaagatgacctggatggacagctag

SEQ ID NO: 18971 - DNA, 414 bp, Artificial Sequence
  Description of Artificial Sequence: Synthetic coding sequence
atggcctgcagcctgcagaagctgttcgccgtggaggaggagttcgaggacgaggacttcctgagcgccgtggaggacgccgagaacagattcaccggcagcctgcccgtgaacgccggcagactgagacccgtgagcagcagaccccaggagaccgtgcaggcccagagcagcagactgctgctgctgcaccccaccgcccccagcgaggccctgggcctgcccgacctggacctgtgcctgcccgccagcagcacccccagcgccgacagcagacccagctgcatcggcgccgcccccctgagacccgtgagcaccagcaactgcctgaacagcagccacagcgccacccccctgggcagcctgagcgccaccctgccctgcagcagcaccagcgccagccccagctgctag

SEQ ID NO: 18972 - DNA, 1944 bp, Artificial Sequence
  Description of Artificial Sequence: Synthetic coding sequence
atggcctgcagcctgcagaagctgttcgccgtggaggaggagttcgaggacgaggacttcctgagcgccgtggaggacgccgagaacagattcaccggcagcctgcccgtgaacgccggcagactgagacccgtgagcagcagaccccaggagaccgtgcaggcccagagcagcagactgctgctgctgcaccccaccgcccccagcgaggccctgggcctgcccgacctggacctgtgcctgcccgccagcagcacccccagcgccgacagcagacccagctgcatcggcgccgcccccctgagacccgtgagcaccagcagcagctggatcggcaaccagagaagagtgaccgtgaccgaggtgctgagagagaccgccagaccccagagcagcgccctgcaccccctgctgaccttcgagagccagcagcagcaggtgggcggcttcgagggccccgagcaggacgagttcgacaaggtgctggccagcatggagctggaggagcccggcatggagctggagtgcggcgtgagcagcgaggccatccccatcctgcccgcccagcagagagagggcagcgtgctggccaagaaggccagagtggtggacctgagcggcagctgccagaagggccccgtgcccgccatccacaaggccggcatcatgagcgcccaggacgagagcctggaccccgtgatccagtgcagaacccccagaccccccctgagacccggcgccgtgggccacctgcccgtgcccaccgccctgaccgtgcccacccagcagctgcactgggaggtgtgcccccagagaagccccgtgcaggccctgcagcccctgcaggccgccagaggcaccatccagagcagcccccagaacagattcccctgccagcccttccagagccccagcagctggctgagcggcaaggcccacctgcccagacccagaacccccaacagcagctgcagcacccccagcagaaccagcagcggcctgttccccagaatccccctgcagccccaggcccccgtgagcagcatcggcagccccgtgggcacccccaagggcccccagggcgccctgcagacccccatcgtgaccaaccacctggtgcagctggtgaccgccgccagcagaaccccccagcagcccacccaccccagcaccagagccaagaccagaagattccccggccccgccggcatcctgccccaccagcagagcggcagaagcctggaggacatcatggtgagcgccccccagacccccacccacggcgccctggccaagttccagaccgagatcgtggccagcagccaggccagcgtggaggaggacttcggcagaggcccctggctgaccatgaagagcaccctgggcctggacgagagagaccccagctgcttcctgtgcacctacagcatcgtgatggtgctgagaaagcaggccgccctgaagcagctgcccagaaacaaggtgcccaacatggccgtgatgatcaagagcctgaccagaagcaccatggacgccagcgtggtgttcaaggaccccaccggcgagatgcagggcaccgtgcacagactgctgctggagacctgccagaacgagctgaagcccggcagcgtgctgctgctgaagcagatcggcgtgttcagccccagcctgagaaaccactacctgaacgtgacccccaacaacctggtgcacatctacagccccgacagcggcgacggcagcttcctgaagcccagccagcccttccccaaggacagcggcagcttccagcacgacgtggccgccaagcccgaggagggcttcagaaccgcccagaacctggaggccgaggccagccccgaggaggagctgcccgaggccgacgacctggacggcctgctgagcgagctgcccgaggacttcttctgcggcaccagcagctag

SEQ ID NO: 18973 - DNA, 2922 bp, Artificial Sequence
  Description of Artificial Sequence: Synthetic coding sequence
atggagaccaaggtgcacctgttctgccaggccgaggagaacatcgacctgctggacgacggcagcaacagcttcgccaccgacctgagcagcggcaccatcaaccacaagaagtacatcaagttcagcaagaccatcgagaaggagatcagccccgagatcagaagcctgagccccgagtacaagaagatcttcgagaccagcatcatcttctgcggcgaggagaagagcagcgacttcagcggcgagaagaaggtgggcagaaagagcctgcaggtgcagcagcacagcaagagaaccgagatcatcccccccttcctgaagctgagcaaggagaaggtgaccagaaaggagaacagcctgtgcaagctgcccaaccagtacagcgtgcacaagaccagcagccccctgtgcaccagcagcgccatcaccagagagaaggagatgctgagcaacctgtacatgaccctgtacgacgaggtgacccacggctacctgcacagcaaggagctgagcgccctgcacaaggcctgcaagatcttcagcaagatcagaagcggcaagatctacgtgaacgacctgcccgtgatcctgtgcatcctgagaatcagcatcagcgacctggagatgagacaggccctgaagaccgtggacatcgacgccttccaggacgccctgaagatcttctgcagaatcaagggcggcagagtgagcaccgacgacgtgttcgccgtgctggacagcatgggcatccccatcaacagagagatcctggaggaggtgaccaagcacacctacatcgacagcaaccacatggtggacatcggcgacatcatcttcaccctgaacgagctgcaggagcagtacgaggacgtgagcatcaccgagggcagccccctgaacgagatcaccagcgacagaaagctgagcagcgtggccggctgctacctgaagtacaagaagaagaacagcctgagcagcaagctgcccgagcccagcatcagcaagaagctgaacaagaagagcaaccagtactacagcaagatcatggagaacgacgacctggagagcaagagacccaagaacacctggcagatcagaaagttcctgggcggcgtgggcagcagcaacgtgggcgtgcaggagccctacagcaagaacggcatcaacttcaagaagcacagcgagaagggcgagatccacgacagcaagagcaagccccagagcctgaagagcagcaccagcctgagcaagagcctggacaagagcgacatcagcagcatccccaagctgcagaagcccgccgtgagaaagcacagcagcctgcagaagcaggtgagcagcaccgagaagaccgccatcagcaccctggagaacttctgcgaggccatcagcaagctgcaggagaactacatcgccgccgaggagctgcagagcatcctgcccagcaccggcatcaacctgctggacgaggagttccagaagatcgtgaccgacaccagcagaaacgagaacggcatggtggagctggacgacttcgtgaacgccctggccaaggagagaagcttccccgagtgcaacgccctgcccggcgtgatcaaggccatcgacaagatcaaggacaagaacgtggactacgaggacctgaacacctgcctgcagaacttcggcatctacctgagcaagcccgagttcaagaagatcaccgagctgaccgaggccggcgagaccaagaaggtgaacttcaaggagttcatcgacaccatgatgagcaacaccgagtgcttcagcgagaagctggtgctgcccgacgccatcgagaccctggacgacctgagaaaggagaccatgagcgtgagcgacctgtggaacaccctgagcagcctgaacagcaacctgaagaaggacgagttcctggccgccctggagctggtgaccgtggacgagggcgacaaggtgcagttcgaggagttcgccaaggtggtgagaaacatgagagacgccgccagactggaggagctgcaggaggtggtgctggccgccgacctgctggagggcgacatgatcgccggcaagaacctggaggacttcctgagaaacgtgggcatcaagagccccaaggaggaggtggagaagatcctgcagagcgacttcgtgagcgaggacaacatggtgaacatcaaggactgcatgagagccctgagagacacccagaagttcagcaactacatcgacttcagaaaggaggccagcaacctgaagctgcccaaggtgaacgagatcaaggaggccgccaacatcctgagccacgtggacaacggcaagatcggcatccccgacctggagcacgccctgaagtgcctgaacgtgaacctgaccgaggaggacttcaacgaggccctgaactgctgcaacgtgagcgacaacatggaggtggacctgaaggacttcctgatgaagatgaaggagagcccccacttccagaagagcaaggccacccagatcctgctggccaccacccagatcctgcagaacgacctggtggacgtgagcgacctgaagaccctgctgatggacaaggacctgcacaccgccaacgccatcctgaccgtgatgctgagacacgtgcccgagcacgagagcggcaaggtgagcatccaggagttcatgaccaagctgagcgacatcctgaccatccccaaggccgccggcaagttctacctgatctgcacctactgccccgacctggagagacaggccgtggtgtacatgctgaagaccatccaggacagcatcgtgaaggcccaggtgagcaagaagcagtacaacatgaacatcaagcagcacaagatcagcctgcacaacttctgcctgaacagcaaggccaacatcgccaagctgaaccccaacagcaagttctag

SEQ ID NO: 18974 - DNA, 1596 bp, Artificial Sequence
  Description of Artificial Sequence: Synthetic coding sequence
atggagaccaaggtgcacctgttctgccaggccgaggagaacatcgacctgctggacgacggcagcaacagcttcgccaccgacctgagcagcggcaccatcaaccacaagaagtacatcaagttcagcaagaccatcgagaaggagatcagccccgagatcagaagcctgagccccgagtacaagaagatcttcgagaccagcatcatcttctgcggcgaggagaagagcagcgacttcagcggcgagaagaaggtgggcagaaagagcctgcaggtgcagcagcacagcaagagaaccgagatcatcccccccttcctgaagctgagcaaggagaaggtgaccagaaaggagaacagcctgtgcaagctgcccaaccagtacagcgtgcacaagaccagcagccccctgtgcaccagcagcgccatcaccagagagaaggagatgctgagcaacctgtacatgaccctgtacgacgaggtgacccacggctacctgcacagcaaggagctgagcgccttccaggacgccctgaagatcttctgcagaatcaagggcggcagagtgagcaccgacgacgtgttcgccgtgctggacagcatgggcatccccatcaacagagagatcctggaggaggtgaccaagcacacctacatcgacagcaaccacatggtggacatcggcgacatcatcttcaccctgaacgagctgcaggagcagtacgaggacgtgagcatcaccgagggcagccccctgaacgagatcaccagcgacagaaagctgagcagcgtggccggctgctacctgaagtacaagaagaagaacagcctgagcagcaagctgcccgagcccagcatcagcaagaagctgaacaagaagagcaaccagtactacagcaagatcatggagaacgacgacctggagagcaagagacccaagaacacctggcagatcagaaagttcctgggcggcgtgggcagcagcaacgtgggcgtgcaggagccctacagcaagaacggcatcaacttcaagaagcacagcgagaagggcgagatccacgacagcaagagcaagccccagagcctgaagagcagcaccagcctgagcaagagcctggacaagagcgacatcagcagcatccccaagctgcagaagcccgccgtgagaaagcacagcagcctgcagaagcaggtgagcagcaccgagaagaccgccatcagcaccctggagaacttctgcgaggccatcagcaagctgcaggagaactacatcgccgccgaggagctgcagagcatcctgcccagcaccggcatcaacctgctggacgaggagttccagaagatcgtgaccgacaccagcagaaacgagaacggcatggtggagctggacgacttcgtgaacgccctggccaaggagagaagcttccccgagtgcaacgccctgcccggcgtgatcaaggccatcgacaagatcaaggacaagaacgtggactacgaggacctgaacacctgcctgcagaacttcggcatctacctgagcaagcccgagttcaagaagatcaccgagctgaccgaggccggcgagaccaagaagtag

SEQ ID NO: 18975 - DNA, 162 bp, Artificial Sequence
  Description of Artificial Sequence: Synthetic coding sequence
atggagaccaaggtgcacctgttctgccaggccgaggagaacatcgacctgctggacgacggcagcaacagcttcgccaccgacctgagcagcggcaccatcaaccacaagaagtacatcaagttcagcaagaccatcgagaaggagatcagccccgagtag

SEQ ID NO: 18976 - DNA, 114 bp, Artificial Sequence
  Description of Artificial Sequence: Synthetic coding sequence
atggagaccaaggtgcacctgttctgccaggccgaggagaacatcgacctgctggacgacggcagcaacagcttcgccaccgacctgagcagcggcaccatcaaccacaagtag

SEQ ID NO: 18977 - DNA, 228 bp, Artificial Sequence
  Description of Artificial Sequence: Synthetic coding sequence
atgaacagactgtacctgacccccgacggcttcttcttcagagtgcacatgctggccctggacagcagcagctgcaacaagccctgccccgagttcaagcccggcatcgagaccgacctgaacgacgccgcctacgtgctgtacaccaccgtgtgcaacgtgggcgccaccgccagagccgtgggcagacccgccttcttctgggagagatgggagaccatgacctag

SEQ ID NO: 18978 - DNA, 294 bp, Artificial Sequence
  Description of Artificial Sequence: Synthetic coding sequence
atgaacagactgtacctgacccccgacggcttcttcttcagagtgcacatgctggccctggacagcagcagctgcaacaagccctgccccgagttcaagcccggcagcagatacatcgtgatgggccacatctaccacaagagaagacagctgcccaccgccctgctgcaggtgctgagaggcagactgagacccggcgacggcctgctgagaagcagcagcagctacgtgaagagattcaacagaaagagagagggccagatccagggcgccatccacacccagtgcatctag

SEQ ID NO: 18979 - DNA, 228 bp, Artificial Sequence; identical to SEQ ID NO: 18977
  Description of Artificial Sequence: Synthetic coding sequence

SEQ ID NO: 18980 - DNA, 228 bp, Artificial Sequence; identical to SEQ ID NO: 18977
  Description of Artificial Sequence: Synthetic coding sequence

SEQ ID NO: 18981 - DNA, 1689 bp, Artificial Sequence
  Description of Artificial Sequence: Synthetic coding sequence
atgctggcctgcctgcccggccccggcgacctgagcttccagctgctgagccacacccagatgaacaccggcctgcagaagtgggacaccacccagaagatgagaaccgcccactaccccacccccgccgagctggacgcctacgccaagaaggtggccaacaaccccctgaccatcaagatcttccccaacagcgtgaaggtgccccagagaaagcacgtgagaagaaccgtgaacggcctggacaccagcgcccagagatacagcccctaccccacccaggccgccaccaaggccggcctgctggccatcgtgaaggtgcccgccaagagcatcctgaaggacttcgacggcaccagagccagactgctgcccgaggccatcatgaacccccccgtggccccctacgccaccgtggcccccagcaccctggcccacccccaggcccaggccctggccagacagcaggccctgcagcacgcccagaccctggcccacgcccccccccagaccctgcagcacccccagggcatcccccccccccaggccctgagccacccccagagcctgcagcagccccagggcctgggccacccccagcccatggcccagacccagggcctggtgcacccccaggccctggcccaccagggcctgcagcacccccacaaccccctgctgcacggcggcagaaagatgcccgacagcgacgccccccccaacgtgaccgtgagcaccagcaccatccccctgagcatggccgccaccctgcagcacagccagccccccgacctgagcagcatcgtgcaccagatcaaccagttctgccagaccagagccggcatcagcaccaccagcgtgtgcgagggccagatcgccaaccccagccccatcagcagaagcctgctgatcaacgccagcaccagagtgagcacccacagcgtgcccacccccatgcccagctgcgtggtgaaccccatggagcacacccacgccgccaccgccgccctgcccgccgccggccccgtgaacctgcccaccggcatcagcagagtgcccaccggctaccccagcgacctgaagcccgtgacctggaaccagcaccagctggcccacctgcagcagatgtgcagcgaggccagcggcacccccgcccccggcctgaccggcaagcacgccgccggcagagagctggccggccccggcttcgtgggcaaggcccccgcctacccccaggagctgtgcctggcccagagcttccacctgaagccccccctggagaagcccacccccagcccccccgtgaacggcatggccgcccccctggcctaccccaacggccactacttccagcccctgtggaacaacatcctgcccacccccaacagcgacagcagcggcagccaggacctggccatgcccttccacggcggccagcccaccggcgcccccctggactgcgccgccgcccccggcgcccactacagagccggcaccggcggcggccccgtggccagccagaacagcctgatgcagaccgtggactacctgagcggcgacttccagcaggcctgcttcagagagcagagcctggccatgctgagcaaggcccacagagcccccggcaacagagcccccgaccccaccgagagcagaagcctgcacatccagcaccccggctacagatag

SEQ ID NO: 18982 - DNA, 1689 bp, Artificial Sequence; identical to SEQ ID NO: 18981
  Description of Artificial Sequence: Synthetic coding sequence

SEQ ID NO: 18983 - DNA, 711 bp, Artificial Sequence
  Description of Artificial Sequence: Synthetic coding sequence
atggaggccagcgacggccagggcggcgagggcgacaagcccctggagcaggtgaccaacgtgagctgcctggagaccagcagcagcgccagccccgccagagacagcctgatgagacacgccaagggcctggaccaggacaccttcaagacctgcaaggagtacctgagacccctgaagaagttcctgagaaagctgcacctgcccagagacctgccccagaagaagaagctgaagtacatgaagcagagcctggtggtgctgggcgaccacatcaacaccttcctgcagcactactgccaggcctgggagatcaagcactggagaaagatgctgtggagattcatcagcctgttcagcgagctggaggccaagcagctgagaagactgtacaagtacaccaagagcagccagcccgccaagttcctggtgaccttctgcgccagcgacgcccccgagagaagcctgctggccgacagagaggacagcctgcccaagctgtgccacgcctggggcctgcacagcaacatcagcggcatgaaggagagactgagcaacatgcagacccccggccagggcagccccctgcccggccagcccagaagccaggaccacgtgaagaaggacagcctgagagagctgagccagaagcccaagctgaagagaaagagaatcaaggaggcccccgagacccccgagaccgagccctag

SEQ ID NO: 18984 - DNA, 582 bp, Artificial Sequence
  Description of Artificial Sequence: Synthetic coding sequence
atgagcggcccccccagcgccccccagggcgccctggccgcccccagaagccccgccgtgagaagaaagggcctgcaggcccccagctggggcagccccggcagacccgccgcccacagcccctgggcctgcggccccccccactggggcccccagagaggccccagaaacgccgccgccgccagacccggccccagaagcagatggcacaagagatgcgccgccgcctgcggcgcctgcgccagaccccccggccaccagctgcagccccccggcgccggcgccccccagcccggcgtggcctgcagctacctgggccccagaccccagagaaccccctgcagcgcccagagcagacccggctggtgcgccggccccagaagaagacacgcccccggcaccgagccccacgtggcccccggcagagcccccccccccagagccggcgccagccccggcagcagactgctgcccggcagccccagcctgctgctgcccgccgccacctggagaacctggggccaggagagcaaggtgctgagaaagatcctgaaggcctgggaccccttcagcctgctgtag

SEQ ID NO: 18985 - DNA, 1713 bp, Artificial Sequence
  Description of Artificial Sequence: Synthetic coding sequence
atggcctacgagaagagcaccgacatcagcgacgtgagcagaagcatgttcctgtacccctggctggagtaccccgacaagaccaaggagctgagaaaggccatggcccccgtgcacctgcccctgagctgctaccagatgcccaaggaggagttcccccccagccccgagtgctggagacagcaccccagcaagcccaacagcgtgccctactgctacttcaagaagcccgagatctacacccactggcacgacctgtacgaccagagagaggagagagaggccgagaagatgctgagaaagatgagagacgactgcagatacatcaaggaggtgcaccagacccacatcaagatgttccacctgcccatgagcaagctgaccatcaagagcgagatgagaagcagacccctggagcccacccaggaccccctgaagtggcagagactgagagagctgaccaagagcctggagagccccagagaggacgagcagttctacgccgcccaggccctgggctgcctgagaatcagcgacaagttcgtgatggaggccctgcagcaggtggcccagaccggccccgagaaggtgaagtacgaggcctacagaaccctggccatcctgggctgcctgaacaagcacgtgatcagagccctgatcaagcagctgaaggagaagaacgagggccagagaatggagaccctgaccggcctgagaatggccctgaacagctgggccgccgtgagcaaggacaagagaacccaggtgggcgacgagggcaagctggtgcccgtgctgcagaccctgatcaagaagagcagcagcgaggccagcctggaggccgccctgtgcctgggcttcctgagaccctgcagcaacatggtgcaggagttcctgctgcagtgcctgtgccagggcctgaagacccagagaatgaaggccctgagaatgctggtgaaggtgatgcacgtgcacagcgcccccgtgatcaaggccatcctggaccagctgtgcagcagcagcgtgctggaggacagattcgaggccacccagatgctgaagaccatcggcctggagcagatccaggcccagggcctggaggagctgaccttcaacctgctgagaagaaagacccacaacgagcccttcctggccgtgagacaggccgtggcccagaccgtggaggagctgaagctgaagcccaccatgatgaacctggtggaggcccagctgatgaaccccgacgccaccgccagacaggaggccgtgatcagcctgggcgtgctgggcatcagaagcccccaggtgttccacctgctgctggacctgctggacgccgagaaccaccaggccgtgaagaagagcctgcaggagaccctgatcctgtgcgccagcatcgacccctggatccagaacaagctgaagaacaaggtgctgagcgtgtacgaggcccccaagaccaacgtgaaggccgagcccaccagattccagaaggagcccgagaaccccgaggagctgaccatccaggacttcagactggccaagctgaaccccctgttcatcgccaagagcatcaccaaggtgggccagaagaagacccccgccttccccccctgctgcagcaagcccagaaagcacagaccccaggtgatcggcccctggcagcccagaatcaagaagcagctgagagtgctggccgagatcgccaagtag

SEQ ID NO: 18986 - DNA, 1422 bp, Artificial Sequence
  Description of Artificial Sequence: Synthetic coding sequence
atgctgcccggccccgccctgagaggccccggccccgcccagtaccagagacccggcatgagccccggcaacagaatgcccatggccctggccggcggcaccccctgctggctgcccatctggtgcagcagcagcgccagcacctggcacgccacccaccacgacggcagcatccccaagacccccgcctgcgccccccagccccccatgcccgcccagagaagaggcctgaagagaagaaagatggccgacaaggtgctgccccagagaatcagagagctggtgcccgagagccaggcctacatggacctgctggccttcgagagaaagctggaccagaccatcgccagaaagagaatggagatccaggaggccatcaagaagcccctgacccagaagagaaagctgagaatctacatcagcaacaccttcagccccagcaaggccgagggcgacagcgccggcaccgccggcacccccggcggcacccccgccggcgacaaggtggccagctgggagctgagagtggagggcaagctgctggacgaccccagcaagcagaagagaaagttcagcagcttcttcaagagcctggtgatcgagctggacaaggagctgtacggccccgacaaccacctggtggagtggcacagaatgcccaccacccaggagaccgacggcttccaggtgaagagacccggcgacctgaacgtgaagtgcaccctgctgctgatgctggaccaccagcccccccagtacaagctggaccccagactggccagactgctgggcgtgcacacccagaccagagccgccatcatgcaggccctgtggctgtacatcaagcacaaccagctgcaggacggccacgagagagagtacatcaactgcaacagatacttcagacagatcttcagctgcggcagactgagattcagcgagatccccatgaagctggccggcctgctgcagcaccccgaccccatcgtgatcaaccacgtgatcagcgtggaccccaacgaccagaagaagaccgcctgctacgacatcgacgtggaggtggacgaccccctgaaggcccagatgagcaacttcctggccagcaccaccaaccagcaggagatcgccagcctggacgtgaagatccacgagaccatcgagagcatcaaccagctgaagacccagagagacttcatgctgagcttcagcaccgacccccaggacttcatccaggagtggctgagaagccagagaagagacctgaagatcatcaccgacgtgatcggcaaccccgaggaggagagaagagccgccttctaccaccagccctgggcccaggaggccgtgggcagacacatcttcgccaaggtgcagcagagaagacaggagctggagcaggtgctgggcatcagactgacctag

SEQ ID NO: 18987 - DNA, 570 bp, Artificial Sequence
  Description of Artificial Sequence: Synthetic coding sequence
atggccagcggcgccggcggcagctggggcagaagccccccccagagcgccgtgcccaccccctgggtgaccttcctgcagcccctgagctgggccgtgccccccgcccccccccagcccggcagagtgaaggaggacctgctggagctgatgatgctgcagaacgcccagatgcaccagctgctgctgagcagactggtggccggcgccctgcagcccagacccgccagcccctgcccccaggtgtacctggaggtgccccaggaggagcccgaggaggaggaggaggagatggacgtgagagagaagggccccctggtgttccaccaccactacctgccctacctgatgcccagccccggcgccctgctgccctggcccgcccccttcttccccacccccgcctgccagccctacctgcaggacgtgcccagaatccagcactgccccgccagcagagagagagaggtgagagccgtgccccccccccccccccccagcgccaccggcaccgtgggcgccgacgtgccccccgccagcgactactacgacgccgagagcctgctgtag

SEQ ID NO: 18988 - DNA, 711 bp, Artificial Sequence
  Description of Artificial Sequence: Synthetic coding sequence
atggccagcggcgccggcggcagctggggcagaagccccccccagagcgccgtgcccaccccctgggtgaccttcctgcagcccctgagctgggccgtgccccccgcccccccccagcccggcagagtgaaggaggacctgctggagctgatgatgctgcagaacgcccagatgcaccagctgctgctgagcagactggtggccggcgccctgcagcccagacccgccagcccctgcccccaggtgtacctggaggtgccccaggaggagcccgaggaggaggaggaggagatggacgtgagagagaagggccccctggtgttccaccaccactacctgccctacctgatgcccagccccggcgccctgctgccctggcccgcccccttcttccccacccccgcctgccagccctacctgcaggacgtgcccagaatccagcactgccccgccagcagagagagagagaccaccatgatgcccagagccagctacgaggacagacccagaccctgggagctgcaccagctgcccgccctggacaccgcccccgagcccccccccgcccccctgctgagcacccccagatgcccctggctggccgtgctgctgacccccagcaccagcgccagacccagcagccccggcgagatcagcccctgccccacccccatgagcagctggaccggcagaatctgcgccgtggtgtag

SEQ ID NO: 18989 - DNA, 420 bp, Artificial Sequence
  Description of Artificial Sequence: Synthetic coding sequence
atgatgctgcagaacgcccagatgcaccagctgctgctgagcagactggtggccggcgccctgcagcccagacccgccagcccctgcccccaggtgtacctggaggtgccccaggaggagcccgaggaggaggaggaggagatggacgtgagagagaagggccccctggtgttccaccaccactacctgccctacctgatgcccagccccggcgccctgctgccctggcccgcccccttcttccccacccccgcctgccagccctacctgcaggacgtgcccagaatccagcactgccccgccagcagagagagagaggtgagagccgtgccccccccccccccccccagcgccaccggcaccgtgggcgccgacgtgccccccgccagcgactactacgacgccgagagcctgctgtag

SEQ ID NO: 18990 - DNA, 297 bp, Artificial Sequence
  Description of Artificial Sequence: Synthetic coding sequence
atggccagcggcgccggcggcagctggggcagaagccccccccagagcgccgtgcccaccccctgggtgaccttcctgcagcccctgagctgggccgtgccccccgcccccccccagcccggcagagtgaaggaggacctgctggagctgatgatgctgcagaacgcccagatgcaccagctgctgctgagcagactggtggccggcgccctgcagcccagacccgccagcccctgcccccaggagagctgcgcccccacccccaccccccagtgccacagagactgcggctgctag

SEQ ID NO: 18991 - DNA, 1506 bp, Artificial Sequence
  Description of Artificial Sequence: Synthetic coding sequence
atggagaaccagctgtggcacaacaccgtgagatgctgcaaccagtaccaggagagcccccacgacgccgaggacatcctgctgctgctgctgggcctgatcgtgctggtgaacatcggcatcaacgtggccaccatgatgtggcacggcctgcagaacgccctggacaagatgatcgactgggccacccagaagaacgagatccaggccagcgagagcccccccagcggcccccccgacaaggcccaggacgtgcacatccactgcatcctggaccccgtgcaggtgaagatgagcagacccacccagtacagcagcttcagctgccaccacttcagcaaccaccacagcagcagcctgctgagatgcgtgagaagaagaagaagaagacacagaagatgcagaagaagatgctgcaaccaccagcagagaccccagaactacagacagatcccccacagccacagcgtgttcagaaacccccacagaagccagaagatgagccagctgcacagagtgcccttcttcgaccaggaggaccccgacagctacctggaggaggaggacaacctgcccttcccctaccccaagtaccccagaagaggctggggcggcttctaccagagagccggcctgcccagcaacgtgggcctgtggggccaccagggcggcatcctggccagcctgcccccccccagcctgtacctgagccccgagctgagatgcatgcccaagagagtggaggccagaagcgagctgagactgcagagctacggcagacacggcagccagagcagactgtggggcaacgtggaggccgagcagtgggccagcagccccccccccccccacagactgccccccaaccccagctgggtgcccgtgggccacagcccctaccccagcgtgggctggatgctgtacgacagctgggaccagagaagaagaggcaccgagggcttcgagagaccccccgccagcgtgagcagaaacgccagacccgaggcccagggctgcagagagcaccacagcccccagagccaccagcagagcctgctgggccacgcctacggccagagccacagaagcccccaccccagcaccgagcccctgggctacagcagccaggaccccagagaggtgagaagaagagccgccgactgggccgaggccctgcccgcctggagacccctgaccaccagcgccagcctgaccgtgctggacgaggccagccaccagagaacccccgcccccagcagcgtgctggtgccccacagcagccagccctggcccaaggtgcaggccgccgaccccgcccccccccccaccatgttcgtgcccctgagcagaaaccccggcggcaacgccaactaccaggtgtacgacagcctggagctgaagagacaggtgcagaagagcagagccagaagcagcagcctgccccccgccagcaccagcaccctgagacccagcctgcacagaagccagaccgagaagctgaactag

SEQ ID NO: 18992 - DNA, 1812 bp, Artificial Sequence
  Description of Artificial Sequence: Synthetic coding sequence
atgagcggctacagcagcgacagagacagaggcagagacagaggcttcggcgcccccagattcggcggcagcagagccggccccctgagcggcaagaagttcggcaaccccggcgagaagctggtgaagaagaagaacttctaccaggagcaccccgacctggccagaagaaccgcccaggaggtggagacctacagaagaagcaaggagatcaccgtgagaggccacaactgccccaagcccgtgctgaacttctacgaggccaacttccccgccaacgtgatggacgtgatcgccagacagaacttcaccgagcccaccgccatccaggcccagggctggcccgtggccctgagcggcctggacatggtgggcgtggcccagaccggcagcggcaagaccctgagctacctgctgcccgccatcgtgcacatcaaccaccagcccttcctggagagaggcgacggccccatctgcctggtgctggcccccaccagagagctggcccagcaggtgcagcaggtggccgccgagtactgcagagcctgcagactgaagagcacctgcatctacggcggcgcccccaagggcccccagatcagagacctggagagaggcgtggagatctgcatcgccacccccggcagactgatcgacttcctggagtgcggcaagaccaacctgagaagaaccacctacctggtgctggacgaggccgacagaatgctggacatgggcttcgagccccagatcagaaagatcgtggaccagatcagacccgacagacagaccctgatgtggagcgccacctggcccaaggaggtgagacagctggccgaggacttcctgaaggactacatccacatcaacatcggcgccctggagctgagcgccaaccacaacatcctgcagatcgtggacgtgtgccacgacgtggagaaggacgagaagctgatcagactgatggaggagatcatgagcgagaaggagaacaagaccatcgtgttcgtggagaccaagagaagatgcgacgagctgaccagaaagatgagaagagacggctggcccgccatgggcatccacggcgacaagagccagcaggagagagactgggtgctgaacgagttcaagcacggcaaggcccccatcctgatcgccaccgacgtggccagcagaggcctggacgtggaggacgtgaagttcgtgatcaactacgactaccccaacagcagcgaggactacatccacagaatcggcagaaccgccagaagcaccaagaccggcaccgcctacaccttcttcacccccaacaacatcaagcaggtgagcgacctgatcagcgtgctgagagaggccaaccaggccatcaaccccaagctgctgcagctggtggaggacagaggcagcggcagaagcagaggcagaggcggcatgaaggacgacagaagagacagatacagcgccggcaagagaggcggcttcaacaccttcagagacagagagaactacgacagaggctacagcagcctgctgaagagagacttcggcgccaagacccagaacggcgtgtacagcgccgccaactacaccaacggcagcttcggcagcaacttcgtgagcgccggcatccagaccagcttcagaaccggcaaccccaccggcacctaccagaacggctacgacagcacccagcagtacggcagcaacgtgcccaacatgcacaacggcatgaaccagcaggcctacgcctaccccgccaccgccgccgcccccatgatcggctaccccatgcccaccggctacagccagtag

SEQ ID NO: 18993 - DNA, 1191 bp, Artificial Sequence
  Description of Artificial Sequence: Synthetic coding sequence
atgctgcccagcctgcaggagagcatggacggcgacgagaaggagctggagagcagcgaggagggcggcagcgccgaggagagaagactggagccccccagcagcagccactactgcctgtacagctacagaggcagcagactggcccagcagagaggcgacagcgaggacggcagccccagcggcaccaacgccgagacccccagcggcgacgacttcagcctgagcctggccgacaccaacctgcccagcgaggtggagcccgagctgagaagcttcatcgccaagagactgagcagaggcgccgtgttcgagggcctgggcaacgtggccagcgtggagctgaagatccccggctacagagtgggctgctactactgcctgttccagaacgagaagctgctgcccgagaccgtgaccatcgacagcgagagaaaccccagcgagtacgtggtgtgcttcctgggcggcagcgagaagggcctggagctgttcagactggagctggacaagtacatccagggcctgaagaacaacatgaactgcgaggccagaggcctggagagccacatcaagagctacctgagcagctggttcgaggacgtggtgtgccccatccagagagtggtgctgctgttccaggagaagctgaccttcctgctgcacgccgccctgagctacacccccgtggaggtgaaggagagcgacgagaagaccaagagagacatcaacagattcctgagcgtggccagcctgcagggcctgatccacgagggcaccatgaccagcctgtgcatggccatgaccgaggagcagcacaagagcgtggtgatcgactgcagcagcagccagccccagttctgcaacgccggcagcaacagattctgcgaggactggatgcaggccttcctgaacggcgccaagggcggcaaccccttcctgttcagacaggtgctggagaacttcaagctgaaggccatccaggacaccaacaacctgaagagattcatcagacaggccgagatgaaccactacgccctgttcaagtgctacatgttcctgaagaactgcggcagcggcgacatcctgctgaagatcgtgaaggtggagcacgaggagatgcccgaggccaagaacgtgatcgccgtgctggaggagttcatgaaggaggccctggaccagagcttctag

SEQ ID NO: 18994 - DNA, 732 bp, Artificial Sequence
  Description of Artificial Sequence: Synthetic coding sequence
atggacgagctggccctgagcttcagcctgacctgcctgctgcccgagaacagagccagcctgagccccagccagcccctgagcttccagtgcctgaaggcccccgccaccctgacctgggaggacgagaagcagcagagatggggccagccccacggccccgtgagcagccccctgctgggcgaccacagatgcctggtgcccttcagagacctgaaccccagcagcgaggtgaacaccgccaacctgctggagagccccagcagcctgctgctgaccagctgctacatctgcagctacttcagcttctacatcctgggcgagaagagatgccacagcctgaagagactgagatacagcgtgtgctgcaaggtgtgccccaacttctgcgcctgcggcaaggagaacgtgagcggcaccggccaggtgtgcaccggcgtgcacgtgggcgccaaggagcaggaggagcccggcggcacccaggccctgagaagctgcggcatctactgcctggaggagagaaccgacaaggccagccacgaggagtgcagagagagaagcaccctgggcagaccccagtgcaccggcctgacccccagcctggccggcgagagcccctgccccagactgctgcccggcagccccaccgtgagacacctgatcgccagcagctgccccggcctgagcgaccccctgcccctgccccccggcaccctgcccctgggcagctag

SEQ ID NO: 18995 - DNA, 732 bp, Artificial Sequence; identical to SEQ ID NO: 18994
  Description of Artificial Sequence: Synthetic coding sequence

SEQ ID NO: 18996 - DNA, 117 bp, Artificial Sequence
  Description of Artificial Sequence: Synthetic coding sequence
atggacgagctggccctgagcttcagcctgacctgcctgctgcccgagaacagagccagcctgagccccagccagcccctgagcttccagtgcctgaaggcccccgccaccctgtag

SEQ ID NO: 18997 - DNA, 756 bp, Artificial Sequence
  Description of Artificial Sequence: Synthetic coding sequence
atgggcagacccctggagggccagcccctgagagccctggacctgtaccccgagcccgccttcctgagaagcggcaaggaccccaagagcagccccgccagcagccccagcttcgccgtgctgggccccgaggtgagaagcaccggcggccaggccggcagcagaagaagacccagcgccccctgcagccaggacagagccgccgccgagggcgcccccgccctgctgggcggcagccccagcagcggcagccccggccacccccccggcagcgccttcggcgtggaggccggctgcagagccctgaacgtgagcgagcacgccagaggcggcttcgccctgggcctgcccttcggcctgagcggcggcgcctacctgttcctgctgctggacggcgccggcgaccccaagcccacccccgaggcccccatcagcagcgccgacggcagagcctggttccccagcgagagcagctggcagctgccccagctgcccgccggcagcaccagcggcagcgagcccagagccagacccggcctgggccccagacagctgctgaccggccccagagacggcgccgccggccagggccccggcagaggcctgaccgccagactgggcagagagagagagatcgactgcggccccagacaggccggccacggcggcaccgccaccgacaccggcagagccggcagcggcgccagacacagaccccccagagacagaggcacccccggcctgagaacccactag

SEQ ID NO: 18998 - DNA, 435 bp, Artificial Sequence
  Description of Artificial Sequence: Synthetic coding sequence
atgaccagaatgaccagacccctgaagagccacgtgcaggtggtgcccagcaccctgatgtggcagagccaggccagaacccagcccgcccccctgtgctgcaagctgctgacccccagatggctgcccctgctgctgcccacccacccccacagccactgcctggccggccacctgttcttccccgccagatacagctgcagcagcgagtggaagcagcagctgacctgccacctgtgcgtgaccgacagcgccccccccagacacaccggcgtggtggtgagcgagcacctgagaagaaccgagaagctgttcttcaccatcctgagccccaaccagagcaagcccttcaagacctggaagatgctgaaggccaccatccccatcttcgtgtgcttcctgctgaacctggcccagaaccccagacccctgtag

SEQ ID NO: 18999 - DNA, 1023 bp, Artificial Sequence
  Description of Artificial Sequence: Synthetic coding sequence
atgaagtacggcaaccccaactacggcggcatgaagggcatcctgagcaacagctggaagagaagataccacagcagaagaatccagagagacgtgatcaagaagagagccctgatcggcgacgacgtgggcctgaccagctacaagcacagacacagcggcctggtgaacgtgcccgaggagcccatcgaggaggaggaggaggaggaggaggaggaggaggaggaggaggaggaggaccaggacatggacgccgacgacagagtggtggtggagtaccacgaggagctgcccgccctgaagcagcccagagagagaagcgccagcagaagaagcagcgccagcagcagcgacagcgacgagatggactacgacctggagctgaagatgatcagcacccccagccccaagaagagcatgaagatgaccatgtacgccgacgaggtggagagccagctgaagaacatcagaaacagcatgagagccgacagcgtgagcagcagcaacatcaagaacagaatcggcaacaagctgccccccgagaagttcgccgacgtgagacacctgctggacgagaagagacagcacagcagacccagaccccccgtgagcagcaccaagagcgacatcagacagagactgggcaagagaccccacagccccgagaaggccttcagcagcaaccccgtggtgagaagagagcccagcagcgacgtgcacagcagactgggcgtgcccagacaggacagcaagggcctgtacgccgacaccagagagaagaagagcggcaacctgtggaccagactgggcagcgcccccaagaccaaggagaagaacaccaagaaggtggaccacagagcccccggcgccgaggaggacgacagcgagctgcagagagcctggggcgccctgatcaaggagaaggagcagagcagacagaagaagagcagactggacaacctgcccagcctgcagatcgaggtgagcagagagagcagcagcggcagcgaggccgagagctag

SEQ ID NO: 19000 - DNA, 1863 bp, Artificial Sequence
  Description of Artificial Sequence: Synthetic coding sequence
atggccgccgtgagaggcctgagagtgagcgtgaaggccgaggcccccgccggccccgccctgggcctgcccagccccgaggccgagagcggcgtggacagaggcgagcccgagcccatggaggtggaggagggcgagctggagatcgtgcccgtgagaagaagcctgaaggagctgatccccgacaccagcagaagatacgagaacaaggccggcagcttcatcaccggcatcgacgtgaccagcaaggaggccatcgagaagaaggagcagagagccaagagattccacttcagaagcgaggtgaacctggcccagagaaacgtggccctggacagagacatgatgaagaaggccatccccaaggtgagactggagaccatctacatctgcggcgtggacgagatgagcacccaggacgtgttcagctacttcaaggagtacccccccgcccacatcgagtggctggacgacaccagctgcaacgtggtgtggctggacgagatgaccgccaccagagccctgatcaacatgagcagcctgcccgcccaggacaagatcagaagcagagacgccagcgaggacaagagcgccgagaagagaaagaaggacaagcaggaggacagcagcgacgacgacgaggccgaggagggcgaggtggaggacgagaacagcagcgacgtggagctggacaccctgagccaggtggaggaggagagcctgctgagaaacgacctgagacccgccaacaagctggccaagggcaacagactgttcatgagattcgccaccaaggacgacaagaaggagctgggcgccgccagaagaagccagtactacatgaagtacggcaaccccaactacggcggcatgaagggcatcctgagcaacagctggaagagaagataccacagcagaagaatccagagagacgtgatcaagaagagagccctgatcggcgacgacgtgggcctgaccagctacaagcacagacacagcggcctggtgaacgtgcccgaggagcccatcgaggaggaggaggaggaggaggaggaggaggaggaggaggaggaggaggaccaggacatggacgccgacgacagagtggtggtggagtaccacgaggagctgcccgccctgaagcagcccagagagagaagcgccagcagaagaagcagcgccagcagcagcgacagcgacgagatggactacgacctggagctgaagatgatcagcacccccagccccaagaagagcatgaagatgaccatgtacgccgacgaggtggagagccagctgaagaacatcagaaacagcatgagagccgacagcgtgagcagcagcaacatcaagaacagaatcggcaacaagctgccccccgagaagttcgccgacgtgagacacctgctggacgagaagagacagcacagcagacccagaccccccgtgagcagcaccaagagcgacatcagacagagactgggcaagagaccccacagccccgagaaggccttcagcagcaaccccgtggtgagaagagagcccagcagcgacgtgcacagcagactgggcgtgcccagacaggacagcaagggcctgtacgccgacaccagagagaagaagagcggcaacctgtggaccagactgggcagcgcccccaagaccaaggagaagaacaccaagaaggtggaccacagagcccccggcgccgaggaggacgacagcgagctgcagagagcctggggcgccctgatcaaggagaaggagcagagcagacagaagaagagcagactggacaacctgcccagcctgcagatcgaggtgagcagagagagcagcagcggcagcgaggccgagagctag

SEQ ID NO: 19001 - DNA, 1140 bp, Artificial Sequence
  Description of Artificial Sequence: Synthetic coding sequence
atggagaccctgtgccccgcccccagactggccgtgcccgccagccccagaggcagcccctgcagccccacccccagaaagccctgcagaggcacccaggagttcagccccctgtgcctgagagccctggccttctgcgccctggccaagcccagagccagcagcctgggccccggccccggcgagctggccgccagaagccccgtgctgagaggcccccaggcccccctgagacccggcggctgggcccccgacggcctgaagcacctgtgggcccccaccggcagacccggcgtgcccaacaccgccgccggcgaggacgccgacgtggccgcctgccccagaagaggcgaggaggaggagggcggcggcggcttcccccacttcggcgtgagaagctgcgccccccccggcagatgccccgcccccccccaccccagagagagcaccaccagcttcgccagcgccccccccagacccgcccccggcctggagccccagagaggccccgccgccagccccccccaggagcccagcagcagaccccccagcccccccgccggcctgagcaccgagcccgccggccccggcaccgcccccagacccttcctgcccggccagcccgccgaggtggacggcaaccccccccccgccgcccccgaggcccccgccgccagccccagcaccgccagccccgcccccgccgcccccggcgacctgagacaggagcacttcgacagactgatcagaagaagcaagctgtggtgctacgccaagggcttcgccctggacacccccagcctgagaagaggccccgagagaccccccgccaagggccccgccagaggcgccgccaagaagagaagactgcccgcccccccccccagaaccgcccagcccagaagacccgcccccaccctgcccaccaccagcaccttcagcctgctgaactgcttcccctgcccccccgccctggtggtgggcgaggacggcgacctgaagcccgccagcagcctgagactgcagggcgacagcaagcccccccccgcccaccccctgtggagatggcagatgggcggccccgccgtgcccgagccccccggcctgaagttctggggcatcaacatggacgagagctag

SEQ ID NO: 19002 - DNA, 1272 bp, Artificial Sequence
  Description of Artificial Sequence: Synthetic coding sequence
atggagaccagaggccccggcctggccgtgagagccgagagcagaagactggtgggcatcggccccagagccccccccggcagagtgggcctgcagcccagcggcagactggacagaagaggcggcgccggcaccatgggctacaaggacaacgacggcgaggaggaggagagagagggcggcgccgccggccccagaggcagcagactgccccccatcaccggcggcgccagcgagctggccaagagaaaggtgaagaagaagaagagaaagaagaagaccaagggcagcggcaagggcgacgacaagcaccagagccagagcctgaagagccagcccctgagcagcagcttccacgacatcctgagcccctgcaaggagagaggccccaagcccgagcacagacagagcaaggtggagaagaagcacctgcccagcgacagcagcaccgtgagcctgcccgacttcgccgagatcgagaacctggccaacagaatcaacgagagcctgagatgggacggcatcctggccgaccccgaggccgagaaggagagaatcagaatctacaagctgaacagaagaaagagatacagatgcctggccctgaagggcttccaccccgaccccgaggccctgaagggcttccaccccgaccccgacgccctgaagggcttccaccccgaccccgaggccctgaagggcttccaccccgaccccgaggccctgaagggcatccaccccgaccccgaggccctgaagggcttccaccccgaccccgaggccctgaagggcttccaccccgaccccgaggccctgaagggcttccacaccgaccccgaggccctgaagggcttccacatcgaccccgaggccctgaagggcttccaccccgaccccaaggccctgaagggcttccaccccgaccccaaggccctgaagggcttccacaccgaccccgaggccctgaagggcttccaccccgaccccaaggccctgaagggcttccaccccgaccccgaggccctgaagggcttccaccccgaccccgaggccctgaagggcttccaccccgaccccgaggccctgaagggcttccacaccgaccccaacgccgaggaggcccccgagaacctgccctacctgagcgacaaggacggcagcagcagccacagacagcccaccagcaaggccgagtgccccaacctgtgcttcgagggcaacctgacccccaagctgctgcacagcgacctggcccccaccctgctggagtag

SEQ ID NO: 19003 - DNA, 465 bp, Artificial Sequence
  Description of Artificial Sequence: Synthetic coding sequence
atggcctacctgagcgagtgcagactgagactggagaagggcttcatcctggacggcgtggccgtgagcaccgccgccagagcctacggcagaagcagacccaagctgtggagcgccatccccccctacaacgcccagcaggactaccacgccagaagctacttccagagccacgtggtgccccccctgctgagaaagaccgaccaggaccacggcggcaccggcagagacggctggatcgtggactacatccacatcttcggccagggccagagatacctgaacagaagaaactgggccggcaccggccacagcctgcagcaggtgaccggccacgaccactacaacgccgacctgaagcccatcgacggcttcaacggcagattcggctacagaagaaacacccccgccctgagacagagcaccagcgtgttcggcgaggtgacccacttccccctgttctag

SEQ ID NO: 19004 - DNA, 798 bp, Artificial Sequence
  Description of Artificial Sequence: Synthetic coding sequence
atgggcctgcccggcctgttctgcctggccgtgctggccgccagcagcttcagcaaggccagagaggaggagatcacccccgtggtgagcatcgcctacaaggtgctggaggtgttccccaagggcagatgggtgctgatcacctgctgcgccccccagccccccccccccatcacctacagcctgtgcggcaccaagaacatcaaggtggccaagaaggtggtgaagacccacgagcccgccagcttcaacctgaacgtgaccctgaagagcagccccgacctgctgacctacttctgctgggccagcagcaccagcggcgcccacgtggacagcgccagactgcagatgcactgggagctgtggagcaagcccgtgagcgagctgagagccaacttcaccctgcaggacagaggcgccggccccagagtggagatgatctgccaggccagcagcggcagcccccccatcaccaacagcctgatcggcaaggacggccaggtgcacctgcagcagagaccctgccacagacagcccgccaacttcagcttcctgcccagccagaccagcgactggttctggtgccaggccgccaacaacgccaacgtgcagcacagcgccctgaccgtggtgccccccggcggcgaccagaagatggaggactggcagggccccctggagagccccatcctggccctgcccctgtacagaagcaccagaagactgagcgaggaggagttcggcggcttcagaatcggcaacggcgaggtgagaggcagaaaggccgccgccatgtag

SEQ ID NO: 19005 - DNA, 903 bp, Artificial Sequence
  Description of Artificial Sequence: Synthetic coding sequence
atgagcagacccggcatcgtggagagctacgagatcacccccgtggtgagcatcgcctacaaggtgctggaggtgttccccaagggcagatgggtgctgatcacctgctgcgccccccagccccccccccccatcacctacagcctgtgcggcaccaagaacatcaaggtggccaagaaggtggtgaagacccacgagcccgccagcttcaacctgaacgtgaccctgaagagcagccccgacctgctgacctacttctgctgggccagcagcaccagcggcgcccacgtggacagcgccagactgcagatgcactgggagctgtggagcaagcccgtgagcgagctgagagccaacttcaccctgcaggacagaggcgccggccccagagtggagatgatctgccaggccagcagcggcagcccccccatcaccaacagcctgatcggcaaggacggccaggtgcacctgcagcagagaccctgccacagacagcccgccaacttcagcttcctgcccagccagaccagcgactggttctggtgccaggccgccaacaacgccaacgtgcagcacagcgccctgaccgtggtgccccccggcgagagagccctgggcttccccgagggccagctggccctgctgtgcagagagggcgccagcgtgcaggacaccggcagatgggaggtgggccagctgtaccccgccaccgccgagagcagagagggcaccggcggcaaccacgcccaccccggcccctgcctgaaggaggcccagcccagctgcctgagacccctgcccggcggcctgcccagagcccccaccatcgtgctggtgggcagcctggccagcaccgccgccatcaccagcagaatgctgggctggaccacctgggccagatag

SEQ ID NO: 19006 - DNA, 399 bp, Artificial Sequence
  Description of Artificial Sequence: Synthetic coding sequence
atggtgaagaagttcaaggacagcaagagcgtgctgctgatcacctgcaagacctgcaacagaaccgtgaagcaccacggcaagagcagaagcttcgtgagcaccctgaagagcaaccccgccacccccaccagcaagctgagcctgaagacccccgagagaagaaccgccaaccccaaccacgacatgagcggcagcaagggcaagagccccgccagcgtgttcagaacccccaccagcggccagagcgtgagcacctgcagcagcaagaacaccagcaagaccaagaagcacttcagccagctgaagatgctgctgagccagaacgagagccagaagatccccaaggtggacttcagaaacttcctgagcagcctgaagggcggcctgctgaagtag

SEQ ID NO: 19007 - DNA, 663 bp, Artificial Sequence
  Description of Artificial Sequence: Synthetic coding sequence
atgagacagaagcactacctggaggccgccgccagaggcctgcacgacagctgccccggccaggccagatacctgctgtgggcctacaccagcagccacgacgacaagagcaccttcgaggagacctgcccctactgcttccagctgctggtgctggacaacagcagagtgagactgaagcccaaggccagactgacccccaagatccagaagctgctgaacagagaggccagaaactacaccctgagcttcaaggaggccaagatggtgaagaagttcaaggacagcaagagcgtgctgctgatcacctgcaagacctgcaacagaaccgtgaagcaccacggcaagagcagaagcttcgtgagcaccctgaagagcaaccccgccacccccaccagcaagctgagcctgaagacccccgagagaagaaccgccaaccccaaccacgacatgagcggcagcaagggcaagagccccgccagcgtgttcagaacccccaccagcggccagagcgtgagcacctgcagcagcaagaacaccagcaagaccaagaagcacttcagccagctgaagatgctgctgagccagaacgagagccagaagatccccaaggtggacttcagaaacttcctgagcagcctgaagggcggcctgctgaagtag

SEQ ID NO: 19008 - DNA, 663 bp, Artificial Sequence; identical to SEQ ID NO: 19007
  Description of Artificial Sequence: Synthetic coding sequence

SEQ ID NO: 19009 - DNA, 1212 bp, Artificial Sequence
  Description of Artificial Sequence: Synthetic coding sequence
atgaagatggaggaggccgtgggcaaggtggaggagctgatcgagagcgaggccccccccaaggccagcgagcaggagaccgccaaggaggaggacggcagcgtggagctggagagccaggtgcagaaggacggcgtggccgacagcaccgtgatcagcagcatgccctgcctgctgatggagctgagaagagacagcagcgagagccagctggccagcaccgagagcgacaagcccaccaccggcagagtgtacgagagcgacagcagcaaccactgcatgctgagccccagcagcagcggccacctggccgacagcgacaccctgagcagcgccgaggagaacgagcccagccaggccgagaccgccgtggagggcgaccccagcggcgtgagcggcgccaccgtgggcagaaagagcagaagaagcagaagcgagagcgagaccagcaccatggccgccaagaagaacagacagagcagcgacaagcagaacggcagagtggccaaggtgaagggccacagaagccagaagcacaaggagagaatcagactgctgagacagaagagagaggccgccgccagaaagaagtacaacctgctgcaggacagcagcaccagcgacagcgacctgacctgcgacagcagcaccagcagcagcgacgacgacgaggaggtgagcggcagcagcaagaccatcaccgccgagatccccgacggcccccccgtggtggcccactacgacatgagcgacaccaacagcgaccccgaggtggtgaacgtggacaacctgctggccgccgccgtggtgcaggagcacagcaacagcgtgggcggccaggacaccggcgccacctggagaaccagcggcctgctggaggagctgaacgccgaggccggccacctggaccccggcttcctggccagcgacaagaccagcggcaacgcccccctgaacgaggagatcaacatcgccagcagcgacagcgaggtggagatcgtgggcgtgcaggagcacgccagatgcgtgcaccccagaggcggcgtgatccagagcgtgagcagctggaagcacggcagcggcacccagtacgtgagcaccagacagacccagagctggaccgccgtgaccccccagcagacctgggccagccccgccgaggtggtggacctgaccctggacgaggacagcagaagaaagtacctgctgtag

SEQ ID NO: 19010 - DNA, 1029 bp, Artificial Sequence
  Description of Artificial Sequence: Synthetic coding sequence
atgaagatggaggaggccgtgggcaaggtggaggagctgatcgagagcgaggccccccccaaggccagcgagcaggagaccgccaaggaggaggacggcagcgtggagctggagagccaggtgcagaaggacggcgtggccgacagcaccgtgatcagcagcatgccctgcctgctgatggagctgagaagagacagcagcgagagccagctggccagcaccgagagcgacaagcccaccaccggcagagtgtacgagagcgacagcagcaaccactgcatgctgagccccagcagcagcggccacctggccgacagcgacaccctgagcagcgccgaggagaacgagcccagccaggccgagaccgccgtggagggcgaccccagcggcgtgagcggcgccaccgtgggcagaaagagcagaagaagcagaagcgagagcgagaccagcaccatggccgccaagaagaacagacagagcagcgacaagcagaacggcagagtggccaaggtgaagggccacagaagccagaagcacaaggagagaatcagactgctgagacagaagagagaggccgccgccagaaagaagtacaacctgctgcaggacagcagcaccagcgacagcgacctgacctgcgacagcagcaccagcagcagcgacgacgacgaggaggtgagcggcagcagcaagaccatcaccgccgagatccccggccacctggaccccggcttcctggccagcgacaagaccagcggcaacgcccccctgaacgaggagatcaacatcgccagcagcgacagcgaggtggagatcgtgggcgtgcaggagcacgccagatgcgtgcaccccagaggcggcgtgatccagagcgtgagcagctggaagcacggcagcggcacccagtacgtgagcaccagacagacccagagctggaccgccgtgaccccccagcagacctgggccagccccgccgaggtggtggacctgaccctggacgaggacagcagaagaaagtacctgctgtag

SEQ ID NO: 19011 - DNA, 231 bp, Artificial Sequence
  Description of Artificial Sequence: Synthetic coding sequence
atggtgtgcatcccctgcatcgtgatccccgtgctgctgtggatctacaagaagttcctggagccctacatctaccccctggtgagccccttcgtgagcagaatctggcccaagaaggccatccaggagagcaacgacaccaacaagggcaaggtgaacttcaagggcgccgacatgaacggcctgcccaccaagggccccaccgagatctgcgacaagaagaaggactag

SEQ ID NO: 19012 - DNA, 231 bp, Artificial Sequence; identical to SEQ ID NO: 19011
  Description of Artificial Sequence: Synthetic coding sequence

SEQ ID NO: 19013 - DNA, 2490 bp, Artificial Sequence
  Description of Artificial Sequence: Synthetic coding sequence
atgaccgagaacaagaccgtgagcagcagcagcaccagagacgaccagaccaacatcggcctgacctgccaggaggtgaaggccctgagagagaaggcctggagcagaaccaacgagggcaacgccatgagccagagcctggtgctgtacggcgccagcaaggagaacagcgagggcttccacgagagcaagatgaccaacaccgagggcgtgaacaagggcatctacttcagctacccctgcagaagacacagctgcgccgtggtgaacatccccgccccctgcgtgaacaagatgatcagccacatccaggacgtggagagcaagatccaggagcacctgaagagattcgagaccagcttcgaggagtggagcagaaccagcagcaccaaggacctgaaggaggactggagcgtgaccacccccgtgaaggaggtgaagcccggcgagaagagagacgagaagtgccccgagctgaagcaggagatggagaccctgctgagcgaggccatcagactgatcaagagcctggagaccgacagagccgacgccgaggaggccctgaagcagcagagaagcagaaagaacatgatcaacatgaagatcgacagctggagcgtgtggaagctgcaggagctgcccctggccgtgcagaaggagcacgaggcctacctgagcgacgtgatcgagctgcagtggcacctggaggacaaggccaaccagctgcagcacttcgagaagcagaagaccgagctggaggaggccaacgccaagatccaggccgacatcgactacatgaacgagcacggccccctgctggacagcaagcagaaccaggagctgcaggacctgaagaaccactacaagaagaagatggaggtgatggacctgcacagaaaggtgaacgaggagctggaggaggccctggaggcctgcgagaacgccagactgaaggcccagcagatcaaggaggagatcgacaaggacatctaccaggacgagaagaccatcgaggcctacaagagagagatctaccagctgaacagcctgttcgaccactacagcagcagcgtgatcaacgtgaacaccaacatcgaggagaaggaggaggaggtgaccgaggccatcagagagaccaagagcagcaagaacgagctgcacagcctgagcaagatgctggaggacctgagaagagtgtacgaccagctgacctggaagcagaagagccacgagaaccagtacctggaggccgtgaacgacttctacgccgccaagaagacctgggacatcgagctgagcgacgtggccaaggacttcagcgccatcagcctggcctgcaccaagctgaccgaggacaacaagaagctggagatcgacatcaacaagatcaccgtgaagaccaacgagagcatcagaaagaagagcaagtacgagagcgagatcaagtacctgaccatcatgaagctgaagaacgacaagcacctgaagaacatctacaaggaggcctacagaatcggcaccctgttccacctgaccaagcacaagaccgacgagatggaggacaagatcgccgaggtgagaagaaagttcaagggcagagaggagttcctgaagaagctgacccagggcgaggtggccgccggcatggtgctgcagaagaagctgtacagcatctacgaggtgcaggccctggagagaaaggagctgatcaagaacagagccatctgcgccatgagcctggccgagctgcaggagcccctgctgcagctggaggacgaggccgagagaatcagaagcctggacaaggagcacagcgtgagcaagagaagcgccatcttcaaggacctggaggccaccaagagcaagaccatgatcttctacgccaagatcaacgagctgaacgaggagctgaaggccaaggaggaggagaagaagagcttcgaccagaccctggagatcctgaagaacaagttcatcaccatgagattcaagagagagcacgcccagaccgtgttcgaccactacatgcaggagaagaaggactgcgaggagagaatcttcgaggaggaccagagattcagagtgctgctggccgtgagacagaagaccctgcaggacacccagaagatcatcgccgacagcctggaggagaacctgagactggcccaggagtaccagcagctgcagatcaccttcctgaaggagaaggacaactacttcaacatctacgacaagcagctgagcctggacaccagcatcagagacaagaagcagctgtgccagctgcagagaagaatgcacaccctgtggcaggagcacttcaagctggtggtgctgttcagccagatgagactggccaacttccagaccgacagccaggagagcatccagaagatcctggccgtgcaggaggagagcagcaacctgatgcagcacatcctgggcttcttccagaccctgaccgacggcacctgcgagaacgacggctag

SEQ ID NO: 19014 - DNA, 2604 bp, Artificial Sequence
  Description of Artificial Sequence: Synthetic coding sequence
atgaccgagaacaagaccgtgagcagcagcagcaccagagacgaccagaccaacatcggcctgacctgccaggaggtgaaggccctgagagagaaggcctggagcagaaccaacgagggcaacgccatgagccagagcctggtgctgtacggcgccagcaaggagaacagcgagggcttccacgagagcaagatgaccaacaccgagggcgtgaacaagggcatctacttcagctacccctgcagaagacacagctgcgccgtggtgaacatccccgccccctgcgtgaacaagatgatcagccacatccaggacgtggagagcaagatccaggagcacctgaagagattcgagaccagcttcgaggagtggagcagaaccagcagcaccaaggacctgaaggaggactggagcgtgaccacccccgtgaaggaggtgaagcccggcgagaagagagacgagaagtgccccgagctgaagcaggagatggagaccctgctgagcgaggccatcagactgatcaagagcctggagaccgacagagccgacgccgaggaggccctgaagcagcagagaagcagaaagaacatgatcaacatgaagatcgacagctggagcgtgtggaagctgcaggagctgcccctggccgtgcagaaggagcacgaggcctacctgagcgacgtgatcgagctgcagtggcacctggaggacaaggccaaccagctgcagcacttcgagaagcagaagaccgagctggaggaggccaacgccaagatccaggccgacatcgactacatgaacgagcacggccccctgctggacagcaagcagaaccaggagctgcaggacctgaagaaccactacaagaagaagatggaggtgatggacctgcacagaaaggtgaacgaggagctggaggaggccctggaggcctgcgagaacgccagactgaaggcccagcagatcaaggaggagatcgacaaggacatctaccaggacgagaagaccatcgaggcctacaagagagagatctaccagctgaacagcctgttcgaccactacagcagcagcgtgatcaacgtgaacaccaacatcgaggagaaggaggaggaggtgaccgaggccatcagagagaccaagagcagcaagaacgagctgcacagcctgagcaagatgctggaggacctgagaagagtgtacgaccagctgacctggaagcagaagagccacgagaaccagtacctggaggccgtgaacgacttctacgccgccaagaagacctgggacatcgagctgagcgacgtggccaaggacttcagcgccatcagcctggcctgcaccaagctgaccgaggacaacaagaagctggagatcgacatcaacaagatcaccgtgaagaccaacgagagcatcagaaagaagagcaagtacgagagcgagatcaagtacctgaccatcatgaagctgaagaacgacaagcacctgaagaacatctacaaggaggcctacagaatcggcaccctgttccacctgaccaagcacaagaccgacgagatggaggacaagatcgccgaggtgagaagaaagttcaagggcagagaggagttcctgaagaagctgacccagggcgaggtggccgccggcatggtgctgcagaagaagctgtacagcatctacgaggtgcaggccctggagagaaaggagctgatcaagaacagagccatctgcgccatgagcctggccgagctgcaggagcccctgctgcagctggaggacgaggccgagagaatcagaagcctggacaaggagcacagcgtgatgctgaacaacatcatcgaccagaaggacctgatcagaagaaaggtgggcaaggtgaagaagaagctgagaaagaagggcaagaagaccctggacgccctgatcgagaccgagagcaagagaagcgccatcttcaaggacctggaggccaccaagagcaagaccatgatcttctacgccaagatcaacgagctgaacgaggagctgaaggccaaggaggaggagaagaagagcttcgaccagaccctggagatcctgaagaacaagttcatcaccatgagattcaagagagagcacgcccagaccgtgttcgaccactacatgcaggagaagaaggactgcgaggagagaatcttcgaggaggaccagagattcagagtgctgctggccgtgagacagaagaccctgcaggacacccagaagatcatcgccgacagcctggaggagaacctgagactggcccaggagtaccagcagctgcagatcaccttcctgaaggagaaggacaactacttcaacatctacgacaagcagctgagcctggacaccagcatcagagacaagaagcagctgtgccagctgcagagaagaatgcacaccctgtggcaggagcacttcaagctggtggtgctgttcagccagatgagactggccaacttccagaccgacagccaggagagcatccagaagatcctggccgtgcaggaggagagcagcaacctgatgcagcacatcctgggcttcttccagaccctgaccgacggcacctgcgagaacgacggctag

SEQ ID NO: 19015 - DNA, 894 bp, Artificial Sequence
  Description of Artificial Sequence: Synthetic coding sequence
atgaccgagaacaagaccgtgagcagcagcagcaccagagacgaccagaccaacatcggcctgacctgccaggaggtgaaggccctgagagagaaggcctggagcagaaccaacgagggcaacgccatgagccagagcctggtgctgtacggcgccagcaaggagaacagcgagggcttccacgagagcaagatgaccaacaccgagggcgtgaacaagggcatctacttcagctacccctgcagaagacacagctgcgccgtggtgaacatccccgccccctgcgtgaacaagatgatcagccacatccaggacgtggagagcaagatccaggagcacctgaagagattcgagaccagcttcgaggagtggagcagaaccagcagcaccaaggacctgaaggaggactggagcgtgaccacccccgtgaaggaggtgaagcccggcgagaagagagacgagaagtgccccgagctgaagcaggagatggagaccctgctgagcgaggccatcagactgatcaagagcctggagaccgacagagccgacgccgaggaggccctgaagcagcagagaagcagaaagaacatgatcaacatgaagatcgacagctggagcgtgtggaagctgcaggagctgcccctggccgtgcagaaggagcacgaggcctacctgagcgacgtgatcgagctgcagtggcacctggaggacaaggccaaccagctgcagcacttcgagaagcagaagaccgagctggaggaggccaacgccaagatccaggccgacatcgactacatgaacgagcacggccccctgctggacagcaagcagaaccaggagctgcaggacctgaagaaccactacaagaagaagatcaagaagaagaagaagtag

SEQ ID NO: 19016 - DNA, 2454 bp, Artificial Sequence
  Description of Artificial Sequence: Synthetic coding sequence
atgaccgagaacaagaccgtgagcagcagcagcaccagagacgaccagaccaacatcggcctgacctgccaggaggtgaaggccctgagagagaaggcctggagcagaaccaacgagggcaacgccatgagccagagcctggtgctgtacggcgccagcaaggagaacagcgagggcttccacgagagcaagatgaccaacaccgagggcgtgaacaagggcatctacttcagctacccctgcagaagacacagctgcgccgtggtgaacatccccgccccctgcgtgaacaagatgatcagccacatccaggacgtggagagcaagatccaggagcacctgaagagattcgagaccagcttcgaggagtggagcagaaccagcagcaccaaggacctgaaggaggactggagcgtgaccacccccgtgaaggaggtgaagcccggcgagaagagagacgagaagtgccccgagctgaagcaggagatggagaccctgctgagcgaggccatcagactgatcaagagcctggagaccgacagagccgacgccgaggaggccctgaagcagcagagaagcagaaagaacatgatcaacatgaagatcgacagctggagcgtgtggaagctgcaggagctgcccctggccgtgcagaaggagcacgaggcctacctgagcgacgtgatcgagctgcagtggcacctggaggacaaggccaaccagctgcagcacttcgagaagcagaagaccgagctggaggaggccaacgccaagatccaggccgacatcgactacatgaacgagcacggccccctgctggacagcaagcagaaccaggagctgcaggacctgaagaaccactacaagaagaagatggaggtgatggacctgcacagaaaggtgaacgaggagctggaggaggccctggaggcctgcgagaacgccagactgaaggcccagcagatcaaggaggagatcgacaaggacatctaccaggacgagaagaccatcgaggcctacaagagagagatctaccagctgaacagcctgttcgaccactacagcagcagcgtgatcaacgtgaacaccaacatcgaggagaaggaggaggaggtgaccgaggccatcagagagaccaagagcagcaagaacgagctgcacagcctgagcaagatgctggaggacctgagaagagtgtacgaccagctgacctggaagcagaagagccacgagaaccagtacctggaggccgtgaacgacttctacgccgccaagaagacctgggacatcgagctgagcgacgtggccaaggacttcagcgccatcagcctggcctgcaccaagctgaccgaggacaacaagaagctggagatcgacatcaacaagatcaccgtgaagaccaacgagagcatcagaaagaagagcaagtacgagagcgagatcaagtacctgaccatcatgaagctgaagaacgacaagcacctgaagaacatctacaaggaggcctacagaatcggcaccctgttccacctgaccaagcacaagaccgacgagatggaggacaagatcgccgaggtgagaagaaagttcaagggcagagaggagttcctgaagaagctgacccagggcgaggtggccgccggcatggtgctgcagaagaagctgtacagcatctacgaggtgcaggccctggagagaaaggagctgatcaagaacagagccatctgcgccatgagcctggccgagctgcaggagcccctgctgcagctggaggacgaggccgagagaatcagaagcctggacaaggagcacagcgtgatgctgaacaacatcatcgaccagaaggacctgatcagaagaaaggtgggcaaggtgaagaagaagctgagaaagaagggcaagaagaccctggacgccctgatcgagaccgagagcaagagaagcgccatcttcaaggacctggaggccaccaagagcaagaccatgatcttctacgccaagatcaacgagctgaacgaggagctgaaggccaaggaggaggagaagaagagcttcgaccagaccctggagatcctgaagaacaagttcatcaccatgagattcaagagagagcacgcccagaccgtgttcgaccactacatgcaggagaagaaggactgcgaggagagaatcttcgaggaggaccagagattcagagtgctgctggccgtgagacagaagaccctgcaggacacccagctgtgccagctgcagagaagaatgcacaccctgtggcaggagcacttcaagctggtggtgctgttcagccagatgagactggccaacttccagaccgacagccaggagagcatccagaagatcctggccgtgcaggaggagagcagcaacctgatgcagcacatcctgggcttcttccagaccctgaccgacggcacctgcgagaacgacggctag

SEQ ID NO: 19017 - DNA, 2604 bp, Artificial Sequence; identical to SEQ ID NO: 19014
  Description of Artificial Sequence: Synthetic coding sequence

SEQ ID NO: 19018 - DNA, 2676 bp, Artificial Sequence
  Description of Artificial Sequence: Synthetic coding sequence
atgaccgagaacaagaccgtgagcagcagcagcaccagagacgaccagaccaacatcggcctgacctgccaggaggtgaaggccctgagagagaaggcctggagcagaaccaacgagggcaacgccatgagccagagcctggtgctgtacggcgccagcaaggagaacagcgagggcttccacgagagcaagatgaccaacaccgagggcgtgaacaagggcatctacttcagctacccctgcagaagacacagctgcgccgtggtgaacatccccgccccctgcgtgaacaagatgatcagccacatccaggacgtggagagcaagatccaggagcacctgaagagattcgagaccagcttcgaggagtggagcagaaccagcagcaccaaggacctgaaggaggactggagcgtgaccacccccgtgaaggaggtgaagcccggcgagaagagagacgagaagtgccccgagctgaagcaggagatggagaccctgctgagcgaggccatcagactgatcaagagcctggagaccgacagagccgacgccgaggaggccctgaagcagcagagaagcagaaagaacatgatcaacatgaagatcgacagctggagcgtgtggaagctgcaggagctgcccctggccgtgcagaaggagcacgaggcctacctgagcgacgtgatcgagctgcagtggcacctggaggacaaggccaaccagctgcagcacttcgagaagcagaagaccgagctggaggaggccaacgccaagatccaggccgacatcgactacatgaacgagcacggccccctgctggacagcaagcagaaccaggagctgcaggacctgaagaaccactacaagaagaagatggaggtgatggacctgcacagaaaggtgaacgaggagctggaggaggccctggaggcctgcgagaacgccagactgaaggcccagcagatcaaggaggagatcgacaaggacatctaccaggacgagaagaccatcgaggcctacaagagagagatctaccagctgaacagcctgttcgaccactacagcagcagcgtgatcaacgtgaacaccaacatcgaggagaaggaggaggaggtgaccgaggccatcagagagaccaagagcagcaagaacgagctgcacagcctgagcaagatgctggaggacctgagaagagtgtacgaccagctgacctggaagcagaagagccacgagaaccagtacctggaggccgtgaacgacttctacgccgccaagaagacctgggacatcgagctgagcgacgtggccaaggacttcagcgccatcagcctggcctgcaccaagctgaccgaggacaacaagaagctggagatcgacatcaacaagatcaccgtgaagaccaacgagagcatcagaaagaagagcaagtacgagagcgagatcaagtacctgaccatcatgaagctgaagaacgacaagcacctgaagaacatctacaaggaggcctacagaatcggcaccctgttccacctgaccaagcacaagaccgacgagatggaggacaagatcgccgaggtgagaagaaagttcaagggcagagaggagttcctgaagaagctgacccagggcgaggtggccgccggcatggtgctgcagaagaagctgtacagcatctacgaggtgcaggccctggagagaaaggagctgatcaagaacagagccatctgcgccatgagcctggccgagctgcaggagcccctgctgcagctggaggacgaggccgagagaatcagaagcctggacaaggagcacagcgtgatgctgaacaacatcatcgaccagaaggacctgatcagaagaaaggtgggcaaggtgaagaagaagctgagaaagaagggcaagaagaccctggacgccctgatcgagaccgagagcaagagaagcgccatcttcaaggacctggaggccaccaagagcaagaccatgatcttctacgccaagatcaacgagctgaacgaggagctgaaggccaaggaggaggagaagaagagcttcgaccagaccctggagatcctgaagaacaagttcatcaccatgagattcaagagagagcacgcccagaccgtgttcgaccactacatgcaggagaagaaggactgcgaggagagaatcttcgaggaggaccagagattcagagtgctgctggccgtgagacagaagaccctgcaggacacccagaagatcatcgccgacagcctggaggagaacctgagactggcccaggagtaccagcagctgcagatcaccttcctgaaggagaaggacaactacttcaacatctacgacaagcagctgagcctggacaccagcatcagagacaagaagcaggtggccggcttcctgcccaagaagctgcccaacagcctgcccatcatcagcgacgagctgagcaacttccagctgtgccagctgcagagaagaatgcacaccctgtggcaggagcacttcaagctggtggtgctgttcagccagatgagactggccaacttccagaccgacagccaggagagcatccagaagatcctggccgtgcaggaggagagcagcaacctgatgcagcacatcctgggcttcttccagaccctgaccgacggcacctgcgagaacgacggctag

SEQ ID NO: 19019 - DNA, 210 bp, Artificial Sequence
  Description of Artificial Sequence: Synthetic coding sequence
atggtgttcgcccccggcgagaagcccggcaacgagcccgaggaggtgaagctgcagaacgccagcaagcagatcgtgcagaacgccatcctgcaggccgtgcagcaggtgagccaggagagccagagaagagaggagagaatcagcgacaacagagaccacatccagctgggcgtgggcgagctgaccaagaagcacgagaagaagtag

SEQ ID NO: 19020 - DNA, 372 bp, Artificial Sequence
  Description of Artificial Sequence: Synthetic coding sequence
atgacccccgccagcggcgccaccgccagcctgggcagactgagagccagacccagaagcagatgggacgccgcctacctgcccgccgtggccgccgtgtgcgtggccagagccagccacgtgcccaacggcaccctgagattcggcgtgtgcaaggccagaagaaccatgagacccctgcccagaagaatcgaggtgagaaccaagagaggcccccagagacccgccgcccccgagagaagcccccagcccagactgccccccagcagacaccccagcagaagaggccccagaagacacctgagcggctgcagcgcccccgcctgcagaatccccaccggctgcagatgcccctgcggcagacccagctag

SEQ ID NO: 19021 - DNA, 2058 bp, Artificial Sequence
  Description of Artificial Sequence: Synthetic coding sequence
atgaacgacagcagacagcagagcctgttcttcatcaccctgcccgacctgaacaagctgtgcgccgtgagaatcatcctgagcaacaaggtggccgacaccgagatcagaaccatccagatgaagatgtgcagacagctgctgttcctgcaccaggacatcctgaccagccccgtgagcggcatcctgaaccagatctgggtggtgatggccatccccttctacaaggccagaaagctgaacgcctacgtggagaagtacggcgccaagatggaggccccccagagagtgatccccgtgatcctgcagaactgcctgagctacagcttcatggccagactggcccccgcctggaacagaaccggccacctgctgatccagggcagagacttcctgagccagatgggcaagcagagcgccgtggtgctgaacatcaacgtgaccgagacccaggtgtgcctgagcatcgaggcctgcaccatcagactgcccgcccccgagctgaaggagttcgagatcagccagagcatcatcaaggacttccacgccaacaagcacgccgtgatcgagagacacagcatcctgagcaactggtgctacgtgctgcccagcatgaagatgggccagatcatcaacatcttccacgccatccccgccgcctgccccttccacagctacggcgacttccagagacactgggacgccctgtacggctacaagctgcccggcgactgcggcaagatcaagatctactgcaacatctacttcaagatgctgggcgagagaaccttcacctaccccctgagctgcatcagaagccagcccatgcagttcttccccagagtggacagcgaggtggtgctgaagagcttcctgagcgacctgaagagcaagctgccccacatctgcggcttccccatcaagatgaccagcaagccctgctactacacccaggagctgaccaagcccaacatccaggagcacaaggtgaagccccccaacctgaccaccaagaagatgctgagagccagcctgacccaggccaccagcagaaagcccgcctgcgcccagagcctgctgccctgcagcgtggccgtggaccacaaggtggagctgagcgtgagccagcccaccagcggcatcttcagcgccctgcacctgcagcccgagagcgtgcagggcagaaagaagagcctgagcatcagagccccccaggtgcacagcgaggtgctgatgcccaacagaggcaacacccaggtgcagcacaccaacctgagcagccagagcaacatcacccccaagttcgtgcccgtgttcaagaacagactgctgcagatgaacaagaacaccagcgtgctgggcagccccaagagaaagcagcacgacgtgacccagagcaagctgttcagcctgaagaccagcatgatccagcacgacaagctgaacctgggccccgccatcaagaacagatacagcagcaacatccagatgcaggccgccaacaacctgaaccaggagaacagcagacccctgcaggagaagaacaccgagagcagcgagaacatgaccaagttccccagcagcagaggcaagagcaccgtgagcctgaacaagaacaagcagctgagcaacagcgccgtgttcgtggtgagcaacaacaacctgggcgtggtgaagagcgccgtggacttccagatgaagggcaaggagaacctgaccggcaagggcatcacccagatcctgggcaagagccacggcagcctgaagctgaagagacagccccacatcttcgagagcgacggcgagaccgaggaccccagactgctgcagcagcagagcgagaaccaggccaaggaggtgggcaccagcgaccacagactgatcgtgagcaagatcgcccacagaagcaagagaaagctgtgccccgagagcagcaagaccagcaagaagcaccacagcgacaccgtgcactacggccagagcagcagcagcaagaagcagatcctggacagcgacaagagcaagctgaagaagagcctgatcatccacaacgcctag

SEQ ID NO: 19022 - DNA, 1974 bp, Artificial Sequence
  Description of Artificial Sequence: Synthetic coding sequence
atgggcgaggaggactactacctggagctgtgcgagagacccgtgcagttcgagaaggccaaccccgtgaactgcgtgttcttcgacgaggccaacaagcaggtgttcgccgtgagaagcggcggcgccaccggcgtggtggtgaagggccccgacgacagaaaccccatcagcttcagaatggacgacaagggcgaggtgaagtgcatcaagttcagcctggagaacaagatcctggccgtgcagagaaccagcaagaccgtggacttctgcaacttcatccccgacaacagccagctggagtacacccaggagtgcaagaccaagaacgccaacatcctgggcttctgctggaccagcagcaccgagatcgtgttcatcaccgaccagggcatcgagttctaccaggtgctgcccgagaagagaagcctgaagctgctgaagagccacaacctgaacgtgaactggtacatgtactgccccgagagcgccgtgatcctgctgagcaccaccgtgctggagaacgtgctgcagcccttccacttcagagccggcaccatgagcaagctgcccaagttcgagatcgagctgcccgccgcccccaagagcaccaagcccagcctgagcgagagagacatcgccatggccaccatctacggccagctgtacgtgctgttcctgagacaccacagcagaaccagcaacagcaccggcgccgaggtggtgctgtaccacctgcccagagagggcgcctgcaagaagatgcacatcctgaagctgaacagaaccggcaagttcgccctgaacgtggtggacaacctggtggtggtgcaccaccaggacaccgagaccagcgtgatcttcgacatcaagctgagaggcgagttcgacggcagcgtgaccttccaccaccccgtgctgcccgccagaagcatccagccctaccagatccccatcaccggccccgccgccgtgaccagccagagccccgtgccctgcaagctgtacagcagcagctggatcgtgttccagcccgacatcatcatcagcgccagccagggctacctgtggaacctgcaggtgaagctggagcccatcgtgaacctgctgcccgacaagggcagactgatggacttcctgctgcagagaaaggagtgcaagatggtgatcctgagcgtgtgcagccagatgctgagcgagagcgacagagccagcctgcccgtgatcgccaccgtgttcgacaagctgaaccacgagtacaagaagtacctggacgccgagcagagctacgccatggccgtggaggccggccagagcagaagcagccccctgctgaagagacccgtgagaacccaggccgtgctggaccagagcgacgtgtacacccacgtgctgagcgccttcgtggagaagaaggagatgccccacaagttcgtgatcgccgtgctgatggagtacatcagaagcctgaaccagttccagatcgccgtgcagcactacctgcacgagctggtgatcaagaccctggtgcagcacaacctgttctacatgctgcaccagttcctgcagtaccacgtgctgagcgacagcaagcccctggcctgcctgctgctgagcctggagagcttctacccccccgcccaccagctgagcctggacatgctgaagagactgagcaccgccaacgacgagatcgtggaggtgctgctgagcaagcaccaggtgctggccgccctgagattcatcagaggcatcggcggccacgacaacatcagcgccagaaagttcctggacgccgccaagcagaccgaggacaacatgctgttctacaccatcttcagattcttcgagcagagaaaccagagactgagaggcagccccaacttcacccccggcgagcactgcgaggagcacgtggccttcttcaagcagatcttcggcgaccaggccctgatgagacccaccaccttctag

SEQ ID NO: 19023 - DNA, 1830 bp, Artificial Sequence
  Description of Artificial Sequence: Synthetic coding sequence
atgggcgaggaggactactacctggagctgtgcgagagacccgtgcagttcgagaaggccaaccccgtgaactgcgtgttcttcgacgaggccaacaagcaggtgttcgccgtgagaagcggcggcgccaccggcgtggtggtgaagggccccgacgacagaaaccccatcagcttcagaatggacgacaagggcgaggtgaagtgcatcaagttcagcctggagaacaagatcctggccgtgcagagaaccagcaagaccgtggtgctgcccgagaagagaagcctgaagctgctgaagagccacaacctgaacgtgaactggtacatgtactgccccgagagcgccgtgatcctgctgagcaccaccgtgctggagaacgtgctgcagcccttccacttcagagccggcaccatgagcaagctgcccaagttcgagatcgagctgcccgccgcccccaagagcaccaagcccagcctgagcgagagagacatcgccatggccaccatctacggccagctgtacgtgctgttcctgagacaccacagcagaaccagcaacagcaccggcgccgaggtggtgctgtaccacctgcccagagagggcgcctgcaagaagatgcacatcctgaagctgaacagaaccggcaagttcgccctgaacgtggtggacaacctggtggtggtgcaccaccaggacaccgagaccagcgtgatcttcgacatcaagctgagaggcgagttcgacggcagcgtgaccttccaccaccccgtgctgcccgccagaagcatccagccctaccagatccccatcaccggccccgccgccgtgaccagccagagccccgtgccctgcaagctgtacagcagcagctggatcgtgttccagcccgacatcatcatcagcgccagccagggctacctgtggaacctgcaggtgaagctggagcccatcgtgaacctgctgcccgacaagggcagactgatggacttcctgctgcagagaaaggagtgcaagatggtgatcctgagcgtgtgcagccagatgctgagcgagagcgacagagccagcctgcccgtgatcgccaccgtgttcgacaagctgaaccacgagtacaagaagtacctggacgccgagcagagctacgccatggccgtggaggccggccagagcagaagcagccccctgctgaagagacccgtgagaacccaggccgtgctggaccagagcgacgtgtacacccacgtgctgagcgccttcgtggagaagaaggagatgccccacaagttcgtgatcgccgtgctgatggagtacatcagaagcctgaaccagttccagatcgccgtgcagcactacctgcacgagctggtgatcaagaccctggtgcagcacaacctgttctacatgctgcaccagttcctgcagtaccacgtgctgagcgacagcaagcccctggcctgcctgctgctgagcctggagagcttctacccccccgcccaccagctgagcctggacatgctgaagagactgagcaccgccaacgacgagatcgtggaggtgctgctgagcaagcaccaggtgctggccgccctgagattcatcagaggcatcggcggccacgacaacatcagcgccagaaagttcctggacgccgccaagcagaccgaggacaacatgctgttctacaccatcttcagattcttcgagcagagaaaccagagactgagaggcagccccaacttcacccccggcgagcactgcgaggagcacgtggccttcttcaagcagatcttcggcgaccaggccctgatgagacccaccaccttctag

SEQ ID NO: 19024 - DNA, 1503 bp, Artificial Sequence
  Description of Artificial Sequence: Synthetic coding sequence
atgtactgccccgagagcgccgtgatcctgctgagcaccaccgtgctggagaacgtgctgcagcccttccacttcagagccggcaccatgagcaagctgcccaagttcgagatcgagctgcccgccgcccccaagagcaccaagcccagcctgagcgagagagacatcgccatggccaccatctacggccagctgtacgtgctgttcctgagacaccacagcagaaccagcaacagcaccggcgccgaggtggtgctgtaccacctgcccagagagggcgcctgcaagaagatgcacatcctgaagctgaacagaaccggcaagttcgccctgaacgtggtggacaacctggtggtggtgcaccaccaggacaccgagaccagcgtgatcttcgacatcaagctgagaggcgagttcgacggcagcgtgaccttccaccaccccgtgctgcccgccagaagcatccagccctaccagatccccatcaccggccccgccgccgtgaccagccagagccccgtgccctgcaagctgtacagcagcagctggatcgtgttccagcccgacatcatcatcagcgccagccagggctacctgtggaacctgcaggtgaagctggagcccatcgtgaacctgctgcccgacaagggcagactgatggacttcctgctgcagagaaaggagtgcaagatggtgatcctgagcgtgtgcagccagatgctgagcgagagcgacagagccagcctgcccgtgatcgccaccgtgttcgacaagctgaaccacgagtacaagaagtacctggacgccgagcagagctacgccatggccgtggaggccggccagagcagaagcagccccctgctgaagagacccgtgagaacccaggccgtgctggaccagagcgacgtgtacacccacgtgctgagcgccttcgtggagaagaaggagatgccccacaagttcgtgatcgccgtgctgatggagtacatcagaagcctgaaccagttccagatcgccgtgcagcactacctgcacgagctggtgatcaagaccctggtgcagcacaacctgttctacatgctgcaccagttcctgcagtaccacgtgctgagcgacagcaagcccctggcctgcctgctgctgagcctggagagcttctacccccccgcccaccagctgagcctggacatgctgaagagactgagcaccgccaacgacgagatcgtggaggtgctgctgagcaagcaccaggtgctggccgccctgagattcatcagaggcatcggcggccacgacaacatcagcgccagaaagttcctggacgccgccaagcagaccgaggacaacatgctgttctacaccatcttcagattcttcgagcagagaaaccagagactgagaggcagccccaacttcacccccggcgagcactgcgaggagcacgtggccttcttcaagcagatcttcggcgaccaggccctgatgagacccaccaccttctag

SEQ ID NO: 19025 - DNA, 1359 bp, Artificial Sequence
  Description of Artificial Sequence: Synthetic coding sequence
atgtactgccccgagagcgccgtgatcctgctgagcaccaccgtgctggagaacgtgctgcagcccttccacttcagagccggcaccatgagcaagctgcccaagttcgagatcgagctgcccgccgcccccaagagcaccaagcccagcctgagcgagagagacatcgccatggccaccatctacggccagctgtacgtgctgttcctgagacaccacagcagaaccagcaacagcaccggcgccgaggtggtgctgtaccacctgcccagagagggcgcctgcaagaagatgcacatcctgaagctgaacagaaccggcaagttcgccctgaacgtggtggacaacctggtggtggtgcaccaccaggacaccgagaccagcgtgatcttcgacatcaagctgagaggcgagttcgacggcagcgtgaccttccaccaccccgtgctgcccgccagaagcatccagccctaccagatccccatcaccggccccgccgccgtgaccagccagagccccgtgccctgcaagctgtacagcagcagctggatcgtgttccagcccgacatcatcatcagcgccagccagggctacctgtggaacctgcaggtgaagctggagcccatcgtgaacctgctgcccgacaagggcagactgatggacttcctgctgcagagaaaggagtgcaagatggtgatcctgagcgtgtgcagccagatgctgagcgagagcgacagagccagcctgcccgtgatcgccaccgtgttcgacaagctgaaccacgagtacaagaagtacctggacgccgagcagagctacgccatggccgtggaggccggccagagcagaagcagccccctgctgaagagacccgtgagaacccaggccgtgctggaccagagcgacgtgtacacccacgtgctgagcgccttcgtggagaagaaggagatgccccacaagttcgtgatcgccgtgctgatggagtacatcagaagcctgaaccagttccagatcgccgtgcagcactacctgcacgagctggtgatcaagaccctggtgcagcacaacctgttctacatgctgcaccagttcctgcagtaccacgtgctgagcgacagcaagcccctggcctgcctgctgctgagcctggagagcttctacccccccgcccaccagctgagcctggacatgctgaagatgctgcagagcagactgaagaccacctgcttcagcatccagtacagcgccttcctgaacagcgagaccagcgtgtgcgagggcgcccccatcagccaccagggcaacaccgtgaagaacatgctgctgttcagcaacagattcctggagaccaagctgtag

SEQ ID NO: 19026 - DNA, 711 bp, Artificial Sequence
  Description of Artificial Sequence: Synthetic coding sequence
atggccagacccctggtgcccagcagccagaaggccctgctgctggagctgaagggcctgcaggaggagcccgtggagggcttcagagtgaccctggtggacgagggcgacctgtacaactgggaggtggccatcttcggcccccccaacacctactacgagggcggctacttcaaggccagactgaagttccccatcgactacccctacagcccccccgccttcagattcctgaccaagatgtggcaccccaacatctacgagaccggcgacgtgtgcatcagcatcctgcacccccccgtggacgacccccagagcggcgagctgcccagcgagagatggaaccccacccagaacgtgagaaccatcctgctgagcgtgatcagcctgctgaacgagcccaacaccttcagccccgccaacgtggacgccagcgtgatgtacagaaagtggaaggagagcaagggcaaggacagagagtacaccgacatcatcagaaagcaggtgctgggcaccaaggtggacgccgagagagacggcgtgaaggtgcccaccaccctggccgagtactgcgtgaagaccaaggcccccgcccccgacgagggcagcgacctgttctacgacgactactacgaggacggcgaggtggaggaggaggccgacagctgcttcggcgacgacgaggacgacagcggcaccgaggagagctag

SEQ ID NO: 19027 - DNA, 486 bp, Artificial Sequence
  Description of Artificial Sequence: Synthetic coding sequence
atgggcagcaaggccaagaagagagtgctgctgcccaccagacccgccccccccaccgtggagcagatcctggaggacgtgagaggcgcccccgccgaggaccccgtgttcaccatcctggcccccgaggacccccccgtgcccttcagaatgatggaggacgccgaggcccccggcgagcagctgtaccagcagagcagagcctacgtggccgccaaccagagactgcagcaggccggcaacgtgcccagactgcccccccaggccgacctgagcggccccgccggcctgggcagcgcccagggcggcctgcaccccggcttcccctggggcagcgtgggccccagactggccttcaccggcagccagcccacctgggtgctgacccaggcccccctgctgatgctgggcctgagattcatcagaagactgatccacgccgagctggtgggccccacccagctggcccccagctgcgtgacctag

SEQ ID NO: 19028 - DNA, 477 bp, Artificial Sequence
  Description of Artificial Sequence: Synthetic coding sequence
atgggcagcaaggccaagaagagagtgctgctgcccaccagacccgccccccccaccgtggagcagatcctggaggacgtgagaggcgcccccgccgaggaccccgtgttcaccatcctggcccccgagggcagaggcagccccgtgcccggcaagagcggccccgagacccccgccgccagaggcagagagagaagcacccccctgacccccgaccccaccccctgggagcccccccagcacggccacgacccccccgtgcccttcagaatgatggaggacgccgaggcccccggcgagcagctgtaccagcagagcagagcctacgtggccgccaaccagagactgcagcaggccggcaacgtgctgagacagagatgcgagctgctgcagagagccggcgaggacctggagagagaggtggcccagatgaagcaggccgccctgcccgccgccgaggccgccagcagcggctag

SEQ ID NO: 19029 - DNA, 357 bp, Artificial Sequence
  Description of Artificial Sequence: Synthetic coding sequence
atgggcagcaaggccaagaagagagtgctgctgcccaccagacccgccccccccaccgtggagcagatcctggaggacgtgagaggcgcccccgccgaggaccccgtgttcaccatcctggcccccgaggacccccccgtgcccttcagaatgatggaggacgccgaggcccccggcgagcagctgtaccagcagagcagagcctacgtggccgccaaccagagactgcagcaggccggcaacgtgctgagacagagatgcgagctgctgcagagagccggcgaggacctggagagagaggtggcccagatgaagcaggccgccctgcccgccgccgaggccgccagcagcggctag

SEQ ID NO: 19030 - DNA, 507 bp, Artificial Sequence
  Description of Artificial Sequence: Synthetic coding sequence
atgctgcccgccgccctgctgagaagacccggcctgggcagactggtgagacacgccagagcctacgccgaggccgccgccgcccccgccgccgccagcggccccaaccagatgagcttcaccttcgccagccccacccaggtgttcttcaacggcgccaacgtgagacaggtggacgtgcccaccctgaccggcgccttcggcatcctggccgcccacgtgcccaccctgcaggtgctgagacccggcctggtggtggtgcacgccgaggacggcaccaccagcaagtacttcgtgagcagcggcagcatcgccgtgaacgccgacagcagcgtgcagctgctggccgaggaggccgtgaccctggacatgctggacctgggcgccgccaaggccaacctggagaaggcccaggccgagctggtgggcaccgccgacgaggccaccagagccgagatccagatcagaatcgaggccaacgaggccctggtgaaggccctggagtag

SEQ ID NO: 19031 - DNA, 1422 bp, Artificial Sequence
  Description of Artificial Sequence: Synthetic coding sequence
atgagcagccccgagccccccaccgagccccccgagcccgacaaccccacctggagcacccagcccacctacagcaacctgggccagatcagagcccacctgctgcccagcaaggcctgcagactgagaacccccggcagcctgagcaccaaccccgagcccctgcccccccccctgcccaagaagatcctgaccagaacccagagcctgcccaccagaagaaccctgcaccccagcagcatccaggtgcagccccccagaagacccttcctgggcagccacagcgtggacaagagccaggccgccgtgggccccgcctgcctgcccgccgagctgaccttcggccccgccgacgcccccctgggcctgagcctgagagacctgcacagccccgaggccgtgcacaccgccctggccgccagacagctgcagggcctgagaaccatctacgccagactgagagccagactgatgggcggccaccccggcccctgccaccccggccacagcttcagactgctggacagcagcccctgcgccgagagcggcgacgccctgtactacagagtggtgagagcccacgaggacgcctggcacatcctggtggccaaggtgcccaagcccggcgccgacgtgccccacccctggggcctggagctgcaggccagcctgagcccccacttcaacctgcagggcctgtgcggcctggtgcccgagggcaccctgcccggcgccccctggagaggcgccgtggccctggccgccgaggtgcccgagagaaccgtggcccagtggctggccgaggcctgcacccagccccccgaggagttcgtgtgggccgtggccctgctgctgctgcagctgagcgccgccctgaagttcctggaggcctggggcgccgccctggtggagctgagacccgagaacctgctgctggtggcccccagaggctgcgccaccaccggcccccccagactgctgctgaccgacttcggcagagtgtgcctgcagccccccggcccccccggcagccccggcccccacgccccccagctgggcagcctgctgagagccctgctgagcctggccgcccccagcaccacccccctggccgccggcctggagctgctggccgcccagctgaccagactgagacccagcgccagcagaaccagaggcgccctgcaggccctgctgtggggccccggccccgagctgagaggcagaggcgcccccctgggcccctggctgagagccctgggcccctggctgagagtgagaagaggcctgctggtgctgagactggccgagagagccgccggcggcgaggcccccagcctggaggactggctgtgctgcgagtacctggccgaggccaccgagagcagcatgggccaggccctggccctgctgtgggactag

SEQ ID NO: 19032 - DNA, 228 bp, Artificial Sequence
  Description of Artificial Sequence: Synthetic coding sequence
atgatcggcgacatcctgctgttcggcaccctgctgatgaacgccggcgccgtgctgaacttcaagctgaagaagaaggacacccagggcttcggcgaggagagcagagagcccagcaccggcgacaacatcagagagttcctgctgagcctgagatacttcagaatcttcatcgccctgtggaacatcttcatgatgttctgcatgatcgtgctgttcggcagctag

SEQ ID NO: 19033 - DNA, 531 bp, Artificial Sequence
  Description of Artificial Sequence: Synthetic coding sequence
atggccgccagaggcagaagagccgagccccagggcagagaggcccccggccccgccggcggcggcggcggcggcagcagatgggccgagagcggcagcggcaccagccccgagagcggcgacgaggaggtgagcggcgccggcagcagccccgtgagcggcggcgtgaacctgttcgccaacgacggcagcttcctggagctgttcaagagaaagatggaggaggagcagagacagagacaggaggagcccccccccggcccccagagacccgaccagagcgccgccgccgccggccccggcgaccccaagagaaagggcggccccggcagcaccctgagcttcgtgggcaagagaagaggcggcaacaagctggccctgaagaccggcatcgtggccaagaagcagaagaccgaggacgaggtgctgaccagcaagggcgacgcctgggccaagtacatggccgaggtgaagaagtacaaggcccaccagtgcggcgacgacgacaagaccagacccctggtgaagtag

SEQ ID NO: 19034 - DNA, 1518 bp, Artificial Sequence
  Description of Artificial Sequence: Synthetic coding sequence
atggccaccggcgccctgctgccctgcagcagaccctgccccatgagcagactggacttcctgaaggccagccacttcagcctgggccccgacctgagactgcacgagggcaccatgagaaccaccagccacagagacttcgcctaccccgccgccaccagagagccccccagcctgcagcccccccccgccctgctgttccccatggaccccagatgggacagagaggagagagtgagcgaggcccacagagccttccccccccccagcacccccccctgggagctgctgcaggcccaggccagagagagaaccctggccatgcaggccggcaacctgcacctgcacgaggacgcccacgccggcatcggcctgagcaacgcccacgccgcctacggctggcccgagctgcccgccagaaccagagagagaatcagaggcgccagactgatcttcgacagagacagcctgccccccggcgacagagacaagctgagaatcccccccaccacccaccaggccctgttccccccccacgacgccagaccccagcccagagcccccagctgccacctgggcggccccaacaccctgaagtgggactacaccagacaggacggcaccagctaccagagacagttccaggccctgcccggcccccccgccctgagatgcaagagagccagcagcggcgtggagctgggcgactgcaagatcagctacggcagcacctgcagcgagcagaagcaggcctacagaccccaggacctgcccgaggacagatacgacaaggcccaggccaccgcccacatccactgcgtgaacatcagacccggcgacggcctgttcagagacagaaccaccaaggccgagcacttctacgccagagagcccgagcccttcgtgctgcaccacgaccagacccccgagagccacatcctgaagggcaactggtgccccggccccggcagcctggacaccttcatgcagtacttctacggccagccccccccccccacccagccccccagcagacacgtgccccacgagaagctgcagagccacgtgaccctgggcgagcccaagctgctgaagagattcttcaagaccaccatgggcagcgactactgccccagcgagtggagacaggtgcagaaggcccccaacctgcacctgcagcagagctacctgcccagaggcaccggcgagttcgacttcctgaccatgaaccagaagatgctgaagccccacagaaccccccccgcccccgtgaccgaggagatgctgcagagatgcaagtacagccacatggagccccccctgggcggcctgagattcttcagcacccagtacaaggacgagttccccttcaagtaccagggccccgccgccctgagactgaagaacccccaggagggcttcgtgcccctgggcaccccccaccagagaggctgcagagagaagatcgaccccctggtgccccagccccccatgtacctgtgccccagccagcagtag

SEQ ID NO: 19035 - DNA, 672 bp, Artificial Sequence
  Description of Artificial Sequence: Synthetic coding sequence
atggccaccggcgccctgctgccctgcagcagaccctgccccatgagcagactggacttcctgaaggccagccacttcagcctgggccccgacctgagactgcacgagggcaccatgagaaccaccagccacagagacttcgcctaccccgccgccaccagagagccccccagcctgcagcccccccccgccctgctgttccccatggaccccagatgggacagagaggagagagtgagcgaggcccacagagccttccccccccccagcacccccccctgggagctgctgcaggcccaggccagagagagaaccctggccatgcaggccggcaacctgcacctgcacgaggacgcccacgccggcatcggcctgagcaacgcccacgccgcctacggctggcccgagctgcccgccagaaccagagagagaatcagaggcgccagactgatcttcgacagagacagcctgccccccggcgacagagacaagctgagaatcccccccaccacccaccaggccctgttccccccccacgacgccagaccccagcccagagcccccagctgccacctgggcggccccaacaccctgaagtgggactacaccagacaggacggcaccagctaccagagacagttccaggccctgcccggcccccccgccctgtag

SEQ ID NO: 19036 - DNA, 579 bp, Artificial Sequence
  Description of Artificial Sequence: Synthetic coding sequence
atggccaccggcgccctgctgccctgcagcagaccctgccccatgagcagactggacttcctgaaggccagccacttcagcctgggccccgacctgagactgcacgagggcaccatgagaaccaccagccacagagacttcgcctaccccgccgccaccagagagccccccagcctgcagcccccccccgccctgctgttccccatggaccccagatgggacagagaggagagagtgagcgaggcccacagagccttccccccccccagcacccccccctgggagctgctgcaggcccaggccagagagagaaccctggccatgcaggccggcaacctgcacctgcacgaggacgcccacgccggcatcggcctgagcaacgcccacgccgcctacggctggcccgagctgcccgccagaaccagagagagaatcagaggcgccagactgatcttcgacagagacagcctgccccccggcgacagagacaagctgagaatcccccccaccacccaccaggccctgttccccccccacgacgccagaccccagcccagagcccccagctgccacctgtag

SEQ ID NO: 19037 - DNA, 1269 bp, Artificial Sequence
  Description of Artificial Sequence: Synthetic coding sequence
atggtgatggccgccctgagcctggtggccgcctgctggggcagagccgccgccgacgagagcgtgcagctgcccgccgcccccggcagcagcgtgagagccagagagaccatggtgagcgtgaccatggccaccagcgagtggatccagttcttcaaggaggccggcatcccccccggccccgccgtgaactacgccgtgatgttcgtggacaacagaatccagaagagcatgctgctggacctgaacaaggagatcatgaacgagctgggcgtgaccgtggtgggcgacatcatcgccatcctgaagcacgccaaggtggtgcacagacaggacatgtgcaaggccgccaccgagagcgtgccctgcagccccagccccctggccggcgagatcagaagaggcaccagcgccgccagcagaatgatcaccaacagcctgaaccacgacagcccccccagcaccccccccagaagacccgacaccagcaccagcaagatcagcgtgaccgtgagcaacaagatggccgccaagagcgccaaggccaccgccgccctggccagaagagaggaggagagcctggccgtgcccgccaagagaagaagagtgaccgccgagatggagggcaagtacgtgatcaacatgcccaagggcaccacccccagaaccagaaagatcctggagcagcagcaggccgccaagggcctgcacagaaccagcgtgttcgacagactgggcgccgagaccaaggccgacaccaccaccggcagcaagcccaccggcgtgttcagcagactgggcgccacccccgagaccgacgaggacctggcctgggacagcgacaacgacagcagcagcagcgtgctgcagtacgccggcgtgctgaagaagctgggcagaggccccgccaaggccagcccccagcccgccctgaccgtgaaggccaaggccaccagcagcgccaccaccgccgccgcccccaccctgagaagactggccctgagcagcagaagcggcctggagagaaagcccgagagcctgagcaaggtgagcatcatcaagagactgggcgccgccgccctggtgcccgaggcccaggacagccaggtgaccagcaccaagagcaagagcagcgccgaggtgaaggtgaccatcaagagaaccctggtgggccccagaggcagcagcagcagcgagggcctgggcgcccagatggaccacgccggcaccgtgagcgtgttcaagagactgggcagaagaaccttctag

SEQ ID NO: 19038 - DNA, 1068 bp, Artificial Sequence
  Description of Artificial Sequence: Synthetic coding sequence
atgttcgtggacaacagaatccagaagagcatgctgctggacctgaacaaggagatcatgaacgagctgggcgtgaccgtggtgggcgacatcatcgccatcctgaagcacgccaaggtggtgcacagacaggacatgtgcaaggccgccaccgagagcgtgccctgcagccccagccccctggccggcgagatcagaagaggcaccagcgccgccagcagaatgatcaccaacagcctgaaccacgacagcccccccagcaccccccccagaagacccgacaccagcaccagcaagatcagcgtgaccgtgagcaacaagatggccgccaagagcgccaaggccaccgccgccctggccagaagagaggaggagagcctggccgtgcccgccaagagaagaagagtgaccgccgagatggagggcaagtacgtgatcaacatgcccaagggcaccacccccagaaccagaaagatcctggagcagcagcaggccgccaagggcctgcacagaaccagcgtgttcgacagactgggcgccgagaccaaggccgacaccaccaccggcagcaagcccaccggcgtgttcagcagactgggcgccacccccgagaccgacgaggacctggcctgggacagcgacaacgacagcagcagcagcgtgctgcagtacgccggcgtgctgaagaagctgggcagaggccccgccaaggccagcccccagcccgccctgaccgtgaaggccaaggccaccagcagcgccaccaccgccgccgcccccaccctgagaagactggccctgagcagcagaagcggcctggagagaaagcccgagagcctgagcaaggtgagcatcatcaagagactgggcgccgccgccctggtgcccgaggcccaggacagccaggtgaccagcaccaagagcaagagcagcgccgaggtgaaggtgaccatcaagagaaccctggtgggccccagaggcagcagcagcagcgagggcctgggcgcccagatggaccacgccggcaccgtgagcgtgttcaagagactgggcagaagaaccttctag

SEQ ID NO: 19039 - DNA, 1269 bp, Artificial Sequence; identical to SEQ ID NO: 19037
  Description of Artificial Sequence: Synthetic coding sequence

SEQ ID NO: 19040 - DNA, 354 bp, Artificial Sequence
  Description of Artificial Sequence: Synthetic coding sequence
atgaccgtgctggaggccgtgctggagatccaggccatcaccggcagcagactgctgagcatggtgcccggccccgccagaccccccggcagctgctgggaccccacccagtgcaccagaacctggctgctgagccacacccccagaagaagatggatcagcggcctgcccagagccagctgcagactgggcgaggagcccccccccctgccctactgcgaccaggcctacggcgaggagctgagcatcagacacagagagacctgggcctggctgagcagaaccgacaccgcctggcccggcgcccccggcgtgaagcaggccagaatcctgggcgagctgctgctggtgtag

SEQ ID NO: 19041 - DNA, 354 bp, Artificial Sequence; identical to SEQ ID NO: 19040
  Description of Artificial Sequence: Synthetic coding sequence

SEQ ID NO: 19042 - DNA, 1827 bp, Artificial Sequence
  Description of Artificial Sequence: Synthetic coding sequence
atgctgcccctgctggacagcagcaagagagccggcaccctgggcagcggctgcggcgtgcccagagtgcacagcgccgccctgagcagagaggagggcgccagcagagacatctggagaatcaaggtgtgggccagagtgatgaccacccccgccggcagcggcagcggcttcggcagcgtgagctggtggggcctgagccccgccctggacctgcaggccgagagagacgccaccgtggacgccctgcccaccaccatggtgccccagcccgccgtgatcctgcccggcccccccgtggaccccgacagccaggccgacaccgtgcacagcaaccccgagctggacgtgctgctgctgggcagcgtggacggcagacacctgctgagaaccctgagcagagccaagttctggcccagaagaagattcaacttcttcgtgctggagaacaacctggaggccgtggccagacacatgctgatcttcagcctggccctggaggagcccgagaagatgggcctgcaggagagaagcgagaccttcctggaggtgtggggcaacgccctgctgagaccccccgtggccgccttcgtgagagcccaggccgacctgctggcccacctggtgcccgagcccgacagactggaggagcagctgccctggctgagcctgagagccctgaagttcagagagagagacgccctggaggccgtgttcagattctgggccggcggcgagaagggcccccaggccttccccatgagcagactgtgggacagcagactgagacactacctgggcagcagatacgacgccagaagaggcgtgagcgactgggacctgagaatgaagctgcacgacagaggcgcccaggtgatccacccccaggagttcagaagatggagagacaccggcgtggccttcgagctgagagacagcagcgcctaccacgtgcccaacagaaccctggccagcggcagactgctgagctacagaggcgagagagtggccgccagaggctactggggcgacatcgccaccggccccttcgtggccttcggcatcgaggccgacgacgagagcctgctgagaaccagcaacggccagcccgtgaagaccgccggcgagatcacccagcacaacgtgaccgagctgctgagagacgtggccgcctggggcagagccagagccaccggcggcgacctggaggagcagcagcacgccgagggcagccccgagcccggcacccccgcccccacccccgagagcttcaccgtgcacttcctgcccctggacagcgcccagaccctgcaccacaagagctgctacaacggcagattccagctgctgtacgtggcctgcggcatggtgcacctgctgatccccgagctgggcgcctgcgtggcccccggcggcaacctgatcgtggagctggccagatacctggtggacgtgagacaggagcagctgcagggcttcaacaccagagtgagagagctggcccaggccgccggcttcgccccccagaccggcgccagacccagcgagaccttcgccagattctgcaagagccaggagagcgccctgggcaacaccgtgcccgccgtggagcccggcaccccccccctggacatcctggcccagcccctggaggccagcaaccccgccctggagggcctgacccagcccctgcagggcggcaccccccactgcgagccctgccagctgcccagcgagagccccggcagcctgagcgaggtgctggcccagccccagggcgccctggccccccccaactgcgagagcgacagcaagaccggcgtgtag

SEQ ID NO: 19043 - DNA, 1767 bp, Artificial Sequence
  Description of Artificial Sequence: Synthetic coding sequence
atgctgcccctgctggacagcagcaagagagccggcaccctgggcagcggctgcggcgtgcccagagtgcacagcgccgccctgagcagagaggagggcgccagcagagacatctggagaatcaaggtgtgggccagagtgatgaccacccccgccggcagcggcagcggcttcggcagcgtgagctggtggggcctgagccccgccctggacctgcaggccgagagcccccccgtggaccccgacagccaggccgacaccgtgcacagcaaccccgagctggacgtgctgctgctgggcagcgtggacggcagacacctgctgagaaccctgagcagagccaagttctggcccagaagaagattcaacttcttcgtgctggagaacaacctggaggccgtggccagacacatgctgatcttcagcctggccctggaggagcccgagaagatgggcctgcaggagagaagcgagaccttcctggaggtgtggggcaacgccctgctgagaccccccgtggccgccttcgtgagagcccaggccgacctgctggcccacctggtgcccgagcccgacagactggaggagcagctgccctggctgagcctgagagccctgaagttcagagagagagacgccctggaggccgtgttcagattctgggccggcggcgagaagggcccccaggccttccccatgagcagactgtgggacagcagactgagacactacctgggcagcagatacgacgccagaagaggcgtgagcgactgggacctgagaatgaagctgcacgacagaggcgcccaggtgatccacccccaggagttcagaagatggagagacaccggcgtggccttcgagctgagagacagcagcgcctaccacgtgcccaacagaaccctggccagcggcagactgctgagctacagaggcgagagagtggccgccagaggctactggggcgacatcgccaccggccccttcgtggccttcggcatcgaggccgacgacgagagcctgctgagaaccagcaacggccagcccgtgaagaccgccggcgagatcacccagcacaacgtgaccgagctgctgagagacgtggccgcctggggcagagccagagccaccggcggcgacctggaggagcagcagcacgccgagggcagccccgagcccggcacccccgccgcccccacccccgagagcttcaccgtgcacttcctgcccctggacagcgcccagaccctgcaccacaagagctgctacaacggcagattccagctgctgtacgtggcctgcggcatggtgcacctgctgatccccgagctgggcgcctgcgtggcccccggcggcaacctgatcgtggagctggccagatacctggtggacgtgagacaggagcagctgcagggcttcaacaccagagtgagagagctggcccaggccgccggcttcgccccccagaccggcgccagacccagcgagaccttcgccagattctgcaagagccaggagagcgccctgggcaacaccgtgcccgccgtggagcccggcaccccccccctggacatcctggcccagcccctggaggccagcaaccccgccctggagggcctgacccagcccctgcagggcggcaccccccactgcgagccctgccagctgcccagcgagagccccggcagcctgagcgaggtgctggcccagccccagggcgccctggccccccccaactgcgagagcgacagcaagaccggcgtgtag

SEQ ID NO: 19044 - DNA, 1464 bp, Artificial Sequence
  Description of Artificial Sequence: Synthetic coding sequence
atgaagatgagagcccagatccccgagagcctgagagaggagggcatcgagatcctgaagccccagttcttcgtgctggagaacaacctggaggccgtggccagacacatgctgatcttcagcctggccctggaggagcccgagaagatgggcctgcaggagagaagcgagaccttcctggaggtgtggggcaacgccctgctgagaccccccgtggccgccttcgtgagagcccaggccgacctgctggcccacctggtgcccgagcccgacagactggaggagcagctgccctggctgagcctgagagccctgaagttcagagagagagacgccctggaggccgtgttcagattctgggccggcggcgagaagggcccccaggccttccccatgagcagactgtgggacagcagactgagacactacctgggcagcagatacgacgccagaagaggcgtgagcgactgggacctgagaatgaagctgcacgacagaggcgcccaggtgatccacccccaggagttcagaagatggagagacaccggcgtggccttcgagctgagagacagcagcgcctaccacgtgcccaacagaaccctggccagcggcagactgctgagctacagaggcgagagagtggccgccagaggctactggggcgacatcgccaccggccccttcgtggccttcggcatcgaggccgacgacgagagcctgctgagaaccagcaacggccagcccgtgaagaccgccggcgagatcacccagcacaacgtgaccgagctgctgagagacgtggccgcctggggcagagccagagccaccggcggcgacctggaggagcagcagcacgccgagggcagccccgagcccggcacccccgccgcccccacccccgagagcttcaccgtgcacttcctgcccctggacagcgcccagaccctgcaccacaagagctgctacaacggcagattccagctgctgtacgtggcctgcggcatggtgcacctgctgatccccgagctgggcgcctgcgtggcccccggcggcaacctgatcgtggagctggccagatacctggtggacgtgagacaggagcagctgcagggcttcaacaccagagtgagagagctggcccaggccgccggcttcgccccccagaccggcgccagacccagcgagaccttcgccagattctgcaagagccaggagagcgccctgggcaacaccgtgcccgccgtggagcccggcaccccccccctggacatcctggcccagcccctggaggccagcaaccccgccctggagggcctgacccagcccctgcagggcggcaccccccactgcgagccctgccagctgcccagcgagagccccggcagcctgagcgaggtgctggcccagccccagggcgccctggccccccccaactgcgagagcgacagcaagaccggcgtgtag

SEQ ID NO: 19045 - DNA, 783 bp, Artificial Sequence
  Description of Artificial Sequence: Synthetic coding sequence
atggccgccgccgccctgagaagattctggagcagaagaagagccgaggccggcgacgccgtggtggccaagcccggcgtgtgggccagactgggcagctgggccagagccctgctgagagactacgccgaggcctgcagagacgccagcgccgaggccagagccagacccggcagagccgccgtgtacgtgggcctgctgggcggcgccgccgcctgcttcaccctggcccccagcgagggcgccttcgaggaggccctgctggaggccagcggcaccctgctgctgctggcccccgccaccagaaacagagagagcgaggccttcgtgcagagactgctgtggctgagaggcagaggcagactgagatacgtgaacctgggcctgtgcagcctggtgtacgaggcccccttcgacgcccaggccagcctgtaccaggccagatgcagatacctgcagcccagatggaccgacttccccggcagagtgctggacgtgggcttcgtgggcagatggtgggtgctgggcgcctggatgagagactgcgacatcaacgacgacgagttcctgcacctgcccgcccacctgagagtggtgggcccccagcagctgcacagcgagaccaacgagagactgttcgacgagaagtacaagcccgtggtgctgaccgacgaccaggtggaccaggccctgtgggaggagcaggtgctgcagaaggagaagaaggacagactggccctgagccaggcccacagcctggtgcaggccgaggcccccagatag

SEQ ID NO: 19046 - DNA, 1005 bp, Artificial Sequence
  Description of Artificial Sequence: Synthetic coding sequence
atgaagcccccccccagaagaagagccgcccccgccagatacctgggcgaggtgaccggccccgccacctggagcgccagagagaagagacagctggtgagactgctgcaggccagacagggccagcccgagcccgacgccaccgagctggccagagagctgagaggcagaagcgaggccgagatcagagtgttcctgcagcagctgaagggcagagtggccagagaggccatccagaaggtgcaccccggcggcctgcagggccccagaagaagagaggcccagccccccgcccccatcgaggtgtggaccgacctggccgagaagatcaccggccccctggaggaggccctggccgtggccttcagccaggtgctgaccatcgccgccaccgagcccgtgaccctgctgcacagcaagccccccaagcccacccaggccagaggcaagcccctgctgctgagcgcccccggcggccaggaggaccccgcccccgagatccccagcagcgcccccgccgcccccagcagcgcccccagaacccccgaccccgcccccgagaagcccagcgagagcagcgccggccccagcaccgaggaggacttcgccgtggacttcgagaagatctacaagtacctgagcagcgtgagcagaagcggcagaagccccgagctgagcgccgccgagagcgccgtggtgctggacctgctgatgagcctgcccgaggagctgcccctgctgccctgcaccgccctggtggagcacatgaccgagacctacctgagactgaccgccccccagcccatccccgccggcggcagcctgggccccgccgccgagggcgacggcgccggcagcaaggcccccgaggagaccccccccgccaccgagaaggccgagcacagcgagctgaagagcccctggcaggccgccggcatctgccccctgaaccccttcctggtgcccctggagctgctgggcagagccgccacccccgccagatag

SEQ ID NO: 19047 - DNA, 300 bp, Artificial Sequence
  Description of Artificial Sequence: Synthetic coding sequence
atggcccagggccagagaaagttccaggcccacaagcccgccaagagcaagaccgccgccgccgccagcgagaagaacagaggccccagaaagggcggcagagtgatcgcccccaagaaggccagagtggtgcagcagcagaagctgaagaagaacctggaggtgggcatcagaaagaagatcgagcacgacgtggtgatgaaggccagcagcagcctgcccaagaagctggccctgctgaaggcccccgccaagaagaagggcgccgccgccgccaccagcagcaagacccccagctag

SEQ ID NO: 19048 - DNA, 420 bp, Artificial Sequence
  Description of Artificial Sequence: Synthetic coding sequence
atgagagccggcggcctggtggacggcagatacagccccgtggccccccagtggagaccccccggcgagacccacaccggcggccacggcaagagactgcacggccccggcagagacgtgctgagcaccagctacgacgaggacttcaaccacgagccctgccagagaaagggccacaaggcccactgggccgtgagcgccggcgtgctgctgggcgtgagagccgtgcccagcctgggctacaccgaggaccccgagctgcccggcctgttccaccccgtgctgggcaccccctgccagccccccagcctgcccgaggagggcagccccggcgccgtgtacctgctgagcaagcagggcaagagctggcactaccagctgtgggactacgaccagggcccccccctgagcagccactag

SEQ ID NO: 19049 - DNA, 1056 bp, Artificial Sequence
  Description of Artificial Sequence: Synthetic coding sequence
atgaccagcccctgcagcccccccctgaagccccccatcagcccccccaagacccccgtgccccaggccagcagcatccccagcccccccctgccccccagccccctggacttcagcgccctgcccagccccccctggagccagcagacccccgtgcccccccccctgcccctgccccccccccccgccgccaccggccccgcccccagacacgtgttcggcctggagaagagccagctgctgaaggaggccttcgacaaggccggccccgtgcccaagggcagagaggacgtgaagagactgctgaagctgcacaaggacagattcagaggcgacctgagatggatcctgttctgcgccgacctgcccagcctgatccaggagggcccccagtgcggcctggtggccctgtggatggccggcaccctgctgagcccccccagcggcgtgcccctggagagactgatcagagtggccaccgagagaggctacaccgcccagggcgagatgttcagcgtggccgacatgggcagactggcccaggaggtgctgggctgccaggccaagctgctgagcggcggcctgggcggccccaacagagacctggtgctgcagcacctggtgaccggccaccccctgctgatcccctacgacgaggacttcaaccacgagccctgccagagaaagggccacaaggcccactgggccgtgagcgccggcgtgctgctgggcgtgagagccgtgcccagcctgggctacaccgaggaccccgagctgcccggcctgttccaccccgtgctgggcaccccctgccagccccccagcctgcccgaggagggcagccccggcgccgtgtacctgctgagcaagcagggcaagagctggcactaccagctgtgggactacgaccaggtgagagagagcaacctgcagctgaccgacttcagccccagcagagccaccgacggcagagtgtacgtggtgcccgtgggcggcgtgagagccggcctgtgcggccaggccctgctgctgaccccccaggactgcagccactag

SEQ ID NO: 19050 - DNA, 1440 bp, Artificial Sequence
  Description of Artificial Sequence: Synthetic coding sequence
atggacagaagcctgcccgtgttcagcatccaggacagccccttcggcgacgcccccctgggcagaagccactactggcccagccagagccagacctggtgccccaagaccctgagccccagcagaagccagagaagcagactgccccaggcccccaaggccctggccaccggccccaacagccccgagctgttcgaggagagctggcccagcagcagcggcacccccagcctgcccagcaccaccgagggccagatgtgggccagccccgcccccaccctgatcgacagcggcgacagcgtggtggccaagtacatcaacagattcagacaggcccagcccaccagcagagaggagagacagcccgccggccccacccccgccgacttctggtggctgcagagcgacagccccgaccccagcagccagagcgccgccgccggcgccaacaagcccgagggcagaccccacaccgccgtgcccaccgccgtgaacgtgaccagcgccagccacgccgtggcccccctgcaggagatcaagcagaacctgcacacctggaacagcagcctgctggacctggagaccctgagcctgcagagcagagccgccagactgctgaagagaagcaaggccagcatcagcagcagcagcagcctgagccccagcgacgccagcaccagcagcttccccaccagcagcgacggcctgagccccttcagcgagaccttcatccccgacagcagcaagggcctgggccccagagcccccgccagccccgcccccgcccaggcccagacccccacccccgcccccgcccccgccagcagccaggcccccctgagacccgaggacgacatcctgtaccagtggagacagagaagaaagctggagcaggcccagggcagcaagggcgacagagcctgggtgccccccctgacccccgccctgagaaccctggccgagagcctgaaggccaaggccctgccccccgccgccggcagcgtgatcagaaagagcgaggccacccccagccccggcgcctgcctgcagcccgaggtgcccctgagccccgccgagcaggccaccaccgtgaaggccagcccccccgccttccaggtgggcagccccgaggccctggccccccccccccccgccgccgaccacgcccccagcgaggccctgctggcccaggccctgctgctgcaggccgccgaggacagcgacggcagcgagttccaggacgaccccgtgctgcaggtgctgagagcccacagagccgagctgagcagacagaagagagaggccgacgccagactgagcttcctgctggaccaggccgaggacctgggcagctggagcccccccgccggcagcccccccagaagccccagaagactgctgagaagagagggcgacagcctggaggccagaagactgtag

SEQ ID NO: 19051 - DNA, 330 bp, Artificial Sequence
  Description of Artificial Sequence: Synthetic coding sequence
atgtgggccagccccgcccccaccctgatcgacagcggcgacagcgtggtggccaagtacatcaacagattcagacaggcccagcccaccagcagagaggagagacagcccgccggccccacccccgccgacttctggtggctgcagagcgacagccccgaccccagcagccagagcgccgccgccggcgccaacaagcccgagggcagaccccacaccgccgtgcccaccgccgtgaacgtgaccagcgccagccacgccgtggcccccctgcaggagatcaagcaggtgaccagccccttcacccccagcctgggctgcctgaactag

SEQ ID NO: 19052 - DNA, 1914 bp, Artificial Sequence
  Description of Artificial Sequence: Synthetic coding sequence
atgaccaagagaaagaagctgagaaccagcggcgagggcctgtgcccccccaagcccctgaagaaccccagactgggcgacttctacggcgacccccagagcagcatgctgggctgcctgcaccaccccgaggagcccgagggcaagctgggccccgtgcccagcacccagcagcacggcgaggagcccggcaaggccgtgagcagcagccccgacgaggagaccggcagcccctgcagactgctgagacagcccgagaaggagcccgcccccctgccccccagccagaacagcttcggcagattcgtgccccagttcgccaagagcagaaagaccgtgaccagaaaggaggagatgaaggacgaggacagaggcagcggcgccttcagcctggagaccatcgccgagagcagcgcccagagccccggctgccagctgctggtggagaccctgggcgtgcccctgcaggaggccaccgagctgggcgaccccacccaggccgacagcgccagacccgagcagagcagccagagccccgtgcaggccgtgcccggcagcggcgacagccagcccgacgacccccccgacagaggcaccggcctgagcgccagccagagagccagccaggaccacctgagcgagcagggcgccgacgacagcaagcccgagaccgacagagtgcccggcgacggcggccagaaggagcacctgcccagcatcgacagcgagggcgagaagcccgacagaggcgccccccaggagggcggcgcccagagaaccgccggcgccggcctgcccggcggcccccaggaggagggcgacggcgtgccctgcacccccgccagcgcccccaccagcggccccgcccccggcctgggccccgccagctggtgcctggagcccggcagcgtggcccagggcagccccgacccccagcagacccccagcagaatgggcagagagggcgagggcacccacagcagcctgggctgcagcagcctgggcatggtggtgatcgccgacctgagcaccgaccccaccgagctggaggagagagccctggaggtggccggccccgacggccaggccagcgccatcagccccgccagccccagaagaaaggccgccgacggcggccacagaagagccctgcccggctgcaccagcctgaccggcgagaccaccggcgagagcggcgaggccggccaggacggcaagccccccggcgacgtgctggtgggccccaccgccagcctggccctggcccccggcagcggcgagagcatgatgggcgccggcgacagcggccacgccagccccgacaccggcccctgcgtgaaccagaagcaggagcccggccccgcccaggaggaggccgagctgggcggccagaacctggagagagacctggagggcttcagagtgagcccccaggccagcgtggtgctggagcacagagagatcgccgacgaccccctgcaggagcccggcgcccagcagggcatccccgacaccaccagcgagctggccggccagagagaccacctgccccacagcgccgaccagggcacctgggccgacagcctggccgtggagctggacttcctgctggacagccagatccaggacgccctggacgccagcgacttcgaggccccccccgagcagctgttccccagcggcaacaagcccggcccctgctggcccggccccagcagccacgccaacggcgaccccgtggccgtggccaaggcccagcccagcagactgatcatgggcacccacagagacctggaggccttcaagagactgaactacagaaagaccaagctgggcggcaaggcccccctgccctaccccagcaagggccccggcaacatccccagaggcgaccccccctggagagagctgtag

SEQ ID NO: 19053 - DNA, 2007 bp, Artificial Sequence
  Description of Artificial Sequence: Synthetic coding sequence
atgaccaagagaaagaagctgagaaccagcggcgagggcctgtgcccccccaagcccctgaagaaccccagactgggcgacttctacggcgacccccagagcagcatgctgggctgcctgcaccaccccgaggagcccgagggcaagctgggccccgtgcccagcacccagcagcacggcgaggagcccggcaaggccgtgagcagcagccccgacgaggagaccggcagcccctgcagactgctgagacagcccgagaaggagcccgcccccctgccccccagccagaacagcttcggcagattcgtgccccagttcgccaagagcagaaagaccgtgaccagaaaggaggagatgaaggacgaggacagaggcagcggcgccttcagcctggagaccatcgccgagagcagcgcccagagccccggctgccagctgctggtggagaccctgggcgtgcccctgcaggaggccaccgagctgggcgaccccacccaggccgacagcgccagacccgagcagagcagccagagccccgtgcaggccgtgcccggcagcggcgacagccagcccgacgacccccccgacagaggcaccggcctgagcgccagccagagagccagccaggaccacctgagcgagcagggcgccgacgacagcaagcccgagaccgacagagtgcccggcgacggcggccagaaggagcacctgcccagcatcgacagcgagggcgagaagcccgacagaggcgccccccaggagggcggcgcccagagaaccgccggcgccggcctgcccggcggcccccaggaggagggcgacggcgtgccctgcacccccgccagcgcccccaccagcggccccgcccccggcctgggccccgccagctggtgcctggagcccggcagcgtggcccagggcagccccgacccccagcagacccccagcagaatgggcagagagggcgagggcacccacagcagcctgggctgcagcagcctgggcatggtggtgatcgccgacctgagcaccgaccccaccgagctggaggagagagccctggaggtggccggccccgacggccaggccagcgccatcagccccgccagccccagaagaaaggccgccgacggcggccacagaagagccctgcccggctgcaccagcctgaccggcgagaccaccggcgagagcggcgaggccggccaggacggcaagccccccggcgacgtgctggtgggccccaccgccagcctggccctggcccccggcagcggcgagagcatgatgggcgccggcgacagcggccacgccagccccgacaccggcccctgcgtgaaccagaagcaggagcccggccccgcccaggaggaggccgagctgggcggccagaacctggagagagacctggagggcttcagagtgagcccccaggccagcgtggtgctggagcacagagagatcgccgacgaccccctgcaggagcccggcgcccagcagggcatccccgacaccaccagcgagctggccggccagagagaccacctgccccacagcgccgaccagggcacctgggccgacagcctggccgtggagctggacttcctgctggacagccagatccaggacgccctggacgccagcgacttcgaggccccccccgagcagctgttccccagcggcaacaagcccggcccctgctggcccggccccagcagccacgccaacggcgaccccgtggccgtggccaaggcccagcccagaaccttcgtgggcatccaggccagcgaggccagcagaatggaggacgccaccaacgtggtgagaggcctgatcgtggagctgagcaacctgaacagactgatcatgggcacccacagagacctggaggccttcaagagactgaactacagaaagaccaagctgggcggcaaggcccccctgccctaccccagcaagggccccggcaacatccccagaggcgaccccccctggagagagctgtag

SEQ ID NO: 19054 - DNA, 606 bp, Artificial Sequence
  Description of Artificial Sequence: Synthetic coding sequence
atgatcaccgagaccgccgccgagcccaccgtgcccgccgtgcccgccgccgaggaggccaccgaggccagaggcagagaggagcccgcctggccctggaaggacgcccccatcagaaccctggtgcagagaatccaccagctgcaggccgagagagcccagggcttcagaagactggaggagtggctggcccccgtgcagggcctgagagcctggggcagaggcctgagagtgcccacctgcagaagaggccacagacagtacctgagaagcggccccgactacgacttcgccagatacagaagcaccgtgcacggcgtgacccaggccttcgccgccgccagcagagaggtgctggccgtggaggccgagctgggcggccccagaagacagcccctgctggccggccacgtgagaagcctgcaggagctggagcagaccagactgggcaccgtggccctgctgcagctgatggagacccccgagctggccggccaggaggacgccgtgagaatgcagcagctgaagatgaaggtgatcaagaccatggaggccatcagcgaggtgctgcaggacctgagattcgacgccgagagcgccgagtag

SEQ ID NO: 19055 - DNA, 540 bp, Artificial Sequence
  Description of Artificial Sequence: Synthetic coding sequence
atgatcaccgagaccgccgccgagcccaccgtgcccgccgtgcccgccgccgaggaggccaccgaggccagaggcagagaggagcccgcctggccctggaaggacgcccccatcagaaccctggtgcagagaatccaccagctgcaggccgagagagcccagggcttcagaagactggaggagggccacagacagtacctgagaagcggccccgactacgacttcgccagatacagaagcaccgtgcacggcgtgacccaggccttcgccgccgccagcagagaggtgctggccgtggaggccgagctgggcggccccagaagacagcccctgctggccggccacgtgagaagcctgcaggagctggagcagaccagactgggcaccgtggccctgctgcagctgatggagacccccgagctggccggccaggaggacgccgtgagaatgcagcagctgaagatgaaggtgatcaagaccatggaggccatcagcgaggtgctgcaggacctgagattcgacgccgagagcgccgagtag

SEQ ID NO: 19056 - DNA, 876 bp, Artificial Sequence
  Description of Artificial Sequence: Synthetic coding sequence
atgagccaggagggcgtggagctggagaagagcgtgagaagactgagagagaagttccacggcaaggtgagcagcaagaaggccggcgccctgatgagaaagttcggcagcgaccacaccggcgtgggcagaagcatcgtgtacggcgtgaagcagaaggacggccaggagctgagcaacgacctggacgcccaggacccccccgaggacatgaagcaggacagagacatccaggccgtggccaccagcctgctgcccctgaccgaggccaacctgagaatgttccagagagcccaggacgacctgatccccgccgtggacagacagttcgcctgcagcagctgcgaccacgtgtggtggagaagagtgccccagagaaaggaggtgagcagatgcagaaagtgcagaaagagatacgagcccgtgcccgccgacaagatgtggggcctggccgagttccactgccccaagtgcagacacaacttcagaggctgggcccagatgggcagccccagcccctgctacggctgcggcttccccgtgtaccccaccagaatcctgccccccagatgggacagagaccccgacagaagaagcacccacacccacagctgcagcgccgccgactgctacaacagaagagagccccacgtgcccggcaccagctgcgcccaccccaagagcagaaagcagaaccacctgcccaaggtgctgcaccccagcaacccccacatcagcagcggcagcaccgtggccacctgcctgagccagggcggcctgctggaggacctggacaacctgatcctggaggacctgaaggaggaggaggaggaggaggaggaggtggaggacgaggagggcggccccagagagtag

SEQ ID NO: 19057 - DNA, 723 bp, Artificial Sequence
  Description of Artificial Sequence: Synthetic coding sequence
atgagccagcaccagcaggcctgcggcatctgcagacaggaggacccccccgaggacatgaagcaggacagagacatccaggccgtggccaccagcctgctgcccctgaccgaggccaacctgagaatgttccagagagcccaggacgacctgatccccgccgtggacagacagttcgcctgcagcagctgcgaccacgtgtggtggagaagagtgccccagagaaaggaggtgagcagatgcagaaagtgcagaaagagatacgagcccgtgcccgccgacaagatgtggggcctggccgagttccactgccccaagtgcagacacaacttcagaggctgggcccagatgggcagccccagcccctgctacggctgcggcttccccgtgtaccccaccagaatcctgccccccagatgggacagagaccccgacagaagaagcacccacacccacagctgcagcgccgccgactgctacaacagaagagagccccacgtgcccggcaccagctgcgcccaccccaagagcagaaagcagaaccacctgcccaaggtgctgcaccccagcaacccccacatcagcagcggcagcaccgtggccacctgcctgagccagggcggcctgctggaggacctggacaacctgatcctggaggacctgaaggaggaggaggaggaggaggaggaggtggaggacgaggagggcggccccagagagtag

SEQ ID NO: 19058 - DNA, 1884 bp, Artificial Sequence
  Description of Artificial Sequence: Synthetic coding sequence
atggagagacccgagcccccccccggcaccgccgccggccaggaggagcaggagctgagagagagagccttcttcagctgggccgagttcagcagattcttcgacgcctggtgccagcagagactggccctgttcttcgtgaagagcagcatgcacctggccagatgcagatgggccagcgccccccccctgtacaccctgatcgacgtgctgaagtacagctacgtgagactggtgtgcaaggacgtgagagcccccagcagacccgccgtgggccccccccagcccggctgccccgccttcatcatcgtgaagctgagccccctgagagacagactggtggtgaccgagtgccagctgacccacagccaccccgcctgccccctggagttcgcctactacttcagacccggccacctgctggccaacgcctgcctgcccgtgagaaccaccaacaagatcagcaagcagttcgtggcccccgccgacgtgagaagactgctgagctactgcaagggcagagaccacggcgtgctggacgccctgcacgtgctggagggcctgttcagaaccgaccccgaggccaaggtgaagctggtgttcgtggaggaccaggccgtggtggagaccgtgttcttcctgaccagcagaaccagagccctgctgagaagattccccagaatgctgctggtggacagactgcccggcctgcagggcgccctggacctgctggccgtgctgtgcgtggacggcagcggcagagccagacaggccgcctgctgcgtggccagacccggcacccccagcctgctgagattcgccctggccagcctgctgcagagcgcccccgacgtgaagggcagagtgagatgcctgaccgccggccccgaggtggccgcccagctgcccgccgtgagacagctgctgccctgcgccagagtgcagatctgcagagcccagggcctggagaccctgttcagcaaggcccaggagctgggcggcgccggcagagaggaccccggcctgtggagcagactgtgcagactggccggcgccagcagccccgccgcctacgacgaggccctggccgagctgcacgcccacggccccgccgccttcgtggactacttcgagagaaactgggagcccagaagagacatgtgggtgagattcagagccttcgaggccgccagagacctggacgcctgcgccctggtgagaggccacagaagaagactgctgagaagactgagccccagcagaggcgtggcccagtgcctgagagacctggtggccatgcagtgggccgacgccgccggcgaggccgtgcccgagggccccgacggcggcggcccctggctggaggacgagcccggcagaggcgcccagggcgagaacgagagagtgagaggcctggagaccggcgactggggcggcgcccccaaggagggcagcatctggagaggcgcccagatggagaaggagtgggccagagccctggagaccagagactggggcggcgcccagttcgagggcgagaagggcagagccctgcagatcagagactggagaggcggcagactggagaaccagaagcccagaggcctggagggcggcgtgctgagaggcagcaagctggagaagggccacctgagaggccccgagatcagagactggagaggcccccagctggagggcgagaaggactggggcctggagggctacgtgtggagaggcagccagctggaggaccaggccctgagaggcctggagggctacacctggagagtggcccagctggaggacagaagaagcaccaccgacctgagaggcacccagttcgactacgagagaggcaagggcgagagcaccgaggacagatag

SEQ ID NO: 19059 - DNA, 393 bp, Artificial Sequence
  Description of Artificial Sequence: Synthetic coding sequence
atggagctgtggagacagctgaaccaggccggcctggtgccccccggcctgggcccccccccccaggccctgagagaggtgagccccgtggagatccccggccagaccctgagaaccgccggcgccgacaccggcggcgcctgcgacagcctgctgtggatcagagaggagctgggcaacctgagaagagtggacgtgcagctgctgggccagctgtgcagcctgggcctggagatgggcgccctgagagaggagctggtgaccatcctggaggaggaggaggagagcagcaaggaggaggaggaggaccaggagccccagagaaagcaggaggaggagcacctggaggcctgccccgccccccacccccccgacttcgagatgatgatctag

SEQ ID NO: 19060 - DNA, 630 bp, Artificial Sequence
  Description of Artificial Sequence: Synthetic coding sequence
atgcagaccctgagacaggaggccgccagaccctgcatccccagcggcaccctggaggccagcttccccgcccccctgtacagcgacgactacctgagcctggagggcagcagatggccccccgccatcagacaggccaccagatggaagtacacccccatgggcagagacgccgccggccagctgtggtacaccggcctgaccaacagcgacgcctgggaggcctggtacaacctgcccagagcccccgccagccccttcagagaggcctacaacagatggcacagctgctaccagcacagagagtgcagcatgcccagcgcctacacccagcacctgagagagaccgcctggcacgaccccatcgtgcccgcccagtaccaggcccccagcaccagatggggcagcgccctgtggaaggacagacccatcagaggcaaggagtacgtgctgaacagaaacagatacggcgtggagcccctgtggagagccagcgactacgtgcccagcctgagcgccccccagagaccccccggcaccacccagaactacagagagtgggtgctggagccctactgccccagcacctgccagagaagcccccccagcctgacccccacccccagatag

SEQ ID NO: 19061 - DNA, 390 bp, Artificial Sequence
  Description of Artificial Sequence: Synthetic coding sequence
atgagactgaaggtgggcttccagggcggcggctgcttcagaaaggacgccctgtgcctggagggcggcgtgagcgccagatgggccagagccccccacagcgcccccctgagaccccccagagagctgcacgccgcccccccccccgccacccccacccagaccgtggtgagacccgccggcttccccagaagaaccagactgatggtgagaagcgccccccccacccagagaccccccaccggcagcggctgcgtgagcggcctgtggagaaagggcctgggcctgagaccccagaccctgctgagagtgggcagcgtggtgctgagcagcgcccccgccctgagacccagactgggcccctgcctgagacccccccccagcgactag

SEQ ID NO: 19062 - DNA, 222 bp, Artificial Sequence
  Description of Artificial Sequence: Synthetic coding sequence
atgggcgtgaagctggagatcttcagaatgatcatctacctgaccttccccgtggccatgttctgggtgagcaaccaggccgagtggttcgaggacgacgtgatccagagaaagagagagctgtggccccccgagaagctgcaggagatcgaggagttcaaggagagactgagaaagagaagagaggagaagctgctgagagacgcccagcagaacagctag

SEQ ID NO: 19063 - DNA, 5955 bp, Artificial Sequence
  Description of Artificial Sequence: Synthetic coding sequence
atggagctgacccccggcgcccagcagcagggcatcaactaccaggagctgaccagcggctggcaggacgtgaagagcatgatgctggtgcccgagcccaccagaaagttccccagcggccccctgctgaccagcgtgagattcagcaacctgagccccgagagccagcagcaggacgtgaagagcctggagttcaccgtggagcccaagctgcagagcgtgaagcacgtgaagctgagcagcgtgagcctgcagcagaccatcaagagcgtggagctggcccccggcagcctgccccagagagtgaagtacggcgagcagacccccagaaccaactaccagatcatggagagcagcgagctgatccccagacccggccaccagttcgccaagtacgccgagatgatcccccagcccaagtaccagatccccaagagcgccaacctgatcagcatccccatctaccacgccaccgagagcagcgagatggcccagggcctggcctacaagggcatcgacaccgtggagaagagcgtgggcctgacccccaagctgaccggcagagccaaggagagcctgggcatgctgctgcagcccgacctgcaggtgcccaagttcgtggacctgacccccatggtgagagaccagggcagcaagttcctgggcctgacccccgagaagagctaccagatcctggagaccatggagctgctgagccagagcagacccagagtgaaggacgtgggcgagctgtacatgaagcccctgcagcagaccgtggagtacgagggcatcacccccgagctgaagcactacttcaccgaggccatgggcctgaccgccgaggccagaatccaggccaacgagttcttcggcatgacccccaagcccaccagccaggccaccggcttcgccgagagaagccccagactgtgcccccagaacctggagtgcgtggaggtgatcagcgagaagagactgcagggcgaggagagcgtggtgctgatccccaagagcctgcaccacgtgcccgacagcgccagcggcatgacccccggcctgggccacagagtgcccgagagcgtggagctgaccagcaagagcggcgtgcaggtggagaagaccctgcagctgacccccaagccccagcaccacgtgggcagccccggcatcatcagcggcctgggccaccaggtgcccgagagcgtgaacctgacctgcaagcagtggctgcagatggaggagagcctggaggtgcccctgaagcagaccagccaggtgatcggccacgaggagagcgtggagctgaccagcgaggccagacagcacagagaggtgagcatgggcctgaccaagagcaagaaccagagcatgaagagccccggcaccacccccggccccctgggcagaatcgtggagttcatgagaatcagccccgagcccctggaccaggtgaccgagagcgccagaacccagctgcaggtggcccagagcgaggaggtgatcctgatcgacgtgcccaaggtggtgcagagcgtgaaggtgacccccggcccccccttccagatcgtgaagagcgtgaccatccccagacccaccccccagatggtggagtacatcgagctgacccccaagctgcagtacgtgagacccagcgagcaccacaccggcccctgcctgcaggacgtgaagagcaccaagctgatcaccaagcccaagcaccagatcctggagaccgtggagctgaccggcttccagatcgtgaagaccatgctgatccccggccccagcctgcagatcgtgaagagcgaggagctggcccccggccccatcccccaggtggtggagcccatcggcgtggccctggagagcggcatcgaggccatcaactgcgtggacctgctgcccagaccccacctgcaggagctgatcgtgcccgccgagctgacccccagcccctgcacccaggtgaagagcgccgagctgaccagcccccagaccagccccttcgaggagcacaccatcctgacccacaagcagggcctgcaggccgtgaagagcaccgtgatcaagaccgagccccccaaggtgatggagaccgaggacctgaacctgggccacgtgtgccagaacagagactgccagaagctgaccagcgaggagctgcaggtgggcaccgacttcagcagattcctgcagagcagcagcaccaccctgatcagcagcagcgtgagaaccgccagcgagctgggcggcctgtgggacagcggcatccaggaggtgagcagagccctggacatcaagaaccccggcaccgacatcctgcagcccgaggagacctacatcgaccccaccatgatccagagcctgaccttccccctggccctgcacaaccagagcagcgacaagaccgccaacatcgtggagaacccctgccccgagatcctgggcgtggacgtgatcagcaaggagaccaccaagagaaagcagatggaggagctggagaacagcctgcagagacacctgccccagagctggagaagcagaagcagaaccttccaggccgagagcggcgtgcagaagggcctgatcaagagcttccccggcagacagcacaacgtgtgggagagccacgcctggagacagagactgcccagaaagtacctgagcaccatgctgatgctgggcaacatcctgggcaccaccatggagagaaagctgtgcagccagaccagcctggccgagagagccaccgccgacacctgccagagcatccagaacctgttcggcatccccgccgagctgatggagcccagccagagcctgcccgagaagggccccgtgaccatcagccagcccagcgtggtgaagaactacatccagagacacaccttctaccacggccacaagaagagaatggccctgagaatctggaccagaggcagcaccagcagcatcatccagcagtacagcggcaccagagtgagaatcaagaagaccaacagcaccttcaacggcatcagccaggaggtgatccagcacatgcccgtgagctgcgccggcggccagctgcccgtgctggtgaagagcgagagcagcctgagcatcttctacgacagagaggacctggtgcccatggaggagagcgaggacagccagagcgacagccagaccagaatcagcgagagccagcacagcctgaagcccaactacctgagccaggccaagaccgacttcagcgagcagttccagctgctggaggacctgcagctgaagatcgccgccaagctgctgagaagccagatcccccccgacgtgcccccccccctggccagcggcctggtgctgaagtaccccatctgcctgcagtgcggcagatgcagcggcctgaactgccaccacaagctgcagaccaccagcggcccctacctgctgatctacccccagctgcacctggtgagaacccccgagggccacggcgaggtgagactgcacctgggcttcagactgagaatcggcaagagaagccagatcagcaagtacagagagagagacagacccgtgatcagaagaagccccatcagccccagccagagaaaggccaagatctacacccaggccagcaagagccccaccagcaccatcgacctgcagagcggccccagccagagccccgcccccgtgcaggtgtacatcagaagaggccagagaagcagacccgacctggtggagaagaccaagaccagagcccccggccactacgagttcacccaggtgcacaacctgcccgagagcgacagcgagagcacccagaacgagaagagagccaaggtgagaaccaagaagaccagcgacagcaagtaccccatgaagagaatcaccaagagactgagaaagcacagaaagttctacaccaacagcagaaccaccatcgagagccccagcagagagctggccgcccacctgagaagaaagagaatcggcgccacccagaccagcaccgccagcctgaagagacagcccaagaagcccagccagcccaagttcatgcagctgctgttccagagcctgaagagagccttccagaccgcccacagagtgatcgccagcgtgggcagaaagcccgtggacggcaccagacccgacaacctgtgggccagcaagaactactaccccaagcagaacgccagagactactgcctgcccagcagcatcaagagagacaagagaagcgccgacaagctgacccccgccggcagcaccatcaagcaggaggacatcctgtggggcggcaccgtgcagtgcagaagcgcccagcagcccagaagagcctacagcttccagcccagacccctgagactgcccaagcccaccgacagccagagcggcatcgccttccagaccgccagcgtgggccagcccctgagaaccgtgcagaaggacagcagcagcagaagcaagaagaacttctacagaaacgagaccagcagccaggagagcaagaacctgagcacccccggcaccagagtgcaggccagaggcagaatcctgcccggcagccccgtgaagagaacctggcacagacacctgaaggacaagctgacccacaaggagcacaaccaccccagcttctacagagagagaacccccagaggccccagcgagagaaccagacacaaccccagctggagaaaccacagaagccccagcgagagaagccagagaagcagcctggagagaagacaccacagccccagccagagaagccactgcagccccagcagaaagaaccacagcagccccagcgagagaagctggagaagccccagccagagaaaccactgcagcccccccgagagaagctgccacagcctgagcgagagaggcctgcacagccccagccagagaagccacagaggccccagccagagaagacaccacagccccagcgagagaagccacagaagccccagcgagagaagccacagaagcagcagcgagagaagacacagaagccccagccagagaagccacagaggccccagcgagagaagccactgcagccccagcgagagaagacacagaagccccagccagagaagccacagaggccccagcgagagaagacaccacagccccagcaagagaagccacagaagccccgccagaagaagccacagaagccccagcgagagaagccaccacagccccagcgagagaagccaccacagccccagcgagagaagacaccacagccccagcgagagaagccactgcagccccagcgagagaagccactgcagccccagcgagagaagacacagaagccccagcgagagaagacaccacagccccagcgagaagagccaccacagccccagcgagagaagccaccacagccccagcgagagaagaagacacagccccctggagagaagcagacacagcctgctggagagaagccacagaagccccagcgagagaagaagccacagaagcttcgagagaagccacagaagaatcagcgagagaagccacagccccagcgagaagagccacctgagccccctggagagaagcagatgcagccccagcgagagaagaggccacagcagcagcggcaagacctgccacagccccagcgagagaagccacagaagccccagcggcatgagacagggcagaaccagcgagagaagccacagaagcagctgcgagagaaccagacacagccccagcgagatgagacccggcagacccagcggcagaaaccactgcagccccagcgagagaagcagaagaagccccctgaaggagggcctgaagtacagcttccccggcgagagacccagccacagcctgagcagagacttcaagaaccagaccaccctgctgggcaccacccacaagaaccccaaggccggccaggtgtggagacccgaggccaccagatag

SEQ ID NO: 19064 - DNA, 612 bp, Artificial Sequence
  Description of Artificial Sequence: Synthetic coding sequence
atgaccgtgaagtggaagcagctgagcgcccccgccagcggcgccgagatccagagattccccgtgcccgccgtggagcccgtgcccgcccccggcgccgacagcccccccggcaccgccctggagctggaggaggcccccgagcccagctgcagatgccccggcaccgcccaggaccagcccagcgaggagctgcccgacttcatggccccccccgtggagccccccgccagcgccctggagctgaaggtgtggctggagctggaggtggccgagagaggcggccagcacagcagcagccagcagctgccccactgcagccagagctgggcccagtggaagctgtggagacagagacccggcttcgccatctgggcccccctgccccactggagaggcaccagcctgatccagcagagcagcagccccgccgccgagggccccgccgccaccgccgccggcgccgtgtgcctgcccgccggcggcgccggcgagcaggagaaggagcccgtgagcagaggcagcagcagaagcagctgcagccagagaagaccccccccccccggcatggaggtgtgcccccagctgggcatctgggccatctgcccctag

SEQ ID NO: 19065 - DNA, 630 bp, Artificial Sequence
  Description of Artificial Sequence: Synthetic coding sequence
atgttcgtgagacccgagagcggcgagcagggccccgagaccctggcccccgccagcggcgccgagatccagagattccccgtgcccgccgtggagcccgtgcccgcccccggcgccgacagcccccccggcaccgccctggagctggaggaggcccccgagcccagctgcagatgccccggcaccgcccaggaccagcccagcgaggagctgcccgacttcatggccccccccgtggagccccccgccagcgccctggagctgaaggtgtggctggagctggaggtggccgagagaggcggccagcacagcagcagccagcagctgccccactgcagccagagctgggcccagtggaagctgtggagacagagacccggcttcgccatctgggcccccctgccccactggagaggcaccagcctgatccagcagagcagcagccccgccgccgagggccccgccgccaccgccgccggcgccgtgtgcctgcccgccggcggcgccggcgagcaggagaaggagcccgtgagcagaggcagcagcagaagcagctgcagccagagaagaccccccccccccggcatggaggtgtgcccccagctgggcatctgggccatctgcccctag

SEQ ID NO: 19066 - DNA, 1725 bp, Artificial Sequence
  Description of Artificial Sequence: Synthetic coding sequence
atggagcccaacagcctgagaaccaaggtgcccgccttcctgagcgacctgggcaaggccaccctgagaggcatcagaaagtgccccagatgcggcacctacaacggcaccagaggcctgagctgcaagaacaagacctgcggcaccatcttcagatacggcgccagaaagcagcccagcgtggaggccgtgaagatcatcaccggcagcgacctgcaggtgtacagcgtgagacagagagacagaggccccgactacagatgcttcgtggagctgggcgtgagcgagaccaccatccagaccgtggacggcaccatcatcacccagctgagcagcggcagatgctacgtgcccagctgcctgaaggccgccacccagggcgtggtggagaaccagtgccagcacatcaagctggccgtgaactgccaggccgaggccacccccctgaccctgaagagcagcgtgctgaacgccatgcaggccagccccgagaccaagcagaccatctggcagctggccaccgagcccaccggccccctggtgcagagaatcaccaagaacatcctggtggtgaagtgcaaggccagccagaagcacagcctgggctacctgcacaccagcttcgtgcagaaggtgagcggcaagagcctgcccgagagaagattcttctgcagctgccagaccctgaagagccacaagagcaacgccagcaaggacgagaccgcccagagatgcatccacttcttcgcctgcatctgcgccttcgccagcgacgagaccctggcccaggagttcagcgacttcctgaacttcgacagcagcggcctgaaggagatcatcgtgccccagctgggctgccacagcgagagcaccgtgagcgcctgcgagagcaccgccagcaagagcaagaagagaagaaaggacgaggtgagcggcgcccagatgaacagcagcctgctgccccaggacgccgtgagcagcaacctgagaaagagcggcctgaagaagcccgtggtggccagcagcctgaagagacaggcctgcggccagctgctggacgaggcccaggtgaccctgagcttccaggactggctggccagcgtgaccgagagaatccaccagaccatgcactaccagttcgacggcaagcccgagcccctggtgttccacatcccccagagcttcttcgacgccctgcagcagagaatcagcatcggcagcgccaagaagagactgcccaacagcaccaccgccttcgtgagaaaggacgccctgcccctgggcaccttcagcaagtacacctggcacatcaccaacatcctgcaggtgaagcagatcctggacacccccgagatgcccctggagatcaccagaagcttcatccagaacagagacggcacctacgagctgttcaagtgccccaaggtggaggtggagagcatcgccgagacctacggcagaatcgagaagcagcccgtgctgagacccctggagctgaagaccttcctgaaggtgggcaacaccagccccgaccagaaggagcccacccccttcatcatcgagtggatccccgacatcctgccccagagcaagatcggcgagctgagaatcaagttcgagtacggccaccacagaaacggccacgtggccgagtaccaggaccagagaccccccctggaccagcccctggagctggcccccctgaccaccatcaccttcccctag

SEQ ID NO: 19067 - DNA, 69 bp, Artificial Sequence
  Description of Artificial Sequence: Synthetic coding sequence
atggagcccaacagcctgagaaccaaggtgcccgccttcctgagcgacctgggcaaggccaccctgtag

SEQ ID NO: 19068 - DNA, 480 bp, Artificial Sequence
  Description of Artificial Sequence: Synthetic coding sequence
atggagcccaacagcctgagaaccaaggtgcccgccttcctgagcgacctgggcaaggccaccctgagaggcatcagaaagtgccccagatgcggcacctacaacggcaccagaggcctgagctgcaagaacaagacctgcggcaccatcttcagatacggcgccagaaagcagcccagcgtggaggccgtgaagatcatcaccggcagcgacctgcaggtgtacagcgtgagacagagagacagaggccccgactacagatgcttcgtggagctgggcgtgagcgagaccaccatccagaccgtggacggcaccatcatcacccagctgagcagcggcagatgctacgtgcccagctgcctgaaggccgccacccagggcgtggtggagaaccagtgccagcacatcaagctggccgtgaactgccaggccgaggccacccccctgaccctgaagagcagcgtgctgaacgccatgtag

SEQ ID NO: 19069 - DNA, 387 bp, Artificial Sequence
  Description of Artificial Sequence: Synthetic coding sequence
atggagcccaacagcctgagaaccaaggtgcccgccttcctgagcgacctgggcaaggccaccctgagaggcatcagaaagtgccccagatgcggcacctacaacggcaccagaggcctgagctgcaagaacaagacctgcggcaccatcttcagatacggcgccagaaagcagcccagcgtggaggccgtgaagatcatcaccggcagcgacctgcaggtgtacagcgtgagacagagagacagaggccccgactacagatgcttcgtggagctgggcgtgagcgagaccaccatccagaccgtggacggcaccatcatcacccagctgagcagcggcagatgctacgtgcccagctgcctgaaggccgccacccagggcgtgtag

SEQ ID NO: 19070 - DNA, 1725 bp, Artificial Sequence; identical to SEQ ID NO: 19066
  Description of Artificial Sequence: Synthetic coding sequence

SEQ ID NO: 19071 - DNA, 180 bp, Artificial Sequence
  Description of Artificial Sequence: Synthetic coding sequence
atggagcccaacagcctgagaaccaaggtgcccgccttcctgagcgacctgggcaaggccaccctgagaggcatcagaaagtgccccagatgcggcacctacaacggcaccagaggcctgagctgcaagaacaagacctgcggcaccatcttcagatacggcgccagaaagcagccctag

SEQ ID NO: 19072 - DNA, 183 bp, Artificial Sequence
  Description of Artificial Sequence: Synthetic coding sequence
atggagcccaacagcctgagaaccaaggtgcccgccttcctgagcgacctgggcaaggccaccctgagaggcatcagaaagtgccccagatgcggcacctacaacggcaccagaggcctgagctgcaagaacaagacctgcggcaccatcttcagatacggcgccagaaagcagcccagctag

SEQ ID NO: 19073 - DNA, 96 bp, Artificial Sequence
  Description of Artificial Sequence: Synthetic coding sequence
atggagcccaacagcctgagaaccaaggtgcccgccttcctgagcgacctgggcaaggccaccctgagaggcatcagaaagtgccccagatgctag

SEQ ID NO: 19074 - DNA, 507 bp, Artificial Sequence
  Description of Artificial Sequence: Synthetic coding sequence
atggagcccaacagcctgagaaccaaggtgcccgccttcctgagcgacctgggcaaggccaccctgagaggcatcagaaagtgccccagatgcggcacctacaacggcaccagaggcctgagctgcaagaacaagacctgcggcaccatcttcagatacggcgccagaaagcagcccagcgtggaggccgtgaagatcatcaccggcagcgacctgcaggtgtacagcgtgagacagagagacagaggccccgactacagatgcttcgtggagctgggcgtgagcgagaccaccatccagaccgtggacggcaccatcatcacccagctgagcagcggcagatgctacgtgcccagctgcctgaaggccgccacccagggcgtggtggagaaccagtgccagcacatcaagctggccgtgaactgccaggccgaggccacccccctgaccctgaagagcagcgtgctgaacgccatgcaggccagccccgagaccaagcagacctag

SEQ ID NO: 19075 - DNA, 339 bp, Artificial Sequence
  Description of Artificial Sequence: Synthetic coding sequence
atggagcccaacagcctgagaaccaaggtgcccgccttcctgagcgacctgggcaaggccaccctgagaggcatcagaaagtgccccagatgcggcacctacaacggcaccagaggcctgagctgcaagaacaagacctgcggcaccatcttcagatacggcgccagaaagcagcccagcgtggaggccgtgaagatcatcaccggcagcgacctgcaggtgtacagcgtgagacagagagacagaggccccgactacagatgcttcgtggagctgggcgtgagcgagaccaccatccagaccgtggacggcaccatcatcacccagctgagcagctag

SEQ ID NO: 19076 - DNA, 978 bp, Artificial Sequence
  Description of Artificial Sequence: Synthetic coding sequence
atggacagcgagctgaaggaggagatccccgtgcacgaggagttcatcctgtgcggcggcgccgagacccaggtgctgaagtgcggcccctggaccgacctgttccacgaccagagcgtgaagagacccaagctgctgatcttcatcatccccggcaaccccggcttcagcgccttctacgtgcccttcgccaaggccctgtacagcctgaccaacagaagattccccgtgtggaccatcagccacgccggccacgccctggcccccaaggacaagaagatcctgaccaccagcgaggacagcaacgcccaggagatcaaggacatctacggcctgaacggccagatcgagcacaagctggccttcctgagaacccacgtgcccaaggacatgaagctggtgctgatcggccacagcatcggcagctacttcaccctgcagatgctgaagagagtgcccgagctgcccgtgatcagagccttcctgctgttccccaccatcgagagaatgagcgagagccccaacggcagaatcgccacccccctgctgtgctggttcagatacgtgctgtacgtgaccggctacctgctgctgaagccctgccccgagaccatcaagagcctgctgatcagaagaggcctgcaggtgatgaacctggagaacgagttcagccccctgaacatcctggagcccttctgcctggccaacgccgcctacctgggcggccaggagatgatggaggtggtgaagagagacgacgagaccatcaaggagcacctgtgcaagctgaccttctactacggcaccatcgacccctggtgccccaaggagtactacgaggacatcaagaaggacttccccgagggcgacatcagactgtgcgagaagaacatcccccacgccttcatcacccacttcaaccaggagatggccgacatgatcgccgacagcctgaaggacgacctgagcaagatgtag

SEQ ID NO: 19077 - DNA, 834 bp, Artificial Sequence
  Description of Artificial Sequence: Synthetic coding sequence
atggacagcgagctgaaggaggagatccccgtgcacgaggagttcatcctgtgcggcggcgccgagacccaggtgctgaagtgcggcccctggaccgacctgttccacgaccagagcgtgaagagacccaagctgctgatcttcatcatccccgacagcaacgcccaggagatcaaggacatctacggcctgaacggccagatcgagcacaagctggccttcctgagaacccacgtgcccaaggacatgaagctggtgctgatcggccacagcatcggcagctacttcaccctgcagatgctgaagagagtgcccgagctgcccgtgatcagagccttcctgctgttccccaccatcgagagaatgagcgagagccccaacggcagaatcgccacccccctgctgtgctggttcagatacgtgctgtacgtgaccggctacctgctgctgaagccctgccccgagaccatcaagagcctgctgatcagaagaggcctgcaggtgatgaacctggagaacgagttcagccccctgaacatcctggagcccttctgcctggccaacgccgcctacctgggcggccaggagatgatggaggtggtgaagagagacgacgagaccatcaaggagcacctgtgcaagctgaccttctactacggcaccatcgacccctggtgccccaaggagtactacgaggacatcaagaaggacttccccgagggcgacatcagactgtgcgagaagaacatcccccacgccttcatcacccacttcaaccaggagatggccgacatgatcgccgacagcctgaaggacgacctgagcaagatgtag

SEQ ID NO: 19078 - DNA, 501 bp, Artificial Sequence
  Description of Artificial Sequence: Synthetic coding sequence
atggacagcgagctgaaggaggagatccccgtgcacgaggagttcatcctgtgcggcggcgccgagacccaggtgctgaagtgcggcccctggaccgacctgttccacgaccagagcgtgaagagacccaagctgctgatcttcatcatccccggcaaccccggcttcagcgccttctacgtgcccttcgccaaggccctgtacagcctgaccaacagaagattccccgtgtggaccatcagccacgccggccacgccctggcccccaaggacaagaagatcctgaccaccagcgaggacagcaacgcccaggagatcaaggacatctacggcctgaacggccagatcgagcacaagctggccttcctgagaacccacgtgcccaaggacatgaagctggtgctgatcggccacagcatcggcagctacttcaccctgcagatgctgaagagagtgcccgagctgcccctgatgctgcccaccctgggcgccaagaagtag

SEQ ID NO: 19079 - DNA, 588 bp, Artificial Sequence
  Description of Artificial Sequence: Synthetic coding sequence
atgaagctggtgctgatcggccacagcatcggcagctacttcaccctgcagatgctgaagagagtgcccgagctgcccgtgatcagagccttcctgctgttccccaccatcgagagaatgagcgagagccccaacggcagaatcgccacccccctgctgtgctggttcagatacgtgctgtacgtgaccggctacctgctgctgaagccctgccccgagaccatcaagagcctgctgatcagaagaggcctgcaggtgatgaacctggagaacgagttcagccccctgaacatcctggagcccttctgcctggccaacgccgcctacctgggcggccaggagatgatggaggtggtgaagagagacgacgagaccatcaaggagcacctgtgcaagctgaccttctactacggcaccatcgacccctggtgccccaaggagtactacgaggacatcaagaaggacttccccgagggcgacatcagactgtgcgagaagaacatcccccacgccttcatcacccacttcaaccaggagatggccgacatgatcgccgacagcctgaaggacgacctgagcaagatgtag

SEQ ID NO: 19080 - DNA, 2166 bp, Artificial Sequence
  Description of Artificial Sequence: Synthetic coding sequence
atggagctgggcaagggcaagctgctgagaaccggcctgaacgccctgcaccaggccgtgcaccccatccacggcctggcctggaccgacggcaaccaggtggtgctgaccgacctgagactgcacagcggcgaggtgaagttcggcgacagcaaggtgatcggccagttcgagtgcgtgtgcggcctgagctgggccccccccgtggccgacgacacccccgtgctgctggccgtgcagcacgagaagcacgtgaccgtgtggcagctgtgccccagccccatggagagcagcaagtggctgaccagccagacctgcgagatcagaggcagcctgcccatcctgccccagggctgcgtgtggcaccccaagtgcgccatcctgaccgtgctgaccgcccaggacgtgagcatcttccccaacgtgcacagcgacgacagccaggtgaaggccgacatcaacacccagggcagaatccactgcgcctgctggacccaggacggcctgagactggtggtggccgtgggcagcagcctgcacagctacatctgggacagcgcccagaagaccctgcacagatgcagcagctgcctggtgttcgacgtggacagccacgtgtgcagcatcaccgccaccgtggacagccaggtggccatcgccaccgagctgcccctggacaagatctgcggcctgaacgccagcgagaccttcaacatcccccccaacagcaaggacatgaccccctacgccctgcccgtgatcggcgaggtgagaagcatggacaaggaggccaccgacagcgagaccaacagcgaggtgagcgtgagcagcagctacctggagcccctggacctgacccacatccacttcaaccagcacaagagcgagggcaacagcctgatctgcctgagaaagaaggactacctgaccggcaccggccaggacagcagccacctggtgctggtgaccttcaagaaggccgtgaccatgaccagaaaggtgaccatccccggcatcctggtgcccgacctgatcgccttcaacctgaaggcccacgtggtggccgtggccagcaacacctgcaacatcatcctgatctacagcgtgatccccagcagcgtgcccaacatccagcagatcagactggagaacaccgagagacccaagggcatctgcttcctgaccgaccagctgctgctgatcctggtgggcaagcagaagctgaccgacaccaccttcctgcccagcagcaagagcgaccagtacgccatcagcctgatcgtgagagagatcatgctggaggaggagcccagcatcaccagcggcgagagccagaccacctacagcaccttcagcgcccccctgaacaaggccaacagaaagaagctgatcgagagcctgagccccgacttctgccaccagaacaagggcctgctgctgaccgtgaacaccagcagccagaacggcagacccggcagaaccctgatcaaggagatccagagccccctgagcagcatctgcgacggcagcatcgccctggacgccgagcccgtgacccagcccgccagcctgcccagacacagcagcacccccgaccacaccagcaccctggagccccccagactgccccagagaaagaacctgcagagcgagaaggagacctaccagctgagcaaggaggtggagatcctgagcagaaacctggtggagatgcagagatgcctgagcgagctgaccaacagactgcacaacggcaagaagagcagcagcgtgtaccccctgagccaggacctgccctacgtgcacatcatctaccagaagccctactacctgggccccgtggtggagaagagagccgtgctgctgtgcgacggcaagctgagactgagcaccgtgcagcagaccttcggcctgagcctgatcgagatgctgcacgacagccactggatcctgctgagcgccgacagcgagggcttcatccccctgaccttcaccgccacccaggagatcatcatcagagacggcagcctgagcagaagcgacgtgttcagagacagcttcagccacagccccggcgccgtgagcagcctgaaggtgttcaccggcctggccgcccccagcctggacaccaccggctgctgcaaccacgtggacggcatggcctag

SEQ ID NO: 19081 - DNA, 525 bp, Artificial Sequence
  Description of Artificial Sequence: Synthetic coding sequence
atggagctgggcaagggcaagctgctgagaaccggcctgaacgccctgcaccaggccgtgcaccccatccacggcctggcctggaccgacggcaaccaggtggtgctgaccgacctgagactgcacagcggcgaggtgaagttcggcgacagcaaggtgatcggccagttcgagtgcgtgtgcggcctgagctgggccccccccgtggccgacgacacccccgtgctgctggccgtgcagcacgagaagcacgtgaccgtgtggcagctgtgccccagccccatggagagcagcaagtggctgaccagccagacctgcgagatcagaggcagcctgcccatcctgccccagggctgcgtgtggcaccccaagtgcgccatcctgaccgtgctgaccgcccaggacgtgagcatcttccccaacgtgcacagcgacgacagccaggtgaaggccgacatcaacacccagggcagaatccactgcgcctgctggacccaggacggcctgagactggtggtggcctag

SEQ ID NO: 19082 - DNA, 1869 bp, Artificial Sequence
  Description of Artificial Sequence: Synthetic coding sequence
atggagctgggcaagggcaagctgctgagaaccggcctgaacgccctgcaccaggccgtgcaccccatccacggcctggcctggaccgacggcaaccaggtggtgctgaccgacctgagactgcacagcggcgaggtgaagttcggcgacagcaaggtgatcggccagttcgagtgcgtgtgcggcctgagctgggccccccccgtggccgacgacacccccgtgctgctggccgtgcagcacgagaagcacgtgaccgtgtggcagctgtgccccagccccatggagagcagcaagtggctgaccagccagacctgcgagatcagaggcagcctgcccatcctgccccagggctgcgtgtggcaccccaagtgcgccatcctgaccgtgctgaccgcccaggacgtgagcatcttccccaacgtgcacagcgacgacagccaggtgaaggccgacatcaacacccagggcagaatccactgcgcctgctggacccaggacggcctgagactggtggtggccgtgggcagcagcctgcacagctacatctgggacagcgcccagaagaccctgcacagatgcagcagctgcctggtgttcgacgtggacagccacgtgtgcagcatcaccgccaccgtggacagccaggtggccatcgccaccgagctgcccctggacaagatctgcggcctgaacgccagcgagaccttcaacatcccccccaacagcaaggacatgaccccctacgccctgcccgtgatcggcgaggtgagaagcatggacaaggaggccaccgacagcgagaccaacagcgaggtgagcgtgagcagcagctacctggagcccctggacctgacccacatccacttcaaccagcacaagagcgagggcaacagcctgatctgcctgagaaagaaggactacctgaccggcaccggccaggacagcagccacctggtgctggtgaccttcaagaaggccgtgaccatgaccagaaaggtgaccatccccggcatcctggtgcccgacctgatcgccttcaacctgaaggcccacgtggtggccgtggccagcaacacctgcaacatcatcctgatctacagcgtgatccccagcagcgtgcccaacatccagcagatcagactggagaacaccgagagacccaagggcatctgcttcctgaccgaccagctgctgctgatcctggtgggcaagcagaagctgaccgacaccaccttcctgcccagcagcaagagcgaccagtacgccatcagcctgatcgtgagagagatcatgctggaggaggagcccagcatcaccagcggcgagagccagaccacctacagcaccttcagcgcccccctgaacaaggccaacagaaagaagctgatcgagagcctgagccccgacttctgccaccagaacaagggcctgctgctgaccgtgaacaccagcagccagaacggcagacccggcagaaccctgatcaaggagatccagagccccctgagcagcatctgcgacggcagcatcgccctggacgccgagcccgtgacccagcccgccagcctgcccagacacagcagcacccccgaccacaccagcaccctggagccccccagactgccccagagaaagaacctgcagagcgagaaggagacctaccagctgagcaaggaggtggagatcctgagcagaaacctggtggagatgcagagatgcctgagcgagctgaccaacagactgcacaacggcaagaagagcagcagcgtgtaccccctgagccaggacctgccctacgtgcacatcatctaccagatccccaccggcttcttcagcctgctgaccgtgagagccctgagcagatag

SEQ ID NO: 19083 - DNA, 480 bp, Artificial Sequence
  Description of Artificial Sequence: Synthetic coding sequence
atggagagcagacccagcggcagacagcacgccagcgagggcgacggcgaccagagccccacccagtgcgccggcatgagaagcagcggcagaagcgaccagccctacgtgctgaagggcaaccccctgctgctgagagtgagatgctacagcggctgcgccagcggcagcggcagacagctgcagctgagcgtgttccaggacctgaaccagttcagccactgcagagtgtggagaagccccgccctgatcgtgaagggcgagcccccctggtgcagccagcaggacacccagagccccttccagaccggcacccccctggagagaccctgcttcagaatgaagctgagcggctgggagctgaccaagaacgcccagagagccctgggcagcaagctgcagcacatcctgagcctggacagcacccaggcctgcggcgccggcggccccaccatcctgagaccccccagagccccctag

SEQ ID NO: 19084 - DNA, 699 bp, Artificial Sequence
  Description of Artificial Sequence: Synthetic coding sequence
atggccggcgacgtgggcggcagaagctgcaccgacagcgagctgctgctgcaccccgagctgctgagccaggagttcctgctgctgaccctggagcagaagaacatcgccgtggagaccgacgtgagagtgaacaaggacagcctgaccgacctgtacgtgcagcacgccatccccctgccccagagagacctgcccaagaacagatggggcaagatgatggagaagaagagagagcagcacgagatcaagaacgagaccaagagaagcagcaccgtggacggcctgagaaagagacccctgatcgtgttcgacggcagcagcaccagcaccagcatcaaggtgaagaagaccgagaacggcgacaacgacagactgaagccccccccccaggccagcttcaccagcaacgccttcagaaagctgagcaacagcagcagcagcgtgagccccctgatcctgagcagcaacctgcccgtgaacaacaagaccgagcacaacaacaacgacgccaagcagaaccacgacctgacccacagaaagagccccagcggccccgtgaagagcccccccctgagccccgtgggcaccacccccgtgaagctgaagagagccgcccccaaggaggaggccgaggccatgaacaacctgaagcccccccaggccaagagaaagatccagcacgtgacctggccctag

SEQ ID NO: 19085 - DNA, 687 bp, Artificial Sequence
  Description of Artificial Sequence: Synthetic coding sequence
atgagaagactgagagtgaccacccacgccagcctgagacccagcaccagcctgccccagagattcctgagaggcgccctgtgggtggccgactggggcctgctggccaccaccatggccggcgacgtgggcggcagaagctgcaccgacagcgagctgctgctgcaccccgagctgctgagccaggagttcctgctgctgaccctggagcagaagaacatcgccgtggagaccgacgtgagagtgaacaaggacagcctgaccgacctgtacgtgcagcacgccatccccctgccccagagagacctgcccaagaacagatggggcaagatgatggagaagaagagagagcagcacgagatcaagaacgagaccaagagaagcagcaccgtggacggcctgagaaagagacccctgatcgtgttcgacggcagcagcaccagcaccagcatcaaggtgaagaagaccgagaacggcgacaacgacagactgaagccccccccccagaaccacgacctgacccacagaaagagccccagcggccccgtgaagagcccccccctgagccccgtgggcaccacccccgtgaagctgaagagagccgcccccaaggaggaggccgaggccatgaacaacctgaagcccccccaggccaagagaaagatccagcacgtgacctggccctag

SEQ ID NO: 19086 - DNA, 489 bp, Artificial Sequence
  Description of Artificial Sequence: Synthetic coding sequence
atgggcagccaccccacccccggcctgcagagaaccaccagcgccggctacagactgccccccaccagaccccccgccagcgtgagccccgccgccagaggcggccccatggccagcagaggcctggccggcggctgccaggccccccaggccctgaaggcccagagagtggcccagggcgccgcctgcgacggcgtgcagcaggaccagctgtggagagagctgctggaggccgagagaagaggccagcagagatggatccagaactggagcttcctgaaggactacgaccccatgggcaacaagaaggagcccgagaagctgcccgaccacgtgcccctgttcagcgacaccgtgcccagcagcaccaaccaggtggtgggcagcagactggacacccccctgggccagaccctgatcagaatggacttcttcttcaccgagggcgccagaaagaagaagctggaggaccagatgcagcccatctag

SEQ ID NO: 19087 - DNA, 489 bp, Artificial Sequence; identical to SEQ ID NO: 19086
  Description of Artificial Sequence: Synthetic coding sequence

SEQ ID NO: 19088 - DNA, 1239 bp, Artificial Sequence
  Description of Artificial Sequence: Synthetic coding sequence
atgctgccccagaacaaggaccaggtgctgccccagaccagcgtgctgcccggcagacccacctggggcttcagccagctggtggacagcagcccccacaacctgcagcccctgagcccccaccagggcctgccccccagccagccccccttcagcagcacccagagcagaagacccagcagccccccccccgccagccccagccccggcttccagttcggcagctgcgacagcaacagcgacttcgccccccacccctacagccccagcctgcccagcagccccaccttcttccaccagaactacctgagcctgcccagacccagagccagcagccccagcaaccactggctgtaccccagcccccccctgacccccagcttcagccccagccagccccagaacagcagcctgccccacagcccctgccagagccccagccaccccgaggagctgcacagcagcaccctgaccagccccggccccagcccccccagccacagactgcacagcaacagacagacctggagatggcaccagtacagagacaccggcagcggcagccccggcgtggtggagagatgcgtgcccagcgagaaggaccccgcccagttcagagaccccggcgccctggcccaggccctggtggtgcagctgggccacagaagaatcgcccacgacctgagactgctgctgctgcagcacctgtggctgggcagaaccggccaggcccccgtggtggagtaccccatctgcctggtgtgcctgagacccagaagccccagctgccccctgcccagatacagaaccggccccagactgctggccttcccccagctgctgccctgcgtgcagggccaggagagcggccccctgagaatcggcatcggcttcggcctgagactgccccagggccaggccagagccctgcacctgctgcccgagaagagacccaaggaggccggcccccagggcaaggccacccaggcctgcggccaccagctgcccgccagccagccccccgccgcccaggccagagccgaccccgtgcccggcacccccagccagaccagaagcttcagaagcgccggcctgcagagccccaacagccccagatgcttcagcggccccccccccagagcccccaagcaggtgaccaccagcctgaagcccagaccctgccccggccccaagagacccgtgagcctggagctgatcctgcagaagagcagcgtgtag

SEQ ID NO: 19089 - DNA, 897 bp, Artificial Sequence
  Description of Artificial Sequence: Synthetic coding sequence
atggacaccggcgtgtggggctggggcgccgccgcctgcagatggggccccgccgagagagccgccggcagcctgaacgccgccagcctgagagaggagcagctgcacctgagcctgctggtgagcagcggctggagaaccatcagcttccacgtggtgcccgtggtgagaagaaagctgggcgcccccgccctggagggcgtgcagcagatgcccggcttccccgagggcagcctgagaagaatcctgagccagggcgtggacctggtgcccgccagcgcccagctgtggagaaccagcaccgactacctgctgaccagactgctgggcgagctgggcagcctgcagggccacagactggacagcctgagcatcctggacagagtgaaccacgagagctggagagacagcggccagaccgacggcctgaccttcggccacctgaagatggtgctgctgtgggccagcgtgctgttcctggcccccgaggactgggccgagctgcagggcgccgtgtacagactgctggtggtgctgctgtgctgcctggccaccagaaagctgccccacttcctgcacccccagagaaacctgctgcagggcagcggcctggacctgggcgccatctaccagagagtggagggcttcgccagccagcccgaggccgccctgagaatccacgccacccacctgggcagaagccccccccccagaatcggcagcggcctgaaggccctgctgcagctgcccgccagcgaccccacctactgggccaccgcctacttcgacgtgctgctggacaagttccaggtgttcaacatccaggacaaggacagaatcagcgccatgcagagcatcttccagaagaccagaaccctgggcggcgaggagagctag

SEQ ID NO: 19090 - DNA, 1344 bp, Artificial Sequence
  Description of Artificial Sequence: Synthetic coding sequence
atgcccgcccccgccctgcccaccagcgccatggccgtgcaggtgcccctgtggcaccactacctgcaggccatcagaagcagagaggcccccagagcccaggacttccagagagccgagaacgtgctgctgaccgtgctggagagagtgcacgccctggaccccagattcatcgtggactacagcagaggcctggaggccttccagttcgccctgagaagcagcgaggaccccatggacatggaggtgcccctgtgggtggacgccgaggccctgctgatcgaggagcccgaggccacccagcccgaggacggcctggagctgtgccacctgggcgtgcccagagagggcgccggcctggagagatggaccaccgaggacaccttcaccgccagcagcgagggcgacgccaagtgcagaggccacatcgtgcccagcaaggtgctgtgcgtgctgaaggacctgctggtggccgccatcgtgcactgcaagcaccacagcctgatcgcccccggcagcctgaacgccgccagcctgagagaggagcagctgcacctgagcctgctggtgagcagcggctggagaaccatcagcttccacgtggtgcccgtggtgagaagaaagctgggcgcccccgccctggagggcgtgcagcagatgcccggcttccccgagggcagcctgagaagaatcctgagccagggcgtggacctggtgcccgccagcgcccagctgtggagaaccagcaccgactacctgctgaccagactgctgggcgagctgggcagcctgcagggccacagactggacagcctgagcatcctggacagagtgaaccacgagagctggagagacagcggccagaccgacggcctgaccttcggccacctgaagatggtgctgctgtgggccagcgtgctgttcctggcccccgaggactgggccgagctgcagggcgccgtgtacagactgctggtggtgctgctgtgctgcctggccaccagaaagctgccccacttcctgcacccccagagaaacctgctgcagggcagcggcctggacctgggcgccatctaccagagagtggagggcttcgccagccagcccgaggccgccctgagaatccacgccacccacctgggcagaagccccccccccagaatcggcagcggcctgaaggccctgctgcagctgcccgccagcgaccccacctactgggccaccgcctacttcgacgtgctgctggacaagttccaggtgttcaacatccaggacaaggacagaatcagcgccatgcagagcatcttccagaagaccagaaccctgggcggcgaggagagctag

SEQ ID NO: 19091 - DNA, 840 bp, Artificial Sequence
  Description of Artificial Sequence: Synthetic coding sequence
atggacaccggcagcctgaacgccgccagcctgagagaggagcagctgcacctgagcctgctggtgagcagcggctggagaaccatcagcttccacgtggtgcccgtggtgagaagaaagctgggcgcccccgccctggagggcgtgcagcagatgcccggcttccccgagggcagcctgagaagaatcctgagccagggcgtggacctggtgcccgccagcgcccagctgtggagaaccagcaccgactacctgctgaccagactgctgggcgagctgggcagcctgcagggccacagactggacagcctgagcatcctggacagagtgaaccacgagagctggagagacagcggccagaccgacggcctgaccttcggccacctgaagatggtgctgctgtgggccagcgtgctgttcctggcccccgaggactgggccgagctgcagggcgccgtgtacagactgctggtggtgctgctgtgctgcctggccaccagaaagctgccccacttcctgcacccccagagaaacctgctgcagggcagcggcctggacctgggcgccatctaccagagagtggagggcttcgccagccagcccgaggccgccctgagaatccacgccacccacctgggcagaagccccccccccagaatcggcagcggcctgaaggccctgctgcagctgcccgccagcgaccccacctactgggccaccgcctacttcgacgtgctgctggacaagttccaggtgttcaacatccaggacaaggacagaatcagcgccatgcagagcatcttccagaagaccagaaccctgggcggcgaggagagctag

SEQ ID NO: 19092 - DNA, 402 bp, Artificial Sequence
  Description of Artificial Sequence: Synthetic coding sequence
atgcccgcccccgccctgcccaccagcgccatggccgtgcaggtgcccctgtggcaccactacctgcaggccatcagaagcagagaggcccccagagcccaggacttccagagagccgagaacgtgctgctgaccgtgctggagagagtgcacgccctggaccccagattcatcgtggactacagcagaggcctggaggccttccagttcgccctgagaagcagcgaggaccccatggacatggaggtgcccctgtgggtggacgccgaggccctgctgatcgaggagcccgaggccacccagcccgaggacggcctggagctgtgccacctgggcgtgcccagagagggcgccggcctggagagatggaccaccgaggacaccttcaccgccagcagctag

SEQ ID NO: 19093 - DNA, 2889 bp, Artificial Sequence
  Description of Artificial Sequence: Synthetic coding sequence
atgatcagcaccagagtgatggacatcaagctgagagaggccgccgagggcctgggcgaggacagcaccggcaagaagaagagcaagttcaagaccttcaagaagttcttcggcaagaagaagagaaaggagagccccagcagcaccggcagcagcacctggaagcagagccagaccagaaacgaggtgatcgccatcgagagcggccccgtgggctacgacagcgaggacgagctggaggagagcagaggcaccctgggcagcagagccctgagccacgacagcatcttcatccccgagagcggccaggacgccaccagacccgtgagagtgttcagccaggagaacgtgtgcgacagaatcaaggccctgcagctgaagatccagtgcaacgtgaagatgggccccccccccccccccggcggcctgcccgccaagagaggcgaggacgccggcatgagcagcgaggacgacggcctgcccagaagcccccccgagatgagcctgctgcacgacgtgggccccggcaccaccatcaaggtgagcgtggtgagccccgaccacgtgagcgacagcaccgtgagcgccagaatcagcgacaacagcctggcccccgtggccgacttcagctaccccgccgagagcagcagctgcctggacaacagcgccgccaagcacaagctgcaggtgaagcccagaaaccagagaagcagcaagatgagaagactgagcagcagagcccagagcgagagcctgagcgacctgacctgcacccccgaggaggaggagaacgaggagaagcccctgctggaggtgagccccgaggagagacccagcagcggccagcaggacgtggcccccgacagaggccccgagcccggcccccccgcccccctgcccccccccggcggcgccagagccagaagagccagactgcagcacagcagcgccctgaccgccagcgtggaggagggcggcgtgcccggcgaggaccccagcagcagacccgccacccccgagctggccgagcccgagagcgcccccaccctgagagtggagccccccagcccccccgagggcccccccaaccccggccccgacggcggcaagcaggacggcgaggccccccccgccggcccctgcgcccccgccaccgacaaggccgaggaggtggtgtgcgcccccgaggacgtggccagccccttccccaccgccatccccgagggcgacaccaccccccccgagaccgaccccgccgccaccagcgaggcccccagcgccagagacggccccgagagaagcgtgcccaaggaggccgagcccaccccccccgtgctgcccgacgaggagaagggcccccccggccccgcccccgagcccgagagagaggccgagaccgagcccgagagaggcgccggcaccgagcccgagagaatcggcaccgagcccagcaccgcccccgcccccagcccccccgcccccaagagctgcctgaagcacagacccgccgccgccagcgagggccccgccgccagcccccccctggccgccgccgagagcccccccgtggagcccggccccggcagcctggacgccgaggccgccgcccccgagagacccaaggccgagagagccgaggccccccccgccggcgccgagagagccgcccccgagagaaaggccgagagaggcggcgccgagctgagaggcgccaagaagttcagcgtgagcagctgcagagccagacccagacccggcgtgagcagacccctggagagagccagcggcagactgcccctggccagaagcggccccgtgtggagaagcgaggccgccctggacgacctgcagggcctgcccgagccccagcacgccaagcccggccccagaaagctggccgagagaggcccccaggacagcggcgacagagccgccagccccgccggccccagaaagagcccccaggaggccgccgccgcccccggcaccagagagccctgccccgccgcccaggagcccgcccccagcgaggacagaaaccccttccccgtgaagctgagaagcaccagcctgagcctgaagtacagagacggcgccagccaggaggtgaagggcgtgaagagatacagcgccgaggtgagactggagagaagcctgaccgtgctgcccaaggaggagaagtgccccctgggcaccgcccccgccctgagaggcaccagagcccccagcgaccagggcaagggcaaggccagaccccccgagcccctgagcagcaagccccccctgcccagaaagcccctgctgcagagcttcaccctgccccaccagcccgccccccccgacgccggccccggcgagagagagcccagaaaggagcccagaaccgccgagaagagacccctgagaagaggcgccgagaagagcctgccccccgccgccaccggccccggcgccgacggccagcccgcccccccctggatcaccgtgaccagacagaagagaagaggcaccctggaccagccccccaaccaggaggacaagcccggcgccagaaccctgaagagcgagcccggcaagcaggccaaggtgcccgagagaggccaggagcccgtgaagcaggccgacttcgtgagaagcaagagcttcctgatcacccccgtgaagcccgccgtggacagaaagcagggcgccaagctgaacttcaaggagggcctgcagagaggcatcagcctgagccaccagaacctggcccagagcgccgtgatgatggagaaggagctgcaccagctgaagagagccagctacgccagcaccgaccagcccagctggatggagctggccagaaagaagagccaggcctggagcgacatgccccagatcatcaagtag

SEQ ID NO: 19094 - DNA, 1188 bp, Artificial Sequence
  Description of Artificial Sequence: Synthetic coding sequence
atggccctgcccggctaccccctgggcaacgtggacgacagcagaagcaaggacagccccgccggcgagccccagggccaggtgcccctgaccgccgacgtgctggccgtgagcagcagcgtggccagcaccgactggcaggacatcgaccaggccagcttcaagaccgccacccccagagccatcagcaccagcggcgacaaggacaagagcgccgtggtgcccgagcacggccagaagacccccagaaagatcacccccctgctgcccagccagaaccccagccccctgcaggtgagcatgagcctgcagaaccccgcctgggacagacaggtgcaggacgccagaaccagccagagcctggtggtgttccccagccacctgctgggcaaggacaagatgagccagatggccagcgtgcccgagagagagcccgagagcgcccccagcgcccccagcgccgagctgcagagcacccagcacatggaggcccagcccgtggagagcgacgccgaccacgtgaccgccggcgccaacggccagcacggcccccaggccgccagcaccaccaagagcgccgaggagaaggccgagcaccccaaggccccccaccccgaggccgaggccctgcccagcgacgagagccccgtggccatgggcgccaacgtggtggacagcctgggcgacctgcagacctggttcttcccccccccccccgccggcagcgtgagccccagccccggcccccacgaggtggccctgggcagaagacccctggacagcagcctgtacaccgccagcgaggagaacagctacatgagaagcatgaccagcctgctggacagaggcgagggcagcatcagcagcctggccgacatcctggtgtggagcgagaccaccatgggcatggccatcgccaccggcttcctggacagcggccacagcaccgtggccgacctgctgcacagcagcggccccagcctgagaagcgtgcccagcctggtgggcagcgtgagcagcgccttcagcagcggcctggtgagcggcaccagcagcgccctgagaaccatcaccagagtgctggagaccgtggagcagagaaccgtggagggcatcagaagcgccatgagatacctgaccagccacctgacccccagacaggcccaggccgaccccaactacgactag

SEQ ID NO: 19095 - DNA, 534 bp, Artificial Sequence
  Description of Artificial Sequence: Synthetic coding sequence
atggaccagcccgccgtggccaccgccagcaccagcatcagagaggacctggtgggcggcgagagcttcatcaccgccagcaagcccgcccagaagaccagcagcttcgagagagagggctggtggagaatcgccctgaccgacacccccatccccggcacctaccacctgaagaccttcatcgaggagagcctgctgaaccccgtgatcgccacctacaacttcaagaacgagggcagaaagaagccccccctggtgcagagaaacaaccccgtgctgaacgacctgccccagtacatgccccccgacttcctggacctgctgaagaagcaggtggccacctacagcttcaaggacaagcccagacccagccccagcaccctggtggacaaggaccagagcctgcagctgagccccggccagtacaacgtgctgcccgcccccgtgcccaagtacgccagcagaagctgcgtgttcagaagcaccgtgcagagattccccaccacctacttcatccccgtgagcatcatgtag

SEQ ID NO: 19096 - DNA, 747 bp, Artificial Sequence
  Description of Artificial Sequence: Synthetic coding sequence
atggaccagcccgccgtggccaccgccagcaccagcatcagagaggacctggtgggcggcgagagcttcatcaccgccagcaagcccgcccagaagaccagcagcttcgagagagagggctggtggagaatcgccctgaccgacacccccatccccggcacctaccacctgaagaccttcatcgaggagagcctgctgaaccccgtgatcgccacctacaacttcaagaacgagggcagaaagaagccccccctggtgcagagaaacaaccccgtgctgaacgacctgccccagtacatgccccccgacttcctggacctgctgaagaagcaggtggccacctacagcttcaaggacaagcccagacccagccccagcaccctggtggacaaggaccagagcctgcagctgagccccggccagtacaacgtgctgcccgcccccgtgcccaagtacgccagcagaagctgcgtgttcagaagcaccgtgcagagattccccaccacctacttcatcccccacgagggccccggccccggccactacaacgtgaagatgccccccaccagcagcgtgaccagctgcttccagagcagagtgcccagattcctgcccagctgcagcaagacccccggccccggcgcctacaccaccctgagacagttccccaagcagagccccaccatcgccaagatgggccaggagcacagcctgttcttcaacaacaacaactggctgctgaagtag

SEQ ID NO: 19097 - DNA, 1164 bp, Artificial Sequence
  Description of Artificial Sequence: Synthetic coding sequence
atgagcagcaaggtgtacagcaccggcagcagagccaaggaccaccagcccagcggccccgagtgcctgcccctgcccgaggccaacgccgaggccatcgacttcctgagcagcctgcacaaggaggagctgcagatgctgttcttcagcgagaccctggccatggtgagcgacaccggcgagccccagggcgagctgaccatcgaggtgcagagaggcaagtaccaggagaagctgggcatgctgacctactgcctgttcgtgcacgccagcagcagaggcttcctggacaagatgctgtgcggcaacagcctgctgggctacctgagcgagaagctggagctgatggagcagcacagccaggacttcatcaagttcctgatcctgcccatggagagaaagatgagcctgctgaagcaggacgaccagctggccgtgaccagaagcatcaaggagggcgaggaggtgaagaccggcgtgaccagcttcccctggagcagcatcaagggcttcatcagcgaggccgccaacctggtgctgctgagagtgatggcctggagaagaatggtgcccagcaacgccagattcctgaccctggacaccgagggcaagctgtgctacctgacctaccagaacctgggcttccagaccatccaggtggaccaccagcaggccgaggtgttcatcgtggagcagaccgtgcacgccgaggagggcatccccatgagctgccagtactacctgctgagcgacggccacctggccaagagaatccaggtgggcagccccggctgctgcatcatcaccaagatgcccatcctgagagaggaggacgagatcgagcccagacccgtgttcgagaagaagcccctggtgtgggaggaggacatggagctgtacagcaagttcctggacagaaaggaggagctgagactgggccacgccagctacctgagacagcaccccgaggcccacgccctgatcagcgacttcctgctgttcctgctgctgagacagcccgaggacgtggtgaccttcgccgccgagttcttcggccccttcgacccctggagacccagcagccccgccctgggcagcagccacagacccaaccccttcagaagcctggagcccgagggcgacgccagaagcggcgccgcctag

SEQ ID NO: 19098 - DNA, 1761 bp, Artificial Sequence
  Description of Artificial Sequence: Synthetic coding sequence
atgagcgtgcaccagatcagaaagcacgccgtgctgccccccatcatctgcagaagcgacaaggagttcctggagagcgtgcagagatacatcatcaccgagaccgagagactgggctgcagcgaggagggccccgccgacgagtactacatcatctacagaaacgtgttcgacaaggtgatcgagcacatcaccgcctacaagagcatcctgaccagcatcaagaaggagtacgacgccttcatcgagaccatcaagaaggacagaagaaccaccttctgcctgcacggcaagctgaagggcctggccgccgagcccaccgccctggtgtactacagaaagagaaccatccagctggaggccaagatgagaatcatcgagagcaacagcagcaagatccagagccagatcgaccacatcaagcagtgcagagccgagtacgacaccaaggaggtgaagtactgcaccttcagcaaggaccccagcaagcccatccccggcatgaccctgcaggagagcatgaacctggacgccctgaccaagtacatgaagcacctggaggacaagtacgccgagatcaagcaggccatgctgatcaagtacgtgcccgcccagagaaaggccgacctggacgaggagatgatcgtgctgctgaagagaagagacgtggccgagaacctgaacaagaagctgcagttctgccaccagagactgcagatcatcagccaggccctgagcagctgggtgaagagcgacatgagcagccccttccaggacttcgtggagcagatccagaagaccaagtacctgcagggcgaccagggcatcgtggaggagctgatggaggacgaccccagaagagccaaggaggccgagatcatgctgcactacatcgagagattcaacgagctgatcagcctgggcgagtacgagaaggccgcctgctacgccgccaacagccccagaagaatcctgagaaacatcggcaccatgaacaccttcaaggccgtgggcaagatcagaggcaagcccctgcccctgctgctgttcttcgaggccctgttcatcaccagccacgccttcccctgccccgtggacgccgccctgaccctggagggcatcaagtgcggcctgagcgagaagagactggacctggtgaccaactgggtgacccaggagagactgaccttcagcgaggaggccggcgacgtgatctgcgactacggcgagcaggacacctacaacaaggccaagtgcctggccctggcccagatcgtgtacagcgagtgcggcctgcacaagaaggccatcctgtgcctgtgcaagcagggccagacccacagagtgatggagtacatccagcagctgaaggacttcaccaccgacgacctgctgcagctgctgatgagctgcccccaggtggagctgatccagtgcctgaccaaggagctgaacgagaagcagcccagcctgagcttcggcctggccatcctgcacctgttcagcgccgacatgaagaaggtgggcatcaagctgctgcaggagatcaacaagggcggcatcgacgccgtggagagcctgatgatcaacgacagcttctgcagcatcgagaagtggcaggaggtggccaacatctgcagccagaacggcttcgacaagctgagcaacgacatcaccagcatcctgagaagccaggccgccgtgaccgagatcagcgaggaggacgacgccgtgaacctgatggagcacgtgttctggtag

SEQ ID NO: 19099 - DNA, 141 bp, Artificial Sequence
  Description of Artificial Sequence: Synthetic coding sequence
atgagcgtgcaccagatcagaaagcacgccgtgctgccccccatcatctgcagaagcgacaaggagttcctggagagcgtgcagagatacatcatcaccgagaccgagagactgggctgcagcgaggagggccccgcctag

SEQ ID NO: 19100 - DNA, 414 bp, Artificial Sequence
  Description of Artificial Sequence: Synthetic coding sequence
atggagtacatccagcagctgaaggacttcaccaccgacgacctgctgcagctgctgatgagctgcccccaggtggagctgatccagtgcctgaccaaggagctgaacgagaagcagcccagcctgagcttcggcctggccatcctgcacctgttcagcgccgacatgaagaaggtgggcatcaagctgctgcaggagatcaacaagggcggcatcgacgccgtggagagcctgatgatcaacgacagcttctgcagcatcgagaagtggcaggaggtggccaacatctgcagccagaacggcttcgacaagctgagcaacgacatcaccagcatcctgagaagccaggccgccgtgaccgagatcagcgaggaggacgacgccgtgaacctgatggagcacgtgttctggtag

SEQ ID NO: 19101 - DNA, 1761 bp, Artificial Sequence; identical to SEQ ID NO: 19098
  Description of Artificial Sequence: Synthetic coding sequence

SEQ ID NO: 19102 - DNA, 54 bp, Artificial Sequence
  Description of Artificial Sequence: Synthetic coding sequence
atgagcgtgcaccagatcagaaagcacgccgtgctgccccccatcatctgctag

SEQ ID NO: 19103 - DNA, 243 bp, Artificial Sequence
  Description of Artificial Sequence: Synthetic coding sequence
atgagcgtgcaccagatcagaaagcacgccgtgctgccccccatcatctgcagaagcgacaaggagttcctggagagcgtgcagagatacatcatcaccgagaccgagagactgggctgcagcgaggagggccccgccgacgagtactacatcatctacagaaacgtgttcgacaaggtgatcgagcacatcaccgcctacaagagcatcctgaccagcatcaagaaggagtacgacgcctag

SEQ ID NO: 19104 - DNA, 501 bp, Artificial Sequence
  Description of Artificial Sequence: Synthetic coding sequence
atggaggccggcccccaccccagacccggccactgctgcaagcccggcggcagactggacatgaaccacggcttcgtgcaccacatcagaagaaaccagatcgccagagacgactacgacaagaaggtgaagcaggccgccaaggagaaggtgagaagaagacacacccccgcccccaccagacccagaaagcccgacctgcaggtgtacctgcccagacacagagacgtgagcgcccaccccagaaaccccgactacgaggagagcggcgagagcagcagcagcggcggcagcgagctggagcccagcggccaccagctgttctgcctggagtacgaggccgacagcggcgaggtgaccagcgtgatcgtgtaccagggcgacgaccccggcaaggtgagcgagaaggtgagcgcccacacccccctggacccccccatgagagaggccctgaagctgagaatccaggaggagatcgccaagagacagagccagcactag

SEQ ID NO: 19105 - DNA, 384 bp, Artificial Sequence
  Description of Artificial Sequence: Synthetic coding sequence
atggaggccggcccccaccccagacccggccactgctgcaagcccggcggcagactggacatgaaccacggcttcgtgcaccacatcagaagaaaccagatcgccagagacgactacgacaagaaggtgaagcaggccgccaaggagaaggtgagaagaagacacacccccgcccccaccagacccagaaagcccgacctgcaggtgtacctgcccagacacagaggcgaggccgccagacccgcctgcctgcagcccgccagaagcagctgcaacgccctgcccttcagcatcggcaagaaccacttcctgctgctgagattcagcagcagcagactgttccccgagccccccccccagagaagccagatcagcgccgagtag

SEQ ID NO: 19106 - DNA, 606 bp, Artificial Sequence
  Description of Artificial Sequence: Synthetic coding sequence
atggccagcagaagcgccggcaccctgctgaccgagttcaacgccgcctacgtgccccccggcctgatgcccggctaccagggccacgtgcccaccgtggccttcagcttcggcgccccctacggcaccaccaccctgaagtacttccaggaccacagaaacagagccatggagaagagccacacccccttcagccagggcggccacttccccaccatcttcagcaccaaccccaacctgctgctgatggagagagccagcaccagagacagatggctgcacaagcccagctacaccagattcaacctggacagccacagaagcaccgagctgaccaacttctaccagatggtgcagcagcacagaaagtactaccaggacaagaccggcaccgtgcccagagtgccctacttcgccatgcccgtgagagagcccgagagataccccctgcccaccgtgctgccccccctgtgccccaagaagaagtggcacctgctgagactggcccccgagaacctgaagacctaccagaccttccccagcggcaagagagtgagcccccaggagagaaagaagagagactgctacttcgagttcagagcctag

SEQ ID NO: 19107 - DNA, 348 bp, Artificial Sequence
  Description of Artificial Sequence: Synthetic coding sequence
atgcaggtgatgaacctgaacgtgcccatgagacccggcatcctggtgcagagacagagcaaggaggtgctggccacccccctggagaacagaagagacatggaggccgaggaggagaaccagatcaacgagaagcaggagcccgagaacgccggcgagaccggccaggaggaggacgacggcctgcagaagatccacaccagcgtgaccagaacccccagcgtggtggagagccagaagagacccctgaagggcgtgaccttcagcagagaggtgatcgtggtggacctgggcaacgagtaccccacccccagaagctacaccagagagcacaaggagagaaagtag

SEQ ID NO: 19108 - DNA, 585 bp, Artificial Sequence
  Description of Artificial Sequence: Synthetic coding sequence
atgagcctgctggccaagcccatgagcttcgagaccaccgccatcaccttcttcatcatcctgctgatctgcctgatctgcatcctgctgctgctggtggtgttcctgtacaagtgcttccagggcagaaagggcaaggagaccaagaaggtgccctgcaccgacgccaacggcggcgtggactgcgccgccgccaaggtggtgaccagcaaccccgaggaccacgagagaatcctgatgcaggtgatgaacctgaacgtgcccatgagacccggcatcctggtgcagagacagagcaaggaggtgctggccacccccctggagaacagaagagacatggaggccgaggaggagaaccagatcaacgagaagcaggagcccgagaacgccggcgagaccggccaggaggaggacgacggcctgcagaagatccacaccagcgtgaccagaacccccagcgtggtggagagccagaagagacccctgaagggcgtgaccttcagcagagaggtgatcgtggtggacctgggcaacgagtaccccacccccagaagctacaccagagagcacaaggagagaaagtag

SEQ ID NO: 19109 - DNA, 381 bp, Artificial Sequence
  Description of Artificial Sequence: Synthetic coding sequence
atggcccccggcgaggtgaccatcaccgtgagactgatcagaagcttcgagcacagaaacttcaagcccgtggtgtaccacggcgtgaacctggaccagaccgtgaaggagttcatcgtgttcctgaagcaggacatccccctgagaaccaacctgcccccccccttcagaaactacaagtacgacgccctgaagatcatccaccaggcccacaagagcaagaccaacgagctggtgctgagcctggaggacgacgagagactgctgctgaaggaggacagcaccctgaaggccgccggcatcgccagcgagaccgagatcgccttcttctgcgaggaggactacaagaactacaaggccaaccccatcagcagctggtag

SEQ ID NO: 19110 - DNA, 381 bp, Artificial Sequence; identical to SEQ ID NO: 19109
  Description of Artificial Sequence: Synthetic coding sequence

SEQ ID NO: 19111 - DNA, 381 bp, Artificial Sequence; identical to SEQ ID NO: 19109
  Description of Artificial Sequence: Synthetic coding sequence

SEQ ID NO: 19112 - DNA, 381 bp, Artificial Sequence; identical to SEQ ID NO: 19109
  Description of Artificial Sequence: Synthetic coding sequence

SEQ ID NO: 19113 - DNA, 1659 bp, Artificial Sequence
  Description of Artificial Sequence: Synthetic coding sequence
atggacaccagcagcgagatgctggtgagattcggcagaagatgcggcagagccaaggagagcaccgagatcagaaacagcgaggaggaccaggtgctgtacctgcccctgctgcccagcaaggtggacctgcagcaggtgaccatcatcccccacgacgagtggaagagaatccaggacagcctggacagactgaccagagaggccgcctgcctgagagccgagagaaaggccaagaaggagatgcacctgagaagccaggaggtggtgaagcactggaccaacacctacgccggcatgaaggagcagaagctggaggccaagaagaagagagacgaggagatcgaggccgagagacagatcctggacctggaggaggagatctacaagcagggcaagagaaagaaggccatcgagaacgccaagcagtaccagttctaccagaccgagagagtgaagaacttccacagcggcctgctgctgagcagagtgatgaaggagagagacgcccagatcgagttcagaaagagcaagatcaagagcgacaagaagtgggaggagcagctgaagctgaacatcgagaaggccttcaaggaggagcaggagaaggccgagaagagacacagagagagagtggccctggccaaggaccacctgaagcagatcaaggagcacgaggaggaggaggagagaagaaagaagtacgaggagaaggacgccgaggagatcaagagacagaacgccctgtacgagatcgagatgagaaagaagctggagaagaagagagaggagatgcacgagagcagaagaagattcctggagcacatgcaggacaagcacatcatcaaggccgtggagcagcagcagcaggaggaggaggacgagaagatgagaaagttcatcaaggccaagaagagactgatccagatgggcaaggagaaggaggccgagacccacagactgatggagaagagaagagagagaatccacaacttcctgagcgagctgctgaaggagaagctggacaacgaggacatgatcatcgccagagacatcgccgaggccgaggccgagtgggagaagagagagagagagaaggacgagaagaacaaggccgagctgaagaccatcgccgagtacagagccatcgtgatgaagaacaaggaggaggaggagagacagagaaagatcgaggccaaggagcagctgctggccgtgatgaaggccgaccagatcttctgggagcacgagaaggagaagaagtgcaaggccgacaaggagcaccaggaggtgcaggacgcccacatccagcagatggccaagaacaagttcaacgccaagcaggccaagcaggccgagctggactactgcagactgaccgaggccctggtggccgagaaggagaaggagttccaggactacgccagagaggtgatcgagctggagagcgagaccaccaacaagtacatctaccccctggtgaaggccgtgcaggagggccccggcggcggcagaggccccgtgttcgtggacagaggcggcctgagacccagctaccaggccaacgacgtgaccggcgtgcagctgcccttctacaacagccagggccccaagtacaacttccagaagagcaagagaagactgggcttcacctggtag

SEQ ID NO: 19114 - DNA, 2679 bp, Artificial Sequence
  Description of Artificial Sequence: Synthetic coding sequence
atgcactggctggccagcgccacccagaccagcgccagcatcgtgagcagcagcctgctgagcgccgtggacgtgagcagcagcctgaccatgagcgagtacttccagaacaccagcctgcccggcaccgccaacagcagacagttcagcctgcccgtggtgagcaacgccgccttcctgaccggcagcatcagcaacttcagcagagccagcgcccccgccatcagcagcgcctggctgcagcccagcgccagcggcaccagcttccagcccctgatgggcagcgcctacctgtaccagcacagcagcaccaccatgctgagcggcgtgaccggccagagccacatctgcaccagcgccgccagctaccccggcgtgttcgagtgggacagcaccgccagcaccgtgaagaagagcagcagcctgagagacttcaccgtgaccgtgatcgaccagaacaccgccgtgagcagcatgagcatgaccgcccagtactacaagaccagcgacaccaacaccatggtgcccctgtaccccagcctgagcgccagcctggtgcagggcaccctgacccagatccccaaccagcagggccacaacctgagcctgccctgccagatcggcagccaggtgtactactacaaccagggcaccctgggcccccagctgagctgcctgcagagctacggcagcgtgagctacaccggctacagagccagcgcccaccagcccgagatggtgatggtgctgaaggaggtgcagcccaccaacgtgctgccccccgtgagcaccagcggcatgtactacagcgtgagcagccagcccatcaccgagaccagcgtgcaggtgatggagaccagcctgggcatggacaccagcctgggcctgcagagccccagccagaccttctgcctgccccagacccccgagttcagcaagagcttcagcagcagaaacacccagaccctggagagcaaccccagccccgagctgggcgacatcagcatcacccccgtgcagagccccaccaacctgctgaccctgagccccgcccccagccaggagaagaacgagaacgagaacctggacgagatcaagaccaacctgagcagaaaccaggacccccccctgctgcccgtggagatccccgacatccaccccctgctggcctgcatcgaccccctgggccaggaggagcagcccggcagcgagaacgccaacctgagaaacaagagcctgagcctggaggaccagggcatcttcgagaacggcatcgagagcagcagcgacctggccgacatcaccacctgggtggaggacacctacctgccccccatcttcagcagcctgcaggacctggaccagcccgagaagagctgcgtgatcaagggccacagcgaccaggtgagaaagaacaagcacaaggccagcgagcccatccagggcgcccccaaggccaagatccagcccaagaaccccgagtgcctgctggagagagaggtggtggtgggcagcgccaccgtgagcaacagcgccagcgtgaacaaggccaagcacagcagcaacaagccccacaaggccgccagcagcagaatcagcaagaccaagagccacggccaggagaagaccaagggcaacagaaagaacagcagcaagaagagcgaggagagcaagcagagcggcaagaaggtgaaggtggaggagaagcagaccatccccaacatgaagagaaagaagaaccagcccgagctgagccagaagaccctgaagaagcccagaagcagcctgggcatgcacatgctggagagcgtgcaggtgttccacgccctgggcaagaagatcgacatgaagaccggcttcagcagcagcagaaccctgggcagcagcagcaacacccagaacagacagcccttccccgccctgaagccctggctggacatccagcacgagggcaagggccccgagaagatccaggtgaaggcccagaagctggacggcagcgccgagaaggagtgcaccagccccagccacagcgagctgcccccccccggcaaggtgaagctgatccccctgcccttcctgaccctggaccagccccaggccagacacgtgagcagaagacccaaccccctggccagcagaagacccgccgtggcctaccccgccagacccgacagcaccaacagcgcccagagcaacgccgtgaaccccagcagacccgcccccaccaacaccagcctgaccggccccgccacccccgcccagcccatcagcgccaaggccacccagcccagcagcgccaaccccacccagcccaccgtgccccagagcgccgccagcagacccagcgcctacaagaccagcagctgcagcagcctgcagagagagcccgtgagcaccgccgtgaccagcctgagaagcctgcccaagccccagaaccagttcctgatccaggacttcagcctgcagcccagaccctggagaaagcccaccgtgcccgagcccgtgatgagcacccccatcaccgaggagcagagacccgagagagaggccatgaagagaaaggcccagcaggagagagagaacgccgccaagtacaccagcctgggcaaggtgcagttcttcatcgagagagagagagacatggagatcgccgagtactacggctacaccatctag

SEQ ID NO: 19115 - DNA, 2769 bp, Artificial Sequence
  Description of Artificial Sequence: Synthetic coding sequence
atgcactggctggccagcgccacccagaccagcgccagcatcgtgagcagcagcctgctgagcgccgtggacgtgagcagcagcctgaccatgagcgagtacttccagaacaccagcctgcccggcaccgccaacagcagacagttcagcctgcccgtggtgagcaacgccgccttcctgaccggcagcatcagcaacttcagcagagccagcgcccccgccatcagcagcgcctggctgcagcccagcgccagcggcaccagcttccagcccctgatgggcagcgcctacctgtaccagcacagcagcaccaccatgctgagcggcgtgaccggccagagccacatctgcaccagcgccgccagctaccccggcgtgttcgagtgggacagcaccgccagcaccgtgaagaagagcagcagcctgagagacttcaccgtgaccgtgatcgaccagaacaccgccgtgagcagcatgagcatgaccgcccagtactacaagaccagcgacaccaacaccatggtgcccctgtaccccagcctgagcgccagcctggtgcagggcaccctgacccagatccccaaccagcagggccacaacctgagcctgccctgccagatcggcagccaggtgtactactacaaccagggcaccctgggcccccagctgagctgcctgcagagctacggcagcgtgagctacaccggctacagagccagcgcccaccagcccgagatggtgatggtgctgaaggaggtgcagcccaccaacgtgctgccccccgtgagcaccagcggcatgtactacagcgtgagcagccagcccatcaccgagaccagcgtgcaggtgatggagaccagcctgggcatggacaccagcctgggcctgcagagccccagccagaccttctgcctgccccagacccccgagttcagcaagagcttcagcagcagaaacacccagaccctggagagcaaccccagccccgagctgggcgacatcagcatcacccccgtgcagagccccaccaacctgctgaccctgagccccgcccccagccaggagaagaacgagaacgagaacctggacgagatcaagaccaacctgagcaagcccctggacgtgcaccagatcctgatcggcaaccaggacccccccctgctgcccgtggagatccccgacatccaccccctgctggcctgcatcgaccccctgggccaggaggagcagcccggcagcgagaacgccaacctgagaaacaagagcctgagcctggaggaccagggcatcttcgagaacggcatcgagagcagcagcgacctggccgacatcaccacctgggtggaggacacctacctgccccccatcttcagcagcctgcaggacctggaccagcccgagagccccagcgccaagaaggccaaggacaccagcgccatcaaggtgaaccaggtgcaggagaagagctgcgtgatcaagggccacagcgaccaggtgagaaagaacaagcacaaggccagcgagcccatccagggcgcccccaaggccaagatccagcccaagaaccccgagtgcctgctggagagagaggtggtggtgggcagcgccaccgtgagcaacagcgccagcgtgaacaaggccaagcacagcagcaacaagccccacaaggccgccagcagcagaatcagcaagaccaagagccacggccaggagaagaccaagggcaacagaaagaacagcagcaagaagagcgaggagagcaagcagagcggcaagaaggtgaaggtggaggagaagcagaccatccccaacatgaagagaaagaagaaccagcccgagctgagccagaagaccctgaagaagcccagaagcagcctgggcatgcacatgctggagagcgtgcaggtgttccacgccctgggcaagaagatcgacatgaagaccggcttcagcagcagcagaaccctgggcagcagcagcaacacccagaacagacagcccttccccgccctgaagccctggctggacatccagcacgagggcaagggccccgagaagatccaggtgaaggcccagaagctggacggcagcgccgagaaggagtgcaccagccccagccacagcgagctgcccccccccggcaaggtgaagctgatccccctgcccttcctgaccctggaccagccccaggccagacacgtgagcagaagacccaaccccctggccagcagaagacccgccgtggcctaccccgccagacccgacagcaccaacagcgcccagagcaacgccgtgaaccccagcagacccgcccccaccaacaccagcctgaccggccccgccacccccgcccagcccatcagcgccaaggccacccagcccagcagcgccaaccccacccagcccaccgtgccccagagcgccgccagcagacccagcgcctacaagaccagcagctgcagcagcctgcagagagagcccgtgagcaccgccgtgaccagcctgagaagcctgcccaagccccagaaccagttcctgatccaggacttcagcctgcagcccagaccctggagaaagcccaccgtgcccgagcccgtgatgagcacccccatcaccgaggagcagagacccgagagagaggccatgaagagaaaggcccagcaggagagagagaacgccgccaagtacaccagcctgggcaaggtgcagttcttcatcgagagagagagagacatggagatcgccgagtactacggctacaccatctag

SEQ ID NO: 19116 - DNA, 582 bp, Artificial Sequence
  Description of Artificial Sequence: Synthetic coding sequence
atggagagaagactgatcaagaaggagatgaagaagctgctgggcgactacatcggcatcagactgagagagaacgagttcgaccccaagggcagaagacagctgaccttcctggacgacatggcccactacgacctggccatcagcgtggccctgcagtggctggaccccagcgaggacctgacctggctggagtgggaggagctgaagatccccctgcacggcagacccatctaccccaacagaagagagagagaggccatgatcctgagcagctacgccggcatcctgatgaacagcatccccatcgaggaggtgttcaagatctacggcgccgacagcagcgccgacagcggcaccatcaaggtgcccagagtgagcagcctgtgcctgagcctgcaccccttcgccatgctgaccgcccccaaggccgccgcctacgccagaaagcagagcgtgaagagcagaaaggtgaccaccaacaagaacgccaccagcatcagcgccaaggaggccaacgccaccgagtggaagagcagccagagattcagcgacacccagcccaagcacaaggtgacctag

SEQ ID NO: 19117 - DNA, 201 bp, Artificial Sequence
  Description of Artificial Sequence: Synthetic coding sequence
atggagagaagactgatcaagaaggagatgaagaagctgctgggcgactacatcggcatcagactgagagagaacgagttcgaccccaagggcagaagacagctgaccttcctggacgacatggcccactacgacctggccatcagcgtggccctgcagtggctggaccccagcgaggacctgacctggctggagtggtag

SEQ ID NO: 19118 - DNA, 1767 bp, Artificial Sequence
  Description of Artificial Sequence: Synthetic coding sequence
atggagatgcagagccccatcgtgcagagacaggagagacaggtgagagacagaggcgtgaccagaagcaaggccgagaaggtgagaccccccaccgtgcccgtgccccaggtggacatcgtgcccggcagactgagcgaggccgagtggatggccctgaccgccctggaggagggcgaggacgtggtgggcgacatcctggccgacctgctggccagagtgatggacagcgccttcaaggtgtacctgacccagcagtgcatccccttcaccatcagccaggccagagaggccatgctgcagatcaccgagtggagattcctggccagagacgagggcgagagcgccgtggccgaggaccccacctggggcgaggacgaggagcccagcgcctgcaccaccgacagctgggcccagggcagcgtgcccgtgctgcacgccagcaccagcgagggcctggagaacttccagggcgaggaccccggcggcgtggacagaatccccctgggcagaagctggatgggcagaggcagccaggagcagatggagagctgggagcccagcccccagctgagagtgaccagcgcccccccccccaccagcgagctgttccaggaggccggccccggcggccccgtggaggaggccgacggccagagcagaggcctgagcagcgccggcagcctgagcgccagcttccagctgagcgtggaggaggcccccgccgacgacgccgaccccagcctggacccctacctggtggccagcccccaggccagcaccggcagaggccaccccctgggcttccacctgagcctggaggacctgtactgctgcatgccccagctggacgccgccggcgacagactggagctgagaagcgagggcgtgccctgcatcgccagcggcgtgctggtgagctaccccagcgtgggcggcgccaccagacccagcgccagctgccagcagcagagagccggccacagcgacgtgagactgagcgcccaccaccacagaatgagaagaaaggccgccgtgaagagactggaccccgccagactgccctgccactgggtgagacccctggccgaggtgctggtgcccgacagccagaccagacccctggaggcctacagaggcagacagagaggcgagaagaccaaggccagagccgagccccaggccctgggccccggcaccagagtgagccccgccgccttcttccccctgagacccggcatccccttcagagacctggacagcggccccgccctgctgttccccaccctgaacctgggcctgagcagccccagcctggagagcaagctgcccctgcccaacagcagaatcagattcctgaccacccaccccgtgctgcccgacgtggccagaagcagaagccccaagctgtggcccagcgtgagatggcccagcggctgggagggcaaggccgagctgctgggcgagctgtgggccggcagaaccagagtgcccccccagggcctggagctggccgacagagagggccaggaccccggcagatggcccagaaccaccccccccgtgctggaggccaccagccaggtgatgtggaagcccgtgctgctgcccgaggccctgaagctggcccccggcgtgagcatgtggaacagaagcacccaggtgctgctgagcagcggcgtgcccgagcaggaggacaaggagggcagcaccttcccccccgtggagcagcaccccatccagaccggcgcccccaagcccagatag

SEQ ID NO: 19119 - DNA, 63 bp, Artificial Sequence
  Description of Artificial Sequence: Synthetic coding sequence
atggccagctgcctggccctgagaatggccctgctgctggtgagcggcgtgctggccccctag

SEQ ID NO: 19120 - DNA, 453 bp, Artificial Sequence
  Description of Artificial Sequence: Synthetic coding sequence
atggaggactacgccctgaccttcggcatcaaccccttcatcgccctgatgatccagcccatcgtgaccatgaccgtggtggacaaccagggcctgggcctgcccgtggacatccagcacaaggccaagcccagccccaaggccagccagatgctgccccccgacctgggcccccccagcttccagaacctgctgagccccagcgagaagctggagccctgggaccccggcatgagaaagctgaccgtgcagacctgcggcctgaccttcatccaccccgccggccacggcctgtgccaccccaccgccgaggccagcgccgagaccctgagcagcaccgccctgaacagacccagcgtgagagagggcgcctgcaacgagaagagcaccgagaacaagaagccccaggacagcgtgctgtggagccacagcagatggttccagggcaactag

SEQ ID NO: 19121 - DNA, 291 bp, Artificial Sequence
  Description of Artificial Sequence: Synthetic coding sequence
atggaggactacgccctgaccttcggcatcaaccccttcatcgccctgatgatccagcccatcgtgaccatgaccgtggtggacaaccagggcctgggcctgcccgtggacatccagcacaaggccaagcccagccccaaggccagccagatgctgccccccgacctgggcccccccagcttccagaactgcttcacctgcagaaccgcccccagcctggtgatggtgctgagctggaagagcggcgtgagaagagaggtgcccgtgcaccccagctacgccaagtactag

SEQ ID NO: 19122 - DNA, 621 bp, Artificial Sequence
  Description of Artificial Sequence: Synthetic coding sequence
atggccgccaccaagaccgccagctacgacgagcacttcagacccgagaagctgagagagtggcccgagcccgagagcgtgagcctgatggaggtgctggccagagaggacatcgacgaggccgtgtgcgccatcctgttcaaggagaacagcatcgtgaaggtgaccgtgccccccttcgtggaccccctgttccagagacagcaggaggtggacgaggagagaagaaccggcctgcagtgcgagaccggcaagagacacagcatcaaggagctggaggagatcgagaaggccagactgcacgccagcagcccctacttcaccttcaccagccactgcgtgatccccaaggagtggcacaaggccagcgccagagccagaagcaagacctacaagtacagccccgagaagctgatctacgccgacaagaagcagaagagaaaggagaagaagaccgccgacctgagccaggccgccttcgagagacagttcctgagcagcaagctgagccagaagaacaaggtgggcgagagaaagggcctggtgagcagaggcctgggcagaggctggcacgccggcctgtgcagcacccacgagcagcacatcctggtgcccgagtag

SEQ ID NO: 19123 - DNA, 288 bp, Artificial Sequence
  Description of Artificial Sequence: Synthetic coding sequence
atgggctgcatgaagagcaagcagaccttccccttccccaccatctacgagggcgagaagcagcacgagagcgaggagcccttcatgcccgaggagagatgcctgcccagaatggccagccccgtgaacgtgaaggaggaggtgaaggagccccccggcaccaacaccgtgatcctggagtacgcccacagactgagccaggacatcctgtgcgacgccctgcagcagtgggcctgcaacaacatcaagtaccacgacatcccctacatcgagagcgagggcccctag

SEQ ID NO: 19124 - DNA, 288 bp, Artificial Sequence; identical to SEQ ID NO: 19123
  Description of Artificial Sequence: Synthetic coding sequence

SEQ ID NO: 19125 - DNA, 204 bp, Artificial Sequence
  Description of Artificial Sequence: Synthetic coding sequence
atgggctgcatgaagagcaagcagaccttccccttccccaccatctacgagggcgagaagcagcacgagagcgaggagcccttcatgcccgaggagagatgcctgcccagaatggccagccccgtgaacgtgaaggaggaggtgaaggagccccccggcaccaacaccgtgatcctggagtacgcccacagactgagccagtag

SEQ ID NO: 19126 - DNA, 288 bp, Artificial Sequence; identical to SEQ ID NO: 19123
  Description of Artificial Sequence: Synthetic coding sequence

SEQ ID NO: 19127 - DNA, 288 bp, Artificial Sequence; identical to SEQ ID NO: 19123
  Description of Artificial Sequence: Synthetic coding sequence

SEQ ID NO: 19128 - DNA, 93 bp, Artificial Sequence
  Description of Artificial Sequence: Synthetic coding sequence
atgggctgcatgaagagcaagcagaccttccccttccccaccatctacgagggcgagaagcagcacgagagcgaggagcccttcatgccctag

SEQ ID NO: 19129 - DNA, 396 bp, Artificial Sequence
  Description of Artificial Sequence: Synthetic coding sequence
atggtgagaatgagcagacccctgttcctggactgggcctggagacccctgtgcagccccagccagagcctgcccctgacctacggccccgagggctggatcctgcagtggaagggcacctgcagacagcagaccgccctgcactgccccttcgacttcccccaggcccccctgagaggcagacacaccctgagccaggtgcccaacaagggccacgagaaggccagcgccgtgcagctgcccgagaagcagggcaccgaccagagcagaagaggccccaccagcgccgtgaccaaggccagaaccagctaccccgagagcgagaccttcatcgtgtacctgtgcagctacttctggaacagcagcaagggcgtgtacatgagcggcagcacctag

SEQ ID NO: 19130 - DNA, 879 bp, Artificial Sequence
  Description of Artificial Sequence: Synthetic coding sequence
atgaagagcgaggccaaggacggcgaggaggagagcctgcagaccgccttcaagaagctgagagtggacgccagcggcagcgtggccagcctgagcgtgggcgagggcaccggcgtgagagcccccgtgagaaccgccaccgacgacaccaagcccaagaccacctgcgccagcaaggacagctggcacggcagcaccagaaagagcagcagaggcgccgtgagaacccagagaagaagaagaagcaagagccccgtgctgcacccccccaagttcatccactgcagcaccatcgccagcagcagcagcagccagctgaagcacaagagccagaccgacagccccgacggcagcagcggcctgggcatcagcagccccaaggagttcagcgccggcgagagcagcaccagcctggacgccaaccacaccggcgccgtggtggagcccctgagaaccagcgtgcccagactgcccagcgagagcaagaaggaggacagcagcgacgccacccaggtgccccaggccagcctgaaggccagcgacctgagcgacttccagagcgtgagcaagctgaaccagggcaagccctgcacctgcatcggcaaggagtgccagtgcaagagatggcacgacatggaggtgtacagcttcagcggcctgcagagcgtgccccccctggcccccgagagaagaagcaccctggaggactacagccagagcctgcacgccagaaccctgagcggcagccccagaagctgcagcgagcaggccagagtgttcgtggacgacgtgaccatcgaggacctgagcggctacatggagtactacctgtacatccccaagaagatgagccacatggccgagatgatgtacacctag

SEQ ID NO: 19131 - DNA, 879 bp, Artificial Sequence; identical to SEQ ID NO: 19130
  Description of Artificial Sequence: Synthetic coding sequence

SEQ ID NO: 19132 - DNA, 528 bp, Artificial Sequence
  Description of Artificial Sequence: Synthetic coding sequence
atgggccaggtggtgtacgtgcccgtgaagaccggcagcggcgccgacggcctgagcgagcccgagggcatcagcctgaagagagtggccgtggtggaggacttcttcgacatcatctacagcatgcacgtggagagcagcgccgagcccggcaaggcccccaagcacgccggccagaagaagacctacagagccatcgccgagacctacgccttcctgcccagagaggccgtgaccagattcctgatgagctgcaccgagtgccagaagagaatgcacttcaacagcaacggcctggagcccaaggagaacgagccccccagccccctggtgagcggcatcatcgactacaacatgcccctgaccagcacctacctgaagcagatgaagctgagagtgatgaacagccaggagcagtgcctgcccagcggcgccgaggacatcatgagcggcggccccaccctggaggccgccgagttcgacgacctgatcggcaagtgcctgcccgacagacccatcgccgagtag

SEQ ID NO: 19133 - DNA, 276 bp, Artificial Sequence
  Description of Artificial Sequence: Synthetic coding sequence
atgagcgacagcacctggatgagcgccgacccccacctggccagcagcctgagccccagccaggacgagagaatgagaagcccccagaacctgcacagccaggaggacggcccccacagactgagccacctgagccagggcctgaacatcatctgcagcctggacaccagcctgagagccagaaaccccagagtgagcgccgagagaaacgacttcagcttcagaggcagaagcagatgcgtgaccagcaacagcctggccaaggacggctactag

SEQ ID NO: 19134 - DNA, 1311 bp, Artificial Sequence
  Description of Artificial Sequence: Synthetic coding sequence
atgagcgacagcacctggatgagcgccgacccccacctggccagcagcctgagccccagccaggacgagagaatgagaagcccccagaacctgcacagccaggaggacgacgacagcagcagcgagagcggcagcggcaacggcagcagcaccctgaaccccagcaccagcagcagcacccagggcgaccccgccttccccgagatgaacggcaacggcgccgtggcccccatggacttcaccaccgccgccgaggaccagcccatcaacctgtgcgacaagctgccccccgccaccgccctgggcaccgccagctaccccagcgacggctgcggcgccgacggcctgagaagcagagtgaagtacggcgtgaagaccacccccgagagccccccctacagcagcggcagctacgacagcatcaagaccgaggtgagcggctgccccgaggacctgaccgtgggcagagcccccaccgccgacgacgacgacgacgaccacgacgaccacgaggacaacgacaagatgaacgacagcgagggcatggaccccgagagactgaaggccttcaacatgttcgtgagactgttcgtggacgagaacctggacagaatggtgcccatcagcaagcagcccaaggagaagatccaggccatcatcgagagctgcagcagacagttccccgagttccaggagagagccagaaagagaatcagaacctacctgaagagctgcagaagaatgaagaagaacggcatggagatgaccagacccacccccccccacctgaccagcgccatggccgagaacatcctggccgccgcctgcgagagcgagaccagaaaggccgccaagagaatgagactggagatctaccagagcagccaggacgagcccatcgccctggacaagcagcacagcagagacagcgccgccatcacccacagcacctacagcctgcccgccagcagctacagccaggaccccgtgtacgccaacggcggcctgaactacagctacagaggctacggcgccctgagcagcaacctgcagccccccgccagcctgcagaccggcaaccacagcaacggccccaccgacctgagcatgaagggcggcgccagcaccaccagcaccacccccacccccacccccagcagcaccagcaccagcagacccgtgcccaccgcccagctgagccccaccgagatcagcgccgtgagacagctgatcgccggctacagagagagcgccgccttcctgctgagaagcgccgacgagctggagaacctgatcctgcagcagaactag

SEQ ID NO: 19135 - DNA, 246 bp, Artificial Sequence
  Description of Artificial Sequence: Synthetic coding sequence
atgagctgcaccgagtgccagaagagaatgcacttcaacagcaacggcctggagcccaaggagaacgagccccccagccccctggtgagcggcatcatcgactacaacatgcccctgaccagcacctacctgaagcagatgaagctgagagtgatgaacagccaggagcagcccagcagcctgagccccgcccccggcttcgtgaacaccgtgatcaccgtgctgatctgcgcccacgaggagtag

SEQ ID NO: 19136 - DNA, 342 bp, Artificial Sequence
  Description of Artificial Sequence: Synthetic coding sequence
atgaagctgagagtgatgaacagccaggagcaggacgagaccagcgtgagcagcgaggacttcgacatgagcgacagcacctggatgagcgccgacccccacctggccagcagcctgagccccagccaggacgagagaatgagaagcccccagaacctgcacagccaggaggacggcccccacagactgagccacctgagccagggcctgaacatcatctgcagcctggacaccagcctgagagccagaaaccccagagtgagcgccgagagaaacgacttcagcttcagaggcagaagcagatgcgtgaccagcaacagcctggccaaggacggctactag

SEQ ID NO: 19137 - DNA, 468 bp, Artificial Sequence
  Description of Artificial Sequence: Synthetic coding sequence
atgcacgtggagagcagcgccgagcccggcaaggcccccaagcacgccggccagaagaagacctacagagccatcgccgagacctacgccttcctgcccagagaggccgtgaccagattcctgatgagctgcaccgagtgccagaagagaatgcacttcaacagcaacggcctggagcccaaggagaacgagccccccagccccctggtgagcggcatcatcgactacaacatgcccctgaccagcacctacctgaagcagatgaagctgagagtgatgaacagccaggagcaggacgagaccagcgtgagcagcgaggacttcgacatgagcgacagcacctggatgagcgccgacccccacctggccagcagcctgagccccagccaggacgagagaatgagaagcccccagaacctgcacagccaggaggacggcggcgtgtgcctgcagggccccaccgcctag

SEQ ID NO: 19138 - DNA, 1197 bp, Artificial Sequence
  Description of Artificial Sequence: Synthetic coding sequence
atgagcgacagcacctggatgagcgccgacccccacctggccagcagcctgagccccagccaggacgagagaatgagaagcccccagaacctgcacagccaggaggacgacgacagcagcagcgagagcggcagcggcaacggcagcagcaccctgaaccccagcaccagcagcagcacccagggcgaccccgccttccccgagatgaacggcaacggcgccgtggcccccatggacttcaccaccgccgccgaggaccagcccatcaacctgtgcgacaagctgccccccgccaccgccctgggcaccgccagctaccccagcgacggctgcggcgccgacggcctgagaagcagagtgaagtacggcgtgaagaccacccccgagagccccccctacagcagcggcagctacgacagcatcaagaccgaggtgagcggctgccccgaggacctgaccgtgggcagagcccccaccgccgacgacgacgacgacgaccacgacgaccacgaggacaacgacaagatgaacgacagcgagggcatggaccccgagagactgaaggccttcaacatgttcgtgagactgttcgtggacgagaacctggacagaatggtgcccatcagcaagcagcccaaggagaagatccaggccatcatcgagagctgcagcagacagttccccgagttccaggagagagccagaaagagaatcagaacctacctgaagagctgcagaagaatgaagaagaacggcatggagatgaccagacccacccccccccacctgaccagcgccatggccgagaacatcctggccgccgcctgcgagagcgagaccagaaaggccgccaagagaatgagactggagatctaccagagcagccaggacgagcccatcgccctggacaagcagcacagcagagacagcgccgccatcacccacagcacctacagcctgcccgccagcagctacagccaggaccccgtgtacgccaacggcggcctgaactacagctacagaggctacggcgccctgagcagcaacctgcagccccccgccagcctgcagaccggcaaccacagcaacggccccaccgacctgagcatgaagggcggcgccagcaccaccagcaccacccccacccccagactgggcgcccccctgaccagaagatggggctgcagcagcgtgtag

SEQ ID NO: 19139 - DNA, 231 bp, Artificial Sequence
  Description of Artificial Sequence: Synthetic coding sequence
tgacagaagagaatgcacttcaacagcaacggcctggagcccaaggagaacgagccccccagccccctggtgagcggcatcatcgactacaacatgcccctgaccagcacctacctgaagcagatgaagctgagagtgatgaacagccaggagcagcccagcagcctgagccccgcccccggcttcgtgaacaccgtgatcaccgtgctgatctgcgcccacgaggagtag

SEQ ID NO: 19140 - DNA, 648 bp, Artificial Sequence
  Description of Artificial Sequence: Synthetic coding sequence
atgagaggcctgagatggagatacaccagactgcccagccaggtggaggacaccctgagcggcgaggagggcaacgaggaggaggaggaggaggaggccgcccccgaccccgccgccgcccccgaggaccccaccgtgccccagctgaccgaggccagccaggtgctgagcgccagcgagatcagacagctgagcttccacttcccccccagagtgaccggccacccctggagcctggtgttctgcaccagcagagacggcttcagcctgcagagcctgtacagaagaatggagggctgcagcggccccgtgctgctggtgctgagagaccaggacggccagatcttcggcgccttcagcagcagcgccatcagactgagcaagggcttctacggcaccggcgagaccttcctgttcagcttcagcccccagctgaaggtgttcaagtggaccggcagcaacagcttcttcgtgaagggcgacctggacagcctgatgatgggcagcggcagcggcagattcggcctgtggctggacggcgacctgttcagaggcggcagcagcccctgccccaccttcaacaacgaggtgctggccagacaggagcagttctgcatccaggagctggaggcctggctgctgagctag

SEQ ID NO: 19141 - DNA, 3210 bp, Artificial Sequence
  Description of Artificial Sequence: Synthetic coding sequence
tgagtggccggcacccccaccagcagccagcccagcttcggccccagcatcagagagagacccagccagagcctgtgcccctgcccctgccccgccggcgagggcgaccccgcctggcccgccctggagagaagactggtgaccagcagaggcagacagcccagcccccagagccacgcccagctgctgaccagaagaagacacagcagcgagcaggtgccccccgagagcgagcccagagccgacttcagaagcggcaagtggctgcaggagcccgccaccggcgacgccagagacagcagacaggccctgagagccagaatgagcagcaagcacagaatctgcagccaggaggaggtggtgatcccctgcgcctacgacagcgacagcgagagcgtggacctggagctgagcaacctggagatcatcaagaagggcagcagcagcatcgagctgaccgacctggacatccccgacatccccggcctgcactgcgagcccctgagccacagccccagacacctgacccagcaggaccccctgagcgaggccatcgtggagaagctgatccagagcatccagaaggtgttcaacggcgagctgaagggcgagctggagaagctgaagttcctgggcgacctgagcagcctgagccaggccctgccctacgacgagaccgccaagagcttcatccacagccacatcgccgacatcgtgcacaccctgaacgtgctggtgcaggaggagagaccccacagcctgagcagcagcatgagacaggaggtgttcgtgaccatcgccgacctgagctaccaggacgtgcacctgctgctgggcagcgaggacagagccgagctgttcagcctgaccatcaagagcatcatcaccctgcccagcgtgagaaccctgacccagatccaggagatcatgcccaacggcacctgcaacaccgagtgcctgtacagacagaccttccaggccttcagcgagatgctgcagagcctggtggtgaaggacccccacctggagaacctggacaccatcatcaagcacctggtgccctggctgcagagcgtgaaggaccacgagagagagagagccaccgccagcatggcccaggtgctgaagtgcctgagcaagcacctgaacctgaagctgcccctgagattccagagactgggccacctggtggccctgatggccctgctgtgcggcgacccccaggagaaggtggccgaggaggccgccgagggcatccacagcctgctgcacatcaccctgagactgaagtacatcacccacgacaagaaggaccagcagaacctgaagagagccctgaccaagtgcagagagttcctggagctgcacagcagcgccgccaagtgcttctacaactgccccttcagaatcgcccaggtgttcgagggcttcctggacagcaacgagctgtgccagttcatcatgaccaccttcgacaccctgaagaccctgaagcacccctgcatccagagaagcgccggcgagctgctgctgaccctggccaagaacaccgagagccagttcgagaaggtgcccgagatcatgggcgtgatctgcgcccagctgagcatcatcagccagcccagagtgagacagcagatcatcaacaccgtgagcctgttcatcagcagacccaagtacaccgacatcgtgctgagcttcctgctgtgccaccccgtgccctacaacagacacctggccgaggtgtggagaatgctgagcgtggagctgcccagcaccacctggatcctgtggagactgctgagaaagctgcagaagtgccacaacgagcccgcccaggagaagatggcctacgtggccgtggccgccaccgacgccctgtacgaggtgttcctgggcaacagactgagagccgccaccttcagactgttcccccagctgctgatgaccctgctgatccagatccaccacagcatcggcctgaccatgagcgacgtggacatccccagcggcctgtacaccgagcaggaggtgcccagcgaggtgacccccctgtgcttcgccatgcaggccaccaagaccctgctgctgagaacctgctgcctgcaggagttcaacatcatggagaagaacaagggctgggccctgctgggcggcaaggacggccacctgcagggcctgttcctgctggccaacgccctgctggagagaaaccagctgctggcccagaaggtgatgtacctgctggtgcccctgctgaacagaggcaacgacaagcacaagctgaccagcgccggcttcttcgtggagctgctgagaagccccgtggccaagagactgcccagcatctacagcgtggccagattcaaggactggctgcaggacggcaaccacctgttcagaatcctgggcctgagaggcctgtacaacctggtgggccaccaggagatgagagaggacatcaagagcctgctgccctacatcgtggacagcctgagagagaccgacgagaagatcgtgctgagcgccatccagatcctgctgcagctggtgagaaccatggacttcaccaccctggccgccatgatgagaaccctgttcagcctgttcggcgacgtgagaagcgacgtgcacagattcagcgtgaccctgttcggcgccgccatcaagagcgtgaagaaccccgacaagaagagcatcgagaaccaggtgctggacagcctggtgcccctgctgctgtacagccaggacgagaacgacgccgtggccgaggagagcagacaggtgctgaccatctgcgcccagttcctgaagtggaagctgccccaggaggtgtacagcaaggacccctggcacatcaagcccaccgaggccggcaccatctgcagattcttcgagaagaagtgcaagggcaagatcaacatcctggagcagaccctgatgtacagcaagaaccccaagctgcccatcagaagaagcgccgtgctgttcgtgggcctgctgagcaagtacatggaccacaacgagctgagaagaatgggcaccgactggatcgaggacgacctgagagacctgctgtgcgaccccgagcccagcctgtgcatcatcgccagccagaccctgctgctggtgcagatggccagagccgagcccaagcccaagcagagagtgaactggctgcagaagctgatgggcagaagcagcgcctag

SEQ ID NO: 19142 - DNA, 1890 bp, Artificial Sequence
  Description of Artificial Sequence: Synthetic coding sequence
tgacagcccagacaggtggccggcacccccaccagcagccagcccagcttcggccccagcatcagagagagacccagccagagcctgtgcccctgcccctgccccgccggcgagggcgaccccgcctggcccgccctggagagaagactggtgaccagcagaggcagacagcccagcccccagagccacgcccagctgctgaccagaagaagacacagcagcgagcaggtgccccccgagagcgagcccagagccgacttcagaagcggcaagtggctgcaggagcccgccaccggcgacgccagagacagcagacaggccctgagagccagaatgagcagcaagcacagaatctgcagccaggaggaggtggtgatcccctgcgcctacgacagcgacagcgagagcgtggacctggagctgagcaacctggagatcatcaagaagggcagcagcagcatcgagctgaccgacctggacatccccgacatccccggcctgcactgcgagcccctgagccacagccccagacacctgacccagcaggaccccctgagcgaggccatcgtggagaagctgatccagagcatccagaaggtgttcaacggcgagctgaagggcgagctggagaagctgaagttcctgggcgacctgagcagcctgagccaggccctgccctacgacgagaccgccaagagcttcatccacagccacatcgccgacatcgtgcacaccctgaacgtgctggtgcaggaggagagaccccacagcctgagcagcagcatgagacaggaggtgttcgtgaccatcgccgacctgagctaccaggacgtgcacctgctgctgggcagcgaggacagagccgagctgttcagcctgaccatcaagagcatcatcaccctgcccagcgtgagaaccctgacccagatccaggagatcatgcccaacggcacctgcaacaccgagtgcctgtacagacagaccttccaggccttcagcgagatgctgcagagcctggtggtgaaggacccccacctggagaacctggacaccatcatcaagcacctggtgccctggctgcagagcgtgaaggaccacgagagagagagagccaccgccagcatggcccaggtgctgaagtgcctgagcaagcacctgaacctgaagctgcccctgagattccagagactgggccacctggtggccctgatggccctgctgtgcggcgacccccaggagaaggtggccgaggaggccgccgagggcatccacagcctgctgcacatcaccctgagactgaagtacatcacccacgacaagaaggaccagcagaacctgaagagagccctgaccaagtgcagagagttcctggagctgcacagcagcgccgccaagtgcttctacaactgccccttcagaatcgcccaggtgttcgagggcttcctggacagcaacgagctgtgccagttcatcatgaccaccttcgacaccctgaagaccctgaagcacccctgcatccagagaagcgccggcgagctgctgctgaccctggccaagaacaccgagagccagttcgagaaggtgcccgagatcatgggcgtgatctgcgcccagctgagcatcatcagccagcccagagtgagacagcagatcatcaacaccgtgagcctgttcatcagcagacccaagtacaccgacatcgtgctgagcttcctgctgtgccaccccgtgccctacaacagacacctggccgaggtgtggagaatgctgagcgtggagctgcccagcaccacctggatcctgtggagactgctgagaaagctgcagaagtgccacaacgagcccgcccaggagaagatggcctacgtggccgtggccgtgagcccctag

SEQ ID NO: 19143 - DNA, 3129 bp, Artificial Sequence
  Description of Artificial Sequence: Synthetic coding sequence
atgcccctgagcagaagaggcagaggcagcagactggccggcagcagagccgccaccagcaacctgcccagagccaccgccctgagccccaagcacgcccagctgctgaccagaagaagacacagcagcgagcaggtgccccccgagagcgagcccagagccgacttcagaagcggcaagtggctgcaggagcccgccaccggcgacgccagagacagcagacaggccctgagagccagaatgagcagcaagcacagaatctgcagccaggaggaggtggtgatcccctgcgcctacgacagcgacagcgagagcgtggacctggagctgagcaacctggagatcatcaagaagggcagcagcagcatcgagctgaccgacctggacatccccgacatccccggcctgcactgcgagcccctgagccacagccccagacacctgacccagcaggaccccctgagcgaggccatcgtggagaagctgatccagagcatccagaaggtgttcaacggcgagctgaagggcgagctggagaagctgaagttcctgggcgacctgagcagcctgagccaggccctgccctacgacgagaccgccaagagcttcatccacagccacatcgccgacatcgtgcacaccctgaacgtgctggtgcaggaggagagaccccacagcctgagcagcagcatgagacaggaggtgttcgtgaccatcgccgacctgagctaccaggacgtgcacctgctgctgggcagcgaggacagagccgagctgttcagcctgaccatcaagagcatcatcaccctgcccagcgtgagaaccctgacccagatccaggagatcatgcccaacggcacctgcaacaccgagtgcctgtacagacagaccttccaggccttcagcgagatgctgcagagcctggtggtgaaggacccccacctggagaacctggacaccatcatcaagcacctggtgccctggctgcagagcgtgaaggaccacgagagagagagagccaccgccagcatggcccaggtgctgaagtgcctgagcaagcacctgaacctgaagctgcccctgagattccagagactgggccacctggtggccctgatggccctgctgtgcggcgacccccaggagaaggtggccgaggaggccgccgagggcatccacagcctgctgcacatcaccctgagactgaagtacatcacccacgacaagaaggaccagcagaacctgaagagagccctgaccaagtgcagagagttcctggagctgcacagcagcgccgccaagtgcttctacaactgccccttcagaatcgcccaggtgttcgagggcttcctggacagcaacgagctgtgccagttcatcatgaccaccttcgacaccctgaagaccctgaagcacccctgcatccagagaagcgccggcgagctgctgctgaccctggccaagaacaccgagagccagttcgagaaggtgcccgagatcatgggcgtgatctgcgcccagctgagcatcatcagccagcccagagtgagacagcagatcatcaacaccgtgagcctgttcatcagcagacccaagtacaccgacatcgtgctgagcttcctgctgtgccaccccgtgccctacaacagacacctggccgaggtgtggagaatgctgagcgtggagctgcccagcaccacctggatcctgtggagactgctgagaaagctgcagaagtgccacaacgagcccgcccaggagaagatggcctacgtggccgtggccgccaccgacgccctgtacgaggtgttcctgggcaacagactgagagccgccaccttcagactgttcccccagctgctgatgaccctgctgatccagatccaccacagcatcggcctgaccatgagcgacgtggacatccccagcggcctgtacaccgagcaggaggtgcccagcgaggtgacccccctgtgcttcgccatgcaggccaccaagaccctgctgctgagaacctgctgcctgcaggagttcaacatcatggagaagaacaagggctgggccctgctgggcggcaaggacggccacctgcagggcctgttcctgctggccaacgccctgctggagagaaaccagctgctggcccagaaggtgatgtacctgctggtgcccctgctgaacagaggcaacgacaagcacaagctgaccagcgccggcttcttcgtggagctgctgagaagccccgtggccaagagactgcccagcatctacagcgtggccagattcaaggactggctgcaggacggcaaccacctgttcagaatcctgggcctgagaggcctgtacaacctggtgggccaccaggagatgagagaggacatcaagagcctgctgccctacatcgtggacagcctgagagagaccgacgagaagatcgtgctgagcgccatccagatcctgctgcagctggtgagaaccatggacttcaccaccctggccgccatgatgagaaccctgttcagcctgttcggcgacgtgagaagcgacgtgcacagattcagcgtgaccctgttcggcgccgccatcaagagcgtgaagaaccccgacaagaagagcatcgagaaccaggtgctggacagcctggtgcccctgctgctgtacagccaggacgagaacgacgccgtggccgaggagagcagacaggtgctgaccatctgcgcccagttcctgaagtggaagctgccccaggaggtgtacagcaaggacccctggcacatcaagcccaccgaggccggcaccatctgcagattcttcgagaagaagtgcaagggcaagatcaacatcctggagcagaccctgatgtacagcaagaaccccaagctgcccatcagaagaagcgccgtgctgttcgtgggcctgctgagcaagtacatggaccacaacgagctgagaagaatgggcaccgactggatcgaggacgacctgagagacctgctgtgcgaccccgagcccagcctgtgcatcatcgccagccagaccctgctgctggtgcagatggccagagccgagcccaagcccaagcagagagtgaactggctgcagaagctgatgggcagaagcagcgcctag

SEQ ID NO: 19144 - DNA, 2013 bp, Artificial Sequence
  Description of Artificial Sequence: Synthetic coding sequence
tgatgcaacaccgagtgcctgtacagacagaccttccaggccttcagcgagatgctgcagagcctggtggtgaaggacccccacctggagaacctggacaccatcatcaagctgcccctgagattccagagactgggccacctggtggccctgatggccctgctgtgcggcgacccccaggagaaggtggccgaggaggccgccgagggcatccacagcctgctgcacatcaccctgagactgaagtacatcacccacgacaagaaggaccagcagaacctgaagagagccctgaccaagtgcagagagttcctggagctgcacagcagcgccgccaagtgcttctacaactgccccttcagaatcgcccaggtgcccgagatcatgggcgtgatctgcgcccagctgagcatcatcagccagcccagagtgagacagcagatcatcaacaccgtgagcctgttcatcagcagacccaagtacaccgacatcgtgctgagcttcctgctgtgccaccccgtgccctacaacagacacctggccgaggtgtggagaatgctgagcgtggagctgcccagcaccacctggatcctgtggagactgctgagaaagctgcagaagtgccacaacgagcccgcccaggagaagatggcctacgtggccgtggccgccaccgacgccctgtacgaggtgttcctgggcaacagactgagagccgccaccttcagactgttcccccagctgctgatgaccctgctgatccagatccaccacagcatcggcctgaccatgagcgacgtggacatccccagcggcctgtacaccgagcaggaggtgcccagcgaggtgacccccctgtgcttcgccatgcaggccaccaagaccctgctgctgagaacctgctgcctgcaggagttcaacatcatggagaagaacaagggctgggccctgctgggcggcaaggacggccacctgcagggcctgttcctgctggccaacgccctgctggagagaaaccagctgctggcccagaaggtgatgtacctgctggtgcccctgctgaacagaggcaacgacaagcacaagctgaccagcgccggcttcttcgtggagctgctgagaagccccgtggccaagagactgcccagcatctacagcgtggccagattcaaggactggctgcaggacggcaaccacctgttcagaatcctgggcctgagaggcctgtacaacctggtgggccaccaggagatgagagaggacatcaagagcctgctgccctacatcgtggacagcctgagagagaccgacgagaagatcgtgctgagcgccatccagatcctgctgcagctggtgagaaccatggacttcaccaccctggccgccatgatgagaaccctgttcagcctgttcggcgacgtgagaagcgacgtgcacagattcagcgtgaccctgttcggcgccgccatcaagagcgtgaagaaccccgacaagaagagcatcgagaaccaggtgctggacagcctggtgcccctgctgctgtacagccaggacgagaacgacgccgtggccgaggagagcagacaggtgctgaccatctgcgcccagttcctgaagtggaagctgccccaggaggtgtacagcaaggacccctggcacatcaagcccaccgaggccggcaccatctgcagattcttcgagaagaagtgcaagggcaagatcaacatcctggagcagaccctgatgtacagcaagaaccccaagctgcccatcagaagaagcgccgtgctgttcgtgggcctgctgagcaagtacatggaccacaacgagctgagaagaatgggcaccgactggatcgaggacgacctgagagacctgctgtgcgaccccgagcccagcctgtgcatcatcgccagccagaccctgctgctggtgcagatggccagagccgagcccaagcccaagcagagagtgaactggctgcagaagctgatgggcagaagcagcgcctag

SEQ ID NO: 19145 - DNA, 1803 bp, Artificial Sequence
  Description of Artificial Sequence: Synthetic coding sequence
tgacaccccagccccagacaccagcccagacaggtggccggcacccccaccagcagccagcccagcttcggccccagcatcagagagagacccagccagagcctgtgcccctgcccctgccccgccggcgagggcgaccccgcctggcccgccctggagagaagactggtgaccagcagaggcagacagcccagcccccagagccacgcccagctgctgaccagaagaagacacagcagcgagcaggtgccccccgagagcgagcccagagccgacttcagaagcggcaagtggctgcaggagcccgccaccggcgacgccagagacagcagacaggccctgagagccagaatgagcagcaagcacagaatctgcagccaggaggaggtggtgatcccctgcgcctacgacagcgacagcgagagcgtggacctggagctgagcaacctggagatcatcaagaagggcagcagcagcatcgagctgaccgacctggacatccccgacatccccggcctgcactgcgagcccctgagccacagccccagacacctgacccagcaggaccccctgagcgaggccatcgtggagaagctgatccagagcatccagaaggtgttcaacggcgagctgaagggcgagctggagaagctgaagttcctgggcgacctgagcagcctgagccaggccctgccctacgacgagaccgccaagagcttcatccacagccacatcgccgacatcgtgcacaccctgaacgtgctggtgcaggaggagagaccccacagcctgagcagcagcatgagacaggaggtgttcgtgaccatcgccgacctgagctaccaggacgtgcacctgctgctgggcagcgaggacagagccgagctgttcagcctgaccatcaagagcatcatcaccctgcccagcgtgagaaccctgacccagatccaggagatcatgcccaacggcacctgcaacaccgagtgcctgtacagacagaccttccaggccttcagcgagatgctgcagagcctggtggtgaaggacccccacctggagaacctggacaccatcatcaagctgcccctgagattccagagactgggccacctggtggccctgatggccctgctgtgcggcgacccccaggagaaggtggccgaggaggccgccgagggcatccacagcctgctgcacatcaccctgagactgaagtacatcacccacgacaagaaggaccagcagaacctgaagagagccctgaccaagtgcagagagttcctggagctgcacagcagcgccgccaagtgcttctacaactgccccttcagaatcgcccaggtgttcgagggcttcctggacagcaacgagctgtgccagttcatcatgaccaccttcgacaccctgaagaccctgaagcacccctgcatccagagaagcgccggcgagctgctgctgaccctggccaagaacaccgagagccagttcgagaaggtgcccgagatcatgggcgtgatctgcgcccagctgagcatcatcagccagcccagagtgagacagcagatcatcaacaccgtgagcctgttcatcagcagacccaagtacaccgacatcgtgctgagcttcctgctgtgccaccccgtgccctacaacagacacctggccgaggtgtggagaatgctgagcgtggagctgcccagcaccacctggatcctgtggagactgctgagaaagctgcagaagtgccacaacgagcccgcccaggagaagatggcctacgtggccgtggccgtgagcccctag

SEQ ID NO: 19146 - DNA, 75 bp, Artificial Sequence
  Description of Artificial Sequence: Synthetic coding sequence
atgagacaggaggtgttcgtgaccatcgccgacctgagctaccaggacgtgcacctgctgctgggcagcgagtag

SEQ ID NO: 19147 - DNA, 105 bp, Artificial Sequence
  Description of Artificial Sequence: Synthetic coding sequence
atgagacaggaggtgttcgtgaccatcgccgacctgagctaccaggacgtgcacctgctgctgggcagcgaggacagagccgagctgttcagcctgaccatctag

SEQ ID NO: 19148 - DNA, 2799 bp, Artificial Sequence
  Description of Artificial Sequence: Synthetic coding sequence
gccggcagcagagccgccaccagcaccagcagaggcgccctgagccagagccacgcccagctgctgaccagaagaagacacagcagcgagcaggtgccccccgagagcgagcccagagccgacttcagaagcggcaagtggctgcaggagcccgccaccggcgacgccagagacagcagacaggccctgagagccagaatgagcagcaagcacagaatctgcagccaggaggaggtggtgatcccctgcgcctacgacagcgacagcgagagcgtggacctggagctgagcaacctggagatcatcaagaagggcagcagcagcatcgagctgaccgacctggacatccccgacatccccggcctgcactgcgagcccctgagccacagccccagacacctgacccagcaggaccccctgagcgaggccatcgtggagaagctgatccagagcatccagaaggtgttcaacggcgagctgaagggcgagctggagaagctgaagttcctgggcgacctgagcagcctgagccaggccctgccctacgacgagaccgccaagagcttcatccacagccacatcgccgacatcgtgcacaccctgaacgtgctggtgcaggaggagagaccccacagcctgagcagcagcatgagacaggaggtgttcgtgaccatcgccgacctgagctaccaggacgtgcacctgctgctgggcagcgaggacagagccgagctgttcagcctgaccatcaagagcatcatcaccctgcccagcgtgagaaccctgacccagatccaggagatcatgcccaacggcacctgcaacaccgagtgcctgtacagacagaccttccaggccttcagcgagatgctgcagagcctggtggtgaaggacccccacctggagaacctggacaccatcatcaagcacctggtgccctggctgcagagcgtgaaggaccacgagagagagagagccaccgccagcatggcccaggtgctgaagtgcctgagcaagcacctgaacctgaagctgcccctgagattccagagactgggccacctggtggccctgatggccctgctgtgcggcgacccccaggagaaggtggccgaggaggccgccgagggcatccacagcctgctgcacatcaccctgagactgaagtacatcacccacgacaagaaggaccagcagaacctgaagagagccctgaccaagtgcagagagttcctggagctgcacagcagcgccgccaagtgcttctacaactgccccttcagaatcgcccaggtgttcgagggcttcctggacagcaacgagctgtgccagttcatcatgaccaccttcgacaccctgaagaccctgaagcacccctgcatccagagaagcgccggcgagctgctgctgaccctggccaagaacaccgagagccagttcgagaaggtgcccgagatcatgggcgtgatctgcgcccagctgagcatcatcagccagcccagagtgagacagcagatcatcaacaccgtgagcctgttcatcagcagacccaagtacaccgacatcgtgctgagcttcctgctgtgccaccccgtgccctacaacagacacctggccgaggtgtggagaatgctgagcgtggagctgcccagcaccacctggatcctgtggagactgctgagaaagctgcagaagtgccacaacgagcccgcccaggagaagatggcctacgtggccgtggccgccaccgacgccctgtacgaggtgttcctgggcaacagactgagagccgccaccttcagactgttcccccagctgctgatgaccctgctgatccagatccaccacagcatcggcctgaccatgagcgacgtggacatccccagcggcctgtacaccgagcaggaggtgcccagcgaggtgacccccctgtgcttcgccatgcaggccaccaagaccctgctgctgagaacctgctgcctgcaggagttcaacatcatggagaagaacaagggctgggccctgctgggcggcaaggacggccacctgcagggcctgttcctgctggccaacgccctgctggagagaaaccagctgctggcccagaaggtgatgtacctgctggtgcccctgctgaacagaggcaacgacaagcacaagctgaccagcgccggcttcttcgtggagctgctgagaagccccgtggccaagagactgcccagcatctacagcgtggccagattcaaggactggctgcaggacggcaaccacctgttcagaatcctgggcctgagaggcctgtacaacctggtgggccaccaggagatgagagaggacatcaagagcctgctgccctacatcgtggacagcctgagagagaccgacgagaagatcgtgctgagcgccatccagatcctgctgcagctggtgagaaccatggacttcaccaccctggccgccatgatgagaaccctgttcagcctgttcggcgacgtgagaagcgacgtgcacagattcagcgtgaccctgttcggcgccgccatcaagagcgtgaagaaccccgacaagaagagcatcgagaaccaggtgctggacagcctggtgcccctgctgctgtacagccaggacgagaacgacgccgtggccgaggagagcagacaggtgctgaccatctgcgcccagttcctgaagtggaagctgccccaggaggtgtacagcaaggacccctggcacatcaagcccaccgaggccggcaccatctgcagattcttcggcaagaaggtgcagggcgagaactag

SEQ ID NO: 19149 - DNA, 462 bp, Artificial Sequence
  Description of Artificial Sequence: Synthetic coding sequence
atgggcaactacagcagccacaagagaaccaaggcccccaagcaggccagaaaggagagacccgccgacatggacaaggcctggtggaagagcttcctgaaccacctgaccagaaagaagcccgccaccagaatcgtgctgatcctgcccctggacaagagacagcccctggccaacgccggccagagaatcgactacgccagcggcgccggcctgggcagccccgccgcccccagactgagaggcgccggcgagggcagcgagagagagcccagaatgcccgtgctgctgctgctgagaagacaggaggccagaagacccgaggagggcggcgccagagccgccctgagctggcccagactgctgagcagattcagaagccccggcaaggcccccagagaggccggccccgccgaggagcagcccagaaagagatgcagatgccccagaccccagctgtag

SEQ ID NO: 19150 - DNA, 1995 bp, Artificial Sequence
  Description of Artificial Sequence: Synthetic coding sequence
atggagagcttcatggagagcctgaacagactgaaggagatccacgagaaggaggtgctgggcctgcagaacaagctgctggagctgaacagcgagagatgcagagacgcccagagaatcgaggagctgttcagcaagaaccaccagctgagagagcagcagaagaccctgaaggagaacctgagagtgctggagaacagactgagagccggcctgtgcgacagatgcatggtgacccaggagctggccagaaagagacagcaggagttcgagagcagccacctgcagaacctgcagagaatcttcatcctgaccaacgagatgaacggcctgaaggaggagaacgagaccctgaaggaggaggtgaagagactgagaggcctgggcgacagacccaagcccagagccaaggagggcaccagcgacccccccagccccctgctgctgcccagccccggcggctggaaggccatcaccgagaagccccccggcggccacgaggaggccgaggaggaccaccagggcgtgggcctgagaggcgaggagaagcccgccggccacagaaccagccccgtggccaagatcagccccggcgccaccctgcccgagagcagagcccccgacatgagcccccagagaatcagcaaccagctgcacggcaccatcgccgtggtgagacccggcagccaggcctgccccgccgacagaggccccgccaacggcacccccccccccctgcccgccagaagcagcccccccagccccgcctacgagagaggcctgagcctggacagcttcctgagagccagcagacccagcgccatgacccacgaggcccccaagctgagccccaaggtggacagactgtgcctgctgaacagacccctgagcctgcacctgcagagcccccacagcagccccctggcccccgccgccgcccccagcgaccccagactgcaggacctgaaggccagagaggccgaggcctgggaggagcccaccgagctgctgggcctgcccagcgccctggccggcatgcaggacctgagactggagggcgccctgcacctgctgctggcccagcagcagctgagagccagagccagagccggcagcgtgagacccagaggccagcccacccccggcgagatgctgcccagcctgcccgtgggcagcgacagcgagggccccgagaacgagggcaccagagccgccctggccgccgccggcctgagcggcggcagacacacccagcccgccggccccggcagagcccagagaaccgaggccgccgccacccaggactgcgccctggacaagcccctggacctgagcgagtggggcagagccagaggccaggacacccccaagcccgccggccagcacggcagcctgagccccgccgccgcccacaccgccagccccgagccccccacccagagcggccccctgaccagaagcccccaggccctgagcaacggcaccaagggcaccagagtgcccgagcaggaggaggccagcacccccatggaccccagcagacccctgcccggcagccagctgagcctgagcagccccggcagcaccgaggacgaggacaccggcagacccctgccccccccccacccccagccccccccccacccccagccccccgacctggacggccaccccgagcccagcaaggccgaggtgctgagacccgagagcgacgagctggacgagaccgacacccccggcagcgaggtgggcctgagcagccaggccgaggccaccaccagcaccaccggcgagggccccgagtgcatctgcacccaggagcacggccagggcccccccagaaagagaaagagagccagcgagcccggcgacaaggccagcaagaagcccagcagaggcagaagaaagctgaccgccaccgagggccccggcagccccagagacgccgaggaccacagccccagccccaacagcagcccctgggaggagacctag

SEQ ID NO: 19151 - DNA, 1719 bp, Artificial Sequence
  Description of Artificial Sequence: Synthetic coding sequence
atgagaagacacatggtgacctacgcctggcagctgctgaagaaggagctgggcctgtaccagctggccatggacatcatcatcatgatcagagtgtgcaagatgttcagacagggcctgagaggcttcagagagtaccagatcatcgagaccgcccactggaagcaccccatcttcagcttctgggacaagaagatgcagagcagagtgaccttcgacaccatggacttcatcgccgaggagggccacttcccccccaaggccatccagatcatgcagaagaagcccagctggagaaccgaggacgagatccaggccgtgtgcaacatcctgcaggtgctggacagctacagaaactacgccgagcccctgcagctgctgctggccaaggtgatgagattcgagagattcggcagaagaagagtgatcatcaagaagggccagaagggcaacagcttctacttcatctacctgggcaccgtggccatcaccaaggacgaggacggcagcagcgccttcctggacccccaccccaagctgctgcacaagggcagctgcttcggcgagatggacgtgctgcacgccagcgtgagaagaagcaccatcgtgtgcatggaggagaccgagttcctggtggtggacagagaggacttcttcgccaacaagctggaccaggaggtgcagaaggacgcccagtacagattcgagttcttcagaaagatggagctgttcgccagctggagcgacgagaagctgtggcagctggtggccatggccaagatcgagagattcagctacggccagctgatcagcaaggacttcggcgagagccccttcatcatgttcatcagcaagggcagctgcgaggtgctgagactgctggacctgggcgccagccccagctacagaagatggatctggcagcacctggagctgatcgacggcagacccctgaagacccacctgagcgagtacagccccatggagagattcaaggagttccagatcaagagctaccccctgcaggacttcagcagcctgaagctgccccacctgaagaaggcctggggcctgcagggcaccagcttcagcagaaagatcagaaccagcggcgacaccctgcccaagatgctgggccccaagatccagagcagacccgcccagagcatcaagtgcgccatgatcaacatcaagcccggcgagctgcccaaggaggccgccgtgggcgcctacgtgaaggtgcacaccgtggagcagggcgagatcctggccttcctgcccgagggcgagtgcgacaccagacccctgatcctgatgagcctgggcaacgagctgatcagaatcagaaaggagatcttctacgagctgatcgacaacgacgacgagatgatcaagaagctgctgaagctgaacatcgccttccccagcgacgaggacatgtgccagaagttcctgcagcagaacagctggaacatcttcagaaaggacctgctgcagctgctggtggagccctgccagagccagctgttcacccccaacagacccaagaagagagagatctacaaccccaagagcgtggtgctggacctgtgcagcatcaacaagaccaccaagcccagataccccatcttcatggccccccagaagtacctgccccccctgagaatcgtgcaggccatcaaggcccccagatacaagatcagagagctgctggcctag

SEQ ID NO: 19152 - DNA, 1731 bp, Artificial Sequence
  Description of Artificial Sequence: Synthetic coding sequence
atgagaagacacatggtgacctacgcctggcagctgctgaagaaggagctgggcctgtaccagctggccatggacatcatcatcatgatcagagtgtgcaagatgttcagacagggcctgagaggcttcagagagtaccagatcatcgagaccgcccactggaagcaccccatcttcagcttctgggacaagaagatgcagagcagagtgaccttcgacaccatggacttcatcgccgaggagggccacttcccccccaaggccatccagatcatgcagaagaagcccagctggagaaccgaggacgagatccaggccgtgtgcaacatcctgcaggtgctggacagctacagaaactacgccgagcccctgcagctgctgctggccaaggtgatgagattcgagagattcggcagaagaagagtgatcatcaagaagggccagaagggcaacagcttctacttcatctacctgggcaccgtggccatcaccaaggacgaggacggcagcagcgccttcctggacccccaccccaagctgctgcacaagggcagctgcttcggcgagatggacgtgctgcacgccagcgtgagaagaagcaccatcgtgtgcatggaggagaccgagttcctggtggtggacagagaggacttcttcgccaacaagctggaccaggaggtgcagaaggacgcccagtacagattcgagttcttcagaaagatggagctgttcgccagctggagcgacgagaagctgtggcagctggtggccatggccaagatcgagagattcagctacggccagctgatcagcaaggacttcggcgagagccccttcatcatgttcatcagcaagggcagctgcgaggtgctgagactgctggacctgggcgccagccccagctacagaagatggatctggcagcacctggagctgatcgacggcagacccctgaagacccacctgagcgagtacagccccatggagagattcaaggagttccagatcaagagctaccccctgcaggacttcagcagcctgaagctgccccacctgaagaaggcctggggcctgcagggcaccagcttcagcagaaagatcagaaccagcggcgacaccctgcccaagatgctgggccccaagatccagagcagacccgcccagagcatcaagtgcgccatgatcaacatcaagcccggcgagctgcccaaggaggccgccgtgggcgcctacgtgaaggtgcacaccgtggagcagggcgagatcctgggcctgcaccaggccttcctgcccgagggcgagtgcgacaccagacccctgatcctgatgagcctgggcaacgagctgatcagaatcagaaaggagatcttctacgagctgatcgacaacgacgacgagatgatcaagaagctgctgaagctgaacatcgccttccccagcgacgaggacatgtgccagaagttcctgcagcagaacagctggaacatcttcagaaaggacctgctgcagctgctggtggagccctgccagagccagctgttcacccccaacagacccaagaagagagagatctacaaccccaagagcgtggtgctggacctgtgcagcatcaacaagaccaccaagcccagataccccatcttcatggccccccagaagtacctgccccccctgagaatcgtgcaggccatcaaggcccccagatacaagatcagagagctgctggcctag

SEQ ID NO: 19153 - DNA, 1272 bp, Artificial Sequence
  Description of Artificial Sequence: Synthetic coding sequence
atgagaagacacatggtgacctacgcctggcagctgctgaagaaggagctgggcctgtaccagctggccatggacatcatcatcatgatcagagtgtgcaagatgttcagacagggcctgagaggcttcagagagtaccagatcatcgagaccgcccactggaagcaccccatcttcagcttctgggacaagaagatgcagagcagagtgaccttcgacaccatggacttcatcgccgaggagggccacttcccccccaaggccatccagatcatgcagaagaagcccagctggagaaccgaggacgagatccaggccgtgtgcaacatcctgcaggtgctggacagctacagaaactacgccgagcccctgcagctgctgctggccaaggtgatgagattcgagagattcggcagaagaagagtgatcatcaagaagggccagaagggcaacagcttctacttcatctacctgggcaccgtggccatcaccaaggacgaggacggcagcagcgccttcctggacccccaccccaagctgctgcacaagggcagctgcttcggcgagatggacgtgctgcacgccagcgtgagaagaagcaccatcgtgtgcatggaggagaccgagttcctggtggtggacagagaggacttcttcgccaacaagctggaccaggaggtgcagaaggacgcccagtacagattcgagttcttcagaaagatggagctgttcgccagctggagcgacgagaagctgtggcagctggtggccatggccaagatcgagagattcagctacggccagctgatcagcaaggacttcggcgagagccccttcatcatgttcatcagcaagggcagctgcgaggtgctgagactgctggacctgggcgccagccccagctacagaagatggatctggcagcacctggagctgatcgacggcagacccctgaagacccacctgagcgagtacagccccatggagagattcaaggagttccagatcaagagctaccccctgcaggacttcagcagcctgaagctgccccacctgaagaaggcctggggcctgcagggcaccagcttcagcagaaagatcagaaccagcggcgacaccctgcccaagatgctgggccccaagatccagagcagacccgcccagagcatcaagtgcgccatgatcaacatcaagcccggcgagctgcccaaggaggccgccgtgggcgcctacgtgaaggtgcacaccgtggagcagggcgagatcctgtag

SEQ ID NO: 19154 - DNA, 1302 bp, Artificial Sequence
  Description of Artificial Sequence: Synthetic coding sequence
atggagtacgaggtgaagaagggcaagaagggcttcgtgagccccatcagaagactggtgttccccaaggccggcagaagagccgcctgcagaagcagcgtgagcagaagacccctgcacagcatgcccctgtacccccccgactacctgatcgacccccagatcctgctgtgcgactacctggagaaggaggtgaagttcctgggccacctgacctgggtgaccagcagcctgaaccccagcagcagagacgagctgctgcagctgctggacaccgccagacagctgaaggagctgcccctgaagaccaccgccgagcaggacagcatcctgagcctgagcgccagatgcctgctgctgacctggagagacaacgaggagctgatcctgagaatccccacccacgagatcgccgccgccagctacctgcaggacgacgccctgcacctgctggtgctgaagaccggcctgggcgtggaccccgtgcccgccggcgtggacgccagccccggcggcgccggcagagaccccggcccccccggcggcgcccccgagaagagaagagtgggcaccgccgagagaagacacaccatctgcagcctggactggagaatgggctggggcggcggcgccgccgaggccagagccggcggcggcggcggcggcagcctggagagacagagagccggcgccagagccagcggcagctgggagagaagacagaccttcagcggcagctgggagagaagacacggcggcggcggcggcggcggcggcgccggcaagcccggcggcagctgggagagaagacaggccggcagcggcggcggcggcagctgggagagaagacaccccggccccaaccccctggacccccaggaccccagccccgacgcctactgcaacctggtgatcctggccgtggccaacagagacgccgccgaggagagctgcgccctgatctgccaggtgttccagatcatctacggcgaccagagcatcgagtgcgtggacagagccggctaccactacaccagcacccccgagagaccctggctgtgcagcagaatcatggcccccagaacccccctgaagcacgtgaccgccgccagaccccacctgctgagcatggcccccaccgccgccgccgccaccaccgccgtgtgggcctggagcagctacagaatcacctggagcagatgcggcgtgagctggggccccagcagaagcagcagcctgagatgctgctgcggcagcaccggctggggctgccccagcagaaccatcgcccaggcctgctag

SEQ ID NO: 19155 - DNA, 1716 bp, Artificial Sequence
  Description of Artificial Sequence: Synthetic coding sequence
atggagtacgaggtgaagaagggcaagaagggcttcgtgagccccatcagaagactggtgttccccaaggccggcagaagagccgcctgcagaagcagcgtgagcagaagacccctgcacagcatgcccctgtacccccccgactacctgatcgacccccagatcctgctgtgcgactacctggagaaggaggtgaagttcctgggccacctgacctgggtgaccagcagcctgaaccccagcagcagagacgagctgctgcagctgctggacaccgccagacagctgaaggagctgcccctgaagaccaccgccgagcaggacagcatcctgagcctgagcgccagatgcctgctgctgacctggagagacaacgaggagctgatcctgagaatccccacccacgagatcgccgccgccagctacctgcaggacgacgccctgcacctgctggtgctgaagaccggcctgggcgtggaccccgtgcccgccggcgtggacgccagccccggcggcgccggcagagaccccggcccccccggcggcgcccccgagaagagaagagtgggcaccgccgagagaagacacaccatctgcagcctggactggagaatgggctggggcggcggcgccgccgaggccagagccggcggcggcggcggcggcagcctggagagacagagagccggcgccagagccagcggcagctgggagagaagacagaccttcagcggcagctgggagagaagacacggcggcggcggcggcggcggcggcgccggcaagcccggcggcagctgggagagaagacaggccggcagcggcggcggcggcagctgggagagaagacaccccggccccaaccccctggacccccaggaccccagccccgacgcctactgcaacctggtgatcctggccgtggccaacagagacgccgccgaggagagctgcgccctgatctgccaggtgttccagatcatctacggcgaccagagcatcgagtgcgtggacagagccggctaccactacaccagcacccccgagagaccctggctgtgcagcagaagcgagagctgccacaccgacggcacctacgcctacgacgccgacttcagctgctgcagcagcttcaacggcagccaggacaccttcgaggcctgctacagcggcaccagcacccccagcttccacggcagccactgcagcggcagcgaccacagcagcctgggcctggagcagctgcaggactacatggtgaccctgagaagcaagctgggccccctggagatccagcagttcgccatgctgctgagagagtacagactgggcctgcccatccaggactactgcaccggcctgctgaagctgtacggcgacagaagaaagttcctgctgctgggcatgagacccttcatccccgaccaggacatcggctacttcgagggcttcctggagggcgtgggcatcagagagggcggcatcctgaccgacagcttcggcagaatcaagagaagcatgagcagcaccagcgccagcgccgtgagaagctacgacggcgccgcccagagacccgaggcccaggccttccacagactgctggccgacatcacccacgacatcgaggccctggcccccgacgacgacgacgacgacgaggacgagcccagaggcagcagaggcggcagcgacgccgccgaggacaactacctgtag

SEQ ID NO: 19156 - DNA, 708 bp, Artificial Sequence
  Description of Artificial Sequence: Synthetic coding sequence
atggagtacgaggtgaagaagggcaagaagggcttcgtgagccccatcagaagactggtgttccccaaggccggcagaagagccgcctgcagaagcagcgtgagcagaagacccctgcacagcatgcccctgtacccccccgactacctgatcgacccccagatcctgctgtgcgactacctggagaaggaggtgaagttcctgggccacctgacctgggtgaccagcagcctgaaccccagcagcagagacgagctgctgcagctgctggacaccgccagacagctgaaggagctgcccctgaagaccaccgccgagcaggacagcatcctgagcctgagcgccagatgcctgctgctgacctggagagacaacgaggagctgatcctgagaatccccacccacgagatcgccgccgccagctacctgcaggacgacgccctgcacctgctggtgctgaagaccggcctgggcgtggaccccgtgcccgccggcgtggacgccagccccggcggcgccggcagagaccccggcccccccggcggcgcccccgagaagagaagagtgggcaccgccgagagaagacacaccatctgcagcctggactggagaatgggctggggcggcggcgccgccgaggcccccaccagaagcaccagaagaacccccgcccccacccccaccgccacctggagcagctggctgtag

SEQ ID NO: 19157 - DNA, 975 bp, Artificial Sequence
  Description of Artificial Sequence: Synthetic coding sequence
gagagaagacacggcggcggcggcggcggcggcggcgccggcaagcccggcggcagctgggagagaagacaggccggcagcggcggcggcggcagctgggagagaagacaccccggccccaaccccctggacccccaggaccccagccccgacgcctactgcaacctggtgatcctggccgtggccaacagagacgccgccgaggagagctgcgccctgatctgccaggtgttccagatcatctacggcgaccagagcatcgagtgcgtggacagagccggctaccactacaccagcacccccgagagaccctggctgtgcagcagaagcgagagctgccacaccgacggcacctacgcctacgacgccgacttcagctgctgcagcagcttcaacggcagccaggacaccttcgaggcctgctacagcggcaccagcacccccagcttccacggcagccactgcagcggcagcgaccacagcagcctgggcctggagcagctgcaggactacatggtgaccctgagaagcaagctgggccccctggagatccagcagttcgccatgctgctgagagagtacagactgggcctgcccatccaggactactgcaccggcctgctgaagctgtacggcgacagaagaaagttcctgctgctgggcatgagacccttcatccccgaccaggacatcggctacttcgagggcttcctggagggcgtgggcatcagagagggcggcatcctgaccgacagcttcggcagaatcaagagaagcatgagcagcaccagcgccagcgccgtgagaagctacgacggcgccgcccagagacccgaggcccaggccttccacagactgctggccgacatcacccacgacatcgaggccctggcccccgacgacgacgacgacgacgaggacgagcccagaggcagcagaggcggcagcgacgccgccgaggacaactacctgtag

SEQ ID NO: 19158 - DNA, 300 bp, Artificial Sequence
  Description of Artificial Sequence: Synthetic coding sequence
atggacaccggcagcagagaggccgccttcaccagagacctgcccagaaagcccgccgacgcccaggtgagccccgagatgagcatcacccacaaggagaaggagaacgcccacctgaaggagatcctgctgttcgtgaacgccgaggccttcagccagccccagccccacagcgcccccgtgtgcgagggccagcagctgaccggcaagttcagcaccagcgtgctgaccagagccggcggcgacgccagcccctgcagctgggagagactgctgtgctacggctggagccactgctag

SEQ ID NO: 19159 - DNA, 300 bp, Artificial Sequence; identical to SEQ ID NO: 19158
  Description of Artificial Sequence: Synthetic coding sequence

SEQ ID NO: 19160 - DNA, 354 bp, Artificial Sequence
  Description of Artificial Sequence: Synthetic coding sequence
atgcccagctgcagctgcgccctgatggccccctgcggccccgccgccggccccgccgccgtggagagaacccagcaggtggccagaggcgagcccggcagcgccagaggccagctgcaggtgagccccgagatgagcatcacccacaaggagaaggagaacgcccacctgaaggagatcctgctgttcgtgaacgccgaggccttcagccagccccagccccacagcgcccccgtgtgcgagggccagcagctgaccggcaagttcagcaccagcgtgctgaccagagccggcggcgacgccagcccctgcagctgggagagactgctgtgctacggctggagccactgctag

SEQ ID NO: 19161 - DNA, 450 bp, Artificial Sequence
  Description of Artificial Sequence: Synthetic coding sequence
atgctgagcggcccccaccccagccccaccttcagacccaacccctgcccctggccctgcctgcacagcctgtggatggagatcagccccacccagctgtgcttcctgagccccggccccagcccccagagccccagctgctgcttccagggcatgaacagcggcagcgagctgggcaagctgtggagaaagctgttcaagggcatccccagactgagcgtgagccacttcgacttctactgcggcacctgcgtgctgctgggcagaccccagatcccccagggcagcagcctgggcaacgacatcgaccagtaccccgtggtgttcagaaacgccagcgaccagggcagctggatgcagctggagatgctgctgagaaagctgagcgacctggtgtggaccagcgacgccctgagcgacaagatcctggaggacggcctggtgccctag

SEQ ID NO: 19162 - DNA, 609 bp, Artificial Sequence
  Description of Artificial Sequence: Synthetic coding sequence
atgaagagatggcagatcttcgtgctgtgggtgttctgggtgctgatcctgtggctgatgaccccctacctggacctgacccccgagagcgccccccaggagaagagaatgtacctggtgccccagcactgcgactgcccctggttcagcagcggcaagtgcggctgccccagcgagaccctgaactgcagcagctgccaccacaccgccgacgagtggaactggctggacgcctgcagcagaaagaccatgggctacctgatgagaaccagagagagcatgaccagcgacaccgtgctgtggtggctgggcatgaacagcggcagcgagctgggcaagctgtggagaaagctgttcaagggcatccccagactgagcgtgagccacttcgacttctactgcggcacctgcgtgctgctgggcagaccccagatcccccagggcagcagcctgggcaacgacatcgaccagtaccccgtggtgttcagaaacgccagcgaccagggcagctggatgcagctggagatgctgctgagaaagctgagcgacctggtgtggaccagcgacgccctgagcgacaagatcctggaggacggcctggtgccctag

SEQ ID NO: 19163 - DNA, 1152 bp, Artificial Sequence
  Description of Artificial Sequence: Synthetic coding sequence
atgaacgccggccccagctggaacaaggtgcagcacagcaagaacagcagcggcaagagacagagcaagagccaggtgccccacgccagcagccagcccagaagcagcctgaccgccgtgacccagcccaccgaggagaagctgaaggagagcatcagccccgaggccagaagaaagagaaaccccctgggcagcagatgccagggcgccagcggcaacaagctgttcctggacttccagagcatgaagatcatcaaggagaacgccgacgaggacagcgccagcgacctgagcgacagcgagagaatccccatcccccccagccccctgaccccccccgacctgaacctgagagccgaggagatcgaccccgtgtacttcgacctgcaccccggccagggccacaccaagcccgagtactactaccccaacttcctgcccagccccttcagcagctgggacctgagagacatggccctgctgctgaacgccgagaacaagaccgaggccgtgcccagagtgggcggcctgctgggcaagtacatcgacagactgatccagctggagtggctgcaggtgcagaccgtgcagtgcgagaaggccaagggcggcaaggccagaccccccaccgcccccggcaccagcggcgccctgaagagccccggcagaagcaagctgatcgccagcgccctgagcaagcccctgccccaccaggagggcgccagcaagagcggccccagcagaaagaaggccttccaccacgaggagatccaccccagccactacgccttcgagaccagccccagacccatcgacgtgctgggcggcaccagattctgcagccagagacagaccctggagatgagaaccgaggagaagaagaagaagagcagcaagagcaccaagctgcagagatgggacctgagcggcagcggcagcagcagcaaggtggagaccagcggccacatcagagtgcccaagcaggccgccgtgatcctggacagcgccgacagctgcaaggccagcaagacccaggcccacgcccaccccagaaagaagggcaaggccgagagctgcggccacgccaccgtgagcagcgagaagaagctgaagaccaacggcgtgaagcagaacacctacaagctgaagtag

SEQ ID NO: 19164 - DNA, 1152 bp, Artificial Sequence; identical to SEQ ID NO: 19163
  Description of Artificial Sequence: Synthetic coding sequence

SEQ ID NO: 19165 - DNA, 147 bp, Artificial Sequence
  Description of Artificial Sequence: Synthetic coding sequence
atgaacgccggccccagctggaacaaggtgcagcacagcaagaacagcagcggcaagagacagagcaagagccaggtgccccacgccagcagccagcccagaagcagcctgaccgccgtgacccagcccaccgaggagaagctgtag

SEQ ID NO: 19166 - DNA, 153 bp, Artificial Sequence
  Description of Artificial Sequence: Synthetic coding sequence
atggacatcctgctggacctgggctggcacttcagcaactgcgacgaggacaccttctacagccccgtgcagaacaccgagggcgacctgctgttcttcgaccacaacctgaagaccgacagaggccacgtggagagaagcgtgatggactag

SEQ ID NO: 19167 - DNA, 126 bp, Artificial Sequence
  Description of Artificial Sequence: Synthetic coding sequence
gacctgggctggcacttcagcaactgcgacgaggacaccttctacagccccgtgcagaacaccgagggcgacctgctgttcttcgaccacaacctgaagaccgacagaggccacgtggagagatag

SEQ ID NO: 19168 - DNA, 957 bp, Artificial Sequence
  Description of Artificial Sequence: Synthetic coding sequence
atgagcacccacgtggccggcctgggcctggacaagatgaagctgggcaacccccagagcttcctggaccaggaggaggccgacgaccagcagctgctggagcccgaggcctggaagacctacaccgagagaagaaacgccctgagagagttcctgaccagcgacctgagcccccacctgctgaagagacaccacgccagaatgcagctgctgagaaagtgcagctactacatcgaggtgctgcccaagcacctggccctgggcgaccagaaccccctggtgctgcccagcgccctgttccagctgatcgacccctggaagttccagagaatgaagaaggtgggcaccgcccagaccaagatccagctgctgctgctgggcgacctgctggagcagctggaccacggcagagccgagctggacgccctgctgagaagccccgaccccagacccttcctggccgactgggccctggtggagagaagactggccgacgtgagcgccgtgatggacagcttcctgaccatgatggtgcccggcagactgcacgtgaagcacagactggtgagcgacgtgagcgccaccaagatcccccacatctggctgatgctgagcaccaagatgcccgtggtgttcgacagaaaggccagcgccgcccaccaggactgggccagactgagatggttcgtgaccatccagcccgccaccagcgagcagtacgagctgagattcagactgctggaccccagaacccagcaggagtgcgcccagtgcggcgtgatccccgtggccgcctgcaccttcgacgtgagaaacctgctgcccaacagaagctacaagttcaccatcaagagagccgagaccagcaccctggtgtacgagccctggagagacagcctgaccctgcacaccaagcccgagcccctggagggccccgccctgagccacagcgtgtag

SEQ ID NO: 19169 - DNA, 957 bp, Artificial Sequence; identical to SEQ ID NO: 19168
  Description of Artificial Sequence: Synthetic coding sequence

SEQ ID NO: 19170 - DNA, 618 bp, Artificial Sequence
  Description of Artificial Sequence: Synthetic coding sequence
atggccgccagagacgccaccagcggcagcctgagcgaggagagcagcgccctggacctgcccagcgcctgcgacatcagagactacgtgctgcagggccccagccaggaggccaacagcgaggccttcagcagcctggagttccacagcttcccctacagcagcgacgtggaccccgacaccagcaacctgaacatcgagcagaacaacagctggaccgccgagaacttctggctggaccccgccgtgaagggccagagcgagaaggaggaggacgacggcctgagaaagagcctggacagattctacgagatgttcggccacccccagcccggcagcgccaacagcctgagcgccagcgtgtgcaagtgcctgagccagaagatcacccagctgagaggccaggagagccagaagtacgccctgagaagcttccagatggccagagtgatcttcaacagagacggctgcagcgtgctgcagagacacagcagagacacccacttctaccccctggaggagggcagcaccagcctggacgacgagaagcccaaccccggcctgagcaaggacatcacccacttcctgctgcagcagaacgtgatgaaggacctgtag

SEQ ID NO: 19171 - DNA, 456 bp, Artificial Sequence
  Description of Artificial Sequence: Synthetic coding sequence
atggccgccagagacgccaccagcggcagcctgagcgaggagagcagcgccctggacctgcccagcgcctgcgacatcagagactacgtgctgcagggccccagccaggaggccaacagcgaggccttcagcagcctggagttccacagcttcccctacagcagcgacgtggaccccgacaccagcaacctgaacatcgagcagaacaacagctggaccgccgagaacttctggctggaccccgccgtgaagggccagagcgagaaggaggaggacgacggcctgagaaagagcctggacagattctacgagatgttcggccacccccagcccggcagcgccaacagcctgagcgccagcgtgtgcaagtgcctgagccagaagatcacccagctgagaggccaggagagccagaagtacgccctgagacagcagaacgtgatgaaggacctgtag

SEQ ID NO: 19172 - DNA, 189 bp, Artificial Sequence
  Description of Artificial Sequence: Synthetic coding sequence
atggccgccagagacgccaccagcggcagcctgagcgaggagagcagcgccctggacctgcccagcgcctgcgacatcagagactacgtgctgcagggccccagccaggaggccaacagcgaggccttcagcagcctggagttccacagcttcccctacagcagcgacgtggaccccgccgacctgtag

SEQ ID NO: 19173 - DNA, 603 bp, Artificial Sequence
  Description of Artificial Sequence: Synthetic coding sequence
atggagagccacagctgcagccccagctggagcaccatgaccatcagcgcccactgcaacctgagactgcccagcgccagccagagcgtgggcatcaccggcgtgagccaccacatctggcccagaatcttctacatgaccatggccgccagagacgccaccagcggcagcctgagcgaggagagcagcgccctggacctgcccagcgcctgcgacatcagagactacgtgctgcagggccccagccaggaggccaacagcgaggccttcagcagcctggagttccacagcttcccctacagcagcgacgtggaccccgacaccagcaacctgaacatcgagcagaacaacagctggaccgccgagaacttctggctggaccccgccgtgaagggccagagcgagaaggaggaggacgacggcctgagaaagagcctggacagattctacgagatgttcggccacccccagcccggcagcgccaacagcctgagcgccagcgtgtgcaagtgcctgagccagaagatcacccagctgagaggccaggagagccagaagtacgccctgagaagcttccagatggccagagtgatcttcaactag

SEQ ID NO: 19174 - DNA, 366 bp, Artificial Sequence
  Description of Artificial Sequence: Synthetic coding sequence
atggccgccagagacgccaccagcggcagcctgagcgaggagagcagcgccctggacctgcccagcgcctgcgacatcagagactacgtgctgcagggccccagccaggaggccaacagcgaggccttcagcagcctggagttccacagcttcccctacagcagcgacgtggaccccgacaccagcaacctgaacatcgagcagaacaacagctggaccgccgagaacttctggctggaccccgccgtgaagggccagagcgagaaggaggaggacgacggcctgagaaagagcctggacagattctacgagatgttcggccacccccagcccggcagcgccaacagcctgagcgccagcgtgtag

SEQ ID NO: 19175 - DNA, 321 bp, Artificial Sequence
  Description of Artificial Sequence: Synthetic coding sequence
atggaggtgtgcagctgctgccccggctggagcgccaccgtgagcgcccactgcaacctgagattcgccagcagcaccagccagagcgccggcatcaccggcatgagccagtgcgcctggcccaccttcaccttcctgaccatggccgccagagacgccaccagcggcagcctgagcgaggagagcagcgccctggacctgcccagcgcctgcgacatcagagactacgtgctgcagggccccagccaggaggccaacagcgaggccttcagcagcctggagttccacagcttcccctacagcagcgacgtggacccctag

SEQ ID NO: 19176 - DNA, 381 bp, Artificial Sequence
  Description of Artificial Sequence: Synthetic coding sequence
atggtggccctgttccagcacagcccctactggcaggccgacggctacggccacagccacagactgaagtgccagcacttcaagcagcacagacagtacaacgacaagctggagatcagcagcaacctgggcccccagttcaacgccctgctgaacatcctgctgaacatcgtgcaccccaccctgagccacgacaccagaagaagcaagggcctgaagatcgagggcctgctgcagagcagagagctgggcaacagctggaccgtgaccatgtgcatctgggtgctgaaggccctgcagagcagcgcccccaacaagcccctggactggctggaccccatgccctgcttccagaacctgctggccagaggcaccccctag

SEQ ID NO: 19177 - DNA, 723 bp, Artificial Sequence
  Description of Artificial Sequence: Synthetic coding sequence
atgcccccccccgccaaggagggcggcagaaagggccccagagagagaagcggcaagagcgcccccggcaccgcccagggcgaggagagagccaagggcgcccccgccaccgagccccccaagcccggctgggccctgaccccccagggcctggccgccatgctgcccgcccagagacacagacacctgctgttcggcgacctgctggaggacgtgggcgccgccgccagcaccttcccctgcggcagcgtggagcccggctacagaatgcccgaccccagaccctggacccagagcctggagctgcccgccgagagacagaacagactgctgggcgtgctgaaggccgccgaggccagaggcagagtgagagccctgagactgagatacaccagaatgagagccgaggagatcgccctgctgatccagagacagaagagcgccagagccgccatcagactggagctgttcctgcccccccagctgaagcccgccagaatccccgaccccctggacagacaggaggtgcagaccagccccggcagaggcggcgagagaggcggcgccctgcccgccagcgcccacgccggcccccagcccctgagccccgccgccgaggccagaggcgaccaccccggcggcgagagaggctggcaccacctgcccgccgtgaccgccaccgagagcgtgagaagagcccccgccagccacatcaagctgtag

SEQ ID NO: 19178 - DNA, 369 bp, Artificial Sequence
  Description of Artificial Sequence: Synthetic coding sequence
atgtacaagagcaagatccccagagcccagaaccaggtgagcgtgaaggtgacccccaagaacaccgagatgaagatcgccgaggagcccagccccagcctgggccagaccctggagtggctgagaaaggagctgagcgagatgcagatccaggaccagagcctgctgctgaccctgagacacctgcacagcgtgctggaggagctgagagccgacagcgcccactgggaggacgccagaagcagcggcggcaccagccccatcagagccagagccggcagcgagggcagaggctgccagcccgtgtgcagcagaggcctggcccagctgctgagaggcgaggacagcagaagaagcagcctgccctag

SEQ ID NO: 19179 - DNA, 3714 bp, Artificial Sequence
  Description of Artificial Sequence: Synthetic coding sequence
atgagcgtgctgaccagccccagaggcaaggtggaggtggtgcactgcagaagaaccgagagccaggacgtgtactgcatcaagagcctgatcagaaagttcacctgcaagctgttcggcaagctgaacatcatctacctgctggagaaggccaacctggccgtgaccctgtgcaacgacaaggaggagatcatggcccaggccaccttcctggactaccccaactggaacgtggccaagcaggacgactgggtgagcgtgttcagagagctggacagcgacatcccctgcacccccctgaacaccctgttcatgcacctgttcgtggccgtggacgagtacagcgtgggctgctgcaaggagatcctgagaaccgtgtacaaggccgtgcccgagctgcacttcatcttcctgatcgtgcccagctacatgagcctgggcagcaccctgatcaccgtgttcgaccaggtgggcaacatcccctgcctgacctacgaggaggacttcgccgtgcacatctgccacagacacagccactacccccagctgcacgtgagaaaggccagagtggaggaccacgacgacctgatgcccatcttcatgagatacgacaccatcctgaaggagacctacggcgagtacttcctggccgagctgatcgaggcccaggacgaggagaaccacgccgtggtgtgcgaggtggagggcaccgccgtgggcttcatgagcgtgtgcagcagagtgaacatgcagctgctgcacgagtgcttcgacctgggccccttccacggcctgtgcttcccccaccccgacgacgtgctggagagcccccaggacctgagcgtgagaagaagccaggacgccgagctgagaagcagcagccagggcagccagaagatcgtggaggagctgcaggagcccgtgagccccgacaccatggagaacatccagggcaacatcgccagagaggccgccagcgaggaggccctgaccgccgtgcagagcggcaacgtgagcgagcccgaggacatcgagaagctgagcgacatcagcaccggctacgcccagtaccaccacgtgagcagcagaagcctggccagcctggtgctgcccgaggagcccgtgcacttcagacccatctacagaggcgccagcgccgccttctgcatccagctgttctgcatcgacgagaagtacgaggccagaagcctggacttcatgaacttcgtgttcagcctgttcagcgacaagaacttctgcgtgatcagcctgccccacctgacccccgagttcttcctgatccagaacttcgtgaagatggtgcccttcaacacctgcaccctggagcaggacctgtacgtgttccacagagccggcctgctgaagagcatcaacatcagattcgccaccctgctggacacccccggcgtggagaacctggtgagcaccctgatgctgaacaagagcatcctggaggacctggacagatacaacaaggccagaaaggaccccgacggcaccctgctgcaggccttcgtggccgaggtggccgagcagatcgtgggcatcgccgtgatcagaaacgagatggacatcgagtacatcagaagccactacaacatcgaggacttcatctacttcagccaccaccagagagaggagcacggccacatgcaccacttcgccctgaaccccatcttcagacactacaccaagttcttcctgaaggagatcctgagactgggcttcaagagctgcctgtactacagagtgtaccccaagagcagagagggcaagttccagaacccctacgcccacagcctgaccagcgccctgcactacctggtgcccgtgagacccagaagacagatcgtgtaccccctggagaagctgggcatcaacgcccccagcaaggccgtgagcaaggaccccatgagctacgccctgaaccacaccaacagaaagctgaccctggagcccaagatcaccgtgaacgccaagatcatcgtggtgggcgccagcagcgtgggcatcagcttcctggagaccctggtgttctgcagccacatgaagttcaacaacctgaccctgatcagcacccacggcctgcccggcaagaagctgctggacaccgagcagagaaagttcctggccagcgaccactgcttcaacgacaaggactacgccctgatgagcctgtgcagctgggtgaacgtggtggtgggcagaatgaccggcatcgacagagccgccaagcacgtggtgctgagcaccgacgagatcgtgccctacgaccacctgatcctgtgcaccggccagcagtaccaggtgccctgccccaccgaggccgacatcagccagcacctgaccaacagagaggtgcccaacagcagccagagaagatacaccggcaaggtgccctgcaaccacttcaccctgaacgaggaggaggactgcttcaaggccctgatctggatcagaaacaacagcatcaccaccgagggcaacatcatcgtgtacggcaacaccatcgacacctacaccaccgtggagaccctgctgaacctgggcgtgagcggcagcagaatccacctggtgcagcccccccccgccagcaccatcacctgcatcaacaactacagcgtggagagcgccgtggccgacgccctgggcgccgccggcgtgaccatgtacagagacgccatcctggcccagtggaacgacggcctgcaccccgaccccatctacagcgccagcttcaccacccccaccaagcccttcagactgcagtgcagcatgttcttcagcttctgcgagaagaacgtggactacgagaccttcaaggccctgaacgacgcctgcctggtgtacgacagcagactggtgatcgacaccaacttccacaccaacgacatcgccatcagagccgccggcagcctgaccaagttcagcaacagatactacagcaacgagtggacccacagcaacttcagcagcaaggagatcggcttccagctggccgccgccatgctgcacctgttcgaccccaccctggagcccgtgaccgagccccccgccaacctggacagactgatccccatgtacaagggcgccaagatccagggcggcatcctgcccggcagctaccactacctgcacatcgccaagcccgccatccccacccccctggaggtgcagatggcccagcccaactacggcctggagctggtgaccggcagcgccaagaacggcacctacttcagaatccacatcaacaagtacaagatggtggagaccatcacctgcctgagcagagagcccttccccgccagcaactacatcagactgttcggccagcacgagcagctgctgaacaacctgtgcgccagatacgacgagaacctgatcaccgacctgtacagctacttcaccgagccctggtgcctggccctgttccacgacagattcatcgacctgagaaaggagctgagacagatcctggccagcaaggaggaggaggacctgcccagcatcgagcagctggcccaccagatcgaggacgaggagatcaaccccaccgagaagcccagacagtacctgaagagagtgttcgaggagagcatctacaagaccctggtggagagaagcaccctggactacctgcactacaacagataccacctgcccatgtacgcctggcccggcatcgtgtag

SEQ ID NO: 19180 - DNA, 765 bp, Artificial Sequence
  Description of Artificial Sequence: Synthetic coding sequence
atgaacttcgtgttcagcctgttcagcgacaagaacttctgcgtgatcagcctgccccacctgacccccgagttcttcctgatccagaacttcgtgaagatggtgcccttcaacacctgcaccctggagcaggacctgtacgtgttccacagagccggcctgctgaagagcatcaacatcagattcgccaccctgctggacacccccggcgtggagaacctggtgagcaccctgatgctgaacaagagcatcctggaggacctggacagatacaacaaggccagaaaggaccccgacatcgagtacatcagaagccactacaacatcgaggacttcatctacttcagccaccaccagagagaggagcacggccacatgcaccacttcgccctgaaccccatcttcagacactacaccaagttcttcctgaaggagatcctgagactgggcttcaagagctgcctgtactacagagtgtaccccaagagcagagagggcaagttccagaacccctacgcccacagcctgaccagcgccctgcactacctggtgcccgtgagacccagaagacagatcgtgtaccccctggagaagctgggcatcaacgcccccagcaaggccgtgagcaaggaccccatgagctacgccctgaaccacaccaacagaaagctgaccctggagcccaagatcaccgtgaacgccaagatcatcgtggtgggcgccagcagcgtgggcatcagcttcctggagaccctggtgttctag

SEQ ID NO: 19181 - DNA, 3534 bp, Artificial Sequence
  Description of Artificial Sequence: Synthetic coding sequence
atgagcgtgctgaccagccccagaggcaaggtggaggtggtgcactgcagaagaaccgagagccaggacgtgtactgcatcaagagcctgatcagaaagttcacctgcaagctgttcggcaagctgaacatcatctacctgctggagaaggccaacctggccgtgaccctgtgcaacgacaaggaggagatcatggcccaggccaccttcctggactaccccaactggaacgtggccaagcaggacgactgggtgagcgtgttcagagagctggacagcgacatcccctgcacccccctgaacaccctgttcatgcacctgttcgtggccgtggacgagtacagcgtgggctgctgcaaggagatcctgagaaccgtgtacaaggccgtgcccgagctgcacttcatcttcctgatcgtgcccagctacatgagcctgggcagcaccctgatcaccgtgttcgaccaggtgggcaacatcccctgcctgacctacgaggaggacttcgccgtgcacatctgccacagacacagccactacccccagctgcacgtgagaaaggccagagtggaggaccacgacgacctgatgcccatcttcatgagatacgacaccatcctgaaggagacctacggcgagtacttcctggccgagctgatcgaggcccaggacgaggagaaccacgccgtggtgtgcgaggtggagggcaccgccgtgggcttcatgagcgtgtgcagcagagtgaacatgcagctgctgcacgagtgcttcgacctgggccccttccacggcctgtgcttcccccaccccgacgacgtgctggagagcccccaggacctgagcgtgagaagaagccaggacgccgagctgagaagcagcagccagggcagccagaagatcgtggaggagctgcaggagcccgtgagccccgacaccatggagaacatccagggcaacatcgccagagaggccgccagcgaggaggccctgaccgccgtgcagagcggcaacgtgagcgagcccgagagcctggacttcatgaacttcgtgttcagcctgttcagcgacaagaacttctgcgtgatcagcctgccccacctgacccccgagttcttcctgatccagaacttcgtgaagatggtgcccttcaacacctgcaccctggagcaggacctgtacgtgttccacagagccggcctgctgaagagcatcaacatcagattcgccaccctgctggacacccccggcgtggagaacctggtgagcaccctgatgctgaacaagagcatcctggaggacctggacagatacaacaaggccagaaaggaccccgacggcaccctgctgcaggccttcgtggccgaggtggccgagcagatcgtgggcatcgccgtgatcagaaacgagatggacatcgagtacatcagaagccactacaacatcgaggacttcatctacttcagccaccaccagagagaggagcacggccacatgcaccacttcgccctgaaccccatcttcagacactacaccaagttcttcctgaaggagatcctgagactgggcttcaagagctgcctgtactacagagtgtaccccaagagcagagagggcaagttccagaacccctacgcccacagcctgaccagcgccctgcactacctggtgcccgtgagacccagaagacagatcgtgtaccccctggagaagctgggcatcaacgcccccagcaaggccgtgagcaaggaccccatgagctacgccctgaaccacaccaacagaaagctgaccctggagcccaagatcaccgtgaacgccaagatcatcgtggtgggcgccagcagcgtgggcatcagcttcctggagaccctggtgttctgcagccacatgaagttcaacaacctgaccctgatcagcacccacggcctgcccggcaagaagctgctggacaccgagcagagaaagttcctggccagcgaccactgcttcaacgacaaggactacgccctgatgagcctgtgcagctgggtgaacgtggtggtgggcagaatgaccggcatcgacagagccgccaagcacgtggtgctgagcaccgacgagatcgtgccctacgaccacctgatcctgtgcaccggccagcagtaccaggtgccctgccccaccgaggccgacatcagccagcacctgaccaacagagaggtgcccaacagcagccagagaagatacaccggcaaggtgccctgcaaccacttcaccctgaacgaggaggaggactgcttcaaggccctgatctggatcagaaacaacagcatcaccaccgagggcaacatcatcgtgtacggcaacaccatcgacacctacaccaccgtggagaccctgctgaacctgggcgtgagcggcagcagaatccacctggtgcagcccccccccgccagcaccatcacctgcatcaacaactacagcgtggagagcgccgtggccgacgccctgggcgccgccggcgtgaccatgtacagagacgccatcctggcccagtggaacgacggcctgcaccccgaccccatctacagcgccagcttcaccacccccaccaagcccttcagactgcagtgcagcatgttcttcagcttctgcgagaagaacgtggactacgagaccttcaaggccctgaacgacgcctgcctggtgtacgacagcagactggtgatcgacaccaacttccacaccaacgacatcgccatcagagccgccggcagcctgaccaagttcagcaacagatactacagcaacgagtggacccacagcaacttcagcagcaaggagatcggcttccagctggccgccgccatgctgcacctgttcgaccccaccctggagcccgtgaccgagccccccgccaacctggacagactgatccccatgtacaagggcgccaagatccagggcggcatcctgcccggcagctaccactacctgcacatcgccaagcccgccatccccacccccctggaggtgcagatggcccagcccaactacggcctggagctggtgaccggcagcgccaagaacggcacctacttcagaatccacatcaacaagtacaagatggtggagaccatcacctgcctgagcagagagcccttccccgccagcaactacatcagactgttcggccagcacgagcagctgctgaacaacctgtgcgccagatacgacgagaacctgatcaccgacctgtacagctacttcaccgagccctggtgcctggccctgttccacgacagattcatcgacctgagaaaggagctgagacagatcctggccagcaaggaggaggaggacctgcccagcatcgagcagctggcccaccagatcgaggacgaggagatcaaccccaccgagaagcccagacagtacctgaagagagtgttcgaggagagcatctacaagaccctggtggagagaagcaccctggactacctgcactacaacagataccacctgcccatgtacgcctggcccggcatcgtgtag

SEQ ID NO: 19182 - DNA, 603 bp, Artificial Sequence
  Description of Artificial Sequence: Synthetic coding sequence
atgagctacgccctgaaccacaccaacagaaagctgaccctggagcccaagatcaccgtgaacgccaagatcatcgtggtgggcgccagcagcgtgggcatcagcttcctggagaccctggtgttctgcagccacatgaagttcaacaacctgaccctgatcagcacccacggcctgcccggcaagaagctgctggacaccgagcagagaaagttcctggccagcgaccactgcttcaacgacaaggactacgccctgatgagcctgtgcagctgggtgaacgtggtggtgggcagaatgaccggcatcgacagagccgccaagcacgtggtgctgagcaccgacgagatcgtgccctacgaccacctgatcctgtgcaccggccagcagtaccaggtgccctgccccaccgaggccgacatcagccagcacctgaccaacagagaggtgcccaacagcagccagagaagatacaccggcaaggtgccctgcaaccacttcaccctgaacgaggaggaggactgcttcaaggccctgatctggatcagaaacaacagcatcaccaccgaggacggcggcagagccagcgtgctgttctgctag

SEQ ID NO: 19183 - DNA, 438 bp, Artificial Sequence
  Description of Artificial Sequence: Synthetic coding sequence
ggcctgagagagagcctgttcagaacccccagattcggctgcttcagcatcttccccagaagaatcagagtggaggtggagggcaccgccgtgggcttcatgagcgtgtgcagcagagtgaacatgcagctgctgcacgagtgcttcgacctgggccccttccacggcctgtgcttcccccaccccgacgacgtgctggagagcccccaggacctgagcgtgagaagaagccaggacgccgagctgagaagcagcagccagggcagccagaagatcgtggaggagctgcaggagcccgtgagccccgacaccatggagaacatccagggcaacatcgccagagaggccgccagcgaggaggccctgaccgccgtgcagagcggcaacgtgagcgagcccgaggtggccggcttctacgagttctgcttccagagctag

SEQ ID NO: 19184 - DNA, 570 bp, Artificial Sequence
  Description of Artificial Sequence: Synthetic coding sequence
atgagcgtgctgaccagccccagaggcaaggtggaggtggtgcactgcagaagaaccgagagccaggacgtgtactgcatcaagagcctgatcagaaagttcacctgcaagctgttcggcaagctgaacatcatctacctgctggagaaggccaacctggccgtgaccctgtgcaacgacaaggaggagatcatggcccaggccaccttcctggactaccccaactggaacgtggccaagcaggacgactgggtgagcgtgttcagagagctggacagcgacatcccctgcacccccctgaacaccctgttcatgcacctgttcgtggccgtggacgagtacagcgtgggctgctgcaaggagatcctgagaaccgtgtacaaggccgtgcccgagctgcacttcatcttcctgatcgtgcccagctacatgagcctgggcagcaccctgatcaccgtgttcgaccaggtgggcaacatcccctgcctgacctacgaggaggacttcgccgtgcacatctgccacagacacagccactacccccagctgcacgtgagaaaggccagatag

SEQ ID NO: 19185 - DNA, 1413 bp, Artificial Sequence
  Description of Artificial Sequence: Synthetic coding sequence
atgagcgtgctgaccagccccagaggcaaggtggaggtggtgcactgcagaagaaccgagagccaggacgtgtactgcatcaagagcctgatcagaaagttcacctgcaagctgttcggcaagctgaacatcatctacctgctggagaaggccaacctggccgtgaccctgtgcaacgacaaggaggagatcatggcccaggccaccttcctggactaccccaactggaacgtggccaagcaggacgactgggtgagcgtgttcagagagctggacagcgacatcccctgcacccccctgaacaccctgttcatgcacctgttcgtggccgtggacgagtacagcgtgggctgctgcaaggagatcctgagaaccgtgtacaaggccgtgcccgagctgcacttcatcttcctgatcgtgcccagctacatgagcctgggcagcaccctgatcaccgtgttcgaccaggtgggcaacatcccctgcctgacctacgaggaggacttcgccgtgcacatctgccacagacacagccactacccccagctgcacgtgagaaaggccagagtggaggaccacgacgacctgatgcccatcttcatgagatacgacaccatcctgaaggagacctacggcgagtacttcctggccgagctgatcgaggcccaggacgaggagaaccacgccgtggtgtgcgaggtggagggcaccgccgtgggcttcatgagcgtgtgcagcagagtgaacatgcagctgctgcacgagtgcttcgacctgggccccttccacggcctgtgcttcccccaccccgacgacgtgctggagagcccccaggacctgagcgtgagaagaagccaggacgccgagctgagaagcagcagccagggcagccagaagatcgtggaggagctgcaggagcccgtgagccccgacaccatggagaacatccagggcaacatcgccagagaggccgccagcgaggaggccctgaccgccgtgcagagcggcaacgtgagcgagcccgaggacatcgagaagctgagcgacatcagcaccggctacgcccagtaccaccacgtgagcagcagaagcctggccagcctggtgctgcccgaggagcccgtgcacttcagacccatctacagaggcgccagcgccgccttctgcatccagctgttctgcatcgacgagaagtacgaggccagaagcctggacttcatgaacttcgtgttcagcctgttcagcgacaagaacttctgcgtgatcagcctgccccacctgacccccgagttcttcctgatccagaacttcgtgaagatggtgcccttcaacacctgcaccctggagcaggacctgtacgtgttccacagagccggcctgctgaagaacatctgcctgggcagaagcagctag

SEQ ID NO: 19186 - DNA, 963 bp, Artificial Sequence
  Description of Artificial Sequence: Synthetic coding sequence
atgagctacgccctgaaccacaccaacagaaagctgaccctggagcccaagatcaccgtgaacgccaagatcatcgtggtgggcgccagcagcgtgggcatcagcttcctggagaccctggtgttctgcagccacatgaagttcaacaacctgaccctgatcagcacccacggcctgcccggcaagaagctgctggacaccgagcagagaaagttcctggccagcgaccactgcttcaacgacaaggactacgccctgatgagcctgtgcagctgggtgaacgtggtggtgggcagaatgaccggcatcgacagagccgccaagcacgtggtgctgagcaccgacgagatcgtgccctacgaccacctgatcctgtgcaccggccagcagtaccaggtgccctgccccaccgaggccgacatcagccagcacctgaccaacagagaggtgcccaacagcagccagagaagatacaccggcaaggtgccctgcaaccacttcaccctgaacgaggaggaggactgcttcaaggccctgatctggatcagaaacaacagcatcaccaccgagggcaacatcatcgtgtacggcaacaccatcgacacctacaccaccgtggagaccctgctgaacctgggcgtgagcggcagcagaatccacctggtgcagcccccccccgccagcaccatcacctgcatcaacaactacagcgtggagagcgccgtggccgacgccctgggcgccgccggcgtgaccatgtacagagacgccatcctggcccagtggaacgacggcctgcaccccgaccccatctacagcgccagcttcaccacccccaccaagcccttcagactgcagtgcagcggcgccttcttcctgggcctgaccatcatctgcatcctgcccagcctgcccttccagctgccctggagatacaagtggcacagcctgatcatggtgtag

SEQ ID NO: 19187 - DNA, 3612 bp, Artificial Sequence
  Description of Artificial Sequence: Synthetic coding sequence
atgagcgtgctgaccagccccagaggcaaggtggaggtggtgcactgcagaagaaccgagagccaggacgtgtactgcatcaagagcctgatcagaaagttcacctgcaagctgttcggcaagctgaacatcatctacctgctggagaaggccaacctggccgtgaccctgtgcaacgacaaggaggagatcatggcccaggccaccttcctggactaccccaactggaacgtggccaagcaggacgactgggtgagcgtgttcagagagctggacagcgacatcccctgcacccccctgaacaccctgttcatgcacctgttcgtggccgtggacgagtacagcgtgggctgctgcaaggagatcctgagaaccgtgtacaaggccgtgcccgagctgcacttcatcttcctgatcgtgcccagctacatgagcctgggcagcaccctgatcaccgtgttcgaccaggtgggcaacatcccctgcctgacctacgaggaggacttcgccgtgcacatctgccacagacacagccactacccccagctgcacgtgagaaaggccagagtggaggaccacgacgacctgatgcccatcttcatgagatacgacaccatcctgaaggagacctacggcgagtacttcctggccgagctgatcgaggcccaggacgaggagaaccacgccgtggtgtgcgaggtggagggcaccgccgtgggcttcatgagcgtgtgcagcagagtgaacatgcagctgctgcacgagtgcttcgacctgggccccttccacggcctgtgcttcccccaccccgacgacgtgctggagagcccccaggacctgagcgtgagaagaagccaggacgccgagctgagaagcagcagccagggcagccagaagatcgtggaggagctgcaggagcccgtgagccccgacaccatggagaacatccagggcaacatcgccagagaggccgccagcgaggaggccctgaccgccgtgcagagcggcaacgtgagcgagcccgaggacatcgagaagctgagcgacatcagcaccggctacgcccagtaccaccacgtgagcagcagaagcctggccagcctggtgctgcccgaggagcccgtgcacttcagacccatctacagaggcgccagcgccgccttctgcatccagctgttctgcatcgacgagaagtacgaggccagaagcctggacttcatgaacttcgtgttcagcctgttcagcaacttcgtgaagatggtgcccttcaacacctgcaccctggagcaggacctgtacgtgttccacagagccggcctgctgaagagcatcaacatcagattcgccaccctgctggacacccccggcgtggagaacctggtgagcaccctgatgctgaacaagagcatcctggaggacctggacagatacaacaaggccagaaaggaccccgacggcaccctgctgcaggccttcgtggccgaggtggccgagcagatcgtgggcatcgccgtgatcagaaacgagatggacatcgagtacatcagaagccactacaacatcgaggacttcatctacttcagccaccaccagagagaggagcacggccacatgcaccacttcgccctgaaccccatcttcagacactacaccaagttcttcctgaaggagatcctgagactgggcttcaagagctgcctgtactacagagtgtaccccaagagcagagagggcaagttccagaacccctacgcccacagcctgaccagcgccctgcactacctggtgcccgtgagacccagaagacagatcgtgtaccccctggagaagctgggcatcaacgcccccagcaaggccgtgagcaaggaccccatgagctacgccctgaaccacaccaacagaaagctgaccctggagcccaagatcaccgtgaacgccaagatcatcgtggtgggcgccagcagcgtgggcatcagcttcctggagaccctggtgttctgcagccacatgaagttcaacaacctgaccctgatcagcacccacggcctgcccggcaagaagctgctggacaccgagcagagaaagttcctggccagcgaccactgcttcaacgacaaggactacgccctgatgagcctgtgcagctgggtgaacgtggtggtgggcagaatgaccggcatcgacagagccgccaagcacgtggtgctgagcaccgacgagatcgtgccctacgaccacctgatcctgtgcaccggccagcagtaccaggtgccctgccccaccgaggccgacatcagccagcacctgaccaacagagaggtgcccaacagcagccagagaagatacaccggcaaggtgccctgcaaccacttcaccctgaacgaggaggaggactgcttcaaggccctgatctggatcagaaacaacagcatcaccaccgagggcaacatcatcgtgtacggcaacaccatcgacacctacaccaccgtggagaccctgctgaacctgggcgtgagcggcagcagaatcaacaactacagcgtggagagcgccgtggccgacgccctgggcgccgccggcgtgaccatgtacagagacgccatcctggcccagtggaacgacggcctgcaccccgaccccatctacagcgccagcttcaccacccccaccaagcccttcagactgcagtgcagcatgttcttcagcttctgcgagaagaacgtggactacgagaccttcaaggccctgaacgacgcctgcctggtgtacgacagcagactggtgatcgacaccaacttccacaccaacgacatcgccatcagagccgccggcagcctgaccaagttcagcaacagatactacagcaacgagtggacccacagcaacttcagcagcaaggagatcggcttccagctggccgccgccatgctgcacctgttcgaccccaccctggagcccgtgaccgagccccccgccaacctggacagactgatccccatgtacaagggcgccaagatccagggcggcatcctgcccggcagctaccactacctgcacatcgccaagcccgccatccccacccccctggaggtgcagatggcccagcccaactacggcctggagctggtgaccggcagcgccaagaacggcacctacttcagaatccacatcaacaagtacaagatggtggagaccatcacctgcctgagcagagagcccttccccgccagcaactacatcagactgttcggccagcacgagcagctgctgaacaacctgtgcgccagatacgacgagaacctgatcaccgacctgtacagctacttcaccgagccctggtgcctggccctgttccacgacagattcatcgacctgagaaaggagctgagacagatcctggccagcaaggaggaggaggacctgcccagcatcgagcagctggcccaccagatcgaggacgaggagatcaaccccaccgagaagcccagacagtacctgaagagagtgttcgaggagagcatctacaagaccctggtggagagaagcaccctggactacctgcactacaacagataccacctgcccatgtacgcctggcccggcatcgtgtag

SEQ ID NO: 19188 - DNA, 603 bp, Artificial Sequence; identical to SEQ ID NO: 19182
  Description of Artificial Sequence: Synthetic coding sequence

SEQ ID NO: 19189 - DNA, 1413 bp, Artificial Sequence; identical to SEQ ID NO: 19185
  Description of Artificial Sequence: Synthetic coding sequence

SEQ ID NO: 19190 - DNA, 408 bp, Artificial Sequence
  Description of Artificial Sequence: Synthetic coding sequence
atgagcgtgctgaccagccccagaggcaaggtggaggtggtgcactgcagaagaaccgagagccaggacgtgtactgcatcaagagcctgatcagaaagttcacctgcaagctgttcggcaagctgaacatcatctacctgctggagaaggccaacctggccgtgaccctgtgcaacgacaaggaggagatcatggcccaggccaccttcctggactaccccaactggaacgtggccaagcaggacgactgggtgagcgtgttcagagagctggacagcgacatcccctgcacccccctgaacaccctgttcatgcacctgttcgtggccgtggacgagtacagcgtgggctgctgcaaggagatcctgagaaccgtgtacaaggccgtgcccgagctgcacttctag

SEQ ID NO: 19191 - DNA, 1467 bp, Artificial Sequence
  Description of Artificial Sequence: Synthetic coding sequence
atggagcccttcctgagaagaagactggccttcctgagcttcttctgggacaagatctggcccgccggcggcgagcccgaccacggcacccccggcagcctggaccccaacaccgaccccgtgcccaccctgcccgccgagccctgcagccccttcccccagctgttcctggccctgtacgacttcaccgccagatgcggcggcgagctgagcgtgagaagaggcgacagactgtgcgccctggaggagggcggcggctacatcttcgccagaagactgagcggccagcccagcgccggcctggtgcccatcacccacgtggccaaggccagccccgagaccctgagcgaccagccctggtacttcagcggcgtgagcagaacccaggcccagcagctgctgctgagcccccccaacgagcccggcgccttcctgatcagacccagcgagagcagcctgggcggctacagcctgagcgtgagagcccaggccaaggtgtgccactacagagtgagcatggccgccgacggcagcctgtacctgcagaagggcagactgttccccggcctggaggagctgctgacctactacaaggccaactggaagctgatccagaaccccctgctgcagccctgcatgccccagaaggcccccagacaggacgtgtgggagagaccccacagcgagttcgccctgggcagaaagctgggcgagggctacttcggcgaggtgtgggagggcctgtggctgggcagcctgcccgtggccatcaaggtgatcaagagcgccaacatgaagctgaccgacctggccaaggagatccagaccctgaagggcctgagacacgagagactgatcagactgcacgccgtgtgcagcggcggcgagcccgtgtacatcgtgaccgagctgatgagaaagggcaacctgcaggccttcctgggcacccccgagggcagagccctgagactgccccccctgctgggcttcgcctgccaggtggccgagggcatgagctacctggaggagcagagagtggtgcacagagacctggccgccagaaacgtgctggtggacgacggcctggcctgcaaggtggccgacttcggcctggccagactgctgaaggacgacatctacagccccagcagcagcagcaagatccccgtgaagtggaccgcccccgaggccgccaactacagagtgttcagccagaagagcgacgtgtggagcttcggcgtgctgctgcacgaggtgttcacctacggccagtgcccctacgagggcatgaccaaccacgagaccctgcagcagatcatgagaggctacagactgcccagacccgccgcctgccccgccgaggtgtacgtgctgatgctggagtgctggagaagcagccccgaggagagacccagcttcgccaccctgagagagaagctgcacgccatccacagatgccacccctag

SEQ ID NO: 19192 - DNA, 402 bp, Artificial Sequence
  Description of Artificial Sequence: Synthetic coding sequence
atggccgccgccaacaagggcaacaagcccagagtgagaagcatcagattcgccgccggccacgacgccgagggcagccacagccacgtgcacttcgacgagaagctgcacgacagcgtggtgatggtgacccaggagagcgacagcagcttcctggtgaaggtgggcttcctgaagatcctgcacagatacgagatcaccttcaccctgccccccgtgcacagactgagcaaggacgtgagagaggcccccgtgcccagcctgcacctgaagctgctgagcgtggtgcccgtgcccgaggacagacaccacggcacccccatgctgctggacggcgtgaagtgcgtgggcgccgagctggagtacgacagcgagcacagcgactggcacggcttcgactag

SEQ ID NO: 19193 - DNA, 525 bp, Artificial Sequence
  Description of Artificial Sequence: Synthetic coding sequence
atggccgccgccaacaagggcaacaagcccagagtgagaagcatcagattcgccgccggccacgacgccgagggcagccacagccacgtgcacttcgacgagaagctgcacgacagcgtggtgatggtgacccaggagagcgacagcagcttcctggtgaaggtgggcttcctgaagatcctgcacagatacgagatcaccttcaccctgccccccgtgcacagactgagcaaggacgtgagagaggcccccgtgcccagcctgcacctgaagctgctgagcgtggtgcccgtgcccgagggctacagcgtgaagtgcgagtacagcgcccacaaggagggcgtgctgaaggaggagatcctgctggcctgcgagggcggcaccggcacctgcgtgagagtgaccgtgcaggccagagtgatggacagacaccacggcacccccatgctgctggacggcgtgaagtgcgtgggcgccgagctggagtacgacagcgagcacagcgactggcacggcttcgactag

SEQ ID NO: 19194 - DNA, 525 bp, Artificial Sequence; identical to SEQ ID NO: 19193
  Description of Artificial Sequence: Synthetic coding sequence

SEQ ID NO: 19195 - DNA, 384 bp, Artificial Sequence
  Description of Artificial Sequence: Synthetic coding sequence
tgaaacaagcccagagtgagaagcatcagattcgccgccggccacgacgccgagggcagccacagccacgtgcacttcgacgagaagctgcacgacagcgtggtgatggtgacccaggagagcgacagcagcttcctggtgaaggtgggcttcctgaagatcctgcacagatacgagatcaccttcaccctgccccccgtgcacagactgagcaaggacgtgagagaggcccccgtgcccagcctgcacctgaagctgctgagcgtggtgcccgtgcccgaggacagacaccacggcacccccatgctgctggacggcgtgaagtgcgtgggcgccgagctggagtacgacagcgagcacagcgactggcacggcttcgactag

SEQ ID NO: 19196 - DNA, 603 bp, Artificial Sequence
  Description of Artificial Sequence: Synthetic coding sequence
atggtgcacgccttcctgatccacaccctgagagcccccaacaccgaggacaccggcctgtgcagagtgctgtacagctgcgtgttcggcgccgagaagagccccgacgaccccagaccccacggcgccgagagagacagactgctgagaaaggagcagatcctggccgtggccagacaggtggagagcatgtgcagactgcagcagcaggccagcggcagaccccccatggacctgcagccccagagcagcgacgagcaggtgcccctgcacgaggcccccagaggcgccttcagactggccgccgagaaccccttccaggagcccagaaccgtggtgtggctgggcgtgctgagcctgggcttcgccctggtgctggacgcccacgagaacctgctgctggccgagggcaccctgagactgctgaccagactgctgctggaccacctgagactgctggcccccagcaccagcctgctgctgagagccgacagaatcgagggcatcctgaccagattcctgccccacggccagctgctgttcctgaacgaccagttcgtgcagggcctggagaaggagttcagcgccgcctggcccagatag

SEQ ID NO: 19197 - DNA, 603 bp, Artificial Sequence; identical to SEQ ID NO: 19196
  Description of Artificial Sequence: Synthetic coding sequence

SEQ ID NO: 19198 - DNA, 180 bp, Artificial Sequence
  Description of Artificial Sequence: Synthetic coding sequence
atggtgcacgccttcctgatccacaccctgagagcccccaacaccgaggacaccggcctgtgcagagtgctgtacagctgcgtgttcggcgccgagaagagccccgacgaccccagaccccacggcgccgagagagacagactgctgagaaaggagcagatcctggccgtggccagatag

SEQ ID NO: 19199 - DNA, 261 bp, Artificial Sequence
  Description of Artificial Sequence: Synthetic coding sequence
atggtgcacgccttcctgatccacaccctgagagcccccaacaccgaggacaccggcctgtgcagagtgctgtacagctgcgtgttcggcgccgagaagagccccgacgaccccagaccccacggcgccgagagagacagactgctgagaaaggagcagatcctggccgtggccagacaggtggagagcatgtgcagactgcagcagcaggccagcggcagaccccccatggacctgcagccccagagcagcgacgagtag

SEQ ID NO: 19200 - DNA, 1155 bp, Artificial Sequence
  Description of Artificial Sequence: Synthetic coding sequence
atggccgccgtgcagatggaccccgagctggccaagagactgttcttcgagggcgccaccgtggtgatcctgaacatgcccaagggcaccgagttcggcatcgactacaacagctgggaggtgggccccaagttcagaggcgtgaagatgatcccccccggcatccacttcctgcactacagcagcgtggacaaggccaaccccaaggaggtgggccccagaatgggcttcttcctgagcctgcaccagagaggcctgaccgtgctgagatggagcaccctgagagaggaggtggacctgagccccgcccccgagagcgaggtggaggccatgagagccaacctgcaggagctggaccagttcctgggcccctacccctacgccaccctgaagaagtggatcagcctgaccaacttcatcagcgaggccaccgtggagaagctgcagcccgagaacagacagatctgcgccttcagcgacgtgctgcccgtgctgagcatgaagcacaccaaggacagagtgggccagaacctgcccagatgcggcatcgagtgcaagagctaccaggagggcctggccagactgcccgagatgaagcccagagccggcaccgagatcagattcagcgagctgcccacccagatgttccccgagggcgccacccccgccgagatcaccaagcacagcatggacctgagctacgccctggagaccgtgctgaacaagcagttccccagcagcccccaggacgtgctgggcgagctgcagttcgccttcgtgtgcttcctgctgggcaacgtgtacgaggccttcgagcactggaagagactgctgaacctgctgtgcagaagcgaggccgccatgatgaagcaccacaccctgtacatcaacctgatcagcatcctgtaccaccagctgggcgagatccccgccgacttcttcgtggacatcgtgagccaggacaacttcctgaccagcaccctgcaggtgttcttcagcagcgcctgcagcatcgccgtggacgccaccctgagaaagaaggccgagaagttccaggcccacctgaccaagaagttcagatgggacttcgccgccgagcccgaggactgcgcccccgtggtggtggagctgcccgagggcatcgagatgggctag

SEQ ID NO: 19201 - DNA, 1155 bp, Artificial Sequence; identical to SEQ ID NO: 19200
  Description of Artificial Sequence: Synthetic coding sequence

SEQ ID NO: 19202 - DNA, 921 bp, Artificial Sequence
  Description of Artificial Sequence: Synthetic coding sequence
atgggctgcgacggcggcaccatccccaagagacacgagctggtgaagggccccaagaaggtggagaaggtggacaaggacgccgagctggtggcccagtggaactactgcaccctgagccaggagatcctgagaagacccatcgtggcctgcgagctgggcagactgtacaacaaggacgccgtgatcgagttcctgctggacaagagcgccgagaaggccctgggcaaggccgccagccacatcaagagcatcaagaacgtgaccgagctgaagctgagcgacaaccccgcctgggagggcgacaagggcaacaccaagggcgacaagcacgacgacctgcagagagccagattcatctgccccgtggtgggcctggagatgaacggcagacacagattctgcttcctgagatgctgcggctgcgtgttcagcgagagagccctgaaggagatcaaggccgaggtgtgccacacctgcggcgccgccttccaggaggacgacgtgatcatgctgaacggcaccaaggaggacgtggacgtgctgaagaccagaatggaggagagaagactgagagccaagctggagaagaagaccaagaagcccaaggccgccgagagcgtgagcaagcccgacgtgagcgaggaggcccccggccccagcaaggtgaagaccggcaagcccgaggaggccagcctggacagcagagagaagaagaccaacctggcccccaagagcaccgccatgaacgagagcagcagcggcaaggccggcaagcccccctgcggcgccaccaagagaagcatcgccgacagcgaggagagcgaggcctacaagagcctgttcaccacccacagcagcgccaagagaagcaaggaggagagcgcccactgggtgacccacaccagctactgcttctag

SEQ ID NO: 19203 - DNA, 1011 bp, Artificial Sequence
  Description of Artificial Sequence: Synthetic coding sequence
atgggctgcgacggcggcaccatccccaagagacacgagctggtgaagggccccaagaaggtggagaagatctggcacctgaagaacggcaaggagtggtgcagcctgcacagcgagggcaagaacaagaacggcaaggagtgggacatggagtacgacgtggacaaggacgccgagctggtggcccagtggaactactgcaccctgagccaggagatcctgagaagacccatcgtggcctgcgagctgggcagactgtacaacaaggacgccgtgatcgagttcctgctggacaagagcgccgagaaggccctgggcaaggccgccagccacatcaagagcatcaagaacgtgaccgagctgaagctgagcgacaaccccgcctgggagggcgacaagggcaacaccaagggcgacaagcacgacgacctgcagagagccagattcatctgccccgtggtgggcctggagatgaacggcagacacagattctgcttcctgagatgctgcggctgcgtgttcagcgagagagccctgaaggagatcaaggccgaggtgtgccacacctgcggcgccgccttccaggaggacgacgtgatcatgctgaacggcaccaaggaggacgtggacgtgctgaagaccagaatggaggagagaagactgagagccaagctggagaagaagaccaagaagcccaaggccgccgagagcgtgagcaagcccgacgtgagcgaggaggcccccggccccagcaaggtgaagaccggcaagcccgaggaggccagcctggacagcagagagaagaagaccaacctggcccccaagagcaccgccatgaacgagagcagcagcggcaaggccggcaagcccccctgcggcgccaccaagagaagcatcgccgacagcgaggagagcgaggcctacaagagcctgttcaccacccacagcagcgccaagagaagcaaggaggagagcgcccactgggtgacccacaccagctactgcttctag

SEQ ID NO: 19204 - DNA, 129 bp, Artificial Sequence
  Description of Artificial Sequence: Synthetic coding sequence
atgggctgcgacggcggcaccatccccaagagacacgagctggtgaagggccccaagaaggtggagaaggccatcatcggcggcctgctggacggcgcctggagccccgagacccccagccaggactag

SEQ ID NO: 19205 - DNA, 456 bp, Artificial Sequence
  Description of Artificial Sequence: Synthetic coding sequence
atgttccaggtgttcaagccccacgccggcgaggactacaagtaccccagagagaccgagaccatctggagccacccctacgtggtggagggcagccacaagagccccctggagagcctgagcctgcacggctgcctggccgccatggcccccagcatcaccagcagcgaggacagcagccccagccagagagacaagaaggacctgagcctggacctgctgctgaccagaaagaagagaagccagggcctgcactggagccactggcagggcctgaaccacatgagcatcagaatccacacccccgagcagggcagccccagcctgggccagaactggagctggggcaacagaaaggagaagggcgtggcccagagacaggtgcccaccaccggcacccacagcttcttccactgcaccagcgagggcaacaaggagaagccccaccacttctag

SEQ ID NO: 19206 - DNA, 471 bp, Artificial Sequence
  Description of Artificial Sequence: Synthetic coding sequence
atgtggaagagaagcgaccaccagcccaagatcaaggccgaggacggccccctggtgggccagttcgaggtgctgggcagcgtgcccgagcccgccatgccccaccccctggagctgagcgagttcgagagcttccccgtgttccaggacatcagactgcacatcagagaggtgggcgcccagctggtgaagaaggtgaacgccgtgttccagctggacatcaccaagaacggcaagaccatcctgagatggaccatcgacctgaagaacggcagcggcgacatgtaccccggccccgccagactgcccgccgacaccgtgttcaccatccccgagagcgtgttcatggagctggtgctgggcaagatgaacccccagaaggccttcctggccggcaagttcaaggtgagcggcaaggtgctgctgagctggaagctggagagagtgttcaaggactgggccaagttctag

SEQ ID NO: 19207 - DNA, 414 bp, Artificial Sequence
  Description of Artificial Sequence: Synthetic coding sequence
atggcccagaagcccctgagcaccgccgccgccgagagaatgaacctggtgggccaggacgagatctggaagtacagactgaaggccgagagcgaggccagacagaactggccccagaactggggcttcctgaccacccccttcgaggagctgatcaagtgcgaggaggacctgcccacccccaagcccaagatcgagctgcccgagagattcagaatcagacccgtgacccccgtggagaagtacatcaaggtgttccccagcccccccgtgccccagaccacccagggcttcatcggctggagaagcgccgtgcccggcctgaacaagtgcctggagctggacgacgccatcagaagctgcaagggcgccttcgccagagagctgtgctggcccaagcagggcgtgcactag

SEQ ID NO: 19208 - DNA, 1227 bp, Artificial Sequence
  Description of Artificial Sequence: Synthetic coding sequence
atggccagcaagaagttcgccgtgaagtgcggcaacttcgccgtgctggtggacctgcacatcctgccccagggcagcaacaaggacaccagctggttcagcgagcagaagaaggaggaggtgtgcctgctgctgaaggagaccatcgacagcagagtgcaggagtacctggaggtgagaaagcagcacagacccagcaacgccgagttcaccagaagcaaccccctgagcctgaagggctacggcttccagatcaccgcctacttcctgaagagaggcatcagactgagatgcatcagaagcacccagaacgccgagctgtgcgtgttccccgacagattcgtggtgtgcgtgagccagctggccttcagcagagacctgctggccagccagaacgaggacctgaccgagagagtgctgcacggcgtgagcgactacttcgccgagtgcgccgagagcagcctgccccccagcgccaagctgagaagaaacgccctgaaggagatcgtgaagagaaccgagaccaagagcagcgtgaccagcaagagccagaccagaagagacaccgtggagaccagcagcgacagcgtgatcgccgagatcgccagaagaagaaacgacggccaggccagcagcagcccccccagcgagagcatgggccaggccaaggacagcatcaaggccgccgagagccactggggcctgcccgtgcagaagctggagaaggtgaaccagacccagcccgaggacaccagcggccagcagaagccccaccccggcgagagactgaagaccggcctgctgagcagaagccccgtgtgcagctgcgagagcgccagcccctgccccaagcagagccccagagtggccaagacccagcagaagagaagaaactgcagcagcgccgaggacttcgaccaccacggcagagtgagcctgggcagcgacagactggtgcccagagagatcatcgtggagaagagcaaggccgtgagagtgctgcccgccagcgagctgagcgaccccggcctgctgctgaagcaggacctggccaagaccaccagcaaggaggagctgcacgtgctggagagcctgagcagcagacacctgatgaagaacaaccccggccaggcccagcagaccggcctggccaccaacaccgagagactgagcaccatccagaacagccccaccaagaagagaaagaagtacgagagaggccactag

SEQ ID NO: 19209 - DNA, 1092 bp, Artificial Sequence
  Description of Artificial Sequence: Synthetic coding sequence
atggcccacgtgctgcagaagcccaagcacagcggcacccacagcatcgtgcaggagttccaggtgcccgactacgtgccctggcagcagagcaagcaggagaccaagcccagcaccctgccccccgtgcagcaggccaacagcctgcacaccagcaagatgaagaccctgaccagagtgcagcccgtgttccacttcaagcccaccaccgtggtgaccagctgccagcccaagaaccccagagagctgcacagaagaagaaagctggaccccggcaagatgcacgccaagatctggctgatgaagaccagcctgagaagcggcagagccgccctgagagagctgagaagcagagagaacttcctgagcaagctgaacagagagctgatcgagaccatccaggagatggagaacagcaccaccctgcacgtgagagccctgctgcagcagcaggacaccctggccaccatcatcgacatcctggagtacagcaacaagaagagactgcagcagctgaagagcgagctgcaggagtgggaggagaagaagaagtgcaagatgagctacctggagcagcaggccgagcagctgaacgccaagatcgagaagacccaggaggaggtgaacttcctgagcacctacatggaccacgagtacagcatcaagagcgtgcagatcagcaccctgatgagacagctgcagcaggtgaaggacagccagcaggacgagctggacgacctgggcgagatgagaagaaaggtgctggagagcctgagcgacaagatccagaagaagaagaagaagatcctgagcagcgtggtggccgagacccagagaccctacgaggaggccctgctgcagaagatgtgggagagccaggacttcctgaagtgcatgcagagattcagagagatcatcgaccagttcgaggagaacatgcccgtgctgagagccgaggtggaggagctgcaggcccagaccagagagcccagagaggtgatcttcgaggacgtgctgctgagaagacccaagtgcacccccgacatggacgtgatcctgaacatccccgtggaggagcccctgcccttctag

SEQ ID NO: 19210 - DNA, 987 bp, Artificial Sequence
  Description of Artificial Sequence: Synthetic coding sequence
atggaggtgctgagcctgcccaacagcttccagacccaggccctgtgggacagcctgcacagccccggcgtgcccggcagcgtgttccacttcaagcccaccaccgtggtgaccagctgccagcccaagaaccccagagagctgcacagaagaagaaagctggaccccggcaagatgcacgccaagatctggctgatgaagaccagcctgagaagcggcagagccgccctgagagagctgagaagcagagagaacttcctgagcaagctgaacagagagctgatcgagaccatccaggagatggagaacagcaccaccctgcacgtgagagccctgctgcagcagcaggacaccctggccaccatcatcgacatcctggagtacagcaacaagaagagactgcagcagctgaagagcgagctgcaggagtgggaggagaagaagaagtgcaagatgagctacctggagcagcaggccgagcagctgaacgccaagatcgagaagacccaggaggaggtgaacttcctgagcacctacatggaccacgagtacagcatcaagagcgtgcagatcagcaccctgatgagacagctgcagcaggtgaaggacagccagcaggacgagctggacgacctgggcgagatgagaagaaaggtgctggagagcctgagcgacaagatccagaagaagaagaagaagatcctgagcagcgtggtggccgagacccagagaccctacgaggaggccctgctgcagaagatgtgggagagccaggacttcctgaagtgcatgcagagattcagagagatcatcgaccagttcgaggagaacatgcccgtgctgagagccgaggtggaggagctgcaggcccagaccagagagcccagagaggtgatcttcgaggacgtgctgctgagaagacccaagtgcacccccgacatggacgtgatcctgaacatccccgtggaggagcccctgcccttctag

SEQ ID NO: 19211 - DNA, 771 bp, Artificial Sequence
  Description of Artificial Sequence: Synthetic coding sequence
atgagctacaagatgttccacttcaagcccaccaccgtggtgaccagctgccagcccaagaaccccagagagctgcacagaagaagaaagctggaccccggcaagatgcacgccaagatctggctgatgaagaccagcctgagaagcggcagagccgccctgagagagctgagaagcagagagaacttcctgagcaagctgaacagagagctgatcgagaccatccaggagatggagaacagcaccaccctgcacgtgagagccctgctgcagcagcaggacaccctggccaccatcatcgacatcctggagtacagcaacaagaagagactgcagcagctgaagagcgagctgcaggagtgggaggagaagaagaagtgcaagatgagctacctggagcagcaggccgagcagctgaacgccaagatcgagaagacccaggaggaggtgaacttcctgagcacctacatggaccacgagtacagcatcaagagcgtgcagatcagcaccctgatgagacagctgcagcaggtgaaggacagccagcaggacgagctggacgacctgggcgagatgagaagaaaggtgctggagagcctgagcgacaagatccagaagaagaagaagaagatcctgagcagcgtggtggccgagacccagagaccctacgaggaggccctgctgcagaagatgtgggagagccaggacttcctgaagtgcatgcagagattcagagaggtgagaggccagggcagatggtggagcctgtag

SEQ ID NO: 19212 - DNA, 186 bp, Artificial Sequence
  Description of Artificial Sequence: Synthetic coding sequence
atgggcagagccgacacccccagacacccccccccccccgccgccggcttcggcgtgcacagaggcgccttcctgatccccgtggccctgagagtgctgctggccggcagaacccccagacccttcacccccggcctggccgaccccagaagactgggccccagaagagtgcaggccgcccagtag

SEQ ID NO: 19213 - DNA, 225 bp, Artificial Sequence
  Description of Artificial Sequence: Synthetic coding sequence
atggagagagcccagtgcctgagaaagggcatcctgagcttcgagagaagcctggagcagagaagcctgatcctgagccccagactggagtacagcggcgccatcaccgcccactgcagcctggacctgctggacagcaccaacccccccgccagcgccttctgggtggtggagaccaccgacaccgaggacgagagagagaagaagagagagatcaccgagtag

SEQ ID NO: 19214 - DNA, 240 bp, Artificial Sequence
  Description of Artificial Sequence: Synthetic coding sequence
atgcaccacgtgagacagctgatgatgcccatctgccccatggccctgaacagcaccaccagcagcagcaccaccttcggcgccttcagaatcatgaccctgaacgtggaggagtgggccaccgcctggaaggtgctgatcctgctggaggccgccgtggaggaggagaagagaagcgaggagaagagaatcctggtgtgcggcacctgcggcaccagaagcagccagaagaacctgtag

SEQ ID NO: 19215 - DNA, 240 bp, Artificial Sequence; identical to SEQ ID NO: 19214
  Description of Artificial Sequence: Synthetic coding sequence

SEQ ID NO: 19216 - DNA, 327 bp, Artificial Sequence
  Description of Artificial Sequence: Synthetic coding sequence
atgctggccaagggcgccgaggagggcagaagcggcggccccagacccgccatcaccctgcccggcagcctgcacttcacctgcgacctgaagaccagcccctactgcctgaccagagccgagctgatggagcacctgcccctgagagtggccgtgcacagcatgagcccctgccacagaagctgcttctgcggcgagctgaagagaggccacccctggaacaccccccaggtgagcagcttccccagcagcaccaccagcctgagccacagctgcaccaccagccacctggactgcagccagcaggtggagagcggcagcaagtag

SEQ ID NO: 19217 - DNA, 327 bp, Artificial Sequence; identical to SEQ ID NO: 19216
  Description of Artificial Sequence: Synthetic coding sequence

SEQ ID NO: 19218 - DNA, 969 bp, Artificial Sequence
  Description of Artificial Sequence: Synthetic coding sequence
atggccagaagcagactgcccgccaccagcctgagaaagccctggaagctggacagacagaagctgcccagccccgacagcggccacagcctgctgtgcggctggagccccggcggcaaggccagacccgccggcaacaccggcgcctgggcccccgccgagcagttcttccccgccagcaacagaaccagagagggcggcggcctgtggccccccctgcccctgcagagcagccccgccgcccccaccatgctggacagcagcgccgccgagcaggtgaccagactgaccctgaagctgctgggccagaagctggagcaggagagacagaacgtggagggcggccccgagggcctgcacctggagcccggcaacgaggacagacccgacgacgccctgcagaccgccctgaagagaagaagagacctgctgcagagactgagagagcagcacctgctggacgagctgagcagagcccaggcctggagcggccccagcagaggcgccctgggcagcgccctgccccccgagctgccccccaccggcatcctgcccaccgccagccccagccccctggcccccgacccccccagaatcatcctgcccaccgtgccccagccccccgccaccatcatccagcagctgccccagcagcccctgatcgcccagatcccccccccccaggccttccccacccagagaagcggcagcatcaaggaggacatggtggagctgctgctgctgcagaacgcccaggtgcaccagctggtgctgcagaactggatgctgaaggccctgccccccgccctgcaggaccccccccacgtgccccccagagtgcccagagccgccagacccagactgcccgccgtgcaccaccaccaccaccaccaccacgccgtgtggccccccggcgccgccaccgtgctgcagcccgcccccagcctgtggacccccggccccccctag

SEQ ID NO: 19219 - DNA, 288 bp, Artificial Sequence
  Description of Artificial Sequence: Synthetic coding sequence
atgctggacagcagcgccgccgagcaggtgaccagactgaccctgaagctgctgggccagaagctggagcaggagagacagaacgtggagggcggccccgagggcctgcacctggagcccggcaacgaggacagacccgacgacgccctgcagaccgccctgaagagaagaagagacctgctgcagagactgagagaggccaccctgatgcacatcaccctggagggcagcagcagccacggccaccccgccagaagaggcgcctgcacctggcccagactggcctag

SEQ ID NO: 19220 - DNA, 855 bp, Artificial Sequence
  Description of Artificial Sequence: Synthetic coding sequence
ggcaaggccagacccgccggcaacaccggcgcctgggcccccgccgagcagttcttccccgccagcaacagaaccagagagggcggcggcctgtggccccccctgcccctgcagagcagccccgccgcccccaccatgctggacagcagcgccgccgagcaggtgaccagactgaccctgaagctgctgggccagaagctggagcaggagagacagaacgtggagggcggccccgagggcctgcacctggagcccggcaacgaggacagacccgacgacgccctgcagaccgccctgaagagaagaagagacctgctgcagagactgagagagcagcacctgctggacgagctgagcagagcccaggcctggagcggccccagcagaggcgccctgggcagcgccctgccccccgagctgccccccaccggcatcctgcccaccgccagccccagccccctggcccccgacccccccagaatcatcctgcccaccgtgccccagccccccgccaccatcatccagcagctgccccagcagcccctgatcgcccagatcccccccccccaggccttccccacccagagaagcggcagcatcaaggaggacatggtggagctgctgctgctgcagaacgcccaggtgcaccagctggtgctgcagaactggatgctgaaggccctgccccccgccctgcaggaccccccccacgtgccccccagagtgcccagagccgccagacccagactgcccgccgtgcaccaccaccaccaccaccaccacgccgtgtggccccccggcgccgccaccgtgctgcagcccgcccccagcctgtggacccccggccccccctag

SEQ ID NO: 19221 - DNA, 660 bp, Artificial Sequence
  Description of Artificial Sequence: Synthetic coding sequence
atggccccccccagcagacactgcctgctgctgatcagcaccctgggcgtgttcgccctgaactgcttcaccaagggccagaagaacagcaccctgatcttcaccagagagaacaccatcagaaactgcagctgcagcgccgacatcagagactgcgactacagcctggccaacctgatgtgcaactgcaagaccgtgctgcccctggccgtggagagaaccagctacaacggccacctgaccatctggttcaccgacaccagcgccctgggccacctgctgaacttcaccctggtgcaggacctgaagctgagcctgtgcagcaccaacaccctgcccaccgagtacctggccatctgcggcctgaagagactgagaatcaacatggaggccaagcaccccttccccgagcagagcctgctgatccacagcggcggcgacagcgacagcagagagaagcccatgtggctgcacaagggctggcagccctgcatgtacatcagcttcctggacatggccctgttcaacagagacagcgccttcaagagctacagcatcgagaacgtgaccagcatcgccaacaacttccccgacttcagctacttcagaaccttccccatgcccagcaacaagagctacgtggtgaccttcatctactag

SEQ ID NO: 19222 - DNA, 660 bp, Artificial Sequence; identical to SEQ ID NO: 19221
  Description of Artificial Sequence: Synthetic coding sequence

SEQ ID NO: 19223 - DNA, 660 bp, Artificial Sequence; identical to SEQ ID NO: 19221
  Description of Artificial Sequence: Synthetic coding sequence

SEQ ID NO: 19224 - DNA, 660 bp, Artificial Sequence; identical to SEQ ID NO: 19221
  Description of Artificial Sequence: Synthetic coding sequence

SEQ ID NO: 19225 - DNA, 198 bp, Artificial Sequence
  Description of Artificial Sequence: Synthetic coding sequence
atgggcaaccccagactgcccagactgctgtgcgccctgaagttcagcggcttcctgagcaacatcagaggccccctggccggcgaggacggcatgggcgacacccagctggccagagtgagagacagcgccctgaagaccccctggagacccgccccctgccccccccccgcccacagcctggacgactggaagtag

SEQ ID NO: 19226 - DNA, 894 bp, Artificial Sequence
  Description of Artificial Sequence: Synthetic coding sequence
atgaacgaggaggagcagttcgtgaacatcgacctgaacgacgacaacatctgcagcgtgtgcaagctgggcaccgacaaggagaccctgagcttctgccacatctgcttcgagctgaacatcgagggcgtgcccaagagcgacctgctgcacaccaagagcctgagaggccacaaggactgcttcgagaagtaccacctgatcgccaaccagggctgccccagaagcaagctgagcaagagcacctacgaggaggtgaagaccatcctgagcaagaagatcaactggatcgtgcagtacgcccagaacaaggacctggacagcgacagcgagtgcagcaagaacccccagcaccacctgttcaacttcagacacaagcccgaggagaagctgctgccccagttcgacagccaggtgcccaagtacagcgccaagtggatcgacggcagcgccggcggcatcagcaactgcacccagagaatcctggagcagagagagaacaccgacttcggcctgagcatgctgcaggacagcggcgccaccctgtgcagaaacagcgtgctgtggccccacagccacaaccaggcccagaagaaggaggagaccatcagcagccccgaggccaacgtgcagacccagcacccccactacagcagagaggagctgaacagcatgaccctgggcgaggtggagcagctgaacgccaagctgctgcagcagatccaggaggtgttcgaggagctgacccaccaggtgcaggagaaggacagcctggccagccagctgcacgtgagacacgtggccatcgagcagctgctgaagaactgcagcaagctgccctgcctgcaggtgggcagaaccggcatgaagagccacctgcccatcaacaactag

SEQ ID NO: 19227 - DNA, 891 bp, Artificial Sequence
  Description of Artificial Sequence: Synthetic coding sequence
atgaacgaggaggagcagttcgtgaacatcgacctgaacgacgacaacatctgcagcgtgtgcaagctgggcaccgacaaggagaccctgagcttctgccacatctgcttcgagctgaacatcgagggcgtgcccaagagcgacctgctgcacaccaagagcctgagaggccacaaggactgcttcgagaagtaccacctgatcgccaaccagggctgccccagaagcaagctgagcaagagcacctacgaggaggtgaagaccatcctgagcaagaagatcaactggatcgtgcagtacgcccagaacaaggacctggacagcgacagcgagtgcagcaagaacccccagcaccacctgttcaacttcagacacaagcccgaggagaagctgctgccccagttcgacagccaggtgcccaagtacagcgccaagtggatcgacggcagcgccggcggcatcagcaactgcacccagagaatcctggagcagagagagaacaccgacttcggcctgagcatgctgcaggacagcggcgccaccctgtgcagaaacagcgtgctgtggccccacagccacaaccaggcccagaagaaggaggagaccatcagcagccccgaggccaacgtgcagacccagcacccccactacagcagagaggagctgaacagcatgaccctgggcgaggtggagcagctgaacgccaagctgctgcagcagatccaggtgttcgaggagctgacccaccaggtgcaggagaaggacagcctggccagccagctgcacgtgagacacgtggccatcgagcagctgctgaagaactgcagcaagctgccctgcctgcaggtgggcagaaccggcatgaagagccacctgcccatcaacaactag

SEQ ID NO: 19228 - DNA, 729 bp, Artificial Sequence
  Description of Artificial Sequence: Synthetic coding sequence
atgaacgaggaggagcagttcgtgaacatcgacctgaacgacgacaacatctgcagcgtgtgcaagctgggcaccgacaaggagaccctgagcttctgccacatctgcttcgagctgaacatcgagggcgtgcccaagagcgacctgctgcacaccaagagcctgagaggccacaaggactgcttcgagaagtaccacctgatcgccaaccagggctgccccagaagcaagctgagcaagagcacctacgaggaggtgaagaccatcctgagcaagaagatcaactggatcgtgcagtacgcccagaacaaggacctggacagcgacagcgagtgcagcaagaacccccagcaccacctgttcaacttcagacacaagcccgaggagaagctgctgccccagttcgacagccaggtgcccaagtacagcgccaagtggatcgacggcagcgccggcggcatcagcaactgcacccagagaatcctggagcagagagagaacaccgacttcggcctgagcatgctgcaggacagcggcgccaccctgtgcagaaacagcgtgctgtggccccacagccacaaccaggcccagaagaaggaggagaccatcagcagccccgaggccaacgtgcagacccagcacccccactacagcagagaggagctgaacagcatgaccctgggcgaggtggagcagctgaacgccaagctgctgcagcagatccagtag

SEQ ID NO: 19229 - DNA, 666 bp, Artificial Sequence
  Description of Artificial Sequence: Synthetic coding sequence
atgaacgaggaggagcagttcgtgaacatcgacctgaacgacgacaacatctgcagcgtgtgcaagctgggcaccgacaaggagaccctgagcttctgccacatctgcttcgagctgaacatcgagggcgtgcccaagagcgacctgctgcacaccaagagcctgagaggccacaaggactgcttcgagaagtaccacctgatcgccaaccagggctgccccagaagcaagctgagcaagagcacctacgaggaggtgaagaccatcctgagcaagaagatcaactggatcgtgcagtacgcccagaacaaggacctggacagcgacagcgagtgcagcaagaacccccagcaccacctgttcaacttcagacacaagcccgaggagaagctgctgccccagttcgacagccaggtgcccaagtacagcgccaagtggatcgacggcagcgccggcggcatcagcaactgcacccagagaatcctggagcagagagagaacaccgacttcggcctgagcatgctgcaggacagcggcgccaccctgtgcagaaacagcgtgctgtggccccacagccacaaccaggcccagaagaaggaggagaccatcagcagccccgaggccaacgtgcagacccagcacccccactacagcagagaggagtag

SEQ ID NO: 19230 - DNA, 723 bp, Artificial Sequence
  Description of Artificial Sequence: Synthetic coding sequence
atgagaaccgaggccgaggccgccggcccccccctggagcccggcgacttcgtgcagctgcccgtgcccgtgatccagcagctgtaccactgggactgcggcctggcctgcagcagaatggtgctgagatacctgggccagctggacgacagcgagttcgagagagccctgcagaagctgcagctgaccagaagcatctggaccatcgacctggcctacctgatgcaccacttcggcgtgagacacagattctgcacccagaccctgggcgtggacaagggctacaagaaccagagcttctacagaaagcacttcgacaccgaggagaccagagtgaaccagctgttcgcccaggccaaggcctgcaaggtgctggtggagaagtgcaccgtgagcgtgaaggacatccaggcccacctggcccagggccacgtggccatcgtgctggtgaacagcggcgtgctgcactgcgacctgtgcagcagccccgtgaagtactgctgcttcacccccagcggccaccactgcttctgcagaacccccgactaccagggccacttcatcgtgctgagaggctacaacagagccaccggctgcatcttctacaacaaccccgcctacgccgaccccggcatgtgcagcaccagcatcagcaacttcgaggaggccagaaccagctacggcaccgacgaggacatcctgttcgtgtacctggacagctag

SEQ ID NO: 19231 - DNA, 384 bp, Artificial Sequence
  Description of Artificial Sequence: Synthetic coding sequence
atgagaaccgaggccgaggccgccggcccccccctggagcccggcgacttcgtgcagctgcccgtgcccgtgatccagcagctgtaccactgggactgcggcctggcctgcagcagaatggtgctgagatacctgggccagctggacgacagcgagttcgagagagccctgcagaagctgcagctgaccagaagcatctggaccatcgacctggcctacctgatgcaccacttcggcgtgagacacagattctgcacccagaccctgggcgtggacaagggctacaagaaccagagcttctacagaaagcacttcgacaccgaggagaccagagtgaaccagctgttcgcccaggccaaggcctgcaaggtgctggtggagtag

SEQ ID NO: 19232 - DNA, 429 bp, Artificial Sequence
  Description of Artificial Sequence: Synthetic coding sequence
atgttcatcaaggtgatgttcggcgccggctgcagcgtgctggtgaacaccagctgcagactggtgaacctgaccgcccacctgagacagaaggccggcctgccccccgacgccaccatcgccctgctggccgaggacggcaacctggtgagcctggaggaggacctgaaggagggcgccagcagagcccagaccatgggcaacagcctgctgaaggagagagccatctacgtgctggtgagaatcatcagcaaggtggcccaggagggcgaggacatggccagcaccagatacgagagcctgctggagaacctggacgaccactaccccgagctggccggcgccaacagacagcagcccagcagaacccccctggccgagagcggcatcgccgagaagctgcaccagcaggagggccagggccagtag

SEQ ID NO: 19233 - DNA, 429 bp, Artificial Sequence
  Description of Artificial Sequence: Synthetic coding sequence
atgttcatcaaggtgatgttcggcgccggctgcagcgtgctggtgaacaccagctgcagactggtgaacctgaccgcccacctgagacagaaggccggcctgccccccgacgccaccatcgccctgctggccgaggacggcaacctggtgagcctggaggaggacctgaaggagggcgccagcagagcccagaccatgggcaacagcctgctgaaggagagagccatctacgtgctggtgagaatcatcagcaaggtggcccaggagggcgaggacatggccagcaccagatacgagagcctgctggagaacctggacgaccactaccccgagctggccggcgccaacagacagcagcccagcagaacccccctggccgagagcggcatcgccgagaagctgcaccagcaggagggccagggcccctag

SEQ ID NO: 19234 - DNA, 447 bp, Artificial Sequence
  Description of Artificial Sequence: Synthetic coding sequence
atgttcatcaaggtgatgttcggcgccggctgcagcgtgctggtgaacaccagctgcagactggtgaacctgaccgcccacctgagacagaaggccggcctgccccccgacgccaccatcgccctgctggccgaggacggcaacctggtgagcctggaggaggacctgaaggagggcgccagcagagcccagaccatgggcaacagcctgctgaaggagagagccatctacgtgctggtgagaatcatcaagggcgaggacatggccagcaccagatacgagagcctgctggagaacctggacgaccactaccccgagctggccgaggagctgagaagactgagcggcctgagcagcgtgggccacaactggagaaagagaatgggcaccagaagaggcagacacgagcagagccccaccagcagacccagaaagggccccgactag

SEQ ID NO: 19235 - DNA, 654 bp, Artificial Sequence
  Description of Artificial Sequence: Synthetic coding sequence
atggccagccagaagcagatggaggtggtgaccaagggcaccggcttcagaagaagacccaagaccatcacctacacccccggcacctgcgagctgctgagagtgatgatgaaggagagcaagctgaccaacatccagcagagacacatcatggacatcatgaagagaggcgacgccctgcccctgcagtgcagccccaccagcagccagagagtgctgcccagcaagcagatcgccagccccatctacctgccccccatcctggccgccagaccccacctgagacccgccaacatgtgccaggccaacggcgcctacagcagagagcagttcaagccccaggccaccagagacctggagaaggagaagcagagactgcagaacatcttcgccaccggcaaggacatggaggagagaaagagaaaggccccccccgccagacagaaggcccccgcccccgagctggacagattcgaggagctggtgaaggagatccaggagagaaaggagttcctggccgacatggaggccctgggccagggcaagcagtacagaggcatcatcctggccgagatcagccagaagctgagagagatggaggacatcgaccacagaagaagcgaggagctgagaaagggcctggccaccacctag

SEQ ID NO: 19236 - DNA, 654 bp, Artificial Sequence; identical to SEQ ID NO: 19235
  Description of Artificial Sequence: Synthetic coding sequence

SEQ ID NO: 19237 - DNA, 654 bp, Artificial Sequence; identical to SEQ ID NO: 19235
  Description of Artificial Sequence: Synthetic coding sequence

SEQ ID NO: 19238 - DNA, 489 bp, Artificial Sequence
  Description of Artificial Sequence: Synthetic coding sequence
atggccagccagaagcagatggaggtggtgaccaagggcaccggcttcagaagaagacccaagaccatcacctacacccccggcacctgcgagctgctgagagtgatgatgaaggagagcaagctgaccaacatccagcagagacacatcatggacatcatgaagagaggcgacgccctgcccctgcagtgcagccccaccagcagccagagagtgctgcccagcaagcagatcgccagccccatctacctgccccccatcctggccgccagaccccacctgagacccgccaacatgtgccaggccaacggcgcctacagcagagagcagttcaagccccaggccaccagagacctggagaaggagaagcagagactgcagaacatcttcgccaccggcaaggacatggaggagagaaagagaaaggccccccccgccagacagaaggcccccgcccccgagctggacagattcgaggagctggtgtag

SEQ ID NO: 19239 - DNA, 363 bp, Artificial Sequence
  Description of Artificial Sequence: Synthetic coding sequence
atggccagccagaagcagatggaggtggtgaccaagggcaccggcttcagaagaagacccaagaccatcacctacacccccggcacctgcgagctgctgagagtgatgatgaaggagagcaagctgaccaacatccagcagagacacatcatggacatcatgaagagaggcgacgccctgcccctgcagtgcagccccaccagcagccagagagtgctgcccagcaagcagatcgccagccccatctacctgccccccatcctggccgccagaccccacctgagacccgccaacatgtgccaggccaacggcgcctacagcagagagcagttcaagccccaggccaccagagacctggagtag

SEQ ID NO: 19240 - DNA, 417 bp, Artificial Sequence
  Description of Artificial Sequence: Synthetic coding sequence
atgcccgccagcgccaccgccgcctggcactgcccccccctgtgcctgccccccctgcccgccagcgcccccaccagcccccccaaccccgccaccagacccgcccccggccccggcagaagagccagatgcccccagagcgcccaccccgcccccaccagaggcgccctgaccttctgggcccccggcagctggcccagagtgctgctggtgcccagaagccccggccccgtgctgagagcccccagactgccccaccccgccgccagagccagaagaagagcctggcacggcgccagactgcccggcagccccgccagagccggcagaaccttccagagaggcctggtgagcaacagctgggcccacgccatcttcctgcccagaccccccaacgtgctggagctgcaggtgtag

SEQ ID NO: 19241 - DNA, 417 bp, Artificial Sequence; identical to SEQ ID NO: 19240
  Description of Artificial Sequence: Synthetic coding sequence

SEQ ID NO: 19242 - DNA, 1095 bp, Artificial Sequence
  Description of Artificial Sequence: Synthetic coding sequence
atgcccagaggcagatgcagacagcagggccccagaatccccatctgggccgccgccaactacgccaacgcccacccctggcagcagatggacaaggccagccccggcgtggcctacacccccctggtggacccctggatcgagagaccctgctgcggcgacaccgtgtgcgtgagaaccaccatggagcagaagagcaccgccagcggcacctgcggcggcaagcccgccgagagaggccccctggccggccacatgcccagcagcagaccccacagagtggacttctgctgggtgcccggcagcgaccccggcaccttcgacggcagcccctggctgctggacagattcctggcccagctgggcgactacatgagcttccacttcgagcactaccaggacaacatcagcagagtgtgcgagatcctgagaagactgaccggcagagcccaggcctgggccgccccctacctggacggcgacctgcccctgcccgacgactacgagctgttctgccaggacctgaaggaggtggtgcaggaccccaacagcttcgccgagtaccacgccgtggtgacctgccccctgcccctggccagcagccagctgcccgtggccccccagctgcccgtggtgagacagtacctggccagattcctggagggcctggccctggacatgggcaccgcccccagaagcctgcccgccgccatggccacccccgccgtgagcggcagcaacagcgtgagcagaagcgccctgttcgagcagcagctgaccaaggagagcacccccggccccaaggagccccccgtgctgcccagcagcacctgcagcagcaagcccggccccgtggagcccgccagcagccagcccgaggaggccgcccccacccccgtgcccagactgagcgagagcgccaacccccccgcccagagacccgaccccgcccaccccggcggccccaagccccagaagaccgaggaggaggtgctggagaccgagggcgaccaggaggtgagcctgggcaccccccaggaggtggtggaggcccccgagacccccggcgagccccccctgagccccggcttctag

SEQ ID NO: 19243 - DNA, 1095 bp, Artificial Sequence; identical to SEQ ID NO: 19242
  Description of Artificial Sequence: Synthetic coding sequence

SEQ ID NO: 19244 - DNA, 1095 bp, Artificial Sequence; identical to SEQ ID NO: 19242
  Description of Artificial Sequence: Synthetic coding sequence

SEQ ID NO: 19245 - DNA, 318 bp, Artificial Sequence
  Description of Artificial Sequence: Synthetic coding sequence
atgggcgagaccgagggcaagaaggacgaggccgactacaagagactgcagaccttccccctggtgagacacagcgacatgcccgaggagatgagagtggagaccatggagctgtgcgtgaccgcctgcgagaagttcagcaacaacaacgagagcgccgccaagatgatcaaggagaccatggacaagaagttcggcagcagctggcacgtggtgatcggcgagggcttcggcttcgagatcacccacgaggtgaagaacctgctgtacctgtacttcggcggcaccctggccgtgtgcgtgtggaagtgcagctag

SEQ ID NO: 19246 - DNA, 843 bp, Artificial Sequence
  Description of Artificial Sequence: Synthetic coding sequence
atggagctgggccacggcgccggcaccaccaccttcaccagagcccacctgaacgacaaggagggccagcaggacctggacccctggaaggccgcctacagcagcctggacaccagcaagttcaagaaccagggcctgagcagcccccagcccctgcccctgggcgccagcgcccagggcagcagcctgggccagtgccacctgaaggagatccccccccccccccccaccgccgccagcagagacagcctgggcatggacccccagagcagaagcctgaagaacgccggcagcagaagcagcagcagagagaacagagccaccagcggcgagggcgcccagccctgccagggcaccgacgacggccccagcctgggcgcccaggaccagagaagcacccccaccaaccagaagggcagcatcatccccaacaacatcagacacaagttcggcagcaacgtggtggaccagctggtgagcgaggagcaggcccagaaggccatcgacgaggtgttcgagggccagaagagagccagcagctggcccagcagaacccagaaccccgtggagatcagcagcgtgttcagcgactactacgacctgggctacaacatgagaagcaacctgttcagaggcgccgccgaggagaccaagagcctgatgaaggccagctacacccccgaggtgatcgagaagagcgtgagagacctggagcactggcacggcagaaagaccgacgacctgggcagatggcaccagaagaacgccatgaacctgaacctgcagaaggccctggaggagaagtacggcgagaacagcaagagcaagagcagcaagtactag

SEQ ID NO: 19247 - DNA, 588 bp, Artificial Sequence
  Description of Artificial Sequence: Synthetic coding sequence
atggacccccagagcagaagcctgaagaacgccggcagcagaagcagcagcagagagaacagagccaccagcggcgagggcgcccagccctgccagggcaccgacgacggccccagcctgggcgcccaggaccagagaagcacccccaccaaccagaagggcagcatcatccccaacaacatcagacacaagttcggcagcaacgtggtggaccagctggtgagcgaggagcaggcccagaaggccatcgacgaggtgttcgagggccagaagagagccagcagctggcccagcagaacccagaaccccgtggagatcagcagcgtgttcagcgactactacgacctgggctacaacatgagaagcaacctgttcagaggcgccgccgaggagaccaagagcctgatgaaggccagctacacccccgaggtgatcgagaagagcgtgagagacctggagcactggcacggcagaaagaccgacgacctgggcagatggcaccagaagaacgccatgaacctgaacctgcagaaggccctggaggagaagtacggcgagaacagcaagagcaagagcagcaagtactag

SEQ ID NO: 19248 - DNA, 843 bp, Artificial Sequence; identical to SEQ ID NO: 19246
  Description of Artificial Sequence: Synthetic coding sequence

SEQ ID NO: 19249 - DNA, 552 bp, Artificial Sequence
  Description of Artificial Sequence: Synthetic coding sequence
atgatcgtgttccccgagaccagccagcccagattcctgtacagcctgcagaactacgccgtgagagacggcctgggcaccatcctgagaggcggcgccgaggagggcagctacgacaactggccccacaccagaaagagctggggccccctgagccccggccaccagagagagctgtggacccagcccgacccctggaccgaggtgctgagcggccacaagggcgacgccggcgcctgcggctgctgctgcttctgcagccagttcatcaacgccagatgcgcccaccccctgtgcctggccagaggcctggacagaagagccagcgaggagatgcccatcctgcaggccctgtgcctgctgcccaaggagaacctgcacgacgccagcagaagagtgcacagaggcagaggcgaggagaacgtggagtggaccggcgacctgcaccccgcccagctgggcagaggcggcagacccgagatctgccacagcctggaggccatcgccctggtgaccaaggccagacacagaaagaccaacaccaccttctag

SEQ ID NO: 19250 - DNA, 1089 bp, Artificial Sequence
  Description of Artificial Sequence: Synthetic coding sequence
atgtgcaccgtggacgtggagggcttcgacgacgtgggcgagaccctgagcgacgccgtgagagacggcctgggcaccatcctgagaggcggcgccgaggagggcagctacgacaactggccccacaccagaaagagctggggccccctgagccccggccaccagagagagctgtggacccagcccgacccctggaccgaggtgctgagcggccacaagggcgacgccggcgcctgcggctgctgctgcttctgcagccagttcatcaacgccagatgcgcccaccccctgtgcctggccagaggcctggacagaagagccagcgaggagatgcccatcctgcaggccctgtgcctgctgcccaaggtgagcacccccagcatcaccgtgctgagcccccagagaagcgccgcccccagcatcaccgtgcccagcccccagagaagcgccgcccccagcatcaccgtgcccagcccccagagaagcgcccccagagccagcctgtgccccccccacaagggccagcaccccgagcaccactgcgccctgccccccaagggccagcaccccgagcaccactgcgccctgcccaccaaggtgagcacccccagcatcaccgtgcccagcccccagagaagcccccagatgagcctgagcagcgccgccagaggcagcaacaccgacgtggccggcctgagcgtgggcgagtggcccggctggcagctgtggggcgagggccaggacggcgcccagcagagaccccacctgcccagcggcggcagcggcgccggcgtggccccccagagactgcccaagagcagagcctgcatcctgtgcagcagacacggcgcccagggcccctgggtgaccggcagaagcgtgagccacagccactgccccatccagggcctgctggacctgcagagacccgacctgggcaccgactggggcagaaccagacccctgtgcaccccccaggacctgtgcggcggcagacccctgcccagcacctggggcgtgaccatgcacctgatccactgcctgagcgtgagcctgagcctgtgcctgagcctgagccactgcgtgtag

SEQ ID NO: 19251 - DNA, 429 bp, Artificial Sequence
  Description of Artificial Sequence: Synthetic coding sequence
atgtgcagatgcagcctggtgctgctgagcgtggaccacgaggtgcccttcagcagcttcttcatcggctggagaaccgagggcagagcctggagagccggcagacccgacatggccgacggcagcggctggcagccccccagaccctgcgaggcctacagagccgagtggaagctgtgcagaagcgccagacacttcctgcaccactactacgtgcacggcgagagacccgcctgcgagcagtggcagagagacctggccagctgcagagactgggaggagagaagaaacgccgaggcccagcagagcctgtgcgagagcgagagagccagagtgagagccgccagaaagcacatcctggtgtgggcccccagacagagccccccccccgactggcacctgcccctgccccaggagaaggacgagtag

SEQ ID NO: 19252 - DNA, 318 bp, Artificial Sequence
  Description of Artificial Sequence: Synthetic coding sequence
atggccgacggcagcggctggcagccccccagaccctgcgaggcctacagagccgagtggaagctgtgcagaagcgccagacacttcctgcaccactactacgtgcacggcgagagacccgcctgcgagcagtggcagagagacctggccagctgcagagactgggaggagagaagaaacgccgaggcccagcagagcctgtgcgagagcgagagagccagagtgagagccgccagaaagcacatcctggtgtgggcccccagacagagccccccccccgactggcacctgcccctgccccaggagaaggacgagtag

SEQ ID NO: 19253 - DNA, 354 bp, Artificial Sequence
  Description of Artificial Sequence: Synthetic coding sequence
atgtgcagatgcagcctggtgctgctgagcgtggaccacgaggtgcccttcagcagcttcttcatcggctggagaaccgagggcagagcctggagagccggcagacccgacatggccgacggcagcggctggcagccccccagaccctgcgaggcctacagagccgagtggaagctgtgcagaagcgccagacacttcctgcaccactactacgtgcacggcgagagacccgcctgcgagcagtggcagagagacctggccagctgcagagactgggaggagagaagaaacgccgaggcccaggtgctgagcgtggtggcccacacctgcaacctgagctacctgggcggctag

SEQ ID NO: 19254 - DNA, 756 bp, Artificial Sequence
  Description of Artificial Sequence: Synthetic coding sequence
atgggcagcaagctgacctgctgcctgggccccagcggcggcctgaactgcgactgctgcagacccgacgtgggcccctgccacgagtgcgagatccccgagaccgtggccgccaccgcccccgccagcaccaccgccaagcccgccaagctggacctgaaggccaagaaggcccagctgatgcagtacctgagcctgcccaagacccccaagatgctgaagatgagcaagggcctggacgccagaagcaagagatggctgaagatcatctggagaagacacggcatctggcccctggagaacatcggccccaccgaggacgtgcaggccagcgcccacggcggcgtggaggagaacatgaccagcgacatcgagatccccgaggccaagcacgaccacagacccaccgaggacgtgcaggtgagcgcccacggcggcgtggaggagaacatcaccagcgacatcgagatcagcgaggccaagcacgaccaccacctggtggaggacctgagcgagagcctgagcgtgtgcctggaggacttcatgaccagcgacctgagcgagagcctgagcgtgagcctggaggacttcatgaccagcggcctgagcgagagcctgagcgtgagcctggaggacctgatgacccccgagatggccaaggagagatacgaggactacctgtgctgggtgaagatggccagaagcagactgaacgagcccatcagcagccaggtgctgggcctgctgagactgtag

SEQ ID NO: 19255 - DNA, 690 bp, Artificial Sequence
  Description of Artificial Sequence: Synthetic coding sequence
atgggcaacatcctgacctgctgcatcaacagccactgcggctggcccagaggcaaggacgccccctgctacgagagcgacaccgacatctacgagaccgtggccgccgccaccagcgagagcaccaccgtggagcccggcaagctggacgtgggcgccaccgagggccaggacctgcagcacatcagcaaccagaagatgcccaccggcccccccgaggacagactgagcctgaagttcctgcccagcagcgaggaggacaacgacgacgccaagatcctgcccagccccgtgcagggcagcagcgaggacaacctgagcctggtgtgcctgcccagaagcgaggacgacgactgcgacgacgacgacgacgacgacgcccagatcctgcccagcagagtgcagggcggctgctacagattcgacagcagcagctgcagcagcgaggacaacctgagcctggtgtgcctgcccagaagcgaggacgacgactgcgacgacgacgacgacgacgcccagatcctgcccagccccgtgcaggcctgcagcgaggacagcctgttcctgagatgcagcctgagacacaaggacgaggaggaggaggacgacgacgacatccacatcaccgccagaatcgagagcgacctgaccctggagagcctgagcgacgaggagatccaccccggctag

SEQ ID NO: 19256 - DNA, 480 bp, Artificial Sequence
  Description of Artificial Sequence: Synthetic coding sequence
atggagcaggactggcagcccggcgaggaggtgacccccggccccgagccctgcagcaagggccaggcccccctgtaccccatcgtgcacgtgaccgagctgaagcacaccgaccccaacttccccagcaacagcaacgccgtgggcaccagcagcggctggaacagaatcggcaccggctgcagccacacctgggactggagattcagctgcacccagcaggccctgctgcccctgctgggcgcctgggagtggagcatcgacaccgaggccggcggcggcagaagagagcagagccagaagccctgcagcaacggcggccccgccgccgccggcgagggcagagtgctgcccagcccctgcttcccctggagcacctgccaggccgccatccacaaggtgtgcagatggcagggctgcaccagacccgccctgctggcccccagcctggccaccctgaaggagcacagctacccctag

SEQ ID NO: 19257 - DNA, 480 bp, Artificial Sequence; identical to SEQ ID NO: 19256
  Description of Artificial Sequence: Synthetic coding sequence

SEQ ID NO: 19258 - DNA, 669 bp, Artificial Sequence
  Description of Artificial Sequence: Synthetic coding sequence
atggccctgagcgccgagaccgagagccacatctacagagccctgagaaccgccagcggcgccgccgcccacctggtggccctgggcttcaccatcttcgtggccgtgctggccagacccggcagcagcctgttcagctggcaccccgtgctgatgagcctggccttcagcttcctgatgaccgaggccctgctggtgttcagccccgagagcagcctgctgcacagcctgagcagaaagggcagagccagatgccactgggtgctgcagctgctggccctgctgtgcgccctgctgggcctgggcctggtgatcctgcacaaggagcagctgggcaaggcccacctggtgaccagacacggccaggccggcctgctggccgtgctgtgggccggcctgcagtgcagcggcggcgtgggcctgctgtaccccaagctgctgcccagatggcccctggccaagctgaagctgtaccacgccaccagcggcctggtgggctacctgctgggcagcgccagcctgctgctgggcatgtgcagcctgtggttcaccgccagcgtgaccggcgccgcctggtacctggccgtgctgtgccccgtgctgaccagcctggtgatcatgaaccaggtgagcaacgcctacctgtacagaaagagaatccagccctag

SEQ ID NO: 19259 - DNA, 387 bp, Artificial Sequence
  Description of Artificial Sequence: Synthetic coding sequence
atgaccagcctgttcgcccaggagatcagactgagcaagagacacgaggagatcgtgagccagagactgatgctgctgcagcagatggagaacaagctgggcgaccagcacaccgagaaggccagccagctgcagaccgtggagaccgccttcaagagaaacctgagcctgctgaaggacatcgaggccgccgagaagagcctgcagaccagaatccaccccctgcccagacccgaggtggtgagcctggagaccagatactgggccagcgtggaggagtacatccccaagtgggagcagttcctgctgggcagagccccctaccccttcgccgtggagaaccagaacgaggccgagaacaccatccagaacgaggcccagagatag

SEQ ID NO: 19260 - DNA, 192 bp, Artificial Sequence
  Description of Artificial Sequence: Synthetic coding sequence
atgaccagcctgttcgcccaggagatcagactgagcaagagacacgaggagatcgtgagccagagactgatgctgctgcagcagatggagaacaagctgggcgaccagcacaccgagaaggccagccagctgcagaccgtggagaccgccttcaagagaaacctgagcctgctgaaggacatcgaggcctag

SEQ ID NO: 19261 - DNA, 387 bp, Artificial Sequence; identical to SEQ ID NO: 19259
  Description of Artificial Sequence: Synthetic coding sequence

SEQ ID NO: 19262 - DNA, 387 bp, Artificial Sequence; identical to SEQ ID NO: 19259
  Description of Artificial Sequence: Synthetic coding sequence

SEQ ID NO: 19263 - DNA, 885 bp, Artificial Sequence
  Description of Artificial Sequence: Synthetic coding sequence
atgaccaagggcgacttcatcgacgaggaggtggaggacatgtacctggtggacttcacccagaagatcatcgacaagagaaaggagatggaggccagcggcgcccacagagacagccagaaggccggcgagggcaccaccatgagaaagaccttcctgagagagagaagcctgctgcccaagacccccgtgaagaacggctggatcacctggaccctgtggggcgtgcccggcctgtacgagaaggacctgcccgacctgctggagatggacaagaacctgcagggcagactgttcatcagcctgctgatgaagaccctgctgagcgaggacatgagaaaggagctgcagagacagcagtgggaggaggaggagagagaggccctgaagagacccatgggccccgtgcactacgaggacatcagagagaacgacggcgacgtgatcggccccctgccccccgagcccgaggccgtgcccacccccagacccgccgcccagagcagcaaggtggaggtgatcgtgcaggagagaaaggacaccaagcccggcgtgccccacatcagagagtgggacagaggcaaggagttcagcttcggctactggagcaagagacagagcgacctgagagccgagagagaccccgagttcgccccccccagcgactacttcgtgggccagaagagaaccggcttcagcagcagccaggcctggagcagacccggccccgcccagagcgaccccggccagtgccccgaccagagccacggccccagccccgagcacaccagccccacccccgcccccgacaaccccccccaggcccccaccgtgaccttcaagaccctggacgacatgatcagctactacaagcaggtgacctag

SEQ ID NO: 19264 - DNA, 1404 bp, Artificial Sequence
  Description of Artificial Sequence: Synthetic coding sequence
atggacagaagaaagaagcccctggacgtgaccgccagcagcctggtggacctgaaggccgagctgttcagaaagcaggaggagttcaagcaggagaagctgctgaaggacagcggcgtgttcggcaagcccaagaccaccaacaagaagcccagcatctggagcaagcagaacgtgggcgtgagcaacagagccgagaaggacgccgagcagaagatcgaggagcagaagaccctggacaaggccagagagaagctggaggagaaggccaagctgtacgagaagatgaccaagggcgacttcatcgacgaggaggtggaggacatgtacctggtggacttcacccagaagatcatcgacaagagaaaggagatggaggccagcggcgcccacagagacagccagaaggccggcgagagagacgacgacgaggagaacctgcccgagggcgagatcccccccccccaggaccccagcgaggagtgggtggactacgtggacagcctgggcagaagcagaagatgcatgagaaaggacctgcccgacctgctggagatggacaagaacctgcagggcagactgttcatcagccccgccaacgagaagaccctgctgagcgaggacatgagaaaggagctgcagagacagcagtgggaggaggaggagagagaggccctgaagagacccatgggccccgtgcactacgaggacatcagagagaacgaggccagacagctgggcgtgggctacttcgccttcgccagagacaaggagctgagaaacaagcagatgaagaccctggagatgctgagagagcagaccaccgaccagagaaccaagagagagaacatcaaggagaagagaaaggccatcctggaggccagactggccaagctgagacagaagaagatgaagaagagcaaggagggcggcaccgaggaggagaacagagacggcgacgtgatcggccccctgccccccgagcccgaggccgtgcccacccccagacccgccgcccagagcagcaaggtggaggtgatcgtgcaggagagaaaggacaccaagcccggcgtgccccacatcagagagtgggacagaggcaaggagttcagcttcggctactggagcaagagacagagcgacctgagagccgagagagaccccgagttcgccccccccagcgactacttcgtgggccagaagagaaccggcttcagcagcagccaggcctggagcagacccggccccgcccagagcgaccccggccagtgccccgaccagagccacggccccagccccgagcacaccagccccacccccgcccccgacaaccccccccaggcccccaccgtgaccttcaagaccctggacgacatgatcagctactacaagcaggtgacctag

SEQ ID NO: 19265 - DNA, 426 bp, Artificial Sequence
  Description of Artificial Sequence: Synthetic coding sequence
atggacagcagcgcctgcaagaagagccaccagagcaagaagtggagaatccaggcccaggagaacttcgccaagaagttcccctacagactgagctggctgaccgagcccgaccccgagcccctgcagccctgggaggtgaccaacgacagcaacaccgtgcagctgcccctgcagaagagactggtgcccaccagaagcatccccgtgagaggcctgggcgcccccgacttcaccagccccagcggcagctgccccgcccccctgcccgcccccagccccccccccctgtgcaacctgtgggagctgaagctgctgagcagaagattccccagacagctggccttcctgctgagcaccagacacaccgaggccgcctgcccccagaccagcaaggccgccggcctgagcagaggcctgagctag

SEQ ID NO: 19266 - DNA, 534 bp, Artificial Sequence
  Description of Artificial Sequence: Synthetic coding sequence
atggccggctaccagctgtggagcccctggacccccctggacgagagcttccagtggctgagacacaccacccccacccccagcagcaagcaccccttcaaggccagcccctgcttcccccacacccccagcgacctggaggtgcagctgtgcttccaggaggtgaccctggtgctggacagccccttcctggagagcggcgtgagccccaagctgccctgccacaccagcgagctgagaaccatgaacaacaagggcctggtgagaaagccccagcccatcagactgagcggcgtggacagcgtgttcggcagagtgatcaccgcccagccccccaagtggaccggcaccttcagagtgagcgacaagagcgccttctgcaagatcatcagcagagagcaccagtggcccatcggcctgaaggagccccagatccagatgaccgtgaccatgtgcaagcagatgctgagaagcatcctgctgctgtacgccacctacaagaagtgcaccttcgccctgcagcacagcaagtag

SEQ ID NO: 19267 - DNA, 534 bp, Artificial Sequence; identical to SEQ ID NO: 19266
  Description of Artificial Sequence: Synthetic coding sequence

SEQ ID NO: 19268 - DNA, 1719 bp, Artificial Sequence
  Description of Artificial Sequence: Synthetic coding sequence
atggacgacgactacgaggcctaccacagcctgttcctgagcctgctgggcctgtgccccagcaagacccccatcaacgagaacgcccccgtgttcgaccccgagcccgtgatcgcccactgcttcaagcagttccagcagaaggacttcagactgccccagaccagaagaagaatcatcatggtgcccagaaaggaggaccagacccccctgaaccccgccagccagccccaggccccccccaagcccatccccagcttcaaggtgctggaggccagagacatccaggagcagcccgaggacagaaagacctggctgagccagagaagcaagctgagacaggagctggagagcttcggcgacgtgaagagatggctggagaacaagcccagcatcacccccagcgaggccaaggtgctgcacatgatccacgaggagcagagcgcccagcccaacgccagccaggccaccaccagaaccaccagaaagaaggcccccagactgagcagactgagcagacagatggtgccccagctgcagctgcccgagccccccgccctgagcgtgatgtacagctacctgcacagcagaaagatcaagatcctggagatcttccacaaggtgggccagggcgagaaccagagaatcaccagagaggagttcatcgccgccgtgaaggccgtgggcgtgcccctgaagaaccaggaggtggaggacatcgtgatctacctgagcagcctgggcaagcacaacaccatcaccatggacatcctggccaacacctacaagcagtggagcatggcccagcagagaagcagcctggccaccgccagagagcactacatcctggccaagcacagagacagcctgaagggccccctgaagaagcaggaggtggacagcgccccccagctgcccaaggtggacctgctgaccgtgcccgccgtggacacccagatggagaccagacccatgaccctggaggagatggaggaggtgggcaagagatacagagagagacagagacagcacaagctgaccatccccagcatccagtacaccgagcagtgccacctggtgagatgcggcaacagacacttcgacgagcactgcctgcccagcaccatccacggcgacatgagagagctgatcgacagcgccagaagacacaacttcctggtgtacctgcagtgctggaagctgtgcaagagctacggcctgcccctgaccgaggacatcctgatgaaggccctgctgtaccccggcgacaagatcatcttccagatggacaaggtgtgccccatcagacagcccggcggctactacagcgactggaaggtgttcagccccaacctggccctgctgagaagccagggccccggcaagagcaagagaaccgacaagaagacccccaagaagagcaagaagatgagattcaaggagttcgaggagttcaccagaaagctgaaggtgaagagaagcagcggcctgcagcagacccaccccaacagcttctggcccggccacctgctggacaagctgcagctgtacctgcccaccgtggccaccgacagaagcctggccctgttcagctgcgtgcagcaccagccccacgtgtaccccgccacctaccaccccgaccactggtggcccctgagaaacaagaactacatgacccacgcccactacgacgccgccaaggtgtactacatcaactag

SEQ ID NO: 19269 - DNA, 1719 bp, Artificial Sequence; identical to SEQ ID NO: 19268
  Description of Artificial Sequence: Synthetic coding sequence

SEQ ID NO: 19270 - DNA, 840 bp, Artificial Sequence
  Description of Artificial Sequence: Synthetic coding sequence
atggccgacgacctgggcgacgagtggtgggagaaccagcccaccggcgccggcagcagccccgaggccagcgacggcgagggcgagggcgacaccgaggtgatgcagcaggagaccgtgcccgtgcccgtgcccagcgagaagaccaagcagcccaaggagtgcttcctgatccagcccaaggagagaaaggagaacaccaccaagaccagaaagagaagaaagaagaagatcaccgacgtgctggccaagagcgagcccaagcccggcctgcccgaggacctgcagaagctgatgaaggactactacagcagcagaagactggtgatcgagctggaggagctgaacctgcccgacagctgcttcctgaaggccaacgacctgacccacagcctgagcagctacctgaaggagatctgccccaagtgggtgaagctgagaaagaaccacagcgagaagaagagcgtgctgatgctgatcatctgcagcagcgccgtgagagccctggagctgatcagaagcatgaccgccttcagaggcgacggcaaggtgatcaagctgttcgccaagcacatcaaggtgcaggcccaggtgaagctgctggagaagagagtggtgcacctgggcgtgggcacccccggcagaatcaaggagctggtgaagcagggcggcctgaacctgagccccctgaagttcctggtgttcgactggaactggagagaccagaagctgagaagaatgatggacatccccgagatcagaaaggaggtgttcgagctgctggagatgggcgtgctgagcctgtgcaagagcgagagcctgaagctgggcctgttctag

SEQ ID NO: 19271 - DNA, 450 bp, Artificial Sequence
  Description of Artificial Sequence: Synthetic coding sequence
atgaaggaggccctgcaccagatcgtggtgagatgcagcgagctggtgagcagcaccagcctgcccagactgagcgtgagcagactgcagggcccccccgacagccagcccctgggcaccctgggccagggcggctggaagctgctgggcatcgtgggcagcctggcccccgagaccctgggcggcctgggcaccgagttcggcccctgcacccaccccctgcccttcgacatggtgagagagagagagagagacgacgagctgagacagggctggctgctgcagtgcccccagtgcgccagaaccctgctgtgccactgcggccccttcctgaccccccccagccagaccagcagcagcggcttccagctgtgcagcctgaagcccagcggcagcctggtgaccgccaccgagcccctgagcaacttcgccttcagctacttcccctag

SEQ ID NO: 19272 - DNA, 1611 bp, Artificial Sequence
  Description of Artificial Sequence: Synthetic coding sequence
atggaggagcccccccaggaggccctggccgagcccctgaagcacgagagccccgccgcccccagcagcgccggccacaccaagggccaggaggaggacgaccagaagaaccaggccgagagaaaggccgacaaccacaccgcccacagaatcgccgaccagaccgccctgagagtgcccagccaggccgagagcagcatcttcagccaggccaccaacggcgtggccgagcagaacggccacagcacccccggccaggccggcagaagagccagcaaccccgccgacgtgagcgacctgagagccgacgaccaggtgaaccagacccccagcgagcagaccaagggcaaggccagcagccaggccaacaacgtgcagcacgagcagagcgacggccaggtgagcggcctgaccgaggagagaaccgccgagcagaccgagagaagactgcccacccaggccgagagaagaaccagcggccagatcgacggcagactggccatgcccagcgaccagagaggcagcagacagaccgaccacagaatggccggccagagcgagagaagagccagcgagcagatggacagaagaatgagcggcgaggccgagagaagaaccagcgagcagatcacccacagactgagcaagctgagcgagagaagacccagcgtgcagatcgacagcggcagcagcgtgcccagcgaccagagccccagcgtgcagatcgacagcggcagcagcgtgcccagcgaccagagacccagcgtgcagatcgacagaagaatgagcggcaaggtgagaagaagaagcagcgagaagaccgactacagactggccggcctggccgaccccggcaccagcgagcagaccgacctgagactgtacggcctggtggaccacaagaccagcgtgaagacccaccaccaggtgtacggccaggccaccgagctggccgagcaccaggccatcgaccaggcccacagcaacgccgaccagccccccgtggacaacgcccactacaccgagagcgaccagaccgaccacctggccgacagacaggccaaccacaaggaccagctgagctactacgagaccagaggccagagcgaggacagaatcttcccccagctgggcaacagcaaggaggacaaggaggccgactacagagtgcagccctgcaagttcgaggacagccaggtggacctgaacagcaagcccagcgtggagatggagacccagaacgccaccaccatccccccctacaaccccgtggacgccagattcaccagcaacttccaggccaaggaccaggccctgttccccagactgcccagcatcagcagcaagctgaactacaccagcagccaggagaagacccaggccatcgtgaccaagagcgacgagttcagcgagatcgaccagggcaagggctaccacatcagaaaccagacctacagaagattccccagcatcgtgtacgaggacccctaccaggtgagcctgcagtacatggagaagcaccacatcctgcagatcttccagcagatcaccgagaacctggtgtacgagaagcccgaggaccccctgaacttcatgctgtgccaggtgtag

SEQ ID NO: 19273 - DNA, 1062 bp, Artificial Sequence
  Description of Artificial Sequence: Synthetic coding sequence
atgcccagccccgtgggcctgctgagagccctgcccctgccctggccccagttcctggcctgcaccctgagaagactggccggccccagagagagcaccggccccagccagaagcccccccccctgtgcagcgtgccctgcagagtgcccgccatgaccgaggaggtggccagagaggccctgctgagcttcgtggacagcaagtgctgctacagcagcaccgtggccggcgacctggtgatccaggagctgaagagacagaccctgtgcagatacagactggagaccttcagcgagagcagaatcagcgagtggaccttccagcccttcaccaaccacagcgtggacggcccccagagaggcgccagccccagactgtgggacatcaaggtgcagggcccccccatgttccaggaggacaccagaaagttccaggtgccccacagcagcctggtgaaggagtgccacaagtgccacggcagaggcagatacaagtgcagcggctgccacggcgccggcaccgtgagatgccccagctgctgcggcgccaagagaaaggccaagcagagcagaagatgccagctgtgcgccggcagcggcagaagaagatgcagcacctgcagcggcagaggcaacaagacctgcgccacctgcaagggcgagaagaagctgctgcacttcatccagctggtgatcatgtggaagaacagcctgttcgagttcgtgagcgagcacagactgaactgccccagagagctgctggccaaggccaagggcgagaacctgttcaaggacgagaacagcgtggtgtaccccatcgtggacttccccctgagagacatcagcctggccagccagagaggcatcgccgagcacagcgccgccctggccagcagagccagagtgctgcagcagagacagaccatcgagctgatccccctgaccgaggtgcactactggtaccagggcaagacctacgtgtactacatctacggcaccgaccaccaggtgtacgccgtggactaccccgagagatactgctgcggctgcaccatcgtgtag

SEQ ID NO: 19274 - DNA, 1062 bp, Artificial Sequence; identical to SEQ ID NO: 19273
  Description of Artificial Sequence: Synthetic coding sequence

SEQ ID NO: 19275 - DNA, 948 bp, Artificial Sequence
  Description of Artificial Sequence: Synthetic coding sequence
atgcccagccccgtgggcctgctgagagccctgcccctgccctggccccagttcctggcctgcaccctgagaagactggccggccccagagagagcaccggccccagccagaagcccccccccctgtgcagcgtgccctgcagagtgcccgccatgaccgaggaggtggccagagaggccctgctgagcttcgtggacagcaagtgctgctacagcagcaccgtggccggcgacctggtgatccaggagctgaagagacagaccctgtgcagatacagactggagaccttcagcgagagcagaatcagcgagtggaccttccagcccttcaccaaccacagcgtggacggcccccagagaggcgccagccccagactgtgggacatcaaggtgcagggcccccccatgttccaggaggacaccagaaagttccaggtgccccacagcagcctggtgaaggagtgccacaagtgccacggcagaggcagatacaagtgcagcggctgccacggcgccggcaccgtgagatgccccagctgctgcggcgccaagagaaaggccaagcagagcagaagatgccagctgtgcgccggcagcggcagaagaagatgcagcacctgcagcggcagaggcaacaagacctgcgccacctgcaagggcgagaagaagctgctgcacttcatccagctggtgatcatgtggaagaacagcctgttcgagttcgtgagcgagcacagactgaactgccccagagagctgctggccaaggccaagggcgagaacctgttcaaggacgagaacagcgtggtgtaccccatcgtggacttccccctgagagacatcagcctggccagccagagaggcatcgccgagcacagcgccgccctggccagcagagccagagtgctgcagcaggtgagccagggcggcggcgccatctggctgtag

SEQ ID NO: 19276 - DNA, 1128 bp, Artificial Sequence
  Description of Artificial Sequence: Synthetic coding sequence
atggacagagacctgaacgaggacgacagcgtggtggacctgagcttcgaggccgagagccccctggccccccccaccgagctgctggagagactgcccagctacgactggctgctgcagggcggcagaggccagatcttcttcccccccctggaggcccccggcagaccccaggagcagagaagctggcccagcttcctggagcacagagtgcccgccatgaccgaggaggtggccagagaggccctgctgagcttcgtggacagcaagtgctgctacagcagcaccgtggccggcgacctggtgatccaggagctgaagagacagaccctgtgcagatacagactggagaccttcagcgagagcagaatcagcgagtggaccttccagcccttcaccaaccacagcgtggacggcccccagagaggcgccagccccagactgtgggacatcaaggtgcagggcccccccatgttccaggaggacaccagaaagttccaggtgccccacagcagcctggtgaaggagtgccacaagtgccacggcagaggcagatacaagtgcagcggctgccacggcgccggcaccgtgagatgccccagctgctgcggcgccaagagaaaggccaagcagagcagaagatgccagctgtgcgccggcagcggcagaagaagatgcagcacctgcagcggcagaggcaacaagacctgcgccacctgcaagggcgagaagaagctgctgcacttcatccagctggtgatcatgtggaagaacagcctgttcgagttcgtgagcgagcacagactgaactgccccagagagctgctggccaaggccaagggcgagaacctgttcaaggacgagaacagcgtggtgtaccccatcgtggacttccccctgagagacatcagcctggccagccagagaggcatcgccgagcacagcgccgccctggccagcagagccagagtgctgcagcagagacagaccatcgagctgatccccctgaccgaggtgcactactggtaccagggcaagacctacgtgtactacatctacggcaccgaccaccaggtgtacgccgtggactaccccgagagatactgctgcggctgcaccatcgtgtag

SEQ ID NO: 19277 - DNA, 498 bp, Artificial Sequence
  Description of Artificial Sequence: Synthetic coding sequence
atgcaggccgagaccatcctggagggcctggaggccggcctgccccaggccgtgagcagcggcctgagcctggtgcccgcccccggcctggtgctgacctgcctgagcgcccccagcggccccggcggcatggccctggagcccccccccaccaccctgagaaaggccttcctggcccagagcaccctgctggagagcaccctggagggcgcccccgagtgggccgccccccaccccgaggagcagagaagaagcccccccgcctgcagccagcacaccccccccctgcccagcacccccaccggcccccccccctgcagccccggcggcaaccaccccctgtgcgccctgagcggcagaggcggcggcagatgcagcatccccagcctgagcagcagcagcaccttcagcctgttcagcagcggctgctggaaccccagagtgaagctgagagtgagaaagagccagagccagggcagagccggccagctgatctag

SEQ ID NO: 19278 - DNA, 1065 bp, Artificial Sequence
  Description of Artificial Sequence: Synthetic coding sequence
atgtgcggcagaaccagctgccacctgcccagagacgtgctgaccagagcctgcgcctaccaggacagaagaggccagcagagactgcccgagtggagagaccccgacaagtactgccccagctacaacaagagcccccagagcaacagccccgtgctgctgagcagactgcacttcgagaaggacgccgacagcagcgagagaatcatcgcccccatgagatggggcctggtgcccagctggttcaaggagagcgaccccagcaagctgcagttcaacaccaccaactgcagaagcgacaccgtgatggagaagagaagcttcaaggtgcccctgggcaagggcagaagatgcgtggtgctggccgacggcttctacgagtggcagagatgccagggcaccaaccagagacagccctacttcatctacttcccccagatcaagaccgagaagagcggcagcatcggcgccgccgacagccccgagaactgggagaaggtgtgggacaactggagactgctgaccatggccggcatcttcgactgctgggagccccccgagggcggcgacgtgctgtacagctacaccatcatcaccgtggacagctgcaagggcctgagcgacatccaccacagaatgcccgccatcctggacggcgaggaggccgtgagcaagtggctggacttcggcgaggtgagcacccaggaggccctgaagctgatccaccccaccgagaacatcaccttccacgccgtgagcagcgtggtgaacaacagcagaaacaacacccccgagtgcctggcccccgtggacctggtggtgaagaaggagctgagagccagcggcagcagccagagaatgctgcagtggctggccaccaagagccccaagaaggaggacagcaagaccccccagaaggaggagagcgacgtgccccagtggagcagccagttcctgcagaagagccccctgcccaccaagagaggcaccgccggcctgctggagcagtggctgaagagagagaaggaggaggagcccgtggccaagagaccctacagccagtag

SEQ ID NO: 19279 - DNA, 1065 bp, Artificial Sequence; identical to SEQ ID NO: 19278
  Description of Artificial Sequence: Synthetic coding sequence

SEQ ID NO: 19280 - DNA, 1065 bp, Artificial Sequence; identical to SEQ ID NO: 19278
  Description of Artificial Sequence: Synthetic coding sequence

SEQ ID NO: 19281 - DNA, 990 bp, Artificial Sequence
  Description of Artificial Sequence: Synthetic coding sequence
atggagatgagcggcctgagcttcagcgagatggagggctgcagaaacctgctgggcctgctggacaacgacgagatcatggccctgtgcgacaccgtgaccaacagactggtgcagccccaggacagacaggacgccgtgcacgccatcctggcctacagccagagcgccgaggagctgctgagaagaagaaaggtgcacagagaggtgatcttcaagtacctggccacccagggcatcgtgatcccccccgccaccgagaagcacaacctgatccagcacgccaaggactactggcagaagcagccccagctgaagctgaaggagacccccgagcccgtgaccaagaccgaggacatccacctgttccagcagcaggtgaaggaggacaagaaggccgagaaggtggacttcagaagactgggcgaggagttctgccactggttcttcggcctgctgaacagccagaaccccttcctgggccccccccaggacgagtggggcccccagcacttctggcacgacgtgaagctgagattctactacaacaccagcgagcagaacgtgatggactaccacggcgccgagatcgtgagcctgagactgctgagcctggtgaaggaggagttcctgttcctgagccccaacctggacagccacggcctgaagtgcgccagcagcccccacggcctggtgatggtgggcgtggccggcaccgtgcacagaggcaacacctgcctgggcatcttcgagcagatcttcggcctgatcagatgccccttcgtggagaacacctggaagatcaagttcatcaacctgaagatcatgggcgagagcagcctggcccccggcaccctgcccaagcccagcgtgaagttcgagcagagcgacctggaggccttctacaacgtgatcaccgtgtgcggcaccaacgaggtgagacacaacgtgaagcaggccagcgacagcggcaccggcgaccaggtgtag

SEQ ID NO: 19282 - DNA, 879 bp, Artificial Sequence
  Description of Artificial Sequence: Synthetic coding sequence
atggcccagccccagctgtacctgcccgagcccttcaagatcgcctacagaaaggtgggccagtgcagaagattccagcagctgaagaagaagaacggcagcttcaagagaaagggcatcgagagatggcacagagccgtgagcaccaacctgctgaagcagaacgtgctggtgcccaaggaggagagcagcagcgacagcgacatgggcttccacgagagccagcagaaccagaagagcaacctgaagaccaaggtgaagaccgccttcggcagaatgctgagctacaagtacagaagcaagcccgcctgcgccagccaggagggcagcaccgaccacaaggaggccctgctgagcaacacccagagcctgctgcccagaatcgtgaaggagttcagcagccccaagctgttcaccgccaagatgagaaagctgagcgagaacgccaccatccagctggacgtggtggaggccgagaccgaggagatcacccagggcaacaccctgctgagagccagaagaaccaccaagagactgagcgtgaccagcctgcccagcggcctgcagaagggcccctacagccccaagaagagaccccacttccccgccctgaagaagaagaagagaggcatggagaacatcctgagaaagagcgacctgaccgtgggcaagctgcagatgcaggtggacgacctgatcgagaccgtgaccgacaagagcatgaagctgctggcccagagacacgccgagctgcagcagtgcgagttcctgggcgacgagatcctgcagagcagcaagcagttccagagaatcagcaagagaaccatgagaaagtacaagctgaagaacatgaccaccaagggccccggcgacagctag

SEQ ID NO: 19283 - DNA, 357 bp, Artificial Sequence
  Description of Artificial Sequence: Synthetic coding sequence
atgaaggtggtgggcaactacagagtgaacaccgccaacagcagcaccgacaccagcggcgagcacctgacctgcctgagaagccagctgttcgtggcctacagaaacggcagagtggacgaggccgtgagcctgggcttcctggactgctggatcggcggcgacctgaccaacttcaagggctgctacctgaccaaccagctgcccatccagatcttcaccgccatcttcgacatgaacaccgacgtgatcatcctgagccagttcatgtactacagactgaagaaccagaagaagaagatcagcgaggaggacctgagaaaggagctgcacttctgctgcctgcactggccctag

SEQ ID NO: 19284 - DNA, 402 bp, Artificial Sequence
  Description of Artificial Sequence: Synthetic coding sequence
atgaaggtggtgggcaactacagagtgaacaccgccaacagcagcaccgacaccagcggcgagcacctgacctgcctgagaagccagctgttcgtggcctacagaaacggcagagtggacgaggccgtgagcctgggcttcctggactgctggatcggcggcgacctgaccaacttcaagggctgctacctgaccaaccagctgcccatccaggacatccccaccagcgtgatccagagactgcaccaccagagagagagccagatcgtgaccctgggcagccccctgccctgcatctaccccatcttcttccagatcagcgagatcagcatgcccggctactacagctgcctgtgccacaccaccatcaacaccagcaagagaagattcatcctgacctag

SEQ ID NO: 19285 - DNA, 408 bp, Artificial Sequence
  Description of Artificial Sequence: Synthetic coding sequence
atgaaggtggtgggcaactacagagtgaacaccgccaacagcagcaccgacaccagcggcgagcacctgacctgcctgagaagccagctgttcgtggcctacagaaacggcagagtggacgaggccgtgagcctgggcttcctggactgctggatcggcggcgacctgaccaacttcaagggctgctacctgaccaaccagctgcccatccagatcttcaccgccatcttcgacatgaacaccgacgtgatcatcctgagccagttcatgtactacagactgaagaaccagaagaagaagatgatcttccagccccagctgttcaaggacagcatcaccagagagaaggtgagactgagcctgtggggcgtgctgtgccccgtgtacatcccctacagcttcagatag

SEQ ID NO: 19286 - DNA, 729 bp, Artificial Sequence
  Description of Artificial Sequence: Synthetic coding sequence
atgggcaccggcgccagcgagaagcaggccgagcagaaggtgagaagagccttcgaggccagcgaggaggcccacggcaccctggccgccagcaccccctgggtggccatgggcagcgcctacggcagctgcacctgcctgggcgcccagcccgtgaccgacctggccctgtggcccgtgatctacagctgcatgggcttcagcccccaggcctaccccgccttctgggcctacccctgggtgctgtacggcggctacctgtggatgggctaccccccccccgccgccctggtgcccagcgtgtggctgtactggagaggcgccagcagcttcgaccccctgatcggcagcccctacctggccgccctggcccccaacctgttccccttccccatgaagttcccccccacctacagcctggccagccccaccctgggcggcgccaccagcagccactgcccccaggtgggctgctggacccccgccagcagcgcccccagagccgccgtggagggccccagcagaggcgccccctacctgaagacctgcaaggccccccccagcgagtgggccagcagattcggcatctgggcccccctgccctgctgcagcagcgagctgagacccctgccccccagccccatcgaggacagccagctggaccccggctgcagcagaagcagcagcagaagcccctgcagagccagaagaagactgttcgagtgctag

SEQ ID NO: 19287 - DNA, 804 bp, Artificial Sequence
  Description of Artificial Sequence: Synthetic coding sequence
atgcactacatcaagacctggagcctgctgggcgagatgagcgagaagctgagaagatgcagaaaggagctgaccgccgccatcgacagagccttcgagggcgtgagctacagccaggagtgcaccggccagcagagactggagctgagcgccgcccccctgagcttcagcctgcccgtgcacagactgctgtgcagaagacaccccctggccgcctgcagcagcgccgcccccttcgccgccgtgccctgcgcccccgagaacgagaaccccgccttcgccaccaaccacgcccccgtgaacgccaagccccacgccctgtgccccgagagaaagcccctgaccagcaaggagaacgtgctgatgcacagcagcatcctggcccccgagagagagagctggagaaccgccggcgagggcgagaactggagaaaggagaacctgagaaaggacatggagagagacctgaaggccgacagcaacatgcccctgaacaacagcagccaggaggtgaccaaggacctgctggacatgatcgaccacaccagcatcagaaccatcgaggagctggccggcaagatcgagttcgagaacgagctgaaccacatgtgcggccactgccaggacagccccttcaaggaggaggcctgggccctgctgatggacaagagcccccagaaggccaccgacgccgaccccggcagcctgaagcaggccttcgacgaccacaacatcgtggagaccgtgctggacctggaggaggactacaacgtgatgaccagcttcaagtaccagatcgagtag

SEQ ID NO: 19288 - DNA, 432 bp, Artificial Sequence
  Description of Artificial Sequence: Synthetic coding sequence
atggccacccccctggacaactgcctgagacccttccccgaccccatggtgaaggtgaccgccgagaccaagaagatcagcgaggtgagcagctacgtgagcgccaacaacaagaagaacagcttctggggcagcggcctgctgtaccccgtggccctgctgagatgccaggactgctgggccggccaccagacccacgtgctgagcaaggagttcaccagctacttcagcagcggcgccggcagagaggcccagcaccagcccagcgccgtgctgggcagcctgatctggctgagaagagtgtacctgctgagagccatggtggtgcacggcggcagccagccctgccagagatggctggtgatcagaatggaggtgggcggccaccccagcttccccggccacgcctggctgaccttccacctgaactag

SEQ ID NO: 19289 - DNA, 1692 bp, Artificial Sequence
  Description of Artificial Sequence: Synthetic coding sequence
atgatcaagagaaagatctggtgcaacctgtgcatcgacctggtggccttcaccagcgagatcttcaagggcgccgtgttccagagcctggacggcatcgtggtgagcgccaactgcaagctgagaaagatcttcaccctgaagagcaagccccaggacaccgccgacaaggacgccgtgtacggcgtgcccttcagcaccgacgagcccaccgacatcatccccagaagctgccagctgatgaccgacgtgccccacgtgacccagctgctgaacatgaccaagctgagacagaccgagatcaagttcggcggccaccccctgagaagcgccgagagcgaccagttcatcaacagaggcaccagcatcaccagaaacagcaagaaccaggacgtgtgccacatcgccttcggcagcaaggtgctgggccccccccccctgagcggcagaagaaacaacatgaagatcagcagcgagaccgtgagaagcgtgggcagcaagaacaacagaagctgccagcccagcaccgtggagaagtgcgtgaacggcaccgagatgagcgccctgctgatccccgagagcgaggagcagggcaacaaggagaacatccaccagatcaagcagaccgtgcccatccacgccgccaacctgcacatcatgcacccccaccccccccaggagcccagcgccgacaagaacaacaacagaagaagactgagactgaagagcaccagcagagagagaaccgagacccccagcggcagcagcagcggcaacaacagaatcgaggacaaggccagcaccatcctgaccaccgtgagccagcagggcgccgagctgctgaacagcggcaccctgggcccccagagccccgaccagagcgacgagtggatcttccccgagaacgccgaccacatcagctacctggccagcagcagacagagcctgctgctgggcgacgacagctgcaaccccagccacctgtggctggaggccagcaaggagagcgagcacgaccagcaggccgaggagagccagagcgtgcccaaggacatcttcaccttcagcagcagacccagaagcgccccccacggcaagacccagaccatgagccccgaggagctgagcttcatcctggacctgaaggaggacaacagcgtgaccagcagagacacccagagcgaggacgacttctacggcggcgacagcagcgaggaggagtacgactggagaaactaccagcccagccagatgagcgagagcgagctgcagatgctggccagcctgagatggcagcagaacgaggagctggaggacgccggcaccagccacggcctgagcgccagccaggtggacaactgcaacgtgagcatcagcaccagcagcgacgacaccaccacctggaacagctgcctgcccccccccgtgaaccagggcagacactaccagaaggagatgaacccccccagccccagcaaccccagagactggctgaacatgctgagcccccccatcgtgccccccagccagcagcccgccgagcagagacccgacagctgcgagagcctgagcgtgcagggcgaggaggacctgagcgtggaggaggacgaggaggtgctgaccctgctgtacgacccctgcctgaactgctacttcgacccccagaccggcaagtactacgagctggtgtag

SEQ ID NO: 19290 - DNA, 717 bp, Artificial Sequence
  Description of Artificial Sequence: Synthetic coding sequence
atgagcggcttccccgagaacgccgaccacatcagctacctggccagcagcagacagagcctgctgctgggcgacgacagctgcaaccccagccacctgtggctggaggccagcaaggagagcgagcacgaccagcaggccgaggagagccagagcgtgcccaaggacatcttcaccttcagcagcagacccagaagcgccccccacggcaagacccagaccatgagccccgaggagctgagcttcatcctggacctgaaggaggacaacagcgtgaccagcagagacacccagagcgaggacgacttctacggcggcgacagcagcgaggagggcaaccacagcatccagggcagcagaggccccaccaccggccccagcgagctgacccagctgaccctggagagcctgctgggcaaggccgccaagagaaccagcaaggagtacctgagaagcgcctacaccgaggccggcgccaccgagagccaggacagcagcatggagcagatcgacagaaacaacttcgagatgagcctgctgcccaccacctgcctgagccccaccggcagaagatgcggcagctgccagaagacccccgagcccgtgatcaaggccaaggacctgagcgcccagcaggtgcccgccagcctgaacaagaccagcctgaaggagatcagcggcgagagactgagcagcatccccgaggccagcgagtag

SEQ ID NO: 19291 - DNA, 2070 bp, Artificial Sequence
  Description of Artificial Sequence: Synthetic coding sequence
atgatcaagagaaagatctggtgcaacctgtgcatcgacctggtggccttcaccagcgagatcttcaagggcgccgtgttccagagcctggacggcatcgtggtgagcgccaactgcaagctgagaaagatcttcaccctgaagagcaagccccaggacaccgccgacaaggacgccgtgtacggcgtgcccttcagcaccgacgagcccaccgacatcatccccagaagctgccagctgatgaccgacgtgccccacgtgacccagctgctgaacatgaccaagctgagacagaccgagatcaagttcggcggccaccccctgagaagcgccgagagcgaccagttcatcaacagaggcaccagcatcaccagaaacagcaagaaccaggacgtgtgccacatcgccttcggcagcaaggtgctgggccccccccccctgagcggcagaagaaacaacatgaagatcagcagcgagaccgtgagaagcgtgggcagcaagaacaacagaagctgccagcccagcaccgtggagaagtgcgtgaacggcaccgagatgagcgccctgctgatccccgagagcgaggagcagggcaacaaggagaacatccaccagatcaagcagaccgtgcccatccacgccgccaacctgcacatcatgcacccccaccccccccaggagcccagcgccgacaagaacaacaacagaagaagactgagactgaagagcaccagcagagagagaaccgagacccccagcggcagcagcagcggcaacaacagaatcgaggacaaggccagcaccatcctgaccaccgtgagccagcagggcgccgagctgctgaacagcggcaccctgggcccccagagccccgaccagagcgacgagtggatcttccccgagaacgccgaccacatcagctacctggccagcagcagacagagcctgctgctgggcgacgacagctgcaaccccagccacctgtggctggaggccagcaaggagagcgagcacgaccagcaggccgaggagagccagagcgtgcccaaggacatcttcaccttcagcagcagacccagaagcgccccccacggcaagacccagaccatgagccccgaggagctgagcttcatcctggacctgaaggaggacaacagcgtgaccagcagagacacccagagcgaggacgacttctacggcggcgacagcagcgaggagggcaaccacagcatccagggcagcagaggccccaccaccggccccagcgagctgacccagctgaccctggagagcctgctgggcaaggccgccaagagaaccagcaaggagtacctgagaagcgcctacaccgaggccggcgccaccgagagccaggacagcagcatggagcagatcgacagaaacaacttcgagatgagcctgctgcccaccacctgcctgagccccaccggcagaagatgcggcagctgccagaagacccccgagcccgtgatcaaggccaaggacctgagcgcccagcaggtgcccgccagcctgaacaagaccagcctgaaggagatcagcggcgagagactgagcagcatccccgaggccagcgagtacgactggagaaactaccagcccagccagatgagcgagagcgagctgcagatgctggccagcctgagatggcagcagaacgaggagctggaggacgccggcaccagccacggcctgagcgccagccaggtggacaactgcaacgtgagcatcagcaccagcagcgacgacaccaccacctggaacagctgcctgcccccccccgtgaaccagggcagacactaccagaaggagatgaacccccccagccccagcaaccccagagactggctgaacatgctgagcccccccatcgtgccccccagccagcagcccgccgagcagagacccgacagctgcgagagcctgagcgtgcagggcgaggaggacctgagcgtggaggaggacgaggaggtgctgaccctgctgtacgacccctgcctgaactgctacttcgacccccagaccggcaagtactacgagctggtgtag

SEQ ID NO: 19292 - DNA, 753 bp, Artificial Sequence
  Description of Artificial Sequence: Synthetic coding sequence
atgagcgccgccgccagccccgccagcgagagaggctggaagagcgagaagctggacgaggcccaggccctggccagaagctgcgccgccagaagacccgacttccagccctgcgacggcctgagcatctgcgccacccacagccacggcaagtgcttcaagctgcactggtgctgccacctgggctggtgccactgcaagtacatgtaccagcccatgacccccgtggagcagctgcccagcaccgagatccccgccagacccagagagcccaccaacaccatccagatcagcgtgagcctgaccgagcacttcctgaagttcgccagcgtgttccagccccccctgccccccgacagccccagatactgcatgatcagcgacctgttcatcgacaactaccaggtgaagtgcatcaacggcaagatgtgctacgtgcagaagcagcccgccccccacagccacagaatgagccccgaggaggtgagcgcccacgacgccctgatcagcaaggagagcaacacccccaagatcgaccactgcagcagccccagcagcagcgaggacagcggcatcaacgccatcggcgcccactacgtggagagctgcgacgaggacaccgaggagggcgccgagctgagcagcgaggaggactacagccccgagagcagctgggagcccgacgagtgcaccctgctgagccccagccagagcgacctggaggtgatcgagaccatcgagaccaccgtgtag

SEQ ID NO: 19293 - DNA, 528 bp, Artificial Sequence
  Description of Artificial Sequence: Synthetic coding sequence
atgaccagaacccccgtgggcagcgccagaaccagacccaagcccagaaagctgggcccccagagaggcaaggccctgcaggccagcagcagactgagcgagagccccgccctggtgaagaagagaatgcccgacgcctgcaccctgggcagagccggcatcggcctgcccaagatgtgcctgcacatggccgtgagacacagcaaggcccagaagaccggccccggcatcctgcagcagagacagaagccccccgcccccagagccagcggcggccccgccctgctgggcaagagaagaggctgcagcgaggccggcagcgccagcctggagcccctgagcagcagcagagccgccgccggctgcctgaaccaggtgcccctgagccccttcctggccggccccagaaacaccagaagactgcccgcccccgagagagagagaatcgagctggccgccaccctgtgcctggagggctggcccctgagatgcctggccagcaagggcaagctgcactgcgtgtactag

SEQ ID NO: 19294 - DNA, 492 bp, Artificial Sequence
  Description of Artificial Sequence: Synthetic coding sequence
atgcagagcgtggacagcatgctgggcaccgtgggcggctgcggcggcggcgaggccgccagcaccttcagcaaggaccccagcggctgctgcgtgggcaacgactgcagagacggcggcagaggcctggagagaagacacggcagatggagcagaggcgagggcggcgagagcggcctgtgcagcggcggccagatggccagcgagatcgagtactgggacggcctggccatcagcgtgatggaggtggagaaggccttcggcagcaccaacgtgctgtggaagaccgagcccttcagcctgtgggcctgcaccgccgcctgcccccccagcctgagccccaccctgctggccctgggcctgcccagagacggcaaggagctggccgagcagggcagcctgtggaccgtgctggagcccggcggcgactggagccacagccagagccagctgggcacccccggcagaggcaagggcgccctgggcttctag

SEQ ID NO: 19295 - DNA, 801 bp, Artificial Sequence
  Description of Artificial Sequence: Synthetic coding sequence
atgttcgtggagctgaacaacctgctgaacaccacccccgacagagccgagcagggcaagctgaccctgctgtgcgacgccaagaccgacggcagcttcctggtgcaccacttcctgagcttctacctgaaggccaactgcaaggtgtgcttcgtggccctgatccagagcttcagccactacagcatcgtgggccagaagctgggcgtgagcctgaccatggccagagagagaggccagctggtgttcctggagggcctgaagagcgccgtggacgtggtgttccaggcccagaaggagccccaccccctgcagttcctgagagaggccaacgccggcaacctgaagcccctgttcgagttcgtgagagaggccctgaagcccgtggacagcggcgaggccagatggacctaccccgtgctgctggtggacgacctgagcgtgctgctgagcctgggcatgggcgccgtggccgtgctggacttcatccactactgcagagccaccgtgtgctgggagctgaagggcaacatggtggtgctggtgcacgacagcggcgacgccgaggacgaggagaacgacatcctgctgaacggcctgagccaccagagccacctgatcctgagagccgagggcctggccaccggcttctgcagagacgtgcacggccagctgagaatcctgtggagaagacccagccagcccgccgtgcacagagaccagagcttcacctaccagtacaagatccaggacaagagcgtgagcttcttcgccaagggcatgagccccgccgtgctgtag

SEQ ID NO: 19296 - DNA, 729 bp, Artificial Sequence
  Description of Artificial Sequence: Synthetic coding sequence
atgttcgtggagctgaacaacctgctgaacaccacccccgacagagccgagcagggcaagctgaccctgctgtgcgacgccaagaccgacggcagcttcctggtgcaccacttcctgagcttctacctgaagggcgtgagcctgaccatggccagagagagaggccagctggtgttcctggagggcctgaagagcgccgtggacgtggtgttccaggcccagaaggagccccaccccctgcagttcctgagagaggccaacgccggcaacctgaagcccctgttcgagttcgtgagagaggccctgaagcccgtggacagcggcgaggccagatggacctaccccgtgctgctggtggacgacctgagcgtgctgctgagcctgggcatgggcgccgtggccgtgctggacttcatccactactgcagagccaccgtgtgctgggagctgaagggcaacatggtggtgctggtgcacgacagcggcgacgccgaggacgaggagaacgacatcctgctgaacggcctgagccaccagagccacctgatcctgagagccgagggcctggccaccggcttctgcagagacgtgcacggccagctgagaatcctgtggagaagacccagccagcccgccgtgcacagagaccagagcttcacctaccagtacaagatccaggacaagagcgtgagcttcttcgccaagggcatgagccccgccgtgctgtag

SEQ ID NO: 19297 - DNA, 303 bp, Artificial Sequence
  Description of Artificial Sequence: Synthetic coding sequence
atgcacgtgtgcgacctgcagaagctggtgagaatccagctggccttcaccaccttcccctggatgttcagctgccacctgctgcccacccccgagctgagcagcaagagaaaccagtgcctgctgtacaagaccagcggctgcctgacccagatgcccatcctgtacggccaccccgccaccctgctgaaggactacatcctgcaggccatcctgcagcccggcaagaagatccagggcggcaccgagatccagagaggcagcttcgccaaccagtaccagaccgacgccagccacctgtag

SEQ ID NO: 19298 - DNA, 744 bp, Artificial Sequence
  Description of Artificial Sequence: Synthetic coding sequence
atgtggggccccggcgtgaccgccgagggcctgagcgtggcccccgcccccccccccctgctgcccctgctgctgctgctggccctggccctggtggcccccagcagaggcggcggcggctgcgccgagctggcctgcggcgagagagagagatgctgcgacgccaccaacgccaccgccgtgagatgctgcaagctgcccctgcacgccttcctggacaacgtgggctggttcgtgagaaagctgagcggcctgctgatcctgctggtgctgttcgccatcggctacttcctgcagagaatcatctgccccagccccagaagataccccagaggccaggccagacccggccagagacccggcccccccggcggcgccggccccctgggcggcgccggcccccccgacgacgacgacgacagccccgccctgctgagagacgaggccgccgccggcagccaggacagcctgctggacagcggcggcggcggcagaggcagaggcggcggcggcagaagcgaccccagctgcgccagcgagcacgagatgagagtggtgagccccgtgttcctgcagctgcccagctacgaggaggtgaagtacctgcccacctacgaggagagcatgagactgcagcagctgagccccggcgaggtggtgctgcccgtgagcgtgctgggcagacccagaggcggcgtggccgccgagcccgacggcggcgagggcagataccccctgatctag

SEQ ID NO: 19299 - DNA, 1080 bp, Artificial Sequence
  Description of Artificial Sequence: Synthetic coding sequence
atgaacctgaacccccccaccagcgccctgcagatcgagggcaagggcagccacatcatggccagaaacgtgagctgcttcctggtgagacacaccccccaccccagaagagtgtgccacatcaagggcctgaacaacatccccatctgcaccgtgaacgacgacgagaacgccttcggcaccctgtggggcgtgggccagagcaactacctggagaagaacagaatccccttcgccaactgcagctaccccagcagcaccgccgtgcaggagagccccgtgagaggcatgagccccgcccccaacggcgccaaggtgccccccagaccccacagcgagcccagcagaaagatcaaggagtgcttcaagaccagcagcgagaaccccctggtgatcaagaaggaggagatcaaggccaagagaccccccagcccccccaaggcctgcagcacccccggcagctgcagcagcggcatgaccagcaccaagaacgacgtgaaggccaacaccatctgcatccccaactacctggaccaggagatcaagatcctggccaagctgtgcagcatcctgcacaccgacagcctggccgaggtgctgcagtggctgctgcacgccaccagcaaggagaaggagtgggtgagcgccctgatccacagcgagctggccgagatcaacctgctgacccaccacagaagaaacaccagcatggagcccgccgccgagaccggcaagccccccaccgtgaagagcccccccaccgtgaagctgccccccaacttcaccgccaagagcaaggtgctgaccagagacaccgagggcgaccagcccaccagagtgagcagccagggcagcgaggagaacaaggaggtgcccaaggaggccgagcacaagccccccctgctgatcagaagaaacaacatgaagatccccgtggccgagtacttcagcaagcccaacagcccccccagacccaacacccaggagagcggcagcgccaagcccgtgagcgccagaagcatccaggagtacaacctgtgcccccagagagcctgctaccccagcacccacagaagatag

SEQ ID NO: 19300 - DNA, 945 bp, Artificial Sequence
  Description of Artificial Sequence: Synthetic coding sequence
atgggctgcagatgctgcaagatcatccagagctacctgttcgaccccgtgcaggtgcccagccccggctacgtgaacgaggtgaacagctgcaagctggacgaggacgacaccgacaagctgaagggcaagtggagcagcgaggtgctggtgcagaagaacgacccccagagacagggcagcaagaagaccgagagcagcagcagaaccgccgacccctgggagccctgctggccccaccagggccccctgccccagggcgacgccggcggcgagcaccacgcctgcggcgtgaacggcatcggccccgccgccaccccccagcccaccggcaacagcagccccacccaggacgacagaggcagctgggccagcaccgccaacaccgtgccccccacccagcccttcctggagggcggcggcaccagaaagcaggactgcgtgctgctggccagcgagggcacccaggtgatgagaaacggcgacagcagagcccccagcgaggccgagagcttcgccctggaggtgcaggaccacgtgttccagatccccgcccccgactacctgcagcactggggccccgccggcgacaacgtggaccacaacgagaaggactgcgtgttcaagaaccacaccgaggacgagagcctggagggcatccagccccccgtgggcgagcacggcctgaacacccccttcagcgtgagaagaagctgggacagcctgaacgaggacgtggagaccgaggtgctgagcatctgcttcaacgagaagggccccgtgcacgccatgcccgtggtggacagcggcaacagacaggaggacacccacggcagcgacggcgacggcgacggcgagatcgtggacgaggacgccgccgtggccgaggccctggccgccctggaggccgccaccgccggcgaggacctggacgagaccgactag

SEQ ID NO: 19301 - DNA, 945 bp, Artificial Sequence; identical to SEQ ID NO: 19300
  Description of Artificial Sequence: Synthetic coding sequence

SEQ ID NO: 19302 - DNA, 702 bp, Artificial Sequence
  Description of Artificial Sequence: Synthetic coding sequence
atggaccaggaggagggcctgaaggccctggacaacatcgtgacccagttcaacgcctacgaggacttcctggacagccagatcaccaccgtggacctgtactacctggaggacgagaccctggccagacagctggtggagctgggctacagaggcaccggcgagagagtgaagagagaggacttcgaggccagaaaggccgccatcgagatcgccagactggccgagagagcccagcagaagaccctgaccagcgccggcaaggacctgcaggacaacttcctgaccgccctggccatgagagaggaggacaacagaagcggcaagctgagcagcgtgatcttcatcagagacagaaacagccacggccaggagatcagcggctacatcgactacgcccacagactgaagaccgaggacttcgaggtgtacttcaccggcaagaagagactgctgcccagacccaccgacatcagcttctacaactgggacgccgacatcgccgtgagcaacagcagccccaactaccaggtgatcgccgacaaccccgagggcctgctgttcagatacaagagagacagaaagatcctgaacgtggaccccaaggcccagcccggcgacaacagcaccagaatcaccatcctgaccgagctgtacgtgcaggccgtgatcttcgaccacatcagcagaagaaagacctag

SEQ ID NO: 19303 - DNA, 753 bp, Artificial Sequence
  Description of Artificial Sequence: Synthetic coding sequence
atggaccaggaggagggcctgaaggccctggacaacatcgtgacccagttcaacgcctacgaggacttcctggacagccagatcaccaccgtggacctgtactacctggaggacgagaccctggccagacagctggtggagctgggctacagaggcaccggcgagagagtgaagagagaggacttcgaggccagaaaggccgccatcgagatcgccagactggccgagagagcccagcagaagaccctgaccagcgccggcaaggacctgcaggacaacttcctgaccgccctggccatgagagaggaggacaacagaagcggcaagctgagcctgaaccagcaggagaccgacgccgcccacatcctgaagaagcagctggccagcgtgatcttcatcagagacagaaacagccacggccaggagatcagcggctacatcgactacgcccacagactgaagaccgaggacttcgaggtgtacttcaccggcaagaagagactgctgcccagacccaccgacatcagcttctacaactgggacgccgacatcgccgtgagcaacagcagccccaactaccaggtgatcgccgacaaccccgagggcctgctgttcagatacaagagagacagaaagatcctgaacgtggaccccaaggcccagcccggcgacaacagcaccagaatcaccatcctgaccgagctgtacgtgcaggccgtgatcttcgaccacatcagcagaagaaagacctag

SEQ ID NO: 19304 - DNA, 600 bp, Artificial Sequence
  Description of Artificial Sequence: Synthetic coding sequence
atggacttcaagatcgagcacacctgggacggcttccccgtgaagcacgagcccgtgttcatcagactgaaccccggcgacagaggcgtgatgatggacatcagcgcccccttcttcagagacccccccgcccccctgggcgagcccggcaagcccttcaacgagctgtgggactacgaggtggtggaggccttcttcctgaacgacatcaccgagcagtacctggaggtggagctgtgcccccacggccagcacctggtgctgctgctgagcggcagaagaaacgtgtggaagcaggagctgcccctgagcttcagaatgagcagaggcgagaccaagtgggagggcaaggcctacctgccctggagctacttcccccccaacgtgaccaagttcaacagcttcgccatccacggcagcaaggacaagagaagctacgaggccctgtaccccgtgccccagcacgagctgcagcagggccagaagcccgacttccactgcctggagtacttcaagagcttcaacttcaacaccctgctgggcgaggagtggaagcagcccgagagcgacctgtggctgatcgagaagtgcgacatctag

SEQ ID NO: 19305 - DNA, 600 bp, Artificial Sequence; identical to SEQ ID NO: 19304
  Description of Artificial Sequence: Synthetic coding sequence

SEQ ID NO: 19306 - DNA, 195 bp, Artificial Sequence
  Description of Artificial Sequence: Synthetic coding sequence
atggacttcaagatcgagcacacctgggacggcttccccgtgaagcacgagcccgtgttcatcagactgaaccccggcgacagaggcgtgatgatggacatcagcgcccccttcttcagagacccccccgcccccctgggcgagcccggcaagcccttcaacgagctgtgggactacgaggtggtggaggcctag

SEQ ID NO: 19307 - DNA, 354 bp, Artificial Sequence
  Description of Artificial Sequence: Synthetic coding sequence
atggcctacggcgtgcccagaaagaacaccgtgaagaccatcctgagaggcagctgctacaacgtgcaggagccctgggacatcgccctgctggccaagacctggagcaccaacctggccaacatcaagctgcccttcctggaggagatcagcttcggcggcagcgtgcagctgaccaagtgcaccaccatcaaggacggcctgctgcccagcgccgagagcatcaagctggagagagagtacgaggtgaagagactgtgcaagctgaagtgccaggagaacaccagcaaggagatccagctgctgctgagagagagacccgccggcctgagaagacccctgcccagcaagtag

SEQ ID NO: 19308 - DNA, 354 bp, Artificial Sequence; identical to SEQ ID NO: 19307
  Description of Artificial Sequence: Synthetic coding sequence

SEQ ID NO: 19309 - DNA, 246 bp, Artificial Sequence
  Description of Artificial Sequence: Synthetic coding sequence
atggcctacggcgtgcccagaaagaacaccgtgaagaccatcctgagaggcagctgctacaacgtgcaggagccctgggacatcgccctgctggccaagacctggagcaccaacctggccaacatcaagctgcccttcctggaggagatcagcttcggcggcagcgtgcagctgaccaagtgcaccaccatcaaggacggcctgctgcccagcgccgagagcatcaagctggagagagagtactag

SEQ ID NO: 19310 - DNA, 342 bp, Artificial Sequence
  Description of Artificial Sequence: Synthetic coding sequence
atggcctacggcgtgcccagaaagaacaccgtgaagaccatcctgagaggcagctgctacaacgtgcaggagccctgggacatcgccctgctggccaagacctggagcaccaacctggccaacatcaagctgcccttcctggaggagatcagcttcggcggcagcgtgcagctgaccaagtgcaccaccatcaaggacggcctgctgcccagcgccgagagcatcaagctggagagagagtacgaggtgaagagactgtgcaagctgaagtgccaggagaacaccagcaaggagatccagctgctgctgagagagagacccgccggcctgagaagaccctag

SEQ ID NO: 19311 - DNA, 1380 bp, Artificial Sequence
  Description of Artificial Sequence: Synthetic coding sequence
atgtacgacagagcccccagactgctgaagctggccgagggcggcagcaccgaggcccacgtgggccccggcagctaccaggtgcccttcctgaagcagcaggccaccggcagcaacgcccccttcctgagcctgaccgccagagagagcaccttcaccatcgccagcagcatcgagaaggccgtgcccggccccggccactacaacgtgagcgaggcccagaagatcagcagaagccccaccctgaccagaagcgtggacgtgcccagcatccccagctgcggcaagagctacggctaccacatcaacgacgacggcagcatcatcaagtgcttcccccccgcctgcgacagcaccctgggccccgcctactacaagccccagttcgacgtgagcaacgccaccctgaagtacaagggcatccacttcggcaacagcagcggcagacaggagctgcccaagaagagcggccccggccccggccagtacgacatcgtgcagaagaagaccagctactacgagaacgtgaacatcaagagagaccagcagcagaactactgcagcttcatccccagactgtacgagatcatcgtgctgcaggagaagaagaagagattcctgcccatgaagagcatcacccccgcccccggcacctacaacgagcccagaaccgccctgaagagcctgaagaagaccagcggcctgaagaacatccccttcggccagagcgccgtgagattcacccaggacatcagaaccgaggagatgcccggccccggcttctacaacgtgctgaacaacaccatcatcgccagcgtgagaaacatctgcagcaagaagcagaagaagagcgccttcggcagcagcgtgcccagaaccttcttcagcgtgcagaaggaggcctgcgccacccccggccccgccgactaccaggagttctggcacagccagggcgtgggcatcagcgacgagctgcccaacctgaccaacaagtacgccgccttcctgagcagagccaagagaaccatgaaggtgcccgacatggtgatccccgcccccggcagctacgacgtgcacaagagctacgagatgagccaggtgaagcacaagtacatgccccccagaagcctggtggccaagagaaagcacgccagcttcctgagcgccacccccagatgcctggagaaggtgaccgacggccccggccccgccgcctacaaccccgtgctgagaaagagctgccccatccccctgttcgtgaaggccagcaagagattcgaggagagcaaggagatcacccccggccccgccacctacgagatcagccaggagaagaagaagggcaacctgatcggcgagatggccgccgacatcatgtag

SEQ ID NO: 19312 - DNA, 603 bp, Artificial Sequence
  Description of Artificial Sequence: Synthetic coding sequence
atgaccagcgccgagaccgccagcagagccgccgagagcggcggcacccccgtgagaccctgcagcagaccccacagagcccccagccccgccgcccccagcagacccggcgcccccgccgccggccccagaaagctgctggtgcccggcctgccctgcctggtgagaggcggctggccctggaccagacccgacagcagccccttcagacccgccgccagacccagaatgagcccccacagaagccccgccgtggccagaagatgcggcagacccagaagaagagaccccagaagaagaagaacccccgccctgcccagaccctggcccggcagaggcggccccggcagaagcctgctgcacagacacctgttcatccagcagctgctgagaacctgctggcccgccctgcccagagacagaacccccgcccccggcggcaccatgcccggcgccgccctggccggccccggcagacaggccagcggcagccccgccccccagagcgagggcgccccccccagaccctggacccccctgcagcccggcctgcaccacagaccccccagcagcagcagcggcctgctgagcagcttcttctag

SEQ ID NO: 19313 - DNA, 474 bp, Artificial Sequence
  Description of Artificial Sequence: Synthetic coding sequence
atggagggctgcgccgtgagaagaggcagctgccccctgctgcccggccccagcgcctggagagccagccccgccggctgggccggcagagccaagctgagaagctggtgcagagccagcggcctgcccaacagaccctacaccctgaccggcggcagacacggcagcgtgagcctgctgagacaccccggcaccaccaccttcgtgcagcagagaagcctgcaccagagctgggagaagagaatcgtgttcagcgcctgccccgtgagcagaagctggtgccccgagagaaacttcagcggcagcatccccgccgtgaccccccccaagctgcccggccacagcaagagcgagggcccccccggcaaggtgagaaagagaaccaccatcagaagccagcccctgttcgtgaccagaaccagaggcttcggcagcgccgtgggctggctgcccctgggcagccccgtgctgtag

SEQ ID NO: 19314 - DNA, 561 bp, Artificial Sequence
  Description of Artificial Sequence: Synthetic coding sequence
atgtggctggtggagtgcaccggcagagacctgaccggcctgagctgcctgctgagcatggacagacagcccagaagaagacagcacgtggccggctgcagagacgtgcccccccccctgccccagggcagctggggccagaccagccccagacacagcatcctgtgcagcaagagcggctgcgacctgctgggcggcggcgagtacaacggcgagaccagcggcgaggagttcctggcccccgcctggacctgcagagcccagcaggccgccacctggctgagcgtgcagcagaccagccacaaggccctgggccccgccggcggcgccgccatgagcagcaagctgagccccgaggagcagttcctgagcagaatccacttcctgagaaccttcatgtgcagcgtggccggcgccgagctgcccggcatcccccaggccaccgagaacggcgagggctgcagacccgccagagaccccgccagcagccccagcagcctgagcatggccagcgtgtacacccagtgcagcagcgcccagctggtgagcgccctgagctag

SEQ ID NO: 19315 - DNA, 612 bp, Artificial Sequence
  Description of Artificial Sequence: Synthetic coding sequence
atgcccaaggcccccaagggcaagagcgccggcagagagaagaaggtgatccacccctacagcagaaaggccgcccagatcaccagagaggcccacaagcaggagaagaaggagaagctgaagaacgagaaggccctgagactgaacctggtgggcgagaagctgcagtggttccagaaccacctggacccccagaagaagagatacagcaagaaggacgcctgcgagctgatcgagagatacctgaacagattcagcagcgagctggagcagatcgagctgcacaacagcatcagagacagacagggcagaagacactgcagcagagagaccgtgatcaagcagaccatggagagagagagacagcagttcgagggctacggcctggagatccccgacatcctgaacgccagcaacctgaagaccttcagagagtgggacttcgacctgaagaagctgcccaacatcaagatgagaaagatctgcgccaacgacgccatccccaagacctgcaagagaaagaccatcatcaccgtggaccaggacctgggcgagctggagctgaacgacgagagcagcgacagcgacgaggagatgaccgccgtggcctag

SEQ ID NO: 19316 - DNA, 837 bp, Artificial Sequence
  Description of Artificial Sequence: Synthetic coding sequence
atggtgagaggcgccggccccggccccagcctgagcgccctgagccaccccaccggcgccagcggcatggccgccgccgagggccccggctacctggtgagcccccaggccgagaagcacagaagagccagaaactggaccgacgccgagatgagaggcctgatgctggtgtgggaggagttcttcgacgagctgaagcagaccaagagaaacgccaaggtgtacgagaagatggccagcaagctgttcgagatgaccggcgagagaagactgggcgaggagatcaagatcaagatcaccaacatgaccttccagtacagaaagctgaagtgcatgaccgacagcgagagcgccccccccgactggccctactacctggccatcgacggcatcctggccaaggtgcccgagagctgcgacggcaagctgcccgacagccagccccccggccccagcaccagccagaccgaggccagcctgagcccccccgccaagagcacccccctgtacttcccctacaaccagtgcagctacgagggcagattcgaggacgacagaagcgacagcagcagcagcctgctgagcctgaagttcagaagcgaggagagacccgtgaagaagagaaaggtgcagagctgccacctgcagaagaagcagctgagactgctggaggccatggtggaggagcagagaagactgagcagagccgtggaggagacctgcagagaggtgagaagagtgctggaccagcagcacatcctgcaggtgcagagcctgcagctgcaggagagaatgatgagcctgctggagagaatcatcaccaagagcagcgtgtag

SEQ ID NO: 19317 - DNA, 561 bp, Artificial Sequence
  Description of Artificial Sequence: Synthetic coding sequence
atggccagcgtgagctaccagaagcccaccagcaccaccgtgggcaagcagatgatcttcaccggccccgactacatcaaggactacctgcccaagatccaccagcacaccagctacgtgggcgagcagcacctggccctggagaagaccggcgacctgagatacctgtggagacccgccagcaacagaagcctgcccgccaagtacaagcacgagtacgtgagcgagatcggctggagaatcccccagtacaacttcatcaacaagagcagactgggcagcggcttccacatcaagtacgaggagctgagccaggccagcctggacagcatcacccacagataccagaacccctggcagcccaagccccacgtgctggacatgcagggcaagcagagcagagccagcttcgcctggcacatgagcgccttcgaggacaccgaccagagaaacagcaagtgggccatcctggtgagacagtgcaagagcagcctgcccagagccagcaagccccccaagctgcccaagctgcccaagaaggagaagaagagaaagcactag

SEQ ID NO: 19318 - DNA, 342 bp, Artificial Sequence
  Description of Artificial Sequence: Synthetic coding sequence
atggccgaccccgaggagctgcaggtgagcagcccccccccccccccccccagcagccccagcagcagcgacgccagcgccgccagcagccccggcggccccgtgagcctgggctggcccgtgcccagcagaagcagcggccccaccgtggaccagctggaggaggtggagctgcagatcggcgacgccgccttcagcctgaccaagctgctggaggccaccagcgccgtgagcgcccaggtggaggagctggccttcaagtgcaccgagaacgccagattcctgaagacctggagagacctgctgaaggagggctacgacagcctgaagcccgacgactag

SEQ ID NO: 19319 - DNA, 930 bp, Artificial Sequence
  Description of Artificial Sequence: Synthetic coding sequence
atgcccgccgagggcggcaagaccgacatggagagaatcggcctgttcagcgagatggagtacatcaccgtgggcgacaagtacgtgagccagttcaacagacccttcaacgaggccgccagcaagaacaagcagatgctgcccggcggcagcaaggagatgagcgacctgcaggccggctacttcgacccccacttcgtgagaatcttcgagggcgagggctacatcaacctgaaccaggtgagaagaagagacatggtggaggccgccaagaagaacctgggcaaggccttcctgcccagcaacggcgagaagaagccctgcggcctgggcagctactacggcaccatcggcggccccgtgcccttcttcagcgcccagagcaagcccagagagaagtacaaggcccccggcaagaacctgtacaccaaccccggcaagaagggcaccggctacggctacgccaacatcaccatcggcaagcagttcagccacagcgccgacttctacgacgccgccaagctgaagtacaagaaggccaacgaggagcaccacagactgctgaagggcgcccccttcaagctgaacctgcaccccagagactacttcgacgccaacccctacttcagcgaggagagcctgccccccatcaagaaggaggagaagaagaagaccatcagcaacaccttcaagcccagcagccccggcaagaagcccggcggcatgaaggccggcaccttcgacccctaccccagccacagcgccgacccctacgtggccaagctggccaacatcagcggcaaggacgacaagatcttccacccccccagcggccccaagagcagacccgtggagagcatcatgaccctgaacgtgagaagagccctgaacagcaagaactacaagaccagcagcgtgcccagctactag

SEQ ID NO: 19320 - DNA, 486 bp, Artificial Sequence
  Description of Artificial Sequence: Synthetic coding sequence
atgcccgccgagggcggcaagaccgacatggagagaatcggcctgttcagcgagatggagtacatcaccgtgggcgacaagtacgtgagccagttcaacagacccttcaacgaggccgccagcaagaacaagcagatgctgcccggcggcagcaaggagatgagcgacctgcaggccggctacttcgacccccacttcgtgagaatcttcgagggcgagggctacatcaacctgaaccaggtgagaagaagagacatggtggaggccgccaagaagaacctgggcaaggccttcctgcccagcaacggcgagaagaagccctgcggcctgggcagctactacggcaccatcggcggccccgtgcccttcttcagcgcccagagcaagcccagagagaagtacaaggcccccggcaagaacctgtacaccaaccccggcaagaagggcaccggctacggctacgccaacatcaccatcggcaagtag

SEQ ID NO: 19321 - DNA, 537 bp, Artificial Sequence
  Description of Artificial Sequence: Synthetic coding sequence
atgcccgccgagggcggcaagaccgacatggagagaatcggcctgttcagcgagatggagtacatcaccgtgggcgacaagtacgtgagccagttcaacagacccttcaacgaggccgccagcaagaacaagcagatgctgcccggcggcagcaaggagatgagcgacctgcaggccggctacttcgacccccacttcgtgagaatcttcgagggcgagggctacatcaacctgaaccaggtgagaagaagagacatggtggaggccgccaagaagaacctgggcaaggccttcctgcccagcaacggcgagaagaagccctgcggcctgggcagctactacggcaccatcggcggccccgtgcccttcttcagcgcccagagcaagcccagagagaagtacaaggcccccggcaagaacctgtacaccaaccccggcaagaagggcaccggctacggctacgccaacatcaccatcggcaagcagttcagccacagcgccgacttctacgacgccgccaagctgaagtacaagtag

SEQ ID NO: 19322 - DNA, 831 bp, Artificial Sequence
  Description of Artificial Sequence: Synthetic coding sequence
atgctgagagacagcgaggccgaggtgaccgaggaggaccccagactgagagcccagcagctgcaccacagagtgctgaccctgcagtgccagctgagagaccagggcgccgcccaccaggccagcctggacgaggccaccagactgcaggaggagctgcaggccaagctggaggagctgcagaagaagcagcacgaggccaagctggccgtgacccccctgaaggccaagatcgccagcctggtgagaaagtgcagagagagaaacagactgatcacccacctgctgcaggagctgcacagacacggcctgggcaacctgctgctgagcgagctggcccagaacatgctgaacgacgtggccctggccgagtacaccgccaccttcctggcccccggcgtgcccgagaccagccaccacctggacgtgaagagcgagatgaccgccgccctgagagcccagacctacctgctgaaccccgagatggacagcgtgctgcagagcagcctgagcagcgagagctggcccatccccgagcccgagtggcccgcccagaccgcccagctggacagcctgaagctgcccctgagcctggtgagcaccctggaccccggcacctgcctggccgccgtgaccgtggagcccggcctgcccgcccagagactgcaggagaagggcggcatgccctgccccgccctgcaggtggacaacgtgcccgcccccagcgagctgctgagccccgccagaatcctggccttccaccaggagctgagacagagcatctgcagcaacagccaggtgcacaagagccccctggagctggagatgtag

SEQ ID NO: 19323 - DNA, 2253 bp, Artificial Sequence
  Description of Artificial Sequence: Synthetic coding sequence
atgctgttcttcgccggcgagaccggcctgcccctgttccccagattcgccctgagcgtggagggcgccgagcccaccgaccacggccacccccaggccgtgagcaagggccacaacagatgcgccctgaccatcgacgagctggcccaggacgtggaggcctgcttccagcagctgagcaccctgcagcccggcagcagaggctggcagtgcagcgccagcgcctgcagaggcgagaactggagcttcgcccagaagtggcacagcggctgggagagagcccacagccagcaggtgtggggcaactggggcatctgcagcaacgaggaggccaagagcaaggagagcggcgagggcgacaagcccggcaagaccaccgccctgggcaccagcgaggtgcccggcaaccccggcaccctgccccactgggacgaggccagccccaaccccccccagggccccgccgagccctggggcgccctggagagagtgagaagcagattccaccagctgatcagcggcctgaagaagcagagaagccagatcctgcacgacaacaccaagctgcacggcgaccaggagagattccacgagagagtgtgcgccctggagagagagagagagagagaggtgaccaagatcagcagactggagagagacaaccacagactggtgggcgacatcagccagctgaagaaggagctggaccagtacctgcaggccatcagcgacctggaggactgcaacggcaagagctactgcaagatcctggagctggaggaggagaacgagaccctgaagggcaacctgggccagctgcagaaggccaccagcgagagcgtgagaaagagcaaggacaccatggagcaggtgaccctggagaactggaagctgcagaccctgatcagcgagctgggcgtgagctacaaggagctgatcaaggacatcgtgctgggcatcgaggacatgatcagagccctgagcggcgagaacgagcacctgctgagaagagtgcacgtgctggagagagaggtgaccctgcagagaagcaccgaccagggcagactggtgagaggcagagagcacctgcagggcaaggccaagatgcacgccctggacaaggaggtgcaggtgacccccctgaccggccagctgctgagcagagcctgcggcccccccctggaggaggagatgagcctggccgccggccagaccggccccagcaccggcaccggcaacagcagaagaggcgccgacagccccccccccagcctggtgtggagaaacaccggcgtggccaacgccctgcagggcaacgtgagcggcgccgaggtgaaggaggcccacctggagaaggaggagaagagacccagatgcagcgtggcccagggccaggccctgagcagcctgagcaacggccccatgctgagagacagcgaggccgaggtgaccgaggaggaccccagactgagagcccagcagctgcaccacagagtgctgaccctgcagtgccagctgagagaccagggcgccgcccaccaggccagcctggacgaggccaccagactgcaggaggagctgcaggccaagctggaggagctgcagaagaagcagcacgaggccaagctggccgtgacccccctgaaggccaagatcgccagcctggtgagaaagtgcagagagagaaacagactgatcacccacctgctgcaggagctgcacagacacggcctgggcaacctgctgctgagcgagctggcccagaacatgctgaacgacgtggccctggccgagtacaccgccaccttcctggcccccggcgtgcccgagaccagccaccacctggacgtgaagagcgagatgaccgccgccctgagagcccagacctacctgctgaaccccgagatggacagcgtgctgcagagcagcctgagcagcgagagctggcccatccccgagcccgagtggcccgcccagaccgcccagctggacagcctgaagctgcccctgagcctggtgagcaccctggaccccggcacctgcctggccgccgtgaccgtggagcccggcctgcccgcccagagactgcaggagaagggcggcatgccctgccccgccctgcaggtggacaacgtgcccgcccccagcgagctgctgagccccgccagaatcctggccttccaccaggagctgagacagagcatctgcagcaacagccaggtgcacaagagccccctggagctggagatgtag

SEQ ID NO: 19324 - DNA, 609 bp, Artificial Sequence
  Description of Artificial Sequence: Synthetic coding sequence
atgagccactacttctacctgaccccccagatcctgctgcccttcagccccctgaccagccaggagttcgacctgatcagaagaaaggccggcgccagctggcaggacgagaccagatggagcgacagcagcgtgaccacctacaccggcagctacagaaagaagcagctggacaagagcatgtgcagccagttcagcttcagagccggccagcacgagcccgagtgcaagcagatgagcctgaccaacagcagcgcctgccacctgctgtgctgggccggcacccaggagaccaccgacatcaagggcctgttccccgacatcaccagacccttcaagaagagcttcgacgtgaagcacggcgtggcccaccagatctgggacttcggcgactgcttccccaccccccccaactacggcaagtactgcgtgagacccaagaagcccgcccaggaggccctgatcaactacagcagaagaggcaagggcgtgctgaagcacctgcacggcagatgcgacagcgagagcaaggtgtgcagcagcgaggacagcgaggccgacagatacagcgactacggctggggcggccccagcagccccttcaactag

SEQ ID NO: 19325 - DNA, 489 bp, Artificial Sequence
  Description of Artificial Sequence: Synthetic coding sequence
tgagacagcagcgtgaccacctacaccggcagctacagaaagaagcagctggacaagagcatgtgcagccagttcagcttcagagccggccagcacgagcccgagtgcaagcagatgagcctgaccaacagcagcgcctgccacctgctgtgctgggccggcacccaggagaccaccgacatcaagggcctgttccccgacatcaccagacccttcaagaagagcttcgacgtgaagcacggcgtggcccaccagatctgggacttcggcgactgcttccccaccccccccaactacggcaagtactgcgtgagacccaagaagcccgcccaggaggccctgatcaactacagcagaagaggcaagggcgtgctgaagcacctgcacggcagatgcgacagcgagagcaaggtgtgcagcagcgaggacagcgaggccgacagatacagcgactacggctggggcggccccagcagccccttcaactag

SEQ ID NO: 19326 - DNA, 507 bp, Artificial Sequence
  Description of Artificial Sequence: Synthetic coding sequence
atggtgaaggaggtgtggagagtgctgagagaggagcccggcagaagaaaggagagcagacagaacagagccagaggcaacagagtgcagcagaacagcagcaacctgaaccccacccccgcccccggcccccacagcaccgagagcagaggcagaagaagagccggcagcgaggccccccccgtgcccggcagcgagagcctgagcaccagcagcgagagaggccacggccccgccgtgggcaacctggtgagcgagagcgccggcagaagcgccggccagggcagccccggccccgacgccatgagcagaaacctgagaaccgccctgatcttcggcggcttcatcagcctgatcggcgccgccttctaccccatctacttcagacccctgatgagactggaggagtacaagaaggagcaggccatcaacagagccggcatcgtgcaggaggacgtgcagccccccggcctgaaggtgtggagcgaccccttcggcagaaagtag

SEQ ID NO: 19327 - DNA, 204 bp, Artificial Sequence
  Description of Artificial Sequence: Synthetic coding sequence
atgagcagaaacctgagaaccgccctgatcttcggcggcttcatcagcctgatcggcgccgccttctaccccatctacttcagacccctgatgagactggaggagtacaagaaggagcaggccatcaacagagccggcatcgtgcaggaggacgtgcagccccccggcctgaaggtgtggagcgaccccttcggcagaaagtag

SEQ ID NO: 19328 - DNA, 282 bp, Artificial Sequence
  Description of Artificial Sequence: Synthetic coding sequence
atggacacccagaagcagatccacaagacccacaacagcaagaaccagttcttcaccatcttcttcttcctgagcgtggagttcggcaaggagggcaccagaaagaacttctacctgctgctgagcatcggccactacggcagaaagagcagaagagccgacctgggcaccgccgacaccgccgacaagaccgagcccgagtgcttcgccgccagctggaccttcgaccccaaccccagcgtgaccgtgagcggcgcccacagcaccgccgtgcaccagtag

SEQ ID NO: 19329 - DNA, 477 bp, Artificial Sequence
  Description of Artificial Sequence: Synthetic coding sequence
atgcccgagccccccacccccagcgtgggcagctgcgccgccagagccagcagaatgagcgccgccccctgcagcagagcccccagccccatcgaccaccccagagccgaggagtgcggcagagccgccagagactggcaggccgccccccccgccgcccccgtgagagaccccctgggcgaggccagctgggcccccgagagcggcgaggacatggagaacctgtacgtgcagctgaagctgcagagcgtgggcacctgcttcaacagagaggagctgcccagcgtgctgcagggcgaggagctgggcgccaccagcgtgaccaacaagcccggcctgagcgccatgagaaaggagaccgaccagcaggtgggcgagagaaagctgacctactgcggcgaccaggtgaccctgttcaccgaccaggccctgagccagatcctgagcagcgaggagggcagaatcaaggtgatgtag

SEQ ID NO: 19330 - DNA, 1329 bp, Artificial Sequence
  Description of Artificial Sequence: Synthetic coding sequence
atgagcgacagcgccggcggcagagccggcctgagaagataccccaagctgcccgtgtgggtggtggaggaccaccaggaggtgctgcccttcatctacagagccatcggcagcaagcacctgcccgccagcaacgtgagcttcctgcacttcgacagccaccccgacctgctgatccccgtgaacatgcccgccgacaccgtgttcgacaaggagaccctgttcggcgagctgagcatcgagaactggatcatgcccgccgtgtacgccggccacttcagccacgtgatctggttccaccccacctgggcccagcagatcagagagggcagacaccacttcctggtgggcaaggacaccagcaccaccaccatcagagtgaccagcaccgaccactacttcctgagcgacggcctgtacgtgcccgaggaccagctggagaaccagaagcccctgcagctggacgtgatcatggtgaagccctacaagctgtgcaacaaccaggaggagaacgacgccgtgagcagcgccaagaagcccaagctggccctggaggacagcgagaacaccgccagcaccaactgcgacagcagcagcgagggcctggagaaggacaccgccacccagagaagcgaccagacctgcctggagcccagctgcagctgcagcagcgagaaccaggagtgccagaccgccgccagcaccggcgagatcctggagatcctgaagaagggcaaggccttcgtgctggacatcgacctggacttcttcagcgtgaagaaccccttcaaggagatgttcacccaggaggagtacaagatcctgcaggagctgtaccagttcaagaagcccggcaccaacctgaccgaggaggacctggtggacatcgtggacaccagaatccaccagctggaggacctggaggccaccttcgccgacctgtgcgacggcgacgacgaggagaccgtgcagagatgggccagcaaccccggcatggagagcctggtgcccctggtgcagagcctgaagaagagaatggaggtgcccgactacgagatggtgcaccaggccggcctgacctgcgactacagcgagctgccccaccacatcagcaccgagcaggagatcgagtgcctgatccagagcgtgcactacctgctgaagaacctgcccaaccccaccctggtgaccatcgccagaagcagcctggacgactactgccccagcgaccaggtggacaccatccaggagaaggtgctgaacatgctgagagccctgtacggcaacctggacctgcaggtgtacgccgccgagagcccccccagctag

SEQ ID NO: 19331 - DNA, 492 bp, Artificial Sequence
  Description of Artificial Sequence: Synthetic coding sequence
atggaggtgcccgactacgagatgttccccgccagcagcagcagccccagcgagaccaccagcgcctggatcagcctgagcatgagcctgagcgccttctggagcaagcccttcaacaagagcctgggcagcagcaagctgagcaacatcagcctgcccagcagcgagcccagcaagctgttccagcccctgcccgtgcccaagctgctgccccacttccaggtgcaccaggccggcctgacctgcgactacagcgagctgccccaccacatcagcaccgagcaggagatcgagtgcctgatccagagcgtgcactacctgctgaagaacctgcccaaccccaccctggtgaccatcgccagaagcagcctggacgactactgccccagcgaccaggtggacaccatccaggagaaggtgctgaacatgctgagagccctgtacggcaacctggacctgcaggtgtacgccgccgagagcccccccagctag

SEQ ID NO: 19332 - DNA, 534 bp, Artificial Sequence
  Description of Artificial Sequence: Synthetic coding sequence
ctggtgagccaggaggagtacaagatcctgcaggagctgtaccagttcaagaagcccggcaccaacctgaccgaggaggacctggtggacatcgtggacaccagaatccaccagctggaggacctggaggccaccttcgccgacctgtgcgacggcgacgacgaggagaccgtgcagagatgggccagcaaccccggcatggagagcctggtgcccctggtgcagagcctgaagaagagaatggaggtgcccgactacgagatggtgcaccaggccggcctgacctgcgactacagcgagctgccccaccacatcagcaccgagcaggagatcgagtgcctgatccagagcgtgcactacctgctgaagaacctgcccaaccccaccctggtgaccatcgccagaagcagcctggacgactactgccccagcgaccaggtggacaccatccaggagaaggtgctgaacatgctgagagccctgtacggcaacctggacctgcaggtgtacgccgccgagagcccccccagctag

SEQ ID NO: 19333 - DNA, 567 bp, Artificial Sequence
  Description of Artificial Sequence: Synthetic coding sequence
atgatgcaccccgtggccagcagcaaccccgccttctgcggccccggcaagcccagctgcctgaacgaggacgccatgagagccgccgaccagttcgacatctacagcagccagcagagcaagtacagccacaccgtgaaccacaagcccatggtgtgccagagacaggaccccctgaacgagacccacctgcagaccaccagcggcagaagcatcgagatcaaggacgagctgaagaagaagaagaacctgaacagaagcggcaagagaggcagacccagcggcaccaccaagagcgccggctacagaaccagcaccggcagacccctgggcaccaccaaggccgccggcttcaagaccagccccggcagacccctgggcaccaccaaggccgccggctacaaggtgagccccggcagaccccccggcagcatcaaggccctgagcagactggccgacctgggctacggctgcggcaccgccgccttcccctaccccatgatgcacggcagagccgtgcacggcgtggaggagaccagcagcgaggtgaagccccccaacgagtag

SEQ ID NO: 19334 - DNA, 567 bp, Artificial Sequence; identical to SEQ ID NO: 19333
  Description of Artificial Sequence: Synthetic coding sequence

SEQ ID NO: 19335 - DNA, 567 bp, Artificial Sequence; identical to SEQ ID NO: 19333
  Description of Artificial Sequence: Synthetic coding sequence

SEQ ID NO: 19336 - DNA, 24 bp, Artificial Sequence
  Description of Artificial Sequence: Synthetic coding sequence
atgatgcaccccgtggccagctag

SEQ ID NO: 19337 - DNA, 1002 bp, Artificial Sequence
  Description of Artificial Sequence: Synthetic coding sequence
atgcccagaagcttcgagcaggtgatcatcctgaagaagtggttcctgaagccctacaagggccagaccctgcccggcagagtgctgttcctgagatacgtggtgcagaccctggaggacgacttccagcagaccctgagaagacagagacagcacctgcagcagagcatcgccaacatggtgctgagctgcgacaagcagccccacaacgtgagagacgtgatcaagtggctggtgaaggccgtgaccgaggacggcctgacccagccccccaacggcaaccagaccagcagcggcaccggcatcctgaaggccagcagcagccaccccagcagccagcccaacctgaccaagaacaccaaccagctgatcgtgtgccagctgcagagaatgctgagcatcgccgtggaggtggacagaacccccacctgcagcagcaacaagatcgccgagatgatgttcggcttcgtgctggacatccccgagagaagccagagagagatgttcttcaccaccatggagagccacctgctgagatgcaaggtgctggagatcatcttcctgcacagctgcgagacccccaccagactgcccctgagcctggcccaggccctgtacttcctgaacaacagcaccagcctgctgaagtgccagagcgacaagagccagtggcagacctgggacgagctggtggagcacctgcagttcctgctgagcagctaccagcacgtgctgagagagcacctgagaagcagcgtgatcgacagaaaggacctgatcatcaagagaatcaagcccaagccccagcagggcgacgacatcaccgtggtggacgtggagaagcagatcgaggccttcagaagcagactgatccagatgctgggcgagcccctggtgccccagctgcaggacaaggtgcacctgctgaagctgctgctgttctacgccgccgacctgaaccccgacgccgagcccttccagaagggctggagcggcagctag

SEQ ID NO: 19338 - DNA, 1374 bp, Artificial Sequence
  Description of Artificial Sequence: Synthetic coding sequence
atggaggacttcatcgtgatcagcgacgacagcggcagcgagagcagcggcggcgccagacccggcagaagcagaagacccagaagagccctgagcagaaccagcggcgccctgcccagaagaaccgtgaacaagggccagaagctggagcccatcccccacagaagactgagaatggtgaccaacaccatcgaggagaacttccccctgggcaccgtgcagttcctgatggacttcgtgagcccccagcactacccccccagagagatcgtggcccacatcatccagaagatcctgctgagcggcagcgagaccgtggacgtgctgaaggaggcctacatgctgctgatgaagatccagcagctgcaccccgccaacgccaagaccgtggagtgggactggaagctgctgacctacgtgatggaggaggagggccagaccctgcccggcagagtgctgttcctgagatacgtggtgcagaccctggaggacgacttccagcagaccctgagaagacagagacagcacctgcagcagagcatcgccaacatggtgctgagctgcgacaagcagccccacaacgtgagagacgtgatcaagtggctggtgaaggccgtgaccgaggacggcctgacccagccccccaacggcaaccagaccagcagcggcaccggcatcctgaaggccagcagcagccaccccagcagccagcccaacctgaccaagaacaccaaccagctgatcgtgtgccagctgcagagaatgctgagcatcgccgtggaggtggacagaacccccacctgcagcagcaacaagatcgccgagatgatgttcggcttcgtgctggacatccccgagagaagccagagagagatgttcttcaccaccatggagagccacctgctgagatgcaaggtgctggagatcatcttcctgcacagctgcgagacccccaccagactgcccctgagcctggcccaggccctgtacttcctgaacaacagcaccagcctgctgaagtgccagagcgacaagagccagtggcagacctgggacgagctggtggagcacctgcagttcctgctgagcagctaccagcacgtgctgagagagcacctgagaagcagcgtgatcgacagaaaggacctgatcatcaagagaatcaagcccaagccccagcagggcgacgacatcaccgtggtggacgtggagaagcagatcgaggccttcagaagcagactgatccagatgctgggcgagcccctggtgccccagctgcaggacaaggtgcacctgctgaagctgctgctgttctacgccgccgacctgaaccccgacgccgagcccttccagaagggctggagcggcagctag

SEQ ID NO: 19339 - DNA, 978 bp, Artificial Sequence
  Description of Artificial Sequence: Synthetic coding sequence
atggagggccacgtggacagaagcagccagcccaccgccagaagaatcatcaacagcgaccccgtggacctggacctggtggaggagaacaccttcgtgggccccccccccgccaccagcatcagcggcggcagcgtgtaccccaccgagcccaactgcagcagcgccaccttcaccggcaacctgagcttcctggccagcctgcagctgagcagcgacgtgagcagcctgagccccaccagcaacaacagcagaagcagcagcagcagcagcaaccagaaggcccccctgccctgcccccagcaggacgtgagcagacccccccaggccctgccctgccccctgagacccctgccctgcccccccagagccagcccctgcccccccagagccagcagctgcccccccagagccctgagctgccccagccagaccatgcagtgccagctgcccgccctgacccaccccccccaggaggtgccctgccccagacagaacatccccggccccccccaggacagcctgggcctgccccaggacgtgcccggcctgccccagagcatcctgcacccccaggacgtggcctacctgcaggacatgcccagaagccccggcgacgtgccccagagccccagcgacgtgagccccagccccgacgccccccagagccccggcggcatgccccacctgcccggcgacgtgctgcacagccccggcgacatgccccacagcagcggcgacgtgacccacagccccagagacatcccccacctgcccggcgacagacccgacttcacccagaacgacgtgcagaacagagacatgcccatggacatcagcgccctgagcagccccagctgcagccccacctggggcaccgagcaggacagcgtgaagaagaagaagaagaagaagagaaaggagatcccccccaacttcctgctgttcaacctgtacagaaccagagtgaagaactag

SEQ ID NO: 19340 - DNA, 1836 bp, Artificial Sequence
  Description of Artificial Sequence: Synthetic coding sequence
atggaggacttcatcgtgatcagcgacgacagcggcagcgagagcagcggcggcgccagacccggcagaagcagaagacccagaagagccctgagcagaaccagcggcgccctgcccagaagaaccgtggacttcatcgacctgaccagagagaccagacccagaaccaaggacagaagcggcctgtacgtgatcgacctgaccagagccgagggcgagaacagacccatcgccaccctggacctgaccctggagcccgtgacccccagccagaaggagcccaccagcctgcagacctgcgccagcctgagcggcaaggccgtgatggagggccacgtggacagaagcagccagcccaccgccagaagaatcatcaacagcgaccccgtggacctggacctggtggaggagaacaccttcgtgggccccccccccgccaccagcatcagcggcggcagcgtgtaccccaccgagcccaactgcagcagcgccaccttcaccggcaacctgagcttcctggccagcctgcagctgagcagcgacgtgagcagcctgagccccaccagcaacaacagcagaagcagcagcagcagcagcaaccagaaggcccccctgccctgcccccagcaggacgtgagcagacccccccaggccctgccctgccccctgagacccctgccctgcccccccagagccagcccctgcccccccagagccagcagctgcccccccagagccctgagctgccccagccagaccatgcagtgccagctgcccgccctgacccaccccccccaggaggtgccctgccccagacagaacatccccggccccccccaggacagcctgggcctgccccaggacgtgcccggcctgccccagagcatcctgcacccccaggacgtggcctacctgcaggacatgcccagaagccccggcgacgtgccccagagccccagcgacgtgagccccagccccgacgccccccagagccccggcggcatgccccacctgcccggcgacgtgctgcacagccccggcgacatgccccacagcagcggcgacgtgacccacagccccagagacatcccccacctgcccggcgacagacccgacttcacccagaacgacgtgcagaacagagacatgcccatggacatcagcgccctgagcagccccagctgcagccccagcccccagagcgagacccccctggagaaggtgccctggctgagcgtgatggagacccccgccagaaaggagatcagcctgagcgagcccgccaagcccggcagcgcccacgtgcagagcagaaccccccagggcggcctgtacaacagaccctgcctgcacagactgaagtacttcctgagaccccccgtgcaccacctgttcttccagaccctgatccccgacaaggacaccagagagaacaagggccagaagctggagcccatcccccacagaagactgagaatggtgaccaacaccatcgaggagaacttccccctgggcaccgtgcagttcctgatggacttcgtgagcccccagcactacccccccagagagatcgtggcccacatcatccagaagatcctgctgagcggcagcgagaccgtggacgtgctgaaggaggcctacatgctgctgatgaagatccagcagctgcaccccgccaacgccaagaccgtggagtgggactggaagctgctgacctacgtgatggaggaggagcccgccgagtgcctgagactgcaggccagagccaccacccccgactggttctggtggagaagaggcttcgccgtgctggccggccccgtgagcagcccctag

SEQ ID NO: 19341 - DNA, 1374 bp, Artificial Sequence; identical to SEQ ID NO: 19338
  Description of Artificial Sequence: Synthetic coding sequence

SEQ ID NO: 19342 - DNA, 2619 bp, Artificial Sequence
  Description of Artificial Sequence: Synthetic coding sequence
atggcccccgccagcgccagcggcgaggacctgagaaagctgcccaccatggccgaggtgaacggcgagcaggacttcatcgacctgaccagagagaccagacccagaaccaaggacagaagcggcctgtacgtgatcgacctgaccagagccgagggcgagaacagacccatcgccaccctggacctgaccctggagcccgtgacccccagccagaaggagcccaccagcctgcagacctgcgccagcctgagcggcaaggccgtgatggagggccacgtggacagaagcagccagcccaccgccagaagaatcatcaacagcgaccccgtggacctggacctggtggaggagaacaccttcgtgggccccccccccgccaccagcatcagcggcggcagcgtgtaccccaccgagcccaactgcagcagcgccaccttcaccggcaacctgagcttcctggccagcctgcagctgagcagcgacgtgagcagcctgagccccaccagcaacaacagcagaagcagcagcagcagcagcaaccagaaggcccccctgccctgcccccagcaggacgtgagcagacccccccaggccctgccctgccccctgagacccctgccctgcccccccagagccagcccctgcccccccagagccagcagctgcccccccagagccctgagctgccccagccagaccatgcagtgccagctgcccgccctgacccaccccccccaggaggtgccctgccccagacagaacatccccggccccccccaggacagcctgggcctgccccaggacgtgcccggcctgccccagagcatcctgcacccccaggacgtggcctacctgcaggacatgcccagaagccccggcgacgtgccccagagccccagcgacgtgagccccagccccgacgccccccagagccccggcggcatgccccacctgcccggcgacgtgctgcacagccccggcgacatgccccacagcagcggcgacgtgacccacagccccagagacatcccccacctgcccggcgacagacccgacttcacccagaacgacgtgcagaacagagacatgcccatggacatcagcgccctgagcagccccagctgcagccccagcccccagagcgagacccccctggagaaggtgccctggctgagcgtgatggagacccccgccagaaaggagatcagcctgagcgagcccgccaagcccggcagcgcccacgtgcagagcagaaccccccagggcggcctgtacaacagaccctgcctgcacagactgaagtacttcctgagaccccccgtgcaccacctgttcttccagaccctgatccccgacaaggacaccagagagaacaagggccagaagctggagcccatcccccacagaagactgagaatggtgaccaacaccatcgaggagaacttccccctgggcaccgtgcagttcctgatggacttcgtgagcccccagcactacccccccagagagatcgtggcccacatcatccagaagatcctgctgagcggcagcgagaccgtggacgtgctgaaggaggcctacatgctgctgatgaagatccagcagctgcaccccgccaacgccaagaccgtggagtgggactggaagctgctgacctacgtgatggaggaggagggccagaccctgcccggcagagtgctgttcctgagatacgtggtgcagaccctggaggacgacttccagcagaccctgagaagacagagacagcacctgcagcagagcatcgccaacatggtgctgagctgcgacaagcagccccacaacgtgagagacgtgatcaagtggctggtgaaggccgtgaccgaggacggcctgacccagccccccaacggcaaccagaccagcagcggcaccggcatcctgaaggccagcagcagccaccccagcagccagcccaacctgaccaagaacaccaaccagctgatcgtgtgccagctgcagagaatgctgagcatcgccgtggaggtggacagaacccccacctgcagcagcaacaagatcgccgagatgatgttcggcttcgtgctggacatccccgagagaagccagagagagatgttcttcaccaccatggagagccacctgctgagatgcaaggtgctggagatcatcttcctgcacagctgcgagacccccaccagactgcccctgagcctggcccaggccctgtacttcctgaacaacagcaccagcctgctgaagtgccagagcgacaagagccagtggcagacctgggacgagctggtggagcacctgcagttcctgctgagcagctaccagcacgtgctgagagagcacctgagaagcagcgtgatcgacagaaaggacctgatcatcaagagaatcaagcccaagccccagcagggcgacgacatcaccgtggtggacgtggagaagcagatcgaggccttcagaagcagactgatccagatgctgggcgagcccctggtgccccagctgcaggacaaggtgcacctgctgaagctgctgctgttctacgccgccgacctgaaccccgacgccgagcccttccagaagggctggagcggcagctag

SEQ ID NO: 19343 - DNA, 291 bp, Artificial Sequence
  Description of Artificial Sequence: Synthetic coding sequence
atgaccccctgcctggagagcttctgccagagagccaaggactgcaagcagaacatccccctgcccttcctgatccaggactggcccctgagcgagagcaagccccagggccaggacttctggaccccccagcccctgcaggccgccgcccccagccacgagttccagcaggtggccctgcaccccgccagaaccagactggccagcagaccccagggcggcagactgatgagcagcagagaggtgggcctgagagcccccagatgcagctgcggcaagagaaagagatag

SEQ ID NO: 19344 - DNA, 291 bp, Artificial Sequence; identical to SEQ ID NO: 19343
  Description of Artificial Sequence: Synthetic coding sequence

SEQ ID NO: 19345 - DNA, 621 bp, Artificial Sequence
  Description of Artificial Sequence: Synthetic coding sequence
atggaggtggacatcaacggcgagagcagaagcaccctgaccaccctgcccttccccggcgccgaggccaacagccccggcaaggccgaggccgagaagcccagatgcagcagcaccccctgcagccccatgagaagaaccgtgagcggctaccagatcctgcacatggacagcaactacctggtgggcttcaccaccggcgaggagctgctgaagctggcccagaagtgcaccggcggcgaggagagcaaggccgaggccatgcccagcctgagaagcaagcagctggacgccggcctggccagaagcagcagactgtacaagaccagaagcagatactaccagccctacgagatccccgccgtgaacggcagaagaagaagaagaatgcccagcagcggcgacaagtgcaccaagagcctgccctacgagccctacaaggccctgcacggccccctgcccctgtgcctgctgaagggcaagagagcccacagcaagagcctggactacctgaacctggacaagatgatcaaggagcccgccgacaccgaggtgctgcagtaccagctgcagcacctgaccctgagaggcgacagagtgttcgccagaaacaacacctag

SEQ ID NO: 19346 - DNA, 621 bp, Artificial Sequence; identical to SEQ ID NO: 19345
  Description of Artificial Sequence: Synthetic coding sequence

SEQ ID NO: 19347 - DNA, 621 bp, Artificial Sequence; identical to SEQ ID NO: 19345
  Description of Artificial Sequence: Synthetic coding sequence

SEQ ID NO: 19348 - DNA, 621 bp, Artificial Sequence; identical to SEQ ID NO: 19345
  Description of Artificial Sequence: Synthetic coding sequence

SEQ ID NO: 19349 - DNA, 294 bp, Artificial Sequence
  Description of Artificial Sequence: Synthetic coding sequence
atgaaccaggagaacccccccccctaccccggccccggccccaccgccccctaccccccctaccccccccagcccatgggccccggccccatgggcggcccctacccccccccccagggctacccctaccagggctacccccagtacggctggcagggcggcccccaggagccccccaagaccaccgtgtacgtggtggaggaccagagaagagacgagctgggccccagcacctgcctgaccgcctgctggaccgccctgtgctgctgctgcctgtgggacatgctgacctag

SEQ ID NO: 19350 - DNA, 1917 bp, Artificial Sequence
  Description of Artificial Sequence: Synthetic coding sequence
atggccgccgagctgagaatgatcctgtacgaggacgacagcgtgcaggtgcagtacgtggacggcagcaccctgcagctgagcccctgcggcaccgagttcctgttcgagaagagcccccccgtgagcgcccaccccctggagcagcccgagagaatcagacagagaacccacttcgtgatcagcacctacagagagcagctgcagagagccctggacttcagaaacagcagcgccacctgccccttcctgagcgagaccatcatccccagcgagagaaagaagcacatcttcatcgacatcaccgaggtgagatggcccagcctggacaccgacggcaccatgatctacatggagagcggcatcgtgaagatcaccagcctggacggccacgcctacctgtgcctgcccagaagccagcacgagttcaccgtgcacttcctgtgcaaggtgagccagaagagcgacagcagcgccgtgctgagcgagaccaacaacaaggcccccaaggacaagctggtggagaagaccggcaagatctgcatcagaggcaacctgcccggccagagactgaagaacaaggagaacgagttccactgccagatcatgaagagcaaggagaccctgaagaagatgagctgcgtgaacggcaccgagggcagagaggagctgcccagccccggcaccaagcacacctgcgtgtacacctgggtgaagcagtgctggagcgtggccgcctgccccgaggagtggaagtaccccctgagcctggccctgcacttccacaacaagatcagcaacatgagcaagatcgacgcccacatcacccagagcagattcctgaccagcgacatcagcgaggagagaggcaaggtggtgagcgtgctgcccagagccctgagcctgagctgccccgtgccccacctgcacagatggaacttctgcgacagcctgctgcagagacagagcgacgagtacagctaccccgagctggtgaagatggtgtggtacaagggcgtgacctacagactgacccaccagaacatgaacagcatcgagatctacagcggcgacggcagcgtgttcaagagcgagggcgcctacttcggcaactacttcacctactacagcatccaggagggcagcggcaagagagaggagaagacctacagcgtgaacaacctgccccccgacagacccggcagccccttcaccgtgggcagcctgatcaagcaggccaccagaatcctgcagcactgcgtgaagatgagactgagcctgagccacaactacagaatctgctgctggaagatggtgcccggcatcaacgacagcaacatcctgcccctggtgctgaaggagagcctgatccccagcgtgggcagattcctggcctacagcgacgacaaggtgcacgccatcttcctggacggcatcaccctgaccctgaactggaacttcagcagccccatcgagaagagacaggtgaaccagggcctgaacctgggctggtgcaagctgaccttccccgacggccaggagcagctgatccagatcgagcaccccgagccctacgagagatacgtgaccaccgtgaccagctggtgcagaagactgacccagaccagccccagagagatgcccacccacagcagcagcagcgtgctgcaggagaactggagcgtggccagcgagctggagaagatccagaagttcaacctgctgctggagaacagcggcatcctgaaccagatcagcaacaagaagaacgagcagcagagcttcgaccactacaagcccggcagcagcgagaccctgctgggcgaggtgaacgagaacagagtgagcatcgccctgaagaagaccagcgagatcctgcacgacatcgactgcctgctgagcaacagcaagaagtag

SEQ ID NO: 19351 - DNA, 900 bp, Artificial Sequence
  Description of Artificial Sequence: Synthetic coding sequence
atgcccggcagactgctgagaggcctgtggcagagatggagaagatacaagtacagattcgtgccctggatcgccctgaacctgagccacaaccccagaaccctgagatacgtgcccgaggagagcaaggacaaggtgatcagcgacgaggacgtgctgggcaccctgctgaaggtgttccaggccctgttcctgaacgacttcaacaagcagagcgagatcctgagcatgctgcccgagagcgtgaagagcaagtaccaggacctgctggccgtggagcaccagggcgtgaagctgctggagaacagacaccagcagcagagcaccttcaagcccgaggagatcctgtacaagaccctgggcttcagcgtggcccaggccaccagcagcctgatcagcgccggcaagggcgtgttcgtgaccaagggcctggtgcccaagggcgccgtggtgagcatgtaccccggcaccgtgtaccagaagtacgagcccatcttcttccagagcatcggcaaccccttcatcttcagatgcctggacggcgtgctgatcgacggcaacgacaagggcatcagcaaggtggtgtacagaagctgcaacggcagagacagactgggccccctgaagatgagcgacagcacctggctgaccagcgagatccacaaccccctggccgtgggccagtacgtgaacaactgcagcaacgacagagccgccaacgtgtgctaccaggagttcgacgtgcccgccgtgttccccatcgagctgaagcagtacctgcccaacatcgcctacagctacgacaagcagagccccctgagatgcgtggtgctggtggccctgagagacatcaaccagggcgaggagctgttcagcaactactacaccatcgtgagctag

SEQ ID NO: 19352 - DNA, 816 bp, Artificial Sequence
  Description of Artificial Sequence: Synthetic coding sequence
atgcccggcagactgctgagaggcctgtggcagagatggagaagatacaagtacagattcgtgccctggatcgccctgaacctgagccacaaccccagaaccctgagatacgtgcccgaggagagcaaggacaaggtgatcagcgacgaggacgtgctgggcaccctgctgaaggtgttccaggccctgttcctgaacgacttcaacaagcagagcgagatcctgagcatgctgcccgagagcgtgaagagcaagtaccaggacctgctggccgtggagcaccagggcgtgaagctgctggagaacagacaccagcagcagagcaccttcaagcccgaggagatcctgtacaagaccctgggcttcagcgtggcccaggccaccagcagcctgatcagcgccggcaagggcgtgttcgtgaccaagggcctggtgcccaagggcgccgtggtgagcatgtaccccggcaccgtgtaccagaagtacgagcccatcttcttccagagcatcggcaaccccttcatcttcagatgcctggacggcgtgctgatcgacggcaacgacaagggcatcagcaaggtggtgtacagaagctgcaacggcagagacagactgggccccctgaagatgagcgacagcacctggctgaccagcgagatccacaaccccctggccgtgggccagtacgtgaacaactgcagcaacgacagagccgccaacgtgtgctaccaggagttcgacgtgcccgccgtgttccccatcgagctgaagcagtacctgcccaacatcgcctacagctacgacaagcagagatag

SEQ ID NO: 19353 - DNA, 582 bp, Artificial Sequence
  Description of Artificial Sequence: Synthetic coding sequence
atggagcagcacttcctgggctgcgtgaagagagcctgggacagcgccgaggtggcccccgagccccagcccccccccatcgtgagcagcgaggacagaggcccctggcccctgcccctgtaccccgtgctgggcgagtacagcctggacagctgcgacctgggcctgctgagcagcccctgctggagactgcccggcgtgtactggcagaacggcctgagccccggcgtgcagagcaccctggagcccagcaccgccaagcccaccgagttcagctggcccggcacccagaagcagcaggaggcccccgtggaggaggtgggccaggccgaggagcccgacagactgagactgcagcagctgccctggagcagccccctgcacccctgggacagacagcaggacaccgaggtgtgcgacagcggctgcctgctggagagaagacacccccccgccctgcagccctggagacacctgcccggcttcagcgactgcctggagtggatcctgagagtgggcttcgccgccttcagcgtgctgtgggcctgctgcagcagaatctgcggcgccaagcagccctag

SEQ ID NO: 19354 - DNA, 1920 bp, Artificial Sequence
  Description of Artificial Sequence: Synthetic coding sequence
atgccccagcccagcgtgagcggcatggacccccccttcggcgacgccttcagaagccacaccttcagcgagcagaccctgatgagcaccgacctgctggccaacagcagcgaccccgacttcatgtacgagctggacagagagatgaactaccagcagaaccccagagacaacttcctgagcctggaggactgcaaggacatcgagaacctggagagcttcaccgacgtgctggacaacgagggcgccctgaccagcaactgggagcagtgggacacctactgcgaggacctgaccaagtacaccaagctgaccagctgcgacatctggggcaccaaggaggtggactacctgggcctggacgacttcagcagcccctaccaggacgaggaggtgatcagcaagacccccaccctggcccagctgaacagcgaggacagccagagcgtgagcgacagcctgtactaccccgacagcctgttcagcgtgaagcagaaccccctgcccagcagcttccccggcaagaagatcaccagcagagccgccgcccccgtgtgcagcagcaagaccctgcaggccgaggtgcccctgagcgactgcgtgcagaaggccagcaagcccaccagcagcacccagatcatggtgaagaccaacatgtaccacaacgagaaggtgaacttccacgtggagtgcaaggactacgtgaagaaggccaaggtgaagatcaaccccgtgcagcagagcagacccctgctgagccagatccacaccgacgccgccaaggagaacacctgctactgcggcgccgtggccaagagacaggagaagaagggcatggagcccctgcagggccacgccacccccgccctgcccttcaaggagacccaggagctgctgctgagccccctgccccaggagggccccggcagcctggccgccggcgagagcagcagcctgagcgccagcaccagcgtgagcgacagcagccagaagaaggaggagcacaactacagcctgttcgtgagcgacaacctgggcgagcagcccaccaagtgcagccccgaggaggacgaggaggacgaggaggacgtggacgacgaggaccacgacgagggcttcggcagcgagcacgagctgagcgagaacgaggaggaggaggaggaggaggaggactacgaggacgacaaggacgacgacatcagcgacaccttcagcgagcccggctacgagaacgacagcgtggaggacctgaaggaggtgaccagcatcagcagcagaaagagaggcaagagaagatacttctgggagtacagcgagcagctgacccccagccagcaggagagaatgctgagacccagcgagtggaacagagacaccctgcccagcaacatgtaccagaagaacggcctgcaccacggcaagtacgccgtgaagaagagcagaagaaccgacgtggaggacctgacccccaaccccaagaagctgctgcagatcggcaacgagctgagaaagctgaacaaggtgatcagcgacctgacccccgtgagcgagctgcccctgaccgccagacccagaagcagaaaggagaagaacaagctggccagcagagcctgcagactgaagaagaaggcccagtacgaggccaacaaggtgaagctgtggggcctgaacaccgagtacgacaacctgctgttcgtgatcaacagcatcaagcaggagatcgtgaacagagtgcagaaccccagagacgagagaggccccaacatgggccagaagctggagatcctgatcaaggacaccctgggcctgcccgtggccggccagaccagcgagttcgtgaaccaggtgctggagaagaccgccgagggcaaccccaccggcggcctggtgggcctgagaatccccaccagcaaggtgtag

SEQ ID NO: 19355 - DNA, 1920 bp, Artificial Sequence
  Description of Artificial Sequence: Synthetic coding sequence
atccccaagcccagcgtgagcggcatggacccccccttcggcgacgccttcagaagccacaccttcagcgagcagaccctgatgagcaccgacctgctggccaacagcagcgaccccgacttcatgtacgagctggacagagagatgaactaccagcagaaccccagagacaacttcctgagcctggaggactgcaaggacatcgagaacctggagagcttcaccgacgtgctggacaacgagggcgccctgaccagcaactgggagcagtgggacacctactgcgaggacctgaccaagtacaccaagctgaccagctgcgacatctggggcaccaaggaggtggactacctgggcctggacgacttcagcagcccctaccaggacgaggaggtgatcagcaagacccccaccctggcccagctgaacagcgaggacagccagagcgtgagcgacagcctgtactaccccgacagcctgttcagcgtgaagcagaaccccctgcccagcagcttccccggcaagaagatcaccagcagagccgccgcccccgtgtgcagcagcaagaccctgcaggccgaggtgcccctgagcgactgcgtgcagaaggccagcaagcccaccagcagcacccagatcatggtgaagaccaacatgtaccacaacgagaaggtgaacttccacgtggagtgcaaggactacgtgaagaaggccaaggtgaagatcaaccccgtgcagcagagcagacccctgctgagccagatccacaccgacgccgccaaggagaacacctgctactgcggcgccgtggccaagagacaggagaagaagggcatggagcccctgcagggccacgccacccccgccctgcccttcaaggagacccaggagctgctgctgagccccctgccccaggagggccccggcagcctggccgccggcgagagcagcagcctgagcgccagcaccagcgtgagcgacagcagccagaagaaggaggagcacaactacagcctgttcgtgagcgacaacctgggcgagcagcccaccaagtgcagccccgaggaggacgaggaggacgaggaggacgtggacgacgaggaccacgacgagggcttcggcagcgagcacgagctgagcgagaacgaggaggaggaggaggaggaggaggactacgaggacgacaaggacgacgacatcagcgacaccttcagcgagcccggctacgagaacgacagcgtggaggacctgaaggaggtgaccagcatcagcagcagaaagagaggcaagagaagatacttctgggagtacagcgagcagctgacccccagccagcaggagagaatgctgagacccagcgagtggaacagagacaccctgcccagcaacatgtaccagaagaacggcctgcaccacggcaagtacgccgtgaagaagagcagaagaaccgacgtggaggacctgacccccaaccccaagaagctgctgcagatcggcaacgagctgagaaagctgaacaaggtgatcagcgacctgacccccgtgagcgagctgcccctgaccgccagacccagaagcagaaaggagaagaacaagctggccagcagagcctgcagactgaagaagaaggcccagtacgaggccaacaaggtgaagctgtggggcctgaacaccgagtacgacaacctgctgttcgtgatcaacagcatcaagcaggagatcgtgaacagagtgcagaaccccagagacgagagaggccccaacatgggccagaagctggagatcctgatcaaggacaccctgggcctgcccgtggccggccagaccagcgagttcgtgaaccaggtgctggagaagaccgccgagggcaaccccaccggcggcctggtgggcctgagaatccccaccagcaaggtgtag

SEQ ID NO: 19356 - DNA, 1254 bp, Artificial Sequence
  Description of Artificial Sequence: Synthetic coding sequence
atgccccagcccagcgtgagcggcatggacccccccttcggcgacgccttcagaagccacaccttcagcgagcagaccctgatgagcaccgacctgctggccaacagcagcgaccccgacttcatgtacgagctggacagagagatgaactaccagcagaaccccagagacaacttcctgagcctggaggactgcaaggacatcgagaacctggagagcttcaccgacgtgctggacaacgagggcgccctgaccagcaactgggagcagtgggacacctactgcgaggacctgaccaagtacaccaagctgaccagctgcgacatctggggcaccaaggaggtggactacctgggcctggacgacttcagcagcccctaccaggacgaggaggtgatcagcaagacccccaccctggcccagctgaacagcgaggacagccagagcgtgagcgacagcctgtactaccccgacagcctgttcagcgtgaagcagaaccccctgcccagcagcttccccggcaagaagatcaccagcagagccgccgcccccgtgtgcagcagcaagaccctgcaggccgaggtgcccctgagcgactgcgtgcagaaggccagcaagcccaccagcagcacccagatcatggtgaagaccaacatgtaccacaacgagaaggtgaacttccacgtggagtgcaaggactacgtgaagaaggccaaggtgaagatcaaccccgtgcagcagagcagacccctgctgagccagatccacaccgacgccgccaaggagaacacctgctactgcggcgccgtggccaagagacaggagaagaagggcatggagcccctgcagggccacgccacccccgccctgcccttcaaggagacccaggagctgctgctgagccccctgccccaggagggccccggcagcctggccgccggcgagagcagcagcctgagcgccagcaccagcgtgagcgacagcagccagaagaaggaggagcacaactacagcctgttcgtgagcgacaacctgggcgagcagcccaccaagtgcagccccgaggaggacgaggaggacgaggaggacgtggacgacgaggaccacgacgagggcttcggcagcgagcacgagctgagcgagaacgaggaggaggaggaggaggaggaggactacgaggacgacaaggacgacgacatcagcgacaccttcagcgagcccggcatcatcatgctggccagcctgcccgactag

SEQ ID NO: 19357 - DNA, 1254 bp, Artificial Sequence; identical to SEQ ID NO: 19356
  Description of Artificial Sequence: Synthetic coding sequence

SEQ ID NO: 19358 - DNA, 81 bp, Artificial Sequence
  Description of Artificial Sequence: Synthetic coding sequence
atgccccagcccagcgtgagcggcatggacccccccttcggcgacgccttcagaagccacaccttcagcgagcagacctag

SEQ ID NO: 19359 - DNA, 1962 bp, Artificial Sequence
  Description of Artificial Sequence: Synthetic coding sequence
atgccccagcccagcgtgagcggcatggacccccccttcggcgacgccttcagaagccacaccttcagcgagcagaccctgatgagcaccgacctgctggccaacagcagcgaccccgacttcatgtacgagctggacagagagatgaactaccagcagaaccccagagacaacttcctgagcctggaggactgcaaggacatcgagaacctggagagcttcaccgacgtgctggacaacgagggcgccctgaccagcaactgggagcagtgggacacctactgcgaggacctgaccaagtacaccaagctgaccagctgcgacatctggggcaccaaggaggtggactacctgggcctggacgacttcagcagcccctaccaggacgaggaggtgatcagcaagacccccaccctggcccagctgaacagcgaggacagccagagcgtgagcgacagcctgtactaccccgacagcctgttcagcgtgaagcagaaccccctgcccagcagcttccccggcaagaagatcaccagcagagccgccgcccccgtgtgcagcagcaagaccctgcaggccgaggtgcccctgagcgactgcgtgcagaaggccagcaagcccaccagcagcacccagatcatggtgaagaccaacatgtaccacaacgagaaggtgaacttccacgtggagtgcaaggactacgtgaagaaggccaaggtgaagatcaaccccgtgcagcagagcagacccctgctgagccagatccacaccgacgccgccaaggagaacacctgctactgcggcgccgtggccaagagacaggagaagaagggcatggagcccctgcagggccacgccacccccgccctgcccttcaaggagacccaggagctgctgctgagccccctgccccaggagggccccggcagcctggccgccggcgagagcagcagcctgagcgccagcaccagcgtgagcgacagcagccagaagaaggaggagcacaactacagcctgttcgtgagcgacaacctgggcgagcagcccaccaagtgcagccccgaggaggacgaggaggacgaggaggacgtggacgacgaggaccacgacgagggcttcggcagcgagcacgagctgagcgagaacgaggaggaggaggaggaggaggaggactacgaggacgacaaggacgacgacatcagcgacaccttcagcgagcccggctacgagaacgacagcgtggaggacctgaaggaggtgaccagcatcagcagcagaaagagaggcaagagaagatacttctgggagtacagcgagcagctgacccccagccagcaggagagaatgctgagacccagcgagtggaacagagacaccctgcccagcaacatgtaccagaagaacggcctgcaccacggcaagtacgccgtgaagaagagcagaagaaccgacgtggaggacctgacccccaaccccaagaagctgctgcagatcggcaacgagctgagaaagctgaacaaggtgatcagcgacctgacccccgtgagcgagctgcccctgaccgccagacccagaagcagaaaggagaagaacaagctggccagcagagcctgcagactgaagaagaaggcccagtacgaggccaacaaggtgaagctgtggggcctgaacaccgagtacgacaacctgctgttcgtgatcaacagcatcaagcaggagatcgtgaacagagtgcagaaccccagagacgagagaggccccaacatgggccagaagctggagatcctgatcaaggacaccctgggcctgcccgtggccggccagaccagcgagttcgtgaaccaggtgctggagaagaccgccgagggcaaccccaccggcggcctggtgttctggggcaacagcaagaccggcaacatcctgtacgacgagaaccccaacgagaagaagcaggacatctag

SEQ ID NO: 19360 - DNA, 1926 bp, Artificial Sequence
  Description of Artificial Sequence: Synthetic coding sequence
atgccccagcccagcgtgagcggcatggacccccccttcggcgacgccttcagaagccacaccttcagcgagcagaccctgatgagcaccgacctgctggccaacagcagcgaccccgacttcatgtacgagctggacagagagatgaactaccagcagaaccccagagacaacttcctgagcctggaggactgcaaggacatcgagaacctggagagcttcaccgacgtgctggacaacgagggcgccctgaccagcaactgggagcagtgggacacctactgcgaggacctgaccaagtacaccaagctgaccagctgcgacatctggggcaccaaggaggtggactacctgggcctggacgacttcagcagcccctaccaggacgaggaggtgatcagcaagacccccaccctggcccagctgaacagcgaggacagccagagcgtgagcgacagcctgtactaccccgacagcctgttcagcgtgaagcagaaccccctgcccagcagcttccccggcaagaagatcaccagcagagccgccgcccccgtgtgcagcagcaagaccctgcaggccgaggtgcccctgagcgactgcgtgcagaaggccagcaagcccaccagcagcacccagatcatggtgaagaccaacatgtaccacaacgagaaggtgaacttccacgtggagtgcaaggactacgtgaagaaggccaaggtgaagatcaaccccgtgcagcagagcagacccctgctgagccagatccacaccgacgccgccaaggagaacacctgctactgcggcgccgtggccaagagacaggagaagaagggcatggagcccctgcagggccacgccacccccgccctgcccttcaaggagacccaggagctgctgctgagccccctgccccaggagggccccggcagcctggccgccggcgagagcagcagcctgagcgccagcaccagcgtgagcgacagcagccagaagaaggaggagcacaactacagcctgttcgtgagcgacaacctgggcgagcagcccaccaagtgcagccccgaggaggacgaggaggacgaggaggacgtggacgacgaggaccacgacgagggcttcggcagcgagcacgagctgagcgagaacgaggaggaggaggaggaggaggaggactacgaggacgacaaggacgacgacatcagcgacaccttcagcgagcccggctacgagaacgacagcgtggaggacctgaaggaggtgaccagcatcagcagcagaaagagaggcaagagaagatacttctgggagtacagcgagcagctgacccccagccagcaggagagaatgctgagacccagcgagtggaacagagacaccctgcccagcaacatgtaccagaagaacggcctgcaccacggcagcggcaagtacgccgtgaagaagagcagaagaaccgacgtggaggacctgacccccaaccccaagaagctgctgcagatcggcaacgagctgagaaagctgaacaaggtgatcagcgacctgacccccgtgagcgagctgcccctgaccgccagacccagaagcagaaaggagaagaacaagctggccagcagagcctgcagactgaagaagaaggcccagtacgaggccaacaaggtgaagctgtggggcctgaacaccgagtacgacaacctgctgttcgtgatcaacagcatcaagcaggagatcgtgaacagagtgcagaaccccagagacgagagaggccccaacatgggccagaagctggagatcctgatcaaggacaccctgggcctgcccgtggccggccagaccagcgagttcgtgaaccaggtgctggagaagaccgccgagggcaaccccaccggcggcctggtgggcctgagaatccccaccagcaaggtgtag

SEQ ID NO: 19361 - DNA, 6288 bp, Artificial Sequence
  Description of Artificial Sequence: Synthetic coding sequence
atggccgacgccgacatcctgagcgagaccttccagctgctgatcgacagcgccaaggacttcagcaagagactgtggggcctggtgcccttcggcctgtacctgcccgccccccccctgtactgcccccagcccgccatcctgagcgaggaggacggcgacgacctgctgctgaaggccgagaagaacaacagacagaaggtgagcggcatcctgcagagagtgctgctgctgttcagagccgcccagtgcagcttccccgtggcccagtggtacatcctgcagctgagatgggccagaaaggtgatgcagaagatcagaatgaagggcagcctgcccagcctgagccccttcccccagagcctgctgaactactgcaagggcggcatcgccttcttcagacccggcgccgccggcgaccacaagctggacgaggtgagcatcagagccatcggctgcttcagagagctgtgcgccctgtgctggatgctgcacgtgagagacaagctgagctacagctgcagacagtaccagaaggccagagagaacgtgaagggcgagaaggacctggaggtggagttcgacagctgcatgatcgagcactgcctgagcgccgtggagtgggcctacagaatgctgcccttcagcagattcttcaacatggaggagctgatccaggacatcatcctgagcctgatcggcgagctgccccccatcagaaaggtggccgagatcttcgtgaaggccttcccctaccccgaggacgtgagagtgcccctgagagacaagtaccacagcctgcaccagagactgagacactgcgtggtgaagggcccccagaccgaggagatgatgagcgtggtgatgcacagcatccagaaggtgagagtgaaggccctgaagagagtgcagagaaacatcggcagcttcgaggtgaacatctgggagcccatcgaggaggagaagcccgacgaggcccccggcgtggacagatacagcctgggcaccagcctgagcagaagcaccctgaccgagctgggcgacagcgtggtgcacagcgacgccgacaccttcagcgaggccctgagcgtggaggagaagagcagaatcaacatctaccagagaaacgcccccaaccacatggagctgaccagcatccacaagcccaccgacaagagaaagatgtgcaaccagaaggagaaccccaccaagaaggaggaccacgagaagctgagccagaacaccctgcccgtgatcggcgtgtgggagttcgagagagacgacgacgagtacatcaagttcctggacctgttcctgagctacatcctggagagagacctgccctacagcagagacgccgacatccccttcctgaccagcttcagcggcaagctgagagagcacgagctgaacagcctgctgttcgacgtgcacaccaccctgaagagacaccagagcaagaccaagagccagaacgtgttcagagccggcagctgcttcgtggtggcccccgagagctacgagagcgagaagagcagcagcctgaacgacgagtacggcatgcacctggagaaccagaagctgagcagcagcgtgctggtgaaccagggcatcaagcccttcctgcagtaccccagcaacgaggtgaacaagaacgagggcatgagcggcctgttcggcctgaagcagagaagcatctacaagatccaggacgacaccagagagaagtgcctgatccagagaagcagcaaccacatcttctggacccccaagagcatcaagaccagaagatgcatcttcaaggccatccagtgcaacgacatcaacccccaggaggacctgcccctggccctgaacaccttcggcagcatcggcagactgctggagtggatgatcagatggagcaacagaagactgctgtgcgacagcggcatcaccgagagcagcagcgagtacagccccgtgatcagagtgaagaccagcaccgccgccatcctgaccagcctgtggctgctggagcagccctacttcgccacctacaaggccaagaacgccatcatcaagatggtggagaacagagacaccggctgccagatcggccccaacatcgagagagagagcaagagcgacgccggcggcagcgtggccgtggccacccccggcggcaccgaggagagaaacggccagaacaagagctgccagaacatcctgaagatgcccaccgaggccaagaaccccgacatcaaggagatcaacgacgacatcatcagcatcacccacaacaccaagaaggagttcatcgacatcgacgagaacctgctggaggtggaggccttcaccgaggaggagatggacatgcacatcagcgactacgaggaggacatcgaggagagcgtgggcggcttcagaagccccagcctggccatctgcatgatgaccctgccccagcagctggaggaggagttcaccgaggaggtgcagtgccagagagaggagcccctggagaccatcatggaggagaagagcaccgagcagaagggcatgatcgaggccttcagccaccccggccacaccaccccccagagcatgcaggtggacaccagcagcgagatcagcagcgcccagatcagcacctacaaggagaagagcagcagcgtgcccctgctgatcagcaacggcgtgaacgtggccagccagccccccgcccccaccccccagaagacccagagaaacgagttcaccgcccagctgcccgactgcagcgagagcgtgagacagatgctgcaggacgagatgttcaagctggtgcagctgcagcagatcaacttcatgagcctgatgcagatcgtgggcagcagcttcgccaacctgcccgacacccagcagctggtgcagcagagccagagcgtgcacctgggcgagagccaggagagcaacctgagaggctgcggcgacgtggaggacagcaacaagaacctgaaggagagattcttcatcaagccccagagcatgggcgagaacgccagagagcccagaaagaacagcccccactgccacgagggcaccatccccagcggccagaacagcaccggcaacgtgcagaacgtgccccacggcagcatccccctgtgccagctgaacggccagcccagaaagaagggccccatccccagcagccagaacctgcccagcaccagcttctaccccgcccccgccggcaacacccacctgtacctgctgagcacccccagcgtggtgcagaaggcccccagactgatcccccacgccaagaccttcagccccggcgacggcttccccctgctgcagttcaagagcaagcaggagttccagcccctgttcctgcacaccggcagcatcccccaggtgcccttcagacccctgccccagcccagagaggcctggggcctgagcgacagcttccagcccgccctgccccagagagccgcccagaccacccccgccagccacctgaacgtgagccagtacaacaccgaggccagaaagaaggaggtggagcagaagacctgggccgagaccgtgatcaccgagatccccaaccacgtgaacctggaccagtacgtgggccaggagaacctgaccccccagcaggacagcagcgtgttcatcaagcccgagaagctgttcgacgtgaagcccggcaccctggagatcagcccccaccacagcttcggcctgcccctgctgtacctgcccctgaagccccccaacatgttccccagcaccagcagagccagcatcaccgtgcccagcacccccatccagcccatcgccgaggagagaaagtaccccagactgagcctgctgcacagccacctgagccccgagaacagatgcaagaagacccagctgatccccctggagaacctgatcgccttcaagcagagccagcagaagctgacccacaacctgttcgagcagggcgacgccggccacctgcagctgctgaaggtgaagatcgagccccccgaggtgagacagggcaaggacagcaagaagagacagagaagaagagccgagaaggagctgcaggagaagagatgcgagaagctgagaagaaagcccaacgtgaccttcagacccgagaacagcatcatcaacaacgacgacagcgagatcatcaagaagcccaaggagcagcaggagcactgcggcagccaccccctggacgacttcgacgtgcccttcgagatgctgcaggacgacaacaccagcgccggcctgcacttcatggccagcgtgaagaagaaggccatcggcagccaggacgccagcaccaacaccgaccccgagcacgagcccctgaccgccccccagctgctggtgcccgacgtgtacctgaacctgaagctgagcagcgagatgagcgagaagccctggagccccagcatcccccacaccgtgaccaacctggtgggccacacctacatcaacgtgatcgacatcgaggccaacgacctgctgcaggagctgcccgtgagagaggagcccagcaacgacaacgtgatcaagcagcagagcgaccacctggccgtgcccagcagcgccgagctgcactacatggccgccagcgtgaccaacgccgtgcccccccacaacttcaagagccagggcctgcccaagcccgagttcagattcaagggccagagcaccaagagcgacagcgccgaggactacctgctgtggaagagactgcagggcgtgagcgccgcctgccccgcccccagcagcgccgcccaccagctggagcacctgagcgccaagctgcagaagatcgacgagcagctgctggccatccagaacatcgccgagaacatcgagcaggacttccccaagcccgagatgctggacctgcactgcgacaagatcggccccgtggaccacatcgagttcagcagcggccccgagttcaagaagaccctggccagcaagaccatcagcatcagcgaggaggtgagattcctgacccacatggacgaggaggaccagagcgacaagaaggagaccagcgagcccgagttcagcatcaccgagaactacagcggccagaagacctgcgtgttccccaccgccgacagcgccgtgagcctgagcagcagcagcgaccagaacaccaccagccccggcatgaacagcagcgacgagctgtgcgagagcgtgagcgtgcaccccctgcagatgaccggcctgaccgacatcgccgacatcatcgacgacctgatcatcaaggacggcgtgagcagcgaggagctgggcctgaccgagcaggccatgggcaccagcagaatccagcactacagcggcagacacagccagagaaccgacaaggagagaagagagatccaggcctggatgaagagaaagagaaaggagagaatggccaagtacctgaacgagctggccgagaagagaggccaggagcacgaccccttctgccccagaagcaaccccctgtacatgaccagcagagagatcagactgagacagaagatgaagcacgagaaggacagactgctgctgagcgagcactacagcagaagaatcagccaggcctacggcctgatgaacgagctgctgagcgagagcgtgcagctgcccaccctgccccagaagcccctgcccaacaagcccagccccacccagagcagcagctgccagcactgccccagccccagaggcgagaaccagcacggccacagcttcctgatcaacagacccggcaaggtgaagtacatgagcaagcccagctacatccacaagagaaagagcttcggccagccccagggcagcccctggccccacggcaccgccaccttcaccatccagaagaaggccggcggcgccaaggccgccgtgagaaaggccacccagagccccgtgaccttccagaagggcagcaacgccccctgccacagcctgcagcacaccaagaagcacggcagcgccggcctggccccccagaccaagcaggtgtgcgtggagtacgagagagaggagaccgtggtgagcccctggaccatccccagcgagatccacaagatcctgcacgagagccacaacagcctgctgcaggacctgagccccaccgaggaggaggagcccgagcaccccttcggcgtgggcggcgtggacagcgtgagcgagagcaccggcagcatcctgagcaagctggactggaacgccatcgaggacatggtggccagcgtggaggaccagggcctgagcgtgcactgggccctggacctgtag

SEQ ID NO: 19362 - DNA, 5442 bp, Artificial Sequence
  Description of Artificial Sequence: Synthetic coding sequence
atggccgacgccgacatcctgagcgagaccttccagctgctgatcgacagcgccaaggacttcagcaagagactgtggggcctggtgcccttcggcctgtacctgcccgccccccccctgtactgcccccagcccgccatcctgagcgaggaggacggcgacgacctgctgctgaaggccgagaagaacaacagacagaaggtgagcggcatcctgcagagagtgctgctgctgttcagagccgcccagtgcagcttccccgtggcccagtggtacatcctgcagctgagatgggccagaaaggtgatgcagaagatcagaatgaagggcagcctgcccagcctgagccccttcccccagagcctgctgaactactgcaagggcggcatcgccttcttcagacccggcgccgccggcgaccacaagctggacgaggtgagcatcagagccatcggctgcttcagagagctgtgcgccctgtgctggatgctgcacgtgagagacaagctgagctacagctgcagacagtaccagaaggccagagagaacgtgaagggcgagaaggacctggaggtggagttcgacagctgcatgatcgagcactgcctgagcgccgtggagtgggcctacagaatgctgcccttcagcagattcttcaacatggaggagctgatccaggacatcatcctgagcctgatcggcgagctgccccccatcagaaaggtggccgagatcttcgtgaaggccttcccctaccccgaggacgtgagagtgcccctgagagacaagtaccacagcctgcaccagagactgagacactgcgtggtgaagggcccccagaccgaggagatgatgagcgtggtgatgcacagcatccagaaggtgagagtgaaggccctgaagagagtgcagagaaacatcggcagcttcgaggtgaacatctgggagcccatcgaggaggagaagcccgacgaggcccccggcgtggacagatacagcctgggcaccagcctgagcagaagcaccctgaccgagctgggcgacagcgtggtgcacagcgacgccgacaccttcagcgaggccctgagcgtggaggagaagagcagaatcaacatctaccagagaaacgcccccaaccacatggagctgaccagcatccacaagcccaccgacaagagaaagatgtgcaaccagaaggagaaccccaccaagaaggaggaccacgagaagctgagccagaacaccctgcccgtgatcggcgtgtgggagttcgagagagacgacgacgagtacatcaagttcctggacctgttcctgagctacatcctggagagagacctgccctacagcagagacgccgacatccccttcctgaccagcttcagcggcaagctgagagagcacgagctgaacagcctgctgttcgacgtgcacaccaccctgaagagacaccagagcaagaccaagagccagaacgtgttcagagccggcagctgcttcgtggtggcccccgagagctacgagagcgagaagagcagcagcctgaacgacgagtacggcatgcacctggagaaccagaagctgagcagcagcgtgctggtgaaccagggcatcaagcccttcctgcagtaccccagcaacgaggtgaacaagaacgagggcatgagcggcctgttcggcctgaagcagagaagcatctacaagatccaggacgacaccagagagaagtgcctgatccagagaagcagcaaccacatcttctggacccccaagagcatcaagaccagaagatgcatcttcaaggccatccagtgcaacgacatcaacccccaggaggacctgcccctggccctgaacaccttcggcagcatcggcagactgctggagtggatgatcagatggagcaacagaagactgctgtgcgacagcggcatcaccgagagcagcagcgagtacagccccgtgatcagagtgaagaccagcaccgccgccatcctgaccagcctgtggctgctggagcagccctacttcgccacctacaaggccaagaacgccatcatcaagatggtggagaacagagacaccggctgccagatcggccccaacatcgagagagagagcaagagcgacgccggcggcagcgtggccgtggccacccccggcggcaccgaggagagaaacggccagaacaagagctgccagaacatcctgaagatgcccaccgaggccaagaaccccgacatcaaggagatcaacgacgacatcatcagcatcacccacaacaccaagaaggagttcatcgacatcgacgagaacctgctggaggtggaggccttcaccgaggaggagatggacatgcacatcagcgactacgaggaggacatcgaggagagcgtgggcggcttcagaagccccagcctggccatctgcatgatgaccctgccccagcagctggaggaggagttcaccgaggaggtgcagtgccagagagaggagcccctggagaccatcatggaggagaagagcaccgagcagaagggcatgatcgaggccttcagccaccccggccacaccaccccccagagcatgcaggtggacaccagcagcgagatcagcagcgcccagatcagcacctacaaggagaagagcagcagcgtgcccctgctgatcagcaacggcgtgaacgtggccagccagccccccgcccccaccccccagaagacccagagaaacgagttcaccgcccagctgcccgactgcagcgagagcgtgagacagatgctgcaggacgagatgttcaagctggtgcagctgcagcagatcaacttcatgagcctgatgcagatcgtgggcagcagcttcgccaacctgcccgacacccagcagctggtgcagcagagccagagcgtgcacctgggcgagagccaggagagcaacctgagaggctgcggcgacgtggaggacagcaacaagaacctgaaggagagattcttcatcaagccccagagcatgggcgagaacgccagagagcccagaaagaacagcccccactgccacgagggcaccatccccagcggccagaacagcaccggcaacgtgcagaacgtgccccacggcagcatccccctgtgccagctgaacggccagcccagaaagaagggccccatccccagcagccagaacctgcccagcaccagcttctaccccgcccccgccggcaacacccacctgtacctgctgagcacccccagcgtggtgcagaaggcccccagactgatcccccacgccaagaccttcagccccggcgacggcttccccctgctgcagttcaagagcaagcaggagttccagcccctgttcctgcacaccggcagcatcccccaggtgcccttcagacccctgccccagcccagagaggcctggggcctgagcgacagcttccagcccgccctgccccagagagccgcccagaccacccccgccagccacctgaacgtgagccagtacaacaccgaggccagaaagaaggaggtggagcagaagacctgggccgagaccgtgatcaccgagatccccaaccacgtgaacctggaccagtacgtgggccaggagaacctgaccccccagcaggacagcagcgtgttcatcaagcccgagaagctgttcgacgtgaagcccggcaccctggagatcagcccccaccacagcttcggcctgcccctgctgtacctgcccctgaagccccccaacatgttccccagcaccagcagagccagcatcaccgtgcccagcacccccatccagcccatcgccgaggagagaaagtaccccagactgagcctgctgcacagccacctgagccccgagaacagatgcaagaagacccagctgatccccctggagaacctgatcgccttcaagcagagccagcagaagctgacccacaacctgttcgagcagggcgacgccggccacctgcagctgctgaaggtgaagatcgagccccccgaggtgagacagggcaaggacagcaagaagagacagagaagaagagccgagaaggagctgcaggagaagagatgcgagaagctgagaagaaagcccaacgtgaccttcagacccgagaacagcatcatcaacaacgacgacagcgagatcatcaagaagcccaaggagcagcaggagcactgcggcagccaccccctggacgacttcgacgtgcccttcgagatgctgcaggacgacaacaccagcgccggcctgcacttcatggccagcgtgaagaagaaggccatcggcagccaggacgccagcaccaacaccgaccccgagcacgagcccctgaccgccccccagctgctggtgcccgacgtgtacctgaacctgaagctgagcagcgagatgagcgagaagccctggagccccagcatcccccacaccgtgaccaacctggtgggccacacctacatcaacgtgatcgacatcgaggccaacgacctgctgcaggagctgcccgtgagagaggagcccagcaacgacaacgtgatcaagcagcagagcgaccacctggccgtgcccagcagcgccgagctgcactacatggccgccagcgtgaccaacgccgtgcccccccacaacttcaagagccaggaggtgacccccgcctgcctggacggcaagagcctgagagccggcatcaccgaggtgaaggagcccagcgtgaccagccccacccccagcgacatccagcagaacaagggcctgcccaagcccgagttcagattcaagggccagagcaccaagagcgacagcgccgaggactacctgctgtggaagagactgcagggcgtgagcgccgcctgccccgcccccagcagcgccgcccaccagctggagcacctgagcgccaagctgcagaagatcgacgagcagctgctggccatccagaacatcgccgagaacatcgagcaggacttccccaagcccgagatgctggacctgcactgcgacaagatcggccccgtggaccacatcgagttcagcagcggccccgagttcaagaagaccctggccagcaagaccatcagcatcagcgaggaggtgagattcctgacccacatggacgaggaggaccagagcgacaagaaggagaccagcgagcccgagttcagcatcaccgagaactacagcggccagaagacctgcgtgttccccaccgccgacagcgccgtgagcctgagcagcagcagcgaccagaacaccaccagccccggcatgaacagcagcgacgagctgtgcgagagcgtgagcgtgcaccccctgcagatgaccggcctgaccgacatcgccgacatcatcgacgacctgatcatcaaggacggcgtgagcagcgaggagctgggcctgaccgagcaggccatgggcaccagcagattcagctag

SEQ ID NO: 19363 - DNA, 9594 bp, Artificial Sequence
  Description of Artificial Sequence: Synthetic coding sequence
atggagatcagactggagatcctgaccagcaccggcatcaagcagaagaagccctggcccagagtgagctggctgggcaaggagaaggaggccgtgttcctgctggacgacaagttcatcaacgagatcaacctgctgagcggcaagatcaagaagaagatccccagcctgcagcccttcctgaaggacgtgatcgtgctgaccaccagcagcaacgacgcctggctggccggcgtgctgaccaccggcgagctgttcctgtggaacaaggaccaggactgcctgaagaccatccccatcaccgagaagcccaaggagatgatcaaggccaccgtggccagcagcctgagactgtacctgtacgtgagcggcaacggcaagagaatcgtgctgatcacccccagcggctgcatcttcctgtgggagtacctggagctgaagaacatcctgagcagcaagagcctgagcctggccggcagatggagccaggtgatccccgaggaggccgtgctgctgcccagcaccgaggacaaggaggccgtggtgaacgccgtgttcatcaagaacgagctgttcggcgactgctgcctgtgcagcttcaccttctacagcggcgagtgcctgaagctgaccttcctggccatcagatggcacgagaacgtgttcaccagcgtgagaagcctgccctaccacgtgcactgggcccagcaggactgccacctgtgcagcctgatccccaagtgcgagagcgtgaagagcagaggcgccctgatcagcgccttcagcagagacggcctgaccctggccgtgaccctgaaccagaaggaccccaaggccacccaggtgctgttcatcaacaccctgaacttcgtgaccctgtgcggcagcctgaagggctgcagcaacaagagccccgtggtgcccgccaccctgatcagaagctactgggtgggcgacatcagctggacccacgacagcctgttcctggcctgcatgctgaagagaggcagcctggtgctgctgacctgccagggcgagctgctgaccctgatcaccttcggctgcagcatcgagttcggccccgccgagttcatccccctgcaccccctgatcacctacagaccccagcagttcaccttccaggacagcaacaacagcgtggacagcagcgccagcgacagcgaccccatgagacagagattcagcatcaaggcccacagcagactgccctacctggtgatcagcgacggctacatggtgaccaccctgagattcctggacagcctgagccccagcgtgcacatgagaagcctgctgctggacagcacccagagactggagaagatctaccagagcgtgatcctgagcaagcccaagggcaagggcctgaacctgagaagcctgaacagcctgagaagcagcctgctggagcaccagggcaacgagagcagcgccgacttcaccgtgcccaagttcctgcaggccgaggagaccatcaacgagaacgccgccgacttccaggacttcgaggccgaggagaccaacgagggcagacacttccccgacaacctgtgccccttctggaacaagagagacgacgtgctgtgcagcagcatgaaggagggcagactggagttcgccagcatgttcgacaccatccacgccaaggacgacagcgaggagaccgacagaaccatcaccgagctgcacagcatccagaagagcctgctggccgcctggaccatcggcatcagcaagaccgtgaccgagaagaacctgatgctgaactacatcgtggtgtgcatcacccacttcttctacatcctgcagttcatcaagtgccccttccccaagctggacctggtgctgagcaagagcagcagacacaacgcctggatcctgtgcatcttccagctgttccaccagtgcctgagcatccactactgggacatcagatacaagcaggacgtgggccacctgatcaagctgaccagcaacaccgtgaagctgctgctgacccagcagcagaagggccagctgttcagcgagaagctgctggcctgcttctacctgctgaagatggtggccgacaacctgaacggcgtgtacatcctgcagcccgaggtgatcagcgccagcgccgacggcagcaagatcaccgcccaggacagcctggtggtgcccatcttccagatgttccaggacagcggcttccagaagaactggagctggaacagcttcttcaagatccacccccaggtggtgaaccccgtgcagcagcccggccacagactgctgatcctgtggagaatcctgtacaagaagaccctgtggtaccaggcccagctgaacagaagagtgcccgaggccgacagccagctgaccgagaagatgacccacgaggccagcaccgtgaagagcctgctgtgccacctgcaggccaacctgcagagcaccggcgactgcctgaaccagaccctggagctgaagagcatcaacggcgaggagtgcttcctgctgggcagctacgagaagagcgtgcagctgtggaagaaggccctgcaggagatcgaggagaagggcggcagaagaacctacttcctgcagatcagatactacctgagcctgctgtactgccacctgtacagctacaacctgaacgacgcccagggcctgtgcgaccagctggccagagagatcctgagatggagccagctgcccgtgaaggagaacaaggacttcagcggcgccgccaagagccacttcgagtgcggcatggtgggcggcgtgcaccccgaggccgccgtgagagtggtgcagagcatggccagattcatggccgcctacttcaccaaccagcagctgtgcatcctgcccccccaccacgtgaacgtgctgccccccctgcacatcaagaccgagcagagcttcagactgatccccctgcagcacagcaaggtggccagcgtggtgagagaccagaacctgagcaacgtgtggaccgtggagtacgccctggagctgctgttcatcggcggcctggtgcccgaggccgtgtggctggcctacaagctgggcgactggaagaccagcgtgagcatcggcgtggccttccagctgttctgcaagagagacagcaacttcatgagaagcaagaagaagagcctgaacctgcccctgagaatgacccccgcccagatcttccaggagaagctgcagtgcgtgctgggccagcccgccagcctggaggccaagaacgagatgggcagcaagtacaagcagttcaccgaccccatcgaggaggaggacgccaacctgctgttcggcagcgtgcaggaggtgctgaaggccagcgtgatggccgacgccgacatcctgagcgagaccttccagctgctgatcgacagcgccaaggacttcagcaagagactgtggggcctggtgcccttcggcctgtacctgcccgccccccccctgtactgcccccagcccgccatcctgagcgaggaggacggcgacgacctgctgctgaaggccgagaagaacaacagacagaaggtgagcggcatcctgcagagagtgctgctgctgttcagagccgcccagtgcagcttccccgtggcccagtggtacatcctgcagctgagatgggccagaaaggtgatgcagaagatcagaatgaagggcagcctgcccagcctgagccccttcccccagagcctgctgaactactgcaagggcggcatcgccttcttcagacccggcgccgccggcgaccacaagctggacgaggtgagcatcagagccatcggctgcttcagagagctgtgcgccctgtgctggatgctgcacgtgagagacaagctgagctacagctgcagacagtaccagaaggccagagagaacgtgaagggcgagaaggacctggaggtggagttcgacagctgcatgatcgagcactgcctgagcgccgtggagtgggcctacagaatgctgcccttcagcagattcttcaacatggaggagctgatccaggacatcatcctgagcctgatcggcgagctgccccccatcagaaaggtggccgagatcttcgtgaaggccttcccctaccccgaggacgtgagagtgcccctgagagacaagtaccacagcctgcaccagagactgagacactgcgtggtgaagggcccccagaccgaggagatgatgagcgtggtgatgcacagcatccagaaggtgagagtgaaggccctgaagagagtgcagagaaacatcggcagcttcgaggtgaacatctgggagcccatcgaggaggagaagcccgacgaggcccccggcgtggacagatacagcctgggcaccagcctgagcagaagcaccctgaccgagctgggcgacagcgtggtgcacagcgacgccgacaccttcagcgaggccctgagcgtggaggagaagagcagaatcaacatctaccagagaaacgcccccaaccacatggagctgaccagcatccacaagcccaccgacaagagaaagatgtgcaaccagaaggagaaccccaccaagaaggaggaccacgagaagctgagccagaacaccctgcccgtgatcggcgtgtgggagttcgagagagacgacgacgagtacatcaagttcctggacctgttcctgagctacatcctggagagagacctgccctacagcagagacgccgacatccccttcctgaccagcttcagcggcaagctgagagagcacgagctgaacagcctgctgttcgacgtgcacaccaccctgaagagacaccagagcaagaccaagagccagaacgtgttcagagccggcagctgcttcgtggtggcccccgagagctacgagagcgagaagagcagcagcctgaacgacgagtacggcatgcacctggagaaccagaagctgagcagcagcgtgctggtgaaccagggcatcaagcccttcctgcagtaccccagcaacgaggtgaacaagaacgagggcatgagcggcctgttcggcctgaagcagagaagcatctacaagatccaggacgacaccagagagaagtgcctgatccagagaagcagcaaccacatcttctggacccccaagagcatcaagaccagaagatgcatcttcaaggccatccagtgcaacgacatcaacccccaggaggacctgcccctggccctgaacaccttcggcagcatcggcagactgctggagtggatgatcagatggagcaacagaagactgctgtgcgacagcggcatcaccgagagcagcagcgagtacagccccgtgatcagagtgaagaccagcaccgccgccatcctgaccagcctgtggctgctggagcagccctacttcgccacctacaaggccaagaacgccatcatcaagatggtggagaacagagacaccggctgccagatcggccccaacatcgagagagagagcaagagcgacgccggcggcagcgtggccgtggccacccccggcggcaccgaggagagaaacggccagaacaagagctgccagaacatcctgaacagaatgcccaccgaggccaagaaccccgacatcaaggagatcaacgacgacatcatcagcatcacccacaacaccaagaaggagttcatcgacatcgacgagaacctgctggaggtggaggccttcaccgaggaggagatggacatgcacatcagcgactacgaggaggacatcgaggagagcgtgggcggcttcagaagccccagcctggccatctgcatgatgaccctgccccagcagctggaggaggagttcaccgaggaggtgcagtgccagagagaggagcccctggagaccatcatggaggagaagagcaccgagcagaagggcatgatcgaggccttcagccaccccggccacaccaccccccagagcatgcaggtggacaccagcagcgagatcagcagcgcccagatcagcacctacaaggagaagagcagcagcgtgcccctgctgatcagcaacggcgtgaacgtggccagccagccccccgcccccaccccccagaagacccagagaaacgagttcaccgcccagctgcccgactgcagcgagagcgtgagacagatgctgcaggacgagatgttcaagctggtgcagctgcagcagatcaacttcatgagcctgatgcagatcgtgggcagcagcttcgccaacctgcccgacacccagcagctggtgcagcagagccagagcgtgcacctgggcgagagccaggagagcaacctgagaggctgcggcgacgtggaggacagcaacaagaacctgaaggagagattcttcatcaagccccagagcatgggcgagaacgccagagagcccagaaagaacagcccccactgccacgagggcaccatccccagcggccagaacagcaccggcaacgtgcagaacgtgccccacggcagcatccccctgtgccagctgaacggccagcccagaaagaagggccccatccccagcagccagaacctgcccagcaccagcttctaccccgcccccgccggcaacacccacctgtacctgctgagcacccccagcgtggtgcagaaggcccccagactgatcccccacgccaagaccttcagccccggcgacggcttccccctgctgcagttcaagagcaagcaggagttccagcccctgttcctgcacaccggcagcatcccccaggtgcccttcagacccctgccccagcccagagaggcctggggcctgagcgacagcttccagcccgccctgccccagagagccgcccagaccacccccgccagccacctgaacgtgagccagtacaacaccgaggccagaaagaaggaggtggagcagaagacctgggccgagaccgtgatcaccgagatccccaaccacgtgaacctggaccagtacgtgggccaggagaacctgaccccccagcaggacagcagcgtgttcatcaagcccgagaagctgttcgacgtgaagcccggcaccctggagatcagcccccaccacagcttcggcctgcccctgctgtacctgcccctgaagccccccaacatgttccccagcaccagcagagccagcatcaccgtgcccagcacccccatccagcccatcgccgaggagagaaagtaccccagactgagcctgctgcacagccacctgagccccgagaacagatgcaagaagacccagctgatccccctggagaacctgatcgccttcaagcagagccagcagaagctgacccacaacctgttcgagcagggcgacgccggccacctgcagctgctgaaggtgaagatcgagccccccgaggtgagacagggcaaggacagcaagaagagacagagaagaagagccgagaaggagctgcaggagaagagatgcgagaagctgagaagaaagcccaacgtgaccttcagacccgagaacagcatcatcaacaacgacgacagcgagatcatcaagaagcccaaggagcagcaggagcactgcggcagccaccccctggacgacttcgacgtgcccttcgagatgctgcaggacgacaacaccagcgccggcctgcacttcatggccagcgtgaagaagaaggccatcggcagccaggacgccagcaccaacaccgaccccgagcacgagcccctgaccgccccccagctgctggtgcccgacgtgtacctgaacctgaagctgagcagcgagatgagcgagaagccctggagccccagcatcccccacaccgtgaccaacctggagctgcccgtgagagaggagcccagcaacgacaacgtgatcaagcagcagagcgaccacctggccgtgcccagcagcgccgagctgcactacatggccgccagcgtgaccaacgccgtgcccccccacaacttcaagagccagggcctgcccaagcccgagttcagattcaagggccagagcaccaagagcgacagcgccgaggactacctgctgtggaagagactgcagggcgtgagcgccgcctgccccgcccccagcagcgccgcccaccagctggagcacctgagcgccaagctgcagaagatcgacgagcagctgctggccatccagaacatcgccgagaacatcgagcaggacttccccaagcccgagatgctggacctgcactgcgacaagatcggccccgtggaccacatcgagttcagcagcggccccgagttcaagaagaccctggccagcaagaccatcagcatcagcgaggaggtgagattcctgacccacatggacgaggaggaccagagcgacaagaaggagaccagcgagcccgagttcagcatcaccgagaactacagcggccagaagacctgcgtgttccccaccgccgacagcgccgtgagcctgagcagcagcagcgaccagaacaccaccagccccggcatgaacagcagcgacgagctgtgcgagagcgtgagcgtgcaccccctgcagatgaccggcctgaccgacatcgccgacatcatcgacgacctgatcatcaaggacggcgtgagcagcgaggagctgggcctgaccgagcaggccatgggcaccagcagaatccagcactacagcggcagacacagccagagaaccgacaaggagagaagagagatccaggcctggatgaagagaaagagaaaggagagaatggccaagtacctgaacgagctggccgagaagagaggccaggagcacgaccccttctgccccagaagcaaccccctgtacatgaccagcagagagatcagactgagacagaagatgaagcacgagaaggacagactgctgctgagcgagcactacagcagaagaatcagccaggcctacggcctgatgaacgagctgctgagcgagagcgtgcagctgcccaccctgccccagaagcccctgcccaacaagcccagccccacccagagcagcagctgccagcactgccccagccccagaggcgagaaccagcacggccacagcttcctgatcaacagacccggcaaggtgaagtacatgagcaagcccagctacatccacaagagaaagagcttcggccagccccagggcagcccctggccccacggcaccgccaccttcaccatccagaagaaggccggcggcgccaaggccgccgtgagaaaggccacccagagccccgtgaccttccagaagggcagcaacgccccctgccacagcctgcagcacaccaagaagcacggcagcgccggcctggccccccagaccaagcaggtgtgcgtggagtacgagagagaggagaccgtggtgagcccctggaccatccccagcgagatccacaagatcctgcacgagagccacaacagcctgctgcaggacctgagccccaccgaggaggaggagcccgagcaccccttcggcgtgggcggcgtggacagcgtgagcgagagcaccggcagcatcctgagcaagctggactggaacgccatcgaggacatggtggccagcgtggaggaccagggcctgagcgtgcactgggccctggacctgtag

SEQ ID NO: 19364 - DNA, 9594 bp, Artificial Sequence; identical to SEQ ID NO: 19363
  Description of Artificial Sequence: Synthetic coding sequence

SEQ ID NO: 19365 - DNA, 1725 bp, Artificial Sequence
  Description of Artificial Sequence: Synthetic coding sequence
atggccaccctggtggtgaacaagctgggcgccggcgtggacagcggcagacagggcagcagaggcaccgccgtggtgaaggtgctggagtgcggcgtgtgcgaggacgtgttcagcctgcagggcgacaaggtgcccagactgctgctgtgcggccacaccgtgtgccacgactgcctgaccagactgcccctgcacggcagagccatcagatgccccttcgacagacaggtgaccgacctgggcgacagcggcgtgtggggcctgaagaagaacttcgccctgctggagctgctggagagactgcagaacggccccatcggccagtacggcgccgccgaggagagcatcggcatcagcggcgagagcatcatcagatgcgacgaggacgaggcccacctggccagcgtgtactgcaccgtgtgcgccacccacctgtgcagcgagtgcagccaggtgacccacagcaccaagaccctggccaagcacagaagagtgcccctggccgacaagccccacgagaagaccatgtgcagccagcaccaggtgcacgccatcgagttcgtgtgcctggaggagggctgccagaccagccccctgatgtgctgcgtgtgcaaggagtacggcaagcaccagggccacaagcacagcgtgctggagcccgaggccaaccagatcagagccagcatcctggacatggcccactgcatcagaaccttcaccgaggagatcagcgactacagcagaaagctggtgggcatcgtgcagcacatcgagggcggcgagcagatcgtggaggacggcatcggcatggcccacaccgagcacgtgcccggcaccgccgagaacgccagaagctgcatcagagcctacttctacgacctgcacgagaccctgtgcagacaggaggagatggccctgagcgtggtggacgcccacgtgagagagaagctgatctggctgagacagcagcaggaggacatgaccatcctgctgagcgaggtgagcgccgcctgcctgcactgcgagaagaccctgcagcaggacgactgcagagtggtgctggccaagcaggagatcaccagactgctggagaccctgcagaagcagcagcagcagttcaccgaggtggccgaccacatccagctggacgccagcatccccgtgaccttcaccaaggacaacagagtgcacatcggccccaagatggagatcagagtggtgaccctgggcctggacggcgccggcaagaccaccatcctgttcaagctgaagcaggacgagttcatgcagcccatccccaccatcggcttcaacgtggagaccgtggagtacaagaacctgaagttcaccatctgggacgtgggcggcaagcacaagctgagacccctgtggaagcactactacctgaacacccaggccgtggtgttcgtggtggacagcagccacagagacagaatcagcgaggcccacagcgagctggccaagctgctgaccgagaaggagctgagagacgccctgctgctgatcttcgccaacaagcaggacgtggccggcgccctgagcgtggaggagatcaccgagctgctgagcctgcacaagctgtgctgcggcagaagctggtacatccagggctgcgacgccagaagcggcatgggcctgtacgagggcctggactggctgagcagacagctggtggccgccggcgtgctggacgtggcctag

SEQ ID NO: 19366 - DNA, 1254 bp, Artificial Sequence
  Description of Artificial Sequence: Synthetic coding sequence
atggaggtgaacccccccaagcaggagcacctgctggccctgaaggtgatgagactgaccaagcccaccctgttcaccaacatccccgtgacctgcgaggagaaggacctgcccggcgacctgttcaaccagctgatgagagacgaccccagcaccgtgaacggcgccgaggtgctgatgctgggcgagatgctgaccctgccccagaacttcggcaacatcttcctgggcgagaccttcagcagctacatcagcgtgcacaacgacagcaaccaggtggtgaaggacatcctggtgaaggccgacctgcagaccagcagccagagactgaacctgagcgccagcaacgccgccgtggccgagctgaagcccgactgctgcatcgacgacgtgatccaccacgaggtgaaggagatcggcacccacatcctggtgtgcgccgtgagctacaccacccaggccggcgagaagatgtacttcagaaagttcttcaagttccaggtgctgaagcccctggacgtgaagaccaagttctacaacgccgagagcgacctgagcagcgtgaccgacgaggtgttcctggaggcccagatccagaacatgaccaccagccccatgttcatggagaaggtgagcctggagcccagcatcatgtacaacgtgaccgagctgaacagcgtgagccaggccggcgagtgcgtgagcaccttcggcagcagagcctacctgcagcccatggacaccagacagtacctgtactgcctgaagcccaagaacgagttcgccgagaaggccggcatcatcaagggcgtgaccgtgatcggcaagctggacatcgtgtggaagaccaacctgggcgagagaggcagactgcagaccagccagctgcagagaatggcccccggctacggcgacgtgagactgagcctggaggccatccccgacaccgtgaacctggaggagcccttccacatcacctgcaagatcaccaactgcagcgagagaaccatggacctggtgctggagatgtgcaacaccaacagcatccactggtgcggcatcagcggcagacagctgggcaagctgcaccccagcagcagcctgtgcctggccctgaccctgctgagcagcgtgcagggcctgcagagcatcagcggcctgagactgaccgacaccttcctgaagagaacctacgagtacgacgacatcgcccaggtgtgcgtggtgagcagcgccatcaaggtggagagctag

SEQ ID NO: 19367 - DNA, 1239 bp, Artificial Sequence
  Description of Artificial Sequence: Synthetic coding sequence
atggaggtgaacccccccaagcaggagcacctgctggccctgaaggtgatgagactgaccaagcccaccctgttcaccaacatccccgtgacctgcgaggagaaggacctgcccggcgacctgttcaaccagctgatgagagacgaccccagcaccgtgaacggcgccgaggtgctgatgctgggcgagatgctgaccctgccccagaacttcggcaacatcttcctgggcgagaccttcagcagctacatcagcgtgcacaacgacagcaaccaggtggtgaaggacatcctggtgaaggccgacctgcagaccagcagccagagactgaacctgagcgccagcaacgccgccgtggccgagctgaagcccgactgctgcatcgacgacgtgatccaccacgaggtgaaggagatcggcacccacatcctggtgtgcgccgtgagctacaccacccaggccggcgagaagatgtacttcagaaagttcttcaagttccaggtgctgaagcccctggacgtgaagaccaagttctacaacgccgagaccgacgaggtgttcctggaggcccagatccagaacatgaccaccagccccatgttcatggagaaggtgagcctggagcccagcatcatgtacaacgtgaccgagctgaacagcgtgagccaggccggcgagtgcgtgagcaccttcggcagcagagcctacctgcagcccatggacaccagacagtacctgtactgcctgaagcccaagaacgagttcgccgagaaggccggcatcatcaagggcgtgaccgtgatcggcaagctggacatcgtgtggaagaccaacctgggcgagagaggcagactgcagaccagccagctgcagagaatggcccccggctacggcgacgtgagactgagcctggaggccatccccgacaccgtgaacctggaggagcccttccacatcacctgcaagatcaccaactgcagcagcgagagaaccatggacctggtgctggagatgtgcaacaccaacagcatccactggtgcggcatcagcggcagacagctgggcaagctgcaccccagcagcagcctgtgcctggccctgaccctgctgagcagcgtgcagggcctgcagagcatcagcggcctgagactgaccgacaccttcctgaagagaacctacgagtacgacgacatcgcccaggtgtgcgtggtgagcagcgccatcaaggtggagagctag

SEQ ID NO: 19368 - DNA, 1260 bp, Artificial Sequence
  Description of Artificial Sequence: Synthetic coding sequence
atggaggtgaacccccccaagcaggagcacctgctggccctgaaggtgatgagactgaccaagcccaccctgttcaccaacatccccgtgacctgcgaggagaaggacctgcccggcgacctgttcaaccagctgatgagagacgaccccagcaccgtgaacggcgccgaggtgctgatgctgggcgagatgctgaccctgccccagaacttcggcaacatcttcctgggcgagaccttcagcagctacatcagcgtgcacaacgacagcaaccaggtggtgaaggacatcctggtgaaggccgacctgcagaccagcagccagagactgaacctgagcgccagcaacgccgccgtggccgagctgaagcccgactgctgcatcgacgacgtgatccaccacgaggtgaaggagatcggcacccacatcctggtgtgcgccgtgagctacaccacccaggccggcgagaagatgtacttcagaaagttcttcaagttccaggtgctgaagcccctggacgtgaagaccaagttctacaacgccgagaagcagatcgccaacgtgaccaccgacgaggtgttcctggaggcccagatccagaacatgaccaccagccccatgttcatggagaaggtgagcctggagcccagcatcatgtacaacgtgaccgagctgaacagcgtgagccaggccggcgagtgcgtgagcaccttcggcagcagagcctacctgcagcccatggacaccagacagtacctgtactgcctgaagcccaagaacgagttcgccgagaaggccggcatcatcaagggcgtgaccgtgatcggcaagctggacatcgtgtggaagaccaacctgggcgagagaggcagactgcagaccagccagctgcagagaatggcccccggctacggcgacgtgagactgagcctggaggccatccccgacaccgtgaacctggaggagcccttccacatcacctgcaagatcaccaactgcagcagcgagagaaccatggacctggtgctggagatgtgcaacaccaacagcatccactggtgcggcatcagcggcagacagctgggcaagctgcaccccagcagcagcctgtgcctggccctgaccctgctgagcagcgtgcagggcctgcagagcatcagcggcctgagactgaccgacaccttcctgaagagaacctacgagtacgacgacatcgcccaggtgtgcgtggtgagcagcgccatcaaggtggagagctag

SEQ ID NO: 19369 - DNA, 1257 bp, Artificial Sequence
  Description of Artificial Sequence: Synthetic coding sequence
atggaggtgaacccccccaagcaggagcacctgctggccctgaaggtgatgagactgaccaagcccaccctgttcaccaacatccccgtgacctgcgaggagaaggacctgcccggcgacctgttcaaccagctgatgagagacgaccccagcaccgtgaacggcgccgaggtgctgatgctgggcgagatgctgaccctgccccagaacttcggcaacatcttcctgggcgagaccttcagcagctacatcagcgtgcacaacgacagcaaccaggtggtgaaggacatcctggtgaaggccgacctgcagaccagcagccagagactgaacctgagcgccagcaacgccgccgtggccgagctgaagcccgactgctgcatcgacgacgtgatccaccacgaggtgaaggagatcggcacccacatcctggtgtgcgccgtgagctacaccacccaggccggcgagaagatgtacttcagaaagttcttcaagttccaggtgctgaagcccctggacgtgaagaccaagttctacaacgccgagagcgacctgagcagcgtgaccgacgaggtgttcctggaggcccagatccagaacatgaccaccagccccatgttcatggagaaggtgagcctggagcccagcatcatgtacaacgtgaccgagctgaacagcgtgagccaggccggcgagtgcgtgagcaccttcggcagcagagcctacctgcagcccatggacaccagacagtacctgtactgcctgaagcccaagaacgagttcgccgagaaggccggcatcatcaagggcgtgaccgtgatcggcaagctggacatcgtgtggaagaccaacctgggcgagagaggcagactgcagaccagccagctgcagagaatggcccccggctacggcgacgtgagactgagcctggaggccatccccgacaccgtgaacctggaggagcccttccacatcacctgcaagatcaccaactgcagcagcgagagaaccatggacctggtgctggagatgtgcaacaccaacagcatccactggtgcggcatcagcggcagacagctgggcaagctgcaccccagcagcagcctgtgcctggccctgaccctgctgagcagcgtgcagggcctgcagagcatcagcggcctgagactgaccgacaccttcctgaagagaacctacgagtacgacgacatcgcccaggtgtgcgtggtgagcagcgccatcaaggtggagagctag

SEQ ID NO: 19370 - DNA, 1032 bp, Artificial Sequence
  Description of Artificial Sequence: Synthetic coding sequence
atggccagcctgcagagaagcagagtgctgagatgctgcagctgcagactgttccaggcccaccaggtgaagaagagcgtgaagtggacctgcaaggcctgcggcgagaagcagagcttcctgcaggcctacggcgagggcagcggcgccgactgcagaagacacgtgcagaagctgaacctgctgcagggccaggtgagcgagctgcccctgagaagcctggaggagaccgtgagcgccagcgaggaggagaacgtgggccaccagcaggccggcaacgtgaagcagcaggagaagagccagcccagcgagagcagatggctgaagtacctggagaaggacagccaggagctggagctggagggcaccggcgtgtgcttcagcaagcagcccagcagcaagatggaggagcccggccccagattcagccaggacctgcccagaaagagaaagtggagcagaagcaccgtgcagcccccctgcagcagaggcgtgcaggacagcggcggcagcgaggtggcctggggcccccagaagggccaggccggcctgacctggaaggtgaagcagggcagcagcccctgcctgcaggagaacagcgccgactgcagcgccggcgagctgagaggccccggcaaggagctgtggagccccatccagcaggtgaccgccaccagcagcaagtgggcccagttcgtgctgccccccagaaagagcagccacgtggacagcgagcagcccagaagcctgcagagagaccccagacccgccggccccgcccaggccaagcagggcacccccagagcccaggccagcagagagggcctgagcagacccaccgccgccgtgcagctgcccagagccacccaccccgtgaccagcggcagcgagagaccctgcggcaagaccagctgggacgccagaaccccctgggccgagggcggccccctggtgctggaggcccagaaccccagacccaccagactgtgcgacctgttcatcaccggcgaggacttcgacgacgacgtgtag

SEQ ID NO: 19371 - DNA, 867 bp, Artificial Sequence
  Description of Artificial Sequence: Synthetic coding sequence
atggccagcctgcagagaagcagagtgctgagatgctgcagctgcagactgttccaggcccaccaggtgaagaagagcgtgaagtggacctgcaaggcctgcggcgagaagcagagcttcctgcaggagaagagccagcccagcgagagcagatggctgaagtacctggagaaggacagccaggagctggagctggagggcaccggcgtgtgcttcagcaagcagcccagcagcaagatggaggagcccggccccagattcagccaggacctgcccagaaagagaaagtggagcagaagcaccgtgcagcccccctgcagcagaggcgtgcaggacagcggcggcagcgaggtggcctggggcccccagaagggccaggccggcctgacctggaaggtgaagcagggcagcagcccctgcctgcaggagaacagcgccgactgcagcgccggcgagctgagaggccccggcaaggagctgtggagccccatccagcaggtgaccgccaccagcagcaagtgggcccagttcgtgctgccccccagaaagagcagccacgtggacagcgagcagcccagaagcctgcagagagaccccagacccgccggccccgcccaggccaagcagggcacccccagagcccaggccagcagagagggcctgagcagacccaccgccgccgtgcagctgcccagagccacccaccccgtgaccagcggcagcgagagaccctgcggcaagaccagctgggacgccagaaccccctgggccgagggcggccccctggtgctggaggcccagaaccccagacccaccagactgtgcgacctgttcatcaccggcgaggacttcgacgacgacgtgtag

SEQ ID NO: 19372 - DNA, 816 bp, Artificial Sequence
  Description of Artificial Sequence: Synthetic coding sequence
atgcagagcgccagagcctggctgcccggcgactgcaccagcagagacggcgtggccagcgccttcagcggcgccaccctgctgcagctgccccccctgcccggcgcccccggcaagaaggagtgccaggtggacatgcagagcctgtggagagaggccgtgctgttcgccgagttccccagacacggcgcccccgccagcgagctgcccgtgcccagcggcagcgagatggacggcgccgagagcggcaaggcctacggcgagggcagcggcgccgactgcagaagacacgtgcagaagctgaacctgctgcagggccaggtgagcgagctgcccctgagaagcctggaggagaccgtgagcgccagcgaggaggagaacgtgggccaccagcaggccggcaacgtgaagcagcaggagaagagccagcccagcgagagcagatggctgaagtacctggagaaggacagccaggagctggagctggagggcaccggcgtgtgcttcagcaagcagcccagcagcaagatggaggagcccggccccagattcagccaggacctgcccagaaagagaaagtggagcagaagcaccgtgcagcccccctgcagcagaggcgtgcaggacagcggcggcagcgaggtggcctggggcccccagaagggccaggccggcctgacctggaaggtgaagcagggcagcagcccctgcctgcaggagaacagcgccgactgcagcgccggcgagctgagaggccccggcaaggagctgtggagccccatccagcaggacggctacaaggagatcctgttctag

SEQ ID NO: 19373 - DNA, 531 bp, Artificial Sequence
  Description of Artificial Sequence: Synthetic coding sequence
atggccgccgccggcagaggcagagagcaggacagcgccagattcgtgtacgtgaccagattcggcagccaccagtgcagcggcgtgctgcagctgggcggcagaggcgcccagggcctgtggggccagggccccggcgccggctgcagacaggagaagcccagagaggccatggccgtggccggcgtgcagggcggcagcgagctgcccctgggcagccagctgagagtgcccaccacccccggcgtggaggccgccgccagcgccagcagccagctgagagccagcagagtgcagagcggcaccagacagagcgccagagccggcctgatccagaaggacgccgccaagaagtacgacttccccatccccctgaacgaggccagcaagatcatgaagaagaagaagaaggtgctggtgtggaacagagtgtacaaggtgatcagcagaatgctggaggagaacgagaagtacagacacagactgaagtgccagagactgagcagcgagagcagcaactacaccagatag

SEQ ID NO: 19374 - DNA, 405 bp, Artificial Sequence
  Description of Artificial Sequence: Synthetic coding sequence
atggccagcggcaaggacacctgccccaccctgcccaagctgaccaacaactgcagcgacgagagcctgtacaagagcgccaacaagtacgaggagatccacctgcccagattcagcctgaagcagggcatgatccccagaagatacgtgatgccctggaaggagaacatgatcttcagaaacgtgaacctgaagcaggccgaggtgtgcggcatccacaccggccccctggaggacagcctgttcctgaaccacagcgagagactgtgccacggcgaggacagaaaggtggtgttccagaagggcccccccgagatcaagatcgccgacatgcccctgcacagccccctgagcagataccagagcaccgtgatcagccacggcttcagaagaagactggtgtag

SEQ ID NO: 19375 - DNA, 444 bp, Artificial Sequence
  Description of Artificial Sequence: Synthetic coding sequence
atggaggacgacgaggaggagaccaccgccagcaccctgagaggcaagcccagacccccccccgtgagcgcccagagcgccttcagctacatcccccccagaagactggaccccaaggagcacagctactactacagacccgccagaaccggcatcatcagcctgtacgactgcatcttcaagagaagactggactacgaccagaagctgcacagagacgacagagagcacgccaagagcctgggcctgcacgtgaacgaggaggagcaggagagacccgtgggcgtgctgaccagcagcgtgtacggcaagagaatcaaccagcccatcgagcccctgaacagagacttcggcagagccaaccacgtgcaggccgacttctacagaaagaacgacatccccagcctgaaggagcccggcttcggccacatcgcccccagctag

SEQ ID NO: 19376 - DNA, 471 bp, Artificial Sequence
  Description of Artificial Sequence: Synthetic coding sequence
atggccacccagcaggtggacagcagaagacaggtggccgccgagcaggtggccgcccagctgctggagagaagaagaggcagccactgcgacgacgagaagcagaccctgctggccctgctgatcctggtgctgtacctgagcaccgagatctggggcagcagctgggaggtgagcgagagaatcagagagtgcaactactaccagaacctggccgtgccccagggcctggagtaccagaccaacgagcccagcgaggagcccatcaagaccatcagaaactggctgaaggagaagctgcacgtgttcagcgagaagctggaggaggaggtgcagcagctggagcagctggcctgggacctggagctgtggctggacgccctgctgggcgagccccaccaggaggagcactgcagcacctacaagagccacctgcacctggagcacgaggtgagcatcagagaccactag

SEQ ID NO: 19377 - DNA, 885 bp, Artificial Sequence
  Description of Artificial Sequence: Synthetic coding sequence
atggccgccgccgtgagcagcgtggtgagaagagtggaggagctgggcgacctggcccaggcccacatccagcagctgagcgaggccgccggcgaggacgaccacttcctgatcagagccagcgccgccctggagaagctgaagctgctgtgcggcgaggagaaggagtgcagcaaccccagcaacctgctggagctgtacacccaggccatcctggacatgacctacttcgaggagaacaagctggtggacgaggacttccccgaggacagcagcagccagaaggtgaaggagctgatcagcttcctgagcgagcccgagatcctggtgaaggagaacaacatgcaccccaagcactgcaacctgctgggcgacgagctgctggagtgcctgagctggagaagaggcgccctgctgtacatgtactgccacagcctgaccaagagaagagagtggctgctgagaaagagcagcctgctgaagaagtacctgctggacggcatcagctacctgctgcagatgctgaactacagatgccccatccagctgaacgagggcgtgagcttccaggacctggacaccgccaagctgctgagcgccggcatcttcagcgacatccacctgctggccatgatgtacagcggcgagatgtgctactggggcagcaagtactgcgccgaccagcagcccgagaaccacgaggtggacaccagcgtgagcggcgccggctgcaccacctacaaggagcccctggacttcagagaggtgggcgagaagatcctgaagaagtacgtgagcgtgtgcgagggccccctgaaggagcaggagtggaacaccaccaacgccaagcagatcctgaacttcttccaccacagatgcaactag

SEQ ID NO: 19378 - DNA, 480 bp, Artificial Sequence
  Description of Artificial Sequence: Synthetic coding sequence
atgacccagcccaccagacccagcgtgacctgcgaccagggcagcagcaccatcggcggcaccgccgcccaggccaccaccagcagcagcgccaccagcggcagcaactaccagagagacagactgggcagaagacccgagatcggcgtgggcggccagccccagatctgcttccccagacccagaagcgcccagcagcccgtgctgttcagcctgatgaacagcagcgaggccgccatgaagaagaccctgcccaagagccacctgagcagagtgatcatccacgacaacagaatcacccagagaatctacgagatggaggtgagcgccctggagaagaccaagaagaagatcagccactactacgagcacctgaagaagaagttcatgaccgagcagctgagaaagctgggcagatggagagaggagagcgtgaacagcaacagatacctgaccttcggcatccccccccccgtgtag

SEQ ID NO: 19379 - DNA, 1785 bp, Artificial Sequence
  Description of Artificial Sequence: Synthetic coding sequence
atgagcaagaagagaaagtgggacgacgactacgtgagatactggttcacctgcaccaccgaggtggacggcacccagagaccccagtgcgtgctgtgcaacagcgtgttcagcaacgccgacctgagacccagcaagctgagcgaccacttcaacagacagcacggcggcgtggccggccacgacctgaacagcctgaagcacatgcccgcccccagcgaccagagcgagaccctgaaggccttcggcgtggccagccacgaggacaccctgctgcaggccagctaccagttcgcctacctgtgcgccaaggagaagaacccccacaccgtggccgagaagctggtgaagccctgcgccctggagatcgcccagatcgtgctgggccccgacgcccagaagaagctgcagcaggtgcccctgagcgacgacgtgatccacagcagaatcgacgagatgagccaggacatcctgcagcaggtgctggaggacatcaaggccagccccctgaaggtgggcatccagctggccgagaccaccgacatggacgactgcagccagctgatggccttcgtgagatacatcaaggagagagagatcgtggaggagttcctgttctgcgagcccctgcagctgagcatgaagggcatcgacgtgttcaacctgttcagagacttcttcctgaagcacaagatcgccctggacgtgtgcggcagcgtgtgcaccgacggcgccagcagcatgctgggcgagaacagcgagttcgtggcctacgtgaagaaggagatcccccacatcgtggtgacccactgcctgctgaacccccacgccctggtgatcaagaccctgcccaccaagctgagagacgccctgttcaccgtggtgagagtgatcaacttcatcaagggcagagcccccaaccacagactgttccaggccttcttcgaggagatcggcatcgagtacagcgtgctgctgttccacaccgagatgagatggctgagcagaggccagatcctgacccacatcttcgagatgtacgaggagatcaaccagttcctgcaccacaagagcagcaacctggtggacggcttcgagaacaaggagttcaagatccacctggcctacctggccgacctgttcaagcacctgaacgagctgagcgccagcatgcagagaaccggcatgaacaccgtgagcgccagagagaagctgagcgccttcgtgagaaagttccccttctggcagaagagaatcgagaagagaaacttcaccaacttccccttcctggaggagatcatcgtgagcgacaacgagggcatcttcatcgccgccgagatcaccctgcacctgcagcagctgagcaacttcttccacggctacttcagcatcggcgacctgaacgaggccagcaagtggatcctggaccccttcctgttcaacatcgacttcgtggacgacagctacctgatgaagaacgacctggccgagctgagagccagcggccagatcctgatggagttcgagaccatgaagctggaggacttctggtgcgcccagttcaccgccttccccaacctggccaagaccgccctggagatcctgatgcccttcgccaccacctacctgtgcgagctgggcttcagcagcctgctgcacttcaagaccaagagcagaagctgcttcaacctgagcgacgacatcagagtggccatcagcaagaaggtgcccagattcagcgacatcatcgagcagaagctgcagctgcagcagaagagcctgtag

SEQ ID NO: 19380 - DNA, 1785 bp, Artificial Sequence; identical to SEQ ID NO: 19379
  Description of Artificial Sequence: Synthetic coding sequence

SEQ ID NO: 19381 - DNA, 309 bp, Artificial Sequence
  Description of Artificial Sequence: Synthetic coding sequence
atgagagagatcgccgagatcctgcccgcccaggagaaggtggaggccagaatcgacctgaagatgggcaagaagagagtgaccgaccacaagctgaacgtggacaaggtgatcaagaacatcaacaccatcagcagcgagctgaagaagatcaaggagctgagccagctgctgctgtgcgacctgatcctgcacttcaaccaccccatcaagaccgagaacctggccgaggccgagagaaacaaccccctgttcgaggagagcaagatcagcgacgtgagcctggtgagcaacagcttcagcatctag

SEQ ID NO: 19382 - DNA, 309 bp, Artificial Sequence; identical to SEQ ID NO: 19381
  Description of Artificial Sequence: Synthetic coding sequence

SEQ ID NO: 19383 - DNA, 834 bp, Artificial Sequence
  Description of Artificial Sequence: Synthetic coding sequence
atgcccagagcccagctgcccgaggacagcagcgccgtggacatggacatcctgttccccctggacagcgtgatcggcaccgagctgtgccccagccccatcccccagatcatccacttcgtgctgttcgtggtgttcagcctggtgatcctgatcatcctgagactgtacatccccagagagcccagcagcgtgccccccagagaggaggacagcgagaacgaccaggccgaggtgggcgagtggctgagaatcggcaacaagtacatcaccctgaaggactacagaatcctgctgaaggagctggagaacctggagatctacaccttcctgagcaagaagtgcctgaagaagctgagcagagagggcagcagccaccacctgcccagacaggtgagacccggccccgtgtacaagcccgcccccgccagaaaccacagacccagaggcggcagaggcaaggccagccccaccagcttccacgtgagccccagagcccccctggcccccctggccagcatgcccagcagcgtgcccaagaccagcgtggagagcctgggcagccccagcagcctgagcagcagcaagcccagagagcccctgtgccccctgaagcaccccagccaccagccccccgccagcaccctgagccccaaccccaccagcagcaccgagagcctgggcgagaccccccacgccggcagatggagacagggcagcagattcccccagcccggctgcgccaacgccgccggcagaatcagacaccagaaccccagacacagccacggccacagaatcagcgacatccacgagcagctgggcatcagctag

SEQ ID NO: 19384 - DNA, 348 bp, Artificial Sequence
  Description of Artificial Sequence: Synthetic coding sequence
atgctgtggttccagggcaacagcatgcagctggccagaagcagcttcggcctgttcctgagaaactgcagcgccagcaagaccaccctgcccgtgctgaccctgttcaccaaggacccctgccccctgtgcgacgaggccaaggaggtgctgaagccctacgagaacagattcatcctgcaggaggtgaacatcaccctgcccgagaacagcgtgtggtacgagagatacaagttcgacatccccgtgttccacctgaacggccagttcctgatgatgcacagagtgaacaccagcaagctggagaagcagctgctgaagctggagcagcagagcaccggcggctag

SEQ ID NO: 19385 - DNA, 417 bp, Artificial Sequence
  Description of Artificial Sequence: Synthetic coding sequence
atgctgtggttccagggcaacagcatgcagctggccagaagcagcttcggcctgttcctgagaaactgcagcgccagcaagaccaccctgcccgtgctgaccctgttcaccaaggacccctgccccctgtgcgacgaggccaaggaggtgctgaagccctacgagaacagacagccctacaaggaccagaagctgcccggcaccagaagaagaagaagccccagcagccccagccacccccacatggccagccagagcggcaagagatacaacctgaccctgaaccaggtgctgagcttcgactacgacatgggcctggacgcccccaagaccatcagcagcgactgcggcgccttctactgcctgagaatgttcaagagccccgacatgacctgctgcttctaccccaagcagtag

SEQ ID NO: 19386 - DNA, 3048 bp, Artificial Sequence
  Description of Artificial Sequence: Synthetic coding sequence
atgctgaccgccctggccccccccgccctgcccggcatccccagacagctgcccaccgcccccgccagaagacaggacagcagcggcagcagcggcagctactacaccgcccccggcagccccgagccccccgacgtgggccccgacgccaagggccccgccaactggccctgggtggcccccggcagaggcgccggcgcccagcccagactgagcgtgagcgcccagaacagcagacagagacacggccccggcagcggcttccccagaggccccggcagcggccccagacccccccagccccagctgagaaccctgcccagcggcgagatggaggtgatcttcggcgtgggccccctgttcggctgcagcggcgccgacgacagagaggcccagcagcagttcaccgagcccgccttcatcagccccctgccccccggccccgccagccccgccgccgtgcccagacagagccaggtgcccgacggcggcagcagatgggccacctacctggagctgagacccagaggccccagccccgccgcccccgcccagttcgagtgcgtggaggtggccctggaggagggcgccgcccccgccagacccagaaccgtgcccaagagacagatcgagctgagacccagaccccagagcccccccagagccgccggcgcccccagacccagactgctgctgagaaccggcagcctggacgagagcctgggccccctgcaggccgccgccggcttcgtgcagaccgccctggccagaaagctgagccccgaggcccccgcccccagcagcgccaccttcggcagcaccggcagaagcgagcccgagaccagagagaccgccagaagcacccacgtggtgctggagaaggccaagagcagacccctgagagtgagagacaacagcgcccccgccaaggcccccagaccctggcccagcctgagagagagagccatcagaagagacaagcccgcccccggcaccgagcccctgggccccgtgagcagcagcatcttcctgcagagcgaggagaagatccaggaggccagaaagaccagattccccagagaggcccccgacagaaccgtgcagagagccagaagcccccccttcgagtgcagaatccccagcgaggtgcccagcagagccgtgagacccagaagccccagcccccccagacagacccccaacggcgccgtgagaggccccagatgccccagcccccagaacctgagcccctgggacagaaccaccagaagagtgagcagccccctgttccccgaggccagcagcgagtgggagaaccagaaccccgccgtggaggagaccgtgagcagaagaagccccagcccccccatcctgagccagtggaaccagtgcgtggccggcgagagaagccccagcctggaggcccccagcctgtgggagatcccccacagcgccgtggccgacgccgtggagcccagaagcagccccagcccccccgccttcttcccctgggaggcccccgacagacccatcggcacctggggccccagcccccaggagacctgggaccccatgggccccggcagcagcatcgccttcacccaggaggcccagaacggcctgacccaggaggagctggccccccccacccccagcgcccccggcacccccgagcccaccgagatgcagagccccagcaccagagagatcagcgacctggccttcggcggcagccagcagagccccgaggtggccgcccccgagccccccggcagccaccccgtgggcaccctggacgccgacaagtgccccgaggtgctgggccccggcgaggccgccagcggcagacccagaatggccatccccagacccagagacgtgagaaagctggtgaagaccacctacgcccccggcttccccgccggcgcccagggcagcggcctgcccgccccccccgccgacccctgcggcgaggagggcggcgagagcaagacccaggagccccccgccctgggcccccccgcccccgcccactacaccagcgtgttcatcaaggacttcctgcccgtggtgccccacccctacgagccccccgagcccagcttcgacaccgtggccagagacgccagccagcccaacggcgtgctgagaagaagagccgagaacagcaccgccaagcccttcaagagaaccgagatcagactgcccggcgccctggccctgggcagaagacccgaggtgaccagcagagtgagagccagaggccccggcggcgagaacagagacgtggaggcccagagactggtgcccgacggcgacggcagaaccagccccctgggcggcgccagaagcagcagccagagaagccccgtgggccccgccggcgtgagaagccccagacccggcagcccccagatgcaggccagccccagccccggcatcgcccccaagcccaagaccccccccaccgcccccgagcccgccgccgccgtgcaggcccccctgcccagagagcccctggccctggccggcagaaccgcccccgcccagcccagagccgccagcgccccccccaccgacagaagcccccagagccccagccagggcgccagaagacagcccggcgccgcccccctgggcaaggtgctggtggaccccgagagcggcagatactacttcgtggaggcccccagacagcccagactgagagtgctgttcgaccccgagagcggccagtacgtggaggtgctgctgccccccagcagccccggccccccccacagagtgtacacccccctggccctgggcctgggcctgtacccccccgcctacggccccatccccagcctgagcctgccccccagccccggcccccaggccctgggcagcccccagctgccctgggtgagcgaggccggccccctggacggcacctactacctgcccgtgagcggcacccccaaccccgccccccccctgctgctgtgcgccccccccagcagcagcggccccacccagcccggcaagggcagcctgttccccctgtag

SEQ ID NO: 19387 - DNA, 1689 bp, Artificial Sequence
  Description of Artificial Sequence: Synthetic coding sequence
atgaccgtgctggagatcaccctggccgtgatcctgaccctgctgggcctggccatcctggccatcctgctgaccagatgggccagaagaaagcagagcgagatgtacatcagcagatacagcagcgagcagagcgccagactgctggactacgaggacggcagaggcagcagacacgcctacagcacccagagcgacaccagctacgacaacagagagagaagcaagagagactacacccccagcaccaacagcctggccctgagcagaagcagcatcgccctgccccagggcagcatgagcagcatcaagtgcctgcagaccaccgaggagccccccagcagaaccgccggcgccatgatgcagttcaccgcccccatccccggcgccaccggccccatcaagctgagccagaagaccatcgtgcagaccctgggccccatcgtgcagtaccccggcagcaacgtgagaagccacccccacaccatcaccggcccccccagcgcccccagaggcccccccatggcccccatcatcatcagccagagaaccgccagccagctggccgcccccatcagaatcccccaggtgcacaccatggacagcagcggcaagatcaccctgacccccgtggtgatcctgaccggctacatggacgaggagctggccaagaagagctgcagcaagatccagatcctgaagtgcggcggcaccgccagaagccagaacagcagagaggagaacaaggaggccctgaagaacgacatcatcttcaccaacagcgtggagagcctgaagagcgcccacatcaaggagcccgagagagagggcaagggcaccgacctggagaaggacaagatcggcatggaggtgaaggtggacagcgacgccggcatccccaagagacaggagacccagctgaagatcagcgagatgagcatcccccagggccagggcgcccagatcaagaagagcgtgagcgacgtgcccagaggccaggagagccaggtgaagaagagcgagagcggcgtgcccaagggccaggaggcccaggtgaccaagagcggcctggtggtgctgaagggccaggaggcccaggtggagaagagcgagatgggcgtgcccagaagacaggagagccaggtgaagaagagccagagcggcgtgagcaagggccaggaggcccaggtgaagaagagagagagcgtggtgctgaagggccaggaggcccaggtggagaagagcgagctgaaggtgcccaagggccaggagggccaggtggagaagaccgaggccgacgtgcccaaggagcaggaggtgcaggagaagaagagcgaggccggcgtgctgaagggccccgagagccaggtgaagaacaccgaggtgagcgtgcccgagaccctggagagccaggtgaagaagagcgagagcggcgtgctgaagggccaggaggcccaggagaagaaggagagcttcgaggacaagggcaacaacgacaaggagaaggagagagacgccgagaaggaccccaacaagaaggagaagggcgacaagaacaccaagggcgacaagggcaaggacaaggtgaagggcaagagagagagcgagatcaacggcgagaagagcaagggcagcaagagagccaaggccaacaccggcagaaagtacaacaagaaggtggaggagtag

SEQ ID NO: 19388 - DNA, 1692 bp, Artificial Sequence
  Description of Artificial Sequence: Synthetic coding sequence
atgaccgtgctggagatcaccctggccgtgatcctgaccctgctgggcctggccatcctggccatcctgctgaccagatgggccagaagaaagcagagcgagatgtacatcagcagatacagcagcgagcagagcgccagactgctggactacgaggacggcagaggcagcagacacgcctacagcacccagagcgacaccagctacgacaacagagagagaagcaagagagactacacccccagcaccaacagcctggtgagcatggccagcaagttcagcctgggccagaccgagctgatcctgctgctgatgtgcttcatcctggccctgagcagaagcagcatcggcagcatcaagtgcctgcagaccaccgaggagccccccagcagaaccgccggcgccatgatgcagttcaccgcccccatccccggcgccaccggccccatcaagctgagccagaagaccatcgtgcagaccctgggccccatcgtgcagtaccccggcagcaacgccggcccccccagcgcccccagaggcccccccatggcccccatcatcatcagccagagaaccgccagaatcccccaggtgcacaccatggacagcagcggcaagatcaccctgacccccgtggtgatcctgaccggctacatggacgaggagctggccaagaagagctgcagcaagatccagatcctgaagtgcggcggcaccgccagaagccagaacagcagagaggagaacaaggaggccctgaagaacgacatcatcttcaccaacagcgtggagagcctgaagagcgcccacatcaaggagcccgagagagagggcaagggcaccgacctggagaaggacaagatcggcatggaggtgaaggtggacagcgacgccggcatccccaagagacaggagacccagctgaagatcagcgagatgagcatcccccagggccagggcgcccagatcaagaagagcgtgagcgacgtgcccagaggccaggagagccaggtgaagaagagcgagagcggcgtgcccaagggccaggaggcccaggtgaccaagagcggcctggtggtgctgaagggccaggaggcccaggtggagaagagcgagatgggcgtgcccagaagacaggagagccaggtgaagaagagccagagcggcgtgagcaagggccaggaggcccaggtgaagaagagagagagcgtggtgctgaagggccaggaggcccaggtggagaagagcgagctgaaggtgcccaagggccaggagggccaggtggagaagaccgaggccgacgtgcccaaggagcaggaggtgcaggagaagaagagcgaggccggcgtgctgaagggccccgagagccaggtgaagaacaccgaggtgagcgtgcccgagaccctggagagccaggtgaagaagagcgagagcggcgtgctgaagggccaggaggcccaggagaagaaggagagcttcgaggacaagggcaacaacgacaaggagaaggagagagacgccgagaaggaccccaacaagaaggagaagggcgacaagaacaccaagggcgacaagggcaaggacaaggtgaagggcaagagagagagcgagatcaacggcgagaagagcaagggcagcaagagagccaaggccaacaccggcagaaagtacaacaagaaggtggaggagtag

SEQ ID NO: 19389 - DNA, 582 bp, Artificial Sequence
  Description of Artificial Sequence: Synthetic coding sequence
atgaccgtgctggagatcaccctggccgtgatcctgaccctgctgggcctggccatcctggccatcctgctgaccagatgggccagaagaaagcagagcgagatgcacatcagcagatacagcagcgagcagagcgccagactgctggactacgaggacggcagaggcagcagacacgcctacagcacccagagcgacaccagctgcgacaacagagagagaagcaagagagactacacccccagcaccaacagcctggtgagcatggccagcaagttcagcctgggccagaccgagctgatcctgctgctgatgtgcttcatcctggccctgagcagaagcagcatcggcagcatcaagtgcctgcagaccaccgaggagctgcccagcagaaccgccggcgccatgatgcagttcaccgcccccatccccggcgccaccggccccatcaagctgagccagaagaccatcgtgcagacccccggccccatcgtgcagtaccccggccccaacgccggcccccccagcgcccccagaggcccccccatggcccccatcatcatcagccagagaaccgcctag

SEQ ID NO: 19390 - DNA, 579 bp, Artificial Sequence
  Description of Artificial Sequence: Synthetic coding sequence
atgaccgtgctggagatcaccctggccgtgatcctgaccctgctgggcctggccatcctggccatcctgctgaccagatgggccagaagaaagcagagcgagatgcacatcagcagatacagcagcgagcagagcgccagactgctggactacgaggacggcagaggcagcagacacgcctacagcacccagagcgacaccagctgcgacaacagagagagaagcaagagagactacacccccagcaccaacagcctggccctgagcagaagcagcatcgccctgccccagggcagcatgagcagcatcaagtgcctgcagaccaccgaggagctgcccagcagaaccgccggcgccatgatgcagttcaccgcccccatccccggcgccaccggccccatcaagctgagccagaagaccatcgtgcagacccccggccccatcgtgcagtaccccggccccaacgtgagaagccacccccacaccatcaccggcccccccagcgcccccagaggcccccccatggcccccatcatcatcagccagagaaccgccagccagctggccgcccccatctag

SEQ ID NO: 19391 - DNA, 579 bp, Artificial Sequence; identical to SEQ ID NO: 19390
  Description of Artificial Sequence: Synthetic coding sequence

SEQ ID NO: 19392 - DNA, 1689 bp, Artificial Sequence
  Description of Artificial Sequence: Synthetic coding sequence
atgaccgtgctggagatcaccctggccgtgatcctgaccctgctgggcctggccatcctggccatcctgctgaccagatgggccagaagaaagcagagcgagatgtacatcagcagatacagcagcgagcagagcgccagactgctggactacgaggacggcagaggcagcagacacgcctacagcacccagagcgacaccagctacgacaacagagagagaagcaagagagactacacccccagcaccaacagcctggccctgagcagaagcagcatcgccctgccccagggcagcatgagcagcatcaagtgcctgcagaccaccgaggagccccccagcagaaccgccggcgccatgatgcagttcaccgcccccatccccggcgccaccggccccatcaagctgagccagaagaccatcgtgcagaccctgggccccatcgtgcagtaccccggcagcaacgtgagaagccacccccacaccatcaccggcccccccagcgcccccagaggcccccccatggcccccatcatcatcagccagagaaccgccagccagctggccgcccccatcagaatcccccaggtgcacaccatggacagcagcggcaagatcaccctgacccccgtggtgatcctgaccggctacatggacgaggagctggccaagaagagctgcagcaagatccagatcctgaagtgcggcggcaccgccagaagccagaacagcagagaggagaacaaggaggccctgaagaacgacatcatcttcaccaacagcgtggagagcctgaagagcgcccacatcaaggagcccgagagagagggcaagggcaccgacctggagaaggacaagatcggcatggaggtgaaggtggacagcgacgccggcatccccaagagacaggagacccagctgaagatcagcgagatgagcgtgccccagggccagggcgcccagatcaagaagagcgtgagcgacgtgcccagaggccaggagagccaggtgaagaagagcgagagcggcgtgcccaagggccaggaggcccaggtgaccaagagcggcctggtggtgctgaagggccaggaggcccaggtggagaagagcgagatgggcgtgcccagaagacaggagagccaggtgaagaagagccagagcggcgtgagcaagggccaggaggcccaggtgaagaagagagagagcgtggtgctgaagggccaggaggcccaggtggagaagagcgagctgaaggtgcccaagggccaggagggccaggtggagaagaccgaggccgacgtgcccaaggagcaggaggtgcaggagaagaagagcgaggccggcgtgctgaagggccccgagagccaggtgaagaacaccgaggtgagcgtgcccgagaccctggagagccaggtgaagaagagcgagagcggcgtgctgaagggccaggaggcccaggagaagaaggagagcttcgaggacaagggcaacaacgacaaggagaaggagagagacgccgagaaggaccccaacaagaaggagaagggcgacaagaacaccaagggcgacaagggcaaggacaaggtgaagggcaagagagagagcgagatcaacggcgagaagagcaagggcagcaagagagccaaggccaacaccggcagaaagtacaacaagaaggtggaggagtag

SEQ ID NO: 19393 - DNA, 582 bp, Artificial Sequence; identical to SEQ ID NO: 19389
  Description of Artificial Sequence: Synthetic coding sequence

SEQ ID NO: 19394 - DNA, 1689 bp, Artificial Sequence
  Description of Artificial Sequence: Synthetic coding sequence
atgaccgtgctggagatcaccctggccgtgatcctgaccctgctgggcctggccatcctggccatcctgctgaccagatgggccagaagaaagcagagcgagatgtacatcagcagatacagcagcgagcagagcgccagactgctggactacgaggacggcagaggcagcagacacgcctacagcacccagagcgacaccagctacgacaacagagagagaagcaagagagactacacccccagcaccaacagcctggccctgagcagaagcagcatcgccctgccccagggcagcatgagcagcatcaagtgcctgcagaccaccgaggagccccccagcagaaccgccggcgccatgatgcagttcaccgcccccatccccggcgccaccggccccttcaagctgagccagaagaccatcgtgcagaccctgggccccatcgtgcagtaccccggcagcaacgtgagaagccacccccacaccatcaccggcccccccagcgcccccagaggcccccccatggcccccatcatcatcagccagagaaccgccagccagctggccgcccccatcagaatcccccaggtgcacaccatggacagcagcggcaagatcaccctgacccccgtggtgatcctgaccggctacatggacgaggagctggccaagaagagctgcagcaagatccagatcctgaagtgcggcggcaccgccagaagccagaacagcagagaggagaacaaggaggccctgaagaacgacatcatcttcaccaacagcgtggagagcctgaagagcgcccacatcaaggagcccgagagagagggcaagggcaccgacctggagaaggacaagatcggcatggaggtgaaggtggacagcgacgccggcatccccaagagacaggagacccagctgaagatcagcgagatgagcgtgccccagggccagggcgcccagatcaagaagagcgtgagcgacgtgcccagaggccaggagagccaggtgaagaagagcgagagcggcgtgcccaagggccaggaggcccaggtgaccaagagcggcctggtggtgctgaagggccaggaggcccaggtggagaagagcgagatgggcgtgcccagaagacaggagagccaggtgaagaagagccagagcggcgtgagcaagggccaggaggcccaggtgaagcagagagagagcgtggtgctgaagggccaggaggcccaggtggagaagagcgagctgaaggtgcccaagggccaggagggccaggtggagaagaccgaggccgacgtgcccaaggagcaggaggtgcaggagaagaagagcgaggccggcgtgctgaagggccccgagagccaggtgaagaacaccgaggtgagcgtgcccgagaccctggagagccaggtgaagaagagcgagagcggcgtgctgaagggccaggaggcccaggagaagaaggagagcttcgaggacaagggcaacaacgacaaggagaaggagagagacgccgagaaggaccccaacaagaaggagaagggcgacaagaacaccaagggcgacaagggcaaggacaaggtgaagggcaagagagagagcgagatcaacggcgagaagagcaagggcagcaagagagccaaggccaacaccggcagaaagtacaacaagaaggtggaggagtag

SEQ ID NO: 19395 - DNA, 1692 bp, Artificial Sequence
  Description of Artificial Sequence: Synthetic coding sequence
atgaccgtgctggagatcaccctggccgtgatcctgaccctgctgggcctggccatcctggccatcctgctgaccagatgggccagaagaaagcagagcgagatgtacatcagcagatacagcagcgagcagagcgccagactgctggactacgaggacggcagaggcagcagacacgcctacagcacccagagcgacaccagctacgacaacagagagagaagcaagagagactacacccccagcaccaacagcctggtgagcatggccagcaagttcagcctgggccagaccgagctgatcctgctgctgatgtgcttcatcctggccctgagcagaagcagcatcggcagcatcaagtgcctgcagaccaccgaggagccccccagcagaaccgccggcgccatgatgcagttcaccgcccccatccccggcgccaccggccccatcaagctgagccagaagaccatcgtgcagaccctgggccccatcgtgcagtaccccggcagcaacgccggcccccccagcgcccccagaggcccccccatggcccccatcatcatcagccagagaaccgccagaatcccccaggtgcacaccatggacagcagcggcaagatcaccctgacccccgtggtgatcctgaccggctacatggacgaggagctggccaagaagagctgcagcaagatccagatcctgaagtgcggcggcaccgccagaagccagaacagcagagaggagaacaaggaggccctgaagaacgacatcatcttcaccaacagcgtggagagcctgaagagcgcccacatcaaggagcccgagagagagggcaagggcaccgacctggagaaggacaagatcggcatggaggtgaaggtggacagcgacgccggcatccccaagagacaggagacccagctgaagatcagcgagatgagcgtgccccagggccagggcgcccagatcaagaagagcgtgagcgacgtgcccagaggccaggagagccaggtgaagaagagcgagagcggcgtgcccaagggccaggaggcccaggtgaccaagagcggcctggtggtgctgaagggccaggaggcccaggtggagaagagcgagatgggcgtgcccagaagacaggagagccaggtgaagaagagccagagcggcgtgagcaagggccaggaggcccaggtgaagaagagagagagcgtggtgctgaagggccaggaggcccaggtggagaagagcgagctgaaggtgcccaagggccaggagggccaggtggagaagaccgaggccgacgtgcccaaggagcaggaggtgcaggagaagaagagcgaggccggcgtgctgaagggccccgagagccaggtgaagaacaccgaggtgagcgtgcccgagaccctggagagccaggtgaagaagagcgagagcggcgtgctgaagggccaggaggcccaggagaagaaggagagcttcgaggacaagggcaacaacgacaaggagaaggagagagacgccgagaaggaccccaacaagaaggagaagggcgacaagaacaccaagggcgacaagggcaaggacaaggtgaagggcaagagagagagcgagatcaacggcgagaagagcaagggcagcaagagagccaaggccaacaccggcagaaagtacaacaagaaggtggaggagtag

SEQ ID NO: 19396 - DNA, 1692 bp, Artificial Sequence
  Description of Artificial Sequence: Synthetic coding sequence
atgaccgtgctggagatcaccctggccgtgatcctgaccctgctgggcctggccatcctggccatcctgctgaccagatgggccagaagaaagcagagcgagatgtacatcagcagatacagcagcgagcagagcgccagactgctggactacgaggacggcagaggcagcagacacgcctacagcacccagagcgacaccagctacgacaacagagagagaagcaagagagactacacccccagcaccaacagcctggtgagcatggccagcaagttcagcctgggccagaccgagctgatcctgctgctgatgtgcttcatcctggccctgagcagaagcagcatcggcagcatcaagtgcctgcagaccaccgaggagccccccagcagaaccgccggcgccatgatgcagttcaccgcccccatccccggcgccaccggccccttcaagctgagccagaagaccatcgtgcagaccctgggccccatcgtgcagtaccccggcagcaacgccggcccccccagcgcccccagaggcccccccatggcccccatcatcatcagccagagaaccgccagaatcccccaggtgcacaccatggacagcagcggcaagatcaccctgacccccgtggtgatcctgaccggctacatggacgaggagctggccaagaagagctgcagcaagatccagatcctgaagtgcggcggcaccgccagaagccagaacagcagagaggagaacaaggaggccctgaagaacgacatcatcttcaccaacagcgtggagagcctgaagagcgcccacatcaaggagcccgagagagagggcaagggcaccgacctggagaaggacaagatcggcatggaggtgaaggtggacagcgacgccggcatccccaagagacaggagacccagctgaagatcagcgagatgagcgtgccccagggccagggcgcccagatcaagaagagcgtgagcgacgtgcccagaggccaggagagccaggtgaagaagagcgagagcggcgtgcccaagggccaggaggcccaggtgaccaagagcggcctggtggtgctgaagggccaggaggcccaggtggagaagagcgagatgggcgtgcccagaagacaggagagccaggtgaagaagagccagagcggcgtgagcaagggccaggaggcccaggtgaagcagagagagagcgtggtgctgaagggccaggaggcccaggtggagaagagcgagctgaaggtgcccaagggccaggagggccaggtggagaagaccgaggccgacgtgcccaaggagcaggaggtgcaggagaagaagagcgaggccggcgtgctgaagggccccgagagccaggtgaagaacaccgaggtgagcgtgcccgagaccctggagagccaggtgaagaagagcgagagcggcgtgctgaagggccaggaggcccaggagaagaaggagagcttcgaggacaagggcaacaacgacaaggagaaggagagagacgccgagaaggaccccaacaagaaggagaagggcgacaagaacaccaagggcgacaagggcaaggacaaggtgaagggcaagagagagagcgagatcaacggcgagaagagcaagggcagcaagagagccaaggccaacaccggcagaaagtacaacaagaaggtggaggagtag

SEQ ID NO: 19397 - DNA, 1689 bp, Artificial Sequence
  Description of Artificial Sequence: Synthetic coding sequence
atgaccgtgctggagatcaccctggccgtgatcctgaccctgctgggcctggccatcctggccatcctgctgaccagatgggccagaagaaagcagagcgagatgcacatcagcagatacagcagcgagcagagcgccagactgctggactacgaggacggcagaggcagcagacacgcctacagcacccagagcgacaccagctgcgacaacagagagagaagcaagagagactacacccccagcaccaacagcctggccctgagcagaagcagcatcgccctgccccagggcagcatgagcagcatcaagtgcctgcagaccaccgaggagctgcccagcagaaccgccggcgccatgatgcagttcaccgcccccatccccggcgccaccggccccatcaagctgagccagaagaccatcgtgcagacccccggccccatcgtgcagtaccccggccccaacgtgagaagccacccccacaccatcaccggcccccccagcgcccccagaggcccccccatggcccccatcatcatcagccagagaaccgccagccagctggccgcccccatcagaatcccccaggtgcacaccatggacagcagcggcaagatcaccctgacccccgtggtgatcctgaccggctacatggacgaggagctggccaagaagccctgcagcaagatccagatcctgaagtgcggcggcaccgccagaagccagaacagcagagaggagaacaaggaggccctgaagaacgacatcatcttcaccaacagcgtggagagcctgaagagcgcccacatcaaggagcccgagagagagggcaagggcaccgacctggagaaggacaagatcggcatggaggtgaaggtggacagcgacgccggcatccccaagagacaggagacccagctgaagatcagcgagatgagcatcccccagggccagggcgcccagatcaagaagagcgtgagcgacgtgcccagaggccaggagagccaggtgaagaagagcgagagcggcgtgcccaagggccaggaggcccaggtgaccaagagcggcctggtggtgctgaagggccaggaggcccaggtggagaagagcgagatgggcgtgcccagaagacaggagagccaggtgaagaagagccagagcggcgtgagcaagggccaggaggcccaggtgaagaagagagagagcgtggtgctgaagggccaggaggcccaggtggagaagagcgagctgaaggtgcccaagggccaggagggccaggtggagaagaccgaggccgacgtgcccaaggagcaggaggtgcaggagaagaagagcgaggccggcgtgctgaagggccccgagagccaggtgaagaacaccgaggtgagcgtgcccgagaccctggagagccaggtgaagaagagcgagagcggcgtgctgaagggccaggaggcccaggagaagaaggagagcttcgaggacaagggcaacaacgacaaggagaaggagagagacgccgagaaggaccccaacaagaaggagaagggcgacaagaacaccaagggcgacaagggcaaggacaaggtgaagggcaagagagagagcgagatcaacggcgagaagagcaagggcagcaagagagccaaggccaacaccggcagaaagtacaacaagaaggtggaggagtag

SEQ ID NO: 19398 - DNA, 1692 bp, Artificial Sequence
  Description of Artificial Sequence: Synthetic coding sequence
atgaccgtgctggagatcaccctggccgtgatcctgaccctgctgggcctggccatcctggccatcctgctgaccagatgggccagaagaaagcagagcgagatgcacatcagcagatacagcagcgagcagagcgccagactgctggactacgaggacggcagaggcagcagacacgcctacagcacccagagcgacaccagctgcgacaacagagagagaagcaagagagactacacccccagcaccaacagcctggtgagcatggccagcaagttcagcctgggccagaccgagctgatcctgctgctgatgtgcttcatcctggccctgagcagaagcagcatcggcagcatcaagtgcctgcagaccaccgaggagctgcccagcagaaccgccggcgccatgatgcagttcaccgcccccatccccggcgccaccggccccatcaagctgagccagaagaccatcgtgcagacccccggccccatcgtgcagtaccccggccccaacgccggcccccccagcgcccccagaggcccccccatggcccccatcatcatcagccagagaaccgccagaatcccccaggtgcacaccatggacagcagcggcaagatcaccctgacccccgtggtgatcctgaccggctacatggacgaggagctggccaagaagccctgcagcaagatccagatcctgaagtgcggcggcaccgccagaagccagaacagcagagaggagaacaaggaggccctgaagaacgacatcatcttcaccaacagcgtggagagcctgaagagcgcccacatcaaggagcccgagagagagggcaagggcaccgacctggagaaggacaagatcggcatggaggtgaaggtggacagcgacgccggcatccccaagagacaggagacccagctgaagatcagcgagatgagcatcccccagggccagggcgcccagatcaagaagagcgtgagcgacgtgcccagaggccaggagagccaggtgaagaagagcgagagcggcgtgcccaagggccaggaggcccaggtgaccaagagcggcctggtggtgctgaagggccaggaggcccaggtggagaagagcgagatgggcgtgcccagaagacaggagagccaggtgaagaagagccagagcggcgtgagcaagggccaggaggcccaggtgaagaagagagagagcgtggtgctgaagggccaggaggcccaggtggagaagagcgagctgaaggtgcccaagggccaggagggccaggtggagaagaccgaggccgacgtgcccaaggagcaggaggtgcaggagaagaagagcgaggccggcgtgctgaagggccccgagagccaggtgaagaacaccgaggtgagcgtgcccgagaccctggagagccaggtgaagaagagcgagagcggcgtgctgaagggccaggaggcccaggagaagaaggagagcttcgaggacaagggcaacaacgacaaggagaaggagagagacgccgagaaggaccccaacaagaaggagaagggcgacaagaacaccaagggcgacaagggcaaggacaaggtgaagggcaagagagagagcgagatcaacggcgagaagagcaagggcagcaagagagccaaggccaacaccggcagaaagtacaacaagaaggtggaggagtag

SEQ ID NO: 19399 - DNA, 1644 bp, Artificial Sequence
  Description of Artificial Sequence: Synthetic coding sequence
atgaccgtgctggagatcaccctggccgtgatcctgaccctgctgggcctggccatcctggccatcctgctgaccagatgggccagaagaaagcagagcgagatgcacatcagcagatacagcagcgagcagagcgccagactgctggactacgaggacggcagaggcagcagacacgcctacagcacccagagcgagagaagcaagagagactacacccccagcaccaacagcctggccctgagcagaagcagcatcgccctgccccagggcagcatgagcagcatcaagtgcctgcagaccaccgaggagctgcccagcagaaccgccggcgccatgatgcagttcaccgcccccatccccggcgccaccggccccatcaagctgagccagaagaccatcgtgcagacccccggccccatcgtgcagtaccccggccccaacgccggcccccccagcgcccccagaggcccccccatggcccccatcatcatcagccagagaaccgccagccagctggccgcccccatcagaatcccccaggtgcacaccatggacagcagcggcaagatcaccctgacccccgtggtgatcctgaccggctacatggacgaggagctggccaagaagccctgcagcaagatccagatcctgaagtgcggcggcaccgccagaagccagaacagcagagaggagaacaaggaggccctgaagaacgacatcatcttcaccaacagcgtggagagcctgaagagcgcccacatcaaggagcccgagagagagggcaagggcaccgacctggagaaggacaagatcggcatggaggtgaaggtggacagcgacgccggcatccccaagagacaggagacccagctgaagatcagcgagatgagcatcccccagggccagggcgcccagatcaagaagagcgtgagcgacgtgcccagaggccaggagagccaggtgaagaagagcgagagcggcgtgcccaagggccaggaggcccaggtgaccaagagcggcctggtggtgctgaagggccaggaggcccaggtggagaagagcgagatgggcgtgcccagaagacaggagagccaggtgaagaagagccagagcggcgtgagcaagggccaggaggcccaggtgaagaagagagagagcgtggtgctgaagggccaggaggcccaggtggagaagagcgagctgaaggtgcccaagggccaggagggccaggtggagaagaccgaggccgacgtgcccaaggagcaggaggtgcaggagaagaagagcgaggccggcgtgctgaagggccccgagagccaggtgaagaacaccgaggtgagcgtgcccgagaccctggagagccaggtgaagaagagcgagagcggcgtgctgaagggccaggaggcccaggagaagaaggagagcttcgaggacaagggcaacaacgacaaggagaaggagagagacgccgagaaggaccccaacaagaaggagaagggcgacaagaacaccaagggcgacaagggcaaggacaaggtgaagggcaagagagagagcgagatcaacggcgagaagagcaagggcagcaagagagccaaggccaacaccggcagaaagtacaacaagaaggtggaggagtag

SEQ ID NO: 19400 - DNA, 189 bp, Artificial Sequence
  Description of Artificial Sequence: Synthetic coding sequence
atgctgcaggtggtgcaggagggcaaccccgcccccttcatcatcaacaccgtgaagagaggcagaagagacagagagagacagagaaccccctgggccccccaccccctgggcttccagggcagaagatacatctacgagagccccaaccacagaggcaaggacagcagcttcctggcccagaagtag

SEQ ID NO: 19401 - DNA, 189 bp, Artificial Sequence; identical to SEQ ID NO: 19400
  Description of Artificial Sequence: Synthetic coding sequence

SEQ ID NO: 19402 - DNA, 189 bp, Artificial Sequence; identical to SEQ ID NO: 19400
  Description of Artificial Sequence: Synthetic coding sequence

SEQ ID NO: 19403 - DNA, 189 bp, Artificial Sequence
  Description of Artificial Sequence: Synthetic coding sequence
atgctgcaggtggtgcaggagggcaaccccgcccccttcatcatcaacaccgtgaagagaggcagaagagacagagagagacagagaaccccctgggccccccaccccctgggcttccaggagagaagatacatctacgagagccccaaccacagaggcaaggacagcagcttcctggcccagaagtag

SEQ ID NO: 19404 - DNA, 189 bp, Artificial Sequence; identical to SEQ ID NO: 19403
  Description of Artificial Sequence: Synthetic coding sequence

SEQ ID NO: 19405 - DNA, 189 bp, Artificial Sequence; identical to SEQ ID NO: 19403
  Description of Artificial Sequence: Synthetic coding sequence

SEQ ID NO: 19406 - DNA, 708 bp, Artificial Sequence
  Description of Artificial Sequence: Synthetic coding sequence
atgcacgagcacgccacccccgtgaccagcgcctacggcgagagacacgaggagctgatcaacctgggcagccccgacagccacaccatcagcgagggccagaagagcagcgtgaccagcaagaccaccagaaagggcaaggagaagagcagcgagaaggagaagaccgccaaggagaagcaggcccccagattcgagccccagatcagcaccgtgcacccccagcaggaggaccccaacaagccctactggatcctgagactggtgaccgagcacaacgagagcgagctgttcgaggtgaagaaggacaccgagagagccgacgagatcagagccatgaagcaggcctgggagaccaccgagcccggcagagccatcaaggccagccaggccagactgcactacctgagcggcttcatcaagaagaccagcgacgccgagagcccccccatcagcgagagccagaccaagcccaaggaggaggtggagaccgccgccagaggcgtgaaggagcccaacagcaagaacagcgccggcagcgagagcaaggagatgacccagaccggcagcggcagcgccgtgtggaagaagtggcagctgaccaagggcctgagagacgtggccaagagcaccagcagcgagagcggcggcgtgagcagccccggcaaggaggagagagagcagagcaccagaaaggagaacatctag

SEQ ID NO: 19407 - DNA, 2142 bp, Artificial Sequence
  Description of Artificial Sequence: Synthetic coding sequence
accgacgagcagaccgacttcggcctgggcgacgcccaccagagcgacggcctgaacctggagagagagatcgtgagccagaccaccgccacccaggagaagagccaggaggagctgcccaccaccaacaacagcgtgagcaaggagatctggctggacttcgaggacttctgcgtgtgcttccagaacatctacatcttccacaagcccagcagctactgcctgaacttccagaagagcgagttcaagttcagcgaggagagagtgagctactacctgttcgtggacagcctgaagcccatcgagctgctggtgtgcttcagcgccctggtgagatggggcgagtacggcgccctgaccaaggacagcccccccatcgagcccggcctgctgaccgccgagaccttcagctggaagagcctgaagcccggcagcctggtgctgaagatccacacctacgccaccaaggccaccgtggtgagactgcccgtgggcagacacatgctgctgttcaacgcctacagccccgtgggccacagcatccacatctgcagcatggtgagcttcgtgatcggcgacgagcacgtggtgctgcccaacttcgagcccgagagctgcagattcaccgagcagagcctgctgatcatgaaggccatcggcaacgtgatcgccaacttcaaggacaagggcaagctgagcgccgccctgaaggacctgcagaccgcccactaccccgtgcccttccacgacaaggagctgaccgcccagcacttcagagtgttccacctgagcctgtggagactgatgaagaaggtgcagatcaccaagcccccccccaacttcaagttcgccttcagagccatggtgctggacctggagctgctgaacagcagcctggaggaggtgagcctggtggagtggctggacgtgaagtactgcatgcccaccagcgacaaggagtacagcgccgaggaggtggccgccgccatcaagatccaggccatgtggagaggcacctacgtgagactgctgatgaaggccagaatccccgacaccaaggagaacatcagcgtggccgacaccctgcagaaggtgtgggccgtgctggagatgaacctggagcagtacgccgtgagcctgctgagactgatgttcaagagcaagtgcaagagcctggagagctacccctgctaccaggacgaggagaccaagatcgccttcgccgactacaccgtgacctaccaggagcagccccccaacagctggttcatcgtgttcagagagaccttcctggtgcaccaggacatgatcctggtgcccaaggtgtacaccaccctgcccatctgcatcctgcacatcgtgaacaacgacaccatggagcaggtgcccaaggtgttccagaaggtggtgccctacctgtacaccaagaacaagaagggctacaccttcgtggccgaggccttcaccggcgacacctacgtggccgccagcagatggaagctgagactgatcggcagcagcgcccccctgccctgcctgagcagagacagcccctgcaacagcttcgccatcaaggagatcagagactactacatccccaacgacaagaagatcctgttcagatacagcgtgaaggtgctgaccccccagcccgccaccatccaggtgagaaccagcaagcccgacgccttcatcaagctgcaggtgctggagaacgaggagaccatggtgagcagcaccggcaagggccaggccatcatccccgccttccacttcctgaagagcgagaagggcctgagcagccagagctacggcgagagacacgaggagctgatcaacctgggcagccccgacagccacaccatcagcgagggccagaagagcagcgtgaccagcaagaccaccagaaagggcaaggagaagagcagcgagaaggagaagaccgccaaggagaagcaggcccccagattcgagccccagatcagcaccgtgcacccccagcaggaggaccccaacaagccctactggatcctgagactgctgagactggtgtgcatcaccctggccggcagcctgagaaagcacctgatgctgagagtgagactgtacctgaaggccaagctgaaccagaagaagaagtag

SEQ ID NO: 19408 - DNA, 5004 bp, Artificial Sequence
  Description of Artificial Sequence: Synthetic coding sequence
atggccagcaagcagaccaagaagaaggaggtgcacagaatcaacagcgcccacggcagcgacaagagcaaggacttctaccccttcggcagcaacgtgcagagcggcagcaccgagcagaagaagggcaagttccccctgtggcccgagtggagcgaggccgacatcaacagcgagaagtgggacgccggcaagggcgccaaggagaaggacaagaccggcaagagccccgtgttccacttcttcgaggaccccgagggcaagatcgagctgccccccagcctgaagatctacagctggaagagaccccaggacatcctgttcagccagacccccgtggtggtgaagaacgagatcaccttcgacctgttcagcgccaacgagcacctgctgtgcagcgagctgatgagatggatcatcagcgagatctacgccgtgtggaagatcttcaacggcggcatcctgagcaactacttcaagggcaccagcggcgagccccccctgctgccctggaagccctgggagcacatctacagcctgtgcaaggccgtgaagggccacatgcccctgttcaacagctacggcaagtacgtggtgaagctgtactggatgggctgctggagaaagatcaccatcgacgacttcctgcccttcgacgaggacaacaacctgctgctgcccgccaccacctacgagttcgagctgtggcccatgctgctgagcaaggccatcatcaagctggccaacatcgacatccacgtggccgacagaagagagctgggcgagttcaccgtgatccacgccctgaccggctggctgcccgaggtgatcagcctgcaccccggctacatggacaaggtgtgggagctgctgaaggagatcctgcccgagttcaagctgagcgacgaggccagcagcgagagcaagatcgccgtgctggacagcaagctgaaggagcccggcaaggagggcaaggagggcaaggagatcaaggacggcaaggaggtgaaggacgtgaaggagttcaagcccgagagcagcctgaccaccctgaaggcccccgagaagagcgacaaggtgcccaaggagaaggccgacgccagagacatcggcaagaagagaagcaaggacggcgagaaggagaagttcaagttcagcctgcacggcagcagacccagcagcgaggtgcagtacagcgtgcagagcctgagcgactgcagcagcgccatccagaccagccacatggtggtgtacgccaccttcacccccctgtacctgttcgagaacaagatcttcagcctggagaagatggccgacagcgccgagaagctgagagagtacggcctgagccacatctgcagccaccccgtgctggtgaccagaagcagaagctgccccctggtggccccccccaagcccccccccctgcccccctggaagctgatcagacagaagaaggagaccgtgatcaccgacgaggcccaggagctgatcgtgaagaagcccgagagattcctggagatcagcagccccttcctgaactacagaatgacccccttcaccatccccaccgagatgcacttcgtgagaagcctgatcaagaagggcatcccccccggcagcgacctgcccagcgtgagcgagaccgacgagaccgccacccacagccagaccgacctgagccagatcaccaaggccaccagccagggcaacaccgccagccaggtgatcctgggcaagggcaccgacgagcagaccgacttcggcctgggcgacgcccaccagagcgacggcctgaacctggagagagagatcgtgagccagaccaccgccacccaggagaagagccaggaggagctgcccaccaccaacaacagcgtgagcaaggagatctggctggacttcgaggacttctgcgtgtgcttccagaacatctacatcttccacaagcccagcagctactgcctgaacttccagaagagcgagttcaagttcagcgaggagagagtgagctactacctgttcgtggacagcctgaagcccatcgagctgctggtgtgcttcagcgccctggtgagatggggcgagtacggcgccctgaccaaggacagcccccccatcgagcccggcctgctgaccgccgagaccttcagctggaagagcctgaagcccggcagcctggtgctgaagatccacacctacgccaccaaggccaccgtggtgagactgcccgtgggcagacacatgctgctgttcaacgcctacagccccgtgggccacagcatccacatctgcagcatggtgagcttcgtgatcggcgacgagcacgtggtgctgcccaacttcgagcccgagagctgcagattcaccgagcagagcctgctgatcatgaaggccatcggcaacgtgatcgccaacttcaaggacaagggcaagctgagcgccgccctgaaggacctgcagaccgcccactaccccgtgcccttccacgacaaggagctgaccgcccagcacttcagagtgttccacctgagcctgtggagactgatgaagaaggtgcagatcaccaagcccccccccaacttcaagttcgccttcagagccatggtgctggacctggagctgctgaacagcagcctggaggaggtgagcctggtggagtggctggacgtgaagtactgcatgcccaccagcgacaaggagtacagcgccgaggaggtggccgccgccatcaagatccaggccatgtggagaggcacctacgtgagactgctgatgaaggccagaatccccgacaccaaggagaacatcagcgtggccgacaccctgcagaaggtgtgggccgtgctggagatgaacctggagcagtacgccgtgagcctgctgagactgatgttcaagagcaagtgcaagagcctggagagctacccctgctaccaggacgaggagaccaagatcgccttcgccgactacaccgtgacctaccaggagcagccccccaacagctggttcatcgtgttcagagagaccttcctggtgcaccaggacatgatcctggtgcccaaggtgtacaccaccctgcccatctgcatcctgcacatcgtgaacaacgacaccatggagcaggtgcccaaggtgttccagaaggtggtgccctacctgtacaccaagaacaagaagggctacaccttcgtggccgaggccttcaccggcgacacctacgtggccgccagcagatggaagctgagactgatcggcagcagcgcccccctgccctgcctgagcagagacagcccctgcaacagcttcgccatcaaggagatcagagactactacatccccaacgacaagaagatcctgttcagatacagcgtgaaggtgctgaccccccagcccgccaccatccaggtgagaaccagcaagcccgacgccttcatcaagctgcaggtgctggagaacgaggagaccatggtgagcagcaccggcaagggccaggccatcatccccgccttccacttcctgaagagcgagaagggcctgagcagccagagcagcaagcacatcctgagcttccacagcgccagcaagaaggagcaggaggtgtacgtgaagaagaaggccgcccagggcatccagaagagccccaagggcagagccgtgagcgccatccaggacatcggcctgcccctggtggaggaggagaccaccagcacccccaccagagaggacagcagcagcacccccctgcagaactacaagtacatcatccagtgcagcgtgctgtacaacagctggcccctgaccgagagccagctgaccttcgtgcaggccctgaaggacctgaagaagagcaacaccaaggcctacggcgagagacacgaggagctgatcaacctgggcagccccgacagccacaccatcagcgagggccagaagagcagcgtgaccagcaagaccaccagaaagggcaaggagaagagcagcgagaaggagaagaccgccaaggagaagcaggcccccagattcgagccccagatcagcaccgtgcacccccagcaggaggaccccaacaagccctactggatcctgagactggtgaccgagcacaacgagagcgagctgttcgaggtgaagaaggacaccgagagagccgacgagatcagagccatgaagcaggcctgggagaccaccgagcccggcagagccatcaaggccagccaggccagactgcactacctgagcggcttcatcaagaagaccagcgacgccgagagcccccccatcagcgagagccagaccaagcccaaggaggaggtggagaccgccgccagaggcgtgaaggagcccaacagcaagaacagcgccggcagcgagagcaaggagatgacccagaccggcagcggcagcgccgtgtggaagaagtggcagctgaccaagggcctgagagacgtggccaagagcaccagcagcgagagcggcggcgtgagcagccccggcaaggaggagagagagcagagcaccagaaaggagaacatccagaccggccccagaaccagaagccccaccatcctggagaccagccccagactgatcagaaaggccctggagttcatggacctgagccagtacgtgagaaagaccgacaccgaccccctgctgcagaccgacgagctgaaccagcagcaggccatgcagaaggccgaggagatccaccagttcagacagcacagaaccagagtgctgagcatcagaaacatcgaccaggaggagagactgaagctgaaggacgaggtgctggacatgtacaaggagatgcaggacagcctggacgaggccagacagaagatcttcgacatcagagaggagtacagaaacaagctgctggaggccgagcacctgaagctggagaccctggccgcccaggaggccgccatgaagctggagaccgagaagatgacccccgcccccgacacccagaagaagaagaagggcaagaagaagtag

SEQ ID NO: 19409 - DNA, 153 bp, Artificial Sequence
  Description of Artificial Sequence: Synthetic coding sequence
atgctgagaagcaccttcaccgtgcactggaccaccatcctgggcatctgcagacccatcaagcccatctacaagagccaggcctgccccctgagcgagaagagaaacgccgacaaccacctggtgagcgaggacaacaccttcaaggtgtag

SEQ ID NO: 19410 - DNA, 297 bp, Artificial Sequence
  Description of Artificial Sequence: Synthetic coding sequence
atgctgagaagcaccttcaccgtgcactggaccaccatcctgggcatctgcagacccatcaagcccatctacaagagccaggcctgccccctgagcgagaagagaaacgccgacaaccacctggtgagcgaggacaacaccttcaaggagcccgagagatacatcagcagcagctgcgtgctgaccagcatcctgtacctgggcgagaagaccttcagcttcagaaccctgatcagccccagaggcatgaagctggtggagatcctgcagcagcccagcctgaccatggtggcctag

SEQ ID NO: 19411 - DNA, 246 bp, Artificial Sequence
  Description of Artificial Sequence: Synthetic coding sequence
atgaacgtggaccacgaggtgaacctgctggtggaggagatccacagactgggcagcaagaacgccgacggcaagctgagcgtgaagttcggcgtgctgttcagagacgacaagtgcgccaacctgttcgaggccctggtgggcaccctgaaggccgccaagagaagaaagatcgtgacctaccccggcgagctgctgctgcagggcgtgcacgacgacgtggacatcatcctgctgcaggactag

SEQ ID NO: 19412 - DNA, 204 bp, Artificial Sequence
  Description of Artificial Sequence: Synthetic coding sequence
atgaacgtggaccacgaggtgaacctgctggtggaggagatccacagactgggcagcaagagcaagtacctgaccgagatcgagtacttcagctggctgtacctgggcaccggcgagaccggcatgctggagaagcccatgaagggcagccccagagccagcggccacagaagcggcagcagcgcccacagccccagactgtag

SEQ ID NO: 19413 - DNA, 1374 bp, Artificial Sequence
  Description of Artificial Sequence: Synthetic coding sequence
atggacagaagcctgagaaacgtgctggtggtgagcttcggcttcctgctgctgttcaccgcctacggcggcctgcagagcctgcagagcagcctgtacagcgaggagggcctgggcgtgaccgccctgagcaccctgtacggcggcatgctgctgagcagcatgttcctgccccccctgctgatcgagagactgggctgcaagggcaccatcatcctgagcatgtgcggctacgtggccttcagcgtgggcaacttcttcgccagctggtacaccctgatccccaccagcatcctgctgggcctgggcgccgcccccctgtggagcgcccagtgcacctacctgaccatcaccggcaacacccacgccgagaaggccggcaagagaggcaaggacatggtgaaccagtacttcggcatcttcttcctgatcttccagagcagcggcgtgtggggcaacctgatcagcagcctggtgttcggccagacccccagccaggagaccctgcccgaggagcagctgaccagctgcggcgccagcgactgcctgatggccaccaccaccaccaacagcacccagagacccagccagcagctggtgtacaccctgctgggcatctacaccggcagcggcgtgctggccgtgctgatgatcgccgccttcctgcagcccatcagagacgtgcagagagagagcgagggcgagaagaagagcgtgcccttctggagcaccctgctgagcaccttcaagctgtacagagacaagagactgtgcctgctgatcctgctgcccctgtacagcggcctgcagcagggcttcctgagcagcgagtacaccagaagctacgtgacctgcaccctgggcatccagttcgtgggctacgtgatgatctgcttcagcgccaccgacgccctgtgcagcgtgctgtacggcaaggtgagccagtacaccggcagagccgtgctgtacgtgctgggcgccgtgacccacgtgagctgcatgatcgccctgctgctgtggagacccagagccgaccacctggccgtgttcttcgtgttcagcggcctgtggggcgtggccgacgccgtgtggcagacccagaacaacgccctgtacggcgtgctgttcgagaagagcaaggaggccgccttcgccaactacagactgtgggaggccctgggcttcgtgatcgccttcggctacagcatgttcctgtgcgtgcacgtgaagctgtacatcctgctgggcgtgctgagcctgaccatggtggcctacggcctggtggagtgcgtggagagcaagaaccccatcagaccccacgcccccggccaggtgaaccaggccgaggacgaggagatccagaccaagatgtag

SEQ ID NO: 19414 - DNA, 912 bp, Artificial Sequence
  Description of Artificial Sequence: Synthetic coding sequence
atgaaggaggccctggcccacttcaccatccacaccgccctggtgcccagcgaggcccaggacacccccctgttcagatacctgaacccccaggccagcctgagccacaccagcgaggaggacttcctgcccgtggaggccgtgagagagggcaaggaggagaagaagggcggcccccccggcagaggcccccccggctggagaagaagagaggagctgagactgcccgacctgaaggtgctgtgctaccaggaggccggcagcagaggcaccagagacagacaccactacgtgagcagctacctggccggcgccaccagcgccgacagatacagaatgttcctgagattccagaaggaggtgctggccaagcaggacctgctgaagaacgacttcaccggcagcaaggccgccgccggccacgagagaaagctgcagcaggagctgcagaagatctgcacctgcagcccccagcagttcaacagactgcacgtgttcggcaaggtgttcgaggacatctgcaacagcagcctgatcttcggcgacctgctgaagaaggtgaaggacgagtacgagctgtacatggccaccctgctggagagccagcccgccgcccagtacgaggccctgctggcccagctgaaggccctgggccagagacccgtgaagaccgccgacatggacctggccagagaggagctgagaatgctggtgaccgccaccaaggccgccctggagcagaacgacagactgagaagcgagctggagatggaggtggccctgctgcagagcgccaaggagagaagcggcagatgcctgtgcgacgtgctgccctacggctgcttcgccgtgaccttcatcatcagcgccgccgccgtgtggctgcccgtgtgccagctgggcagatgctag

SEQ ID NO: 19415 - DNA, 174 bp, Artificial Sequence
  Description of Artificial Sequence: Synthetic coding sequence
atgggcaccgccgtgggcccccaccacagccccgccccccacgacagcgccctgcccgccagactgctgaccagcgacttcccctacggcagaagctgccagatcgagcaggtgaagtacagcgtgcccgacaccggcctgttccagcactgggagggcagcatccccacctag

SEQ ID NO: 19416 - DNA, 174 bp, Artificial Sequence; identical to SEQ ID NO: 19415
  Description of Artificial Sequence: Synthetic coding sequence

SEQ ID NO: 19417 - DNA, 462 bp, Artificial Sequence
  Description of Artificial Sequence: Synthetic coding sequence
atggccgccgccctggccctggtggccggcgtgctgagcggcgccgtgctgcccctgtggagcgccctgccccagtacaagaagaagatcaccgacagatgcttccaccacagcgagtgctacagcggctgctgcctgatggacctggacagcggcggcgccttctgcgcccccagagccagaatcaccatgatctgcctgccccagtggctggagctgttcaagggcagagacagaatcatcttcatctacgaggcccccacccccagcctggtgagcgcccacaaccagggcagctaccagcaccacctgcccctgcccgacggcctggacgtgcacatccagggcctggacgtgttcccccccgtgccctacgacctggaggaggacgccggctggagcctgctgccctggggccacagaccctggctgccccccacctgcagcaagagcagcagctag

SEQ ID NO: 19418 - DNA, 546 bp, Artificial Sequence
  Description of Artificial Sequence: Synthetic coding sequence
atgtaccagcccagcagaggcgccgccagaagactgggcccctgcctgagagcctaccaggccagaccccagctgcccaagctgttcctgcagagccacgactacagcctgtacagcctggacgtggagttcatcaacgagatcctgaacatcagaaccaagggcagaacctggtacatcctgagcctgaccctgtgcagattcctggcctggaactacttcgcccacctgagactggaggtgctgcagctgaccagacaccccgagaactggaccctgcaggccagatggagactggtgggcctgcccgtgcacctgctgttcctgagattctacaagagagacaaggacgagcactacagaacctacgacgcctacagcaccttctacctgaacagcagcggcctgatctgcagacacagactggacaagctgatgcccagccacagcccccccacccccgtgaagaagctgctggtgggcgccctggtggccctgggcctgagcgagcccgagcccgacctgaacctgtgcagcaagccctag

SEQ ID NO: 19419 - DNA, 948 bp, Artificial Sequence
  Description of Artificial Sequence: Synthetic coding sequence
atgtaccagcccagcagaggcgccgccagaagactgggcccctgcctgagagcctaccaggccagaccccaggaccagctgtaccccggcaccctgcccttcccccccctgtggccccacagcaccaccaccaccagccccagcagccccctgttctggagccccctgccccccagactgcccacccagagactgccccaggtgccccccctgcccctgccccagatccaggccctgagcagcgcctgggtggtgctgccccccggcaagggcgaggagggccccggccccgagctgcacagcggctgcctggacggcctgagaagcctgttcgagggccccccctgcccctaccccggcgcctggatccccttccaggtgcccggcaccgcccaccccagccccgccacccccagcggcgaccccagcatggaggagcacctgagcgtgatgtacgagagactgagacaggagctgcccaagctgttcctgcagagccacgactacagcctgtacagcctggacgtggagttcatcaacgagatcctgaacatcagaaccaagggcagaacctggtacatcctgagcctgaccctgtgcagattcctggcctggaactacttcgcccacctgagactggaggtgctgcagctgaccagacaccccgagaactggaccctgcaggccagatggagactggtgggcctgcccgtgcacctgctgttcctgagattctacaagagagacaaggacgagcactacagaacctacgacgcctacagcaccttctacctgaacagcagcggcctgatctgcagacacagactggacaagctgatgcccagccacagcccccccacccccgtgaagaagctgctggtgggcgccctggtggccctgggcctgagcgagcccgagcccgacctgaacctgtgcagcaagccctag

SEQ ID NO: 19420 - DNA, 1302 bp, Artificial Sequence
  Description of Artificial Sequence: Synthetic coding sequence
ctgcccacctgcgccctgcagagagtggacagactgggcgtggccggcgccggcggcagaagatgcagagcctgcagagccagaaccagcgtgctgcccggcctgagagccgtgagaagaggccagggccaggccgccggcagagtgtgcgtggcccccgacagccccagactgcccgtgcccagaggcgacctgaagggcagaggcagagagatcagaagccccgccgccgcccccagcagaagcagccccgcccagaccagacccgccggcagaccccagcagcccgccagactggccctgggcgagagaagctggcaggagggcagacccgtgtgcaccagattcggccccctgagacccggctggcaggacggccacgcccccagcagagacggcgccagcagaacccccagcggcaccgaggaccagctgtaccccggcaccctgcccttcccccccctgtggccccacagcaccaccaccaccagccccagcagccccctgttctggagccccctgccccccagactgcccacccagagactgccccaggtgccccccctgcccctgccccagatccaggccctgagcagcgcctgggtggtgctgccccccggcaagggcgaggagggccccggccccgagctgcacagcggctgcctggacggcctgagaagcctgttcgagggccccccctgcccctaccccggcgcctggatccccttccaggtgcccggcaccgcccaccccagccccgccacccccagcggcgaccccagcatggaggagcacctgagcgtgatgtacgagagactgagacaggagctgcccaagctgttcctgcagagccacgactacagcctgtacagcctggacgtggagttcatcaacgagatcctgaacatcagaaccaagggcagaacctggtacatcctgagcctgaccctgtgcagattcctggcctggaactacttcgcccacctgagactggaggtgctgcagctgaccagacaccccgagaactggaccctgcaggccagatggagactggtgggcctgcccgtgcacctgctgttcctgagattctacaagagagacaaggacgagcactacagaacctacgacgcctacagcaccttctacctgaacagcagcggcctgatctgcagacacagactggacaagctgatgcccagccacagcccccccacccccgtgaagaagctgctggtgggcgccctggtggccctgggcctgagcgagcccgagcccgacctgaacctgtgcagcaagccctag

SEQ ID NO: 19421 - DNA, 546 bp, Artificial Sequence; identical to SEQ ID NO: 19418
  Description of Artificial Sequence: Synthetic coding sequence

SEQ ID NO: 19422 - DNA, 546 bp, Artificial Sequence; identical to SEQ ID NO: 19418
  Description of Artificial Sequence: Synthetic coding sequence

SEQ ID NO: 19423 - DNA, 546 bp, Artificial Sequence; identical to SEQ ID NO: 19418
  Description of Artificial Sequence: Synthetic coding sequence

SEQ ID NO: 19424 - DNA, 948 bp, Artificial Sequence; identical to SEQ ID NO: 19419
  Description of Artificial Sequence: Synthetic coding sequence

SEQ ID NO: 19425 - DNA, 948 bp, Artificial Sequence; identical to SEQ ID NO: 19419
  Description of Artificial Sequence: Synthetic coding sequence

SEQ ID NO: 19426 - DNA, 1302 bp, Artificial Sequence; identical to SEQ ID NO: 19420
  Description of Artificial Sequence: Synthetic coding sequence

SEQ ID NO: 19427 - DNA, 948 bp, Artificial Sequence; identical to SEQ ID NO: 19419
  Description of Artificial Sequence: Synthetic coding sequence

SEQ ID NO: 19428 - DNA, 948 bp, Artificial Sequence; identical to SEQ ID NO: 19419
  Description of Artificial Sequence: Synthetic coding sequence

SEQ ID NO: 19429 - DNA, 1302 bp, Artificial Sequence; identical to SEQ ID NO: 19420
  Description of Artificial Sequence: Synthetic coding sequence

SEQ ID NO: 19430 - DNA, 1302 bp, Artificial Sequence; identical to SEQ ID NO: 19420
  Description of Artificial Sequence: Synthetic coding sequence

SEQ ID NO: 19431 - DNA, 948 bp, Artificial Sequence; identical to SEQ ID NO: 19419
  Description of Artificial Sequence: Synthetic coding sequence

SEQ ID NO: 19432 - DNA, 1302 bp, Artificial Sequence
  Description of Artificial Sequence: Synthetic coding sequence
ctgcccacctgcgccctgcagagagtggacagactgggcgtggccgaggccggcggcagaagatgcagagcctgcagagccagaaccagcgtgctgcccggcctgagagccgtgagaagaggccagggccaggccgccggcagagtgtgcgtggcccccgacagccccagactgcccgtgcccagaggcgacctgaagggcagaggcagagagatcagaagccccgccgccgcccccagcagaagcagccccgcccagaccagacccgccggcagaccccagcagcccgccagactggccctgggcgagagaagctggcaggagggcagacccgtgtgcaccagattcggccccctgagacccggctggcaggacggccacgcccccagcagagacggcgccagcagaacccccagcggcaccgaggaccagctgtaccccggcaccctgcccttcccccccctgtggccccacagcaccaccaccaccagccccagcagccccctgttctggagccccctgccccccagactgcccacccagagactgccccaggtgccccccctgcccctgccccagatccaggccctgagcagcgcctgggtggtgctgccccccggcaagggcgaggagggccccggccccgagctgcacagcggctgcctggacggcctgagaagcctgttcgagggccccccctgcccctaccccggcgcctggatccccttccaggtgcccggcaccgcccaccccagccccgccacccccagcggcgaccccagcatggaggagcacctgagcgtgatgtacgagagactgagacaggagctgcccaagctgttcctgcagagccacgactacagcctgtacagcctggacgtggagttcatcaacgagatcctgaacatcagaaccaagggcagaacctggtacatcctgagcctgaccctgtgcagattcctggcctggaactacttcgcccacctgagactggaggtgctgcagctgaccagacaccccgagaactggaccctgcaggccagatggagactggtgggcctgcccgtgcacctgctgttcctgagattctacaagagagacaaggacgagcactacagaacctacgacgcctacagcaccttctacctgaacagcagcggcctgatctgcagacacagactggacaagctgatgcccagccacagcccccccacccccgtgaagaagctgctggtgggcgccctggtggccctgggcctgagcgagcccgagcccgacctgaacctgtgcagcaagccctag

SEQ ID NO: 19433 - DNA, 1302 bp, Artificial Sequence; identical to SEQ ID NO: 19420
  Description of Artificial Sequence: Synthetic coding sequence

SEQ ID NO: 19434 - DNA, 546 bp, Artificial Sequence; identical to SEQ ID NO: 19418
  Description of Artificial Sequence: Synthetic coding sequence

SEQ ID NO: 19435 - DNA, 546 bp, Artificial Sequence; identical to SEQ ID NO: 19418
  Description of Artificial Sequence: Synthetic coding sequence

SEQ ID NO: 19436 - DNA, 1491 bp, Artificial Sequence
  Description of Artificial Sequence: Synthetic coding sequence
atgtaccagcccagcagaggcgccgccagaagactgggcccctgcctgagagcctaccaggccagaccccaggtgagcggcggcgaggagggcggcagaagaggcggcggcgagagacccagcagcaagcccgtgagaggcgccgagagagccctgggcagcgcccaggcccagagacaccccccccccctgcccacctgcgccctgcagagagtggacagactgggcgtggccggcgccggcggcagaagatgcagagcctgcagagccagaaccagcgtgctgcccggcctgagagccgtgagaagaggccagggccaggccgccggcagagtgtgcgtggcccccgacagccccagactgcccgtgcccagaggcgacctgaagggcagaggcagagagatcagaagccccgccgccgcccccagcagaagcagccccgcccagaccagacccgccggcagaccccagcagcccgccagactggccctgggcgagagaagctggcaggagggcagacccgtgtgcaccagattcggccccctgagacccggctggcaggacggccacgcccccagcagagacggcgccagcagaacccccagcggcaccgaggaccagctgtaccccggcaccctgcccttcccccccctgtggccccacagcaccaccaccaccagccccagcagccccctgttctggagccccctgccccccagactgcccacccagagactgccccaggtgccccccctgcccctgccccagatccaggccctgagcagcgcctgggtggtgctgccccccggcaagggcgaggagggccccggccccgagctgcacagcggctgcctggacggcctgagaagcctgttcgagggccccccctgcccctaccccggcgcctggatccccttccaggtgcccggcaccgcccaccccagccccgccacccccagcggcgaccccagcatggaggagcacctgagcgtgatgtacgagagactgagacaggagctgcccaagctgttcctgcagagccacgactacagcctgtacagcctggacgtggagttcatcaacgagatcctgaacatcagaaccaagggcagaacctggtacatcctgagcctgaccctgtgcagattcctggcctggaactacttcgcccacctgagactggaggtgctgcagctgaccagacaccccgagaactggaccctgcaggccagatggagactggtgggcctgcccgtgcacctgctgttcctgagattctacaagagagacaaggacgagcactacagaacctacgacgcctacagcaccttctacctgaacagcagcggcctgatctgcagacacagactggacaagctgatgcccagccacagcccccccacccccgtgaagaagctgctggtgggcgccctggtggccctgggcctgagcgagcccgagcccgacctgaacctgtgcagcaagccctag

SEQ ID NO: 19437 - DNA, 1491 bp, Artificial Sequence; identical to SEQ ID NO: 19436
  Description of Artificial Sequence: Synthetic coding sequence

SEQ ID NO: 19438 - DNA, 1491 bp, Artificial Sequence; identical to SEQ ID NO: 19436
  Description of Artificial Sequence: Synthetic coding sequence

SEQ ID NO: 19439 - DNA, 1491 bp, Artificial Sequence; identical to SEQ ID NO: 19436
  Description of Artificial Sequence: Synthetic coding sequence

SEQ ID NO: 19440 - DNA, 1491 bp, Artificial Sequence
  Description of Artificial Sequence: Synthetic coding sequence
atgtaccagcccagcagaggcgccgccagaagactgggcccctgcctgagagcctaccaggccagaccccaggtgagcggcggcgaggagggcggcagaagaggcggcggcgagagacccagcagcaagcccgtgagaggcgccgagagagccctgggcagcgcccaggcccagagacaccccccccccctgcccacctgcgccctgcagagagtggacagactgggcgtggccgaggccggcggcagaagatgcagagcctgcagagccagaaccagcgtgctgcccggcctgagagccgtgagaagaggccagggccaggccgccggcagagtgtgcgtggcccccgacagccccagactgcccgtgcccagaggcgacctgaagggcagaggcagagagatcagaagccccgccgccgcccccagcagaagcagccccgcccagaccagacccgccggcagaccccagcagcccgccagactggccctgggcgagagaagctggcaggagggcagacccgtgtgcaccagattcggccccctgagacccggctggcaggacggccacgcccccagcagagacggcgccagcagaacccccagcggcaccgaggaccagctgtaccccggcaccctgcccttcccccccctgtggccccacagcaccaccaccaccagccccagcagccccctgttctggagccccctgccccccagactgcccacccagagactgccccaggtgccccccctgcccctgccccagatccaggccctgagcagcgcctgggtggtgctgccccccggcaagggcgaggagggccccggccccgagctgcacagcggctgcctggacggcctgagaagcctgttcgagggccccccctgcccctaccccggcgcctggatccccttccaggtgcccggcaccgcccaccccagccccgccacccccagcggcgaccccagcatggaggagcacctgagcgtgatgtacgagagactgagacaggagctgcccaagctgttcctgcagagccacgactacagcctgtacagcctggacgtggagttcatcaacgagatcctgaacatcagaaccaagggcagaacctggtacatcctgagcctgaccctgtgcagattcctggcctggaactacttcgcccacctgagactggaggtgctgcagctgaccagacaccccgagaactggaccctgcaggccagatggagactggtgggcctgcccgtgcacctgctgttcctgagattctacaagagagacaaggacgagcactacagaacctacgacgcctacagcaccttctacctgaacagcagcggcctgatctgcagacacagactggacaagctgatgcccagccacagcccccccacccccgtgaagaagctgctggtgggcgccctggtggccctgggcctgagcgagcccgagcccgacctgaacctgtgcagcaagccctag

SEQ ID NO: 19441 - DNA, 1491 bp, Artificial Sequence; identical to SEQ ID NO: 19436
  Description of Artificial Sequence: Synthetic coding sequence

SEQ ID NO: 19442 - DNA, 735 bp, Artificial Sequence
  Description of Artificial Sequence: Synthetic coding sequence
atgaacgaccccttcgccagaatggagaccagaggcccccagggcgccgccaaccccatggacagcagcagaagcctgggcgacctgggccccttccccagagaggtgggcagaggcgcccccctggcccccggcgccagaaaccccgccaccgccggcgccagcagaagccagggcggcggccacgaggacagaaccgccgacagagccctgggccccagagccggcgaggagctggacagagagagctgggtgagagagaaggtgctgttcctgctgcaccccgagagatggctgggcaccagaggcgaccccgccagagaggaggtggccggcgccgaggacctgccccacgccggcggcgaggaccacggcgaggagcccaactaccccagcgtgttccagagacagaagagaatcagcggcagaagagtggccccccccagagacgccgccgacccccccaagtacgtgctggtgagagtggaggactaccaggtgacccaggaggtgctgcagaccagctgggccaagggcagaatgaccaccagaaccgaggagcacttcgtgaccgccctgaccttcagaagcagcagagagggccagcccggcgagagatggggccccgccgagagcagagccctgcaggccagaaccggcgccagcagagtgcacgccgccggcagaagagtgagccccagccccggcacctggctggaggagatcaagctgtag

SEQ ID NO: 19443 - DNA, 1527 bp, Artificial Sequence
  Description of Artificial Sequence: Synthetic coding sequence
atgggcagaagaaacgagaactgcgccaacagcctgagagtgagcaacatcagccaggagaacctgagccactggaacctggacagcgaggtgcccgtgagcgagaacaagaacctgcccgccggcagagacggcgccgccggcggcaagatcaacaagaactacctggagatccccgtggagcagctgatgctggagcccaacctgagcgtgcacagccagaagagcacccagaacagcaagcagggcatcttccagctgtggaactgccccctgaacgagggcagcaccatcgagaagagagagttcaagaagagcagcgtggagaccggcttcaacgtgatcaaccaccccatcagagtgttcaccctgaaccaccccctgaccatcgccagcgtggacaagcaggtgggcccctaccccggcctgcccatgcccctgggcctgtgctggccctacgccgacggcgacttcttcaagaacagaaacgagatccacgtgagcagctgcagcaccatcgagaacaacgacggcgagaccctgcccgcccccaactggaacctgaagcacggcaacagcagcgtggaggagaacttcaccgacgagagcgacctgagcgagaacgagaagaccaacgacaccctgctgagctacttcaagaaggtggacctgaacctgaagcccgagaccatcaagaacgtggaggagcccttcaccgaggagcccaacgaggtgttcccctaccccgacttcctgcccccccccttcagcgccctggacctgcacaacctggccctgagcaagagcgacaactggaaggtgaccgtggaccccgccgagaccagcgtggagcacctgatcaccagactgctggagctggagagactgcagcacatgaccatccagaaggagagacccagactgcagaccaccttctgcacccccgccgtgaccgagagacccagcagcagcaaggccacccccaaggtgagacagcccaagctgtgcgacagcctgagcctgcagatcccctgcgtggacaagagccaggagaagagcaagaacaacagcggcagctgcaagctggagcagaacgccctgaagagaaactggagcaacgccggcaagtacagatggaacagcagacccctgagcctgaagagcagcagcacccccaagcagctgatcgagacctacgacaagaaccccaagagcagcatcctgagcccctgccaggagctgagcttcaagcccaccatcggccacaccaaccagagcatggtgaagatggtgagcaccagatgcctgccctggagaagccccatgcccgtgagccccatccccctgaccttccccgagaaccagaaggaggagatcaaggcccccaagagaaacttcggcaccaagaagaagctgtacagacagaacatcgtgctgaacagacccttcagcatccagaagctgaactgcctgagccccagcctgatcgccaaggacaagtgctgcagccccatcgagcagaagtag

SEQ ID NO: 19444 - DNA, 1068 bp, Artificial Sequence
  Description of Artificial Sequence: Synthetic coding sequence
atgctgatggagttcttcaagaacagaaacgagatccacgtgagcagctgcagcaccatcgagaacaacgacggcgagaccctgcccgcccccaactggaacctgaagcacggcaacagcagcgtggaggagaacttcaccgacgagagcgacctgagcgagaacgagaagaccaacgacaccctgctgagctacttcaagaaggtggacctgaacctgaagcccgagaccatcaagaacgtggaggagcccttcaccgaggagcccaacgaggtgttcccctaccccgacttcctgcccccccccttcagcgccctggacctgcacaacctggccctgagcaagagcgacaactggaaggtgaccgtggaccccgccgagaccagcgtggagcacctgatcaccagactgctggagctggagagactgcagcacatgaccatccagaaggagagacccagactgcagaccaccttctgcacccccgccgtgaccgagagacccagcagcagcaaggccacccccaaggtgagacagcccaagctgtgcgacagcctgagcctgcagatcccctgcgtggacaagagccaggagaagagcaagaacaacagcggcagctgcaagctggagcagaacgccctgaagagaaactggagcaacgccggcaagtacagatggaacagcagacccctgagcctgaagagcagcagcacccccaagcagctgatcgagacctacgacaagaaccccaagagcagcatcctgagcccctgccaggagctgagcttcaagcccaccatcggccacaccaaccagagcatggtgaagatggtgagcaccagatgcctgccctggagaagccccatgcccgtgagccccatccccctgaccttccccgagaaccagaaggaggagatcaaggcccccaagagaaacttcggcaccaagaagaagctgtacagacagaacatcgtgctgaacagacccttcagcatccagaagctgaactgcctgagccccagcctgatcgccaaggacaagtgctgcagccccatcgagcagaagtag

SEQ ID NO: 19445 - DNA, 978 bp, Artificial Sequence
  Description of Artificial Sequence: Synthetic coding sequence
atgcagggcagagtggccggcagctgcgcccccctgggcctgctgctggtgtgcctgcacctgcccggcctgttcgccagaagcatcggcgtggtggaggagaaggtgagccagaacttcggcaccgacctgccccagctgggccagcccagcagcaccggccccagcaacagcgagcacccccagcccgccctggaccccagaagcaacgacctggccagagtgcccctgaagctgagcgtgccccccagcgacggcttcccccccgccggcggcagcgccgtgcagagatggccccccagctggggcctgcccgccatggacagctggccccccgaggacccctggcagatgatggccgccgccgccgaggacagactgggcgaggccctgcccgaggagctgagctacctgagcagcgccgccgccctggcccccggcagcggccccctgcccggcgagagcagccccgacgccaccggcctgagccccgaggccagcctgctgcaccaggacagcgagagcagaagactgcccagaagcaacagcctgggcgccggcggcaagatcctgagccagagacccccctggagcctgatccacagagtgctgcccgaccacccctggggcaccctgaaccccagcgtgagctggggcggcggcggccccggcaccggctggggcaccagacccatgccccaccccgagggcatctggggcatcaacaaccagccccccggcaccagctggggcaacatcaacagataccccggcggcagctggggcaacatcaacagataccccggcggcagctggggcaacatcaacagataccccggcggcagctggggcaacatccacctgtaccccggcatcaacaaccccttcccccccggcgtgctgagaccccccggcagcagctggaacatccccgccggcttccccaacccccccagccccagactgcagtggggctag

SEQ ID NO: 19446 - DNA, 978 bp, Artificial Sequence
  Description of Artificial Sequence: Synthetic coding sequence
atgcagggcagagtggccggcagctgcgcccccctgggcctgctgctggtgtgcctgcacctgcccggcctgttcgccagaagcatcggcgtggtggaggagaaggtgagccagaacttcggcaccaacctgccccagctgggccagcccagcagcaccggccccagcaacagcgagcacccccagcccgccctggaccccagaagcaacgacctggccagagtgcccctgaagctgagcgtgccccccagcgacggcttcccccccgccggcggcagcgccgtgcagagatggccccccagctggggcctgcccgccatggacagctggccccccgaggacccctggcagatgatggccgccgccgccgaggacagactgggcgaggccctgcccgaggagctgagctacctgagcagcgccgccgccctggcccccggcagcggccccctgcccggcgagagcagccccgacgccaccggcctgagccccgaggccagcctgctgcaccaggacagcgagagcagaagactgcccagaagcaacagcctgggcgccggcggcaagatcctgagccagagacccccctggagcctgatccacagagtgctgcccgaccacccctggggcaccctgaaccccagcgtgagctggggcggcggcggccccggcaccggctggggcaccagacccatgccccaccccgagggcatctggggcatcaacaaccagccccccggcaccagctggggcaacatcaacagataccccggcggcagctggggcaacatcaacagataccccggcggcagctggggcaacatcaacagataccccggcggcagctggggcaacatccacctgtaccccggcatcaacaaccccttcccccccggcgtgctgagaccccccggcagcagctggaacatccccgccggcttccccaacccccccagccccagactgcagtggggctag

SEQ ID NO: 19447 - DNA, 612 bp, Artificial Sequence
  Description of Artificial Sequence: Synthetic coding sequence
atgtaccagaacatggacgacgagatgaagagagagcacctggccgccgagcagagaatggtgcacagaatccagagaatcatgatggagtgccacagagagaaggtggaggccgtggagaaggccagagccgaggagagacacatcgcccaggaggccatccaggcccagaagagcaaggccgtggaggagatcgtgaacaccggcgtgaccgtgatcaaggacgagaagaccagcgtggccagactgatgagagagaaggagcacgagatgagcatcctgtacggcatcgcccagagacagagacaggaggaggtgcaggaggtgctgcaggaggccgagaagacccaccaggccaccctgggcaacatgatggacaagctggccaacacccagggcgagctgctgagcatcgccaagcagctgggcatcatgaccaactggaaggacttcctggaggaggagctgcaggagaccagaatggccttccagaagtacatcaactacaccttccccaagctgagccccggccacgccgacttcatcctgcccgagagaaagaagacccccagcaacctggtgatcaaggagaacaagaccaccctggactag

SEQ ID NO: 19448 - DNA, 990 bp, Artificial Sequence
  Description of Artificial Sequence: Synthetic coding sequence
atgatcagaaacagcgactacaagaacttcgtgtgctgcgccgtgtgcaacaagatcatcccccccgcccccttcggcaagaccttcaagagaatccacgagtacaagcccctgaagaccagattctacacccacaaggacatcctggacatcggcgccaacatcctgaagaaggaggagcagttccaggaggacatcctgagagagcacatcgccaaggccgaggccgaggtgtgggcccaggccaacgagagacagaagcaggccgtggagaaggccctggaggaggccaacgacagacacaagatcgagatccagatcctgaaggaggagcaccagaaggacctgcaggaggtgaccgccaagaccaagaccgagatgtaccagaacatggacgacgagatgaagagagagcacctggccgccgagcagagaatggtgcacagaatccagagaatcatgatggagtgccacagagagaaggtggaggccgtggagaaggccagagccgaggagagacacatcgcccaggaggccatccaggcccagaagagcaaggccgtggaggagatcgtgaacaccggcgtgaccgtgatcaaggacgagaagaccagcgtggccagactgatgagagagaaggagcacgagatgagcatcctgtacggcatcgcccagagacagagacaggaggaggtgcaggaggtgctgcaggaggccgagaagacccaccaggccaccctgggcaacatgatggacaagctggccaacacccagggcgagctgctgagcatcgccaagcagctgggcatcatgaccaactggaaggacttcctggaggaggagctgcaggagaccagaatggccttccagaagtacatcaactacaccttccccaagctgagccccggccacgccgacttcatcctgcccgagagaaagaagacccccagcaacctggtgatcaaggagaacaagaccaccctggactag

SEQ ID NO: 19449 - DNA, 231 bp, Artificial Sequence
  Description of Artificial Sequence: Synthetic coding sequence
atgagccacctgcccgccgtgagccccgtgttcttccagctgcccgccccccacccccccaccgtgctgagaccccagctgggcctgcaccccaaccccgagtgcgacagagagaagatgagcgtgagagaccacgaccccgaggtgctgaccagaaacagcgcctgcaagcccagaggccagctgagcggccacctgctgaagcccagagcccccctggaggccgcctag

SEQ ID NO: 19450 - DNA, 180 bp, Artificial Sequence
  Description of Artificial Sequence: Synthetic coding sequence
atgagccacctgcccgccgtgagccccgtgttcttccagctgcccgccccccacccccccaccgtgctgagaccccagctgggcctgcaccccaaccccgagtgcgacagagagaagatgagcgtgagagaccacgaccccgaggtgctgaccagaaacagcggcagcctgcaggcctag

SEQ ID NO: 19451 - DNA, 1869 bp, Artificial Sequence
  Description of Artificial Sequence: Synthetic coding sequence
atgccccccacccaggccgagagcgtgatcagaagcatcatcagagagatcggccaggagtgcgccgcccacggcgagatcgtgagcgagaccctgatcgccttcatggtgaaggccgtggtgctggaccccagcaacggcttcaacatggacagaaccctgatgaagagcgacgtgcagaacctggtgaagctgtgcatgaccagactgctggacaccaagaaccccagcctggacaccatcaagatgcaggtgtacttcgacatgaactacaccaacagagtggagttcctggaggagcaccacagagtgctggagagcagactgggcagcgtgaccagagagatcaccgacaacagagcctgcgccaaggaggagctggagagcctgtacagaaagatcatcagctacgtgctgctgagaagcggcctgggcagccccaccgacatcaagaccgtgagagaggtgaccgccgccctgcagagcgtgttcccccaggccgagctgggcaccttcctgaccctgagcaagaaggacaaggagagacagctgaaggagctgaccatgatcgtgaccggcatcagactgttcaacagagactgcggcaagggcggcgagggcatcgacgacctgcccgccgtgctgcacgtggccatccccgccaccatgcagcacatcgactaccagctggagaccgccagaagccaggtgtacagatacaccgccatcctggagaaggccgccaacgaccccctgatgagagccgagctgcagccctacatgctgaaggaggccctgtacaacatcagacagtacgaggtgttcctgcagatcatcctgagcgacatcatcaccggcgcccaggaggtggagatgatgaccaagcagctgggcgcccacctggagcagctgaagatgaccatcaagagcaagatcgccgtgcccaccagccaggtgttccccatcttcatcgccctgagcaccctgtggaccagcctgcaggacgagaccatcgtggtgggcgtgctgagcaacctgttcacccacatccagcccttcctgggcgcccacgagctgtacttccccgagagagtgatgcagtgccacctgaacggcgccaccgtgaagaccgacgtgtgcagaatgaaggagcacatggaggacagagtgaacgtggccgacttcagaaagctggagtggctgttccccgagaccaccgccaacttcgacaagctgctgatccagtacagaggcttctgcgcctacaccttcgccgccaccgacggcctgctgctgcccggcaaccccgccatcggcatcctgaagtacaaggagaagtactacaccttcaacagcaaggacgccgcctacagcttcgccgagaaccccgagcactacatcgacatcgtgagagagaaggccaagaagaacaccgagctgatccagctgctggagctgcaccagcagttcgagaccttcatcccctacagccagatgagagacgccgacaagcactacatcaagcccatcaccaagtgcgagagcagcacccagaccaacacccacatcctgccccccaccatcgtgagaagctacgagtggaacgagtgggagctgagaagaaaggccatcaagctggccaacctgagacagaaggtgacccacagcgtgcagaccgacctgagccacctgagaagagagaactgcagccaggtgtacccccccaaggacaccagcacccagagcatgagagaggacagcaccggcgtgcccagaccccagatctacctggccggcctgagaggcggcaagagcgagatcaccgacgaggtgaaggtgaacctgaccagagacgtggacgagacctag

SEQ ID NO: 19452 - DNA, 759 bp, Artificial Sequence
  Description of Artificial Sequence: Synthetic coding sequence
atgccccccacccaggccgagagcgtgatcagaagcatcatcagagagatcggccaggagtgcgccgcccacggcgagatcgtgagcgagaccctgatcgccttcatggtgaaggccgtggtgctggaccccagcaacggcttcaacatggacagaaccctgatgaagagcgacgtgcagaacctggtgaagctgtgcatgaccagactgctggacaccaagaaccccagcctggacaccatcaagatgcaggtgtacttcgacatgaactacaccaacagagtggagttcctggaggagcaccacagagtgctggagagcagactgggcagcgtgaccagagagatcaccgacaacagagcctgcgccaaggaggagctggagagcctgtacagaaagatcatcagctacgtgctgctgagaagcggcctgggcagccccaccgacatcaagaccgtgagagaggtgaccgccgccctgcagagcgtgttcccccaggccgagctgggcaccttcctgaccctgagcaagaaggacaaggagagacagctgaaggagctgaccatgatcgtgaccggcatcagactgttcaacagagactgcggcaagggcggcgagggcatcgacgacctgcccgccgtgctgcacgtggccatccccgccaccatgcagcacatcgactaccagctggagaccgccagaagccaggtgtacagatacaccgccatcctggagaaggccgccaacgaccccctgtag

SEQ ID NO: 19453 - DNA, 1230 bp, Artificial Sequence
  Description of Artificial Sequence: Synthetic coding sequence
atgcactggggcgtgggcttcgccagcagcagaccctgcgtggtggacctgagctggaaccagagcatcagcttcttcggctggtgggccggcagcgaggagcccttcagcttctacggcgacatcatcgccttccccctgcaggactacggcggcatcatggccggcctgggcagcgacccctggtggaagaagaccctgtacctgaccggcggcgccctgctggccgccgccgcctacctgctgcacgagctgctggtgatcagaaagcagcaggagatcgacagcaaggacgccatcatcctgcaccagttcgccagacccaacaacggcgtgcccagcctgagccccttctgcctgaagatggagacctacctgagaatggccgacctgccctaccagaactacttcggcggcaagctgagcgcccagggcaagatgccctggatcgagtacaaccacgagaaggtgagcggcaccgagttcatcatcgacttcctggaggagaagctgggcgtgaacctgaacaagaacctgggcccccacgagagagccatcagcagagccgtgaccaagatggtggaggagcacttctactggaccctggcctactgccagtgggtggacaacctgaacgagaccagaaagatgctgagcctgagcggcggcggccccttcagcaacctgctgagatgggtggtgtgccacatcaccaagggcatcgtgaagagagagatgcacggccacggcatcggcagattcagcgaggaggagatctacatgctgatggagaaggacatgagaagcctggccggcctgctgggcgacaagaagtacatcatgggccccaagctgagcaccctggacgccaccgtgttcggccacctggcccaggccatgtggaccctgcccggcaccagacccgagagactgatcaagggcgagctgatcaacctggccatgtactgcgagagaatcagaagaaagttctggcccgagtggcaccacgacgacgacaacaccatctacgagagcgaggagagcagcgagggcagcaagacccacacccccctgctggacttcagcttctacagcagaaccgagaccttcgaggacgagggcgccgagaacagcttcagcagaacccccgacaccgacttcaccggccacagcctgttcgacagcgacgtggacatggacgactacaccgaccacgagcagtgcaagtag

SEQ ID NO: 19454 - DNA, 390 bp, Artificial Sequence
  Description of Artificial Sequence: Synthetic coding sequence
atgggccccaagctgagcaccctggacgccaccgtgttcggccacctggcccaggccatgtggaccctgcccggcaccagacccgagagactgatcaagggcgagctgatcaacctggccatgtactgcgagagaatcagaagaaagttctggcccgagtggcaccacgacgacgacaacaccatctacgagagcgaggagagcagcgagggcagcaagacccacacccccctgctggacttcagcttctacagcagaaccgagaccttcgaggacgagggcgccgagaacagcttcagcagaacccccgacaccgacttcaccggccacagcctgttcgacagcgacgtggacatggacgactacaccgaccacgagcagtgcaagtag

SEQ ID NO: 19455 - DNA, 384 bp, Artificial Sequence
  Description of Artificial Sequence: Synthetic coding sequence
atgatctaccccctggacctgttcagaaacatcccctggaagcagggcaagtgcttcgccagcctgagccccgagggcgagagagccttcgacggcatggagcccctgtgccagcccggcgccagacccgccctgagaggcctgcagcacgccagcgactgctacagactgctgagcccccccggcagcggcctggtgggcaccaaccccagcgtgcccgcccccagcccccactgcggctgctgccaggcctggagcatcagcagcttcaccttcaccggccccacccccttcaagatcaacagcgaccaggccaccccctgccacctgagaagccccgagaccatcttcagacagagagagatcagcaacgaggccttctag

SEQ ID NO: 19456 - DNA, 432 bp, Artificial Sequence
  Description of Artificial Sequence: Synthetic coding sequence
atggccagcggccccctgggccccggcgccagacccaccagactgcacccccccttccccccccccgcccacatcaagcccggcgccccccccggcgagaaccccgagctgagcggcctggagagaatcctggccagacaccagctgcccaaggagatcaacctgacccccaagcccaacagaatgcccccctggaagagaaagatcatcaacaacgtgaccgacggctggaagaagtgccacctgctgaagagaaacaccaaggagccccccatgagcaccatcgtggtgagaaagctgatccagaagaacgtgcccagaagacacagcctgagaaacaccagcagaaagctgagaaacctgcccaccaccgccaagggcacccagaccggcaagagccagtgcctgctgggcatcagcgagcccacctag

SEQ ID NO: 19457 - DNA, 387 bp, Artificial Sequence
  Description of Artificial Sequence: Synthetic coding sequence
atgctgagcaacctgcacgagctgctgcccaaccacctgatggagaccctgtacagcagaaagagcgaggaggacaagaagaagtgcgagaaccccgagctgagcggcctggagagaatcctggccagacaccagctgcccaaggagatcaacctgacccccaagcccaacagaatgcccccctggaagagaaagatcatcaacaacgtgaccgacggctggaagaagtgccacctgctgaagagaaacaccaaggagccccccatgagcaccatcgtggtgagaaagctgatccagaagaacgtgcccagaagacacagcctgagaaacaccagcagaaagctgagaaacctgcccaccaccgccaagggcacccagaccgagtag

SEQ ID NO: 19458 - DNA, 591 bp, Artificial Sequence
  Description of Artificial Sequence: Synthetic coding sequence
atgctgagcaacctgcacgagctgctgcccaaccacctgatggagaccctgtacagcagaaagagcgaggaggacaagaagaagtgcgagaaccccgagctgagcggcctggagagaatcctggccagacaccagctgcccaaggagatcaacctgacccccaagcccaacagaatgcccccctggaagagaaagatcatcaacaacgtgaccgacggctggaagaagtgccacctgctgaagagaaacaccaaggagccccccatgagcaccatcgtggtgagatggctgaagaagaacatgcagcccaccgaggacctgaagagcgtgatctgcagactgagcgccttcggccccatccagagcgccaccgtgtgcggcagacagagcgccatcgtggccttcaaggacatgaccagcgcctgcaacgccgtgagcgccttccagagcagaacccccggcaccatgttccagtgcagctggcagcagagattcatgagcaaggacaagacctacagcaagaagtgcacccagaagacccagcccaaggagtacaagcaggagaccgagaagcccgccaacaacagctag

SEQ ID NO: 19459 - DNA, 423 bp, Artificial Sequence
  Description of Artificial Sequence: Synthetic coding sequence
atgctgagcaacctgcacgagctgctgcccaaccacctgatggagaccctgtacagcagaaagagcgaggaggacaagaagaagtgcgagaaccccgagctgagcggcctggagagaatcctggccagacaccagctgcccaaggagatcaacctgacccccaagcccaacagaatgcccccctggaagagaaagatcatcaacaacgtgaccgacggctggaagaagtgccacctgctgaagagaaacaccaaggagccccccatgagcaccatcgtggtgagaaagctgatccagaagaacgtgcccagaagacacagcctgagaaacaccagcagaaagctgagaaacctgcccaccaccgccaagggcacccagaccggcaagagccagtgcctgctgggcatcagcgagcccacctag

SEQ ID NO: 19460 - DNA, 1326 bp, Artificial Sequence
  Description of Artificial Sequence: Synthetic coding sequence
atggccgtggtgcccgccagcctgagcggccaggacgtgggcagcttcgcctacctgaccatcaaggacagaatcccccagatcctgaccaaggtgatcgacaccctgcacagacacaagagcgagttcttcgagaagcacggcgaggagggcgtggaggccgagaagaaggccatcagcctgctgagcaagctgagaaacgagctgcagaccgacaagcccttcatccccctggtggagaagttcgtggacaccgacatctggaaccagtacctggagtaccagcagagcctgctgaacgagagcgacggcaagagcagatggttctacagcccctggctgctggtggagtgctacatgtacagaagaatccacgaggccatcatccagagcccccccatcgactacttcgacgtgttcaaggagagcaaggagcagaacttctacggcagccaggagagcatcatcgccctgtgcacccacctgcagcagctgatcagaaccatcgaggacctggacgagaaccagctgaaggacgagttcttcaagctgctgcagatcagcctgtggggcaacaagtgcgacctgagcctgagcggcggcgagagcagcagccagaacaccaacgtgctgaacagcctggaggacctgaagcccttcatcctgctgaacgacatggagcacctgtggagcctgctgagcaactgcaagaagaccagagagaaggccagcgccaccagagtgtacatcgtgctggacaacagcggcttcgagctggtgaccgacctgatcctggccgacttcctgctgagcagcgagctggccaccgaggtgcacttctacggcaagaccatcccctggttcgtgagcgacaccaccatccacgacttcaactggctgatcgagcaggtgaagcacagcaaccacaagtggatgagcaagtgcggcgccgactgggaggagtacatcaagatgggcaagtgggtgtaccacaaccacatcttctggaccctgccccacgagtactgcgccatgccccaggtggcccccgacctgtacgccgagctgcagaaggcccacctgatcctgttcaagggcgacctgaactacagaaagctgaccggcgacagaaagtgggagttcagcgtgcccttccaccaggccctgaacggcttccaccccgcccccctgtgcaccatcagaaccctgaaggccgagatccaggtgggcctgcagcccggccagggcgagcagctgctggccagcgagcccagctggtggaccaccggcaagtacggcatcttccagtacgacggccccctgtag

SEQ ID NO: 19461 - DNA, 969 bp, Artificial Sequence
  Description of Artificial Sequence: Synthetic coding sequence
atgtacagaagaatccacgaggccatcatccagagcccccccatcgactacttcgacgtgttcaaggagagcaaggagcagaacttctacggcagccaggagagcatcatcgccctgtgcacccacctgcagcagctgatcagaaccatcgaggacctggacgagaaccagctgaaggacgagttcttcaagctgctgcagatcagcctgtggggcaacaagtgcgacctgagcctgagcggcggcgagagcagcagccagaacaccaacgtgctgaacagcctggaggacctgaagcccttcatcctgctgaacgacatggagcacctgtggagcctgctgagcaactgcaagaagaccagagagaaggccagcgccaccagagtgtacatcgtgctggacaacagcggcttcgagctggtgaccgacctgatcctggccgacttcctgctgagcagcgagctggccaccgaggtgcacttctacggcaagaccatcccctggttcgtgagcgacaccaccatccacgacttcaactggctgatcgagcaggtgaagcacagcaaccacaagtggatgagcaagtgcggcgccgactgggaggagtacatcaagatgggcaagtgggtgtaccacaaccacatcttctggaccctgccccacgagtactgcgccatgccccaggtggcccccgacctgtacgccgagctgcagaaggcccacctgatcctgttcaagggcgacctgaactacagaaagctgaccggcgacagaaagtgggagttcagcgtgcccttccaccaggccctgaacggcttccaccccgcccccctgtgcaccatcagaaccctgaaggccgagatccaggtgggcctgcagcccggccagggcgagcagctgctggccagcgagcccagctggtggaccaccggcaagtacggcatcttccagtacgacggccccctgtag

SEQ ID NO: 19462 - DNA, 1959 bp, Artificial Sequence
  Description of Artificial Sequence: Synthetic coding sequence
atggagaaccccagatgccccagaagacccctggccgagaagaaggccagaagcctggacagaccccaggcccccggcaagggcagcgagagctgggactgccactggctgagcctgcccaccgcccccagcagaaaggccctgcactggaccaccagcgactgggccagacacagcgacagccccgcccccagcgccgaggcccactgcaccaccgccgccgcccccacccccgaggagaccggcgacttcctgcccagcgagcagagacccagccaggacaccaagaagggctggctgaagaccatgctgaacttcttcgtgagaaccggccccgaggagcccagagagaaggccagcagaagacccagaggcaaggagggcatcagccagcaccccgagcccctggaggccgccggcgagcccgccctgagaaagaaggcccaccacgacaagaagcccagcagaaagaagcagggccacaagaagcacgccgccgaggtgaccaaggccgcccaggaccaggaggccagaggcagagaggagggcctgagcaaggccgccgccgccctgagaagcggcgaggccgacctgggccccgccagaagaggcggcgaggacagcgaccaccagagcttcctgatcaaggtggacggcaccggcgccctggacgtgagcccccacgccaccggccaccagcaggaggaggagctgaagaagcccgaccaggacgccatcatccagatgatcgtggagctgctgaagagagtgggcgaccagtgggaggaggagcagagcctggccagccagctgggcgtggccctgcccaaccccgcccccgccgtgagaaagaagagccaggagaagaagaccagcctgaagagaaccagcaagaccaaccccaagaagcacggcagcgaggaggccaagagaggcgccgccgacgtgagcagccccgaggcctggccccccaagaagagcagcttcctgcccctgtgcgtgagcggccacagacccagcatcagcagcagctacggcctggaggagcccaaggtgcaggaggcccccagcaccgaggccggcgcccccggccccagcgtgctgcccacccccagcgagagccaggagcccggcgaggagctgcccctggacagagccagcgagtacaaggagttcatccagaagatcatcagcatgctgcaggacgccgaggagcagcagggcgaggagcagccccaggtgcagcaggaggaggtgggcgtggagaaccccgccccccactgcagaagaaagagccaggagaagagaagcagcttcagaagagccttctaccacaagaagcacaccagcaaggagcccagaagagccggcgccgccggcgccgccagccccgaggccagaagacccaagagacccagcttcctgcccctgtgcgtgggcggccacagacccagcaccagcagcagcctggaccccgaggacctggagtgcagagagcccctgcccgccgagggcgagcccgtggtgatcagcgaggcccccagccaggccagaggccacacccccgagggcgccccccagctgagcggcgcctgcgagagcaaggagatcatcatccagaagctggtggccctgctgcaggaggtggacggccagctgggccagcagatcagaagacaccccagcttcaagagattcttctacgagttcagcgacagcagcctgagcaagctggtggccaccctgagaagccaggtggcccacagcagcaagctggacagaaacagagccagaagactgtaccagttcgacgtgagcctggccaacaagttcgccggcagcaacagccacgccatgtgcatcctgatgggcctgagagaccactacaactgcacccagttcccctacagagaggaccagcccaacatcaccagccccaaggtggagagccccgactag

SEQ ID NO: 19463 - DNA, 729 bp, Artificial Sequence
  Description of Artificial Sequence: Synthetic coding sequence
atgatgcccctggccgaggccggcgccctggcccagggcggcggccccagcgccaccgagtgggcctgcatcctgagaagaaagacccccagacacaagcagcccaccctgctgatggtgagagccagcagaagaagcggcaagaccagcgccgtgctgaaggccggcagacagagcgtgagcggcagaaagaacagcaccagcaaggacctggtgaccctgggcgccagcagcctgagagaggagagaggccaccccctgcaccccagacacagaaaggccgtgcacctgagaaccagaggcagaaccagaggctgggtgcagaccctggccagaatgagcagaagaaccagaggccccgtggagagagccgccgccgccgccgccgccgccgccggcggcgacgccggccacgcccccttcccccccccccccgccgccgacggcgccagagcccccagaagccccggccaggtgacccccagaggcctgagactgagactgcccagaagagagagcctgctgagaggcctgtgcagacccctgagacccctgctgggcttcagagagagcgacagcgccaagcccgccagcctgagactgctgcagcacacccccagcgccagaagaaactacagaatcgccggcgccagactgatgagaagcaactaccccccccccctgagcagcgccgccctgagaggcgccggccccaccagaagaaactag

SEQ ID NO: 19464 - DNA, 318 bp, Artificial Sequence
  Description of Artificial Sequence: Synthetic coding sequence
atgatgcccctggccgaggccggcgccctggcccagggcggcggccccagcgccaccgagtgggcctgcatcctgagaagactgctgagaaaggagggcgtggacggcggcctgttcagccccgaggacccccaggcccaggccgcccacctgaccgacggccagagcatccagaagaagtggcaggacttcagctgcccccagagcagaaagaccgagtgcttctggcagaaggagcagcacaagcagagaagcggcaaccccagatgcctgcagttcgagggcggcgagagaacccccccccccccccagacctag

SEQ ID NO: 19465 - DNA, 243 bp, Artificial Sequence
  Description of Artificial Sequence: Synthetic coding sequence
atgcccttccagttcggcacccagcccagaagattccccgtggagggcggcgacagcagcatcgagctggagcccggcctgagcagcagcgccgcctgcaacggcaaggagatgagccccaccagacagctgagaagatgccccggcagccactgcctgaccatcaccgacgtgcccgtgaccgtgtacgccaccaccagaaagccccccgcccagagcagcaaggagatgcaccccaagtag

SEQ ID NO: 19466 - DNA, 306 bp, Artificial Sequence
  Description of Artificial Sequence: Synthetic coding sequence
atggagagacccagaagcccccagtgcagcgcccccgccagcgccagcgccagcgtgaccctggcccagctgctgcagctggtgcagcagggccaggagctgcccggcctggagaagagacacatcgccgccatccacggcgagcccaccgccagcagactgcccagaagacccaagccctgggaggccgccgccctggccgagagcctgcccccccccaccctgagaatcggcaccgcccccgccgagcccggcctggtggaggccgccaccgcccccagcagctggcacaccgtgggcccctag

SEQ ID NO: 19467 - DNA, 276 bp, Artificial Sequence
  Description of Artificial Sequence: Synthetic coding sequence
atgtggcacagcgtgggcctgaccctgctggtgttcgtggccaccctgctgatcgtgctgctgctgatggtgtgcggctggtacttcgtgtggcacctgttcctgagcaagttcaagttcctgagagagctggtgggcgacaccggcagccaggagggcgaccacgagcccagcggcagcgagaccgaggaggacaccagcagcagcccccacagaatcagaagcgccagacagagaagagcccccgccgacgagggccacagacccctgacctag

SEQ ID NO: 19468 - DNA, 582 bp, Artificial Sequence
  Description of Artificial Sequence: Synthetic coding sequence
atggccgtgttcctgcagctgctgcccctgctgctgagcagagcccagggcaaccccggcgccagcctggacggcagacccggcgacagagtgaacctgagctgcggcggcgtgagccaccccatcagatgggtgtgggcccccagcttccccgcctgcaagggcctgagcaagggcagaagacccatcctgtgggccagcagcagcggcacccccaccgtgccccccctgcagcccttcgtgggcagactgagaagcctggacagcggcatcagaagactggagctgctgctgagcgccggcgacagcggcaccttcttctgcaagggcagacacgaggacgagagcagaaccgtgctgcacgtgctgggcgacagaacctactgcaaggcccccggccccacccacgccctgagccccccccacagcagcacctgcgagaacagagcccccgaggccagcaagggcggcagagcccaggacagcagaggccccggccccggcaccgagcccgccctgtgcggcagcggccccagcagcccccagcaggccccccccgccgtgcacagcggcccctgctag

SEQ ID NO: 19469 - DNA, 594 bp, Artificial Sequence
  Description of Artificial Sequence: Synthetic coding sequence
atggccgtgttcctgcagctgctgcccctgctgctgagcagagcccagggcaaccccggcgccagcctggacggcagacccggcgacagagtgaacctgagctgcggcggcgtgagccaccccatcagatgggtgtgggcccccagcttccccgcctgcaagggcctgagcaagggcagaagacccatcctgtgggccagcagcagcggcacccccaccgtgccccccctgcagcccttcgtgggcagactgagaagcctggacagcggcatcagaagactggagctgctgctgagcgccggcgacagcggcaccttcttctgcaagggcagacacgaggacgagagcagaaccgtgctgcacgtgctgggcgacagaacctactgcaaggcccccggccccacccacgcccccctggtgaagaccgagccccagagacccgtgaaggaggaggagcccaagatccccggcgacctggaccaggagcccagcctgctgtacgccgacctggaccacctggccctgagcagacccagaagactgagcaccgccgaccccgccgacgccagcaccatctacgccgtggtggtgtag

SEQ ID NO: 19470 - DNA, 714 bp, Artificial Sequence
  Description of Artificial Sequence: Synthetic coding sequence
atggccgtgttcctgcagctgctgcccctgctgctgagcagagcccagggcaaccccggcgccagcctggacggcagacccggcgacagagtgaacctgagctgcggcggcgtgagccaccccatcagatgggtgtgggcccccagcttccccgcctgcaagggcctgagcaagggcagaagacccatcctgtgggccagcagcagcggcacccccaccgtgccccccctgcagcccttcgtgggcagactgagaagcctggacagcggcatcagaagactggagctgctgctgagcgccggcgacagcggcaccttcttctgcaagggcagacacgaggacgagagcagaaccgtgctgcacgtgctgggcgacagaacctactgcaaggcccccggccccacccacggcagcgtgtacccccagctgctgatccccctgctgggcgccggcctggtgctgggcctgggcgccctgggcctggtgtggtggctgcacagaagactgcccccccagcccatcggccccctgcccagattcgccctgagccccccccacagcagcacctgcgagaacagagcccccgaggccagcaagggcggcagagcccaggacagcagaggccccggccccggcaccgagcccgccctgtgcggcagcggccccagcagcccccagcaggccccccccgccgtgcacagcggcccctgctag

SEQ ID NO: 19471 - DNA, 726 bp, Artificial Sequence
  Description of Artificial Sequence: Synthetic coding sequence
atggccgtgttcctgcagctgctgcccctgctgctgagcagagcccagggcaaccccggcgccagcctggacggcagacccggcgacagagtgaacctgagctgcggcggcgtgagccaccccatcagatgggtgtgggcccccagcttccccgcctgcaagggcctgagcaagggcagaagacccatcctgtgggccagcagcagcggcacccccaccgtgccccccctgcagcccttcgtgggcagactgagaagcctggacagcggcatcagaagactggagctgctgctgagcgccggcgacagcggcaccttcttctgcaagggcagacacgaggacgagagcagaaccgtgctgcacgtgctgggcgacagaacctactgcaaggcccccggccccacccacggcagcgtgtacccccagctgctgatccccctgctgggcgccggcctggtgctgggcctgggcgccctgggcctggtgtggtggctgcacagaagactgcccccccagcccatcggccccctgcccagattcgcccccctggtgaagaccgagccccagagacccgtgaaggaggaggagcccaagatccccggcgacctggaccaggagcccagcctgctgtacgccgacctggaccacctggccctgagcagacccagaagactgagcaccgccgaccccgccgacgccagcaccatctacgccgtggtggtgtag

SEQ ID NO: 19472 - DNA, 654 bp, Artificial Sequence
  Description of Artificial Sequence: Synthetic coding sequence
atggccgtgttcctgcagctgctgcccctgctgctgagcagagcccagggcaaccccggcgccagcctggacggcagacccggcgacagagtgaacctgagctgcggcggcgtgagccaccccatcagatgggtgtgggcccccagcttccccgcctgcaagggcctgagcaagggcagaagacccatcctgtgggccagcagcagcggcacccccaccgtgccccccctgcagcccttcgtgggcagactgagaagcctggacagcggcatcagaagactggagctgctgctgagcgccggcgacagcggcaccttcttctgcaagggcagacacgaggacgagagcagaaccgtgctgcacgtgctgggcgacagaacctactgcaaggcccccggccccacccacggcgcctgccccagaaacagactggaccacagcctggacctgctgtgccccccccacatcgcccccctggtgaagaccgagccccagagacccgtgaaggaggaggagcccaagatccccggcgacctggaccaggagcccagcctgctgtacgccgacctggaccacctggccctgagcagacccagaagactgagcaccgccgaccccgccgacgccagcaccatctacgccgtggtggtgtag

SEQ ID NO: 19473 - DNA, 885 bp, Artificial Sequence
  Description of Artificial Sequence: Synthetic coding sequence
atgttcctgagaagactgggcggctggctgcccagaccctggggcagaagaaagcccatgagacccgaccccccctaccccgagcccagaagagtggacagcagcagcgagaacagcggcagcgactgggacagcgcccccgagaccatggaggacgtgggccaccccaagaccaaggacagcggcgccctgagagtgagcagagccgccagcgagcccagcaaggaggagccccaggtggagcagctgggcagcaagagaatggacagcctgaagtgggaccagcccatcagcagcacccaggagagcggcagactggaggccggcggcgccagccccaagctgagatgggaccacgtggacagcggcggcaccagaagacccggcgtgagccccgagggcggcctgagcgtgcccggccccggcgcccccctggagaagcccggcagaagagagaagctgctgggctggctgagaggcgagcccggcgcccccagcagatacctgggcggccccgaggagtgcctgcagatcagcaccaacctgaccctgcacctgctggagctgctggccagcgccctgctggccctgtgcagcagacccctgagagccgccctggacaccctgggcctgagaggccccctgggcctgtggctgcacggcctgctgagcttcctggccgccctgcacggcctgcacgccgtgctgagcctgctgaccgcccaccccctgcacttcgcctgcctgttcggcctgctgcaggccctggtgctggccgtgagcctgagagagcccaacggcgacgaggccgccaccgactgggagagcgagggcctggagagagagggcgaggagcagagaggcgaccccggcaagggcctgtag

SEQ ID NO: 19474 - DNA, 885 bp, Artificial Sequence; identical to SEQ ID NO: 19473
  Description of Artificial Sequence: Synthetic coding sequence

SEQ ID NO: 19475 - DNA, 885 bp, Artificial Sequence
  Description of Artificial Sequence: Synthetic coding sequence
atgttcctgagaagactgggcggctggctgcccagaccctggggcagaagaaagcccatgagacccgaccccccctaccccgagcccagaagagtggacagcagcagcgagaacagcggcagcgactgggacagcgcccccgagaccatggaggacgtgggccaccccaagaccaaggacagcggcgccctgagagtgagcggcgccgccagcgagcccagcaaggaggagccccaggtggagcagctgggcagcaagagaatggacagcctgaagtgggaccagcccatcagcagcacccaggagagcggcagactggaggccggcggcgccagccccaagctgagatgggaccacgtggacagcggcggcaccagaagacccggcgtgagccccgagggcggcctgagcgtgcccggccccggcgcccccctggagaagcccggcagaagagagaagctgctgggctggctgagaggcgagcccggcgcccccagcagatacctgggcggccccgaggagtgcctgcagatcagcaccaacctgaccctgcacctgctggagctgctggccagcgccctgctggccctgtgcagcagacccctgagagccgccctggacaccctgggcctgagaggccccctgggcctgtggctgcacggcctgctgagcttcctggccgccctgcacggcctgcacgccgtgctgagcctgctgaccgcccaccccctgcacttcgcctgcctgttcggcctgctgcaggccctggtgctggccgtgagcctgagagagcccaacggcgacgaggccgccaccgactgggagagcgagggcctggagagagagggcgaggagcagagaggcgaccccggcaagggcctgtag

SEQ ID NO: 19476 - DNA, 885 bp, Artificial Sequence; identical to SEQ ID NO: 19473
  Description of Artificial Sequence: Synthetic coding sequence

SEQ ID NO: 19477 - DNA, 885 bp, Artificial Sequence; identical to SEQ ID NO: 19473
  Description of Artificial Sequence: Synthetic coding sequence

SEQ ID NO: 19478 - DNA, 885 bp, Artificial Sequence; identical to SEQ ID NO: 19473
  Description of Artificial Sequence: Synthetic coding sequence

SEQ ID NO: 19479 - DNA, 885 bp, Artificial Sequence; identical to SEQ ID NO: 19475
  Description of Artificial Sequence: Synthetic coding sequence

SEQ ID NO: 19480 - DNA, 936 bp, Artificial Sequence
  Description of Artificial Sequence: Synthetic coding sequence
atgttcctgagaagactgggcggctggctgcccagaccctggggcagaagaaagcccatgagacccgaccccccctaccccgagcccagaagagtggacagcagcagcgagaacagcggcagcgactgggacagcgcccccgagaccatggaggacgtgggccaccccaagaccaaggacagcggcgccctgagagtgagcggcgccgccagcgagcccagcaaggaggagccccaggtggagcagctgggcagcaagagaatggacagcctgaagtgggaccagcccatcagcagcacccaggagagcggcagactggaggccggcggcgccagccccaagctgagatgggaccacgtggacagcggcggcaccagaagacccggcgtgagccccgagggcggcctgagcgtgcccggccccggcgcccccctggagaagcccggcagaagagagaagctgctgggctggctgagaggcgagcccggcgcccccagcagatacctgggcggccccgaggagtgcctgcagatcagcaccaacctgaccctgcacctgctggagctgctggccagcgccctgctggccctgtgcagcagacccctgagagccgccctggacaccctgggcctgagaggccccctgggcctgtggctgcacggcctgctgagcttcctggccgccctgcacggcctgcacgccgtgctgagcctgctgaccgcccaccccctgcacttcgcctgcctgttcggcctgctgcaggccctggtgctggccgtgagcggcagccccatgggcatgagaagacccctgaccggcagagtgagaggctggagaggcaaggtgagaagcagaggcgagaccagagagagaggctgcgacagaggcgtgggcgccaagggcgaggagagcgtgggcttcagaagaaaggtgtag

SEQ ID NO: 19481 - DNA, 228 bp, Artificial Sequence
  Description of Artificial Sequence: Synthetic coding sequence
atggagagaagcttcgtgtggctgagctgcctggacagcgacagctgcaacctgaccttcagactgggcgaggtggagagccacgcctgcagccccagcctgctgtggaacctgctgacccagtacctgccccccggcgccggccacatcctgagaacctacaacttccccgtgctgagctgcgtgagcagctgccacctgatcggcggcaagatgcccgagaactag

SEQ ID NO: 19482 - DNA, 228 bp, Artificial Sequence; identical to SEQ ID NO: 19481
  Description of Artificial Sequence: Synthetic coding sequence

SEQ ID NO: 19483 - DNA, 378 bp, Artificial Sequence
  Description of Artificial Sequence: Synthetic coding sequence
atgagagtggtgatggccagactgctgagcgagggcgagcagggcatccccaccgcctgcgccgccttcgcccagcagcccgccggccccagaagaggcctggccggcgtgggcgagggcggcccccagtgcagctgggtgaactacagatgcaccctggagttcctggtgagcctgctgggcaccgacctggccagaggcagaggcaacagcgccagcggccccaccgcccccgccgacagcaagcagctgatgaacagcggcagccccgccagagacaacgcccccagccagagattctgcaccaacctgagcgagggcctgagattcggcatcagccccagctggagagaggccctgtacggctgccacgcctag

SEQ ID NO: 19484 - DNA, 228 bp, Artificial Sequence; identical to SEQ ID NO: 19481
  Description of Artificial Sequence: Synthetic coding sequence

SEQ ID NO: 19485 - DNA, 228 bp, Artificial Sequence; identical to SEQ ID NO: 19481
  Description of Artificial Sequence: Synthetic coding sequence

SEQ ID NO: 19486 - DNA, 228 bp, Artificial Sequence; identical to SEQ ID NO: 19481
  Description of Artificial Sequence: Synthetic coding sequence

SEQ ID NO: 19487 - DNA, 228 bp, Artificial Sequence; identical to SEQ ID NO: 19481
  Description of Artificial Sequence: Synthetic coding sequence

SEQ ID NO: 19488 - DNA, 228 bp, Artificial Sequence; identical to SEQ ID NO: 19481
  Description of Artificial Sequence: Synthetic coding sequence

SEQ ID NO: 19489 - DNA, 228 bp, Artificial Sequence; identical to SEQ ID NO: 19481
  Description of Artificial Sequence: Synthetic coding sequence

SEQ ID NO: 19490 - DNA, 228 bp, Artificial Sequence; identical to SEQ ID NO: 19481
  Description of Artificial Sequence: Synthetic coding sequence

SEQ ID NO: 19491 - DNA, 228 bp, Artificial Sequence; identical to SEQ ID NO: 19481
  Description of Artificial Sequence: Synthetic coding sequence

SEQ ID NO: 19492 - DNA, 228 bp, Artificial Sequence; identical to SEQ ID NO: 19481
  Description of Artificial Sequence: Synthetic coding sequence

SEQ ID NO: 19493 - DNA, 228 bp, Artificial Sequence; identical to SEQ ID NO: 19481
  Description of Artificial Sequence: Synthetic coding sequence

SEQ ID NO: 19494 - DNA, 228 bp, Artificial Sequence; identical to SEQ ID NO: 19481
  Description of Artificial Sequence: Synthetic coding sequence

SEQ ID NO: 19495 - DNA, 228 bp, Artificial Sequence; identical to SEQ ID NO: 19481
  Description of Artificial Sequence: Synthetic coding sequence

SEQ ID NO: 19496 - DNA, 228 bp, Artificial Sequence; identical to SEQ ID NO: 19481
  Description of Artificial Sequence: Synthetic coding sequence

SEQ ID NO: 19497 - DNA, 228 bp, Artificial Sequence; identical to SEQ ID NO: 19481
  Description of Artificial Sequence: Synthetic coding sequence

SEQ ID NO: 19498 - DNA, 228 bp, Artificial Sequence; identical to SEQ ID NO: 19481
  Description of Artificial Sequence: Synthetic coding sequence

SEQ ID NO: 19499 - DNA, 228 bp, Artificial Sequence; identical to SEQ ID NO: 19481
  Description of Artificial Sequence: Synthetic coding sequence

SEQ ID NO: 19500 - DNA, 228 bp, Artificial Sequence; identical to SEQ ID NO: 19481
  Description of Artificial Sequence: Synthetic coding sequence

SEQ ID NO: 19501 - DNA, 228 bp, Artificial Sequence; identical to SEQ ID NO: 19481
  Description of Artificial Sequence: Synthetic coding sequence

SEQ ID NO: 19502 - DNA, 228 bp, Artificial Sequence; identical to SEQ ID NO: 19481
  Description of Artificial Sequence: Synthetic coding sequence

SEQ ID NO: 19503 - DNA, 228 bp, Artificial Sequence; identical to SEQ ID NO: 19481
  Description of Artificial Sequence: Synthetic coding sequence

SEQ ID NO: 19504 - DNA, 228 bp, Artificial Sequence; identical to SEQ ID NO: 19481
  Description of Artificial Sequence: Synthetic coding sequence

SEQ ID NO: 19505 - DNA, 228 bp, Artificial Sequence; identical to SEQ ID NO: 19481
  Description of Artificial Sequence: Synthetic coding sequence

SEQ ID NO: 19506 - DNA, 228 bp, Artificial Sequence; identical to SEQ ID NO: 19481
  Description of Artificial Sequence: Synthetic coding sequence

SEQ ID NO: 19507 - DNA, 228 bp, Artificial Sequence; identical to SEQ ID NO: 19481
  Description of Artificial Sequence: Synthetic coding sequence

SEQ ID NO: 19508 - DNA, 228 bp, Artificial Sequence; identical to SEQ ID NO: 19481
  Description of Artificial Sequence: Synthetic coding sequence

SEQ ID NO: 19509 - DNA, 228 bp, Artificial Sequence; identical to SEQ ID NO: 19481
  Description of Artificial Sequence: Synthetic coding sequence

SEQ ID NO: 19510 - DNA, 228 bp, Artificial Sequence; identical to SEQ ID NO: 19481
  Description of Artificial Sequence: Synthetic coding sequence

SEQ ID NO: 19511 - DNA, 228 bp, Artificial Sequence; identical to SEQ ID NO: 19481
  Description of Artificial Sequence: Synthetic coding sequence

SEQ ID NO: 19512 - DNA, 228 bp, Artificial Sequence; identical to SEQ ID NO: 19481
  Description of Artificial Sequence: Synthetic coding sequence

SEQ ID NO: 19513 - DNA, 228 bp, Artificial Sequence; identical to SEQ ID NO: 19481
  Description of Artificial Sequence: Synthetic coding sequence

SEQ ID NO: 19514 - DNA, 228 bp, Artificial Sequence; identical to SEQ ID NO: 19481
  Description of Artificial Sequence: Synthetic coding sequence

SEQ ID NO: 19515 - DNA, 228 bp, Artificial Sequence; identical to SEQ ID NO: 19481
  Description of Artificial Sequence: Synthetic coding sequence

SEQ ID NO: 19516 - DNA, 228 bp, Artificial Sequence; identical to SEQ ID NO: 19481
  Description of Artificial Sequence: Synthetic coding sequence

SEQ ID NO: 19517 - DNA, 228 bp, Artificial Sequence; identical to SEQ ID NO: 19481
  Description of Artificial Sequence: Synthetic coding sequence

SEQ ID NO: 19518 - DNA, 228 bp, Artificial Sequence; identical to SEQ ID NO: 19481
  Description of Artificial Sequence: Synthetic coding sequence

SEQ ID NO: 19519 - DNA, 228 bp, Artificial Sequence; identical to SEQ ID NO: 19481
  Description of Artificial Sequence: Synthetic coding sequence

SEQ ID NO: 19520 - DNA, 228 bp, Artificial Sequence; identical to SEQ ID NO: 19481
  Description of Artificial Sequence: Synthetic coding sequence

SEQ ID NO: 19521 - DNA, 228 bp, Artificial Sequence; identical to SEQ ID NO: 19481
  Description of Artificial Sequence: Synthetic coding sequence

SEQ ID NO: 19522 - DNA, 228 bp, Artificial Sequence; identical to SEQ ID NO: 19481
  Description of Artificial Sequence: Synthetic coding sequence

SEQ ID NO: 19523 - DNA, 228 bp, Artificial Sequence; identical to SEQ ID NO: 19481
  Description of Artificial Sequence: Synthetic coding sequence

SEQ ID NO: 19524 - DNA, 228 bp, Artificial Sequence; identical to SEQ ID NO: 19481
  Description of Artificial Sequence: Synthetic coding sequence

SEQ ID NO: 19525 - DNA, 228 bp, Artificial Sequence; identical to SEQ ID NO: 19481
  Description of Artificial Sequence: Synthetic coding sequence

SEQ ID NO: 19526 - DNA, 228 bp, Artificial Sequence; identical to SEQ ID NO: 19481
  Description of Artificial Sequence: Synthetic coding sequence

SEQ ID NO: 19527 - DNA, 297 bp, Artificial Sequence
  Description of Artificial Sequence: Synthetic coding sequence
atgagagtggtgatggccagactgctgagcgagggcgagcagggcatccccaccgcctgcgccgccttcgcccagcagcccgccggccccagaagaggcctggccggcgtgggcgagggcggcccccagtgcagctgggtgaactacagatgcaccctggagttcctggtgagcctgctgggcaccgacctggccagaggcagaggcaacagcgccagcggccccaccgcccccgccgacagcaagcagctgagctgcaagaccttcatcgccgtgctgagcctgagcaaggagtag

SEQ ID NO: 19528 - DNA, 378 bp, Artificial Sequence; identical to SEQ ID NO: 19483
  Description of Artificial Sequence: Synthetic coding sequence

SEQ ID NO: 19529 - DNA, 297 bp, Artificial Sequence; identical to SEQ ID NO: 19527
  Description of Artificial Sequence: Synthetic coding sequence

SEQ ID NO: 19530 - DNA, 378 bp, Artificial Sequence; identical to SEQ ID NO: 19483
  Description of Artificial Sequence: Synthetic coding sequence

SEQ ID NO: 19531 - DNA, 297 bp, Artificial Sequence; identical to SEQ ID NO: 19527
  Description of Artificial Sequence: Synthetic coding sequence

SEQ ID NO: 19532 - DNA, 297 bp, Artificial Sequence; identical to SEQ ID NO: 19527
  Description of Artificial Sequence: Synthetic coding sequence

SEQ ID NO: 19533 - DNA, 378 bp, Artificial Sequence; identical to SEQ ID NO: 19483
  Description of Artificial Sequence: Synthetic coding sequence

SEQ ID NO: 19534 - DNA, 378 bp, Artificial Sequence; identical to SEQ ID NO: 19483
  Description of Artificial Sequence: Synthetic coding sequence

SEQ ID NO: 19535 - DNA, 297 bp, Artificial Sequence; identical to SEQ ID NO: 19527
  Description of Artificial Sequence: Synthetic coding sequence

SEQ ID NO: 19536 - DNA, 459 bp, Artificial Sequence
  Description of Artificial Sequence: Synthetic coding sequence
atggcccagcccgagagcagcgccgacttcggcatcgcccagcagaacaactactactgctactggcagagcctgcccagcgccatcagagtgaagcaggagttccagcccagccagagctacagatacggcaactggtacgccagacagcacggcagctacctgctgagcggctacagctacggctgcgccgtggacggcaacggcaaggactgcttcagcgcccacgagacccccgagcacaccgccggcaccctggtgatgcccaaggagaccacccccctggccgagaaccaggacgaggaccccctggaggacccccacctgcacctgaacatcgaggagagcaaccaggagttcatggtgaagagcgaggagctgtacgacagcctgatgaactgccactggcagcccctggacaccgtgcacagcgagatccccgacgagacccccaagtag

SEQ ID NO: 19537 - DNA, 198 bp, Artificial Sequence
  Description of Artificial Sequence: Synthetic coding sequence
atgcccaaggagaccacccccctggccgagaaccaggacgaggaccccctggaggacccccacctgcacctgaacatcgaggagagcaaccaggagttcatggtgaagagcgaggagctgtacgacagcctgatgaactgccactggcagcccctggacaccgtgcacagcgagatccccgacgagacccccaagtag

SEQ ID NO: 19538 - DNA, 603 bp, Artificial Sequence
  Description of Artificial Sequence: Synthetic coding sequence
atgagcgagaacctgagcgaccccgtgagccccgtggtgagaaagaagaagagcgccctgttcgaggtgagcgaggtgatccccgtgatgaccaacaactacgaggagaacatcctgaagggcgtgagagacagcagctacagcctggagagcagcctggagctgctgcagaaggacgtggtgcagctgcacgcccccagataccagagcatgagaagagacgtgatcggctgcacccaggagatggacttcatcctgtggcccagaaacgacatcgagaagatcgtgtgcctgctgttcagcagatggaaggagagcgacgagcccttcagacccgtgcaggccaagttcgagttccaccacggcgactacgagaagcagttcctgcacgtgctgagcagaaaggacaagaccggcatcgtggtgaacaaccccaaccagagcgtgttcctgttcatcgacagacagcacctgcagacccccaagaacaaggccaccatcttcaagctgtgcagcatctgcctgtacctgccccaggagcagctgacccactgggccgtgggcaccatcgaggaccacctgagaccctacatgcccgagtag

SEQ ID NO: 19539 - DNA, 690 bp, Artificial Sequence
  Description of Artificial Sequence: Synthetic coding sequence
atgggcgaccccaacagcagaaagaagcaggccctgaacagactgagagcccagctgagaaagaagaaggagagcctggccgaccagttcgacttcaagatgtacatcgccttcgtgttcaaggagaagaagaagaagagcgccctgttcgaggtgagcgaggtgatccccgtgatgaccaacaactacgaggagaacatcctgaagggcgtgagagacagcagctacagcctggagagcagcctggagctgctgcagaaggacgtggtgcagctgcacgcccccagataccagagcatgagaagagacgtgatcggctgcacccaggagatggacttcatcctgtggcccagaaacgacatcgagaagatcgtgtgcctgctgttcagcagatggaaggagagcgacgagcccttcagacccgtgcaggccaagttcgagttccaccacggcgactacgagaagcagttcctgcacgtgctgagcagaaaggacaagaccggcatcgtggtgaacaaccccaaccagagcgtgttcctgttcatcgacagacagcacctgcagacccccaagaacaaggccaccatcttcaagctgtgcagcatctgcctgtacctgccccaggagcagctgacccactgggccgtgggcaccatcgaggaccacctgagaccctacatgcccgagtag

SEQ ID NO: 19540 - DNA, 516 bp, Artificial Sequence
  Description of Artificial Sequence: Synthetic coding sequence
atgaccaacaactacgaggagaacatcctgaagggcgtgagagacagcagctacagcctggagagcagcctggagctgctgcagaaggacgtggtgcagctgcacgcccccagataccagagcatgagaagagacgtgatcggctgcacccaggagatggacttcatcctgtggcccagaaacgacatcgagaagatcgtgtgcctgctgttcagcagatggaaggagagcgacgagcccttcagacccgtgcaggccaagttcgagttccaccacggcgactacgagaagcagttcctgcacgtgctgagcagaaaggacaagaccggcatcgtggtgaacaaccccaaccagagcgtgttcctgttcatcgacagacagcacctgcagacccccaagaacaaggccaccatcttcaagctgtgcagcatctgcctgtacctgccccaggagcagctgacccactgggccgtgggcaccatcgaggaccacctgagaccctacatgcccgagtag

SEQ ID NO: 19541 - DNA, 669 bp, Artificial Sequence
  Description of Artificial Sequence: Synthetic coding sequence
atggccggcgccgagcccttcctggccgacggcaaccaggagctgttcccctgcgaggtgtgcggcagaagattcgccgccgacgtgctggagagacacggccccatctgcaagaagctgttcaacagaaagagaaagcccttcagcagcctgaagcagagactgcagggcaccgacatccccaccgtgaagaagaccccccagagcaagagcccccccgtgagaaagagcaactggagacagcagcacgaggacttcatcaacgccatcagaagcgccaagcagtgcatgctggccatcaaggagggcagacccctgccccccccccccccccccagcctgaaccccgactacatccagagaccctactgcatgagaagattcaacgagagcgccgccgagagacacaccaacttctgcaaggaccagagcagcagaagagtgttcaaccccgcccagaccgccgccaagctggccagcagagcccagggcagagcccagatgggccccaagaaggagcccaccgtgaccagcgccgtgggcgccctgctgcagaacagagtgctggtggccaccaacgaggtgcccaccaagagcggcctggccatggaccccgccagcggcgccaagctgagacagggcttcagcaagagcagcaagaaggactag

SEQ ID NO: 19542 - DNA, 465 bp, Artificial Sequence
  Description of Artificial Sequence: Synthetic coding sequence
tgaggcaaccaggagctgttcccctgcgaggtgtgcggcagaagattcgccgccgacgtgctggagagacacggccccatctgcaagaagctgttcaacagaaagagaaagcccttcagcagcctgaagcagagactgcagggcaccgacatccccaccgtgaagaagaccccccagagcaagagcccccccgtgagaaagagcaactggagacagcagcacgaggacttcatcaacgccatcagaagcgccaagcagtgcatgctggccatcaaggagggcagacccctgccccccccccccccccccagcctgaaccccgactacatccagagaccctactgcatgagaagattcaacgagagcgccgccgagagacacaccaacttctgcaaggaccagagcagcagaagagtgttcaaccccgcccagaccgccgccaagctggccagcagagcccagtag

SEQ ID NO: 19543 - DNA, 348 bp, Artificial Sequence
  Description of Artificial Sequence: Synthetic coding sequence
cccccccccccccccagcctgaaccccgactacatccagagaccctactgcatgagaagattcaacgagagcgccgccgagagacacaccaacttctgcaaggaccagagcagcagaagagtgttcaaccccgcccagaccgccgccaagctggccagcagagcccagggcagagcccagatgggccccaagaaggagcccaccgtgaccagcgccgtgggcgccctgctgcagaacagagtgctggtggccaccaacgaggtgcccaccaagagcggcctggccatggaccccgccagcggcgccaagctgagacagggcttcagcaagagcagcaagaaggactag

SEQ ID NO: 19544 - DNA, 381 bp, Artificial Sequence
  Description of Artificial Sequence: Synthetic coding sequence
atgctggccatcaaggagggcagacccctgccccccccccccccccccagcctgaaccccgactacatccagagaccctactgcatgagaagattcaacgagagcgccgccgagagacacaccaacttctgcaaggaccagagcagcagaagagtgttcaaccccgcccagaccgccgccaagctggccagcagagcccagggcagagcccagatgggccccaagaaggagcccaccgtgaccagcgccgtgggcgccctgctgcagaacagagtgctggtggccaccaacgaggtgcccaccaagagcggcctggccatggaccccgccagcggcgccaagctgagacagggcttcagcaagagcagcaagaaggactag

SEQ ID NO: 19545 - DNA, 2148 bp, Artificial Sequence
  Description of Artificial Sequence: Synthetic coding sequence
atgagcctggactgcaccagccacatcgccctgggcgccgccagccccgcccccgaggagacctacgaccacctgagcgaggtgcccgtgaccagagagcagctgaaccactacagaaacgtggcccagaacgccagaagcgagctggccgccaccctggtgaagttcgagtgcgcccagagcgagctgcaggacctgagaagcaagatgctgagcaaggaggtgagctgccaggagctgaaggccgagatggagagctacaaggagaacaacgccagaaagagcagcctgctgaccagcctgagagacagagtgcaggagctggaggaggagagcgccgccctgagcaccagcaagatcagaaccgagatcaccgcccacgccgccatcaaggagaaccaggagctgaagaagaaggtggtggagctgaacgagaagctgcagaagtgcagcaaggagaacgaggagaacaagaagcaggtgagcaagaactgcagaaagcacgaggagttcctgacccagctgagagactgcctggaccccgacgagagaaacgacaaggccagcgacgaggacctgatcctgaagctgagagacctgagaaaggagaacgagttcgtgaagggccagatcgtgatcctggaggagaccatcaacgtgcacgagatggaggccaaggccagcagagagaccatcatgagactggccagcgaggtgaacagagagcagaagaaggccgccagctgcaccgaggagaaggagaagctgaaccaggacctgctgagcgccgtggaggccaaggaggccctggagagagaggtgaagatcttccaggagagactgctggccggccagcaggtgtgggacgccagcaagcaggaggtgagcctgctgaagaagagcagcagcgagctggagaagagcctgaaggccagccaggacgccgtgaccaccagccagagccagtacttcagcttcagagagaagatcgccgccctgctgagaggcagactgagcatgaccggcagcaccgaggacaccatcctggagaagatcagagagatggacagcagagaggagagcagagacagaatggtgagccagctggaggcccagatcagcgagctggtggagcagctgggcaaggagagcggcttccaccagaaggccctgcagagagcccagaaggccgagaacatgctggagaccctgcagggccagctgacccacctggaggccgagctggtgagcggcggcgtgctgagagacaacctgaacttcgagaagcagaagtacctgaagttcctggaccagctgagccagaagatgaagctggaccagatggccgccgagctgggcttcgacatgagactggacgtggtgctggccagaaccgagcagctggtgagactggagagcaacgccgtgatcgagaacaagaccatcgcccacaacctgcagagaaagctgaagacccagaaggagagactggagagcaaggagctgcacatgagcctgctgagacagaagatcgcccagctggaggaggagaagcaggccagaaccgccctggtggtggagagagacaacgcccacctgaccatcagaaacctgcagaagaaggtggagagactgcagaaggagctgaacacctgcagagacctgcacaccgagctgaaggccaagctggccgacaccaacgagctgaagatcaagaccctggagcagaccaaggccatcgaggacctgaacaagagcagagaccagctggagaagatgaaggagaaggccgagaagaagctgatgagcgtgaagagcgagctggacaccaccgagcacgaggccaaggagaacaaggagagagccagaaacatgatcgaggtggtgaccagcgagatgaagaccctgaagaagagcctggaggaggccgagaagagagagaagcagctggccgacttcagagaggtggtgagccagatgctgggcctgaacgtgaccagcctggccctgcccgactacgagatcatcaagtgcctggagagactggtgcacagccaccagcaccacttcgtgacctgcgcctgcctgaaggacgtgaccaccggccaggagagacacccccagggccacctgcagctgctgcactag

SEQ ID NO: 19546 - DNA, 2169 bp, Artificial Sequence
  Description of Artificial Sequence: Synthetic coding sequence
atgagcctggactgcaccagccacatcgccctgggcgccgccagccccgcccccgaggagacctacgaccacctgagcgaggtgcccgtgaccagagagcagctgaaccactacagaaacgtggcccagaacgccagaagcgagctggccgccaccctggtgaagttcgagtgcgcccagagcgagctgcaggacctgagaagcaagatgctgagcaaggaggtgagctgccaggagctgaaggccgagatggagagctacaaggagaacaacgccagaaagagcagcctgctgaccagcctgagagacagagtgcaggagctggaggaggagagcgccgccctgagcaccagcaagatcagaaccgagatcaccgcccacgccgccatcaaggagaaccaggagctgaagaagaaggtggtggagctgaacgagaagctgcagaagtgcagcaaggagaacgaggagaacaagaagcaggtgagcaagaactgcagaaagcacgaggagttcctgacccagctgagagactgcctggaccccgacgagagaaacgacaaggccagcgacgaggacctgatcctgaagctgagagacctgagaaaggagaacgagttcgtgaagggccagatcgtgatcctggaggagaccatcaacgtgcacgagatggaggccaaggccagcagagagaccatcatgagactggccagcgaggtgaacagagagcagaagaaggccgccagctgcaccgaggagaaggagaagctgaaccaggacctgctgagcgccgtggaggccaaggaggccctggagagagaggtgaagatcttccaggagagactgctggccggccagcaggtgtgggacgccagcaagcaggaggtgagcctgctgaagaagagcagcagcgagctggagaagagcctgaaggccagccaggacgccgtgaccaccagccagagccagtacttcagcttcagagagaagatcgccgccctgctgagaggcagactgagcatgaccggcagcaccgaggacaccatcctggagaagatcagagagatggacagcagagaggagagcagagacagaatggtgagccagctggaggcccagatcagcgagctggtggagcagctgggcaaggagagcggcttccaccagaaggccctgcagagagcccagaaggccgagaacatgctggagaccctgcagggccagctgacccacctggaggccgagctggtgagcggcggcgtgctgagagacaacctgaacttcgagaagcagaagtacctgaagttcctggaccagctgagccagaagatgaagctggaccagatggccgccgagctgggcttcgacatgagactggacgtggtgctggccagaaccgagcagctggtgagactggagagcaacgccgtgatcgagaacaagaccatcgcccacaacctgcagagaaagctgaagacccagaaggagagactggagagcaaggagctgcacatgagcctgctgagacagaagatcgcccagctggaggaggagaagcaggccagaaccgccctggtggtggagagagacaacgcccacctgaccatcagaaacctgcagaagaaggtggagagactgcagaaggagctgaacacctgcagagacctgcacaccgagctgaaggccaagctggccgacaccaacgagctgaaggccagcgcctggctgcacttcatcaagaccctggagcagaccaaggccatcgaggacctgaacaagagcagagaccagctggagaagatgaaggagaaggccgagaagaagctgatgagcgtgaagagcgagctggacaccaccgagcacgaggccaaggagaacaaggagagagccagaaacatgatcgaggtggtgaccagcgagatgaagaccctgaagaagagcctggaggaggccgagaagagagagaagcagctggccgacttcagagaggtggtgagccagatgctgggcctgaacgtgaccagcctggccctgcccgactacgagatcatcaagtgcctggagagactggtgcacagccaccagcaccacttcgtgacctgcgcctgcctgaaggacgtgaccaccggccaggagagacacccccagggccacctgcagctgctgcactag

SEQ ID NO: 19547 - DNA, 378 bp, Artificial Sequence
  Description of Artificial Sequence: Synthetic coding sequence
atgaagaacgaggagcactgccccggcagcttcttcctgtgcaagatcagagagtgcgtgctgaactacagattccagctgcagcaccccggcttccagcactacctgcagagcagcggcagaagagacagaggcagaagcgaggacaagaagcccctggaggccggcgtgtggtgctgggacagaggcggctgggacggcagcagcagagccgtgcacctgctgttcagaggcgtggcccaccccagcctgtacctgttccccagagaggacccccccagactgctgttccccagactgagcctgctggtgtgcgagcagttctggtgctacagcgccaccctgctgctggcccccctgcccgccagcacctgctag

SEQ ID NO: 19548 - DNA, 609 bp, Artificial Sequence
  Description of Artificial Sequence: Synthetic coding sequence
atgaacgccgccgtgccccccgagcaggcccacagctgcggctggggcaccgagggctgcccctgcctgagaagcaccgccatcagacagaccttcttccccggcggcgaccagttccagagagacggcggcctggccatgctgcccatcctggtgagcaagttcctggccagcagcgacccccccgtgagcgtgcccgagatgctgggcctgcagaacagatggagaggcatgaagaacgaggagcactgccccggcagcttcttcctgtgcaagatcagagagtgcgtgctgaactacagattccagctgcagcaccccggcttccagcactacctgcagagcagcggcagaagagacagaggcagaagcgaggacaagaagcccctggaggccggcgtgtggtgctgggacagaggcggctgggacggcagcagcagagccgtgcacctgctgttcagaggcgtggcccaccccagcctgtacctgttccccagagaggacccccccagactgctgttccccagactgagcctgctggtgtgcgagcagttctggtgctacagcgccaccctgctgctggcccccctgcccgccagcacctgctag

SEQ ID NO: 19549 - DNA, 1266 bp, Artificial Sequence
  Description of Artificial Sequence: Synthetic coding sequence
atgagcgcccacagcatgctgtgcgagagaatcgccatcgccaaggagctgatcaagagagccgagagcctgagcagaagcagaaagggcggcatcgagggcggcgccaagctgtgcagcaagctgaaggccgagctgaagttcctgcagaaggtggaggccggcaaggtggccatcaaggagagccacctgcagagcaccaacctgacccacctgagagccatcgtggagagcgccgagaacctggaggaggtggtgagcgtgctgcacgtgttcggctacaccgacaccctgggcgagaagcagaccctggtggtggacgtggtggccaacggcggccacacctgggtgaaggccatcggcagaaaggccgaggccctgcacaacatctggctgggcagaggccagtacggcgacaagagcatcatcgagcaggccgaggacttcctgcaggccagccaccagcagcccgtgcagtacagcaacccccacatcatcttcgccttctacaacagcgtgagcagccccatggccgagaagctgaaggagatgggcatcagcgtgagaggcgacatcgtggccgtgaacgccctgctggaccaccccgaggagctgcagcccagcgagagcgagagcgacgacgagggccccgagctgctgcaggtgaccagagtggacagagagaacatcctggccagcgtggccttccccaccgagatcaaggtggacgtgtgcaagagagtgaacctggacatcaccaccctgatcacctacgtgagcgccctgagctacggcggctgccacttcatcttcaaggagaaggtgctgaccgagcaggccgagcaggagagaaaggagcaggtgctgccccagctggaggccttcatgaaggacaaggagctgttcgcctgcgagagcgccgtgaaggacttccagagcatcctggacaccctgggcggccccggcgagagagagagagccaccgtgctgatcaagagaatcaacgtggtgcccgaccagcccagcgagagagccctgagactggtggccagcagcaagatcaacagcagaagcctgaccatcttcggcaccggcgacaccctgaaggccatcaccatgaccgccaacagcggcttcgtgagagccgccaacaaccagggcgtgaagttcagcgtgttcatccaccagcccagagccctgaccgagagcaaggaggccctggccacccccctgcccaaggactacaccaccgacagcgagcactag

SEQ ID NO: 19550 - DNA, 537 bp, Artificial Sequence
  Description of Artificial Sequence: Synthetic coding sequence
atgagcgcccacagcatgctgtgcgagagaatcgccatcgccaaggagctgatcaagagagccgagagcctgagcagaagcagaaagggcggcatcgagggcggcgccaagctgtgcagcaagctgaaggccgagctgaagttcctgcagaaggtggaggccggcaaggtggccatcaaggagagccacctgcagagcaccaacctgacccacctgagagccatcgtggagagcgccgagaacctggaggaggtggtgagcgtgctgcacgtgttcggctacaccgacaccctgggcgagaagcagaccctggtggtggacgtggtggccaacggcggccacacctgggtgaaggccatcggcagaaaggccgaggccctgcacaacatctggctgggcagaggccagtacggcgacaagagcatcatcgagcaggccgaggacttcctgcaggccagccaccagcagcccgtgcagtacagcaacccccacatcatcttcgccttctacaacagcgtgagcagccccatggcctag

SEQ ID NO: 19551 - DNA, 1440 bp, Artificial Sequence
  Description of Artificial Sequence: Synthetic coding sequence
atgcaggaggtgcccgaggccgccggcctggccagagtggagccccccagaagaagcagcggcgtgggcgccgccagactgagattccccggcggcagcagacccctgagagccagagcctgcgtgctggccctggccgtgctggccctgcccgagagaaacaacgccgacagcatgagcgcccacagcatgctgtgcgagagaatcgccatcgccaaggagctgatcaagagagccgagagcctgagcagaagcagaaagggcggcatcgagggcggcgccaagctgtgcagcaagctgaaggccgagctgaagttcctgcagaaggtggaggccggcaaggtggccatcaaggagagccacctgcagagcaccaacctgacccacctgagagccatcgtggagagcgccgagaacctggaggaggtggtgagcgtgctgcacgtgttcggctacaccgacaccctgggcgagaagcagaccctggtggtggacgtggtggccaacggcggccacacctgggtgaaggccatcggcagaaaggccgaggccctgcacaacatctggctgggcagaggccagtacggcgacaagagcatcatcgagcaggccgaggacttcctgcaggccagccaccagcagcccgtgcagtacagcaacccccacatcatcttcgccttctacaacagcgtgagcagccccatggccgagaagctgaaggagatgggcatcagcgtgagaggcgacatcgtggccgtgaacgccctgctggaccaccccgaggagctgcagcccagcgagagcgagagcgacgacgagggccccgagctgctgcaggtgaccagagtggacagagagaacatcctggccagcgtggccttccccaccgagatcaaggtggacgtgtgcaagagagtgaacctggacatcaccaccctgatcacctacgtgagcgccctgagctacggcggctgccacttcatcttcaaggagaaggtgctgaccgagcaggccgagcaggagagaaaggagcaggtgctgccccagctggaggccttcatgaaggacaaggagctgttcgcctgcgagagcgccgtgaaggacttccagagcatcctggacaccctgggcggccccggcgagagagagagagccaccgtgctgatcaagagaatcaacgtggtgcccgaccagcccagcgagagagccctgagactggtggccagcagcaagatcaacagcagaagcctgaccatcttcggcaccggcgacaccctgaaggccatcaccatgaccgccaacagcggcttcgtgagagccgccaacaaccagggcgtgaagttcagcgtgttcatccaccagcccagagccctgaccgagagcaaggaggccctggccacccccctgcccaaggactacaccaccgacagcgagcactag

SEQ ID NO: 19552 - DNA, 258 bp, Artificial Sequence
  Description of Artificial Sequence: Synthetic coding sequence
atgagcgcccacagcatgctgtgcgagagaatcgccatcgccaaggagctgatcaagagagccgagagcctgagcagaagcagaaagggcggcatcgagggcggcgccaagctgtgcagcaagctgaaggccgagctgaagttcctgcagaaggtggaggccggcaaggtggccatcaaggagagccacctgcagagcaccaacctgacccacctgagagccatcgtggagagcgccgagaacctggaggaggtgtag

SEQ ID NO: 19553 - DNA, 1266 bp, Artificial Sequence; identical to SEQ ID NO: 19549
  Description of Artificial Sequence: Synthetic coding sequence

SEQ ID NO: 19554 - DNA, 1266 bp, Artificial Sequence; identical to SEQ ID NO: 19549
  Description of Artificial Sequence: Synthetic coding sequence

SEQ ID NO: 19555 - DNA, 1350 bp, Artificial Sequence
  Description of Artificial Sequence: Synthetic coding sequence
atgagcgacatcagacacagcctgctgagaagagacgccctgagcgccgccaaggaggtgctgtaccacctggacatctacttcagcagccagctgcagagcgcccccctgcccatcgtggacaagggccccgtggagctgctggaggagttcgtgttccaggtgcccaaggagagaagcgcccagcccaagagactgaacagcctgcaggagctgcagctgctggagatcatgtgcaactacttccaggagcagaccaaggacagcgtgagacagatcatcttcagcagcctgttcagcccccagggcaacaaggccgacgacagcagaatgagcctgctgggcaagctggtgagcatggccgtggccgtgtgcagaatccccgtgctggagtgcgccgccagctggctgcagagaacccccgtggtgtactgcgtgagactggccaaggccctggtggacgactactgctgcctggtgcccggcagcatccagaccctgaagcagatcttcagcgccagccccagattctgctgccagttcatcaccagcgtgaccgccctgtacgacctgagcagcgacgacctgatcccccccatggacctgctggagatgatcgtgacctggatcttcgaggaccccagactgatcctgatcaccttcctgaacacccccatcgccgccaacctgcccatcggcttcctggagctgacccccctggtgggcctgatcagatggtgcgtgaaggcccccctggcctacaagagaaagaagaagccccccctgagcaacggccacgtgagcaacaaggtgaccaaggaccccggcgtgggcatggacagagacagccacctgctgtacagcaagctgcacctgagcgtgctgcaggtgctgatgaccctgcagctgcacctgaccgagaagaacctgtacggcagactgggcctgatcctgttcgaccacatggtgcccctggtggaggagatcaacagactggccgacgagctgaaccccctgaacgccagccaggagatcgagctgagcctggacagactggcccaggccctgcaggtggccatggccagcggcgccctgctgtgcaccagagacgacctgagaaccctgtgcagcagactgccccacaacaacctgctgcagctggtgatcagcggccccgtgcagcagagcccccacgccgccctgccccccggcttctacccccacatccacaccccccccctgggctacggcgccgtgcccgcccaccccgccgcccaccccgccctgcccacccaccccggccacaccttcatcagcggcgtgaccttccccttcagacccatcagatag

SEQ ID NO: 19556 - DNA, 1059 bp, Artificial Sequence
  Description of Artificial Sequence: Synthetic coding sequence
atgagcgacatcagacacagcctgctgagaagagacgccctgagcgccgccaaggaggtgctgtaccacctggacatctacttcagcagccagctgcagagcgcccccctgcccatcgtggacaagggccccgtggagctgctggaggagttcgtgttccaggtgcccaaggagagaagcgcccagcccaaggagcagaccaaggacagcgtgagacagatcatcttcagcagcctgttcagcccccagggcaacaaggccgacgacagcagaatgagcctgctgggcaagctggtgagcatggccgtggccgtgtgcagaatccccgtgctggagtgcgccgccagctggctgcagagaacccccgtggtgtactgcgtgagactggccaaggccctggtggacgactactgctgcctggtgcccggcagcatccagaccctgaagcagatcttcagcgccagccccagattctgctgccagttcatcaccagcgtgaccgccctgtacgacctgagcagcgacgacctgatcccccccatggacctgctggagatgatcgtgacctggatcttcgaggaccccagcgtgctgcaggtgctgatgaccctgcagctgcacctgaccgagaagaacctgtacggcagactgggcctgatcctgttcgaccacatggtgcccctggtggaggagatcaacagactggccgacgagctgaaccccctgaacgccagccaggagatcgagctgagcctggacagactggcccaggccctgcaggtggccatggccagcggcgccctgctgtgcaccagagacgacctgagaaccctgtgcagcagactgccccacaacaacctgctgcagctggtgatcagcggccccgtgcagcagagcccccacgccgccctgccccccggcttctacccccacatccacaccccccccctgggctacggcgccgtgcccgcccaccccgccgcccaccccgccctgcccacccaccccggccacaccttcatcagcggcgtgaccttccccttcagacccatcagatag

SEQ ID NO: 19557 - DNA, 711 bp, Artificial Sequence
  Description of Artificial Sequence: Synthetic coding sequence
atggtggtgagagaggccagcgccgcccaggccagcctgagccaggtgctgccccagctgagatacctgcacatcttcctggagcaggtgcacacccacttccaggagcagagcgtgggcgagagaggcgccgccatccagctggccgagggcctggccagacagctgtgcaccgactgccagctgaacaagctgttctacagagaggagttcgtgctggccaccctgctggacccctgcttcaagggcaagatcgaggccatcctgccctggggccccaccgacatcgaccactggaagcaggtgctggtgtacaaggtgaaggagatcagagtgagcgagtacagcctgaacagccccagccccctgcagagccccagaggcctgtgcgtggaccccaccagagtggccaagagcagcggcgtggagggcagaagccagggcgagcccctgcagagcagcagccacagcggcgccttcctgctggcccagagagagaagggcctgctggagagcatgggcctgctggccagcgagagaagcggcggcagcctgagcaccaagagccactgggccagcatcatcgtgaagaagtacctgtgggagaacgagaccgtgggcgcccaggacgaccccctggcctactgggagaagaagagagaggcctggccccccagcatctgcctgaccccccacagaagcctgctgtag

SEQ ID NO: 19558 - DNA, 1773 bp, Artificial Sequence
  Description of Artificial Sequence: Synthetic coding sequence
atggaggtgatccacggcagaccctactgctgcagagagctggagggcgccgacatcctgagcaacaccttctacagcaacgagctgcacaaccccctgcagaccgtgaccagacccaccgccagcgaggacagataccaggagctgagagagagcctgcagcagtgcagactgccctggggcgccgagagagagtacggcggcatcatccccatcagcctgcccgaggaccacagacccaagtacgagccccccagagtgatgggcaagggccaccagcactacggcttcggcggcgagacctggcccagaaagctgcccgtggagcagttctactacctgacccagaacaagaagagcgacgtgtacggcaacgacagcctgatccccaagccccccaacagcaccgtgggcgagatctgcctgccctaccccatcgagcacccctaccacacccacatctgcagaggcgccatgttccccaccttcaccagccccgaggacctgtacaccggcatcaaggccagaacccagcagcccttcccccccaccgtgcccaccaaggcctacgacagcaccgtgctgaagaccagaggcaacccctacagatacgagctgatcgacatccccatggacagcaagaagaaggccctgacctggcccggccagggcgtgtactacgacttccccagaggcgtggagaagaacaagcccgtgttctaccccaagccccccaagaccttcgcccccaacaccagcctgaacagctgggaccccatctgcagcgccaaggaggccaacatccagagaaacctggagagaagccactggctgaccagctacacccacgacttcaccggcctgggccccatggaccccctggagctggacgactaccacgagaagatggtggccgagctgaccagaaagatcggcttcgaccccgagccccaggagaagttccaccccgtgttcaagccccccagacccctggagggcagaatcgccagactgatccagaacagaagaagcctggaggccatcgtgcagcagagacccagaagctgccccgactgcacccccagagtgctgtgcaacttccacaccttcgtgcccagcagcaaggagatggtggccctgagcgacaacatccccgccggcgtgacccacaagaaccaggacatcgaggagaagatcatcgaggagcagagcctgctgagcacctacgagctgcccagctgctaccccaccaaggacctgaccagcatctacgacatcaagcccttccccaagatcaccgacaccaagaagaccgaggacctgtactggagacagcagagcctgaagacccagcccaccccctactgcaagcccgaccactggatccactacgagaacctgaagagccccctgagagaccagtacaacatgtgccccgaccccgtgagcctgagcaagcccagcgtgctgcagaacaagcaggacaccgaggccttcaccctggagcacttcctgagcaagcccgaggaggagctgttcctgaacatggagaacaacgaggagaccagacccgtgctgggctggatccccagagccggcgtgaccaagccccagaccaacctgctggagctgaagaacagcttcagcaagaccggcgcccagaagagattccacaagagcatcctggaggaccacaaggacctgagagacaacgagcacagcggcatgaagcaccagttctacggccacaacagctactacttctacaactag

SEQ ID NO: 19559 - DNA, 1773 bp, Artificial Sequence; identical to SEQ ID NO: 19558
  Description of Artificial Sequence: Synthetic coding sequence

SEQ ID NO: 19560 - DNA, 348 bp, Artificial Sequence
  Description of Artificial Sequence: Synthetic coding sequence
atggaggtgatccacggcagaccctactgctgcagagagctggagggcgccgacatcctgagcaacaccttctacagcaacgagctgcacaaccccctgcagaccgtgaccagacccaccgccagcgaggacagataccaggagctgagagagagcctgcagcagtgcagactgccctggggcgccgagagagagtacggcggcatcatccccatcagcctgcccgaggaccacagacccaagtacgagccccccagagtgatgggcaagggccaccagcactacggcttcggcggcgagacctggcccagaaagctgcccgtggagcagttctactacctgacctag

SEQ ID NO: 19561 - DNA, 462 bp, Artificial Sequence
  Description of Artificial Sequence: Synthetic coding sequence
atggaggtgatccacggcagaccctactgctgcagagagctggagggcgccgacatcctgagcaacaccttctacagcaacgagctgcacaaccccctgcagaccgtgaccagacccaccgccagcgaggacagataccaggagctgagagagagcctgcagcagtgcagactgccctggggcgccgagagagagtacggcggcatcatccccatcagcctgcccgaggaccacagacccaagtacgagccccccagagtgatgggcaagggccaccagcactacggcttcggcggcgagacctggcccagaaagctgcccgtggagcagttctactacctgacccagaacaagaagagcgacgtgtacggcaacgacagcctgatccccaagccccccaacagcaccgtgggcgagatctgcctgccctaccccatcgagcacccctaccacacccactag

SEQ ID NO: 19562 - DNA, 279 bp, Artificial Sequence
  Description of Artificial Sequence: Synthetic coding sequence
atggaggtgatccacggcagaccctactgctgcagagagctggagggcgccgacatcctgagcaacaccttctacagcaacgagctgcacaaccccctgcagaccgtgaccagacccaccgccagcgaggacagataccaggagctgagagagagcctgcagcagtgcagactgccctggggcgccgagagagagtacggcggcatcatccccatcagcctgcccgaggaccacagacccaagtacgagccccccagagtgatgggcaagggccactag

SEQ ID NO: 19563 - DNA, 534 bp, Artificial Sequence
  Description of Artificial Sequence: Synthetic coding sequence
atgcaggtggaggtgcagagcctgagcctggaggagtgcccctggagactgcccggcccccagtgcgagtgcgaggccctgctgcccagcggcgccagaagaagaatcgacctgagactgagcggcagagccgtggccgtgtgggtgcacgtgagaggcggccccggccagttcaacctgagctacgccaccggcagacacaagaagcccaacccccaccagaacatgaacagaggcatggagttcatcgcccccgtgagcgcccccaccaagagcggcgccccctggcacttcctgagccagggccccaccgacgcccagagagccgtgagaatcagacccggcaccagaatgggcctgagcagcgaccccgtggtgggcaccctgagcagcagctacctggacctgctgaccctgagctacaagcccggcagaaccgtgaccagcagctacctgaacgtgagaggccacgaggtgagaaagctgcagaacagcgtggaggccaccagaatcagcagaaccgacagcagctag

SEQ ID NO: 19564 - DNA, 396 bp, Artificial Sequence
  Description of Artificial Sequence: Synthetic coding sequence
atggacttccagcagctggccgacgtggccgagaagtggtgcagcaacacccccttcgagctgatcgccaccgaggagaccgagagaagaatggacttctacgccgaccccggcgtgagcttctacgtgctgtgccccgacaacggctgcggcgacaacttccacgtgtggagcgagagcgaggactgcctgcccttcctgcagctggcccaggactacatcagcagctgcggcaagaagaccctgcacgaggtgctggagaaggtgttcaagagcttcagacccctgctgggcctgcccgacgccgacgacgacgccttcgaggagtacagcgccgacgtggaggaggaggagcccgaggccgaccacccccagatgggcgtgagccagcagtag

SEQ ID NO: 19565 - DNA, 297 bp, Artificial Sequence
  Description of Artificial Sequence: Synthetic coding sequence
atggccacccactgccccctgtactgcgtgggcgccgacctgatgatgaacagagccggcgagcacgtgtggagcgagagcgaggactgcctgcccttcctgcagctggcccaggactacatcagcagctgcggcaagaagaccctgcacgaggtgctggagaaggtgttcaagagcttcagacccctgctgggcctgcccgacgccgacgacgacgccttcgaggagtacagcgccgacgtggaggaggaggagcccgaggccgaccacccccagatgggcgtgagccagcagtag

SEQ ID NO: 19566 - DNA, 396 bp, Artificial Sequence; identical to SEQ ID NO: 19564
  Description of Artificial Sequence: Synthetic coding sequence

SEQ ID NO: 19567 - DNA, 297 bp, Artificial Sequence; identical to SEQ ID NO: 19565
  Description of Artificial Sequence: Synthetic coding sequence

SEQ ID NO: 19568 - DNA, 600 bp, Artificial Sequence
  Description of Artificial Sequence: Synthetic coding sequence
atgcacaagaagagcggcttcgagaaccagatgagactgtgctggagaagaccctgcggcaacgaggagagatgcagcgtgtgctggagcctgttcctgccccccggcaagcagctgtgcgaggaggagagaagagccatgcaggccgccctggacagcgtggtgtgccacacccccctgaacaacctgggcttcagcagaaagggcagcgccctgaccttcagcgtggccttccaggccctgagaaccggcctgttcgagcacatgaagctgaagctgcagttcaccgccagcgtgagccaccccccccccgaggccagacccctgagcagaaagagcagccccagcagccccgccgtgagagacctggtggagagacaccaggccagcctgggcagaagccagagcttcagccaccagcagcccagcagaagccacctgatgagaagcggcagcgtgatggagagaagagccatcaccccccccgtggccagccccgtgggcagacccctgtacctgccccccgacaaggccgtgctgagcctggacaagatcgccaagagagagtgcaaggtgctggtggtggagcccgtgaagtag

SEQ ID NO: 19569 - DNA, 1743 bp, Artificial Sequence
  Description of Artificial Sequence: Synthetic coding sequence
atggagagccagtgcgactacagcatgtacttccccgccgtgcccctgccccccagagccgagctggccggcgaccccggcagatacagagccctgcccagaagaaaccacctgtacctgggcgagaccgtgagattcctgctggtgctgagatgcagaggcggcgccggcagcggcaccggcggcggccccggcctgggcagcagaggcgcctgggccgagctggccaccgccctggccgccctggccagcgtgagcgccggcggcggcatgcccggcggcggcggcgccggcgaccaggacagcgagccccccggcggcggcgaccccggcggcggcggcctgttcagaggctgcagccccctgctgacccacggccccggccccgccaccagcggcggcgccaccaccctgcccgtggaggagcccatcgtgagcaccgacgaggtgatcttccccctgaccgtgagcctggacagactgccccccggcacccccaaggccaagatcgtggtgaccgtgtggaagagagagatcgaggcccccgaggtgagagaccagggctacctgagactgctgcagaccagaagccccggcgagaccttcagaggcgagcagagcgccttcaaggcccaggtgagcaccctgctgaccctgctgcccccccccgtgctgagatgcagacagttcaccgtggccggcaagcacctgaccgtgctgaaggtgctgaacagcagcagccaggaggagatcagcatctgggacatcagaatcctgcccaacttcaacgccagctacctgcccgtgatgcccgacggcagcgtgctgctggtggacaacgtgtgccaccagagcggcgaggtgagcatgggcagcttctgcagactgcccggcaccagcggctgcttcccctgccccctgaacgccctggaggagcacaacttcctgttccagctgagaggcggcgagcagcccccccccggcgccaaggagggcctggaggtgcccctgatcgccgtggtgcagtggagcacccccaagctgcccttcacccagagcatctacacccactacagactgcccagcgtgagactggacagaccctgcttcgtgatgaccgccagctgcaagagccccgtgagaacctacgagagattcaccgtgacctacaccctgctgaacaacctgcaggacttcctggccgtgagactggtgtggacccccgagcacgcccaggccggcaagcagctgtgcgaggaggagagaagagccatgcaggccgccctggacagcgtggtgtgccacacccccctgaacaacctgggcttcagcagaaagggcagcgccctgaccttcagcgtggccttccaggccctgagaaccggcctgttcgagctgagccagcacatgaagctgaagctgcagttcaccgccagcgtgagccaccccccccccgaggccagacccctgagcagaaagagcagccccagcagccccgccgtgagagacctggtggagagacaccaggccagcctgggcagaagccagagcttcagccaccagcagcccagcagaagccacctgatgagaagcggcagcgtgatggagagaagagccatcaccccccccgtggccagccccgtgggcagacccctgtacctgccccccgacaaggccgtgctgagcctggacaagatcgccaagagagagtgcaaggtgctggtggtggagcccgtgaagtag

SEQ ID NO: 19570 - DNA, 897 bp, Artificial Sequence
  Description of Artificial Sequence: Synthetic coding sequence
atggagagactgaccctgcccctgggcggcgccgccgccgtggacgagtacctggagtacagaagaatcgtgggcgaggacgacggcggcaagctgttcacccccgaggagtacgaggagtacaagagaaaggtgctgcccctgagactgcagaacagactgttcgtgagctggagaagccccaccggcatggactgcaagctggtgggccccgagaccctgtgcttctgcacccacagatacaagcagcacaagaccgacctggaggccatcccccagcagtgccccatcgacctgccctgccaggtgaccggctgccagtgcagagcctacctgtacgtgcccctgaacggcagccagcccatcagatgcagatgcaagcacttcgccgaccagcacagcgccgcccccggcttcacctgcaacacctgcagcaagtgcagcggcttccacagctgcttcacctgcgcctgcggccagcccgcctacgcccacgacaccgtggtggagaccaagcaggagagactggcccaggagaagcccgtgggccaggacatcccctacgccgccatgggcggcctgaccggcttcagcagcctggccgagggctacatgagactggacgacagcggcatcggcgtgcccagcgtggagttcctggagagccccatcaccgccgtggacagccccttcctgaaggccttccaggccagcagcagcagcagccccgagaccctgaccgacgtgggcaccagcagccaggtgagcagcctgagaagacccgaggaggacgacatggccttcttcgagagaagataccaggagagaatgaagatggagaaggccgccaagtggaagggcaaggcccccctgcccagcgccaccaagcccagctag

SEQ ID NO: 19571 - DNA, 789 bp, Artificial Sequence
  Description of Artificial Sequence: Synthetic coding sequence
atggagagactgaccctgcccctgggcggcgccgccgccgtggacgagtacctggagtacagaagaatcgtgggcgaggacgacggcggcaagctgttcacccccgaggagtacgaggagtacaagagaaaggtgctgcccctgagactgcagaacagactgttcgtgagctggagaagccccaccggcatggactgcaagctggtgggccccgagaccctgtgcttctgcacccacagatacaagcagcacaagaccgacctggaggccatcccccagcagtgccccatcgacctgccctgccaggtgaccggctgccagtgcagagcctacctgtacgtgcccctgaacggcagccagcccatcagatgcagatgcaagcacttcgccgaccagcacagcgccgcccccggcttcacctgcaacacctgcagcaagtgcagcggcttccacagctgcttcacctgcgcctgcggccagcccgcctacgcccacgacaccgtggtggagaccaagcaggagagactggcccaggagaagcccgtgggccaggacatcccctacgccgccatgggcggcctgaccggcttcagcagcctggccgagggctacatgagactggacgacagcggcatcgtgggcaccagcagccaggtgagcagcctgagaagacccgaggaggacgacatggccttcttcgagagaagataccaggagagaatgaagatggagaaggccgccaagtggaagggcaaggcccccctgcccagcgccaccaagcccagctag

SEQ ID NO: 19572 - DNA, 615 bp, Artificial Sequence
  Description of Artificial Sequence: Synthetic coding sequence
atggagagactgaccctgcccctgggcggcgccgccgccgtggacgagtacctggagtacagaagatacaagcagcacaagaccgacctggaggccatcccccagcagtgccccatcgacctgccctgccaggtgaccggctgccagtgcagagcctacctgtacgtgcccctgaacggcagccagcccatcagatgcagatgcaagcacttcgccgaccagcacagcgccgcccccggcttcacctgcaacacctgcagcaagtgcagcggcttccacagctgcttcacctgcgcctgcggccagcccgcctacgcccacgacaccgtggtggagaccaagcaggagagactggcccaggagaagcccgtgggccaggacatcccctacgccgccatgggcggcctgaccggcttcagcagcctggccgagggctacatgagactggacgacagcggcatcgtgggcaccagcagccaggtgagcagcctgagaagacccgaggaggacgacatggccttcttcgagagaagataccaggagagaatgaagatggagaaggccgccaagtggaagggcaaggcccccctgcccagcgccaccaagcccagctag

SEQ ID NO: 19573 - DNA, 585 bp, Artificial Sequence
  Description of Artificial Sequence: Synthetic coding sequence
atggccaagcagaagagaaaggtgcccgaggtgaccgagaagaagaacaagaagctgaagaaggccagcgccgagggccccctgctgggccccgaggccgcccccagcggcgagggcgccggcagcaagggcgaggccgtgctgagacccggcctggacgccgagcccgagctgagccccgaggagcagagagtgctggagagaaagctgaagaaggagagaaagaaggaggagagacagagactgagagaggccggcctggtggcccagcacccccccgccagaagaagcggcgccgagctggccctggactacctgtgcagatgggcccagaagcacaagaactggagattccagaagaccagacagacctggctgctgctgcacatgtacgacagcgacaaggtgcccgacgagcacttcagcaccctgctggcctacctggagggcctgcagggcagagccagagagctgaccgtgcagaaggccgaggccctgatgagagagctggacgaggagggcagcgacccccccctgcccggcagagcccagagaatcagacaggtgctgcagctgctgagctag

SEQ ID NO: 19574 - DNA, 585 bp, Artificial Sequence; identical to SEQ ID NO: 19573
  Description of Artificial Sequence: Synthetic coding sequence

SEQ ID NO: 19575 - DNA, 585 bp, Artificial Sequence; identical to SEQ ID NO: 19573
  Description of Artificial Sequence: Synthetic coding sequence

SEQ ID NO: 19576 - DNA, 579 bp, Artificial Sequence
  Description of Artificial Sequence: Synthetic coding sequence
atggccaagcagaagagaaaggtgcccgaggtgaccgagaagaagaacaagaagctgaagaaggccagcgccgagggccccctgctgggccccgaggccgcccccagcggcgagggcgccggcagcaagggcgaggccgtgctgagacccggcctggacgccgagcccgagctgagccccgaggagcagagagtgctggagagaaagctgaagaaggagagaaagaaggaggagagacagagactgagagaggccggcctggtggcccagcacccccccgccagaagaagcggcgccgagctggccctggactacctgtgcagatgggcccagaagcacaagaactggagattccagaagaccagacagacctggctgctgctgcacatgtacgacagcgacaaggtgcccgacgagcacttcagcaccctgctggcctacctggagggcctgcagggcagagccagagagctgaccgtgcagaaggccgaggccctgatgagagagctggacgaggagggcagcgacccccccctgcccggcagagcccagagaatcagacaggtgctgcagctgtag

SEQ ID NO: 19577 - DNA, 888 bp, Artificial Sequence
  Description of Artificial Sequence: Synthetic coding sequence
atgagaaacaccagcaaggagctgcagggcgccacccacagatacgccccctgcgactggtactaccacgtgcccgtgaagagaagcgagaaggccgtggacgccccccccgccagccagatccccggcctgagcaacctgggcgacagccacagcgagaacctgcccggcaccagaagatactggatcaaggagaccgacagcgagtacgtgaagctggccaagcagggcggcagacccgacctgctgaagcacttcgcccccggcaccagaaagggcagccccgtggcctacagcctgcccgactggtacatccaccacagcaagccccccaccgccagccagcaggaggtgagagccgtgagcatgcccgactacatggtgcacgaggagttcaaccccgaccaggccaacggcagctacgccagcagaagaggccccttcgacttcgacatgaagaccgtgtggcagagagaggccgaggagctggagaaggagaagaagaagctgagactgcccgccatcgacagcaagtacctgagcaaggccggcacccccctgggccccaagaaccccgccggcagcagactgagcttcccccccgtgcccggccagaagaacagcagccccaccaacttcagcaagctgatcagcaacggctacaaggacgagtggctgcagcagcagcagagagccgacagcgacaagagaacccccaagaccagcagagccagcgtgctgagccagagccccagagacctggagggcccccaggacgccgccagactgcaggacgccgaggccagcgagggccccgaggacacccccgagagcagccagagccccgaggagagcgtgagcgccagcacccccgccgagctgaagtag

SEQ ID NO: 19578 - DNA, 888 bp, Artificial Sequence
  Description of Artificial Sequence: Synthetic coding sequence
atgagaaacaccagcaaggagctgcagggcgccacccacagatacgccccctgcgactggtactaccacgtgcccgtgaagagaagcgagaaggccgtggacgccccccccgccagccagatccccggcctgagcaacctgggcgacagccacagcgagaacctgcccggcaccagaagatactggatcaaggagaccgacagcgagtacgtgaagctggccaagcagggcggcagacccgacctgctgaagcacttcgcccccggcaccagaaagggcagccccgtggcctacagcctgcccgactggtacatccaccacagcaagccccccaccgccagccagcaggaggtgagagccgtgagcatgcccgactacatggtgcacgaggagttcaaccccgaccaggccaacggcagctacgccagcagaagaggccccttcgacttcgacatgaagaccgtgtggcagagagaggccgaggagctggagaaggagaagaagaagctgagactgcccgccatcgacagcaagtacctgagcaaggccggcacccccctgggccccaagaaccccgccggcagcagactgagcttcccccccgtgcccggccagaagaacagcagccccaccaacttcagcaagctgatcagcaacggctacaaggacgagtggctgcagcagcagcagagagccgacagcgacaagagaacccccaagaccagcagagccagcgtgctgagccagagccccagagacctggagggcccccaggacgccgccagactgcaggacgccgaggccagcgagggccccgaggacacccccgagagcaacacctgccccgaggagagcgtgagcgccagcacccccgccgagctgaagtag

SEQ ID NO: 19579 - DNA, 462 bp, Artificial Sequence
  Description of Artificial Sequence: Synthetic coding sequence
atgcccgactacatggtgcacgaggagttcaaccccgaccaggccaacggcagctacgccagcagaagaggccccttcgacttcgacatgaagaccgtgtggcagagagaggccgaggagctggagaaggagaagaagaagctgagactgcccgccatcgacagcaagtacctgagcaaggccggcacccccctgggccccaagaaccccgccggcagcagactgagcttcccccccgtgaacggctacaaggacgagtggctgcagcagcagcagagagccgacagcgacaagagaacccccaagaccagcagagccagcgtgctgagccagagccccagagacctggagggcccccaggacgccgccagactgcaggacgccgaggccagcgagggccccgaggacacccccggccccgaggagagcgtgagcgccagcacccccgccgagctgaagtag

SEQ ID NO: 19580 - DNA, 300 bp, Artificial Sequence
  Description of Artificial Sequence: Synthetic coding sequence
atgaccagcgccctgacccagggcctggagagaatccccgaccagctgggctacctggtgctgagcgagggcgccgtgctggccagcagcggcgacctggagaacgacgagcaggccgccagcgccatcagcgagctggtgagcaccgcctgcggcttcagactgcacagaggcatgaacgtgcccttcaagagactgagcgtggtgttcggcgagcacaccctgctggtgaccgtgagcggccagagagtgttcgtggtgaagagacagaacagaggcagagagcccatcgacgtgtag

SEQ ID NO: 19581 - DNA, 1218 bp, Artificial Sequence
  Description of Artificial Sequence: Synthetic coding sequence
atggagcccggcgccggcggcagaaacaccgccagagcccagagagccggcagccccaacacccccccccccagagagcaggagagaaagctggagcaggagaagctgagcggcgtggtgaagagcgtgcacagaagactgagaaagaagtacagagaggtgggcgacttcgacaagatctggagagagcactgcgaggacgaggagaccctgtgcgagtacgccgtggccatgaagaacctggccgacaaccactgggccaagacctgcgagggcgagggcagaatcgagtggtgctgcagcgtgtgcagagagtacttccagaacggcggcaagagaaaggccctggagaaggacgagaagagagccgtgctggccaccaagaccacccccgccctgaacatgcacgagagcagccagctggagggccacctgaccaacctgagcttcaccaaccccgagttcatcaccgagctgctgcaggccagcggcaagatcagactgctggacgtgggcagctgcttcaaccccttcctgaagttcgaggagttcctgaccgtgggcatcgacatcgtgcccgccgtggagagcgtgtacaagtgcgacttcctgaacctgcagctgcagcagcccctgcagctggcccaggacgccatcgacgccttcctgaagcagctgaagaaccccatcgacagcctgcccggcgagctgttccacgtggtggtgttcagcctgctgctgagctacttccccagcccctaccagagatggatctgctgcaagaaggcccacgagctgctggtgctgaacggcctgctgctgatcatcacccccgacagcagccaccagaacagacacgccatgatgatgaagagctggaagatcgccatcgagagcctgggcttcaagagattcaagtacagcaagttcagccacatgcacctgatggccttcagaaagatcagcctgaagaccaccagcgacctggtgagcagaaactaccccggcatgctgtacatcccccaggacttcaacagcatcgaggacgaggagtacagcaaccccagctgctacgtgagaagcgacatcgaggacgagcagctggcctacggcttcaccgagctgcccgacgccccctacgacagcgacagcggcgagagccaggccagcagcatccccttctacgagctggaggaccccatcctgctgctgagctag

SEQ ID NO: 19582 - DNA, 1059 bp, Artificial Sequence
  Description of Artificial Sequence: Synthetic coding sequence
atgggcgacttcgacaagatctggagagagcactgcgaggacgaggagaccctgtgcgagtacgccgtggccatgaagaacctggccgacaaccactgggccaagacctgcgagggcgagggcagaatcgagtggtgctgcagcgtgtgcagagagtacttccagaacggcggcaagagaaaggccctggagaaggacgagaagagagccgtgctggccaccaagaccacccccgccctgaacatgcacgagagcagccagctggagggccacctgaccaacctgagcttcaccaaccccgagttcatcaccgagctgctgcaggccagcggcaagatcagactgctggacgtgggcagctgcttcaaccccttcctgaagttcgaggagttcctgaccgtgggcatcgacatcgtgcccgccgtggagagcgtgtacaagtgcgacttcctgaacctgcagctgcagcagcccctgcagctggcccaggacgccatcgacgccttcctgaagcagctgaagaaccccatcgacagcctgcccggcgagctgttccacgtggtggtgttcagcctgctgctgagctacttccccagcccctaccagagatggatctgctgcaagaaggcccacgagctgctggtgctgaacggcctgctgctgatcatcacccccgacagcagccaccagaacagacacgccatgatgatgaagagctggaagatcgccatcgagagcctgggcttcaagagattcaagtacagcaagttcagccacatgcacctgatggccttcagaaagatcagcctgaagaccaccagcgacctggtgagcagaaactaccccggcatgctgtacatcccccaggacttcaacagcatcgaggacgaggagtacagcaaccccagctgctacgtgagaagcgacatcgaggacgagcagctggcctacggcttcaccgagctgcccgacgccccctacgacagcgacagcggcgagagccaggccagcagcatccccttctacgagctggaggaccccatcctgctgctgagctag

SEQ ID NO: 19583 - DNA, 621 bp, Artificial Sequence
  Description of Artificial Sequence: Synthetic coding sequence
atggtggtggtgatgaagttcttcagatgggtgagaagagcctggcagagaatcatcagctgggtgttcttctggagacagaagatcaagcccaccatcagcggccaccccgacagcaagaagcacagcctgaagaagatggagaagaccctgcaggtggtggagaccctgagactggtggagctgcccaaggaggccaagcccaagctgggcgagagccccgagctggccgacccctgcgtgctggccaagaccaccgaggagaccgaggtggagctgggccagcagggccagagcctgctgcagctgcccagaaccgccgtgaagagcgtgagcaccctgatggtgagcgccctgcagagcggctggcagatgtgcagctggaagagcagcgtgagcagcgccagcgtgagcagccaggtgagaacccagagccccctgaagacccccgaggccgagctgctgtgggaggtgtacctggtgctgtgggccgtgagaaagcacctgagaagactgtacagaagacaggagagacacagaagacaccacgtgagatgccacgccgcccccagacccaaccccgcccagagcctgaagctggacgcccagagccccctgtag

SEQ ID NO: 19584 - DNA, 762 bp, Artificial Sequence
  Description of Artificial Sequence: Synthetic coding sequence
atgagcttcagcgtgcacaaccagaagggcagcaagagacccctgcccctggagcccctgctgttcctgcaggtgcccagaagcaactacctgcacttccaggaggagaagcagagactgcacctgaagaagttcctgctggacagaatgttcctggtggccaagatccaggccaacgtggagagaaaggacgtggccgactactacgagcagatgttccagagcgtgctgaagcaccacctgggcgaggccgtgaccggcctgctgctgatctaccccaccagcatcctgcacatcctggagagcagcagcgacaccctgtacaaggtgctgctggactacatcggccacgtgaaggacgagaccgtgttcttcatccagcagatgaagatcatcgtgatcagccacaacatccccatgagactgttcatgcagtggcacgtgagcgtgatcaaggtgcccgtgatgtacctggacgacgtgacccagagccagagcctgaaggaggtgatcaccgacttcctgacccagacccacaagctgagcctgtacctgtgccagaccatgaaggtgggcaccaagggccccggcgacaacctgcaccaggtggcccccgacctgctgctgcccgagcagatcatcaagtacctgtgcaagagcgaggagttcatggaccccgccaccttcatcaacatgtacaacagacccatccacatcaccctggacagcgaggtggtgtggcccgcccccagcagattctag

SEQ ID NO: 19585 - DNA, 2688 bp, Artificial Sequence
  Description of Artificial Sequence: Synthetic coding sequence
atgtggaccgaggaggccggcgccaccgccgaggcccaggagagcggcatcagaaacaagagcagcagcagcagccagatccccgtggtgggcgtggtgaccgaggacgacgaggcccaggacgtgttcaagcccatggacctgaacagagtgatcaagctgctggaggagaccgacaaggacggcctggaggagaagcagctgaagttcgtgaagaagctggtgcagtgctaccagaacggcctgcccctgagagacctggcccagatcttcaagatcctgaacctgtgcagcggcaagatcaagaaccagcccagattcatcgagagcgcctacgacatcatcaagctgtgcggcctgcccttcctgaagaagaaggtgagcgacgagatcacctacgccgaggacaccgccaacagcatcgccctgctgggcgacctgatgaagatccccagcagcgagctgagaatccagatctgcaagtgcatcgtggacttctaccacgccgagccccccaagaagcacatccccggctaccagcaggccagcagcagctacaagatccagatggccgaggtgggcggcctggccaagaccatggtgcagagcatgaccctgctggagaaccagctggtggagaagctgtgggtgctgaaggtgctgcagcacctgagcaccagcgaggtgaactgcaccatcatgatgaaggcccaggccgccagcggcatctgcacccacctgaacgaccccgaccccagcggccagctgctgttcagaagcagcgagatcctgtggaacctgctggagaagagcagcaaggaggaggtgatccagcagctgagcaacctggagtgcctgctggccctgaaggaggtgttcaagaacctgttcatgagaggcttcagccactacgacagacagctgagaaacgacatcctggtgatcaccaccatcatcgcccagaaccccgaggcccccatgatcgagtgcggcttcaccaaggacctgatcctgttcgccaccttcaacgaggtgaagagccagaacctgctggtgaagggcctgaagctgagcaacagctacgaggacttcgagctgaagaagctgctgttcaacgtgatcgtgatcctgtgcaaggacctgcccaccgtgcagctgctgatcgacggcaaggtgatcctggccctgttcacctacgtgaagaagcccgagaagcagaagatcatcgactggagcgccgcccagcacgaggagctgcagctgcacgccatcgccaccctgagcagcgtggcccccctgctgatcgaggagtacatgagctgccagggcaacgccagagtgctggccttcctggagtggtgcgagagcgaggaccccttcttcagccacggcaacagcttccacggcaccggcggcagaggcaacaagttcgcccagatgagatacagcctgagactgctgagagccgtggtgtacctggaggacgagaccgtgaacaaggacctgtgcgagaagggcaccatccagcagatgatcggcatcttcaagaacatcatcagcaagcccaacgagaaggaggaggccatcgtgctggagatccagagcgacatcctgctgatcctgagcggcctgtgcgagaaccacatccagagaaaggagatcttcggcaccgagggcgtggacatcgtgctgcacgtgatgaagaccgaccccagaaagctgcagagcggcctgggctacaacgtgctgctgttcagcaccctggacagcatctggtgctgcatcctgggctgctaccccagcgaggactacttcctggagaaggagggcatcttcctgctgctggacctgctggccctgaaccagaagaagttctgcaacctgatcctgggcatcatggtggagttctgcgacaaccccaagaccgccgcccacgtgaacgcctggcagggcaagaaggaccagaccgccgccagcctgctgatcaagctgtggagaaaggaggagaaggagctgggcgtgaagagagacaagaacggcaagatcatcgacttcgagaacctgcccggcctgagcgccgaggacttcgtgaccctgtgcatcatccacagatacctggacttcaagatcggcgagatctggaacgagatctacgaggagatcaagctggagaagctgagacccgtgaccaccgacaagaaggccctggaggccatcaccaccgccagcgagaacatcggcaagatggtggccagcctgcagagcgacatcatcgagagccaggcctgccaggacatgcagaacgagcagaaggtgtacgccaagatccaggccacccacaagcagagagagctggccaacaagagctgggaggacttcctggccagaaccagcaacgccaagaccctgaagaaggccaagagcctgcaggagaaggccatcgaggccagcagataccacaagagaccccagaacgccatcttccaccagacccacatcaagggcctgaacaccaccgtgcccagcggcggcgtggtgaccgtggagagcacccccgccagactggtgggcggccccctggtggacaccgacatcgccctgaagaagctgcccatcagaggcggcgccctgcagagagtgaaggccgtgaagatcgtggacgcccccaagaagagcatccccacctag

SEQ ID NO: 19586 - DNA, 2826 bp, Artificial Sequence
  Description of Artificial Sequence: Synthetic coding sequence
atgtggaccgaggaggccggcgccaccgccgaggcccaggagagcggcatcagaaacaagagcagcagcagcagccagatccccgtggtgggcgtggtgaccgaggacgacgaggcccaggacgtgttcaagcccatggacctgaacagagtgatcaagctgctggaggagaccgacaaggacggcctggaggagaagcagctgaagttcgtgaagaagctggtgcagtgctaccagaacggcctgcccctgagagacctggcccagatcttcaagatcctgaacctgtgcagcggcaagatcaagaaccagcccagattcatcgagagcgcctacgacatcatcaagctgtgcggcctgcccttcctgaagaagaaggtgagcgacgagatcacctacgccgaggacaccgccaacagcatcgccctgctgggcgacctgatgaagatccccagcagcgagctgagaatccagatctgcaagtgcatcgtggacttctaccacgccgagccccccaagaagcacatccccggctaccagcaggccagcagcagctacaagatccagatggccgaggtgggcggcctggccaagaccatggtgcagagcatgaccctgctggagaaccagctggtggagaagctgtgggtgctgaaggtgctgcagcacctgagcaccagcgaggtgaactgcaccatcatgatgaaggcccaggccgccagcggcatctgcacccacctgaacgaccccgaccccagcggccagctgctgttcagaagcagcgagatcctgtggaacctgctggagaagagcagcaaggaggaggtgatccagcagctgagcaacctggagtgcctgctggccctgaaggaggtgttcaagaacctgttcatgagaggcttcagccactacgacagacagctgagaaacgacatcctggtgatcaccaccatcatcgcccagaaccccgaggcccccatgatcgagtgcggcttcaccaaggacctgatcctgttcgccaccttcaacgaggtgaagagccagaacctgctggtgaagggcctgaagctgagcaacagctacgaggacttcgagctgaagaagctgctgttcaacgtgatcgtgatcctgtgcaaggacctgcccaccgtgcagctgctgatcgacggcaaggtgatcctggccctgttcacctacgtgaagaagcccgagaagcagaagatcatcgactggagcgccgcccagcacgaggagctgcagctgcacgccatcgccaccctgagcagcgtggcccccctgctgatcgaggagtacatgagctgccagggcaacgccagagtgctggccttcctggagtggtgcgagagcgaggaccccttcttcagccacggcaacagcttccacggcaccggcggcagaggcaacaagttcgcccagatgagatacagcctgagactgctgagagccgtggtgtacctggaggacgagaccgtgaacaaggacctgtgcgagaagggcaccatccagcagatgatcggcatcttcaagaacatcatcagcaagcccaacgagaaggaggaggccatcgtgctggagatccagagcgacatcctgctgatcctgagcggcctgtgcgagaaccacatccagagaaaggagatcttcggcaccgagggcgtggacatcgtgctgcacgtgatgaagaccgaccccagaaagctgcagagcggcctgggctacaacgtgctgctgttcagcaccctggacagcatctggtgctgcatcctgggctgctaccccagcgaggactacttcctggagaaggagggcatcttcctgctgctggacctgctggccctgaaccagaagaagttctgcaacctgatcctgggcatcatggtggagttctgcgacaaccccaagaccgccgcccacgtgaacgcctggcagggcaagaaggaccagaccgccgccagcctgctgatcaagctgtggagaaaggaggagaaggagctgggcgtgaagagagacaagaacggcaagatcatcgacaccaagaagcccctgttcaccagcttccaggaggagcagaagatcatccccctgcccgccaactgccccagcatcgccgtgatggacgtgagcgagaacatcagagccaagatctacgccatcctgggcaagctggacttcgagaacctgcccggcctgagcgccgaggacttcgtgaccctgtgcatcatccacagatacctggacttcaagatcggcgagatctggaacgagatctacgaggagatcaagctggagaagctgagacccgtgaccaccgacaagaaggccctggaggccatcaccaccgccagcgagaacatcggcaagatggtggccagcctgcagagcgacatcatcgagagccaggcctgccaggacatgcagaacgagcagaaggtgtacgccaagatccaggccacccacaagcagagagagctggccaacaagagctgggaggacttcctggccagaaccagcaacgccaagaccctgaagaaggccaagagcctgcaggagaaggccatcgaggccagcagataccacaagagaccccagaacgccatcttccaccagacccacatcaagggcctgaacaccaccgtgcccagcggcggcgtggtgaccgtggagagcacccccgccagactggtgggcggccccctggtggacaccgacatcgccctgaagaagctgcccatcagaggcggcgccctgcagagagtgaaggccgtgaagatcgtggacgcccccaagaagagcatccccacctag

SEQ ID NO: 19587 - DNA, 1437 bp, Artificial Sequence
  Description of Artificial Sequence: Synthetic coding sequence
gagctgcagctgcacgccatcgccaccctgagcagcgtggcccccctgctgatcgaggagtacatgagctgccagggcaacgccagagtgctggccttcctggagtggtgcgagagcgaggaccccttcttcagccacggcaacagcttccacggcaccggcggcagaggcaacaagttcgcccagatgagatacagcctgagactgctgagagccgtggtgtacctggaggacgagaccgtgaacaaggacctgtgcgagaagggcaccatccagcagatgatcggcatcttcaagaacatcatcagcaagcccaacgagaaggaggaggccatcgtgctggagatccagagcgacatcctgctgatcctgagcggcctgtgcgagaaccacatccagagaaaggagatcttcggcaccgagggcgtggacatcgtgctgcacgtgatgaagaccgaccccagaaagctgcagagcggcctgggctacaacgtgctgctgttcagcaccctggacagcatctggtgctgcatcctgggctgctaccccagcgaggactacttcctggagaaggagggcatcttcctgctgctggacctgctggccctgaaccagaagaagttctgcaacctgatcctgggcatcatggtggagttctgcgacaaccccaagaccgccgcccacgtgaacgcctggcagggcaagaaggaccagaccgccgccagcctgctgatcaagctgtggagaaaggaggagaaggagctgggcgtgaagagagacaagaacggcaagatcatcgacttcgagaacctgcccggcctgagcgccgaggacttcgtgaccctgtgcatcatccacagatacctggacttcaagatcggcgagatctggaacgagatctacgaggagatcaagctggagaagctgagacccgtgaccaccgacaagaaggccctggaggccatcaccaccgccagcgagaacatcggcaagatggtggccagcctgcagagcgacatcatcgagagccaggcctgccaggacatgcagaacgagcagaaggtgtacgccaagatccaggccacccacaagcagagagagctggccaacaagagctgggaggacttcctggccagaaccagcaacgccaagaccctgaagaaggccaagagcctgcaggagaaggccatcgaggccagcagataccacaagagaccccagaacgccatcttccaccagacccacatcaagggcctgaacaccaccgtgcccagcggcggcgtggtgaccgtggagagcacccccgccagactggtgggcggccccctggtggacaccgacatcgccctgaagaagctgcccatcagaggcggcgccctgcagagagtgaaggccgtgaagatcgtggacgcccccaagaagagcatccccacctag

SEQ ID NO: 19588 - DNA, 2772 bp, Artificial Sequence
  Description of Artificial Sequence: Synthetic coding sequence
atgtggaccgaggaggccggcgccaccgccgaggcccaggagagcggcatcagaaacaagagcagcagcagcagccagatccccgtggtgggcgtggtgaccgaggacgacgaggcccaggacgtgttcaagcccatggacctgaacagagtgatcaagctgctggaggagaccgacaaggacggcctggaggagaagcagctgaagttcgtgaagaagctggtgcagtgctaccagaacggcctgcccctgagagacctggcccagatcttcaagatcctgaacctgtgcagcggcaagatcaagaaccagcccagattcatcgagagcgcctacgacatcatcaagctgtgcggcctgcccttcctgaagaagaaggtgagcgacgagatcacctacgccgaggacaccgccaacagcatcgccctgctgggcgacctgatgaagatccccagcagcgagctgagaatccagatctgctaccagcaggccagcagcagctacaagatccagatggccgaggtgggcggcctggccaagaccatggtgcagagcatgaccctgctggagaaccagctggtggagaagctgtgggtgctgaaggtgctgcagcacctgagcaccagcgaggtgaactgcaccatcatgatgaaggcccaggccgccagcggcatctgcacccacctgaacgaccccgaccccagcggccagctgctgttcagaagcagcgagatcctgtggaacctgctggagaagagcagcaaggaggaggtgatccagcagctgagcaacctggagtgcctgctggccctgaaggaggtgttcaagaacctgttcatgagaggcttcagccactacgacagacagctgagaaacgacatcctggtgatcaccaccatcatcgcccagaaccccgaggcccccatgatcgagtgcggcttcaccaaggacctgatcctgttcgccaccttcaacgaggtgaagagccagaacctgctggtgaagggcctgaagctgagcaacagctacgaggacttcgagctgaagaagctgctgttcaacgtgatcgtgatcctgtgcaaggacctgcccaccgtgcagctgctgatcgacggcaaggtgatcctggccctgttcacctacgtgaagaagcccgagaagcagaagatcatcgactggagcgccgcccagcacgaggagctgcagctgcacgccatcgccaccctgagcagcgtggcccccctgctgatcgaggagtacatgagctgccagggcaacgccagagtgctggccttcctggagtggtgcgagagcgaggaccccttcttcagccacggcaacagcttccacggcaccggcggcagaggcaacaagttcgcccagatgagatacagcctgagactgctgagagccgtggtgtacctggaggacgagaccgtgaacaaggacctgtgcgagaagggcaccatccagcagatgatcggcatcttcaagaacatcatcagcaagcccaacgagaaggaggaggccatcgtgctggagatccagagcgacatcctgctgatcctgagcggcctgtgcgagaaccacatccagagaaaggagatcttcggcaccgagggcgtggacatcgtgctgcacgtgatgaagaccgaccccagaaagctgcagagcggcctgggctacaacgtgctgctgttcagcaccctggacagcatctggtgctgcatcctgggctgctaccccagcgaggactacttcctggagaaggagggcatcttcctgctgctggacctgctggccctgaaccagaagaagttctgcaacctgatcctgggcatcatggtggagttctgcgacaaccccaagaccgccgcccacgtgaacgcctggcagggcaagaaggaccagaccgccgccagcctgctgatcaagctgtggagaaaggaggagaaggagctgggcgtgaagagagacaagaacggcaagatcatcgacaccaagaagcccctgttcaccagcttccaggaggagcagaagatcatccccctgcccgccaactgccccagcatcgccgtgatggacgtgagcgagaacatcagagccaagatctacgccatcctgggcaagctggacttcgagaacctgcccggcctgagcgccgaggacttcgtgaccctgtgcatcatccacagatacctggacttcaagatcggcgagatctggaacgagatctacgaggagatcaagctggagaagctgagacccgtgaccaccgacaagaaggccctggaggccatcaccaccgccagcgagaacatcggcaagatggtggccagcctgcagagcgacatcatcgagagccaggcctgccaggacatgcagaacgagcagaaggtgtacgccaagatccaggccacccacaagcagagagagctggccaacaagagctgggaggacttcctggccagaaccagcaacgccaagaccctgaagaaggccaagagcctgcaggagaaggccatcgaggccagcagataccacaagagaccccagaacgccatcttccaccagacccacatcaagggcctgaacaccaccgtgcccagcggcggcgtggtgaccgtggagagcacccccgccagactggtgggcggccccctggtggacaccgacatcgccctgaagaagctgcccatcagaggcggcgccctgcagagagtgaaggccgtgaagatcgtggacgcccccaagaagagcatccccacctag

SEQ ID NO: 19589 - DNA, 456 bp, Artificial Sequence
  Description of Artificial Sequence: Synthetic coding sequence
atgagaatggcccccaccgagagcaccgagggcagaagactgtggcccggccccagagagggcggcagcggcaaggagaccaccagcgagaagctgagcaacctgcccagaccccacagctacagccccaagagagccgacgccgagagcttcagaggcgtgcccgccgccttcaagaagtgcagagaggtgttcagagcctgctggggcagcagagagctgctgttcctgttcaaggccatcagcgaggccggccccgcccagaacagctgcggcatcaccctggagaaggccggcggcctggaggacaccggcagccactggctgagctgggccagatgcaaggtgctgtacatcaacggcttcaccgacccctggaaggacgcccaggcctggatcctgatcgtgagctgcaagaagggcaagggcacccccgagagagagggcagaaactag

SEQ ID NO: 19590 - DNA, 510 bp, Artificial Sequence
  Description of Artificial Sequence: Synthetic coding sequence
atgggcagctgcggctgggccctgacccagagcgactggtgccccttcaagaagagaaagagacaccagagatgcgcccacagcgagaccagacacatgagaacccagagacagggcggctacctgcaggccagagagagaggcctgggcgaggccaaccccgcctacgccctgatcctggacttccagccccccgagctgcagaacctgagcgagatgggcatcaaccacgagctgggctacagcagcatcatccccatgatgaagagagccttcagcgcctgcggcaccctgggcctgatcatgagcggcatcttcgacaaccccggccccatcaagaacaccctgaagaaggccttcaccatgctgtggagcttcaccgtgtacaccagactggagagcctgagagtggccctgagcaacgaggagatggtgcccttcatcttccacctgaagacccagaccgccaacatgctgagcggccccatcagcacccccatgctgctgtag

SEQ ID NO: 19591 - DNA, 1317 bp, Artificial Sequence
  Description of Artificial Sequence: Synthetic coding sequence
atggacgtggagatccaggacacccccggcaagatcagcatcagcaagagaagcatcctgagcggcaccgtggagaacatcgactacccccactactgcgacctgctgagaaagatgaacatgcccttcgtgaagggcctggagaacagacacaactacggcagattcgagaagaagtgcaaccccgccttcctgaagttccacccctacccccccagcgtgctgcccgactaccacctgcacgacccctacccccccccctacggcccccactaccccctgttccccctgagagacgacgtgaccctgggcgacagctgcagcggcttcatgagccccggcggcgacgccgacctgaaccccggcatcggcagaaccatccccaccctggtggacttcagcgacgtgaagccccagcacagagtgcccagacccgacaccggcttccagaccaccatcaagagacagaagatcctgagcgaggagctgcagcagaacagaagatggaacagcagagaggtgcccgacatcagcatcagagccagactgggcggctggaccagccccctgaaggtgacccccctgcagccccaccacgagggcagaagcctgagccacatcttcaccttcgacgaggaggccacctgcaccgacgagggcgagcccctggtgcagaccaacaagaagtgcaacgccaaggacagcttctacaagagcagcacccagaaggcctacgaggacgtgccctgggacaagatgctgccccccaagctggtgcccgaggagaccaccctggagaagaccgccgaccccatcagccagtgcttcaccctgaagagatacaagggcgtgcccgccatcacccagatggtgggcgagctgtgggacagattccagaccagaagcttcctggcccccgtgaagcccatcaacttcgtgagcagcagcagcagaagcaagtacatccccctgtacaccggccacgtgcagagcaccaacgccgacgacgtggacaaccccctgggcgacatcgccagcctggccaagcagagatacagcaagcccctgtacaccaacaccagcagagccgccaacatccccggctacaccggcaaggtgcacttcaccgccacccaccccgccaacagcaacatccccagcaccacccccagccccgacagcgagctgcacagagtgttccagaaggagatggccgtggacctgttcagacaccaggcccccctgagcagactggtgaccaccgtgagaccctacaaccccttcaacaagaaggacaaggagaccatcgactactag

SEQ ID NO: 19592 - DNA, 144 bp, Artificial Sequence
  Description of Artificial Sequence: Synthetic coding sequence
atgctgcagttcctgctgggcttcaccctgggcaacgtggtgggcatgtacctggcccagaactacgacatccccaacctggccaagaagctggaggagatcaagaaggacctggacgccaagaagaagccccccagcgcctag

SEQ ID NO: 19593 - DNA, 315 bp, Artificial Sequence
  Description of Artificial Sequence: Synthetic coding sequence
atgggcagaagcccctgcttcttcaagagcttcaagggcaagctgcacaaggacagaagccccgaccccagcaccctggccagcccccaccccagcaccgaggccagaagacccgtggaggccggcagcgccgagtggacctggggctggatgaagagactgccccccgccagcctgagccccggcatcgccatgagctgctacagcggcgacagcatgctgcagaagtacaaggtgaagaacgcctacagactgcactggcagggcagagaggagcccggcgccagcaccttcgccagcctggtgttccagtag

SEQ ID NO: 19594 - DNA, 315 bp, Artificial Sequence; identical to SEQ ID NO: 19593
  Description of Artificial Sequence: Synthetic coding sequence

SEQ ID NO: 19595 - DNA, 255 bp, Artificial Sequence
  Description of Artificial Sequence: Synthetic coding sequence
atggccagcgtgcccagcatcggctgcctgctggccagaaaccagtactacagaaagagcagcgtgagcagcgtgagcagcctgaccagcagcgacagcgtgaacttcatcgacgacgacaagccccagcagggcctgcccgaggtggccgagagcacctggtggttcaagagcttcttccacagcgagcccgtgctgagcaacgtgagaatcaaggacctgagcgccaccggcagcctgagcggcagaagctag

SEQ ID NO: 19596 - DNA, 246 bp, Artificial Sequence
  Description of Artificial Sequence: Synthetic coding sequence
atggccagcgtgcccagcatcggctgcctgctggccagaaaccagtactacagaaagagcagcgtgagcagcgtgagcagcctgaccagcagcgacagcgtgaacttcatcgacgacgacaagccccagcagggcctgcccgaggtggccgagagcacctggtggttcaagagcttcttccacagcgagcccgtgctgagcaacgtgagaatcaaggacctgagcgccaccggcatgaacagctag

SEQ ID NO: 19597 - DNA, 399 bp, Artificial Sequence
  Description of Artificial Sequence: Synthetic coding sequence
atggccgagaagccccaccagaacagctgcaacagcgtgagacagctgttcaagaccaagcagctggtgacccacagagacagaggcagctgcacccacagagcccagggcctgctggccgccagaaccaccgccctgcagagaagccccctgcagcaggagatctgggagagcaccaccgccctgaacctgcccagcgccctggccccccagggcctgaccgccaaggacgcccacttcctgggcgacaccgaccccatccaggagggcgccagagaccacgccgccggcggccccttccaggacagacaggccagcgtggccgcccagaccctgagctgggagagaggccagggcttcagcagacaccacggcaaccacctgctgtacagccactag

SEQ ID NO: 19598 - DNA, 690 bp, Artificial Sequence
  Description of Artificial Sequence: Synthetic coding sequence
atggccgccctgggccacctggccggcgaggccgccgccgcccccggccccggcaccccctgcgccagcagaggcgccagactgcccggccccgtgagcagcgccagaaaccccagcaccgtgtgcctgtgccccgagcagcccacctgcagcaacgccgacagcagagcccaccccctgggcgacgagggcggcaccgccagcaagaagcagaagaacaagaagaagaccagaaacagagccagcgtggccaacggcggcgagaaggccagcgagaagctggcccccgaggaggtgcccctgagcgccgaggcccaggcccagcagctggcccaggagctggcctggtgcgtggagcagctggagctgggcctgaagagacagaagcccacccccaagcagaaggagcaggccatcggcgccatcagaaccctgagaagcaagagaacccccctgcccagaaagagacagctgatgcacagcctgttcggcgactacagagcccagatggaggccgagtggagagaggccctgagagccctgagagccgccgcctacagcgcccaggtgcagcccgtggacggcgccaccagaaagaagagccagagagtgtgcagacccagaagcatctggagagccaaggccaccctggacatgcccgacgaggagttcagattcaacttcttctag

SEQ ID NO: 19599 - DNA, 606 bp, Artificial Sequence
  Description of Artificial Sequence: Synthetic coding sequence
atggagaacggcttcaccatgtgccagaccggcagacagcaccccgtggcctgcggcctgcacctgagcggcggcaaggaggacctgaacgacctgagaatggagggcgtgaccaccctggtgcccagcggcagcaagttcaaccagggcagacccacctaccccgccgagccccaggccaaggtgaccctgaacatctgcagcagatgcgccagactgcagggcgacaacctggaggagagaaccgaggagagcctgcccatcctgcacagccccgacgagaagatccccgacagcttcgacagcctgcccggcaccgaggaggccctgatggaggagggcgacgagttcgagaaggccagcaagctgaccggccccggcgaggccagcagcggcgtgggccacagcctgaagaactacatggaggaggacgagagcctgaagcagctgcaggtggtgcaccagccctggatcctgcccagcgacaccgagagcgagggcgtggaggccgagcaggagaagcacctgctgaaccagaacctgtgcggctgggacagcgagttctgcatcttccacaccctggccagcttcctgatctacaagtag

SEQ ID NO: 19600 - DNA, 1284 bp, Artificial Sequence
  Description of Artificial Sequence: Synthetic coding sequence
atgaccaagctgatcaccgagacccccgaccagcccatccccttcctgatcgaccacctgcagagcaagcagggcaacagaggccagctgcagagaaccctgagcggcagcgccgccctgtgggccgagagcgagaagagcgagagcaagggcaccagaagagacttcagaagctacgacaagccctggcagctgaacgccaagaagcccaagaagagcaagagcgacctggccgtgagcaacatcagcccccccagccccgacagcaagagcctgcccagaagcgtggagcaccccaagtggaactggagaaccaagccccagagcagagacttcgacgagctgaaccacatcctgcaggagagcaagaagctgggcaaggccctggagaacctgagcagaagcatcgccatcagcgacgagctggacaaggagaccgtgaccttcaacagcagcctgctgagacccagagtgatcggcgagtggatcggcagagaggagaacgacgccgaccccctggccgccgagatgctgcagccccccatccccagaagcaagaacgaccagtgggagagcgaggacagcggcagcagccccgccggcagcctgaagatggagcccaagaacaagggcctgaagcagcagcagcagcagcacaagaagctgctggccgccatgctgagccaggacagcttcgagagcatccacagccccacccccagcgtgaccgaggaggacatcgacaacgaggacgacgccatggagctgctggaggacctgaacgacctgagaatggagggcgtgaccaccctggtgcccagcggcagcaagttcaaccagggcagacccacctaccccgccgagccccaggccaaggtgaccctgaacatctgcagcagatgcgccagactgcagggcgacaacctggaggagagaaccgaggagagcctgcccatcctgcacagccccgacgagaagatccccgacagcttcgacagcctgcccggcaccgaggaggccctgatggaggagggcgacgagttcgagaaggccagcaagctgaccggccccggcgaggccagcagcggcgtgggccacagcctgaagaactacatggaggaggacgagagcctgaagcagctgcaggtggtgcaccagccctggatcctgcccagcgacaccgagagcgagggcgtggaggccgagcaggagaagagaagcgccgacctgctgctgtgcgtgccctgcagcagctgccccaccctggtgtacagcggcctgtag

SEQ ID NO: 19601 - DNA, 864 bp, Artificial Sequence
  Description of Artificial Sequence: Synthetic coding sequence
atggccagccacccccagaccagaatccaggcctacctggagaagaacaagatcggccccctgttcgaggagctgatgaccaagctgatcaccgagacccccgaccagcccatccccttcctgatcgaccacctgcagagcaagcagggcaacagaggccagctgcagagaaccctgagcggcagcgccgccctgtgggccgagagcgagaagagcgagagcaagggcaccagaagagacttcagaagctacgacaagccctggcagctgaacgccaagaagcccaagaagagcaagagcgacctggccgtgagcaacatcagcccccccagccccgacagcaagagcctgcccagaagcgtggagcaccccaagtggaactggagaaccaagccccagagcagagacttcgacgagctgaaccacatcctgcaggagagcaagaagctgggcaaggccctggagaacctgagcagaagcatcgccatcagcgacgagctggacaaggagaccgtgaccttcaacagcagcctgctgagacccagagtgatcggcgagtggatcggcagagaggagaacgacgccgaccccctggccgccgagatgctgcagccccccatccccagaagcaagaacgaccagtgggagagcgaggacagcggcagcagccccgccggcagcctgaagatggagcccaagaacaagggcctgaagcagcagcagcagcagcacaagaagctgctggccgccatgctgagccaggacagcttcgagagcatccacagccccacccccagcgtgaccgaggaggacatcgacaacgaggacgacgccatggagctgctgggcaacttcaagaactag

SEQ ID NO: 19602 - DNA, 1617 bp, Artificial Sequence
  Description of Artificial Sequence: Synthetic coding sequence
atgagcagccccctggccagcgagctgagcgagctggccgccctgagacccggcttcagactgagcgccccccacgccagagtggcccccagagccgccacccacgccagaggcagaggcagagccagccacgccggccagcccagactgagaagcagctgccccggccccagccccggcaagagaagagtggtgcccagcggcggcgcccagcccagagtgctgcccgccctgagcagcagaagccacctgttccccatggccagccacccccagaccagaatccaggcctacctggagaagaacaagatcggccccctgttcgaggagctgatgaccaagctgatcaccgagacccccgaccagcccatccccttcctgatcgaccacctgcagagcaagcagggcaacagaggccagctgcagagaaccctgagcggcagcgccgccctgtgggccgagagcgagaagagcgagagcaagggcaccagaagagacttcagaagctacgacaagccctggcagctgaacgccaagaagcccaagaagagcaagagcgacctggccgtgagcaacatcagcccccccagccccgacagcaagagcctgcccagaagcgtggagcaccccaagtggaactggagaaccaagccccagagcagagacttcgacgagctgaaccacatcctgcaggagagcaagaagctgggcaaggccctggagaacctgagcagaagcatcgccatcagcgacgagctggacaaggagaccgtgaccttcaacagcagcctgctgagacccagagtgatcggcgagtggatcggcagagaggagaacgacgccgaccccctggccgccgagatgctgcagccccccatccccagaagcaagaacgaccagtgggagagcgaggacagcggcagcagccccgccggcagcctgaagatggagcccaagaacaagggcctgaagcagcagcagcagcagcacaagaagctgctggccgccatgctgagccaggacagcttcgagagcatccacagccccacccccagcgtgaccgaggaggacatcgacaacgaggacgacgccatggagctgctggaggacctgaacgacctgagaatggagggcgtgaccaccctggtgcccagcggcagcaagttcaaccagggcagacccacctaccccgccgagccccaggccaaggtgaccctgaacatctgcagcagatgcgccagactgcagggcgacaacctggaggagagaaccgaggagagcctgcccatcctgcacagccccgacgagaagatccccgacagcttcgacagcctgcccggcaccgaggaggccctgatggaggagggcgacgagttcgagaaggccagcaagctgaccggccccggcgaggccagcagcggcgtgggccacagcctgaagaactacatggaggaggacgagagcctgaagcagctgcaggtggtgcaccagccctggatcctgcccagcgacaccgagagcgagggcgtggaggccgagcaggagaagagaagcgccgacctgctgctgtgcgtgccctgcagcagctgccccaccctggtgtacagcggcctgtag

SEQ ID NO: 19603 - DNA, 390 bp, Artificial Sequence
  Description of Artificial Sequence: Synthetic coding sequence
atggccagccacccccagaccagaatccaggcctacctggagaagaacaagatcggccccctgttcgaggagctgatgaccaagctgatcaccgagacccccgaccagcccatccccttcctgatcgaccacctgcagagcaagcagggcaacagaggccagctgcagagaaccctgagcggcagcgccgccctgtgggccgagagcgagaagagcgagagcaagggcaccagaagagacttcagaagctacgacaagccctggcagctgaacgccaagaagcccaagaagagcaagagcgacctggccgtgagcaacatcagcccccccagccccgacagcaagagctgcaaggaggtgagctacagcaacgccatccagagcatgtag

SEQ ID NO: 19604 - DNA, 1359 bp, Artificial Sequence
  Description of Artificial Sequence: Synthetic coding sequence
atggccagccacccccagaccagaatccaggcctacctggagaagaacaagatcggccccctgttcgaggagctgatgaccaagctgatcaccgagacccccgaccagcccatccccttcctgatcgaccacctgcagagcaagcagggcaacagaggccagctgcagagaaccctgagcggcagcgccgccctgtgggccgagagcgagaagagcgagagcaagggcaccagaagagacttcagaagctacgacaagccctggcagctgaacgccaagaagcccaagaagagcaagagcgacctggccgtgagcaacatcagcccccccagccccgacagcaagagcctgcccagaagcgtggagcaccccaagtggaactggagaaccaagccccagagcagagacttcgacgagctgaaccacatcctgcaggagagcaagaagctgggcaaggccctggagaacctgagcagaagcatcgccatcagcgacgagctggacaaggagaccgtgaccttcaacagcagcctgctgagacccagagtgatcggcgagtggatcggcagagaggagaacgacgccgaccccctggccgccgagatgctgcagccccccatccccagaagcaagaacgaccagtgggagagcgaggacagcggcagcagccccgccggcagcctgaagatggagcccaagaacaagggcctgaagcagcagcagcagcagcacaagaagctgctggccgccatgctgagccaggacagcttcgagagcatccacagccccacccccagcgtgaccgaggaggacatcgacaacgaggacgacgccatggagctgctggaggacctgaacgacctgagaatggagggcgtgaccaccctggtgcccagcggcagcaagttcaaccagggcagacccacctaccccgccgagccccaggccaaggtgaccctgaacatctgcagcagatgcgccagactgcagggcgacaacctggaggagagaaccgaggagagcctgcccatcctgcacagccccgacgagaagatccccgacagcttcgacagcctgcccggcaccgaggaggccctgatggaggagggcgacgagttcgagaaggccagcaagctgaccggccccggcgaggccagcagcggcgtgggccacagcctgaagaactacatggaggaggacgagagcctgaagcagctgcaggtggtgcaccagccctggatcctgcccagcgacaccgagagcgagggcgtggaggccgagcaggagaagagaagcgccgacctgctgctgtgcgtgccctgcagcagctgccccaccctggtgtacagcggcctgtag

SEQ ID NO: 19605 - DNA, 624 bp, Artificial Sequence
  Description of Artificial Sequence: Synthetic coding sequence
atggccgaggacctggacgagctgctggacgaggtggagagcaagttctgcacccccgacctgctgagaagaggcatggtggagcagcccaagggctgcggcggcggcacccacagcagcgacagaaaccaggccaaggccaaggagaccctgagaagcaccgagaccttcaagaaggaggacgacctggacagcctgatcaacgagatcctggaggagcccaacctggacaagaagcccagcaagctgaagagcaagagcagcggcaacaccagcgtgagagccagcatcgagggcctgggcaagagctgcagccccgtgtacctgggcggcagcagcatcccctgcggcatcggcaccaacatcagctggagagcctgcgaccacctgagatgcatcgcctgcgacttcctggtggtgagctacgacgactacatgtgggacaagagctgcgactacctgttcttcagaaacaacatgcccgagttccacaagctgaaggccaagctgatcaagaagaagggcaccagagcctacgcctgccagtgcagctggagaaccatcgaggaggtgaccgacctgcagaccgaccaccagctgagatgggtgtgcggcaagcactag

SEQ ID NO: 19606 - DNA, 309 bp, Artificial Sequence
  Description of Artificial Sequence: Synthetic coding sequence
atggcccaggacttcagccagcacccccagaccggcatcatcagaagacacagattctacagccccaagcccctgagcaccacccccagaggccagagcttcctgctgagcagacaggccaaggtggccacctgggaccccatgctgagccccgacttccagcccaagagcgccttcaagctgacctggaccgcccagcccccctgcctgagcgtgacccccagccagggccagaccttccaccccaacagccccgagggcgagctgccccccgacctgaccgagaacacctgccccagccaggcctag

SEQ ID NO: 19607 - DNA, 558 bp, Artificial Sequence
  Description of Artificial Sequence: Synthetic coding sequence
atgtggaagctgggcagaggcagagtgctgctggacgagccccccgaggaggaggacggcctgagaggcggccccccccccgccgccgccgccgccgcccaggcccaggtgcagggcgccagcttcagaggctggaaggaggtgaccagcctgttcaacaaggacgacgagcagcacctgctggagagatgcaagagccccaagagcaagggcaccaacctgagactgaaggaggagctgaaggccgagaagaagagcggcttctgggacaacctggtgctgaagcagaacatccagagcaagaagcccgacgagatcgagggctgggagccccccaagctggccctggaggacatcagcgccgaccccgaggacaccgtgggcggccaccccagctggagcggctgggaggacgacgccaagggcagcaccaagtacaccagcctggccagcagcgccaacagcagcagatggagcctgagagccgccggcagactggtgagcatcagaagacagagcaagggccacctgaccgacagccccgaggaggccgagtag

SEQ ID NO: 19608 - DNA, 597 bp, Artificial Sequence
  Description of Artificial Sequence: Synthetic coding sequence
atgtggaagctgggcagaggcagagtgctgctggacgagccccccgaggaggaggacggcctgagaggcggccccccccccgccgccgccgccgccgcccaggcccaggtgcagggcgccagcttcagaggctggaaggaggtgaccagcctgttcaacaaggacgacgagcagcacctgctggagagatgcaagagccccaagagcaagggcaccaacctgagactgaaggaggagctgaaggccgagaagaagagcggcttctgggacaacctggtgctgaagcagaacatccagagcaagaagcccgacgagatcgagggctgggagccccccaagctggccctggaggacatcagcgccgaccccgaggacaccgtgggcggccaccccagctggagcggctgggaggacgacgccaagggcagcaccaagtacaccagcctggccagcagcgccaacagcagcagatggagcctgagagccgccggcagactgatcaaggaggtgtggatcaacttcagccagctgatcatcagcttcagaaagcactgcctggcccactacagagagctgagactgtgcatcaagtactag

SEQ ID NO: 19609 - DNA, 597 bp, Artificial Sequence; identical to SEQ ID NO: 19608
  Description of Artificial Sequence: Synthetic coding sequence

SEQ ID NO: 19610 - DNA, 480 bp, Artificial Sequence
  Description of Artificial Sequence: Synthetic coding sequence
atgagaaagaacgagagctacctgaaccagcccgccccccccatccccatccccaccctgagcctgatgggcggctgcagagagcacttcgagaaccactggaagggcagagccagatggctgatgcccgtgatccccgccctgtgggaggccaaggccggcagaagccccgaggtgagaagcagcaagcccgcctggcccacctggagaaaccccatcttcaccaagaacaccaagatcagccaggtgctggagctgttcctgaactaccagagcctgatctgcgccctggagaagcagaagagacagaagggcagcctggccatcttctgctggagcttccagggcggctgcgtgagcaagagacccgacgtgcccagcctgaagagccagaagcccaagagaaagagaatcaccggcagaaagagactgagcaagggcttctggagcctgctgttcagcaacctgggcagattctag

SEQ ID NO: 19611 - DNA, 480 bp, Artificial Sequence; identical to SEQ ID NO: 19610
  Description of Artificial Sequence: Synthetic coding sequence

SEQ ID NO: 19612 - DNA, 1899 bp, Artificial Sequence
  Description of Artificial Sequence: Synthetic coding sequence
atgagcaacctgaagatgaaggaggccgccctgatctacctggacagaagcggcggcctgcagaagttcatcgacgactgcaagtactacaacgacagcaagcagagctacgccgtgtacagattcaagatcctgatcaaccccagcgacgtggtggagctggacgccgagctgggcaaccacatcctgcaccagcccctgaaggccgccgaggtgttccagagcgtgtgcttcatcgccgtgaagaccctgagcctgatcggccagctgcagaccgagacccagatcaacatcgtgctgaagctgacccacctgccccccctgcccagctacggcctggacctgtgcgagttccccctggactacaccagccagagattctacatgatgcagggcatcgtgatcgccatgaccaccatcaccaagtacacccagggcgccagattcctgtgcagcgacgaggcctgccccctgagcaagggcttccagtacatcagagtgcacgtgcccggcgccaccgagagcgccaccatcagaaacgacttcctgtgcaacctgtgcgccagcagcctgcaggaggacagaaagttcagagtgctgggcgacaagcagatcgtggagatcatcgccaccaaggccctgagagccttccagggctacagcaacaaccagcccttcagattccagagcctgaccatcttcctgagagacgagagcgtgaacaagatgaacatcggcaacgagtacaagatcatcggcatccccacctgcgtgaagaccagccagaccgccgtgtgcatcgaggccaacagcatcaccttctgcaacagcaaggtgcccagcggcatcagcgacaacttcagatgcctgctgagcctgaccagcagcagctgctggaagttcaccgccatcctggccaacatcttcgccagccagatcaccccccccggcacctacaacctgctgaagctgtgcctgctgatgagcctggtgcagaccaccgacagaaacaaggagctggaggactgcctggacatcctgatcatcaccagcgacaccctgctgatcgacagactgctgaacttcagcatcaacctggtgcccagaggcatcagacacctggtgagcaccgagatcttccccaccctgagcagaaacaagtacggcaccggcgccgtgagcatccaggccggcagcgccctgctggccaagggcggcatctgcttcatcggcgacctggccagccacaagaaggacaagctggagcagctgcagaccgtgctggagagcagaagcatcaccgtgtacatccccggcaagaagttcggcgaggacatcgaccagcagatgaccttccccgtgcagtgcagcttctggagcttcgtggacgtggacagcagcagcagaagaaacgcccagaagatcaacaccctgatcggccagatggactgcagcctgatccccgccaacctggtggaggccttcggcctgctgatcaactgcaacgagagcagcccctgccaccccttcctgcccaccgtgcagcacaccctgaacaaggccatcaaccccgagggcctgttctacgccgccagcagacagttcaccaccgaggacttcgagaagctgctggccttcgccaagaacctgaacgtggagttcagcctggaggccgagagaatgacccacggctactacctggccagcagaagaatcagaaccggcagcgtgtgcggcagcaagctgagcgccagcgccctgaagtacctggtgttcctgagcgaggcccacgccagactgaacctgagaaacaaggtgctgaaggaggacgtgctgatcgccgccctgctgttcgagaccagcctgaccctgaagtacggcaacgagctgaactactag

SEQ ID NO: 19613 - DNA, 1002 bp, Artificial Sequence
  Description of Artificial Sequence: Synthetic coding sequence
atgatgcagggcatcgtgatcgccatgaccaccatcaccaagtacacccagggcgccagattcctgtgcagcgacgaggcctgccccctgagcaagggcttccagtacatcagagtgcacgtgcccggcgccaccgagagcgccaccatcagaaacgacttcctgtgcaacctgtgcgccagcagcctgcaggaggacagaaagttcagagtgctgggcgacaagcagatcgtggagatcatcgccaccaaggccctgagagccttccagggctacagcaacaaccagcccttcagattccagagcctgaccatcttcctgagagacgagagcgtgaacaagatgaacatcggcaacgagtacaagatcatcggcatccccacctgcgtgaagaccagccagaccgccgtgtgcatcgaggccaacagcatcaccttctgcaacagcaaggtgcccagcggcatcagcgacaacttcagatgcctgctgagcctgaccagcagcagctgctggaagttcaccgccatcctggccaacatcttcgccagccagatcaccccccccggcacctacaacctgctgaagctgtgcctgctgatgagcctggtgcagaccaccgacagaaacaaggagctggaggactgcctggacatcctgatcatcaccagcgacaccctgctgatcgacagactgctgaacttcagcatcaacctggtgcccagaggcatcagacacctggtgagcaccgagatcttccccaccctgagcagaaacaagtacggcaccggcgccgtgagcatccaggccggcagcgccctgctggccaagggcggcatctgcttcatcggcgacctggccagccacaagaaggacaagctggagcagctgcagaccgtgctggagagcagaagcatcaccgtgtacatccccggcaagaagttcggcgaggacatcgaccagcagatgaccttccccagcgtgcagttcctggtgttctgctag

SEQ ID NO: 19614 - DNA, 1773 bp, Artificial Sequence
  Description of Artificial Sequence: Synthetic coding sequence
atgagcaacctgaagatgaaggaggccgccctgatctacctggacagaagcggcggcctgcagaagttcatcgacgactgcaagtactacaacgacagcaagcagagctacgccgtgtacagattcaagatcctgatcaaccccagcgacgtggtggagctggacgccgagctgggcaaccacatcctgcaccagcccctgaaggccgccgaggtgttccagagcgtgtgcttcatcgccgtgaagaccctgagcctgatcggccagctgcagaccgagacccagatcaacatcgtgctgaagctgacccacctgccccccctgcccagctacggcctggacctgtgcgagttccccctggactacaccagccagagattctacatgatgcagggcatcgtgatcgccatgaccaccatcaccaagtacacccagggcgccagattcctgtgcagcgacgaggcctgccccctgagcaagggcttccagtacatcagagtgcacgtgcccggcgccaccgagagcgccaccatcagaaacgacttcctgtgcaacctgtgcgccagcagcctgcaggaggacagaaagttcagagtgctgggcgacaagcagatcgtggagatcatcgccaccaaggccctgagagccttccagggctacagcaacaaccagcccttcagattccagagcctgaccatcttcctgagagacgagagcgtgaacaagatgaacatcggcaacgagtacaagatcatcggcatccccacctgcgtgaagaccagccagaccgccgtgtgcatcgaggccaacagcatcaccttctgcaacagcaaggtgcccagcggcatcagcgacaacttcagatgcctgctgagcctgaccagcagcagctgctggaagttcaccgccatcctggccaacatcttcgccagccagatcaccccccccggcacctacaacctgctgaagctgtgcctgctgatgagcctggtgcagaccaccgacagaaacaaggagctggaggactgcctggacatcctgatcatcaccagcgacaccctgctgatcgacagactgctgaacttcagcatcaacctggtgcccagaggcatcagacacctggtgagcaccgagatcttccccaccctgagcagaaacaagtacggcaccggcgccgtgagcatccaggccggcagcgccctgctggccaagggcggcatctgcttcatcggcgacctggccagccacaagaaggacaagctggagcagctgcagaccgtgctggagagcagaagcatcaccgtgtacatccccggcaagaagttcggcgaggacatcgaccagcagatgaccttccccgtgcagtgcagcttctggagcttcgtggacgtggacagcagcagcagaagaaacgcccagaagatcaacaccctgatcggccagatggactgcagcctgatccccgccaacctggtggaggccttcggcctgctgatcaactgcaacgagagcagcccctgccaccccttcctgcccaccgtgcagcacaccctgaacaaggccatcaaccccgagggcctgttctacgccgccagcagacagttcaccaccgaggacttcgagaagctgctggccttcgccaagaacctgaacgtggagttcagcctggaggccgagagaatgacccacggctactacctggccagcagaagaatcagaaccggcagcgtgtgcggcagcaagctgagcgccagcgccctgaagtacctgtag

SEQ ID NO: 19615 - DNA, 2046 bp, Artificial Sequence
  Description of Artificial Sequence: Synthetic coding sequence
atgagcaacctgaagatgaaggaggccgccctgatctacctggacagaagcggcggcctgcagaagttcatcgacgactgcaagtactacaacgacagcaagcagagctacgccgtgtacagattcaagatcctgatcaaccccagcgacgtggtggagctggacgccgagctgggcaaccacatcctgcaccagcccctgaaggccgccgaggtgttccagagcgtgtgcttcatcgccgtgaagaccctgagcctgatcggccagctgcagaccgagacccagatcaacatcgtgctgaagctgacccacctgccccccctgcccagctacggcctggacctgtgcgagttccccctggactacaccagccagagattctacatgatgcagggcatcgtgatcgccatgaccaccatcaccaagtacacccagggcgccagattcctgtgcagcgacgaggcctgccccctgagcaagggcttccagtacatcagagtgcacgtgcccggcgccaccgagagcgccaccatcagaaacgacttcctgtgcaacctgtgcgccagcagcctgcaggaggacagaaagttcagagtgctgggcgacaagcagatcgtggagatcatcgccaccaaggccctgagagccttccagggctacagcaacaaccagcccttcagattccagagcctgaccatcttcctgagagacgagagcgtgaacaagatgaacatcggcaacgagtacaagatcatcggcatccccacctgcgtgaagaccagccagaccgccgtgtgcatcgaggccaacagcatcaccttctgcaacagcaaggtgcccagcggcatcagcgacaacttcagatgcctgctgagcctgaccagcagcagctgctggaagttcaccgccatcctggccaacatcttcgccagccagatcaccccccccggcacctacaacctgctgaagctgtgcctgctgatgagcctggtgcagaccaccgacagaaacaaggagctggaggactgcctggacatcctgatcatcaccagcgacaccctgctgatcgacagactgctgaacttcagcatcaacctggtgcccagaggcatcagacacctggtgagcaccgagatcttccccaccctgagcagaaacaagtacggcaccggcgccgtgagcatccaggccggcagcgccctgctggccaagggcggcatctgcttcatcggcgacctggccagccacaagaaggacaagctggagcagctgcagaccgtgctggagagcagaagcatcaccgtgtacatccccggcaagaagttcggcgaggacatcgaccagcagatgaccttccccgtgcagtgcagcttctggagcttcgtggacgtggacagcagcagcagaagaaacgcccagaagatcaacaccctgatcggccagatggactgcagcctgatccccgccaacctggtggaggccttcggcctgctgatcaactgcaacgagagcagcccctgccaccccttcctgcccaccgtgcagcacaccctgaacaaggccatcaaccccgagggcctgttctacgccgccagcagacagttcaccaccgaggacttcgagaagctgctggccttcgccaagaacctgaacgtggagttcagcctggaggccgagagaatgacccacggctactacctggccagcagaagaatcagaaccggcagcgtgtgcggcagcaagctgagcgccagcgccctgaagtacctggtgttcctgagcgaggcccacgccagactgaacctgagaaacaaggtgctgaaggaggacgtgctgatcgccgccctgctgttcgagaccagcctgaccctgaagtacggcgccaccgtgttctgcgtggcccccaacgccgtgttccccttcgagctgtacaacgaggagtacctggagcagagagacctgtacctgacccagtgccagcagcagctggagcagttcatcgccacctacggccccggcaccaccatcttcagcagcgacgagtag

SEQ ID NO: 19616 - DNA, 1857 bp, Artificial Sequence
  Description of Artificial Sequence: Synthetic coding sequence
atgatcgccagcaccaccatggtgagaagcgccaaggtgtgcttcatcgccgtgaagaccctgagcctgatcggccagctgcagaccgagacccagatcaacatcgtgctgaagctgacccacctgccccccctgcccagctacggcctggacctgtgcgagttccccctggactacaccagccagagattctacatgatgcagggcatcgtgatcgccatgaccaccatcaccaagtacacccagggcgccagattcctgtgcagcgacgaggcctgccccctgagcaagggcttccagtacatcagagtgcacgtgcccggcgccaccgagagcgccaccatcagaaacgacttcctgtgcaacctgtgcgccagcagcctgcaggaggacagaaagttcagagtgctgggcgacaagcagatcgtggagatcatcgccaccaaggccctgagagccttccagggctacagcaacaaccagcccttcagattccagagcctgaccatcttcctgagagacgagagcgtgaacaagatgaacatcggcaacgagtacaagatcatcggcatccccacctgcgtgaagaccagccagaccgccgtgtgcatcgaggccaacagcatcaccttctgcaacagcaaggtgcccagcggcatcagcgacaacttcagatgcctgctgagcctgaccagcagcagctgctggaagttcaccgccatcctggccaacatcttcgccagccagatcaccccccccggcacctacaacctgctgaagctgtgcctgctgatgagcctggtgcagaccaccgacagaaacaaggagctggaggactgcctggacatcctgatcatcaccagcgacaccctgctgatcgacagactgctgaacttcagcatcaacctggtgcccagaggcatcagacacctggtgagcaccgagatcttccccaccctgagcagaaacaagtacggcaccggcgccgtgagcatccaggccggcagcgccctgctggccaagggcggcatctgcttcatcggcgacctggccagccacaagaaggacaagctggagcagctgcagaccgtgctggagagcagaagcatcaccgtgtacatccccggcaagaagttcggcgaggacatcgaccagcagatgaccttccccgtgcagtgcagcttctggagcttcgtggacgtggacagcagcagcagaagaaacgcccagaagatcaacaccctgatcggccagatggactgcagcctgatccccgccaacctggtggaggccttcggcctgctgatcaactgcaacgagagcagcccctgccaccccttcctgcccaccgtgcagcacaccctgaacaaggccatcaaccccgagggcctgttctacgccgccagcagacagttcaccaccgaggacttcgagaagctgctggccttcgccaagaacctgaacgtggagttcagcctggaggccgagagaatgacccacggctactacctggccagcagaagaatcagaaccggcagcgtgtgcggcagcaagctgagcgccagcgccctgaagtacctggtgttcctgagcgaggcccacgccagactgaacctgagaaacaaggtgctgaaggaggacgtgctgatcgccgccctgctgttcgagaccagcctgaccctgaagtacggcgccaccgtgttctgcgtggcccccaacgccgtgttccccttcgagctgtacaacgaggagtacctggagcagagagacctgtacctgacccagtgccagcagcagctggagcagttcatcgccacctacggccccggcaccaccatcttcagcagcgacgagtag

SEQ ID NO: 19617 - DNA, 624 bp, Artificial Sequence
  Description of Artificial Sequence: Synthetic coding sequence
atgatgcaccagatctacagctgcagcgacgagaacatcgaggtgttcaccaccgtgatccccagcaaggtgagcagccccgccagaagaagagccaagagcagccagcacctgctgaccaagaacgtggtgatcgagagcgacctgtacacccaccagcccctggagctgctgccccacagaggcgacagaagagaccccggcgacagaagaagattcggcagactgcagaccgccagaccccccaccgcccaccccgccaaggccagcgccagacccgtgggcatcagcgagcccaagaccagcaacctgtgcggcaacagagcctacggcaagagcctgatcccccccgtgcccagaatcagcgtgaagaccagcgccagcgccagcctggaggccaccgccatgggcaccgagaagggcgccgtgctgatgagaggcagcagacacctgaagaagatgaccgaggagtaccccgccctgccccagggcgccgaggccagcctgcccctgaccggcagcgccagctgcggcgtgcccggcatcctgagaaagatgtggaccagacacaagaagaagagcgagtacgtgggcgccaccaacagcgccttcgaggccgactag

SEQ ID NO: 19618 - DNA, 1125 bp, Artificial Sequence
  Description of Artificial Sequence: Synthetic coding sequence
atgggctgcagcagcagcgccctgaacaaggccggcgacagcagcagattccccagcgtgaccagcaacgagcacttcagcaccgccgaggagagcgagagctgcttcgcccagcccaagccccacgccctgggcagagagagcaccgtggacggcaacgtgcagagagagagcagaccccccctgcagaagctgaaggtgagcgccgagcccaccgccaacggcgtgaagcccctgcaggagcagcccctggccaaggacgtggcccccggcagagacgccaccgaccagagcggcagcaccgagaagacccagcccggcgagggcctggaggagagcggccccccccagcccggcggcaaggaggacgcccccgccgccgagggcaagaagaaggacgccggcgccggcaccgaggccgagagcctgaagggcaacgccgaggcccagcccctgggccccgaggccaagggccagcccctgcaggccgccgtggagaaggacagcctgagagccgtggaggtgaccgagaacccccagaccgccgccgagatgaagcccctgggcaccaccgagaacgtgctgaccctgcagatcgccggcgagctgcagccccagggcaccgtgggcaaggacgagcaggcccccctgctggagaccatcagcaaggagaacgagagccccgagatcctggagggcagccagttcgtggagaccgccgaggagcagcagctgcaggccaccctgggcaaggaggagcagccccagctgctggagagaatccccaaggagaacgtgacccccgaggtgctggacagaagccagctggtggagaagcccgtgatgaacgaccccttccacaagacccccgagggccccggcaacatggagcagatccagcccgagggcatcgtgggcagcatggagcaccccgccagaaacgtggaggccggcgcctacgtggagatgatcagaaacatccacaccaacgaggaggaccagagaatcgagggcgagaccggcgagaaggtggagaccgacatggagaacgagaaggtgagcgagggcgccgagaccaaggaggaggagaccggcgaggtggtggacctgagcgccgccacctag

SEQ ID NO: 19619 - DNA, 171 bp, Artificial Sequence
  Description of Artificial Sequence: Synthetic coding sequence
atgggctgcagcagcagcgccctgaacaaggccggcgacagcagcagattccccagcggcgagaccggcgagaaggtggagaccgacatggagaacgagaaggtgagcgagggcgccgagaccaaggaggaggagaccggcgaggtggtggacctgagcgccgccacctag

SEQ ID NO: 19620 - DNA, 960 bp, Artificial Sequence
  Description of Artificial Sequence: Synthetic coding sequence
atggccatctgccccgagctggcccagaccgacaagagcgccctggccaacctgagcgacgagaccgagaccctgaagaacagcaccgacgaggtgcagaccagcagcagcttcagcagcagcggcggcagacagagcagccccctgaccagcggcagcaagctggagagagagaagcagacccccagcctggagcagggcgacacccagagcgagctgctggactacaagaactacgagaagaagctgagcaagaagtggatcaactacctgaagctgaaggacagcaacttcgagagacaccagcccgacaccaagctgcccaccgagatcaccagagtgagcgacgaggagctgaacgccctgcagagctactgcaccatgaagatcaacctgatccacagaagaggcgacagcaagaagaagaccagcagcagacacaagaagctgcacctgggcctggacgtggaggccagcgagagagacgccttcagctgcaccgtgcccgacgagctgctgaacagaatctacttcaagaacatgagaaccacccccaagcaggaggccgccgccaagcagcacatcagctaccagtgcccctactgcaacagaaagagagccgagctggccctgagcgccttcctgaagcagaagaagaccctgctggagagcttcctgctgcaggagagaatcgacgagcacctgcacaccaaggacttcctgaccagaatcggcgaggcccaccaggacttccccagactgagcgacgaccccagaatcatctggaagagactgaccgagaagagccacatcagatacagcggcttcgagagaagcgagaccgagcagaagctgcagagagacggcaacagcgcctgccacctgcccttcagcctgcccttcctgaagagactgaccctgatcaagcccgagctggtgatcgtgaacgacaacgtgtag

SEQ ID NO: 19621 - DNA, 693 bp, Artificial Sequence
  Description of Artificial Sequence: Synthetic coding sequence
atggagaagcccagactgtaccagaagtacaagatcagcagagtgtggtggagactgcccgtgatccccgccaccggcgaggccgaggacaacagactgaaccccgagggcagaggctgcggcgagcccagaagcagacactgcacccccgcctggaccaccaccgccaagctgcacctgaagaccatcatcagcctgcagcccctgaacatgtaccagatggagcccggcgtgggcagcatcagaaccagccccgccctgcagagcccccccgccctgaccagaggccccagcgcctgggacaccgccatcagaaaggccctgagcttcggcgtgggcctgggcgtgctggtgctggtgtgcctgttctaccacttcgtgaccctggcccccatcctgcagttcgccagcctgccctgcctgctggaggccggcgcccagatgagcagacaccccgtgaccacccaggtgtgcgtgatgcccgccagactgagcctgggcagcggcatcagcagaaacctgctgagactgagcgtgtgccacttcaccctgctgctgcccttcagaagcctgagaccctgccccctgagcagcagagacatggtgctgagctacgagctgtggctgctgtgcgacttctacatcgccccccccgacagcagcggcagcggcatctgcaagaaggccatctag

SEQ ID NO: 19622 - DNA, 318 bp, Artificial Sequence
  Description of Artificial Sequence: Synthetic coding sequence
atgagcctgaagagctggcacccccagagcaagaccaagagagtgggcgccagcgagggcaacccccagtggggcagcggcagcatggaggcccccctgctgagcagcttcctgccccccctggccagcgaggccgagctgaccggcaacacctggttcctgcacagatgcagctgcatcctgaacctggaggagagcatggacagcgactggggcgcctggtggggcgtgagcctgcccagaagagcccccttcctgatctacggcagcgacggcccctggtgcacccaggccggcttccccggctggggccactag

SEQ ID NO: 19623 - DNA, 318 bp, Artificial Sequence; identical to SEQ ID NO: 19622
  Description of Artificial Sequence: Synthetic coding sequence

SEQ ID NO: 19624 - DNA, 1098 bp, Artificial Sequence
  Description of Artificial Sequence: Synthetic coding sequence
atgatgggcagaagaagagccttcgccgtggacggcagagacggcgccggcgagggcctggccagaggctgcatcgtgcccggcgtgaccagcacctacagaagaatccccgacgccgcccacggctgcagcagctgggagagaggcgacaagttcagaggcgtgggcagagaggccctgttcctgaagctggccagcagagacagcggcgtggagatggccgtgggcgacagccccctggccgccctgcccggcctgagccaggacagcctggacttcgagagcagcggcagcagcgagccccccgcccaggtgggcagactgctggccagccagaagctgggcgaggtgctggagagaagcagaagactgcccaccgcccccaccagcctgagcggccagcacagaagcctgagactggccagcaagcccgagagagaggtgcccctgggcgccggccagcaggagagcatggaggccgacaccgacctggaggccggcctggaggaggaggccgtgggcggcctgggccccggcgcctgggcctgcctgcccggccagggcctgagatacctggagcacctgtgcctggtgctggagcagatggccagactgcagcagctgtacctgcagctgagaatccagagaccccccggcgaccccggcgaggaggagagcaccagagcccccctgcccagccccctgcacacccccggcaacagaggccagggcccctgggagctgctgagccagaccgagcacaccggcgccaaggccgccagcccccccaaggtggaggtgcccagcgccaacccccccagactgcccgagacccccgtggagcccacctaccacctgcccagcagccagggccacaagagagacatcagccactgggacaaggtgaaggtgctgctgaacagaatctgcagaagaagccaccaccaccccgagccccccgccccccccgacggcagcgaccccagaatcgagagcagagacctgcccgagagaccccagtgcagaccccacagaaagaccttcatgcccagcctggtggtgaagaagcagagagccaagaacctgagcgtgggctag

SEQ ID NO: 19625 - DNA, 987 bp, Artificial Sequence
  Description of Artificial Sequence: Synthetic coding sequence
atggccgtgggcgacagccccctggccgccctgcccggcctgagccaggacagcctggacttcgagagcagcggcagcagcgagccccccgcccaggtgggcagactgctggccagccagaagctgggcgaggtgctggagagaagcagaagactgcccaccgcccccaccagcctgagcggccagcacagaagcctgagactggccagcaagcccgagagagaggtgcccctgggcgccggccagcaggagagcatggaggccgacaccgacctggaggccggcctggaggaggaggccgtgggcggcctgggccccggcgcctgggcctgcctgcccggccagggcctgagatacctggagcacctgtgcctggtgctggagcagatggccagactgcagcagctgtacctgcagctgagaatccagagaccccccggcgaccccggcgaggaggagagcaccagagcccccctgcccagccccctgcacacccccggcaacagaggccagggcccctgggagctgctgagccagaccgagcacaccggcgccaaggccgccagcccccccaaggtggaggtgcccagcgccaacccccccagactgcccgagacccccgtggagcccacctaccacctgcccagcagccagggccacaagagagacatcagccactgggacaaggtgaaggtgctgctgaacagaatctgcagaagaagccaccaccaccccgagccccccgccccccccgacggcagcgaccccagaatcgagagcagagacctgcccgagagaccccagtgcagaccccacagaaagaccttcatgcccagcctggtggtgaagaagcagagaaagaagcccttctgcagactgagacccctgggcgcccccggcgaccccggctggagaggcctggccgtgaagagcagcagccccagcgccctgctgctgctgctgcacatcgccagaaagagctgctag

SEQ ID NO: 19626 - DNA, 1074 bp, Artificial Sequence
  Description of Artificial Sequence: Synthetic coding sequence
atgatgggcagaagaagagccttcgccgtggacggcagagacggcgccggcgagggcctggccagaggctgcatcgtgcccggcgtgaccagcacctacagaagaatccccgacgccgcccacggctgcagcagctgggagagaggcgacaagttcagaggcgtgggcagagaggccctgttcctgaagctggccagcagagacagcggcgtggagatggccgtgggcgacagccccctggccgccctgcccggcctgagccaggacagcctggacttcgagagcagcggcagcagcgagccccccgcccaggtgggcagactgctggccagccagaagctgggcgaggtgctggagagaagcagaagactgcccaccgcccccaccagcctgagcggccagcacagaagcctgagactggccagcaagcccgagagagaggtgcccctgggcgccggccagcaggagagcatggaggccgacaccgacctggaggccggcctggaggaggaggccgtgggcggcctgggccccggcgcctgggcctgcctgcccggccagggcctgagatacctggagcacctgtgcctggtgctggagcagatggccagactgcagcagctgtacctgcagctgagaatccagagaccccccggcgaccccggcgaggaggagagcaccagagcccccctgcccagccccctgcacacccccggcaacagaggccagggcccctgggagctgctgagccagaccgagcacaccggcgccaaggccgccagcccccccaaggtggaggtgcccagcgccaacccccccagactgcccgagacccccgtggagcccacctaccacctgcccagcagccagggccacaaggtgaaggtgctgctgaacagaatctgcagaagaagccaccaccaccccgagccccccgccccccccgacggcagcgaccccagaatcgagagcagagacctgcccgagagaccccagtgcagaccccacagaaagaccttcatgcccagcctggtggtgaagaagcagagagccaagaacctgagcgtgggctag

SEQ ID NO: 19627 - DNA, 132 bp, Artificial Sequence
  Description of Artificial Sequence: Synthetic coding sequence
atggccaagaacaagctgagaggccccaagagcagaaacgtgttccacatcgccagccagaagaacttcaaggccaagaacaaggccaagcccgtgaccaccaacctgaagaaggtgctgcacttcagctag

SEQ ID NO: 19628 - DNA, 297 bp, Artificial Sequence
  Description of Artificial Sequence: Synthetic coding sequence
atggccaagaacaagctgagaggccccaagagcagaaacgtgttccacatcgccagccagaagaacttcaaggccaagaacaaggccaagcccgtgaccaccaacctgaagaagatcaacatcatgaacgaggagaaggtgaacagagtgaacaaggccttcgtgaacgtgcagaaggagctggcccacttcgccaagagcatcagcctggagcccctgcagaaggagctgatcccccagcagagacacgagagcaagcccgtggacgaggccaccagactgatggccctgctgtag

SEQ ID NO: 19629 - DNA, 297 bp, Artificial Sequence; identical to SEQ ID NO: 19628
  Description of Artificial Sequence: Synthetic coding sequence

SEQ ID NO: 19630 - DNA, 297 bp, Artificial Sequence; identical to SEQ ID NO: 19628
  Description of Artificial Sequence: Synthetic coding sequence

SEQ ID NO: 19631 - DNA, 297 bp, Artificial Sequence; identical to SEQ ID NO: 19628
  Description of Artificial Sequence: Synthetic coding sequence

SEQ ID NO: 19632 - DNA, 138 bp, Artificial Sequence
  Description of Artificial Sequence: Synthetic coding sequence
atggccaagaacaagctgagaggccccaagagcagaaacgtgttccacatcgccagccagaagaacttcaaggccaagaacaaggccaagcccgtgaccaccaacctgaagaagatcaacatcatgaacgaggagtag

SEQ ID NO: 19633 - DNA, 297 bp, Artificial Sequence; identical to SEQ ID NO: 19628
  Description of Artificial Sequence: Synthetic coding sequence

SEQ ID NO: 19634 - DNA, 132 bp, Artificial Sequence; identical to SEQ ID NO: 19627
  Description of Artificial Sequence: Synthetic coding sequence

SEQ ID NO: 19635 - DNA, 2160 bp, Artificial Sequence
  Description of Artificial Sequence: Synthetic coding sequence
atggccggcggcgtgtggggcagaagcagagccagagaggcccccgtgggcgccctgaccctgaccgccctgaccgagggcatcagagccagacagggccagccccagggcccccccagcgccggcccccagcccaagagctgggaggtgaagcccgaggccgagccccagacccaggccctgaccgcccccagcgaggccgagcccggcagaggcgccaccgtgcccgaggccggcagcgagccctgcagcctgaacagcgccctggagcccgcccccgagggcccccaccaggtgccccagagcagctgggaggagggcgtgctggccgacctggccctgtacaccgccgcctgcctggaggaggccggcttcgccggcacccaggccaccgtgctgaccctgagcagcgccctggaggccagaggcgagagactggaggaccaggtgcacgccctggtgagaggcctgctggcccaggtgcccagcctggccgagggcagaccctggagagccgccctgagagtgctgagcgccctggccctggagcacgccagagacgtggtgtgcgccctgctgcccagaagcctgcccgccgacagagtggccgccgagctgtggagaagcctgagcagaaaccagagagtgaacggccaggtgctggtgcagctgctgtgggccctgaagggcgccagcggccccgagccccaggccctggccgccaccagagccctgggcgagatgctggccgtgagcggctgcgtgggcgccaccagaggcttctacccccacctgctgctggccctggtgacccagctgcacaagctggccagaagcccctgcagccccgacatgcccaagatctgggtgctgagccacagaggccccccccacagccacgccagctgcgccgtggaggccctgaaggccctgctgaccggcgacggcggcagaatggtggtgacctgcatggagcaggccggcggctggagaagactggtgggcgcccacacccacctggagggcgtgctgctgctggccagcgccatggtggcccacgccgaccaccacctgagaggcctgttcgccgacctgctgcccagactgagaagcgccgacgacccccagagactgaccgccatggccttcttcaccggcctgctgcagagcagacccaccgccagactgctgagagaggaggtgatcctggagagactgctgacctggcagggcgaccccgagcccaccgtgagatggctgggcctgctgggcctgggccacctggccctgaacagaagaaaggtgagacacgtgagcaccctgctgcccgccctgctgggcgccctgggcgagggcgacgccagactggtgggcgccgccctgggcgccctgagaagactgctgctgagacccagagcccccgtgagactgctgagcgccgagctgggccccagactgccccccctgctggacgacaccagagacagcatcagagccagcgccgtgggcctgctgggcaccctggtgagaagaggcagaggcggcctgagactgggcctgagaggccccctgagaaagctggtgctgcagagcctggtgcccctgctgctgagactgcacgaccccagcagagacgccgccgagagcagcgagtggaccctggccagatgcgaccacgccttctgctggggcctgctggaggagctggtgaccgtggcccactacgacagccccgaggccctgagccacctgtgctgcagactggtgcagagataccccggccacgtgcccaacttcctgagccagacccagggctacctgagaagcccccaggaccccctgagaagagccgccgccgtgctgatcggcttcctggtgcaccacgccagccccggctgcgtgaaccaggacctgctggacagcctgttccaggacctgggcagactgcagagcgaccccaagcccgccgtggccgccgccgcccacgtgagcgcccagcaggtggccatgctggccagagccagaggctgccccagaggccccagactgctgagaatcgcccccagacccgccagacccccccccgtgttcgccgacagccccttccagagaagaagcgtggccggcagatggggctgcagcggccccagaagagcctag

SEQ ID NO: 19636 - DNA, 885 bp, Artificial Sequence
  Description of Artificial Sequence: Synthetic coding sequence
atggccctgctgaccccccagggcgtgaaggaggtgttccagctgcagagaccccagggcagagagagactgagaagactgctgaactgggaggagttcgacgagcagagagacagcagaagaagcatcctgctggacaccctgtacgagagcatcatcttcgccgtgggcaagggcttcccctgggtggaggtggcccaggtggtgaagttcaccgaggagctgctgagagagaccaagggctgcagcatcaccgaggccgtgaccatcctgggcaacaagctgagagactacagaggccacttcaacaccacccacctgctggccctgtgcgactacttccaccacaccttcatcagacactacaagctgtaccagtacgtgctgggccaggaccagcaggtggacctgaccgtggcccacctggaggtgtgcatgcccccccaccccctgcccctggccgagggcatggacagagacctgtggatccacgagcagcaggtggccaccctgaccgaggccgaggcccagaagagagccgacgtgctgctgctgaaggaggccctgagactggagagagagaacagcctgcagaaggccttcgccgccgccgcccccgcccagcccggccaggtgctggagagacaggagctggagagcctgatctgccaggccgtgcacacccagatggagctgctgcaggagctgctgcagagacagatccagaacaccttcgccatcctggacctgaagctgcagaagaagaccctgaacctgaacgcccccacccccatccccccccccatcaccagccacgccggccaggaggaggccctgaagccccagagagccagcaagggcaagaaggccaaggccagaaagtag

SEQ ID NO: 19637 - DNA, 1143 bp, Artificial Sequence
  Description of Artificial Sequence: Synthetic coding sequence
atggacagcggctgctggctgttcggcggcgagttcgaggacagcgtgttcgaggagagacccgagagaagaagcggcccccccgccagctactgcgccaagctgtgcgagccccagtggttctacgaggagaccgagagcagcgacgacgtggaggtgctgaccctgaagaagttcaagggcgacctggcctacagaagacaggagtaccagaaggccctgcaggagtacagcagcatcagcgagaagctgagcagcaccaacttcgccatgaagagagacgtgcaggagggccaggccagatgcctggcccacctgggcagacacatggaggccctggagatcgccgccaacctggagaacaaggccaccaacaccgaccacctgaccaccgtgctgtacctgcagctggccatctgcagcagcctgcagaacctggagaagaccatcttctgcctgcagaagctgatcagcctgcaccccttcaacccctggaactggggcaagctggccgaggcctacctgaacctgggccccgccctgagcgccgccctggccagcagccagaagcagcacagcttcaccagcagcgacaagaccatcaagagcttcttcccccacagcggcaaggactgcctgctgtgcttccccgagaccctgcccgagagcagcctgttcagcgtggaggccaacagcagcaacagccagaagaacgagaaggccctgaccaacatccagaactgcatggccgagaagagagagaccgtgctgatcgagacccagctgaaggcctgcgccagcttcatcagaaccagactgctgctgcagttcacccagccccagcagaccagcttcgccctggagagaaacctgagaacccagcaggagatcgaggacaagatgaagggcttcagcttcaaggaggacaccctgctgctgatcgccgaggtgatgggcgaggacatccccgagaagatcaaggacgaggtgcaccccgaggtgaagtgcgtgggcagcgtggccctgaccgccctggtgaccgtgagcagcgaggagttcgaggacaagtggttcagaaagatcaaggaccacttctgccccttcgagaaccagttccacaccgagatccagatcctggcctag

SEQ ID NO: 19638 - DNA, 636 bp, Artificial Sequence
  Description of Artificial Sequence: Synthetic coding sequence
atgctgagacagagctgcagcttccccgtgaccagcctgcccgccctgggcggcgtgtgcggcagagagggcgccggcgccgaggtgccccccgccgcctgcggctgcgagggcagagaccccgacaccgagagaagctgcggcagaagcagcaccggcggctgcagcccctgcagcggccccggccccagcagccccagaaccagcagaggcgccctgagccccagcctgggcagactgttcccccacctgcaggtggtgatcaagctgagaatccagctggcccccgccgtgcacctggccctgcccacctgcagcctgctgaccagcagcccccccctggagggctgctgccacagactgaacgaggaggccgaggtgcagagaggcttcagacccatcgccgtggagctggagttcgagaaccagcccctgggcgccgagaccagactgagaaacggcagaagagccggcgtgaagagaagcgagggcagaggccaggtgagacccggccaggtgagaagcaccggccccgagggcggcctgaccagaatggagagaaaggccgccagactgcagtgggacagcggcagcatcaagatgagcgagaacgagcagctgtgggaggagccctag

SEQ ID NO: 19639 - DNA, 261 bp, Artificial Sequence
  Description of Artificial Sequence: Synthetic coding sequence
atgtggcccccctgcggcaccctgagaaccctggccctggccagaagcagaggcgccagagcctgcagcggcgacggcggcgtgagctacacccagggccagagccccgagcccagaaccagagagtacttctactacgtggaccaccagggccagctgttcctggacgacagcaagatgaagaacttcatcacctgcttcaagggcaacgccgtgccccccagccccgcccccagcttcagcctgcccggcagcccctag

SEQ ID NO: 19640 - DNA, 468 bp, Artificial Sequence
  Description of Artificial Sequence: Synthetic coding sequence
atgggccccggcgacttcagaagatgcagagagagaatcagccagggcctgcagggcctgcccggcagagccgagctgtggttcccccccagacccgcctgcgacttcttcggcgacggcagaagcaccgacatccaggaggaggccctggccgccagccccctgctggaggacctgagaagaagactgaccagagccttccagtgggccgtgcagagagccatcagcagaagagtgcaggaggccgccgccgccgccgccgccagagaggagcagagctggaccggcgtggaggccaccctggccagactgagagccgagctggtggagatgcacttccagaaccaccagctggccagaaccctgctggacctgaacatgaaggtgcagcagctgaagaaggagtacgagctggagatcaccagcgacagccagagccccaaggacgacgccgccaaccccgagtag

SEQ ID NO: 19641 - DNA, 672 bp, Artificial Sequence
  Description of Artificial Sequence: Synthetic coding sequence
atgagacccctgggcaagggcctgctgcccgccgaggagctgatcagaagcaacctgggcgtgggcagaagcctgagagactgcctgagccagagcggcaagctggccgaggagctgggcagcaagagactgaagcccgccaagttcggcaccgagggcaaggagagagtggagcagagaaccgagagacagagaaccggcagcagcaaggagcccagaatgcagatcatctgcagaagaagatggagagagcccccccccagactgctgtggggctgcctgatgcccagagcccagcccctgctgcacgtgaccgcctacgagaacaccggccactgggagagactggccagcgtggtgagcagcaagacccagcagcccaccgtgatcagccacagcagcatcagcatcaccttcagccactacccccccgccaccctggacagcttcctggtgctggagcccatcaagctgttccccgtgagcagcctgagaagccccctgtgcctgaactgcggcagctgcagagagagcatcagaatcagcggcgagctgatcggcaacgcccacagccccgccccccccagaacccccgagctggagaccctgggctgggacaagcaggccgtgctgagcggcgcccaggtgatcctggtgtgcgccgaggtgtag

SEQ ID NO: 19642 - DNA, 306 bp, Artificial Sequence
  Description of Artificial Sequence: Synthetic coding sequence
atgagaacccccaagagaaccagaagccccaagaccaaggtgagcctgagaggcgagaccctgaccctgcagctgaccaccgtgagcctggacaccagacacatggtgaagagatgcgacgagagacacggcagacccctgccccacagccaggagagccagcacggcagcgccaccagcaagaaggccgtgagaggcaccgccgacaccgcccccctggagagaatcagcgccgccagaggctgggccctgcccatggaggccaccgtgagcgtgttcagagcccaccagtggcagtggaactag

SEQ ID NO: 19643 - DNA, 561 bp, Artificial Sequence
  Description of Artificial Sequence: Synthetic coding sequence
atggagctgagctgccccggcagcagatgccccgtgcaggagcagagagccagatgggagagaaagagagcctgcaccgccagagagctgctggagaccgagagaagataccaggagcagctgggcctggtggccacctacttcctgggcatcctgaaggccaagggcaccctgagaccccccgagagacaggccctgttcggcagctgggagctgatctacggcgccagccaggagctgctgccctacctggagggcggctgctggggccagggcctggagggcttctgcagacacctggagctgtacaaccagttcgccgccaacagcgagagaagccagaccaccctgcaggagcagctgaagaagaacaagggcttcagaagattcgtgagactgcaggagggcagacccgagttcggcggcctgcagctgcaggacctgctgcccctgcccctgcagagactgcagcagtacgagaacctggtggtggccctggccgagaacaccggccccaacagccccgaccaccagcagctgacccccgtgctgcccagctag

SEQ ID NO: 19644 - DNA, 1008 bp, Artificial Sequence
  Description of Artificial Sequence: Synthetic coding sequence
atggagctgagctgccccggcagcagatgccccgtgcaggagcagagagccagatgggagagaaagagagcctgcaccgccagagagctgctggagaccgagagaagataccaggagcagctgggcctggtggccacctacttcctgggcatcctgaaggccaagggcaccctgagaccccccgagagacaggccctgttcggcagctgggagctgatctacggcgccagccaggagctgctgccctacctggagggcggctgctggggccagggcctggagggcttctgcagacacctggagctgtacaaccagttcgccgccaacagcgagagaagccagaccaccctgcaggagcagctgaagaagaacaagggcttcagaagattcgtgagactgcaggagggcagacccgagttcggcggcctgcagctgcaggacctgctgcccctgcccctgcagagactgcagcagtacgagaacctggtggtggccctggccgagaacaccggccccaacagccccgaccaccagcagctgaccagagccgccagactgatcagcgagaccgcccagagagtgcacaccatcggccagaagcagaagaacgaccagcacctgagaagagtgcaggccctgctgagcggcagacaggccaagggcctgaccagcggcagatggttcctgagacagggctggctgctggtggtgcccccccacggcgagcccagacccagaatgttcttcctgttcaccgacgtgctgctgatggccaagcccagaccccccctgcacctgctgagaagcggcaccttcgcctgcaaggccctgtaccccatggcccagtgccacctgagcagagtgttcggccacagcggcggcccctgcggcggcctgctgagcctgagcttcccccacgagaagctgctgctgatgagcaccgaccaggaggagctgagcagatggtaccacagcctgacctgggccatcagcagccagaagaactag

SEQ ID NO: 19645 - DNA, 900 bp, Artificial Sequence
  Description of Artificial Sequence: Synthetic coding sequence
atgctgggcgtgtgccagaccctgaagcagtacttcctgggcatcctgaaggccaagggcaccctgagaccccccgagagacaggccctgttcggcagctgggagctgatctacggcgccagccaggagctgctgccctacctggagggcggctgctggggccagggcctggagggcttctgcagacacctggagctgtacaaccagttcgccgccaacagcgagagaagccagaccaccctgcaggagcagctgaagaagaacaagggcttcagaagattcgtgagactgcaggagggcagacccgagttcggcggcctgcagctgcaggacctgctgcccctgcccctgcagagactgcagcagtacgagaacctggtggtggccctggccgagaacaccggccccaacagccccgaccaccagcagctgaccagagccgccagactgatcagcgagaccgcccagagagtgcacaccatcggccagaagcagaagaacgaccagcacctgagaagagtgcaggccctgctgagcggcagacaggccaagggcctgaccagcggcagatggttcctgagacagggctggctgctggtggtgcccccccacggcgagcccagacccagaatgttcttcctgttcaccgacgtgctgctgatggccaagcccagaccccccctgcacctgctgagaagcggcaccttcgcctgcaaggccctgtaccccatggcccagtgccacctgagcagagtgttcggccacagcggcggcccctgcggcggcctgctgagcctgagcttcccccacgagaagctgctgctgatgagcaccgaccaggaggagctgagcagatggtaccacagcctgacctgggccatcagcagccagaagaactag

SEQ ID NO: 19646 - DNA, 171 bp, Artificial Sequence
  Description of Artificial Sequence: Synthetic coding sequence
atgagaagaccctgggagaagaaggaggccaccagaaaccccatcgccgaggtgctggccagaaagaagagaaccgaggagctgatcagcctgcaggagcacggcagcagaaagcagaagatcaaggaggccagcatcagctgggccgagaccagcagacagatcggctag

SEQ ID NO: 19647 - DNA, 222 bp, Artificial Sequence
  Description of Artificial Sequence: Synthetic coding sequence
atgcagttcgccgactggctgcaccccagcggctggaccatcgagatcctgaacgcctacggcatgggcgacagaaagagaaccaacagcatgagcaaggaggccttcacccccgagcagctgcacctggagaaggagctgggcgagatgagactgagacccaccgtgctgcacagccagaccgaccaccagggcttcagacccatccccatgatgcagtag

SEQ ID NO: 19648 - DNA, 1131 bp, Artificial Sequence
  Description of Artificial Sequence: Synthetic coding sequence
atggccgagagaggcagaaagagaccctgcggccccggcgagcacggccagagaatcgagtggagaaagtggaagcagcagaagaaggaggagaagaagaagtggaaggacctgaagctgatgaagaagctggagagacagagagcccaggaggagcaggccaagagactggaggaggaggaggccgccgccgagaaggaggacagaggcagaccctacaccctgagcgtggccctgcccggcagcatcctggacaacgcccagagccccgagctgagaacctacctggccggccagatcgccagagcctgcgccatcttctgcgtggacgagatcgtggtgttcgacgaggagggccaggacgccaagaccgtggagggcgagttcaccggcgtgggcaagaagggccaggcctgcgtgcagctggccagaatcctgcagtacctggagtgcccccagtacctgagaaaggccttcttccccaagcaccaggacctgcagttcgccggcctgctgaaccccctggacagcccccaccacatgagacaggacgaggagagcgagttcagagagggcatcgtggtggacagacccaccagacccggccacggcagcttcgtgaactgcggcatgaagaaggaggtgaagatcgacaagaacctggagcccggcctgagagtgaccgtgagactgaaccagcagcagcaccccgactgcaagacctaccacggcaaggtggtgagcagccaggaccccagaaccaaggccggcctgtactggggctacaccgtgagactggccagctgcctgagcgccgtgttcgccgaggcccccttccaggacggctacgacctgaccatcggcaccagcgagagaggcagcgacgtggccagcgcccagctgcccaacttcagacacgccctggtggtgttcggcggcctgcagggcctggaggccggcgccgacgccgaccccaacctggaggtggccgagcccagcgtgctgttcgacctgtacgtgaacacctgccccggccagggcagcagaaccatcagaaccgaggaggccatcctgatcagcctggccgccctgcagcccggcctgatccaggccggcgccagacacacctag

SEQ ID NO: 19649 - DNA, 1167 bp, Artificial Sequence
  Description of Artificial Sequence: Synthetic coding sequence
atggccgagagaggcagaaagagaccctgcggccccggcgagcacggccagagaatcgagtggagaaagtggaagcagcagaagaaggaggagaagaagaagtggaaggacctgaagctgatgaagaagctggagagacagagagcccaggaggagcaggccaagagactggaggaggaggaggccgccgccgagaaggaggacagaggcagaccctacaccctgagcgtggccctgcccggcagcatcctgaccatgctgagcagaagaagcttcgcccccacctggcccgtgagactgcccgagcccgtgcccagcagcgtgtggatgagaagctggtgcctgatgagaagagccagaatgcccagactgtggagaggcaacagccaggagctggaggagggcgccggcgtgagaaccgccggccccgaccccgccgtgcccgagtgcccccagtacctgagaaaggccttcttccccaagcaccaggacctgcagttcgccggcctgctgaaccccctggacagcccccaccacatgagacaggacgaggagagcgagttcagagagggcatcgtggtggacagacccaccagacccggccacggcagcttcgtgaactgcggcatgaagaaggaggtgaagatcgacaagaacctggagcccggcctgagagtgaccgtgagactgaaccagcagcagcaccccgactgcaagacctaccacggcaaggtggtgagcagccaggaccccagaaccaaggccggcctgtactggggctacaccgtgagactggccagctgcctgagcgccgtgttcgccgaggcccccttccaggacggctacgacctgaccatcggcaccagcgagagaggcagcgacgtggccagcgccagcttccccaccagcggcatgctgctgtggtgcagcggcgccagcagagtgtggaagctggagagaatgctgacccccacctggagatggctgaaccccgtgagcagcctgacctgcaccagcatccccgtgctggccagagtggccgtgcccagcgccagaagaaagcccagcagcagcccctggcccccctgcagcctggccagcagcagaagagtgcccggcacccccgagagcagcaagggccccagaaccagcgtgaagcagcagtag

SEQ ID NO: 19650 - DNA, 279 bp, Artificial Sequence
  Description of Artificial Sequence: Synthetic coding sequence
atggccgaggagtgccccagagcctgcgccgagcccgtggcccccaaggccaccgccccccccgagagaaccagcgactactacagagtgagcgccgacctgcccggcagattcaacaaccccggctggttcagaggctacagaacccagaaggccgtgagcgtgtacagaaccagcaaccaggcctacggcagcagagcccccaccgtgcacgagatgcccagagtggagtgcagcggcaccatcctgagcatgttcacctggagaaaggccagctag

SEQ ID NO: 19651 - DNA, 279 bp, Artificial Sequence; identical to SEQ ID NO: 19650
  Description of Artificial Sequence: Synthetic coding sequence

SEQ ID NO: 19652 - DNA, 411 bp, Artificial Sequence
  Description of Artificial Sequence: Synthetic coding sequence
atggccgaggagtgccccagagcctgcgccgagcccgtggcccccaaggccaccgccccccccgagagaaccagcgactactacagagtgagcgccgacctgcccggcagattcaacaaccccggctggttcagaggctacagaacccagaaggccgtgagcgtgtacagaaccagcaaccaggcctacggcagcagagcccccaccgtgcacgagatgcccaaggtgttctaccccaacagcaacaagttcagccagcagctggccgccggcggcatgttcagaaacaacaccctgaacgtgtacctggagaagagcatcgtgaccggccccgacaactgcatcaccagctgcgacagactgaacttccaccccagctacaacatcaacagacccagcatctgcgactag

SEQ ID NO: 19653 - DNA, 381 bp, Artificial Sequence
  Description of Artificial Sequence: Synthetic coding sequence
atgggcaccgaggtgggcatcagctggaccagagtgggcaccggcgccaccgtgggcctgctgcccccccacccccaccagcagatgcacagagacgaggaggacagcgacgtggacgtgaccttccagccctggcacaaggagatgctgcagcagctgctggtgatgctgagcagcaccgtggccaccagaccccagaaggccgcctgcccccaccaggagagccagagccacggcccccccaaggagagcgtgccctgggcccccacccagagaagcggcaacgccgagcagagatgcagcggcgagggcgccagaagaagaggccccgagaccagacccctgagaacccccgagggctgggccggcagagccccctag

SEQ ID NO: 19654 - DNA, 1563 bp, Artificial Sequence
  Description of Artificial Sequence: Synthetic coding sequence
atggcccccaagaagagcgtgagcaaggccggcaaggagctggaggtgaagaagaagggcggcaagaaggagcccgtggtggccgtggagccccccctggccaaggagatgaaggagttctaccacatccagatcagagacctggaggacagactggccagataccagagaaagtgggacgagctggccgtgcaggagaagatgttcagacaggagttcgagcagctggccaacaacaagaaggagatcgtggccttcctgaagagaaccctgaaccagcaggtggacgagatcaccgacctgaacgagcagctgcagaacctgcagctggccaaggagatggagaaggacgccttcgaggcccagctggcccaggtgagacacgagttccaggagaccaaggaccagctgaccaccgagaacatcatcctgggcggcaagctggccgccctggaggagttcagactgcagaaggaggaggtgaccgacaagttcaccctgctggaggagcaggtgagaaagcaggagaacgagttcagagactacgcctacaacctggagaagaagagcgtgctggacaaggacagactgagaaaggagatcatccagagagtgaacctggtggccaacgagttccacaaggtgaccaccaacagaatgtgggagaccaccaagagagccatcaaggagaacaacggcatcaccctgcagatggccagagtgagccagcagggcatgaagctgctgcaggagaacgagcagctgaagggcagacagaacaacctgtgcaagcagctggagctgctggagaacacccagaaggtgatggccagacacaagagaggccaccagaagatcatcctgatgctgaccaagaagtgccaggagcagcagcaggacaccaaggaggccgaggagctgagactgctgctgagccagctggagcagagaagcctgcagctgcaggtggacaaccaggccctgaagagccagagagaccagctgagcctgcagctggagcagcagcaggtggacctgcagagactgcagcaggagctggccaacgagcagaaggtgagagccagcctggaggccgccctggtgcaggccaccagcttcctgcagaacatcctgcagatgcacagagacgaggaggacagcgacgtggacgtgaccttccagccctggcacaaggagatgctgcagcagctgctggtgatgctgagcagcaccgtggccaccagaccccagaaggccgcctgcccccaccaggagagccagagccacggcccccccaaggagagcagacccagcatccagctgcccagaaccggcagcctgctgccccagctgagcgacatcaccccctaccagcccggcgacctgggcctggtgcccagacaggtgcacatcccccccaacccccaggacctgagactgctgagctacatcaccagagtgggcaccttcagagcccacagcagccccgagatgagagcccccggcagcctgaagagactggagaagttcagcctgcccgaggtgcccctgagacccaagtag

SEQ ID NO: 19655 - DNA, 210 bp, Artificial Sequence
  Description of Artificial Sequence: Synthetic coding sequence
atgtgctacgtggtgcccggctgcttcatctacatctgcggctgcaccagaatcaagagcacccacttcaacggcaagagccagatggtggacctgaagagccagagctgggacctggagagactggagaacaagcccccccccgccgtgtacgacctggccgccaccaccagccagctgggcgagtgggccaagagcagaatctggtag

SEQ ID NO: 19656 - DNA, 906 bp, Artificial Sequence
  Description of Artificial Sequence: Synthetic coding sequence
atggaggcccacgagatcatcgaggagccccacatcaccatggacgccgagaagcacccccccagcaaggaccccagcgccgaggacctgcaggagaaccacatcagcgagagcttcctgaagcccagcaccagcgagacccccctggagccccacaccagcgagagccccctggtgcccagccccagccagatccccctggaggcccacagccccgagacccaccaggagcccagcatcagcgagacccccagcgagacccccacctacgaggccagcctggacagccccatcagcgtggtgcccgagaagcacctgaccctgcccccccagagcagagactacgtgtgcctgagcagcagcgacaccctgaaggaggacctgagcagcgagagcagcagcaacgaggtgccctggaccagaagaagcacccacctgagcgagagcgagagcctgcccgagcactgcctgagcggccccagcagccaggtgcaggtggacaccaccgagaagcaggaggaggaggccggcgaggtggagaagggcgtggacgccagcgacagcaccgcccacaccgcccagcccggccaccagctgggcaacaccgccagacccgtgttccccgccagacagaccgagctggtggaggtggccaaggccatgcacagagaggagttcggcgcccaggtgaacaacctgttccagtgggagaaggacgccgccctgaacgccatccagaccggcctgtacatcggctggagatgcccccactacctgtgggactgcttcagaatcggcgacgagagcagatgcttctgcggccacctgctgagagagcacagaatcatcagcgacatcagcgtgccctgcaaggtgagccagtgcagatgcttcatgttctgctag

SEQ ID NO: 19657 - DNA, 1209 bp, Artificial Sequence
  Description of Artificial Sequence: Synthetic coding sequence
atggaggcccacgagatcatcgaggagccccacatcaccatggacgccgagaagcacccccccagcaaggaccccagcgccgaggacctgcaggagaaccacatcagcgagagcttcctgaagcccagcaccagcgagacccccctggagccccacaccagcgagagccccctggtgcccagccccagccagatccccctggaggcccacagccccgagacccaccaggagcccagcatcagcgagacccccagcgagacccccacctacgaggccagcctggacagccccatcagcgtggtgcccgagaagcacctgaccctgcccccccagagcagagactacgtgtgcctgagcagcagcgacaccctgaaggaggacctgagcagcgagagcagcagcaacgaggtgccctggaccagaagaagcacccacctgagcgagagcgagagcctgcccgagcactgcctgagcggccccagcagccaggtgcaggtggacaccaccgagaagcaggaggaggaggccggcgaggtggagaagggcgtggacgccagcgacagcaccgcccacaccgcccagcccggccaccagctgggcaacaccgccagacccgtgttccccgccagacagaccgagctggtggaggtggccaaggccatgcacagagaggagttcggcgcccaggtgaacaacctgttccagtgggagaaggacgccgccctgaacgccatccagaccggcctgtacatcggctggagatgcccccactacctgtgggactgcttcagaatcggcgacgagagcagatgcttctgcggccacctgctgagagagcacagaatcatcagcgacatcagcgtgccctgcaaggtgagccagtgcagatgcttcatgttctgcttcatccccagcagacccgaggaggtgggcgagttctggctgaagagaagagccaccttcgaccccaaggcctggagagcccagtgcagatgcaagcacagccacgaggagcacgccgccaccggcccccacccctgcagacaccacggctgctgctgcggctgcttcgagagcaacttcctgtgcgccgcctgcgacagaagatgggaggagcacgagaccttcttcgacacccagaagaccagacagagaggcggcagacccagaggcaccgacaccgtgagcaactggcacagacccctgtag

SEQ ID NO: 19658 - DNA, 273 bp, Artificial Sequence
  Description of Artificial Sequence: Synthetic coding sequence
atggaggcccacgagatcatcgaggagccccacatcaccatggacgccgagaagcacccccccagcaaggaccccagcgccgaggacctgcaggagaaccacatcagcgagagcttcctgaagcccagcaccagcgagacccccctggagccccacaccagcgagagccccctggtgcccagccccagccagatccccctggaggcccacagccccgagacccaccaggagcccagcatcagcgagacccccagcgagacccccacctactag

SEQ ID NO: 19659 - DNA, 591 bp, Artificial Sequence
  Description of Artificial Sequence: Synthetic coding sequence
atgcccggcatggtgcccccccacgtgcccccccagatgctgaacatcccccagaccagcctgcaggccaagcccgtggccccccaggtgcccagccccggcggcgcccccggccagggcccctacccctacagcctgagcgagcccgcccccctgaccctggacaccagcggcaagaacctgaccgagcagaacagctacagcaacatcccccacgagggcaagcacacccccctgtacgagagaagcctgcccatcaaccccgcccagagcggcagccccaaccacgtggacagcgcctacttccccggcagcagcaccagcagcagcagcgacaacgacgagggcagcggcggcgccaccaagtacaccatctactggggcttcagagccaccgaccaccacgtgcagggcagagacagccaggccagaggcaccgccgcccactggcacggcggccacgtgtgcagccccaacgtgttctggagaatcagccacggccccgcccagcagctgaccttccccaccgagcaggccgccccccccgtgtgccccgcccccgccagcagaagactgagcgcccccggctag

SEQ ID NO: 19660 - DNA, 3240 bp, Artificial Sequence
  Description of Artificial Sequence: Synthetic coding sequence
atggagtggctgctggaggacctgctgggcgccaagggcgacatgggcctgctgtggggccagctgacccacgccctggcctgcagacactgcggcagcagctgcttccagagccccggcaacctggtgaccctgttcctgttcgtggtgtggcagatccagagatggtggcagctgggcagactgagacagctgcacccctggtgcagcggcaacatggtgcagggcaaggagctgcccctgctgcacagagtggccttcctggaccacctgtgcaagcagaagagcgaggtggaggaggagggcgaggaggaggaggagggcgaggacgaggccagcctggaccccctgaagccctgcagccccaccaaggaggcccccaccggcgagcaggccacccccgcccccccccagcccagctgcggcagcgagggcctgctgaaggccatcggcatccccgagcagaccgtgatgcagcccgtgagccccagcagaagcttccccatcttccagatcctgaccagcttccccgtgagacacaagatcgccagcggcaacagacagcagcagagaaagagccagctgttctggggcctgcccagcctgcacagcgagagcctggaggccatcttcctgagcagcggcggccccagccccctgaagtggagcgtgtgcagcagcgtgttcttcaacaagctggccttcctgcccagaagcaacctgctgctgccccagtaccacagcagcgcccagttcagcacccacggcgcccacaccatggaggacctggagggcatggcccccgacccccagctgctgcccccccccagcagccccagcgtgagcagcctgctgctgcacctgagacccttccccgtggaccacaagggcgtgctgagcggcgccgaggcccccacccagagccccggcaccagccccctggaggtgctgcccggctacgagacccacctggagaccaccggccacaagaagatgccccaggccttcgagccccccatgccccccccctgccagagccccgccagcctgagcgagcccagaaaggtgagccccgagggcggcctggccatcagcaaggacttctggggcaccgtgggctacagagagaagccccaggccagcgagagcagcatgcccgtgccctgcccccccctggacagcctgcccgagctgcagagagagagcagcctggaggaccccagcagatacaagccccagtgggagtgcagagagaacagcggcaacctgtgggccttcgagagccccgtgctggacctgaaccccgagctgagcggcaccagccccgagtgcgtgccccccgccagcgagaccccctggaagggcatgcagagcagagagaacatctgggtgcccgccgaccccgtgagcccccccagcctgcccagcgtgcccctgctggagagcctggtgatgggcccccagggcgtgctgagcgagagcaaggccctgtgggagaccatgggccagaaggagaacctgtgggccagcgacagccccgaccccgtgcacagcaccccccccaccaccctgatggagccccacagaatcaaccccggcgagtgcctggccaccagcgaggccacctggaaggacaccgagcacagcagaaacagcagcgccagcagaagccccagcctggccctgagccccccccccgccctggcccccgagctgctgagagtgagaagcatgggcgtgctgagcgacagcgaggccagatgcggcgacatccagaagaccaagaacagctgggccagcaagcaccccgcctgcaacctgccccaggacctgcacggcgccagccccctgggcgtgctgagcgacagccagagcatcgtgggcgagatggagcagaaggagaactgcgtgcccgtgttccccggcagaggcagcagccccagcagcaacagcgtgagcaagagccacgtgagcgagcccatcgccgaccagagcaactacaagcccgacggcgaggccgtggagcagagaaagaaccactgggccaccgagctgcccgcccccagcagcctgagcacccccctgcccgagccccacatcgacctggagctggtgtggagaaacgtgcagcagagagaggtgccccagggccccagccccctggccgtggaccccctgcaccccgtgccccagccccccaccctggccgaggccgtgaagatcgagagaacccaccccggcctgcccaagggcgtgacctgccccggcgtgaaggccgaggcccccctgagccagagatggaccgtgcccgagctgctgacccaccccggcatccacgcctggcagtggagcagagagctgaagctgagactgaagaagctgagacagagccccgccagcagagcccccggccccagccagagcttctgcagcagccccatcctgagcagcaccatccccgacttctggggcctgcccagctgccccccccagcagatctacccccccaacccctgcccccacagcagcagctgccacccccaggaggtgcagagaaccgtgccccagcccgtgcagagcagccactgccaccacttccagagcagcagccagctgcagccccaggagagcggcagagccgagcagggcagccagagaggcgagaagatgaagggcaagatggtgagccaggtgcccagccagggcccctgcgtgcacatggaggccggcgtggactacctgagccccggccccggcgagcccagcaacagcaaggtgctggtgagcggcaagagaaaggacaaggccagcgccagcagcagcgccaagaagagagagcaccccagaaagcccaaggccggcgaccacagaagaggcaccgccagactgggcctgagcaccgtgaccggcaagaaccaccccgcccaggccagaagcctggtggaggcccccgtgagcaccttcccccagagaagccagcacagaggccagagcagccagcacaccgccctgccccagctgctgctgcccaaggccagcggcccccaggaccagcccgaggccggcagaagagccagcgacatcctgacccccagacactgcaagcactgcccctgggcccacatggagaagtacctgagcttccccaccctgaaggccagcctgaccagaggcctgcagaaggtgctggccaagtgcctggacaaccacagacccctgcccaccaagagcagccagtag

SEQ ID NO: 19661 - DNA, 3021 bp, Artificial Sequence
  Description of Artificial Sequence: Synthetic coding sequence
atgctgagaaaggagctgcccctgctgcacagagtggccttcctggaccacctgtgcaagcagaagagcgaggtggaggaggagggcgaggaggaggaggagggcgaggacgaggccagcctggaccccctgaagccctgcagccccaccaaggaggcccccaccggcgagcaggccacccccgcccccccccagcccagctgcggcagcgagggcctgctgaaggccatcggcatccccgagcagaccgtgatgcagcccgtgagccccagcagaagcttccccatcttccagatcctgaccagcttccccgtgagacacaagatcgccagcggcaacagacagcagcagagaaagagccagctgttctggggcctgcccagcctgcacagcgagagcctggaggccatcttcctgagcagcggcggccccagccccctgaagtggagcgtgtgcagcagcgtgttcttcaacaagctggccttcctgcccagaagcaacctgctgctgccccagtaccacagcagcgcccagttcagcacccacggcgcccacaccatggaggacctggagggcatggcccccgacccccagctgctgcccccccccagcagccccagcgtgagcagcctgctgctgcacctgagacccttccccgtggaccacaagggcgtgctgagcggcgccgaggcccccacccagagccccggcaccagccccctggaggtgctgcccggctacgagacccacctggagaccaccggccacaagaagatgccccaggccttcgagccccccatgccccccccctgccagagccccgccagcctgagcgagcccagaaaggtgagccccgagggcggcctggccatcagcaaggacttctggggcaccgtgggctacagagagaagccccaggccagcgagagcagcatgcccgtgccctgcccccccctggacagcctgcccgagctgcagagagagagcagcctggaggaccccagcagatacaagccccagtgggagtgcagagagaacagcggcaacctgtgggccttcgagagccccgtgctggacctgaaccccgagctgagcggcaccagccccgagtgcgtgccccccgccagcgagaccccctggaagggcatgcagagcagagagaacatctgggtgcccgccgaccccgtgagcccccccagcctgcccagcgtgcccctgctggagagcctggtgatgggcccccagggcgtgctgagcgagagcaaggccctgtgggagaccatgggccagaaggagaacctgtgggccagcgacagccccgaccccgtgcacagcaccccccccaccaccctgatggagccccacagaatcaaccccggcgagtgcctggccaccagcgaggccacctggaaggacaccgagcacagcagaaacagcagcgccagcagaagccccagcctggccctgagccccccccccgccctggcccccgagctgctgagagtgagaagcatgggcgtgctgagcgacagcgaggccagatgcggcgacatccagaagaccaagaacagctgggccagcaagcaccccgcctgcaacctgccccaggacctgcacggcgccagccccctgggcgtgctgagcgacagccagagcatcgtgggcgagatggagcagaaggagaactgcgtgcccgtgttccccggcagaggcagcagccccagcagcaacagcgtgagcaagagccacgtgagcgagcccatcgccgaccagagcaactacaagcccgacggcgaggccgtggagcagagaaagaaccactgggccaccgagctgcccgcccccagcagcctgagcacccccctgcccgagccccacatcgacctggagctggtgtggagaaacgtgcagcagagagaggtgccccagggccccagccccctggccgtggaccccctgcaccccgtgccccagccccccaccctggccgaggccgtgaagatcgagagaacccaccccggcctgcccaagggcgtgacctgccccggcgtgaaggccgaggcccccctgagccagagatggaccgtgcccgagctgctgacccaccccggcatccacgcctggcagtggagcagagagctgaagctgagactgaagaagctgagacagagccccgccagcagagcccccggccccagccagagcttctgcagcagccccatcctgagcagcaccatccccgacttctggggcctgcccagctgccccccccagcagatctacccccccaacccctgcccccacagcagcagctgccacccccaggaggtgcagagaaccgtgccccagcccgtgcagagcagccactgccaccacttccagagcagcagccagctgcagccccaggagagcggcagagccgagcagggcagccagagaggcgagaagatgaagggcaagatggtgagccaggtgcccagccagggcccctgcgtgcacatggaggccggcgtggactacctgagccccggccccggcgagcccagcaacagcaaggtgctggtgagcggcaagagaaaggacaaggccagcgccagcagcagcgccaagaagagagagcaccccagaaagcccaaggccggcgaccacagaagaggcaccgccagactgggcctgagcaccgtgaccggcaagaaccaccccgcccaggccagaagcctggtggaggcccccgtgagcaccttcccccagagaagccagcacagaggccagagcagccagcacaccgccctgccccagctgctgctgcccaaggccagcggcccccaggaccagcccgaggccggcagaagagccagcgacatcctgacccccagacactgcaagcactgcccctgggcccacatggagaagtacctgagcttccccaccctgaaggccagcctgaccagaggcctgcagaaggtgctggccaagtgcctggacaaccacagacccctgcccaccaagagcagccagtag

SEQ ID NO: 19662 - DNA, 3096 bp, Artificial Sequence
  Description of Artificial Sequence: Synthetic coding sequence
atgctgagaaagatccagagatggtggcagctgggcagactgagacagctgcacccctggtgcagcggcaacatggtgcagggcaaggagctgcccctgctgcacagagtggccttcctggaccacctgtgcaagcagaagagcgaggtggaggaggagggcgaggaggaggaggagggcgaggacgaggccagcctggaccccctgaagccctgcagccccaccaaggaggcccccaccggcgagcaggccacccccgcccccccccagcccagctgcggcagcgagggcctgctgaaggccatcggcatccccgagcagaccgtgatgcagcccgtgagccccagcagaagcttccccatcttccagatcctgaccagcttccccgtgagacacaagatcgccagcggcaacagacagcagcagagaaagagccagctgttctggggcctgcccagcctgcacagcgagagcctggaggccatcttcctgagcagcggcggccccagccccctgaagtggagcgtgtgcagcagcgtgttcttcaacaagctggccttcctgcccagaagcaacctgctgctgccccagtaccacagcagcgcccagttcagcacccacggcgcccacaccatggaggacctggagggcatggcccccgacccccagctgctgcccccccccagcagccccagcgtgagcagcctgctgctgcacctgagacccttccccgtggaccacaagggcgtgctgagcggcgccgaggcccccacccagagccccggcaccagccccctggaggtgctgcccggctacgagacccacctggagaccaccggccacaagaagatgccccaggccttcgagccccccatgccccccccctgccagagccccgccagcctgagcgagcccagaaaggtgagccccgagggcggcctggccatcagcaaggacttctggggcaccgtgggctacagagagaagccccaggccagcgagagcagcatgcccgtgccctgcccccccctggacagcctgcccgagctgcagagagagagcagcctggaggaccccagcagatacaagccccagtgggagtgcagagagaacagcggcaacctgtgggccttcgagagccccgtgctggacctgaaccccgagctgagcggcaccagccccgagtgcgtgccccccgccagcgagaccccctggaagggcatgcagagcagagagaacatctgggtgcccgccgaccccgtgagcccccccagcctgcccagcgtgcccctgctggagagcctggtgatgggcccccagggcgtgctgagcgagagcaaggccctgtgggagaccatgggccagaaggagaacctgtgggccagcgacagccccgaccccgtgcacagcaccccccccaccaccctgatggagccccacagaatcaaccccggcgagtgcctggccaccagcgaggccacctggaaggacaccgagcacagcagaaacagcagcgccagcagaagccccagcctggccctgagccccccccccgccctggcccccgagctgctgagagtgagaagcatgggcgtgctgagcgacagcgaggccagatgcggcgacatccagaagaccaagaacagctgggccagcaagcaccccgcctgcaacctgccccaggacctgcacggcgccagccccctgggcgtgctgagcgacagccagagcatcgtgggcgagatggagcagaaggagaactgcgtgcccgtgttccccggcagaggcagcagccccagcagcaacagcgtgagcaagagccacgtgagcgagcccatcgccgaccagagcaactacaagcccgacggcgaggccgtggagcagagaaagaaccactgggccaccgagctgcccgcccccagcagcctgagcacccccctgcccgagccccacatcgacctggagctggtgtggagaaacgtgcagcagagagaggtgccccagggccccagccccctggccgtggaccccctgcaccccgtgccccagccccccaccctggccgaggccgtgaagatcgagagaacccaccccggcctgcccaagggcgtgacctgccccggcgtgaaggccgaggcccccctgagccagagatggaccgtgcccgagctgctgacccaccccggcatccacgcctggcagtggagcagagagctgaagctgagactgaagaagctgagacagagccccgccagcagagcccccggccccagccagagcttctgcagcagccccatcctgagcagcaccatccccgacttctggggcctgcccagctgccccccccagcagatctacccccccaacccctgcccccacagcagcagctgccacccccaggaggtgcagagaaccgtgccccagcccgtgcagagcagccactgccaccacttccagagcagcagccagctgcagccccaggagagcggcagagccgagcagggcagccagagaggcgagaagatgaagggcaagatggtgagccaggtgcccagccagggcccctgcgtgcacatggaggccggcgtggactacctgagccccggccccggcgagcccagcaacagcaaggtgctggtgagcggcaagagaaaggacaaggccagcgccagcagcagcgccaagaagagagagcaccccagaaagcccaaggccggcgaccacagaagaggcaccgccagactgggcctgagcaccgtgaccggcaagaaccaccccgcccaggccagaagcctggtggaggcccccgtgagcaccttcccccagagaagccagcacagaggccagagcagccagcacaccgccctgccccagctgctgctgcccaaggccagcggcccccaggaccagcccgaggccggcagaagagccagcgacatcctgacccccagacactgcaagcactgcccctgggcccacatggagaagtacctgagcttccccaccctgaaggccagcctgaccagaggcctgcagaaggtgctggccaagtgcctggacaaccacagacccctgcccaccaagagcagccagtag

SEQ ID NO: 19663 - DNA, 1665 bp, Artificial Sequence
  Description of Artificial Sequence: Synthetic coding sequence
atggtgcagggcaaggagctgcccctgctgcacagagtggccttcctggaccacctgtgcaagcagaagagcgaggtggaggaggagggcgaggaggaggaggagggcgaggacgaggccagcctggacccccccgagctgctgagagtgagaagcatgggcgtgctgagcgacagcgaggccagatgcggcgacatccagaagaccaagaacagctgggccagcaagcaccccgcctgcaacctgccccaggacctgcacggcgccagccccctgggcgtgctgagcgacagccagagcatcgtgggcgagatggagcagaaggagaactgcgtgcccgtgttccccggcagaggcagcagccccagcagcaacagcgtgagcaagagccacgtgagcgagcccatcgccgaccagagcaactacaagcccgacggcgaggccgtggagcagagaaagaaccactgggccaccgagctgcccgcccccagcagcctgagcacccccctgcccgagccccacatcgacctggagctggtgtggagaaacgtgcagcagagagaggtgccccagggccccagccccctggccgtggaccccctgcaccccgtgccccagccccccaccctggccgaggccgtgaagatcgagagaacccaccccggcctgcccaagggcgtgacctgccccggcgtgaaggccgaggcccccctgagccagagatggaccgtgcccgagctgctgacccaccccggcatccacgcctggcagtggagcagagagctgaagctgagactgaagaagctgagacagagccccgccagcagagcccccggccccagccagagcttctgcagcagccccatcctgagcagcaccatccccgacttctggggcctgcccagctgccccccccagcagatctacccccccaacccctgcccccacagcagcagctgccacccccaggaggtgcagagaaccgtgccccagcccgtgcagagcagccactgccaccacttccagagcagcagccagctgcagccccaggagagcggcagagccgagcagggcagccagagaggcgagaagatgaagggcaagatggtgagccaggtgcccagccagggcccctgcgtgcacatggaggccggcgtggactacctgagccccggccccggcgagcccagcaacagcaaggtgctggtgagcggcaagagaaaggacaaggccagcgccagcagcagcgccaagaagagagagcaccccagaaagcccaaggccggcgaccacagaagaggcaccgccagactgggcctgagcaccgtgaccggcaagaaccaccccgcccaggccagaagcctggtggaggcccccgtgagcaccttcccccagagaagccagcacagaggccagagcagccagcacaccgccctgccccagctgctgctgcccaaggccagcggcccccaggaccagcccgaggccggcagaagagccagcgacatcctgacccccagacactgcaagcactgcccctgggcccacatggagaagtacctgagcttccccaccctgaaggccagcctgaccagaggcctgcagaaggtgctggccaagtgcctggacaaccacagacccctgcccaccaagagcagccagtag

SEQ ID NO: 19664 - DNA, 573 bp, Artificial Sequence
  Description of Artificial Sequence: Synthetic coding sequence
atggccctgagaggccaccccgagccccagcccaccaacacccccctgagcgccaccgtgggcggccccatcagcctgttcacccagcccagatgccacagcgccgccagagacctggtgtggagccaggcctggcccgaccccgacgtgctggagatcagcatgcagacccccggcggcagcagctgcagaaaggaggccgtgctgcccagactgagagtgaccagacccctggtgcccgagcccgccatcctgcccgtgtgcgccgccagactggccggcagcctggccaccgacctgagcagaagccacagcctgctgcccccctgggtggacctgaaggagccccccccccccagcgcccccagcctgctgctggaggaccccggccagggcggctgccacggcgcccagagctgcgtgggcacctgcgagctggccaacggcgccagaggcttctgccccgagatgggccagaacgagagcctgagcgaggagagaaagggccacgagagcaagagaaagagcggcggcagaggcagccccagcagccaccccacccaggccagctag

SEQ ID NO: 19665 - DNA, 693 bp, Artificial Sequence
  Description of Artificial Sequence: Synthetic coding sequence
atgctgggcacccagtggaccctggccagatgcctgctgcccagccaccccgaccccggcctggccggcagcctgagaggcgacagcagcgaggacggcagaagaggccagctgctgccccagagccccgccccctgcagccccgtgtggagccccggcacccccgtgggcggcccccaccccgccggcgacggccccgccaccgcccccggcccccccgagggccccgagctggccttcccccaggacctgagccccgcctggccccagaagggcgccggcacccaccccgccaacgccggccccggccccctgagcagaagaagcagccagctgagaacccccctggaggccggcagaaagtggggctggaagatgaccagatggagactgagaagagaccaggcccccggcgagggcacccaggccaagctgctgggcgaggccctgagcaccgccggcagaggccacgccggcccccccgagggctgggccggcgagggcggcgtgagccccggcctgacccccctgctgggcaccggccagggcaaggagctggacctggacctgagagagaagttcatcagattcgaccagatcctgggcatcagcctggaccacatccccttcctgccccagaccggccccggcagaccctggggctgcggcgtgggcaagcagagaccccactag

SEQ ID NO: 19666 - DNA, 615 bp, Artificial Sequence
  Description of Artificial Sequence: Synthetic coding sequence
atggaccccctgagcccccccctgtgcaccctgccccccggccccgagccccccagattcgtgtgctactgcgagggcgaggagagcggcgagggcgacagaggcggcttcaacctgtacgtgaccgacgccgccgagctgtggagcacctgcttcacccccgacagcctggccgccctgaaggccagattcggcctgagcgccgccgaggacatcacccccagattcagagccgcctgcgagcagcaggccgtggccctgaccctgcaggaggacagagccagcctgaccctgagcggcggccccagcgccctggccttcgacctgagcaaggtgcccggccccgaggccgcccccagactgagagccctgaccctgggcctggccaagagagtgtggagcctggagagaagactggccgccgccgaggagaccgccgtgagccccagaaagagccccagacccgccggcccccagctgttcctgcccgaccccgacccccagagaggcggccccggccccggcgtgagaagaagatgccccggcgagagcctgatcaaccccggcttcaagagcaagaagcccgccggcggcgtggacttcgacgagacctag

SEQ ID NO: 19667 - DNA, 177 bp, Artificial Sequence
  Description of Artificial Sequence: Synthetic coding sequence
atgcccaacagacacaagaccaaggaccagaccctgctgcccgcccagcagtacatctggctgctgaacagccacacccagatgaccgcccccgtgccccagttcaagctgagcgagaccgccagcctgctgtgcaagagaaagatcagcaccgccatgagcagcacctgcctgtag

SEQ ID NO: 19668 - DNA, 459 bp, Artificial Sequence
  Description of Artificial Sequence: Synthetic coding sequence
tgaggcagacccccccacaagggcgcccccagactgggcagaggcgtgggcgccctggtgcccgcccccagagccggcagccacccccccgccggcgtgtgcgccagcgtgcacagaaacgccgtgggcgccggcggccccgccagagccggccagcccggcctggacggcaccggcagaagaggcgccagagccggcggcgagagacccgagggcagagcccccaaggtgtggaacccccccagccccctgtggagcgaggaggtgtacagcaccgccccctactacaccagctgggccagaggccccagatgcccccccgagctgtgcgccccccccctgaagagaaaggagcagaccgagcccacccccagcgtgagacaccccaccatgatgagatacctggtggagcagaccaacagcgccaccgagaacgacgagagctgcctgaagaagtag

SEQ ID NO: 19669 - DNA, 687 bp, Artificial Sequence
  Description of Artificial Sequence: Synthetic coding sequence
atggaggacagccccctgcccgacctgagagacatcgagctgaagctgggcagaaaggtgcccgagagcctggtgagaagcctgagaggcgaggagcccgtgcccagagagagagacagagacccctgcggcggcagcggcggcggcggcggcggcggcggcggctgcagcagcagcagcagctactgcagcttcccccccagcctgagcagcagcagcagcagcagccccaccagcggcagccccagaggcagccacagcagcgccctggagagactggagaccaagctgcacctgctgagacaggagatggtgaacctgagagccaccgacgtgagactgatgagacagctgctggtgatcaacgagagcatcgagagcatcaagtggatgatcgaggagaaggccaccatcaccagcagaggcagcagcctgagcggcagcctgtgcagcctgctggagagccagagcaccagcctgagaggcagctacaacagcctgcacgacggcagcgacggcctggacggcatcagcgtgggcagctacctggacaccctggccgacgacgtgcccggccaccagacccccagcgacctggaccagttcagcgacagcagcctgatcgaggacagccaggccctgcacaagagacccaagctggacagcgagtactactgcttcggctag

SEQ ID NO: 19670 - DNA, 720 bp, Artificial Sequence
  Description of Artificial Sequence: Synthetic coding sequence
atggagggcctgccctgcccctgccccgccctgccccacttctggcagctgagaagccacctgatggccgagggcagcagaacccaggcccccggcaagggcccccccctgagcatccagttcctgagagcccagtacgagggcctgaagagacagcagagaacccaggcccacctgctggtgctgcccaagggcggcaacacccccgcccccgccgagagcatggtgaacgccgtgtggatcaacaaggagagaagaagcagcctgagcctggaggaggccgacagcgaggtggagggcagactggaggaggccgcccagggctgcctgcaggcccccaagagcccctggcacacccacctggagatgcactgcctggtgcagaccagcccccaggacaccagccaccaggtgcaccacagaggcaagctggtgggcagcgaccagagactgccccccgagggcgacacccacctgttcgagaccaaccagatgacccagcagggcaccggcatccccgaggccgcccagctgccctgccaggtgggcaacacccagaccaaggccgtggagagcggcctgaagttcagcacccagtgccccctgagcatcaagaacccccacagaagcggcaagcccgcctactaccccttcccccagagaaagacccccagaatcagccaggccgccagaaacctgggcctgtacggcagcgcctag

SEQ ID NO: 19671 - DNA, 288 bp, Artificial Sequence
  Description of Artificial Sequence: Synthetic coding sequence
atgttcctgaccggcgacaccagccccgccgaggacaacagagaggccaccctgccccagtgcagcctgcccgagctgtacgcctgcatcgagaacttcaacaaggagagcaagaagagcaacctgctgaagatgcacggcatcagcctgaacgaggcccaggaggtgctggccagaaacctgaacgtgatgagcttcaccagaggcgccgacgtgagaggcgacctgcagcccgtgatcagaaagaccatccacgagagcaagggcagcggcatggagatcttctag

SEQ ID NO: 19672 - DNA, 306 bp, Artificial Sequence
  Description of Artificial Sequence: Synthetic coding sequence
atgttcctgaccggcgacaccagccccgccgaggacaacagagaggccaccctgccccagtgcagcctgcccgagctgtacgcctgcatcgagaacttcaacaaggagagcaagaagagcaacctgctgaagatgcacggcatcagcctgaacgaggcccaggaggtgctggccagaaacctgaacgtgatgagcttcaccagaggcgccgacgtgagaggcgacctgcagcccgtgatcagcgtgaacaagatgaacaagcccggcaagcacagaaagacccccagccccaagatcaacaagtag

SEQ ID NO: 19673 - DNA, 558 bp, Artificial Sequence
  Description of Artificial Sequence: Synthetic coding sequence
atgagctggagccagcccgtgctgagaggcctgcccgccagcagagacgaggacagcaagcaggtgaccaccctgccctggggcaagagaagcagcagaggcggcgccatctacctgagcggcatcgacatgatccacggcacccccgtgctggacatcaagccctacatcgccgagtacgacagcccccagaacgtgatggagcccctggccgacttcaacctgcagaacaaccagcacacccccaacaccgtgagccagagcgacagcaagaccgacagctgcgaccagagacagctgagcggctgcgacgagccccagccccaccacagcaccaagagaaagcccaagtgccccgaggacagaaccagcgaggagaactacctgacccacagcgacaccgccagaatccagcaggccttccccatgcacagagagatcgccgtggacttcggcctggagagcagaagagaccagagcagcagcgtggccgaggagcagatcggcccctactgccccgagaagagcttcagcgagaagggcaccgacagaagctag

SEQ ID NO: 19674 - DNA, 480 bp, Artificial Sequence
  Description of Artificial Sequence: Synthetic coding sequence
agaggcctggaggagagcggccccagacccaccgccaccccctgcggctgcgtgaagcccgccctggagaccggcaacctgctgaccgagcccgtgggctacctggagagctgcttcagcgccaagaacggcacccccagacagcccagcatctgcagctacagcagagcctgcctgagaatcagaaagagaatcttcaacaaccccgagcacagcctgatgggcctggagcagttcagccacgtgtggatcctgttcgtgttccacaagaacggccacctgagctgcaaggccaaggtgcagccccccagactgaacggcgccaagaccggcgtgttcagcaccagaagcccccacagacccaacgccatcggcctgaccctggccaagctggagaaggtggaggccctgggcaagtggaccgacatcatggccgccgtgctgatgagcaccgtgctgtgcggcagaagcctgggctag

SEQ ID NO: 19675 - DNA, 888 bp, Artificial Sequence
  Description of Artificial Sequence: Synthetic coding sequence
atgatccacggcacccccgtgctggacatcaagccctacatcgccgagtacgacagcccccagaacgtgatggagcccctggccgacttcaacctgcagaacaaccagcacacccccaacaccgtgagccagagcgacagcaagaccgacagctgcgaccagagacagctgagcggctgcgacgagccccagccccaccacagcaccaagagaaagcccaagtgccccgaggacagaaccagcgaggagaactacctgacccacagcgacaccgccagaatccagcaggccttccccatgcacagagagatcgccgtggacttcggcctggagagcagaagagaccagagcagcagcgtggccgaggagcagatcggcccctactgccccgagaagagcttcagcgagaagggcaccgacaagaagctggagagagtggagggcgccgccgtgctgcagggcagcagagccgagacccagcccatggccccccactgccccgccggcagagccgacggcgcccccagaagcgtggtgcccgcctgggtgaccgaggcccccgtggccaccctggaggtgagattcaccccccacgccgagatggacctgggccagctgagcagccaggacgtgggccaggccagcttcaagtacttccagagcgccgaggaggccaagagagccatcgaggccgtgctgagcgccgaccccagaagcgtgtacagaagaaagctgtgccaggacagactgttctacttcaccgtggacatcgcccacgtgacctgctggttcggcgacggcttcgccgaggtgctgagaatcaagcccgccagcgagcccgtgcacatgaccggccccgtgggcagcctggtgagcctgggcagctag

SEQ ID NO: 19676 - DNA, 1326 bp, Artificial Sequence
  Description of Artificial Sequence: Synthetic coding sequence
atgagaggcctggaggagagcggccccagacccaccgccaccccctgcggctgcgtgaagcccgccctggagaccggcaacctgctgaccgagcccgtgggctacctggagagctgcttcagcgccaagaacggcacccccagacagcccagcatctgcagctacagcagagcctgcctgagaatcagaaagagaatcttcaacaaccccgagcacagcctgatgggcctggagcagttcagccacgtgtggatcctgttcgtgttccacaagaacggccacctgagctgcaaggccaaggtgcagccccccagactgaacggcgccaagaccggcgtgttcagcaccagaagcccccacagacccaacgccatcggcctgaccctggccaagctggagaaggtggagggcggcgccatctacctgagcggcatcgacatgatccacggcacccccgtgctggacatcaagccctacatcgccgagtacgacagcccccagaacgtgatggagcccctggccgacttcaacctgcagaacaaccagcacacccccaacaccgtgagccagagcgacagcaagaccgacagctgcgaccagagacagctgagcggctgcgacgagccccagccccaccacagcaccaagagaaagcccaagtgccccgaggacagaaccagcgaggagaactacctgacccacagcgacaccgccagaatccagcaggccttccccatgcacagagagatcgccgtggacttcggcctggagagcagaagagaccagagcagcagcgtggccgaggagcagatcggcccctactgccccgagaagagcttcagcgagaagggcaccgacaagaagctggagagagtggagggcgccgccgtgctgcagggcagcagagccgagacccagcccatggccccccactgccccgccggcagagccgacggcgcccccagaagcgtggtgcccgcctgggtgaccgaggcccccgtggccaccctggaggtgagattcaccccccacgccgagatggacctgggccagctgagcagccaggacgtgggccaggccagcttcaagtacttccagagcgccgaggaggccaagagagccatcgaggccgtgctgagcgccgaccccagaagcgtgtacagaagaaagctgtgccaggacagactgttctacttcaccgtggacatcgcccacgtgacctgctggttcggcgacggcttcgccgaggtgctgagaatcaagcccgccagcgagcccgtgcacatgaccggccccgtgggcagcctggtgagcctgggcagctag

SEQ ID NO: 19677 - DNA, 519 bp, Artificial Sequence
  Description of Artificial Sequence: Synthetic coding sequence
ggcctggaggagagcggccccagacccaccgccaccccctgcggctgcgtgaagcccgccctggagaccggcaacctgctgaccgagcccgtgggctacctggagagctgcttcagcgccaagaacggcacccccagacagcccagcatctgcagctacagcagagcctgcctgagaatcagaaagagaatcttcaacaaccccgagcacagcctgatgggcctggagcagttcagccacgtgtggatcctgttcgtgttccacaagaacggccacctgagctgcaaggccaaggtgcagccccccagactgaacggcgccaagaccggcgtgttcagcaccagaagcccccacagacccaacgccatcggcctgaccctggccaagctggagaaggtggagggcaaccccttccacttctacttctacctgttcccccaccccaagaagccctacaagatcaacagcatccaccactggctgttcatccagaccagcaccaacgacgtgaacagctag

SEQ ID NO: 19678 - DNA, 252 bp, Artificial Sequence
  Description of Artificial Sequence: Synthetic coding sequence
atgagcggccccaacggcgacctgggcatgcccgtggaggccggcgccgagggcgaggaggacggcttcggcgaggccgagtacgccgccatcaacagcatgctggaccagatcaacagctgcctggaccacctggaggagaagaacgaccacctgcacgccagactgcaggagctgctggagagcaacagacagaccagactggagttccagcagcagctgggcgaggcccccagcgacgccagcccctag

SEQ ID NO: 19679 - DNA, 612 bp, Artificial Sequence
  Description of Artificial Sequence: Synthetic coding sequence
atgcccggccccctgacctgcacccccgcctggcagggccagggcagagccgccgccttcctgtgctgcagcttccagagagccggcgccgtggtgggcgtgcccgccagatggcacagaggcagactgagcagccagcagagactgagaagcagcctgggcggcagccacccctgcccccagctgggcagaagactggtgagagagggcgtgatcagcgtgcccagacagcagggcagaagaagatgcagagagagcttcagccccgccgacgtggcccccggccccatctgcagcgccaacatctgcctgagcggcgtgagattcctgacctgcctgaacagagtgagagagcacgtggtgggccccagccccagccccgccgcccccatctgcttcttccccgtggtggaggccctgtgcaccctgagaggcagaagatgccactgcctgcccttccccaagagaggcatgcagagatggatgctgcccctgagaagaggcgccagactgctgcccctggccagcagcaagaaccccagagccagaagccccggcctggaccccctgggcagcagcgagaccctgtggagccacagaggcggccactag

SEQ ID NO: 19680 - DNA, 435 bp, Artificial Sequence
  Description of Artificial Sequence: Synthetic coding sequence
atggacccccaggagatggtggtgaagaacccctacgcccacatcagcatccccagagcccacctgagacccgacctgggccagcagctggaggtggccagcacctgcagcagcagcagcgagatgcagcccctgcccgtgggcccctgcgcccccgagcccacccacctgctgcagcccaccgaggtgcccggccccaagggcgccaagggcaaccagggcgccgcccccatccagaaccagcaggcctggcagcagcccggcaacccctacagcagcagccagagacaggccggcctgacctacgccggccccccccccgccggcagaggcgacgacatcgcccaccactgctgctgctgcccctgctgccactgctgccactgcccccccttctgcagatgccacagctgctgctgctgcgtgatcagctag

SEQ ID NO: 19681 - DNA, 366 bp, Artificial Sequence
  Description of Artificial Sequence: Synthetic coding sequence
atgtggagcagaagaggcctgggcgtgagcagagcccccctgcacctgctgctgggcgtgtggggccccagcggcagaaccggcggccagagaaagggcgccagcctggccagacccggcagaggcggcctggccagctgcagcgtgggcgccaacggcaagagagacgtgctgttcctgagaaagaccctgaccaacaccgtggaggacatccagatcgacaacttcagaagaaagagcgacctgggcgtgggcagccccgactggaagaacctgctgatcgacgtgaccagagaggaccacgagaacagccagaacaacagcaagagaagatgcaaggtgaactgcgagaccgaccagagatag

SEQ ID NO: 19682 - DNA, 963 bp, Artificial Sequence
  Description of Artificial Sequence: Synthetic coding sequence
atgcccgaggccagaagcagcggccccgacctgaccagatggagaaagcagcagcagcccgtgagaagaaccgtgagccaggtgtgccccccccccagaagacccctgaccgtggccgacatcagaagcggcatggagaacgagagactgggcgtggtgagagacagcatgttccagaaccccctgatcgtgaaggccgccggccccgccagcgtgggcaccagctacagcgtgtacgacagcagcgccgtgcagaaggtgatccccagcctggccggccaccacatcaagggcggcccccaggccgagctgggcaagcccagagagagaagctacagcctgcccggcatcaacttcaactacggcctgtacatcagaggcctggacggcggcgtgcccgaggccatcggcagatggaacgtgttcaagcagcagcccacctgcccccacgagctgaccagaaactacatcgccatgaacagaggcgccgtgaaggccggcctggtgaccgccagagagaacctgctgtacagacagctgaacgacatcagaatcagcgaccaggacgacagaagaatgaagaaggagcccccccccctgccccccaacatgaccttcggcatcagagccagacccagcacccccttcttcgacctgctgcagcacagatacctgcagctgtgggtgcaggagcagaaggccacccagaaggccatcaagctggagaagaagcagaaggtggtgctgggcaagctgtacgagaccagaagcagccagctgagaaagtacaagccccccgtgaagctggacaccctgtggcacatgccccacttccagaaggtgggcagacacctggacaccttccccaccgaggccgacagacagagagccctgaaggcccacagagaggagtgcgccgtgagacagggcaccctgagaatgggcaactacacccacccctag

SEQ ID NO: 19683 - DNA, 855 bp, Artificial Sequence
  Description of Artificial Sequence: Synthetic coding sequence
atgcccgaggccagaagcagcggccccgacctgaccagatggagaaagcagcagcagcccgtgagaagaaccgtgagccaggtgtgccccccccccagaagacccctgaccgtggccgacatcagaagcggcatggagaacgagagactgggcgtggtgagagacagcatgttccagaaccccctgatcgtgaaggccgagctgggcaagcccagagagagaagctacagcctgcccggcatcaacttcaactacggcctgtacatcagaggcctggacggcggcgtgcccgaggccatcggcagatggaacgtgttcaagcagcagcccacctgcccccacgagctgaccagaaactacatcgccatgaacagaggcgccgtgaaggccggcctggtgaccgccagagagaacctgctgtacagacagctgaacgacatcagaatcagcgaccaggacgacagaagaatgaagaaggagcccccccccctgccccccaacatgaccttcggcatcagagccagacccagcacccccttcttcgacctgctgcagcacagatacctgcagctgtgggtgcaggagcagaaggccacccagaaggccatcaagctggagaagaagcagaaggtggtgctgggcaagctgtacgagaccagaagcagccagctgagaaagtacaagccccccgtgaagctggacaccctgtggcacatgccccacttccagaaggtgggcagacacctggacaccttccccaccgaggccgacagacagagagccctgaaggcccacagagaggagtgcgccgtgagacagggcaccctgagaatgggcaactacacccacccctag

SEQ ID NO: 19684 - DNA, 2931 bp, Artificial Sequence
  Description of Artificial Sequence: Synthetic coding sequence
atgaccagaaccgacccccccgacctgctggtgagcaccgtgtaccaggacatcaaggtggccacccccggccccgccagcaagtgcagcccctgcgagagaagcgtggccagacccgccgagcccgcccccttcaacaagagacactgcagaagcttcgacttcctggaggccctggacggccccgccatggagaccctgcccgagccccccccccccgagagcgccgtgcccagagccagaaccagagaggccgagcccagaagaagagccagaagcaagagcgcccccagagccccccccggcctgacccccgcccccgccagcccccccgtgctgcccagaagaggcagagaggcccagagagccgccagagccgaggccagccccagaagagagcccgcctaccccgccctgagagccctggccaacgagctgcaccccatcaagctgcagccccagagaggcggccccggcagagtggcccccctgtgcgccgccgccggcagatgcgccccccccgagccccccgccggccccgccccccacgtgagatgcagactggacatcaagcccgacgacgccgtgctgcagcacgccaccagaggcagcagaagctgcggccccaccgaggccgcccactgggccagacccgccccccagttccacggcctgaccgtgcccggccccagacacatggccctgagcagaacccccacccccagcgacagctactgcgccgaccccagagccttctactgcgacggccccctgcccggccccagagactacgccgagagaagaagcctgcccttcaccaccccccccggccccacccagttcttctacaccgaggagccccagggcttcagaggcagcttcgccgccagccccggccccaccttcgacgcctactaccccagaccctaccccagcgaggagctgagcggccccagccccagaagaatgggcggctactacgccggcgaggtgagaaccttccccatccaggagccccccagcagaagctactacggcgaggcccccagagcctacggcctgccctacggccccagatacgtgcccgaggagcccagagcccacagcaccgccagacccttctacaccgaggacttcggcagatacagagagagagacgtgctggccagaacctacccccaccccagaagcagccccgcctgggccgactggggccccagaccctacagaaccctgcaggtggtgccccccagcgaccccgaccccctgctggccagctggcacggcggcaccggcaccagcccccccagactggccaccgacagcagacactacagcagaagctgggacaacatcctggcccccggccccagaagagaggaccccctgggcagaggcagaagctacgagaacctgctgggcagagaggtgagagagcccagaggcgtgagccccgagggcagaagaccccccgtggtggtgaacctgagcaccagccccagaagatacgccgccctgagcctgagcgagaccagcctgaccgagaagggcagagccggcgagggcctgggcagaaactggtacgtgacccccgagatcaccatcaccgacaacgacctgagagccaccgagagacccagcgccagagcctgggagctgcccggcggcagaaccagaccccccccccacgccgcccccgacggccccaccagcggcagacagagaagcctggagcagctggacgagctgatcaccgacctggtgatcgacagcagacccaccgccggccaggccagcgagcccgccgccgactgcctgggcccccagctgagaagactgctggacagcagacccgccggcagcggcgcccccgccctggccccccccagaagcccccccgccagcgccggcagcgccgaggagcccgccgcccccggcgaggccgccgacgccagccccgagcccagcgccgacgaggacgacctgatgacctgcagcaacgccagatgcagaagaaccgagaccatgttcaacgcctgcctgtacttcaagagctgccacagctgctacacctactactgcagcagactgtgcagaagagaggactgggacgcccacaaggccagatgcgtgtacggcagagtgggcagcgtgtgcagacacgtgctgcagttctgcagagacagcggccccgtgcacagagccttcagcagaatcgccagagtgggcttcctgagcagaggcagaggcgtgctgttcctgggcttccccagccccggcagcgccgacaacttcctgagattcggcctggagggcctgctgctgagccccacctacctgagcctgagagagctggccacccacgccgcccccctgggcagctacgccagagagctggccgccgccggcagactgtacgagcccgccgagtgcttcctgctgagcgtgagcgtggccgtgggccccggcaccgccccccccggcacccccgccctgcccgcccccgcccccagaagccacggccccaccgtgagaaagttcgccaaggtggccctggccgccggcagccccgccagacccccccccgccagaagcagagagcccgacatggagaccctgatcctgacccccccccccggcaccgccggcctggaccaggacggcgaggccggcagaagagccagagaggtggccttcatccacatccagagagagctgagactgagaggcgtgttcctgagacacgagttccccagagtgtacgagcagctgtgcgagttcgtggaggccaacagaagattcacccccaccaccatctaccccaccgacagaagaaccggcagacccttcatgtgcatgatcatggccgccagcgagcccagagccctggactgggtggccagcgccaacctgctggacgacatcatgtag

SEQ ID NO: 19685 - DNA, 1161 bp, Artificial Sequence
  Description of Artificial Sequence: Synthetic coding sequence
atgatgaacagcgaccagaaggccgtgaagttcctggccaacttctacatcaacggcggcaagcactggacccacggccacctgagacagacccagcccgagcccacccagcccaaggccagcgtgctgctgctgggccccgagcccggcatggcctgggacgagacccagccccccaagatgaaggagatccccgtgggcctgagactgcagaccggcaccccccaggagagcctgcccacctacacccagaccctgagagagctgctgctggagcagagacccctgatcaccgccgacctggaggtgcccagccccaccagataccaggtgcccagccccagcgtgagagagagcagcccccacccccactacagcatcggctgcaagcaccagggcagagagggcggcggcagaagagcctggcagaccctgtggttccagagcgagagccccttcacccagaaggccgacttcgaccaggagcagaagtggcccagccccgcccactaccagctgctgagcagacccgccttccccgccttcagcttcagaggctgccacagcgccagcaagacccccgagggccacacccacctgggcctgcccggcgccagaggcctgggcctgagagtgcagccccagagcctgctgcaggccagcctgcaggcccccggcaagagatgccccggccccaacacctacaacatcctgcccggcagcagactgcagagccccagaagccccgccttcagcatgagcagaagccccgccttcaccagctggctgagcaccagcttcagcttcggcagccccaacccctggcccagcagactgcccagaggcggcctgcagctgaccctgcccttcggcgcctggagaggccaccccggctgcacccagacccaggcccccagacacagacccctgctgcacgccctggagcccgccggccacaacctgctgggccccgccaccgagtggaaccacggcctgcccagaggcttccccagaccccccctgggcctgggcgcccccgcctggcccagcgaccccctgggcacccccatgcaccccagcggctggcccaccctgctgtgggccgtggacaaggccggccccgcctggatcccccacctgcccatcagccccctgcactag

SEQ ID NO: 19686 - DNA, 927 bp, Artificial Sequence
  Description of Artificial Sequence: Synthetic coding sequence
atgatgaacagcgaccagaaggccgtgaagttcctggccaacttctacatcaacggcggcaagcactggacccacggccacctgagacagacccagcccgagcccacccagcccaaggccagcgtgctgctgctgggccccgagcccggcatggcctgggacgagacccagccccccaagatgaaggagatccccgtgggcctgagactgcagaccggcaccccccaggagagcctgcccacctacacccagaccctgagagagctgctgctggagcagagacccctgatcaccgccgacctggaggtgcccagccccaccagataccaggtgcccagccccagcgtgagagagagcagcccccacccccactacagcatcggctgcaagcaccagggcagagagggcggcggcagaagagcctggcagaccctgtggttccagagcgagagccccttcacccagaaggccgacttcgaccaggagcagaagtggcccagccccgcccactaccagctgctgagcagacccgccttccccgccttcagcttcagaggctgccacagcgccagcaagacccccgagggccacacccacctgggcctgcccggcgccagaggcctgggcctgagagtgcagccccagagcctgctgcaggccagcctgcaggcccccggcaagagatgccccggccccaacacctacaacatcctgcccggcagcagactgcagagccccagaagccccgccttcagcatgagcagaagccccgccttcaccagctggctgagcaccagcagaacccccggccccgccgcctaccacgtggaggactgcaacagcagattccccagcgcccccggcgtggtgatccagggcgtgagaagacccaagagacacgacaccggccccttctgcaccctgtag

SEQ ID NO: 19687 - DNA, 549 bp, Artificial Sequence
  Description of Artificial Sequence: Synthetic coding sequence
atggccgcccccgcccccgtgaccagacaggtgagcggcgccgccgccctggtgcccgcccccagcggccccgacagcggccagcccctggccgccgccgtggccgagctgcccgtgctggacgccagaggccagagagtgcccttcggcgccctgttcagagagagaagagccgtggtggtgttcgtgagacacttcctgtgctacatctgcaaggagtacgtggaggacctggccaagatccccagaagcttcctgcaggaggccaacgtgaccctgatcgtgatcggccagagcagctaccaccacatcgagcccttctgcaagctgaccggctacagccacgagatctacgtggaccccgagagagagatctacaagagactgggcatgaagagaggcgaggagatcgccagcagcggcaacaacatccacttcatccacagagacagaaacagactggaccacaagcccatcaacagcgtgctgcagctggtgggcgtgcagcacgtgaacttcaccaacagacccagcgtgatccacgtgtag

SEQ ID NO: 19688 - DNA, 681 bp, Artificial Sequence
  Description of Artificial Sequence: Synthetic coding sequence
atggccgcccccgcccccgtgaccagacaggtgagcggcgccgccgccctggtgcccgcccccagcggccccgacagcggccagcccctggccgccgccgtggccgagctgcccgtgctggacgccagaggccagagagtgcccttcggcgccctgttcagagagagaagagccgtggtggtgttcgtgagacacttcctgtgctacatctgcaaggagtacgtggaggacctggccaagatccccagaagcttcctgcaggaggccaacgtgaccctgatcgtgatcggccagagcagctaccaccacatcgagcccttctgcaagctgaccggctacagccacgagatctacgtggaccccgagagagagatctacaagagactgggcatgaagagaggcgaggagatcgccagcagcggccagagcccccacatcaagagcaacctgctgagcggcagcctgcagagcctgtggagagccgtgaccggccccctgttcgacttccagggcgaccccgcccagcagggcggcaccctgatcctgggccccggcaacaacatccacttcatccacagagacagaaacagactggaccacaagcccatcaacagcgtgctgcagctggtgggcgtgcagcacgtgaacttcaccaacagacccagcgtgatccacgtgtag

SEQ ID NO: 19689 - DNA, 333 bp, Artificial Sequence
  Description of Artificial Sequence: Synthetic coding sequence
tgatacgtggaggacctggccaagatccccagaagcttcctgcaggaggccaacgtgaccctgatcgtgatcggccagagcagctaccaccacatcgagcccttctgcaagctgaccggctacagccacgagatctacgtggaccccgagagagagatctacaagagactgggcatgaagagaggcgaggagatcgccagcagcggcaacaacatccacttcatccacagagacagaaacagactggaccacaagcccatcaacagcgtgctgcagctggtgggcgtgcagcacgtgaacttcaccaacagacccagcgtgatccacgtgtag

SEQ ID NO: 19690 - DNA, 543 bp, Artificial Sequence
  Description of Artificial Sequence: Synthetic coding sequence
tgaggccccagaccccccagagtgatggccgcccccgcccccgtgaccagacagcacttcctgtgctacatctgcaaggagtacgtggaggacctggccaagatccccagaagcttcctgcaggaggccaacgtgaccctgatcgtgatcggccagagcagctaccaccacatcgagcccttctgcaagctgaccggctacagccacgagatctacgtggaccccgagagagagatctacaagagactgggcatgaagagaggcgaggagatcgccagcagcggccagagcccccacatcaagagcaacctgctgagcggcagcctgcagagcctgtggagagccgtgaccggccccctgttcgacttccagggcgaccccgcccagcagggcggcaccctgatcctgggccccggcaacaacatccacttcatccacagagacagaaacagactggaccacaagcccatcaacagcgtgctgcagctggtgggcgtgcagcacgtgaacttcaccaacagacccagcgtgatccacgtgtag

SEQ ID NO: 19691 - DNA, 492 bp, Artificial Sequence
  Description of Artificial Sequence: Synthetic coding sequence
atggagcactacagaaaggccggcagcgtggagctgcccgcccccagccccatgccccagctgccccccgacaccctggagatgagagtgagagacggcagcaagatcagaaacctgctgggcctggccctgggcagactggagggcggcagcgccagacacgtggtgttcagcggcagcggcagagccgccggcaaggccgtgagctgcgccgagatcgtgaagagaagagtgcccggcctgcaccagctgaccaagctgagattcctgcagaccgaggacagctgggtgcccgccagccccgacaccggcctggaccccctgaccgtgagaagacacgtgcccgccgtgtgggtgctgctgagcagagaccccctggaccccaacgagtgcggctaccagccccccggcgccccccccggcctgggcagcatgcccagcagcagctgcggccccagaagcagaagaagagccagagacaccagaagctag

SEQ ID NO: 19692 - DNA, 492 bp, Artificial Sequence; identical to SEQ ID NO: 19691
  Description of Artificial Sequence: Synthetic coding sequence

SEQ ID NO: 19693 - DNA, 495 bp, Artificial Sequence
  Description of Artificial Sequence: Synthetic coding sequence
atggagaccgccgtgagaggcatgcccctggagtgcccccccagacccgagagactgaacgcctacgagagagaggtgatggtgaacatgctgaacagcctgagcagaaaccagcagctgcccagaatcacccccagatgcggctgcgtggaccccctgcccggcagactgcccttccacggctacgagagcgcctgcagcggcagacactactgcctgagaggcatggactactacgccagcggcgccccctgcaccgacagaagactgagaccctggtgcagagagcagcccaccgtgagatgcgtgcccccctacgagcacagacccggcatgcagtgcgccgtgaccacccccccccccagctactacccctaccccaacctgagatgggacaccagccacttcaagaagagcggcggcccccagagaaacaactacgtgatccaccccgagttcgtgagcgagacctaccccgactacagatgctggtag

SEQ ID NO: 19694 - DNA, 336 bp, Artificial Sequence
  Description of Artificial Sequence: Synthetic coding sequence
atggagaccgccgtgagaggcatgcccctggagtgcccccccagacccgagagactgaacgcctacgagagagaggtgatggtgaacatgctgaacagcctgagcagaaaccagcagctgcccagaatcacccccagatgcggctgcgtgcccccctacgagcacagacccggcatgcagtgcgccgtgaccacccccccccccagctactacccctaccccaacctgagatgggacaccagccacttcaagaagagcggcggcccccagagaaacaactacgtgatccaccccgagttcgtgagcgagacctaccccgactacagatgctggtag

SEQ ID NO: 19695 - DNA, 495 bp, Artificial Sequence; identical to SEQ ID NO: 19693
  Description of Artificial Sequence: Synthetic coding sequence

SEQ ID NO: 19696 - DNA, 384 bp, Artificial Sequence
  Description of Artificial Sequence: Synthetic coding sequence
atggagaccgccgtgagaggcatgcccctggagtgcccccccagacccgagagactgaacgcctacgagagagaggtgatggtgaacatgctgaacagcctgagcagaaaccagcagctgcccagaatcacccccagatgcggctgcgtggaccccctgcccggcagactgcccttccacggctacgagagcgcctgcagcggcagacactactgcctgagaggcatggactactacgccagcggcgccccctgcaccgacagaagactgagaccctggtgcagagagcagcccaccatgtgcaccagcctgagagcccccgccagaaacgccgtgtgctgctacaacagccccgccgtgatcctgcccatcagcgagccctag

SEQ ID NO: 19697 - DNA, 381 bp, Artificial Sequence
  Description of Artificial Sequence: Synthetic coding sequence
tgagcctgggaggccaacaagttcctgacccccggcctgacccacaccatggagagacacgtggaccccgaggccctgcagaagatggccaagtgcgccgtgcaggactacacctacagaggcagcatcagcggccacccctacctgcccgagaagtactggctgagccaggaggaggccgacaagtgcagccccaactacctgggcagcgactggtacaacacctggagaatggagccctacaacagcagctgctgcaacaagtacaccacctacctgcccagactgcccaaggtgagcgtggcccccagcaccgacgtgtggggcctgggccacgcctaccccaccaccagccagaccaccgtgaccgacatcagctag

SEQ ID NO: 19698 - DNA, 507 bp, Artificial Sequence
  Description of Artificial Sequence: Synthetic coding sequence
atgatggaggagatcgacagattccaggtgcccaccgcccacagcgagatgcagcccctggaccccgccgccgccagcatcagcgacggcgactgcgacgccagagaggagaagcagagagagctggccagaaagggcagcctgaagaacggcagcatgggcagccccgtgaaccagcagcccaagaagaacaacgtgatggccagaaccagactggtggtgcccaacaagggctacagcagcctggaccagagccccgacgagaagcccctggtggccctggacaccgacagcgacgacgacttcgacatgagcagatacagcagcagcggctacagcagcgccgagcagatcaaccaggacctgaacatccagctgctgaaggacggctacagactggacgagatccccgacgacgaggacctggacctgatcccccccaagagcgtgaaccccacctgcatgtgctgccaggccaccagcagcaccgcctgccacatccagtag

SEQ ID NO: 19699 - DNA, 471 bp, Artificial Sequence
  Description of Artificial Sequence: Synthetic coding sequence
atggaggagatcgacagattccaggtgcccaccgcccacagcgagatgcagcccctggaccccgccgccgccagcatcagcgacggcgactgcgacgccagagagggcgagagcgtggccatgaactacaagcccagccccctgcaggtgaagctggagaagcagagagagctggccagaaagggcagcctgaagaacggcagcatgggcagccccgtgaaccagcagcccaagaagaacaacgtgatggccagaaccagactggtggtgcccaacaagggctacagcagcctggaccagagccccgacgagaagcccctggtggccctggacaccgacagatgcgtgtggggcctgggcggcagctgggccgcccagagaaacctgtacagcaccagcggcctgtacagaccccacctgctgtactgccagaactgggacatcctgcagcccgagagcctgcagggctag

SEQ ID NO: 19700 - DNA, 519 bp, Artificial Sequence
  Description of Artificial Sequence: Synthetic coding sequence
atggaggagatcgacagattccaggaccccgccgccgccagcatcagcgacggcgactgcgacgccagagagggcgagagcgtggccatgaactacaagcccagccccctgcaggtgaagctggagaagcagagagagctggccagaaagggcagcctgaagaacggcagcatgggcagccccgtgaaccagcagcccaagaagaacaacgtgatggccagaaccagactggtggtgcccaacaagggctacagcagcctggaccagagccccgacgagaagcccctggtggccctggacaccgacagcgacgacgacttcgacatgagcagatacagcagcagcggctacagcagcgccgagatcaaccaggacctgaacatccagctgctgaaggacggctacagactggacgagatccccgacgacgaggacctggacctgatcccccccaagagcgtgaaccccacctgcatgtgctgccaggccaccagcagcaccgcctgccacatccagtag

SEQ ID NO: 19701 - DNA, 471 bp, Artificial Sequence
  Description of Artificial Sequence: Synthetic coding sequence
atggaggagatcgacagattccaggaccccgccgccgccagcatcagcgacggcgactgcgacgccagagaggagaagcagagagagctggccagaaagggcagcctgaagaacggcagcatgggcagccccgtgaaccagcagcccaagaagaacaacgtgatggccagaaccagactggtggtgcccaacaagggctacagcagcctggaccagagccccgacgagaagcccctggtggccctggacaccgacagcgacgacgacttcgacatgagcagatacagcagcagcggctacagcagcgccgagcagatcaaccaggacctgaacatccagctgctgaaggacggctacagactggacgagatccccgacgacgaggacctggacctgatcccccccaagagcgtgaaccccacctgcatgtgctgccaggccaccagcagcaccgcctgccacatccagtag

SEQ ID NO: 19702 - DNA, 495 bp, Artificial Sequence
  Description of Artificial Sequence: Synthetic coding sequence
atggaggagatcgacagattccaggtgcccaccgcccacagcgagatgcagcccctggaccccgccgccgccagcatcagcgacggcgactgcgacgccagagaggagaagcagagagagctggccagaaagggcagcctgaagaacggcagcatgggcagccccgtgaaccagcagcccaagaagaacaacgtgatggccagaaccagactggtggtgcccaacaagggctacagcagcctggaccagagccccgacgagaagcccctggtggccctggacaccgacagcgacgacgacttcgacatgagcagatacagcagcagcggctacagcagcgccgagcagatcaaccaggacctgaacatccagctgctgaaggacggctacagactggacgagatccccgacgacgaggacctggacctgatcccccccaaccaggtgagcccctgcagcctgatctacttccaggagggcgtgtggaagacctag

SEQ ID NO: 19703 - DNA, 501 bp, Artificial Sequence
  Description of Artificial Sequence: Synthetic coding sequence
atggaggagatcgacagattccaggtgcccaccgcccacagcgagatgcagcccctggaccccgccgccgccagcatcagcgacggcgactgcgacgccagagaggagaagcagagagagctggccagaaagggcagcctgaagaacggcagcatgggcagccccgtgaaccagcagcccaagaagaacaacgtgatggccagaaccagactggtggtgcccaacaagggctacagcagcctggaccagagccccgacgagaagcccctggtggccctggacaccgacagcgacgacgacttcgacatgagcagatacagcagcagcggctacagcagcgccgagatcaaccaggacctgaacatccagctgctgaaggacggctacagactggacgagatccccgacgacgaggacctggacctgatcccccccaagagcgtgaaccccacctgcatgtgctgccaggccaccagcagcaccgcctgccacatccagtag

SEQ ID NO: 19704 - DNA, 552 bp, Artificial Sequence
  Description of Artificial Sequence: Synthetic coding sequence
atggaggagatcgacagattccaggtgcccaccgcccacagcgagatgcagcccctggaccccgccgccgccagcatcagcgacggcgactgcgacgccagagagggcgagagcgtggccatgaactacaagcccagccccctgcaggtgaagctggagaagcagagagagctggccagaaagggcagcctgaagaacggcagcatgggcagccccgtgaaccagcagcccaagaagaacaacgtgatggccagaaccagactggtggtgcccaacaagggctacagcagcctggaccagagccccgacgagaagcccctggtggccctggacaccgacagcgacgacgacttcgacatgagcagatacagcagcagcggctacagcagcgccgagatcaaccaggacctgaacatccagctgctgaaggacggctacagactggacgagatccccgacgacgaggacctggacctgatcccccccaagagcgtgaaccccacctgcatgtgctgccaggccaccagcagcaccgcctgccacatccagtag

SEQ ID NO: 19705 - DNA, 510 bp, Artificial Sequence
  Description of Artificial Sequence: Synthetic coding sequence
atggaggagatcgacagattccaggtgcccaccgcccacagcgagatgcagcccctggaccccgccgccgccagcatcagcgacggcgactgcgacgccagagagggcgagagcgtggccatgaactacaagcccagccccctgcaggtgaagctggagaagcagagagagctggccagaaagggcagcctgaagaacggcagcatgggcagccccgtgaaccagcagcccaagaagaacaacgtgatggccagaaccagactggtggtgcccaacaagggctacagcagcctggaccagagccccgacgagaagcccctggtggccctggacaccgacagcgacgacgacttcgacatgagcagatacagcagcagcggctacagcagcgccgagcagatcaaccaggacctgaacatccagctgctgaaggacggctacagactggacgagatccccgacgacgaggacctggacctgatcccccccaagagcgtgaaccccacctag

SEQ ID NO: 19706 - DNA, 558 bp, Artificial Sequence
  Description of Artificial Sequence: Synthetic coding sequence
atgatggaggagatcgacagattccaggtgcccaccgcccacagcgagatgcagcccctggaccccgccgccgccagcatcagcgacggcgactgcgacgccagagagggcgagagcgtggccatgaactacaagcccagccccctgcaggtgaagctggagaagcagagagagctggccagaaagggcagcctgaagaacggcagcatgggcagccccgtgaaccagcagcccaagaagaacaacgtgatggccagaaccagactggtggtgcccaacaagggctacagcagcctggaccagagccccgacgagaagcccctggtggccctggacaccgacagcgacgacgacttcgacatgagcagatacagcagcagcggctacagcagcgccgagcagatcaaccaggacctgaacatccagctgctgaaggacggctacagactggacgagatccccgacgacgaggacctggacctgatcccccccaagagcgtgaaccccacctgcatgtgctgccaggccaccagcagcaccgcctgccacatccagtag

SEQ ID NO: 19707 - DNA, 153 bp, Artificial Sequence
  Description of Artificial Sequence: Synthetic coding sequence
atgaagctgctgagcgagcagcaggagctgagaaccgtgagcatgaccgcctggaagcccagaatgaacagaaagagcagaagcagaatgagccccatcgaccccagacacagcggcacccccaacagcaacagaatcggcctgagcacctag

SEQ ID NO: 19708 - DNA, 153 bp, Artificial Sequence; identical to SEQ ID NO: 19707
  Description of Artificial Sequence: Synthetic coding sequence

SEQ ID NO: 19709 - DNA, 360 bp, Artificial Sequence
  Description of Artificial Sequence: Synthetic coding sequence
atgaacagaaacatcctggaggagatgctgcagtacctgctgatcgactggatcgtgggcgaccagttcgagatccagctgaaccagcagctgtggagcctgatccccaacaacgacgtgagaagactggtgagccacgtgatcagaaccctgaagaccgactgcaccgagacccacctgcagctggcctgcgccaagctgatcagcagaaccggcctgctgatgaagctgctgagcgagcagcaggagctgagaaccgtgagcatgaccgcctggaagcccagaatgaacagaaagagcagaagcagaatgagcatccccagcggccccgacatggaggagaccaccgacgtgagctag

SEQ ID NO: 19710 - DNA, 297 bp, Artificial Sequence
  Description of Artificial Sequence: Synthetic coding sequence
atgctgcagtacctgctgatcgactggatcgtgggcgaccagttcgagatccagctgaaccagcagctgtggagcctgatccccaacaacgacgtgagaagactggtgagccacgtgatcagaaccctgaagaccgactgcaccgagacccacctgcagctggcctgcgccaagctgatcagcagaaccggcctgctgatgaagctgctgagcgagcagcaggagctgagaaccgtgagcatgaccgcctggaagcccagaatgaacagaaagagcagaagcagaatgagaagctag

SEQ ID NO: 19711 - DNA, 2163 bp, Artificial Sequence
  Description of Artificial Sequence: Synthetic coding sequence
atggacatccagctggaccccgccagagacgacctgcccctgatggccaacaccagccacatcctggtgaagcactacgtgctggacctggacgtggacttcgagagccaggtgatcgagggcaccatcgtgctgttcctggaggacggcaacagattcaagaagcagaacagcagcatcgaggaggcctgccagagcgagagcaacaaggcctgcaagttcggcatgcccgagccctgccacatccccgtgaccaacgccagaaccttcagcagcgagatggagtacaacgacttcgccatctgcagcaagggcgagaaggacaccagcgacaaggacggcaaccacgacaaccaggagcacgccagcggcatcagcagcagcaagtactgctgcgacaccggcaaccacggcagcgaggacttcctgctggtgctggactgctgcgacctgagcgtgctgaaggtggaggaggtggacgtggccgccgtgcccggcctggagaagttcaccagaagccccgagctgaccgtggtgagcgaggagttcagaaaccagatcgtgagagagctggtgaccctgcccgccaacagatggagagagcagctggactactacgccagatgcagccaggcccccggctgcggcgagctgctgttcgacaccgacacctggagcctgcagatcagaaagaccggcgcccagaccgccaccgacttcccccacgccatcagaatctggtacaagaccaagcccgagggcagaagcgtgacctggaccagcgaccagagcggcagaccctgcgtgtacaccgtgggcagccccatcaacaacagagccctgttcccctgccaggagccccccgtggccatgagcacctggcaggccaccgtgagagccgccgccagcttcgtggtgctgatgagcggcgagaacagcgccaagcccacccagctgtgggaggagtgcagcagctggtactactacgtgaccatgcccatgcccgccagcaccttcaccatcgccgtgggctgctggaccgagatgaagatggagacctggagcagcaacgacctggccaccgagagacccttcagccccagcgaggccaacttcagacacgtgggcgtgtgcagccacatggagtacccctgcagattccagaacgccagcgccaccacccaggagatcatcccccacagagtgttcgcccccgtgtgcctgaccggcgcctgccaggagaccctgctgagactgatccccccctgcctgagcgccgcccacagcgtgctgggcgcccaccccttcagcagactggacgtgctgatcgtgcccgccaacttccccagcctgggcatggccagacccagcaaggacaagaccggccacaccagcgacagcggcgccagcgtgatcaagcacggcctgaaccccgagaagatcttcatgcaggtgcactacctgaagggctacttcctgctgagattcctggccaagagactgggcgacgagacctacttcagcttcctgagaaagttcgtgcacaccttccacggccagctgatcctgagccaggacttcctgcagatgctgctggagaacatccccgaggagaagagactggagctgagcgtggagaacatctaccaggactggctggagagcagcggcatccccaagcccctgcagagagagagaagagccggcgccgagtgcggcctggccagacaggtgagagccgaggtgaccaagtggatcggcgtgaacagaagacccagaaagagaaagagaagagagaaggaggaggtgttcgagaagctgctgcccgaccagctggtgctgctgctggagcacctgctggagcagaagaccctgagccccagaaccctgcagagcctgcagagaacctaccacctgcaggaccaggacgccgaggtgagacacagatggtgcgagctgatcgtgaagcacaagttcaccaaggcctacaagagcgtggagagattcctgcaggaggaccaggccatgggcgtgtacctgtacggcgagctgatggtgagcgaggacgccagacagcagcagctggccagaagatgcttcgagagaaccaaggagcagatggacagaagcagcgcccaggtggtggccgagatgctgttctag

SEQ ID NO: 19712 - DNA, 552 bp, Artificial Sequence
  Description of Artificial Sequence: Synthetic coding sequence
gccgaccccggcagagcccagggcgccggcagcggcgccgccgccgccagcagccccgccgccggcgagcccctgcagagagagagaagagccggcgccgagtgcggcctggccagacaggtgagagccgaggtgaccaagtggatcggcgtgaacagaagacccagaaagagaaagagaagagagaaggaggaggtgttcgagaagctgctgcccgaccagctggtgctgctgctggagcacctgctggagcagaagaccctgagccccagaaccctgcagagcctgcagagaacctaccacctgcaggaccaggacgccgaggtgagacacagatggtgcgagctgatcgtgaagcacaagttcaccaaggcctacaagagcgtggagagattcctgcaggaggaccaggccatgggcgtgtacctgtacggcgagctgatggtgagcgaggacgccagacagcagcagctggccagaagatgcttcgagagaaccaaggagcagatggacagaagcagcgcccaggtggtggccgagatgctgttctag

SEQ ID NO: 19713 - DNA, 2460 bp, Artificial Sequence
  Description of Artificial Sequence: Synthetic coding sequence
atggacatccagctggaccccgccagagacgacctgcccctgatggccaacaccagccacatcctggtgaagcactacgtgctggacctggacgtggacttcgagagccaggtgatcgagggcaccatcgtgctgttcctggaggacggcaacagattcaagaagcagaacagcagcatcgaggaggcctgccagagcgagagcaacaaggcctgcaagttcggcatgcccgagccctgccacatccccgtgaccaacgccagaaccttcagcagcgagatggagtacaacgacttcgccatctgcagcaagggcgagaaggacaccagcgacaaggacggcaaccacgacaaccaggagcacgccagcggcatcagcagcagcaagtactgctgcgacaccggcaaccacggcagcgaggacttcctgctggtgctggactgctgcgacctgagcgtgctgaaggtggaggaggtggacgtggccgccgtgcccggcctggagaagttcaccagaagccccgagctgaccgtggtgagcgaggagttcagaaaccagatcgtgagagagctggtgaccctgcccgccaacagatggagagagcagctggactactacgccagatgcagccaggcccccggctgcggcgagctgctgttcgacaccgacacctggagcctgcagatcagaaagaccggcgcccagaccgccaccgacttcccccacgccatcagaatctggtacaagaccaagcccgagggcagaagcgtgacctggaccagcgaccagagcggcagaccctgcgtgtacaccgtgggcagccccatcaacaacagagccctgttcccctgccaggagccccccgtggccatgagcacctggcaggccaccgtgagagccgccgccagcttcgtggtgctgatgagcggcgagaacagcgccaagcccacccagctgtgggaggagtgcagcagctggtactactacgtgaccatgcccatgcccgccagcaccttcaccatcgccgtgggctgctggaccgagatgaagatggagacctggagcagcaacgacctggccaccgagagacccttcagccccagcgaggccaacttcagacacgtgggcgtgtgcagccacatggagtacccctgcagattccagaacgccagcgccaccacccaggagatcatcccccacagagtgttcgcccccgtgtgcctgaccggcgcctgccaggagaccctgctgagactgatccccccctgcctgagcgccgcccacagcgtgctgggcgcccaccccttcagcagactggacgtgctgatcgtgcccgccaacttccccagcctgggcatggccagcccccacatcatgttcctgagccagagcatcctgaccggcggcaaccacctgtgcggcaccagactgtgccacgagatcgcccacgcctggttcggcctggccatcggcgccagagactggaccgaggagtggctgagcgagggcttcgccacccacctggaggacgtgttctgggccaccgcccagcagctggccccctacgaggccagagagcagcaggagctgagagcctgcctgagatggagaagactgcaggacgagatgcagtgcagccccgaggagatgcaggtgctgagacccagcaaggacaagaccggccacaccagcgacagcggcgccagcgtgatcaagcacggcctgaaccccgagaagatcttcatgcaggtgcactacctgaagggctacttcctgctgagattcctggccaagagactgggcgacgagacctacttcagcttcctgagaaagttcgtgcacaccttccacggccagctgatcctgagccaggacttcctgcagatgctgctggagaacatccccgaggagaagagactggagctgagcgtggagaacatctaccaggactggctggagagcagcggcatccccaagcccctgcagagagagagaagagccggcgccgagtgcggcctggccagacaggtgagagccgaggtgaccaagtggatcggcgtgaacagaagacccagaaagagaaagagaagagagaaggaggaggtgttcgagaagctgctgcccgaccagctggtgctgctgctggagcacctgctggagcagaagaccctgagccccagaaccctgcagagcctgcagagaacctaccacctgcaggaccaggacgccgaggtgagacacagatggtgcgagctgatcgtgaagcacaagttcaccaaggcctacaagagcgtggagagattcctgcaggaggaccaggccatgggcgtgtacctgtacggcgagctgatggtgagcgaggacgccagacagcagcagctggccagaagatgcttcgagagaaccaaggagcagatggacagaagcagcgcccaggtggtggccgagatgctgttctag

SEQ ID NO: 19714 - DNA, 495 bp, Artificial Sequence
  Description of Artificial Sequence: Synthetic coding sequence
atgcaggtgcactacctgaagggctacttcctgctgagattcctggccaagagactgggcgacgagacctacttcagcttcctgagaaagttcgtgcacaccttccacggccagctgatcctgagccaggacttcctgcagatgctgctggagaacatccccgaggagaagagactggagctgagcgtggagaacatctaccaggactggctggagagcagcggcatccccaagcccctgcagagagagagaagagccggcgccgagtgcggcctggccagacaggtgagagccgaggtgaccaagtggatcggcgtgaacagaagacccagaaagagaaagagaagagagaaggaggaggtgttcgagaagaccctgaactggagccacctgagaaacagagagagaagaagaaagaagtggatcaccttcaagaccctgggcggcatcctgttcaccgtgaagcagatgagaaacctgttcgcccaggtgtag

SEQ ID NO: 19715 - DNA, 561 bp, Artificial Sequence
  Description of Artificial Sequence: Synthetic coding sequence
atggagtacccctgcagattccagaacgccagcgccaccacccaggagatcatcccccacagagtgttcgcccccgtgtgcctgaccggcgcctgccaggagaccctgctgagactgatccccccctgcctgagcgccgcccacagcgtgctgggcgcccaccccttcagcagactggacgtgctgatcgtgcccgccaacttccccagcctgggcatggccagcccccacatcatgttcctgagccagagcatcctgaccggcggcaaccacctgtgcggcaccagactgtgccacgagatcgcccacgcctggttcggcctggccatcggcgccagagactggaccgaggagtggctgagcgagggcttcgccacccacctggaggacgtgttctgggccaccgcccagcagctggccccctacgaggccagagagcagcaggagctgagagcctgcctgagatggagaagactgcaggacgagatgcagtgcagccccgaggagatgcaggtgctgagattcccccacgtgggcggctgcagcggcagcttcagctag

SEQ ID NO: 19716 - DNA, 1527 bp, Artificial Sequence
  Description of Artificial Sequence: Synthetic coding sequence
gtggtgagcgaggagttcagaaaccagatcgtgagagagctggtgaccctgcccgccaacagatggagagagcagctggactactacgccagatgcagccaggcccccggctgcggcgagctgctgttcgacaccgacacctggagcctgcagatcagaaagaccggcgcccagaccgccaccgacttcccccacgccatcagaatctggtacaagaccaagcccgagggcagaagcgtgacctggaccagcgaccagagcggcagaccctgcgtgtacaccgtgggcagccccatcaacaacagagccctgttcccctgccaggagccccccgtggccatgagcacctggcaggccaccgtgagagccgccgccagcttcgtggtgctgatgagcggcgagaacagcgccaagcccacccagctgtgggaggagtgcagcagctggtactactacgtgaccatgcccatgcccgccagcaccttcaccatcgccgtgggctgctggaccgagatgaagatggagacctggagcagcaacgacctggccaccgagagacccttcagccccagcgaggccaacttcagacacgtgggcgtgtgcagccacatggagtacccctgcagattccagaacgccagcgccaccacccaggagatcatcccccacagagtgttcgcccccgtgtgcctgaccggcgcctgccaggagaccctgctgagactgatccccccctgcctgagcgccgcccacagcgtgctgggcgcccaccccttcagcagactggacgtgctgatcgtgcccgccaacttccccagcctgggcatggccagacccagcaaggacaagaccggccacaccagcgacagcggcgccagcgtgatcaagcacggcctgaaccccgagaagatcttcatgcaggtgcactacctgaagggctacttcctgctgagattcctggccaagagactgggcgacgagacctacttcagcttcctgagaaagttcgtgcacaccttccacggccagctgatcctgagccaggacttcctgcagatgctgctggagaacatccccgaggagaagagactggagctgagcgtggagaacatctaccaggactggctggagagcagcggcatccccaagcccctgcagagagagagaagagccggcgccgagtgcggcctggccagacaggtgagagccgaggtgaccaagtggatcggcgtgaacagaagacccagaaagagaaagagaagagagaaggaggaggtgttcgagaagctgctgcccgaccagctggtgctgctgctggagcacctgctggagcagaagaccctgagccccagaaccctgcagagcctgcagagaacctaccacctgcaggaccaggacgccgaggtgagacacagatggtgcgagctgatcgtgaagcacaagttcaccaaggcctacaagagcgtggagagattcctgcaggaggaccaggtgggcgtgatcttccagcagatgggcatcctgtag

SEQ ID NO: 19717 - DNA, 546 bp, Artificial Sequence
  Description of Artificial Sequence: Synthetic coding sequence
atgagaatgagaagacccctggccggcggcggcaagagctggggcatcgcccacttctacaagcccctgcagagagagagaagagccggcgccgagtgcggcctggccagacaggtgagagccgaggtgaccaagtggatcggcgtgaacagaagacccagaaagagaaagagaagagagaaggaggaggtgttcgagaagctgctgcccgaccagctggtgctgctgctggagcacctgctggagcagaagaccctgagccccagaaccctgcagagcctgcagagaacctaccacctgcaggaccaggacgccgaggtgagacacagatggtgcgagctgatcgtgaagcacaagttcaccaaggcctacaagagcgtggagagattcctgcaggaggaccaggccatgggcgtgtacctgtacggcgagctgatggtgagcgaggacgccagacagcagcagctggccagaagatgcttcgagagaaccaaggagcagatggacagaagcagcgcccaggtggtggccgagatgctgttctag

SEQ ID NO: 19718 - DNA, 423 bp, Artificial Sequence
  Description of Artificial Sequence: Synthetic coding sequence
agcagcaagtactgctgcgacaccggcaaccacggcagcgaggacttcctgctggtgctggactgctgcgacctgagcgtgctgaaggtggaggaggtggacgtggccgccgtgcccggcctggagaagttcaccagaagccccgagctgaccgtggtgagcgaggagttcagaaaccagatcgtgagagagctggtgaccctgcccgccaacagatggagagagcagctggactactacgccagatgcagccaggcccccggctgcggcgagctgctgttcgacaccgacacctggagcctgcagatcagaaagaccggcgcccagaccgccaccgacttcccccacgccatcagaatctggtacaagaccaagcccgagggcagaagcgtgacctggaccagcgaccagagcggcagatag

SEQ ID NO: 19719 - DNA, 1806 bp, Artificial Sequence
  Description of Artificial Sequence: Synthetic coding sequence
ctgttcgacaccgacacctggagcctgcagatcagaaagaccggcgcccagaccgccaccgacttcccccacgccatcagaatctggtacaagaccaagcccgagggcagaagcgtgacctggaccagcgaccagagcggcagaccctgcgtgtacaccgtgggcagccccatcaacaacagagccctgttcccctgccaggagccccccgtggccatgagcacctggcaggccaccgtgagagccgccgccagcttcgtggtgctgatgagcggcgagaacagcgccaagcccacccagctgtgggaggagtgcagcagctggtactactacgtgaccatgcccatgcccgccagcaccttcaccatcgccgtgggctgctggaccgagatgaagatggagacctggagcagcaacgacctggccaccgagagacccttcagccccagcgaggccaacttcagacacgtgggcgtgtgcagccacatggagtacccctgcagattccagaacgccagcgccaccacccaggagatcatcccccacagagtgttcgcccccgtgtgcctgaccggcgcctgccaggagaccctgctgagactgatccccccctgcctgagcgccgcccacagcgtgctgggcgcccaccccttcagcagactggacgtgctgatcgtgcccgccaacttccccagcctgggcatggccagcccccacatcatgttcctgagccagagcatcctgaccggcggcaaccacctgtgcggcaccagactgtgccacgagatcgcccacgcctggttcggcctggccatcggcgccagagactggaccgaggagtggctgagcgagggcttcgccacccacctggaggacgtgttctgggccaccgcccagcagctggccccctacgaggccagagagcagcaggagctgagagcctgcctgagatggagaagactgcaggacgagatgcagtgcagccccgaggagatgcaggtgctgagacccagcaaggacaagaccggccacaccagcgacagcggcgccagcgtgatcaagcacggcctgaaccccgagaagatcttcatgcaggtgcactacctgaagggctacttcctgctgagattcctggccaagagactgggcgacgagacctacttcagcttcctgagaaagttcgtgcacaccttccacggccagctgatcctgagccaggacttcctgcagatgctgctggagaacatccccgaggagaagagactggagctgagcgtggagaacatctaccaggactggctggagagcagcggcatccccaagcccctgcagagagagagaagagccggcgccgagtgcggcctggccagacaggtgagagccgaggtgaccaagtggatcggcgtgaacagaagacccagaaagagaaagagaagagagaaggaggaggtgttcgagaagctgctgcccgaccagctggtgctgctgctggagcacctgctggagcagaagaccctgagccccagaaccctgcagagcctgcagagaacctaccacctgcaggaccaggacgccgaggtgagacacagatggtgcgagctgatcgtgaagcacaagttcaccaaggcctacaagagcgtggagagattcctgcaggaggaccaggccatgggcgtgtacctgtacggcgagctgatggtgagcgaggacgccagacagcagcagctggccagaagatgcttcgagagaaccaaggagcagatggacagaagcagcgcccaggtggtggccgagatgctgttctag

SEQ ID NO: 19720 - DNA, 483 bp, Artificial Sequence
  Description of Artificial Sequence: Synthetic coding sequence
atgagaatgagaagacccctggccggcggcggcaagagctggggcatcgcccacttctacaaggtgaccaagtggatcggcgtgaacagaagacccagaaagagaaagagaagagagaaggaggaggtgttcgagaagctgctgcccgaccagctggtgctgctgctggagcacctgctggagcagaagaccctgagccccagaaccctgcagagcctgcagagaacctaccacctgcaggaccaggacgccgaggtgagacacagatggtgcgagctgatcgtgaagcacaagttcaccaaggcctacaagagcgtggagagattcctgcaggaggaccaggccatgggcgtgtacctgtacggcgagctgatggtgagcgaggacgccagacagcagcagctggccagaagatgcttcgagagaaccaaggagcagatggacagaagcagcgcccaggtggtggccgagatgctgttctag

SEQ ID NO: 19721 - DNA, 555 bp, Artificial Sequence
  Description of Artificial Sequence: Synthetic coding sequence
tgagccgaccccggcagagcccagggcgccggcagcggcgccgccgccgccagcagccccgccgccggcgagcccctgcagagagagagaagagccggcgccgagtgcggcctggccagacaggtgagagccgaggtgaccaagtggatcggcgtgaacagaagacccagaaagagaaagagaagagagaaggaggaggtgttcgagaagctgctgcccgaccagctggtgctgctgctggagcacctgctggagcagaagaccctgagccccagaaccctgcagagcctgcagagaacctaccacctgcaggaccaggacgccgaggtgagacacagatggtgcgagctgatcgtgaagcacaagttcaccaaggcctacaagagcgtggagagattcctgcaggaggaccaggccatgggcgtgtacctgtacggcgagctgatggtgagcgaggacgccagacagcagcagctggccagaagatgcttcgagagaaccaaggagcagatggacagaagcagcgcccaggtggtggccgagatgctgttctag

SEQ ID NO: 19722 - DNA, 438 bp, Artificial Sequence
  Description of Artificial Sequence: Synthetic coding sequence
tgagacgagacctacttcagcttcctgagaaagttcgtgcacaccttccacggccagctgatcctgagccaggacttcctgcagatgctgctggagaacatccccgaggagaagagactggagctgagcgtggagaacatctaccaggactggctggagagcagcggcatccccaagcccctgcagagagagagaagagccggcgccgagtgcggcctggccagacaggtgagagccgaggtgaccaagtggatcggcgtgaacagaagacccagaaagagaaagagaagagagaaggaggaggtgttcgagaagaccctgaactggagccacctgagaaacagagagagaagaagaaagaagtggatcaccttcaagaccctgggcggcatcctgttcaccgtgaagcagatgagaaacctgttcgcccaggtgtag

SEQ ID NO: 19723 - DNA, 546 bp, Artificial Sequence
  Description of Artificial Sequence: Synthetic coding sequence
atgcagaacaacgagatcatcaagcccgccaagtacttcagcgagctggagaagagcatcctgctggccctggtggagaagtacaagtacgtgctggagtgcaagaagagcgacgccagaaccatcgccctgaagcagagaacctggcaggccctggcccacgagtacaacagccagcccagcgtgagcctgagagacttcaagcagctgaagaagtgctgggagaacatcaaggccagaaccaagaagatcatggcccacgagagaagagagaaggtgaagagaagcgtgagccccctgctgagcacccacgtgctgggcaaggagaagatcgccagcatgctgcccgagcagctgtacttcctgcagagcccccccgaggaggagcccgagtaccaccccgacgccagcgcccaggagagcttcgccgtgagcaacagagagctgtgcgacgacgagaaggagttcatccacttccccgtgtgcgagggcaccagccagcccgagcccagctgcagcgccgtgagaatcaccgccaacaagtag

SEQ ID NO: 19724 - DNA, 828 bp, Artificial Sequence
  Description of Artificial Sequence: Synthetic coding sequence
atgcagaacaacgagatcatcaagcccgccaagtacttcagcgagctggagaagagcatcctgctggccctggtggagaagtacaagtacgtgctggagtgcaagaagagcgacgccagaaccatcgccctgaagcagagaacctggcaggccctggcccacgagtacaacagccagcccagcgtgagcctgagagacttcaagcagctgaagaagtgctgggagaacatcaaggccagaaccaagaagatcatggcccacgagagaagagagaaggtgaagagaagcgtgagccccctgctgagcacccacgtgctgggcaaggagaagatcgccagcatgctgcccgagcagctgtacttcctgcagagcccccccgaggaggagcccgagtaccaccccgacgccagcgcccaggagagcttcgccgtgagcaacagagagctgtgcgacgacgagaaggagttcatccacttccccgtgtgcgagggcaccagccagcccgagcccagctgcagcgccgtgagaatcaccgccaacaagaactacagaagcaagaccagccaggagggcgccctgaagaagatgcacgaggaggagcaccaccagcagatgagcatcctgcagctgcagctgatccagatgaacgaggtgcacgtggccaagatccagcagatcgagagagagtgcgagatggccgaggaggagcacagaatcaagatggaggtgctgaacaagaagaagatgtactgggagagaaagctgcagaccttcaccaaggagtggcccgtgagcagcttcaacagacccttccccaacagcccctag

SEQ ID NO: 19725 - DNA, 405 bp, Artificial Sequence
  Description of Artificial Sequence: Synthetic coding sequence
atgcagaacaacgagatcatcaagcccgccaagtacttcagcgagctggagaagagcatcctgctggccctggtggagaagtacaagtacgtgctggagtgcaagaagagcgacgccagaaccatcgccctgaagcagagaacctggcaggccctggcccacgagtacaacagccagcccagcgtgagcctgagagacttcaagcagctgaagaagtgctgggagaacatcaaggccagaaccaagaagatcatggcccacgagagaagagagaaggtgaagagaagcgtgagccccctgctgagcacccacgtgctgggcaaggagaagatcgccagcatgctgcccgagcagctgtacttcctgcagagcccccccgaggaggagcccgagtaccacccctag

SEQ ID NO: 19726 - DNA, 492 bp, Artificial Sequence
  Description of Artificial Sequence: Synthetic coding sequence
atgacccaccccctgccccacgacagccacaccagcggcgccccccccctggtgaacaagagcagagacctggccaacggcccccccttcttcagccccctgcagagcctgtgggaggagttcctgcacctgctgttcatgggcaccctgctgttctacagaatcgccaccaaggccctgagaggcaaggccaccctgctgaagagccacagcaagcagcccgcccagcccggctgggagcccggcatcagagcccccagccccgtgcccgccagcagcctgcaggaccacagcagactgaccagcctgagcagaaccggcaaggagcagagaagaaccctgagcctgatcagaaagaccagcggcacccccaccgagagcaccgtggccaccgccgccgccagcaccaccgaggtgcccagcagactgccctgggccgccagagccggcttcaagagaaccaccggcgtgtgcatcgccctgcccacctag

SEQ ID NO: 19727 - DNA, 435 bp, Artificial Sequence
  Description of Artificial Sequence: Synthetic coding sequence
atgcccagcagcgcccacgcccacgccatcctgaaggacgcccaggacagccccggcgtggtgctgggccagggcgtgatcagagccggcaagggctgggagaacggccccgagagccacagagtgagatacagaggcaagaagaacaccgactggcacaccagaagccccgccctgaccttcaccgtgctgtggcccagctgccccctggtgcccatcgtgctgggcctgaaccccggcttctgcccctgcgccagaagcagcggcgagtgcaaccacagcggccacatcatcgagggcaccagatgggaccagggccagctgtgcctgctgttcaccctgagcagagccgacatcagagcctgctggagagtgggcgagcagcagtacgtgagcctgttcacccacgtgcagatgcagcaccccagcctgtag

SEQ ID NO: 19728 - DNA, 531 bp, Artificial Sequence
  Description of Artificial Sequence: Synthetic coding sequence
atggagttccactacgtggcccaggccgacctggagctgctgaccagcagcaacccccccgccagcgccagccagagcaccggcatcaccggcggcagccacagagccagacccggccccgtgcacttcatcgacaaggtgaccgacaagcccagccacagccaccccttcgccctgaaggagaactggaacctgaaccccgagcccagcagcccccccagccccctgttcctggaggcccccagcagacaggccagccagcaccacggcgccagccccggcgccggcaccagcgccggctgccccttcgagaagtgctgcagcaccgagccctgcctgagcggcctgggcgacgtgggcagaggcgaggccgccagcctgagagccagacccggcagcggcgccagcagaggccagggccccggcagcagagtgagctgcagaagagacctgggcaagcccctgcacgcccccgccggcttcagcgccggcgaggtgcacaccacccccctgggcaacctgggcgcctag

SEQ ID NO: 19729 - DNA, 357 bp, Artificial Sequence
  Description of Artificial Sequence: Synthetic coding sequence
atgcccagcaagaccgccgagaacgccaccttctactacatcagcagcctgctgagcagcagaagccccgtgttcaaccagagccccaaggtgaaggccggccacatgctggaggccagccagatcagcgccaagaacagcgccgacttcttccaccccacccccagctgcagcgagctggacttcaccctgcaccccgagctggccgacagcctgggcgccaagcacaactacaaggccacctgcctgatgagattcctgcccctgcagagacacaccagaagctggttcagcctgatcctgtggtgcatccagagagacgactacctgatcggcctgttcagctgcttcagctag

SEQ ID NO: 19730 - DNA, 462 bp, Artificial Sequence
  Description of Artificial Sequence: Synthetic coding sequence
atgcagagaagaagaagaccccccccccccaccagcagactgcccgagggctgcggcggcggcggcggcggcagcgaggaggtggaggtgcagttcagcgccggcagatggggcagcgccgccgccgtgagcgccgccgccgccgccgccaccagaagcaccgaggaggaggaggagagactggagagagagcacttctggaagatcatcaacgccttcagatactacggcaccagcatgcacgagagagtgaacagaaccgagagacagttcagaagcctgcccgccaaccagcagaagctgctgccccagttcctgctgcacctggacaagatcagaaagtgcatcgaccacaaccaggagatcctgctgaccatcgtgaacgactgcatccacatgttcgagaacaaggagtacggcgaggacgtgtgcgagagcctgttctacttctgcctgttctag

SEQ ID NO: 19731 - DNA, 1230 bp, Artificial Sequence
  Description of Artificial Sequence: Synthetic coding sequence
atgcagagaagaagaagaccccccccccccaccagcagactgcccgagggctgcggcggcggcggcggcggcagcgaggaggtggaggtgcagttcagcgccggcagatggggcagcgccgccgccgtgagcgccgccgccgccgccgccaccagaagcaccgaggaggaggaggagagactggagagagagcacttctggaagatcatcaacgccttcagatactacggcaccagcatgcacgagagagtgaacagaaccgagagacagttcagaagcctgcccgccaaccagcagaagctgctgccccagttcctgctgcacctggacaagatcagaaagtgcatcgaccacaaccaggagatcctgctgaccatcgtgaacgactgcatccacatgttcgagaacaaggagtacggcgaggacggcaacggcaagatcatgcccgccagcaccttcgacatggacaagctgaagagcaccctgaagcagttcgtgagagactggagcgagaccggcaaggccgagagagacgcctgctaccagcccatcatcaaggagatcctgaagaacttccccaaggagagatgggaccccagcaaggtgaacatcctggtgcccggcgccggcctgggcagactggcctgggagatcgccatgctgggctacgcctgccagggcaacgagtggagcttcttcatgctgttcagcagcaacttcgtgctgaacagatgcagcgagatcaacaagtacaagctgtacccctggatccaccagttcagcaacaacagaagaagcgccgaccagatcagacccatcttcttccccgacgtggacccccacagcctgccccccggcagcaacttcagcatgaccgccggcgacttccaggagatctacagcgagtgcaacacctgggactgcatcgccacctgcttcttcatcgacaccgcccacaacgtgatcgactacatcgacaccatctggaagatcctgaagcccggcggcatctggatcaacctgggccccctgctgtaccacttcgagaacctggccaacgagctgagcatcgagctgagctacgaggacatcaagaacgtggtgctgcagtacggcttcaaggtggaggtggagaaggagagcgtgctgagcacctacaccgtgaacgacctgagcatgatgaagtactactacgagtgcgtgctgttcgtggtgagaaagccccagtag

SEQ ID NO: 19732 - DNA, 591 bp, Artificial Sequence
  Description of Artificial Sequence: Synthetic coding sequence
atgcagagaagaagaagaccccccccccccaccagcagactgcccgagggctgcggcggcggcggcggcggcagcgaggaggtggaggtgcagttcagcgccggcagatggggcagcgccgccgccgtgagcgccgccgccgccgccgccaccagaagcaccgaggaggaggaggagagactggagagagagcacttctggaagatcatcaacgccttcagatactacggcaccagcatgcacgagagagtgaacagaaccgagagacagttcagaagcctgcccgccaaccagcagaagctgctgccccagttcctgctgcacctggacaagatcagaaagtgcatcgaccacaaccaggagatcctgctgaccatcgtgaacgactgcatccacatgttcgagaacaaggagtacggcgaggacggcaacggcaagatcatgcccgccagcaccttcgacatggacaagctgaagagcaccctgaagcagttcgtgagagactggagcgagaccggcaaggccgagagagacgcctgctaccagcccatcatcaaggagatcctgaagaacttccccaaggagagatag

SEQ ID NO: 19733 - DNA, 717 bp, Artificial Sequence
  Description of Artificial Sequence: Synthetic coding sequence
gtgctgagactgcagctggagagcgacagacacgacctgctgagaagcaccagcatgcacgagagagtgaacagaaccgagagacagttcagaagcctgcccgccaaccagcagaagctgctgccccagttcctgctgcacctggacaagatcagaaagtgcatcgaccacaaccaggagatcctgctgaccatcgtgaacgactgcatccacatgttcgagaacaaggagtacggcgaggacggcaacggcaagatcatgcccgccagcaccttcgacatggacaagctgaagagcaccctgaagcagttcgtgagagactggagcgagaccggcaaggccgagagagacgcctgctaccagcccatcatcaaggagatcctgaagaacttccccaaggagagatgggaccccagcaaggtgaacatcctggtgcccggcgccggcctgggcagactggcctgggagatcgccatgctgggctacgcctgccagggcaacgagtggagcttcttcatgctgttcagcagcaacttcgtgctgaacagatgcagcgagatcaacaagtacaagctgtacccctggatccaccagttcagcaacaacagaagaagcgccgaccagatcagacccatcttcttccccgacgtggacccccacagcctgccccccggcagcaacttcagcatgaccgccggcgacttccaggagatctag

SEQ ID NO: 19734 - DNA, 1386 bp, Artificial Sequence
  Description of Artificial Sequence: Synthetic coding sequence
atggacctgcccgacgagagccagtgggacgagaccacctgcggcctggccgtgtgccagcacccccagtgctgggccaccatcagaagaatcgagagaggccaccccagaatcctgggcagcagctgcaagacccccctggacgccgaggacaagctgcccgtgctgaccgtggtggacatcctggacagcggcttcgccgcccaccacctgcccgagtgcaccttcaccaaggcccacagcctgctgagccagagcagcaagttctacagcaagttccacggcagaccccccaagggcctgcccgacaagagcctgatcaactgcaccaacagactgcccaagttccccgtgctgaacctgaacgagacccagctgccctgccccgaggacgtgagaaacatggtggtgctgtggatccccgaggagaccgagatccacgtgagccagcacggcaagaagaagagaaagaacagcgccgtgaagagcaagagcttcctgggcctgagcggcaaccagagcgccggcaccagagtgggcacccccggcatgatcgtgcccccccccacccccgtgcagctgagcgagcagttcagcagcgacttcctgcccctgtgggcccagagcgaggccctgccccaggacctgctgaaggagctgctgcccggcggcaagcagaccatgctgtgccccgagatgaagatcaagctggccatgatgaagaagaacctgcccctggagaagaacagacccgacagcgtgatcagcagcaagatgttcctgagcatccacagactgaccctggagagacccgccctgagataccccgagagactgaagaagctgcacaacctgaagaccgagggctacagaaagcagcagcagagacagcagcagcagcagcagcagcagaagaaggtgaagacccccatcaagaagcaggaggccaagaagaaggccaagagcgaccccggcatccagagcaccagccacaagcaccccgtgaccaccgtgcacgacagactgtacggctacagaaccctgcccggccagaacagcgacatgaagcagcagcagcagatggagaagggcaccaccagcaagcaggacagcaccgagagacccaagatgaactactacgaccacgccgacttccaccacagcgtgaagagccccgagctgtacgagaccgagcccaccaacaaggacatcagcgcccccgtggacgccgtgcccgaggcccaggccgccagacagaagaagatcagcttcaacttcagcgagatcatggccagcaccggctggaacagcgagctgaagctgctgagaatcctgcaggacaccgacgacgaggacgaggaggaccagagcagcggcgccgagtag

SEQ ID NO: 19735 - DNA, 1386 bp, Artificial Sequence; identical to SEQ ID NO: 19734
  Description of Artificial Sequence: Synthetic coding sequence

SEQ ID NO: 19736 - DNA, 1386 bp, Artificial Sequence
  Description of Artificial Sequence: Synthetic coding sequence
atgagcagaatcaacaagaacgtggtgctggccctgctgaccctgaccagcagcgccttcctgctgttccagctgtactactacaagcactacctgagcaccaagaacggcgccggcctgagcaagagcaagggcagcagaatcggcttcgacagcacccagtggagagccgtgaagaagttcatcatgctgaccagcaaccagaacgtgcccgtgttcctgatcgaccccctgatcctggagctgatcaacaagaacttcgagcaggtgaagaacaccagccacggcagcaccagccagtgcaagttcttctgcgtgcccagagacttcaccgccttcgccctgcagtaccacctgtggaagaacgaggagggctggttcagaatcgccgagaacatgggcttccagtgcctgaagatcgagagcaaggaccccagactggacggcatcgacagcctgagcggcaccgagatccccctgcactacatctgcaagctggccacccacgccatccacctggtggtgttccacgagagaagcggcaactacctgtggcacggccacctgagactgaaggagcacatcgacagaaagttcgtgcccttcagaaagctgcagttcggcagataccccggcgccttcgacagacccgagctgcagcaggtgaccgtggacggcctggaggtgctgatccccaaggaccccatgcacttcgtggaggaggtgccccacagcagattcatcgagtgcagatacaaggaggccagagccttcttccagcagtacctggacgacaacaccgtggaggccgtggccttcagaaagagcgccaaggagctgctgcagctggccgccaagaccctgaacaagctgggcgtgcccttctggctgagcagcggcacctgcctgggctggtacagacagtgcaacatcatcccctacagcaaggacgtggacctgggcatcttcatccaggactacaagagcgacatcatcctggccttccaggacgccggcctgcccctgaagcacaagttcggcaaggtggaggacagcctggagctgagcttccagggcaaggacgacgtgaagctggacgtgttcttcttctacgaggagaccgaccacatgtggaacggcggcacccaggccaagaccggcaagaagttcaagtacctgttccccaagttcaccctgtgctggaccgagttcgtggacatgaaggtgcacgtgccctgcgagaccctggagtacatcgaggccaactacggcaagacctggaagatccccgtgaagacctgggactggaagagaagcccccccaacgtgcagcccaacggcatctggcccatcagcgagtgggacgaggtgatccagctgtactag

SEQ ID NO: 19737 - DNA, 2640 bp, Artificial Sequence
  Description of Artificial Sequence: Synthetic coding sequence
atggccgacggcggcggccccaaggacgcccccagcctgagaagcagccccggccccgcccccagagtgcccagagccgtgggccccagcggcggcggcggcgagacccccagaaccgccgccctggccctgagattcgacaagcccatcaagcaggccttctacaacaccggcgccgtgctgttcgtgtgcctgtgctgcggcgccgccgtgctggtgtacttcatcctggaggccttcctgagacccctgctgtgggccgtgctgtgcggcaccttcctgcaccccttcaagagcagcctgaccagactgggcagacactggctgcagagactgcacagagcccacacccccatcgtgctggccgccctgctgctgcccctgtgcttcgtggactacggcgtggaggccctgggcgagcaggccctgagaagaagaagactgctgctgctgctgggcgccggcggccccctgctgtacggcctgtactgcctgggcagctacctgggcgtgcaggtgctgctggtgcacgccgccaccctgatctgcagaggcctggactacttcagcagcctgtggatctggaccctggtggtgggctacgtgctgaccgtgagcttcaagtggaacgccagcaccgagagatacctgagagccgtgagcatccccgtgtggatcatcctgctgttccacctggccagcctggccggcagctggagaatccccgtgttcctggtgatcgtgttcctgatgagcgtgggcaccctgtacgagaagcagaacggcaaggagagcagcggcgccgagctgcccggccaggtgatcagcatggccgccagcaccctggccaacctggccatcagcatcaccggctacgagagcagcagcgaggaccagcccagcacccagcccgccgaggccgtggacagaggcgagagcgcccccaccctgagcaccagccccagccccagcagccccagccccaccagccccagccccaccctgggcagaagaagacccgagatcggcaccttcctgagaaagaagaagaccagcgacatctacttcgtgagcctggtgtgggccatcgtggtgatgcagatctggctgaacctgtggatcgtgcagctgctgcccgtgcccatcgccgtgtggatcctgaagaagctggtgatccacttcggcgtggtggacttcctggagaagagataccacgtgtggtggggcatcatcgagagcttcctgaaggagagacagggcgccctggccccctggcccatcgtgggcctgggcaagttcctgctgaaggtggacagcaagctgtggcactggctgaacaagaagatgatcatctggctggagaagatgctggacaagatcatcagcatcttcatcatcttcctgctggtgatcggcaccctgctgctggccctgctgctgaccgccaaggtgcaccaggagagcgtgcacatgatcgaggtgaccagcaacctgatcaacgagaccctggccaaccaccccgagtgggccaactggctgcccgaggcccaggtggtgcagagagccctgaacagcgccgccaacaacgtgtaccagtacggcagagagtggatcacccacaagctgcacaagatcctgggcgacaaggtgaacaacaccgccgtgatcgagaagcaggtgctggagctgtgggacagactgtaccacagctggttcgtgaagaacgtgacccacagcggcagacacaagggccagaagctgcacgtgagcagacagaacagctggctgggcgacatcctggactggcaggacatcgtgagcttcgtgcacgagaacatcgagaccttcctgagcatcctggagagcctgtggatcgtgatgagcagaaacgtgagcctgctgttcaccaccgtgaccaccctgctgaccatcctgttctacagcggcaccgccctgctgaacttcgtgctgagcctgatcatcttcctgaccaccctgttctacctgctgagcagcagcgacgagtactacaagcccgtgaagtgggtgatcagcctgacccccctgagccagcccggccccagcagcaacatcatcggccagagcgtggaggaggccatcagaggcgtgttcgacgccagcctgaagatggccggcttctacggcctgtacacctggctgacccacaccatgttcggcatcaacatcgtgttcatccccagcgccctggccgccatcctgggcgccgtgcccttcctgggcacctactgggccgccgtgcccgccgtgctggacctgtggctgacccagggcctgggctgcaaggccatcctgctgctgatcttccacctgctgcccacctacttcgtggacaccgccatctacagcgacatcagcggcggcggccacccctacctgaccggcctggccgtggccggcggcgcctactacctgggcctggagggcgccatcatcggccccatcctgctgtgcatcctggtggtggccagcaacatctacagcgccatgctggtgagccccaccaacagcgtgcccacccccaaccagaccccctggcccgcccagccccagagaaccttcagagacatcagcgaggacctgaagagcagcgtgggctag

SEQ ID NO: 19738 - DNA, 1509 bp, Artificial Sequence
  Description of Artificial Sequence: Synthetic coding sequence
atggccgacggcggcggccccaaggacgcccccagcctgagaagcagccccggccccgcccccagagtgcccagagccgtgggccccagcggcggcggcggcgagacccccagaaccgccgccctggccctgagattcgacaagcccatcaagcaggccttctacaacaccggcgccgtgctgttcgtgtgcctgtgctgcggcgccgccgtgctggtgtacttcatcctggaggccttcctgagacccctgctgtgggccgtgctgtgcggcaccttcctgcaccccttcaagagcagcctgaccagactgggcagacactggctgcagagactgcacagagcccacacccccatcgtgctggccgccctgctgctgcccctgtgcttcgtggactacggcgtggaggccctgggcgagcaggccctgagaagaagaagactgctgctgctgctgggcgccggcggccccctgctgtacggcctgtactgcctgggcagctacctgggcgtgcaggtgctgctggtgcacgccgccaccctgatctgcagaggcctggactacttcagcagcctgtggatctggaccctggtggtgggctacgtgctgaccgtgagcttcaagtggaacgccagcaccgagagatacctgagagccgtgagcatccccgtgtggatcatcctgctgttccacctggccagcctggccggcagctggagaatccccgtgttcctggtgatcgtgttcctgatgagcgtgggcaccctgtacgagaagcagaacggcaaggagagcagcggcgccgagctgcccggccaggtgatcagcatggccgccagcaccctggccaacctggccatcagcatcaccggctacgagagcagcagcgaggaccagcccagcacccagcccgccgaggccgtggacagaggcgagagcgcccccaccctgagcaccagccccagccccagcagccccagccccaccagccccagccccaccctgggcagaagaagacccgagatcggcaccttcctgagaaagaagaagaccagcgacatctacttcgtgagcctggtgtgggccatcgtggtgatgcagatctggctgaacctgtggatcgtgcagctgctgcccgtgcccatcgccgtgtggatcctgaagaagctggtgatccacttcggcgtggtggacttcctggagaagagataccacgtgtggtggggcatcatcgagagcttcctgaaggagagacagggcgccctggccccctggcccatcgtgggcctgggcaagttcctgctgaaggtggacagcaagatgatcatctggctggagaagatgctggacaagatcatcagcatcttcatcatcttcctgctggtgatcggcaccctgctgctggccctgctgctgaccgccaaggtgcaccaggagagcgtgcacatgatcgaggtgaccagcaacctgatcaacgagaccctggccaaccaccccgagtgggcctag

SEQ ID NO: 19739 - DNA, 1296 bp, Artificial Sequence
  Description of Artificial Sequence: Synthetic coding sequence
atgttctggagaagactgagacccggcgcccaggacctggcccccaagggcctgcccggcgacggcgacttcagaagaagcagcgaccccagactgcccaagctgaccccccccgccctgagagccgccctgggcgccagaggcagcggcgactggagaatccccggcggcggcgccgcctggtggcccgagggcgacgccaagcccggcgtgggcgtgggcagactgccccccagactgcccgccctgctgaccgccaccagaagagccgtgagaaagagaggcctgctgagaagcctgctgcccccccccctgctgagcgccggcgccagcagagagagcgcccccagacagcccggccccggcgagagagagagacccagaagaagagtggccagagaggaccccgacttcctgggcgccttcctgggcgagctgctgcccagcagattcagagagttcctgcaccagctgcaggagaagtgcgccgaggagcccgagcccctgaccagccccgccccccagcaccagagaggcgtgctggagcactgccccggcagccccagatgccccaactgcagcttcctgcccgacctgtggggccagagcagccacctgcaggacagcctgaccaagatcagcctgcagcagacccccatcctgggccccctgaagggcgaccacagccagttcaccaccgtgagaaaggccaaccacagaccccacggcgcccaggtgcccagactgaaggccgccctgacccacaaccccagcggcgagggcagcagaccctgcagacagagatgccccttcagagtgagattcgccgacgagaccctgcaggacaccaccctgagatactgggagagaagaagaagcgtgcagcagagcgtgatcgtgaaccagaaggccgccctgcccgtggccagcgagagagtgttcggcagcgtgggcaagagactggagagcctgcccaaggccctgtaccccggcgccaaggaggagaccctggccagcagcagctgctgggactgcgccggcctgagcacccagaagacccagggctacctgagcgaggacaccagcatgaacagcagcctgcccttctgcagctggaagaaggccgccgcccagagacccagaagcagcctgagagccttcctggacccccacagaaacctggagcaggagagcctgctgcccaacagagtgctgcagagcgtgctgaagcagggctgccccaagggctaccacctgctgctggccagcgccaccctgcagcccgacaagagatag

SEQ ID NO: 19740 - DNA, 816 bp, Artificial Sequence
  Description of Artificial Sequence: Synthetic coding sequence
atgagagacagaagaggccccctgggcacctgcctggcccaggtgcagtgggccggcggcggcgacagcgacaagctgagctacagcctgaagaagagaatgcccaccgagggcccctggcccgccgacgcccccagctggatgaacaagcccgccgtggacggcaacagccagagcgaggccctgagcctggagatggccggcctgagcctgcccagcggcggccccgtgctgccctacgtgaaggagagcgccagaagaaaccccgccagcgccgccacccccagcgccgccgtgggcctgttccccgcccccaccgagtacttcgccagagtgagctgcagcggcgtggaggccctgggcagagactggctgggcggcggccccagagccacccacggccacagaggccagtgccccaagggcgagcccagagtgagcagactgaccagacaccagaagctgcccgagatgggcagcttctgggacgacccccccagcgccttccccagcggcctgggcagcgagctggagcccagctgcctgcacagcatcctgagcgccaccctgcacgcctgccccgaggtgctgctgaaggacgagaccaagagaatcttcctggacctgctgaaccccatgttcagcaagcagaccatcgagttcaagaagatgttcaagagcaccagcgacggcctgcagatcaccctgggcctgctggccctgcagcacttcgagctggccaacagcctgtgccacagcctgaagtacaagcagaacaacgccagcagactgatcctgagagtggtgctggagtag

SEQ ID NO: 19741 - DNA, 240 bp, Artificial Sequence
  Description of Artificial Sequence: Synthetic coding sequence
atgagacagagaggccaggagcacctgcccaccagcgtgaagagcgagcccagagcctgcaacaaccccaccgtggccgagaacagaagagtgcccagcggcctggccgccgtgatcagaaacctgaccgccctgtggaaccccagcctgggcgtgagcgagagaagaggcggcgactgggagcccagcagaatccccagactgtgggccagagtgggctggatccagctgcccggctag

SEQ ID NO: 19742 - DNA, 459 bp, Artificial Sequence
  Description of Artificial Sequence: Synthetic coding sequence
atgggcctgagccccggccagaccagcgtgagcttcctgtggcccctgctggaggtgagagaccacaacaccggcagaggcctggtgcccgccaccgtgctgacccccggcagccccgagaccctgctggagctgagacaggccttcctgggcagcagacaggccagacacggccacgacgccgcccccagcagcggccagcagggctgcagcgtggacagaaccgccggcagacccgtgctgggctggagactgagaaacagcctgaccggccaggagggcagacagcacctgcacctgagcggcatcagaaccagcagaaaggccaaggagtacaagcccgtgttcttcggcgccaccgagatcagcgtgctgatggccgtggccgagagcctgagagagcccccccccccccagtggggctggttcctgagcagcctgttcctgaagatcttctag

SEQ ID NO: 19743 - DNA, 603 bp, Artificial Sequence
  Description of Artificial Sequence: Synthetic coding sequence
atgcccctggtggaggagagacacagaatcctgaacgagaccggcaagatcctgctggagaagttcggcggcagcttcctgaactgcgtgagagagagcgagaacagcgcccagaagctgatgcacctggtggtggagagcttccccagctacagagacgtgaccctgttcgagggcaagagagtgagcttctacaagagagcccagatcctggtggccgacacctggagcgtgctggagggcaagggcgacggctgcttcaaggacatcagcagcatcaccatgttcgccgactacagactgccccaggtgctggcccacctgggcgccctgaagtacagcgacgacctgctgaagaagctgctgaagggcgagatgctgagctacggcgacagacaggaggtggagatcagaggctgcagcctgtggtgcgtggagctgatcagagactgcctgctggagctgatcgagcagaagggcgagaagcccaacggcgagatcaacagcatcctgctggactactacctgtgggactacgcccacgaccacagagaggacatgaagggcatccccttccacagaatcagatgcatctactactag

SEQ ID NO: 19744 - DNA, 183 bp, Artificial Sequence
  Description of Artificial Sequence: Synthetic coding sequence
atgcccctggtggaggagagacacagaatcctgaacgagaccggcaagatcctgctggagaagttcggcggcagcttcctgaactgcgtgagagagagcgagaacagcgcccagaagctgatgcacctggtggtggagagcttccccagctacagagacgtgaccctgttcgagtgcacctag

SEQ ID NO: 19745 - DNA, 1026 bp, Artificial Sequence
  Description of Artificial Sequence: Synthetic coding sequence
atggacggcctgctgaaccccagagagagcagcaagttcatcgccgagaacagcagagacgtgttcatcgacagcggcggcgtgagaagagtggccgagctgctgctggccaaggccgccggccccgagctgagagtggagggctggaaggccctgcacgagctgaaccccagagccgccgacgaggccgccgtgaactgggtgttcgtgaccgacaccctgaacttcagcttctggagcgagcaggacgagcacaagtgcgtggtgagatacagaggcaagacctacagcggctactggagcctgtgcgccgccgtgaacagagccctggacgagggcatccccatcaccagcgccagctactacgccaccgtgaccctggaccaggtgagaaacatcctgagaagcgacaccgacgtgagcatgcccctggtggaggagagacacagaatcctgaacgagaccggcaagatcctgctggagaagttcggcggcagcttcctgaactgcgtgagagagagcgagaacagcgcccagaagctgatgcacctggtggtggagagcttccccagctacagagacgtgaccctgttcgagggcaagagagtgagcttctacaagagagcccagatcctggtggccgacacctggagcgtgctggagggcaagggcgacggctgcttcaaggacatcagcagcatcaccatgttcgccgactacagactgccccaggtgctggcccacctgggcgccctgaagtacagcgacgacctgctgaagaagctgctgaagggcgagatgctgagctacggcgacagacaggaggtggagatcagaggctgcagcctgtggtgcgtggagctgatcagagactgcctgctggagctgatcgagcagaagggcgagaagcccaacggcgagatcaacagcatcctgctggactactacctgtgggactacgcccacgaccacagagaggacatgaagggcatccccttccacagaatcagatgcatctactactag

SEQ ID NO: 19746 - DNA, 888 bp, Artificial Sequence
  Description of Artificial Sequence: Synthetic coding sequence
atgagacacagcgtggccagacccaccagactgcccagaagactgagccccttctgggaccccgccacctgcaagaacctggagggcggcgccggcgaggtggtgagaggcagagaccccagaagactgagaaccagcagaagcaccgagatcctgggcgaggacctggccggccccagcgccggcgccgccgccagacccgccgccccccccccccagcccagagagcccggcgcccccggcctgagaagagccccccccagaaccagaatggacagcagcggcctgggcccctgcagcgaggcccccctgcacaccagcgccggcctgagcggcagaaacctgagagccgccggcggcgtgctgcccgtggacctggagagagagagagccgccctgtgcgccagacagagcggccacggcccccccgccgtgagatggctgctgggcagcagaggcgccgagagcggcggcctggccagaagaagagtggccgccgagcacgcccagcccagcgccaacctggtgtgcagaagcgccctggagaccagcgccttcccccccagcaagcccaagagccccagaggcagagtgagagccagaagcagcgacggcagactgagacaccccgcctggagagccggcagcggcggcagaggcggcagaggccccagcgccgagctggccagcagatactggggcagaagaagagccctgcccggcgccgccgacctgagacccaagggcgccagagccgacgacagaagacccctgagagccggcagaaagctgcacctgcccgaggccgccagactgcccggcaacgtgggcaagagcggcgagccccacaaggccggcgaggtgggcaaccaccccagagacagctag

SEQ ID NO: 19747 - DNA, 810 bp, Artificial Sequence
  Description of Artificial Sequence: Synthetic coding sequence
atgggccccagacccctggagaagggctgcttccccggctgcttcttcagaaacagcaaggaggagagacacgagagcagaagacccctgagcaccagccacgagcccatcttccccctgaacaccatcaagatgaagctgaaggagaacaacctgaacagactgcccaagggcatgcaggccagagcccccagccagtacagcaccagacacttcttccaggaccagcccgcccagctgaacctgggcaacaacttcaagatcagcggcggcagcaagccccccttcgtggtgagacacgtggacagcgccaagcccttcggcgagaacatcagcgagcaccacctgagaagaagcagaagaaagagcaagttcagcgacttccccttccccaccagaagagccagcagcctggacagcctggccgccaacgtgaaggtgatcaaggagcccgacgagagaatcgtgctgagaagcgacagcagcagctgcctggacagcagccagttcggcaagagcagcagcagcaagcagggcgacgccgacttccacggcaaggccagcttcgccacctaccagcacagcaccagccccggccccctggaccagcccctgctgagagagagattccaccccggcagccagagcacctggaagaacatccacgagagagtgtgcagcctgctgaccagccacagagcccagctgcaccagaacaaggaggacagcaccagcgaggtgaactacatcatcgagagacccagctaccccctgaagaagtacagcctgcacgagcagagatacttctag

SEQ ID NO: 19748 - DNA, 1179 bp, Artificial Sequence
  Description of Artificial Sequence: Synthetic coding sequence
atgcccctggaggtggtggtggagctgcagatcagagccatcagctgccccggcgtgttcctgcccggcaagcaggacgtgtacctgggcgtgtacctgatgaaccagtacctggagaccaacagcttccccagcgccttccccatcatgatccaggagagcatgagattcgagaaggtgttcgagagcgccgtggaccccggcgccgtggtggacctgctggagatgtgggacgagctggcctactacgaggagaacaccagagacttcctgttccccgagcccaagctgacccccagccaccccagaagatgcagagaggtgctgatgaagaccgccctgggcttccccggcatcgcccccaagatcgagttcagcaccagaaccgccatcagagagtgcgtgttcctgcacagaaacagattcctggaggagagacacgagagcagaagacccctgagcaccagccacgagcccatcttccccctgaacaccatcaagatgaagctgaaggagaacaacctgaacagactgcccaagggcatgcaggccagagcccccagccagtacagcaccagacacttcttccaggaccagcccgcccagctgaacctgggcaacaacttcaagatcagcggcggcagcaagccccccttcgtggtgagacacgtggacagcgccaagcccttcggcgagaacatcagcgagcaccacctgagaagaagcagaagaaagagcaagttcagcgacttccccttccccaccagaagagccagcagcctggacagcctggccgccaacgtgaaggtgatcaaggagcccgacgagagaatcgtgctgagaagcgacagcagcagctgcctggacagcagccagttcggcaagagcagcagcagcaagcagggcgacgccgacttccacggcaaggccagcttcgccacctaccagcacagcaccagccccggccccctggaccagcccctgctgagagagagattccaccccggcagccagagcacctggaagaacatccacgagagagtgtgcagcctgctgaccagccacagagcccagctgcaccagaacaaggaggacagcaccagcgaggtgaactacatcatcgagagacccagctaccccctgaagaagtacagcctgcacgagcagagatacttctag

SEQ ID NO: 19749 - DNA, 408 bp, Artificial Sequence
  Description of Artificial Sequence: Synthetic coding sequence
atgacccccacccccaccgccgcctggaccccccccccccccctgagacccagcgccgccgccgccggcgcccagtgcagaagctgccccttcagaggcggctgcgcccccagcaccgccagaaccccccccgcctgcatgagacccgccggcccctgcgccccccccacctggcccgcccccagcaccaccaccagcacctgcaccagcagaagagccggctgcaccgccagcagcgccagctacagcaccctggccgccgcctgcagcctgagaagaagcggcgtgagatggccccccagcagcgcctacagcacctgggccttcgccagctgctgcgccagcagcgccagctgcagatgctgctgctgctgctgggccgccggcgcctggaccagcgcctggtag

SEQ ID NO: 19750 - DNA, 870 bp, Artificial Sequence
  Description of Artificial Sequence: Synthetic coding sequence
atgcccgtggtgagaaagatcttcagaagaagaagaggcgacagcgagagcgaggaggacgagcaggacagcgaggaggtgagactgaagctggaggagaccagagaggtgcagaacctgagaaagagacccaacggcgtgagcgccgtggccctgctggtgggcgagaaggtgcaggaggagaccaccctggtggacgaccccttccagatgaagaccggcggcatggtggacatgaagaagctgaaggagagaggcaaggacaagatcagcgaggaggaggacctgcacctgggcaccagcttcagcgccgagaccaacagaagagacgaggacgccgacatgatgaagtacatcgagaccgagctgaagaagagaaagggcatcgtggagcacgaggagcagaaggtgaagcccaagaacgccgaggactgcctgtacgagctgcccgagaacatcagagtgagcagcgccaagaagaccgaggagatgctgagcaaccagatgctgagcggcatccccgaggtggacctgggcatcgacgccaagatcaagaacatcatcagcaccgaggacgccaaggccagactgctggccgagcagcagaacaagaagaaggacagcgagaccagcttcgtgcccaccaacatggccgtgaactacgtgcagcacaacagattctaccacgaggagctgaacgcccccatcagaagaaacaaggaggagcccaaggccagacccctgagagtgggcgacaccgagaagcccgagcccgagagaagcccccccaacagaaagagacccgccaacgagaaggccaccgacgactaccactacgagaagttcaagaagatgaacagaagatactag

SEQ ID NO: 19751 - DNA, 528 bp, Artificial Sequence
  Description of Artificial Sequence: Synthetic coding sequence
atggtggacatgaagaagctgaaggagagaggcaaggacaagatcagcgaggaggaggacctgcacctgggcaccagcttcagcgccgagaccaacagaagagacgaggacgccgacatgatgaagtacatcgagaccgagctgaagaagagaaagggcatcgtggagcacgaggagcagaaggtgaagcccaagaacgccgaggactgcctgtacgagctgcccgagaacatcagagtgagcagcgccaagaagaccgaggagatgctgagcaaccagatgctgagcggcatccccgaggtggacctgggcatcgacgccaagatcaagaacatcatcagcaccgaggacgccaaggccagactgctggccgagcagcagaacaagaagaaggacagcgagaccagcttcgtgcccaccaacatggccgtgaactacgtgcagcacaacagattctaccacgaggagctgaacgcccacaccgagaagcagagaagagcccagggccccgccctggagagcagatag

SEQ ID NO: 19752 - DNA, 1086 bp, Artificial Sequence
  Description of Artificial Sequence: Synthetic coding sequence
atgaccggcaagaagagcagcagagagaagagaagaaagagaagcagccaggaggccgccgccgccctggccgcccccgacatcgtgcccgccctggccagcggcagcagcggcagcaccagcggctgcggcagcgccggcggctgcggcagcgtgagctgctgcggcaacgccaacttcagcggcagcgtgaccggcggcggcagcggcggcagctgctggggcggcagcagcgtggagagaagcgagagaagaaagagaagaagcaccgacagcagcagcgtgagcggcagcctgcagcaggagaccaagtacatcctgcccaccctggagaaggagctgttcctggccgagcacagcgacctggaggagggcggcctggacctgaccgtgagcctgaagcccgtgagcttctacatcagcgacaagaaggagatgctgcagcagtgcttctgcatcatcggcgagaagaagctgcagaagatgctgcccgacgtgctgaagaactgcagcatcgaggagatcaagaagctgtgccaggagcagctggagctgctgagcgagaagaagatcctgaagatcctggagggcgacaacggcatggacagcgacatggaggaggaggccgacgacggcagcaagatgggcagcgacctggtgagccagcaggacatctgcatcgacagcgccagcagcgtgagagagaacaagcagcccgagggcctggagctgaagcagggcaagggcgaggacagcgacgtgctgagcatcaacgccgacgcctacgacagcgacatcgagggcccctgcaacgaggaggccgccgcccccgaggcccccgagaacaccgtgcagagcgaggccggccagatcgacgacctggagaaggacatcgagaagagcgtgaacgagatcctgggcctggccgagagcagccccaacgagcccaaggccgccaccctggccgtgcccccccccgaggacgtgcagcccagcgcccagcagctggagctgctggagctggagatgagagccagagccatcaaggccctgatgaaggccggcgacatcaagaagcccgcctag

SEQ ID NO: 19753 - DNA, 651 bp, Artificial Sequence
  Description of Artificial Sequence: Synthetic coding sequence
atgctgcagcagtgcttctgcatcatcggcgagaagaagctgcagaagatgctgcccgacgtgctgaagaactgcagcatcgaggagatcaagaagctgtgccaggagcagctggagctgctgagcgagaagaagatcctgaagatcctggagggcgacaacggcatggacagcgacatggaggaggaggccgacgacggcagcaagatgggcagcgacctggtgagccagcaggacatctgcatcgacagcgccagcagcgtgagagagaacaagcagcccgagggcctggagctgaagcagggcaagggcgaggacagcgacgtgctgagcatcaacgccgacgcctacgacagcgacatcgagggcccctgcaacgaggaggccgccgcccccgaggcccccgagaacaccgtgcagagcgaggccggccagatcgacgacctggagaaggacatcgagaagagcgtgaacgagatcctgggcctggccgagagcagccccaacgagcccaaggccgccaccctggccgtgcccccccccgaggacgtgcagcccagcgcccagcagctggagctgctggagctggagatgagagccagagccatcaaggccctgatgaaggccggcgacatcaagaagcccgcctag

SEQ ID NO: 19754 - DNA, 4335 bp, Artificial Sequence
  Description of Artificial Sequence: Synthetic coding sequence
atgaccgacaccagcgtgctggaccagtggaaggccagcttcttcgtggaggacttcctggagaagaagaccatcaccagaatggtgacccagatcaactgcgagttcgaggaggtggtgcccagcagcaaccccgacagccagatcgaggtggaggaggtgagcctgtacacccacatggactacaacgaggtgttcacccccgtgagctgcctggagaagtgcagcgccctgcagaaccagaaccaggacctgttcatcgacgacaagggcatcctgttcgtgagcagcagaaagcacctgcccaccctgcccaccctgctgagcagactgaagctgttcctggtgaaggaccccctgctggacttcaagggccagatcttcaccgaggccaacttcagcagagagtgcttcagcctgcaggagaccctggaggccttcgtgaaggaggacttctgcatggacaaggtgaacttctgccaggagaagctggaggacaccatctgcctgaacgagcccagcagcttcctgatcgagtacgagttcctgatcccccccagcctgaagcccgagatcgacatccccagcctgagcgagctgaaggagctgctgaaccccgtgcccgagatcatcaactacgtggacgagaaggagaagctgttcgagagagacctgaccaacaagcacggcatcgaggacatcggcgacatcaagttcagcagcaccgagatcctgaccatccagagccagagcgagcccgaggagtgcagcaagcccggcgagctggagatgcccctgacccccctgttcctgacctgccagcacagcagcgtgaacagcctgagaaccgagctgcagaccttccccctgagccccgtgtgcaagatcaacctgctgaccgccgaggagagcgccaacgagtactacatgatgtggcagctggagagatgcagaagccccctgaaccccttcctgctgaccgtgcccagaatccaggagccccacagccagtacagcgtgaccgacctgaagaagatcttcagcgtgaaggaggagagcctggtgatcaacctggagaaggccgagtggtggaagcaggccggcctgaacctgaagatgatggagaccctggagcacctgaacacctacctgtgccacgacaacctgagcagcaacgacaccaagatcgagatcttcctgcccaccaaggtgctgcagctggagagctgcctggagcacaagagccacagcagccccatcgccctgatcgacgagaagagcaccaacgcccacctgagcctgccccagaagagccccagcctggccaaggaggtgcccgacctgtgcttcagcgacgactacttcagcgacaagggcgccgccaaggaggagaagcccaagaacgaccaggagcccgtgaacagaatcatccagaagaaggagaacaacgaccacttcgagctggactgcaccggccccagcatcaagagccccagcagcagcatcatcaagaaggccagcttcgagcacggcaagaagcaggagaacgacctggacctgctgagcgacttcatcatgctgagaaacaagtacaagacctgcaccagcaagaccgaggtgaccaacagcgacgagaagcacgacaaggaggcctgcagcctgaccctgcaggaggagagccccatcgtgcacatcaacaagaccctggaggagatcaaccaggagagaggcaccgacagcgtgatcgagatccaggccagcgacagccagtgccaggccttctgcctgctggaggccgccgccagccccatcctgaagaacctggtgagcctgtgcaccctgcccaccgccaactggaagttcgccaccgtgatcttcgaccagaccagattcctgctgaaggagcaggagaaggtggtgagcgacgccgtgagacagggcaccatcgacgagagagagatgaccttcaagcacgccgccctgctgcacctgctggtgaccatcagagacgtgctgctgacctgcagcctggacaccgccctgggctacctgagcaaggccaaggacatctacaacagcatcctgggcccctacctgggcgacatctggagacagctggagatcgtgcagttcatcagaggcaagaagcccgagaccaactacaagatccaggagctgcagtgccagatcctgagctggatgcagagccagcagcagatcaaggtgctgatcatcatcagaatggacagcgacggcgagaagcacttcctgatcaagatcctgaacaagatcgagggcctgaccctgaccgtgctgcacagcaacgagagaaaggacttcctggagagcgagggcgtgctgagaggcaccagcagctgcgtggtggtgcacaaccagtacatcggcgccgacttcccctggagcaacttcagcttcgtggtggagtacaactacgtggaggacagctgctggaccaagcactgcaaggagctgaacatcccctacatggccttcaaggtgatcctgcccgacaccgtgctggagagaagcaccctgctggacagattcggcggcttcctgctggagatccagatcccctacgtgttcttcgccagcgagggcctgctgaacacccccgacatcctgcagctgctggagagcaactacaacatcagcctggtggagagaggctgcagcgagagcctgaagctgttcggcagcagcgagtgctacgtggtggtgaccatcgacgagcacaccgccatcatcctgcaggacctggaggagctgaactacgagaaggccagcgacaacatcatcatgagactgatggccctgagcctgcagtacagatactgctggatcatcctgtacaccaaggagaccctgaacagcgagtacctgctgaccgagaagaccctgcaccacctggccctgatctacgccgccctggtgagcttcggcctgaacagcgaggagctggacgtgaagctgatcatcgcccccggcgtggaggccaccgccctgatcatcagacagatcgccgaccacagcctgatgaccagcaagagagacccccacgagtggctggacaagagctggctgaaggtgagccccagcgaggaggagatgtacctgctggacttcccctgcatcaaccccctggtggcccagctgatgctgaacaagggccccagcctgcactggatcctgctggccaccctgtgccagctgcaggagctgctgcccgaggtgcccgagaaggtgctgaagcacttctgcagcatcaccagcctgttcaagatcggcagcagcagcatcaccaagagcccccagatcagcagcccccaggagaacagaaaccagatcagcaccctgagcagccagagcagcgccagcgacctggacagcgtgatccaggagcacaacgagtactaccagtacctgggcctgggcgagaccgtgcaggaggacaagaccaccatcctgaacgacaacagcagcatcatggagctgaaggagatcagcagcttcctgccccccgtgaccagctacaaccagaccagctactggaaggacagcagctgcaagagcaacatcggccagaacacccccttcctgatcaacatcgagagcagaagacccgcctacaacagcttcctgaaccacagcgacagcgagagcgacgtgttcagcctgggcctgacccagatgaactgcgagaccatcaagagccccaccgacacccagaagagagtgagcgtggtgcccagattcatcaacagccagaagagaagaacccacgaggccaagggcttcatcaacaaggacgtgagcgaccccatcttcagcctggagggcacccagagccccctgcactggaacttcaagaagaacatctgggagcaggagaaccaccccttcaacctgcagtacggcgcccagcagaccgcctgcaacaagctgtacagccagaagggcaacctgttcaccgaccagcagaagtgcctgagcgacgagagcgagggcctgacctgcgagagcagcaaggacgagaccttctggagagagctgcccagcgtgcccagcctggacctgttcagagccagcgacagcaacgccaaccagaaggagttcaacagcctgtacttctaccagagagccggcaagagcctgggccagaagagacaccacgagagcagcttcaacagcggcgacaaggagagcctgaccggcttcatgtgcagccagctgccccagttcaagaagagaagactggcctacgagaaggtgcccggcagagtggacggccagaccagactgagattcttctag

SEQ ID NO: 19755 - DNA, 1467 bp, Artificial Sequence
  Description of Artificial Sequence: Synthetic coding sequence
atgttcagcgccctgaagtaccacgccatcgactacctgtacgagaacgtggtgagaaagaagttctacagagacgccctgctgctgagaatccccagctgcctgtaccaggacgagagctaccacgtggccgtgaccgacaacaagttcagaagaccctggaccagagtgagcgccgtgagcgtgcccggcatgaccgacaccagcgtgctggaccagtggaaggccagcttcttcgtggaggacttcctggagaagaagaccatcaccagaatggtgacccagatcaactgcgagttcgaggaggtggtgcccagcagcaaccccgacagccagatcgaggtggaggaggtgagcctgtacacccacatggactacaacgaggtgttcacccccgtgagctgcctggagaagtgcagcgccctgcagaaccagaaccaggacctgttcatcgacgacaagggcatcctgttcgtgagcagcagaaagcacctgcccaccctgcccaccctgctgagcagactgaagctgttcctggtgaaggaccccctgctggacttcaagggccagatcttcaccgaggccaacttcagcagagagtgcttcagcctgcaggagaccctggaggccttcgtgaaggaggacttctgcatggacaaggtgaacttctgccaggagaagctggaggacaccatctgcctgaacgagcccagcagcttcctgatcgagtacgagttcctgatcccccccagcctgaagcccgagatcgacatccccagcctgagcgagctgaaggagctgctgaaccccgtgcccgagatcatcaactacgtggacgagaaggagaagctgttcgagagagacctgaccaacaagcacggcatcgaggacatcggcgacatcaagttcagcagcaccgagatcctgaccatccagagccagagcgagcccgaggagtgcagcaagcccggcgagctggagatgcccctgacccccctgttcctgacctgccagcacagcagcgtgaacagcctgagaaccgagctgcagaccttccccctgagccccgtgtgcaagatcaacctgctgaccgccgaggagagcgccaacgagtactacatgatgtggcagctggagagatgcagaagccccctgaaccccttcctgctgaccgtgcccagaatccaggagccccacagccagtacagcgtgaccgacctgaagaagatcttcagcgtgaaggaggagagcctggtgatcaacctggagaaggccgagtggtggaagcaggccggcctgaacctgaagatgatggagaccctggagcacctgaacacctacctgtgccacgacaacctgagcagcaacgacaccaagatcgagatcttcctgcccaccaaggtgctgcagctggagtgcaagtacatcaccgtgaacatcagctacgtgaacatcttcagaatgtag

SEQ ID NO: 19756 - DNA, 4335 bp, Artificial Sequence; identical to SEQ ID NO: 19754
  Description of Artificial Sequence: Synthetic coding sequence

SEQ ID NO: 19757 - DNA, 3177 bp, Artificial Sequence
  Description of Artificial Sequence: Synthetic coding sequence
atgatcatctgcctgctgatgaccctgaagctgagatacctgcccaccaaggtgctgcagctggagagctgcctggagcacaagagccacagcagccccatcgccctgatcgacgagaagagcaccaacgcccacctgagcctgccccagaagagccccagcctggccaaggaggtgcccgacctgtgcttcagcgacgactacttcagcgacaagggcgccgccaaggaggagaagcccaagaacgaccaggagcccgtgaacagaatcatccagaagaaggagaacaacgaccacttcgagctggactgcaccggccccagcatcaagagccccagcagcagcatcatcaagaaggccagcttcgagcacggcaagaagcaggagaacgacctggacctgctgagcgacttcatcatgctgagaaacaagtacaagacctgcaccagcaagaccgaggtgaccaacagcgacgagaagcacgacaaggaggcctgcagcctgaccctgcaggaggagagccccatcgtgcacatcaacaagaccctggaggagatcaaccaggagagaggcaccgacagcgtgatcgagatccaggccagcgacagccagtgccaggccttctgcctgctggaggccgccgccagccccatcctgaagaacctggtgagcctgtgcaccctgcccaccgccaactggaagttcgccaccgtgatcttcgaccagaccagattcctgctgaaggagcaggagaaggtggtgagcgacgccgtgagacagggcaccatcgacgagagagagatgaccttcaagcacgccgccctgctgcacctgctggtgaccatcagagacgtgctgctgacctgcagcctggacaccgccctgggctacctgagcaaggccaaggacatctacaacagcatcctgggcccctacctgggcgacatctggagacagctggagatcgtgcagttcatcagaggcaagaagcccgagaccaactacaagatccaggagctgcagtgccagatcctgagctggatgcagagccagcagcagatcaaggtgctgatcatcatcagaatggacagcgacggcgagaagcacttcctgatcaagatcctgaacaagatcgagggcctgaccctgaccgtgctgcacagcaacgagagaaaggacttcctggagagcgagggcgtgctgagaggcaccagcagctgcgtggtggtgcacaaccagtacatcggcgccgacttcccctggagcaacttcagcttcgtggtggagtacaactacgtggaggacagctgctggaccaagcactgcaaggagctgaacatcccctacatggccttcaaggtgatcctgcccgacaccgtgctggagagaagcaccctgctggacagattcggcggcttcctgctggagatccagatcccctacgtgttcttcgccagcgagggcctgctgaacacccccgacatcctgcagctgctggagagcaactacaacatcagcctggtggagagaggctgcagcgagagcctgaagctgttcggcagcagcgagtgctacgtggtggtgaccatcgacgagcacaccgccatcatcctgcaggacctggaggagctgaactacgagaaggccagcgacaacatcatcatgagactgatggccctgagcctgcagtacagatactgctggatcatcctgtacaccaaggagaccctgaacagcgagtacctgctgaccgagaagaccctgcaccacctggccctgatctacgccgccctggtgagcttcggcctgaacagcgaggagctggacgtgaagctgatcatcgcccccggcgtggaggccaccgccctgatcatcagacagatcgccgaccacagcctgatgaccagcaagagagacccccacgagtggctggacaagagctggctgaaggtgagccccagcgaggaggagatgtacctgctggacttcccctgcatcaaccccctggtggcccagctgatgctgaacaagggccccagcctgcactggatcctgctggccaccctgtgccagctgcaggagctgctgcccgaggtgcccgagaaggtgctgaagcacttctgcagcatcaccagcctgttcaagatcggcagcagcagcatcaccaagagcccccagatcagcagcccccaggagaacagaaaccagatcagcaccctgagcagccagagcagcgccagcgacctggacagcgtgatccaggagcacaacgagtactaccagtacctgggcctgggcgagaccgtgcaggaggacaagaccaccatcctgaacgacaacagcagcatcatggagctgaaggagatcagcagcttcctgccccccgtgaccagctacaaccagaccagctactggaaggacagcagctgcaagagcaacatcggccagaacacccccttcctgatcaacatcgagagcagaagacccgcctacaacagcttcctgaaccacagcgacagcgagagcgacgtgttcagcctgggcctgacccagatgaactgcgagaccatcaagagccccaccgacacccagaagagagtgagcgtggtgcccagattcatcaacagccagaagagaagaacccacgaggccaagggcttcatcaacaaggacgtgagcgaccccatcttcagcctggagggcacccagagccccctgcactggaacttcaagaagaacatctgggagcaggagaaccaccccttcaacctgcagtacggcgcccagcagaccgcctgcaacaagctgtacagccagaagggcaacctgttcaccgaccagcagaagtgcctgagcgacgagagcgagggcctgacctgcgagagcagcaaggacgagaccttctggagagagctgcccagcgtgcccagcctggacctgttcagagccagcgacagcaacgccaaccagaaggagttcaacagcctgtacttctaccagagagccggcaagagcctgggccagaagagacaccacgagagcagcttcaacagcggcgacaaggagagcctgaccggcttcatgtgcagccagctgccccagttcaagaagagaagactggcctacgagaaggtgcccggcagagtggacggccagaccagactgagattcttctag

SEQ ID NO: 19758 - DNA, 4218 bp, Artificial Sequence
  Description of Artificial Sequence: Synthetic coding sequence
atgagcgagaccctgggcgacgagctggagatcctgagaggcaagatgatgcagagaagacccagaagcgccgaggtgaagtacttctacttcttcaagatcctgctgagactgagactggccatcctgaagtacctgttcatcgacgacaagggcatcctgttcgtgagcagcagaaagcacctgcccaccctgcccaccctgctgagcagactgaagctgttcctggtgaaggaccccctgctggacttcaagggccagatcttcaccgaggccaacttcagcagagagtgcttcagcctgcaggagaccctggaggccttcgtgaaggaggacttctgcatggacaaggtgaacttctgccaggagaagctggaggacaccatctgcctgaacgagcccagcagcttcctgatcgagtacgagttcctgatcccccccagcctgaagcccgagatcgacatccccagcctgagcgagctgaaggagctgctgaaccccgtgcccgagatcatcaactacgtggacgagaaggagaagctgttcgagagagacctgaccaacaagcacggcatcgaggacatcggcgacatcaagttcagcagcaccgagatcctgaccatccagagccagagcgagcccgaggagtgcagcaagcccggcgagctggagatgcccctgacccccctgttcctgacctgccagcacagcagcgtgaacagcctgagaaccgagctgcagaccttccccctgagccccgtgtgcaagatcaacctgctgaccgccgaggagagcgccaacgagtactacatgatgtggcagctggagagatgcagaagccccctgaaccccttcctgctgaccgtgcccagaatccaggagccccacagccagtacagcgtgaccgacctgaagaagatcttcagcgtgaaggaggagagcctggtgatcaacctggagaaggccgagtggtggaagcaggccggcctgaacctgaagatgatggagaccctggagcacctgaacacctacctgtgccacgacaacctgagcagcaacgacaccaagatcgagatcttcctgcccaccaaggtgctgcagctggagagctgcctggagcacaagagccacagcagccccatcgccctgatcgacgagaagagcaccaacgcccacctgagcctgccccagaagagccccagcctggccaaggaggtgcccgacctgtgcttcagcgacgactacttcagcgacaagggcgccgccaaggaggagaagcccaagaacgaccaggagcccgtgaacagaatcatccagaagaaggagaacaacgaccacttcgagctggactgcaccggccccagcatcaagagccccagcagcagcatcatcaagaaggccagcttcgagcacggcaagaagcaggagaacgacctggacctgctgagcgacttcatcatgctgagaaacaagtacaagacctgcaccagcaagaccgaggtgaccaacagcgacgagaagcacgacaaggaggcctgcagcctgaccctgcaggaggagagccccatcgtgcacatcaacaagaccctggaggagatcaaccaggagagaggcaccgacagcgtgatcgagatccaggccagcgacagccagtgccaggccttctgcctgctggaggccgccgccagccccatcctgaagaacctggtgagcctgtgcaccctgcccaccgccaactggaagttcgccaccgtgatcttcgaccagaccagattcctgctgaaggagcaggagaaggtggtgagcgacgccgtgagacagggcaccatcgacgagagagagatgaccttcaagcacgccgccctgctgcacctgctggtgaccatcagagacgtgctgctgacctgcagcctggacaccgccctgggctacctgagcaaggccaaggacatctacaacagcatcctgggcccctacctgggcgacatctggagacagctggagatcgtgcagttcatcagaggcaagaagcccgagaccaactacaagatccaggagctgcagtgccagatcctgagctggatgcagagccagcagcagatcaaggtgctgatcatcatcagaatggacagcgacggcgagaagcacttcctgatcaagatcctgaacaagatcgagggcctgaccctgaccgtgctgcacagcaacgagagaaaggacttcctggagagcgagggcgtgctgagaggcaccagcagctgcgtggtggtgcacaaccagtacatcggcgccgacttcccctggagcaacttcagcttcgtggtggagtacaactacgtggaggacagctgctggaccaagcactgcaaggagctgaacatcccctacatggccttcaaggtgatcctgcccgacaccgtgctggagagaagcaccctgctggacagattcggcggcttcctgctggagatccagatcccctacgtgttcttcgccagcgagggcctgctgaacacccccgacatcctgcagctgctggagagcaactacaacatcagcctggtggagagaggctgcagcgagagcctgaagctgttcggcagcagcgagtgctacgtggtggtgaccatcgacgagcacaccgccatcatcctgcaggacctggaggagctgaactacgagaaggccagcgacaacatcatcatgagactgatggccctgagcctgcagtacagatactgctggatcatcctgtacaccaaggagaccctgaacagcgagtacctgctgaccgagaagaccctgcaccacctggccctgatctacgccgccctggtgagcttcggcctgaacagcgaggagctggacgtgaagctgatcatcgcccccggcgtggaggccaccgccctgatcatcagacagatcgccgaccacagcctgatgaccagcaagagagacccccacgagtggctggacaagagctggctgaaggtgagccccagcgaggaggagatgtacctgctggacttcccctgcatcaaccccctggtggcccagctgatgctgaacaagggccccagcctgcactggatcctgctggccaccctgtgccagctgcaggagctgctgcccgaggtgcccgagaaggtgctgaagcacttctgcagcatcaccagcctgttcaagatcggcagcagcagcatcaccaagagcccccagatcagcagcccccaggagaacagaaaccagatcagcaccctgagcagccagagcagcgccagcgacctggacagcgtgatccaggagcacaacgagtactaccagtacctgggcctgggcgagaccgtgcaggaggacaagaccaccatcctgaacgacaacagcagcatcatggagctgaaggagatcagcagcttcctgccccccgtgaccagctacaaccagaccagctactggaaggacagcagctgcaagagcaacatcggccagaacacccccttcctgatcaacatcgagagcagaagacccgcctacaacagcttcctgaaccacagcgacagcgagagcgacgtgttcagcctgggcctgacccagatgaactgcgagaccatcaagagccccaccgacacccagaagagagtgagcgtggtgcccagattcatcaacagccagaagagaagaacccacgaggccaagggcttcatcaacaaggacgtgagcgaccccatcttcagcctggagggcacccagagccccctgcactggaacttcaagaagaacatctgggagcaggagaaccaccccttcaacctgcagtacggcgcccagcagaccgcctgcaacaagctgtacagccagaagggcaacctgttcaccgaccagcagaagtgcctgagcgacgagagcgagggcctgacctgcgagagcagcaaggacgagaccttctggagagagctgcccagcgtgcccagcctggacctgttcagagccagcgacagcaacgccaaccagaaggagttcaacagcctgtacttctaccagagagccggcaagagcctgggccagaagagacaccacgagagcagcttcaacagcggcgacaaggagagcctgaccggcttcatgtgcagccagctgccccagttcaagaagagaagactggcctacgagaaggtgcccggcagagtggacggccagaccagactgagattcttctag

SEQ ID NO: 19759 - DNA, 474 bp, Artificial Sequence
  Description of Artificial Sequence: Synthetic coding sequence
atgagcagccagaagggcaacgtggccagaagcagaccccagaagcaccagaacaccttcagcttcaagaacgacaagttcgacaagagcgtgcagaccaagaagatcaacgccaagctgcacgacggcgtgtgccagagatgcaaggaggtgctggagtggagagtgaagtacagcaagtacaagcccctgagcaagcccaagaagtgcgtgaagtgcctgcagaagaccgtgaaggacagctaccacatcatgtgcagaccctgcgcctgcgagctggaggtgtgcgccaagtgcggcaagaaggaggacatcgtgatccccctgaacaaggagaccgagaagatcgagcacaccgagaacaacctgagcagcaaccacagaagaagctgcagaagaaacgaggagagcgacgacgacctggacttcgacatcgacctggaggacaccggcggcgaccaccagatgaactag

SEQ ID NO: 19760 - DNA, 108 bp, Artificial Sequence
  Description of Artificial Sequence: Synthetic coding sequence
atgagcagccagaagggcaacgtggccagaagcagaccccagaagcaccagaacaccttcagcttcaagaacgacaagttcgacaagagcgtgcagaccaagtgctag

SEQ ID NO: 19761 - DNA, 540 bp, Artificial Sequence
  Description of Artificial Sequence: Synthetic coding sequence
atgagcagccagaagggcaacgtggccagaagcagaccccagaagcaccagaacaccttcagcttcaagaacgacaagttcgacaagagcgtgcagaccaagaagatcaacgccaagctgcacgacggcgtgtgccagagatgcaaggaggtgctggagtggagagtgaagtacagcaagtacaagcccctgagcaagcccaagaagtgcgtgaagtgcctgcagaagaccgtgaaggacagctaccacatcatgtgcagaccctgcgcctgcgagctggaggtgtgcgccaagtgcggcaagaaggaggacatcgtgatcccctggagcctgcccctgctgcccagactggagtgcagcggcagaatcctggcccaccacaacctgagactgccctgcagcagcgacagccccgccagcgccagcagagtggccggcaccaccggcgcccaccaccacgcccagctgatcttcgtgttcctggtggagatgggcttccactacgtgggccaggccggcctggagctgctgaccagctag

SEQ ID NO: 19762 - DNA, 507 bp, Artificial Sequence
  Description of Artificial Sequence: Synthetic coding sequence
atgaacgaggtgaaggagagcctgagaagcatcgagcagaagtacaagctgttccagcagcagcagctgaccttcaccgccgccctggagcactgcagagagaacgcccacgacaagatcagacccatcagcagcatcggccaggtgcagagctacatggagcactactgcaacagcagcaccgacagaagagtgctgctgatgttcctggacatctgcagcgagctgaacaagctgtgccagcacttcgaggccgtgcacagcggcacccccgtgaccaacaacctgctggagaagtgcaagaccctggtgagccagagcaacgacctgagcagcctgagagccaagtacccccacgacgtggtgaaccacctgagctgcgacgaggccagaaaccactacggcggcgtggtgagcctgatccccctgatcctggacctgatgaaggagtggatcgcccacagcgagaagctgcccagaaaggtgctgcagcacggcaccacctag

SEQ ID NO: 19763 - DNA, 669 bp, Artificial Sequence
  Description of Artificial Sequence: Synthetic coding sequence
atgaacgaggtgaaggagagcctgagaagcatcgagcagaagtacaagctgttccagcagcagcagctgaccttcaccgccgccctggagcactgcagagagaacgcccacgacaagatcagacccatcagcagcatcggccaggtgcagagctacatggagcactactgcaacagcagcaccgacagaagagtgctgctgatgttcctggacatctgcagcgagctgaacaagctgtgccagcacttcgaggccgtgcacagcggcacccccgtgaccaacaacctgctggagaagtgcaagaccctggtgagccagagcaacgacctgagcagcctgagagccaagtacccccacgacgtggtgaaccacctgagctgcgacgaggccagaaaccactacggcggcgtggtgagcctgatccccctgatcctggacctgatgaaggagtggatcgcccacagcgagaagctgcccagaaaggtgctgcagcacgtgagcgagccccaggcccaccaggagagcaccagaggcgccgccagacccgcccaggccatcggcacccagcccagagccaccaagcacaagtgcagacagctgaccaaggccagcctgaagcccagaggctgcagcaagcccccctggagaccccccggcggcaagctgtag

SEQ ID NO: 19764 - DNA, 669 bp, Artificial Sequence; identical to SEQ ID NO: 19763
  Description of Artificial Sequence: Synthetic coding sequence

SEQ ID NO: 19765 - DNA, 234 bp, Artificial Sequence
  Description of Artificial Sequence: Synthetic coding sequence
atggccagattccagagaaccaaggagagagaggaggacagatgcagcctgaacatctactacgtgagaaacaccacccagggcaccgcccccgcctgcgtgggcaagagaatgcagcccagccccaccggcaagggcggcaagtgctgcaccgtgcacggcctgaccagaaagatccacaacgtgcagcccaacctgcagagccccatcctgagcgccgcctgcgtggactag

SEQ ID NO: 19766 - DNA, 327 bp, Artificial Sequence
  Description of Artificial Sequence: Synthetic coding sequence
atggagctgaacaccaacatcaagagcaagaagggcctgggcagaagaaacctgaagcccatgaacggcgcctggccccccgccagaagagagatggccagattccagagaaccaaggagagagaggaggacagatgcagcctgaacatctactacgtgagaaacaccacccagggcaccgcccccgcctgcgtgggcaagagaatgcagcccagccccaccggcaagggcggcaagtgctgcaccgtgcacggcctgaccagaaagatccacaacgtgcagcccaacctgcagagccccatcctgagcgccgcctgcgtggactag

SEQ ID NO: 19767 - DNA, 234 bp, Artificial Sequence; identical to SEQ ID NO: 19765
  Description of Artificial Sequence: Synthetic coding sequence

SEQ ID NO: 19768 - DNA, 225 bp, Artificial Sequence
  Description of Artificial Sequence: Synthetic coding sequence
tgaaacggcgcctggccccccgccagaagagagatggccagattccagagaaccaaggagagagaggaggacagatgcagcctgaacatctactacgtgagaaacaccacccagggcaccgcccccgcctgcagccagggcagatacatcatgtacagcagaatctacagcctgctgttctgccagctgctggtgctgatcaagaccagcatcaagatcctgtag

SEQ ID NO: 19769 - DNA, 3690 bp, Artificial Sequence
  Description of Artificial Sequence: Synthetic coding sequence
atgaacctgaacaccagcagcaacaccggcgacacccagagactgaagatcgccagcctggacgtgaagcagatcctgaagaacgagaccgagctggacatcaccgacaacctgagaaagaagctgcactgggccaagaaggagaagctggagatcaccaccaagcacaacgccgagctggccagctacgagagccagatcgccaagctgagaagcgaggtggagaagggcgaggccctgagacagagcctggagtacgacctggccgtggccagaaaggaggccggcctgggcagaagagccgccgaggagagactggccgaggcccacagaatccaggagaagctgtgcgcccagaacagcgagctgcaggccaagaccaacgagaccgagaaggccttccagaccagccagcagaagtggaaggaggagtgcagaagattcgagcacgacctggaggagagagacaacatgatccagaactgcaacagagagtacgacctgctgatgaaggagaagagcagactggagaagaccctgcaggaggccctggagaagcaccagagagagaagaacgagatggagagccacatcagagagaccgccctggaggagttcagactgcaggaggagcagtgggaggccgagagaagagagctgcagttcatcgtgcaggagcaggacaccgccgtgcagaacatgcacaagaaggtggagaagctggagaccgagcacatggactgcagcgacctgctgagaagacagaccagcgagctggagttcagcacccagagagaggagagactgagaaaggagttcgaggccaccaccctgagagtgagaaagctggaggagaacatcgaggccgagagagccgcccacctggagagcaagttcaacagcgagatcatccagctgagaatcagagacctggagggcgccctgcaggtggagaaggccagccaggccgaggccgtggccgacctggagatcatcaagaacgagttcaaggaggtggagagcgcctacgagagagagaagcacaacgcccaggagagcttcgccaagctgaacctgctggagaaggagtacttcagcaagaacaagaagctgaacgaggacatcgaggagcagaagaaggtgatcatcgacctgagcaagagactgcagtacaacgagaagagctgcagcgagctgcaggaggagctggtgatggccaagaagcaccaggccttcctggtggagacctgcgagaacaacgtgaaggagctggagagcatcctggacagcttcaccgtgagcggccagtggaccagcggcatccacaaggacaaggacaagccccccagcttcagcgtggtgctggagagactgagaagaaccctgaccgactaccagaacaagctggaggacgccagcaacgaggagaaggcctgcaacgagctggacagcaccaagcagaagatcgacagccacaccaagaacatcaaggagctgcaggacaagctggccgacgtgaacaaggagctgagccacctgcacaccaagtgcgccgacagagaggccctgatcagcaccctgaaggtggagctgcagaacgtgctgcactgctgggagaaggagaaggcccaggccgcccagagcgagagcgagctgcagaagctgagccaggccttccacaaggacgccgaggagaagctgaccttcctgcacaccctgtaccagcacctggtggccggctgcgtgctgatcaagcagcccgagggcatgctggacaagttcagctggagcgagctgtgcgccgtgctgcaggagaacgtggacgccctgatcgccgacctgaacagagccaacgagaagatcagacacctggagtacatctgcaagaacaagagcgacaccatgagagagctgcagcagacccaggaggacaccttcaccaaggtggccgagcagatcaaggcccaggagagctgctggcacagacagaagaaggagctggagctgcagtacagcgagctgttcctggaggtgcagaagagagcccagaagttccaggagatcgccgagaagaacatggagaagctgaaccacatcgagaagagccacgagcagctggtgctggagaacagccacttcaagaagctgctgagccagacccagagagagcagatgagcctgctggccgcctgcgccctgatggccggcgccctgtaccccctgtacagcagaagctgcgccctgagcacccagagagacttcctgcaggagcaggtgaacaccttcgagctgttcaagctggagatcagaaccctggcccaggccctgagcaccgtggaggagaagaagcaggaggaggccaagatgaagaagaagaccttcaagggcctgatcagaatcttcagaaagggcgtgatcgccgtgctggccgccaacagactgaagatcctgggccagagctgcgccagcctgttcacctggatggagagcttcaaggagggcatcggcatgctggtgtgcaccggcgagccccaggacaagcacaagttccccaagcaccagaaggagcagctgagatgcctgcaggccctgagctggctgaccagcagcgacctgctggccgccatcatcagcagcatggccgagctgcaggacgtgatcggcaaggccgaccccaacagcagaatctgcggccacctgctgatcggcgccgccaagaacagcttcgccaagctgatggacaagatcagcctggtgatggagtgcatccccctgcacagcagcagaagcatcacctacgtggagaaggacagcctggtgcagagactggcccacggcctgcacaaggtgaacaccctggccctgaagtacggcctgagaggccacgtgcccatcaccaagagcaccgccagcctgcagaagcagatcctgggcttcacccagagactgcacgccgccgaggtggagagaagaagcctgagactggaggtgaccgagttcaagagaagcgtgaacgagatgaagaaggagctggacaaggcccagggcctgcagatgcagctgaacgagttcaagcagagcaagctgatcacccacgagaagttcgagagcgcctgcgaggagctgaacaacgccctgctgagagaggagcaggcccagatgctgctgaacgagcaggcccagcagctgcaggagctgaactacaagctggagctgcacagcagcgaggaggccgacaagaaccagaccctgggcgaggccgtgaagagcctgagcgaggccaagatggagctgagaagaaaggaccagagcctgagacagctgaacagacacctgacccagctggagcaggacaagagaagactggaggagaacatccacgacgccgagagcgccctgagaatggccgccaaggacaaggagtgcgtggccaaccacatgagagccgtggagaacaccctgcacaaggtgagagaccagatcagcctgagctggagcgccgccagcagaaacgacttcaccctgcagctgcccaagctgcacctggagaccttcgccatggagggcctgaagggcggccccgaggtggtggcctgccaggtgagagtgcagtggtgcgaccacagcagcctgcagagccagatgcccggcctgaagcagagcagctgcctgagcctgctgagcacctag

SEQ ID NO: 19770 - DNA, 411 bp, Artificial Sequence
  Description of Artificial Sequence: Synthetic coding sequence
atgagagccgtggagaacaccctgcacaaggtgagagaccagatcagcctgagctggagcgccgccagcagaaacgacttcaccctgcagctgcccaagctgcacctggagaccttcgccatggagggcctgaagggcggccccgaggtggtggcctgccaggccatgatcaagagcttcatggacgtgtaccagctggccagcaccagaatcatgaccctggagaaggagatgaccagccacagaagccacatcgccgccctgaagagcgagctgcacaccgcctgcctgagagagaacgccagcctgcagagcgacaccttcatcatcagcttcagaagagacggcagcccctgcagcgacagcagcagcatcgagtgcgagaccttcccccaggtgatcctgatgtag

SEQ ID NO: 19771 - DNA, 1497 bp, Artificial Sequence
  Description of Artificial Sequence: Synthetic coding sequence
atggccggcgccctgtaccccctgtacagcagaagctgcgccctgagcacccagagagacttcctgcaggagcaggtgaacaccttcgagctgttcaagctggagatcagaaccctggcccaggccctgagcaccgtggaggagaagaagcaggaggaggccaagatgaagaagaagaccttcaagggcctgatcagaatcttcagaaagggcgtgatcgccgtgctggccgccaacagactgaagatcctgggccagagctgcgccagcctgttcacctggatggagagcttcaaggagggcatcggcatgctggtgtgcaccggcgagccccaggacaagcacaagttccccaagcaccagaaggagcagctgagatgcctgcaggccctgagctggctgaccagcagcgacctgctggccgccatcatcagcagcatggccgagctgcaggacgtgatcggcaaggccgaccccaacagcagaatctgcggccacctgctgatcggcgccgccaagaacagcttcgccaagctgatggacaagatcagcctggtgatggagtgcatccccctgcacagcagcagaagcatcacctacgtggagaaggacagcctggtgcagagactggcccacggcctgcacaaggtgaacaccctggccctgaagtacggcctgagaggccacgtgcccatcaccaagagcaccgccagcctgcagaagcagatcctgggcttcacccagagactgcacgccgccgaggtggagagaagaagcctgagactggaggtgaccgagttcaagagaagcgtgaacgagatgaagaaggagctggacaaggcccagggcctgcagatgcagctgaacgagttcaagcagagcaagctgatcacccacgagaagttcgagagcgcctgcgaggagctgaacaacgccctgctgagagaggagcaggcccagatgctgctgaacgagcaggcccagcagctgcaggagctgaactacaagctggagctgcacagcagcgaggaggccgacaagaaccagaccctgggcgaggccgtgaagagcctgagcgaggccaagatggagctgagaagaaaggaccagagcctgagacagctgaacagacacctgacccagctggagcaggacaagagaagactggaggagaacatccacgacgccgagagcgccctgagaatggccgccaaggacaaggagtgcgtggccaaccacatgagagccgtggagaacaccctgcacaaggtgagagaccagatcagcctgagctggagcgccgccagcagaaacgacttcaccctgcagctgcccaagctgcacctggagaccttcgccatggagggcctgaagggcggccccgaggtggtggcctgccaggtgagagtgagagtgcagtggtgcgaccacagcagcctgcagagccagatgcccggcctgaagcagagcagctgcctgagcctgctgagcacctag

SEQ ID NO: 19772 - DNA, 3981 bp, Artificial Sequence
  Description of Artificial Sequence: Synthetic coding sequence
atgaacctgaacaccagcagcaacaccggcgacacccagagactgaagatcgccagcctggacgtgaagcagatcctgaagaacgagaccgagctggacatcaccgacaacctgagaaagaagctgcactgggccaagaaggagaagctggagatcaccaccaagcacaacgccgagctggccagctacgagagccagatcgccaagctgagaagcgaggtggagaagggcgaggccctgagacagagcctggagtacgacctggccgtggccagaaaggaggccggcctgggcagaagagccgccgaggagagactggccgaggcccacagaatccaggagaagctgtgcgcccagaacagcgagctgcaggccaagaccaacgagaccgagaaggccttccagaccagccagcagaagtggaaggaggagtgcagaagattcgagcacgacctggaggagagagacaacatgatccagaactgcaacagagagtacgacctgctgatgaaggagaagagcagactggagaagaccctgcaggaggccctggagaagcaccagagagagaagaacgagatggagagccacatcagagagaccgccctggaggagttcagactgcaggaggagcagtgggaggccgagagaagagagctgcagttcatcgtgcaggagcaggacaccgccgtgcagaacatgcacaagaaggtggagaagctggagaccgagcacatggactgcagcgacctgctgagaagacagaccagcgagctggagttcagcacccagagagaggagagactgagaaaggagttcgaggccaccaccctgagagtgagaaagctggaggagaacatcgaggccgagagagccgcccacctggagagcaagttcaacagcgagatcatccagctgagaatcagagacctggagggcgccctgcaggtggagaaggccagccaggccgaggccgtggccgacctggagatcatcaagaacgagttcaaggaggtggagagcgcctacgagagagagaagcacaacgcccaggagagcttcgccaagctgaacctgctggagaaggagtacttcagcaagaacaagaagctgaacgaggacatcgaggagcagaagaaggtgatcatcgacctgagcaagagactgcagtacaacgagaagagctgcagcgagctgcaggaggagctggtgatggccaagaagcaccaggccttcctggtggagacctgcgagaacaacgtgaaggagctggagagcatcctggacagcttcaccgtgagcggccagtggaccagcggcatccacaaggacaaggacaagccccccagcttcagcgtggtgctggagagactgagaagaaccctgaccgactaccagaacaagctggaggacgccagcaacgaggagaaggcctgcaacgagctggacagcaccaagcagaagatcgacagccacaccaagaacatcaaggagctgcaggacaagctggccgacgtgaacaaggagctgagccacctgcacaccaagtgcgccgacagagaggccctgatcagcaccctgaaggtggagctgcagaacgtgctgcactgctgggagaaggagaaggcccaggccgcccagagcgagagcgagctgcagaagctgagccaggccttccacaaggacgccgaggagaagctgaccttcctgcacaccctgtaccagcacctggtggccggctgcgtgctgatcaagcagcccgagggcatgctggacaagttcagctggagcgagctgtgcgccgtgctgcaggagaacgtggacgccctgatcgccgacctgaacagagccaacgagaagatcagacacctggagtacatctgcaagaacaagagcgacaccatgagagagctgcagcagacccaggaggacaccttcaccaaggtggccgagcagatcaaggcccaggagagctgctggcacagacagaagaaggagctggagctgcagtacagcgagctgttcctggaggtgcagaagagagcccagaagttccaggagatcgccgagaagaacatggagaagctgaaccacatcgagaagagccacgagcagctggtgctggagaacagccacttcaagaagctgctgagccagacccagagagagcagatgagcctgctggccgcctgcgccctgatggccggcgccctgtaccccctgtacagcagaagctgcgccctgagcacccagagagacttcctgcaggagcaggtgaacaccttcgagctgttcaagctggagatcagaaccctggcccaggccctgagcaccgtggaggagaagaagcaggaggaggccaagatgaagaagaagaccttcaagggcctgatcagaatcttcagaaagggcgtgatcgccgtgctggccgccaacagactgaagatcctgggccagagctgcgccagcctgttcacctggatggagagcttcaaggagggcatcggcatgctggtgtgcaccggcgagccccaggacaagcacaagttccccaagcaccagaaggagcagctgagatgcctgcaggccctgagctggctgaccagcagcgacctgctggccgccatcatcagcagcatggccgagctgcaggacgtgatcggcaaggccgaccccaacagcagaatctgcggccacctgctgatcggcgccgccaagaacagcttcgccaagctgatggacaagatcagcctggtgatggagtgcatccccctgcacagcagcagaagcatcacctacgtggagaaggacagcctggtgcagagactggcccacggcctgcacaaggtgaacaccctggccctgaagtacggcctgagaggccacgtgcccatcaccaagagcaccgccagcctgcagaagcagatcctgggcttcacccagagactgcacgccgccgaggtggagagaagaagcctgagactggaggtgaccgagttcaagagaagcgtgaacgagatgaagaaggagctggacaaggcccagggcctgcagatgcagctgaacgagttcaagcagagcaagctgatcacccacgagaagttcgagagcgcctgcgaggagctgaacaacgccctgctgagagaggagcaggcccagatgctgctgaacgagcaggcccagcagctgcaggagctgaactacaagctggagctgcacagcagcgaggaggccgacaagaaccagaccctgggcgaggccgtgaagagcctgagcgaggccaagatggagctgagaagaaaggaccagagcctgagacagctgaacagacacctgacccagctggagcaggacaagagaagactggaggagaacatccacgacgccgagagcgccctgagaatggccgccaaggacaaggagtgcgtggccaaccacatgagagccgtggagaacaccctgcacaaggtgagagaccagatcagcctgagctggagcgccgccagcagaaacgacttcaccctgcagctgcccaagctgcacctggagaccttcgccatggagggcctgaagggcggccccgaggtggtggcctgccaggccatgatcaagagcttcatggacgtgtaccagctggccagcaccagaatcatgaccctggagaaggagatgaccagccacagaagccacatcgccgccctgaagagcgagctgcacaccgcctgcctgagagagaacgccagcctgcagagcatcggcagcagagaccacagcaacctgagcatccccagcagagcccccctgcccgccgacaccaccggcatcggcgacttcctgcccctgaaggccgagctggacaccacctacaccttcctgaaggagaccttcatcaacaccgtgccccacgccctgaccagcagccacagcagccccgtgaccatgagcgccaacgccaacagacccacccagatcggcctgtag

SEQ ID NO: 19773 - DNA, 774 bp, Artificial Sequence
  Description of Artificial Sequence: Synthetic coding sequence
tgacacaaggtgaacaccctggccctgaagtacggcctgagaggccacgtgcccatcaccaagagcaccgccagcctgcagaagcagatcctgggcttcacccagagactgcacgccgccgaggtggagagaagaagcctgagactggaggtgaccgagttcaagagaagcgtgaacgagatgaagaaggagctggacaaggcccagggcctgcagatgcagctgaacgagttcaagcagagcaagctgatcacccacgagaagttcgagagcgcctgcgaggagctgaacaacgccctgctgagagaggagcaggcccagatgctgctgaacgagcaggcccagcagctgcaggagctgaactacaagctggagctgcacagcagcgaggaggccgacaagaaccagaccctgggcgaggccgtgaagagcctgagcgaggccaagatggagctgagaagaaaggaccagagcctgagacagctgaacagacacctgacccagctggagcaggacaagagaagactggaggagaacatccacgacgccgagagcgccctgagaatggccgccaaggacaaggagtgcgtggccaaccacatgagagccgtggagaacaccctgcacaaggtgagagaccagatcagcctgagctggagcgccgccagcagaaacgacttcaccctgcagctgcccaagctgcacctggagaccttcgccatggagggcctgaagggcggccccgaggtggtggcctgccaggtgagagtgtag

SEQ ID NO: 19774 - DNA, 1416 bp, Artificial Sequence
  Description of Artificial Sequence: Synthetic coding sequence
tgattcgagctgttcaagctggagatcagaaccctggcccaggccctgagcaccgtggaggagaagaagcaggaggaggccaagatgaagaagaagaccttcaagggcctgatcagaatcttcagaaagggcgtgatcgccgtgctggccgccaacagactgaagatcctgggccagagctgcgccagcctgttcacctggatggagagcttcaaggagggcatcggcatgctggtgtgcaccggcgagccccaggacaagcacaagttccccaagcaccagaaggagcagctgagatgcctgcaggccctgagctggctgaccagcagcgacctgctggccgccatcatcagcagcatggccgagctgcaggacgtgatcggcaaggccgaccccaacagcagaatctgcggccacctgctgatcggcgccgccaagaacagcttcgccaagctgatggacaagatcagcctggtgatggagtgcatccccctgcacagcagcagaagcatcacctacgtggagaaggacagcctggtgcagagactggcccacggcctgcacaaggtgaacaccctggccctgaagtacggcctgagaggccacgtgcccatcaccaagagcaccgccagcctgcagaagcagatcctgggcttcacccagagactgcacgccgccgaggtggagagaagaagcctgagactggaggtgaccgagttcaagagaagcgtgaacgagatgaagaaggagctggacaaggcccagggcctgcagatgcagctgaacgagttcaagcagagcaagctgatcacccacgagaagttcgagagcgcctgcgaggagctgaacaacgccctgctgagagaggagcaggcccagatgctgctgaacgagcaggcccagcagctgcaggagctgaactacaagctggagctgcacagcagcgaggaggccgacaagaaccagaccctgggcgaggccgtgaagagcctgagcgaggccaagatggagctgagaagaaaggaccagagcctgagacagctgaacagacacctgacccagctggagcaggacaagagaagactggaggagaacatccacgacgccgagagcgccctgagaatggccgccaaggacaaggagtgcgtggccaaccacatgagagccgtggagaacaccctgcacaaggtgagagaccagatcagcctgagctggagcgccgccagcagaaacgacttcaccctgcagctgcccaagctgcacctggagaccttcgccatggagggcctgaagggcggccccgaggtggtggcctgccaggtgagagtgagagtgcagtggtgcgaccacagcagcctgcagagccagatgcccggcctgaagcagagcagctgcctgagcctgctgagcacctag

SEQ ID NO: 19775 - DNA, 954 bp, Artificial Sequence
  Description of Artificial Sequence: Synthetic coding sequence
atgaacctgaacaccagcagcaacaccggcgacacccagagactgaagatcgccagcctggacgtgaagcagatcctgaagaacgagaccgagctggacatcaccgacaacctgagaaagaagctgcactgggccaagaaggagaagctggagatcaccaccaagcacaacgccgagctggccagctacgagagccagatcgccaagctgagaagcgaggtggagaagggcgaggccctgagacagagcctggagtacgacctggccgtggccagaaaggaggccggcctgggcagaagagccgccgaggagagactggccgaggcccacagaatccaggagaagctgtgcgcccagaacagcgagctgcaggccaagaccaacgagaccgagaaggccttccagaccagccagcagaagtggaaggaggagtgcagaagattcgagcacgacctggaggagagagacaacatgatccagaactgcaacagagagtacgacctgctgatgaaggagaagagcagactggagaagaccctgcaggaggccctggagaagcaccagagagagaagaacgagatggagagccacatcagagagaccgccctggaggagttcagactgcaggaggagcagtgggaggccgagagaagagagctgcagttcatcgtgcaggagcaggacaccgccgtgcagaacatgcacaagaaggtggagaagctggagaccgagcacatggactgcagcgacctgctgagaagacagaccagcgagctggagttcagcacccagagagaggagagactgagaaaggagttcgaggccaccaccctgagagtgagaaagctggaggagaacatcgaggccgagagagccgcccacctggagagcaagttcaacagcgagatcatccaggtgaagtgcaagcagatcttctggcccgccttcagctag

SEQ ID NO: 19776 - DNA, 600 bp, Artificial Sequence
  Description of Artificial Sequence: Synthetic coding sequence
atgaagaccttcatcatcggcatcagcggcgtgaccaacagcggcaagaccaccctggccaagaacctgcagaagcacctgcccaactgcagcgtgatcagccaggacgacttcttcaagcccgagagcgagatcgagaccgacaagaacggcttcctgcagtacgacgtgctggaggccctgaacatggagaagatgatgagcgccatcagctgctggatggagagcgccagacacagcgtggtgagcaccgaccaggagagcgccgaggagatccccatcctgatcatcgagggcttcctgctgttcaactacaagcccctggacaccatctggaacagaagctacttcctgaccatcccctacgaggagtgcaagagaagaagaagcaccagagtgtaccagccccccgacagccccggctacttcgacggccacgtgtggcccatgtacctgaagtacagacaggagatgcaggacatcacctgggaggtggtgtacctggacggcaccaagagcgaggaggacctgttcctgcaggtgtacgaggacctgatccaggagctggccaagcagaagtgcctgcaggtgaccgcctag

SEQ ID NO: 19777 - DNA, 558 bp, Artificial Sequence
  Description of Artificial Sequence: Synthetic coding sequence
atgggcaagagaagacacagaagaggcaacgtgatcagctgcgtgaccaacagcggcaagaccaccctggccaagaacctgcagaagcacctgcccaactgcagcgtgatcagccaggacgacttcttcaagcccgagagcgagatcgagaccgacaagaacggcttcctgcagtacgacgtgctggaggccctgaacatggagaagatgatgagcgccatcagctgctggatggagagcgccagacacagcgtggtgagcaccgaccaggagagcgccgaggagatccccatcctgatcatcgagggcttcctgctgttcaactacaagcccctggacaccatctggaacagaagctacttcctgaccatcccctacgaggagtgcaagagaagaagaagcaccagagtgtaccagccccccgacagccccggctacttcgacggccacgtgtggcccatgtacctgaagtacagacaggagatgcaggacatcacctgggaggtggtgtacctggacggcaccaagagcgaggaggacctgttcctgcaggtgtag

SEQ ID NO: 19778 - DNA, 528 bp, Artificial Sequence
  Description of Artificial Sequence: Synthetic coding sequence
atgaagaccttcatcatcggcatcagcggcgtgaccaacagcggcaagaccaccctggccaagaacctgcagaagcacctgcccaactgcagcgtgatcagccaggacgacttcttcaagcccgagagcgagatcgagaccgacaagaacggcttcctgcagtacgacgtgctggaggccctgaacatggagaagatgatgagcgccatcagctgctggatggagagcgccagacacagcgtggtgagcaccgaccaggagagcgccgaggagatccccatcctgatcatcgagggcttcctgctgttcaactacaacaccagagtgtaccagccccccgacagccccggctacttcgacggccacgtgtggcccatgtacctgaagtacagacaggagatgcaggacatcacctgggaggtggtgtacctggacggcaccaagagcgaggaggacctgttcctgcaggtgtacgaggacctgatccaggagctggccaagcagaagtgcctgcaggtgaccgcctag

SEQ ID NO: 19779 - DNA, 612 bp, Artificial Sequence
  Description of Artificial Sequence: Synthetic coding sequence
atgggcaagagaagacacagaagaggcaacgtgatcagctgcgtgaccaacagcggcaagaccaccctggccaagaacctgcagaagcacctgcccaactgcagcgtgatcagccaggacgacttcttcaagcccgagagcgagatcgagaccgacaagaacggcttcctgcagtacgacgtgctggaggccctgaacatggagaagatgatgagcgccatcagctgctggatggagagcgccagacacagcgtggtgagcaccgaccaggagagcgccgaggagatccccatcctgatcatcgagggcttcctgctgttcaactacaagcccctggacaccatctggaacagaagctacttcctgaccatcccctacgaggagtgcaagagaagaagaagcaccagagtgtaccagccccccgacagccccggctacttcgacggccacgtgtggcccatgtacctgaagtacagacaggagatgcaggacatcacctgggaggtggtgtacctggacggcaccaagagcgaggaggacctgttcctgcaggtgtacgaggacctgatccaggagctggccaagcagaagtgcctgcaggtgaccgcctag

SEQ ID NO: 19780 - DNA, 642 bp, Artificial Sequence
  Description of Artificial Sequence: Synthetic coding sequence
atggagctgcacgacagagtgctggacgtgcagctgtgcgcctgcagcctgctgctgcacctgctgggccagggcatcatcgtgaacaaggcccccctggagaaggtgcccgacctgatcagccaggtgctggccacctaccccgccgacggcgagatggccgaggccagctgcggcgtgttctggctgctgagcctgctgggctgcatcaaggagcagcagttcgagcaggtggtggccctgctgctgcagagcatcagactgtgccaggacagagccctgctggtgaacaacgcctacagaggcctggccagcctggtgaaggtgagcgagctggccgccttcaaggtggtggtgcaggaggagggcggcagcggcctgagcctgatcaaggagacctaccagctgcacagagacgaccccgaggtggtggagaacgtgggcatgctgctggtgcacctggccagctacgaggagatcctgcccgagctggtgagcagcagcatgaaggccctgctgcaggagatcaaggagagattcaccagcagcctggtgagcgacagcagcgccttcagcaagcccggcctgccccccggcggcagcccccagctgggctgcaccaccagcggcggcctggagtag

SEQ ID NO: 19781 - DNA, 2043 bp, Artificial Sequence
  Description of Artificial Sequence: Synthetic coding sequence
atgctgggccccggcagcaacagaagaagacccacccagggcgagagaggccccggcagccccggcgagcccatggagaagtaccaggtgctgtaccagctgaaccccggcgccctgggcgtgaacctggtggtggaggagatggagaccaaggtgaagcacgtgatcaagcaggtggagtgcatggacgaccactacgccagccaggccctggaggagctgatgcccctgctgaagctgagacacgcccacatcagcgtgtaccaggagctgttcatcacctggaacggcgagatcagcagcctgtacctgtgcctggtgatggagttcaacgagctgagcttccaggaggtgatcgaggacaagagaaaggccaagaagatcatcgacagcgagtggatgcagaacgtgctgggccaggtgctggacgccctggagtacctgcaccacctggacatcatccacagaaacctgaagcccagcaacatcatcctgatcagcagcgaccactgcaagctgcaggacctgagcagcaacgtgctgatgaccgacaaggccaagtggaacatcagagccgaggaggaccccttcagaaagagctggatggcccccgaggccctgaacttcagcttcagccagaagagcgacatctggagcctgggctgcatcatcctggacatgaccagctgcagcttcatggacggcaccgaggccatgcacctgagaaagagcctgagacagagccccggcagcctgaaggccgtgctgaagaccatggaggagaagcagatccccgacgtggagaccttcagaaacctgctgcccctgatgctgcagatcgaccccagcgacagaatcaccatcaaggacgtggtgcacatcaccttcctgagaggcagcttcaagagcagctgcgtgagcctgaccctgcacagacagatggtgcccgccagcatcaccgacatgctgctggagggcaacgtggccagcatcctggaggtgatgcagaagttcagcggctggcccgaggtgcagctgagagccatgaagagactgctgaagatgcccgccgaccagctgggcctgccctggccccccgagctggtggaggtggtggtgaccaccatggagctgcacgacagagtgctggacgtgcagctgtgcgcctgcagcctgctgctgcacctgctgggccaggccctggtgcaccaccccgaggccaaggccccctgcaaccaggccatcaccagcaccctgctgagcgccctgcagagccaccccgaggaggagcccctgctggtgatggtgtacagcctgctggccatcaccaccacccaggagagcgagagcctgagcgaggagctgcagaacgccggcctgctggagcacatcctggagcacctgaacagcagcctgaagagcagagacgtgtgcgccagcggcctgggcctgctgtgggccctgctgctggacggcatcatcgtgaacaaggcccccctggagaaggtgcccgacctgatcagccaggtgctggccacctaccccgccgacggcgagatggccgaggccagctgcggcgtgttctggctgctgagcctgctgggctgcatcaaggagcagcagttcgagcaggtggtggccctgctgctgcagagcatcagactgtgccaggacagagccctgctggtgaacaacgcctacagaggcctggccagcctggtgaaggtgagcgagctggccgccttcaaggtggtggtgcaggaggagggcggcagcggcctgagcctgatcaaggagacctaccagctgcacagagacgaccccgaggtggtggagaacgtgggcatgctgctggtgcacctggccagctacgaggagatcctgcccgagctggtgagcagcagcatgaaggccctgctgcaggagatcaaggagagattcaccagcagcctggtgagcgacagcagcgccttcagcaagcccggcctgccccccggcggcagcccccagctgggctgcaccaccagcggcggcctggagtag

SEQ ID NO: 19782 - DNA, 486 bp, Artificial Sequence
  Description of Artificial Sequence: Synthetic coding sequence
atgctgggccccggcagcaacagaagaagacccacccagggcgagagaggccccggcagccccggcgagcccatggagaagtaccaggtgctgtaccagctgaaccccggcgccctgggcgtgaacctggtggtggaggagatggagaccaaggtgaagcacgtgatcaagcaggtggagtgcatggacgaccactacgccagccaggccctggaggagctgatgcccctgctgaagctgagacacgcccacatcagcgtgtaccaggagctgttcatcacctggaacggcgagatcagcagcctgtacctgtgcctggtgatggagttcaacgagctgagcttccaggaggtgatcgaggacaagagaaaggccaagaagatcatcgacagcgagatcaagaccgagggcgtgcccaacaccagaagattccccgtgggcgaccacgacagcagactgttctgcagaagcctgaagttcctgtag

SEQ ID NO: 19783 - DNA, 906 bp, Artificial Sequence
  Description of Artificial Sequence: Synthetic coding sequence
atgctgagcgagggctacctgagcggcctggagtactggaacgacatccactggagctgcgccagctacaacgagcaggtggccggcgagaaggaggaggagaccaacagcgtggccaccctgagctacagcagcgtggacgagacccaggtgagaagcctgtacgtgagctgcaagagcagcggcaagttcatcagcagcgtgcacagcagagagagccagcacagcagaagccagagagtgaccgtgctgcagaccaaccccaaccccgtgttcgagagccccaacctggccgccgtggagatctgcagagacgccagcagagagacctacctggtgcccagcagctgcaagagcatctgcaagaactacaacgacctgcagatcgccggcggccaggtgatggccatcaacagcgtgaccaccgacttccccagcgagagcagcttcgagtacggccccctgctgaagagcagcgagatccccctgcccatggaggacagcatcagcacccagcccagcgacttcccccagaagcccatccagagatacagcagctactggagaatcaccagcatcaaggagaagagcagcctgcagatgcagaaccccatcagcaacgccgtgctgaacgagtacctggagcagaaggtggtggagctgtacaagcagtacatcatggacaccgtgttccacgacagcagccccacccagatcctggccagcgagctgatcatgaccagcgtggaccagatcagcctgcaggtgagcagagagaagaacctggagaccagcaaggccagagacatcgtgttcagcagactgctgcagctgatgagcaccgagatcaccgagatcagcacccccagcctgcacatcagccagtacagcaacgtgaacccctag

SEQ ID NO: 19784 - DNA, 2931 bp, Artificial Sequence
  Description of Artificial Sequence: Synthetic coding sequence
atgaacacccagaagggcagcctgaccatcaacgtgcacagaggcagcctggccatgagcatccagagaggcagcctggtgcccagagacatggacagcagcggcagagacatgcagctgagagtgatccccgccgaggtgaagttcctggacaccatggccggcagagtgtacagactgcccatcaccgtgcacaacatctgcagatggaaccagaagatcagattcaaggagcccgtgaagccccagttcaagctgatgctgaccagcctggacaaggagctggccagcggcctgcagatgaccgccatggtggagtaccaccccgacaaggacgaggacaccttcgacagactgctgatcagcatcgagaacaagaccaccgagatccccctgatcggcctgatccccagctgccagctggagatcgagagcgtggtgaacttcggcaccctggtggccaacagcaaggtgtacagcaaggagatcaccatcaccaaccacggcaaggcccccggcatcttcaaggccgagtaccacggccagctgcccatcctgatcttccccaccagcggcatcgtggacgccaagagcagcatggtgatcaaggtggacttctgcgccgaccagcccagaatcgtggacgaggaggccatcgtgatcctgcagggccagcccgagatgctgctgagcatcaaggcccacgtggtggagcagatcatcgagctgctgagcatgagcagcgacagaagactggagtgcatccacttcggccccgtgttcttcggcagcagcaagatcaagcacgccagagtgtacaacaacagccccgagcccatcaactgggtggccatcatccaggacgacgccgtgggcgaggagctgggcaccgacatccagcagagaaccgacatcgccctgaacaacctgacctacatcagaaagatcaagaacatcgacaccaccatcatcatcagctgcctgcccaacgagggcaccctgcagccctaccagaagaccgtgatcaccttctgcttcacccccaagctgatggccgtgggcaagaaggacatcggccccagctacagacaggactacgccctgttcctgagattcgagagcgtgggcagcaaggacggcttcctgagagacgacgactacaagaccatcaagagcgagagattccagaaggtggagctggccctgaccggcaccggcctgcccgtgctgctgcagttcgaccccggccccgtgctgaacttcaagccctgcttcatgggcgagagaagcgagatccagtgcatcatcaagaaccagtgcgagctgctgcccgtgacctaccacttcaagaagaccgccaacttcgagatcgaccccgagaagggcaagatcaccggcggcggcatggtggacgtgatgtgcagcttcgtgccccaccagctgggcgtgttcaaggtgaagcagatgatcgagatcatcggcctggtggccgaggaggacctgcagagcctgagcgtgaagagcttccaccacgtgtacctggccttcaacagcatctgcaaggccagcaccaagaaggtggtgatgaagttcgaccccggcatcctgcccagcatcagaaaccccaccggcaagttcgtggtgaaggacctggccaagagaaagaactacgcccccgtggccatgctgcagagcgccatgaccagaacccacaaccacagaagctgcgaggagcccgtgaaggacatgctgctggccttccccaacgacagagccgccaccatcagaagcaaggaccaccacaagcacttcagacccatcttcaccaaggtgcccagattcaactacgtgaaccacgacttcgcctacaccaccttcgagaagcagcagaagaagctgcacgagaactactacgccatgtacctgaagtacctgagaagcgtgagactgcagaagaagcaggccgagagagagagaatgtacagctacgacgacaccgacatcggcctggagcccggcagcggcctgaagagccccagcctgagcgaggccgagatcgaggaggagctgagcagcgccgccaacagcatcagagccaacagactgctgaccaccagaggcatcgccagccaggaggaggagagcgtgagaagaaaggtgctgaagggcctgaagagcgagcccagcaccccccaggagaagcacgactgcagcctgatgctgacccccaagcagatccaccaggtgatcgtgggccccagcgtgctgaacttcggcaacatctgcgtgaacagccccaacacccacctgctgcacgtgatcaacatgctgcccatgcacgtgctgctgcagctggacaccgacctggaggagctgcagaagaccaaccagttcagctacgtgatcctgcccaccagcagcacctacatcagcatggtgttcgacagccccaccatcggcaagttctggaagagcttcaccttcaccgtgaacaacgtgcccagcggccacatcctggtggtggccgtggtgcagcccgtgaccctggagctgagcagcaacgagctggtgctgagacccagaggcttcttcatgaagacctgcttcagaggcaccgtgagactgtacaacagacagaactgctgcgcccagttccagtggcagcccgtgaacaccggcagaggcatcgccttcagcatctgccccgccaagggcaccgtggaggcctacagcagcctggagtgcgaggtgacctggcagcagggcttcagcagccccgaggagggcgagttcatcctgcacgtgttccagggcaacgccctgaagctgaagtgcgtggcccacgtgatcatcttcctggagcacggcttctgcttcgagggctacgagttcgtgggctacaccctggtgtacatcgtgacctacatctag

SEQ ID NO: 19785 - DNA, 705 bp, Artificial Sequence
  Description of Artificial Sequence: Synthetic coding sequence
tgaagccagaagctgcccgacgtgaagcccagccccatcaacctgagaaagaagagcctgaccgtgaaggtggacgtgaagaagaccgtggacaccttcagagtggccagcagctacagcaccgagagacagatgagccacgacctggtggccgtgggcagaaagagcgagaacttccaccccgtgttcgagcacctggacagcacccagaacaccgagaacaagcccaccggcgagttcgcccaggagatcatcaccatcatccaccaggtgaaggccaactacttccccagccccggcatcaccctgcacgagagattcagcaccatgcaggacatccacaaggccgacgtgaacgagatccccctgaacagcgaccccgagatccacagaagaatcgacatgagcctggccgagctgcagagcaagcaggccgtgatctacgagagcgagcagaccctgatcaagatcatcgaccccaacgacctgagacacgacatcgagagaagaagaaaggagagactgcagaacgaggacgagcacatcttccacatcgccagcgccgccgagagagacgaccagaacagcagcttcagcaagggcctggccctgagccccagactggagtgcggcgtgaccatcaccgcctactgcagcctgtacctgcaggacagcagctacctgcccccccagccccccgagtag

SEQ ID NO: 19786 - DNA, 1878 bp, Artificial Sequence
  Description of Artificial Sequence: Synthetic coding sequence
atggccagaagcagaagcagaagccccagatggaagcacagaagcctgagccccgtgcccagaaacgccgagcactacaagcagagacacagccacggccactacggctgcgagtacagaaaggaccccaagagacccgtggcctggagaatggacagcgagaagcacggccagagcaagcccagaatccccagcagaggcaacatctactaccagagctacgagcacagaagccccagccccaacatcagaaacagcctggagaacgtgtacatgtacaagccccacagaggctacagccccggcagaggcgacagcaacagaagagcccagtacatgcccaagtacagcgagggcatcccctacaaggagcacgagagaaacagctacccccagaaggtgcagggcggccacagccccgacgaccacagagtgagaggcagcggcaagggcggcaagcccccccagagaagcatcgccgacagcttcagattcgagggcaagtggcacgaggacgagctgagacaccagagaatccaggaggagaagtacagccagagcaccagaagaggcagcgaggacttcgagaccagaagcagcttccagaagagataccccgaggacagagacttcagaaagtacggccacaccagcaagagacccaaggacgtggagagatacgagagcagagagcccgccagaaaccccaagtggaagcccgagcacagcctgcccccctaccaggaggacaccgaccagtggaacctgggcccccagacctacagacacgccgagagagagcaccccgagaccagcagcgccaccaaggtgagctacgactacagacacaagagacccaagctgctggacggcgaccaggacttcagcgacggcagaacccagaagtactgcaaggaggaggacagaaagtacagcttccagaagggccccctgaacagagagctggactgcttcaacaccggcagaggcagagagacccaggacggccaggtgaaggagcccttcaagcccagcaagaaggacagcatcgcctgcacctacagcaacaagaacgacgtggacctgagaagcagcaacgacaagtggaaggagaagatcaagaaggagggcgactgcagaaaggagagcaacagcagcagcaaccagctggacaagagccagaagctgcccgacgtgaagcccagccccatcaacctgagaaagaagagcctgaccgtgaaggtggacgtgaagaagaccgtggacaccttcagagtggccagcagctacagcaccgagagacagatgagccacgacctggtggccgtgggcagaaagagcgagaacttccaccccgtgttcgagcacctggacagcacccagaacaccgagaacaagcccaccggcgagttcgcccaggagatcatcaccatcatccaccaggtgaaggccaactacttccccagccccggcatcaccctgcacgagagattcagcaccatgcaggacatccacaaggccgacgtgaacgagatccccctgaacagcgaccccgagatccacagaagaatcgacatgagcctggccgagctgcagagcaagcaggccgtgatctacgagagcgagcagaccctgatcaagatcatcgaccccaacgacctgagacacgacatcgagagaagaagaaaggagagactgcagaacgaggacgagcacatcttccacatcgccagcgccgccgagagagacgaccagaacagcagcttcagcaagggcctggccctgagccccagactggagtgcggcgtgaccatcaccgcctactgcagcctgtacctgcaggacagcagctacctgcccccccagccccccgagtag

SEQ ID NO: 19787 - DNA, 2049 bp, Artificial Sequence
  Description of Artificial Sequence: Synthetic coding sequence
atggccagaagcagaagcagaagccccagatggaagcacagaagcctgagccccgtgcccagaaacgccgagcactacaagcagagacacagccacggccactacggctgcgagtacagaaaggaccccaagagacccgtggcctggagaatggacagcgagaagcacggccagagcaagcccagaatccccagcagaggcaacatctactaccagagctacgagcacagaagccccagccccaacatcagaaacagcctggagaacgtgtacatgtacaagccccacagaggctacagccccggcagaggcgacagcaacagaagagcccagtacatgcccaagtacagcgagggcatcccctacaaggagcacgagagaaacagctacccccagaaggtgcagggcggccacagccccgacgaccacagagtgagaggcagcggcaagggcggcaagcccccccagagaagcatcgccgacagcttcagattcgagggcaagtggcacgaggacgagctgagacaccagagaatccaggaggagaagtacagccagagcaccagaagaggcagcgaggacttcgagaccagaagcagcttccagaagagataccccgaggacagagacttcagaaagtacggccacaccagcaagagacccaaggacgtggagagatacgagagcagagagcccgccagaaaccccaagtggaagcccgagcacagcctgcccccctaccaggaggacaccgaccagtggaacctgggcccccagacctacagacacgccgagagagagcaccccgagaccagcagcgccaccaaggtgagctacgactacagacacaagagacccaagctgctggacggcgaccaggacttcagcgacggcagaacccagaagtactgcaaggaggaggacagaaagtacagcttccagaagggccccctgaacagagagctggactgcttcaacaccggcagaggcagagagacccaggacggccaggtgaaggagcccttcaagcccagcaagaaggacagcatcgcctgcacctacagcaacaagaacgacgtggacctgagaagcagcaacgacaagtggaaggagaagatcaagaaggagggcgactgcagaaaggagagcaacagcagcagcaaccagctggacaagagccagaagctgcccgacgtgaagcccagccccatcaacctgagaaagaagagcctgaccgtgaaggtggacgtgaagaagaccgtggacaccttcagagtggccagcagctacagcaccgagagacagatgagccacgacctggtggccgtgggcagaaagagcgagaacttccaccccgtgttcgagcacctggacagcacccagaacaccgagaacaagcccaccggcgagttcgcccaggagatcatcaccatcatccaccaggtgaaggccaactacttccccagccccggcatcaccctgcacgagagattcagcaccatgcaggacatccacaaggccgacgtgaacgagatccccctgaacagcgaccccgagatccacagaagaatcgacatgagcctggccgagctgcagagcaagcaggccgtgatctacgagagcgagcagaccctgatcaagatcatcgaccccaacgacctgagacacgacatcgagagaagaagaaaggagagactgcagaacgaggacgagcacatcttccacatcgccagcgccgccgagagagacgaccagaacagcagcttcagcaagaactacaccacccagagaaaggacatcatcacccacaagcccttcgaggtggagggcaaccacagaaacaccagagtgagacccttcaagagcaacttcagaggcggcagatgccagcccaactacaagagcggcctggtgcagaagagcctgtacatccaggccaagtaccagagactgagattcaccggccccagaggcttcatcacccacaagttcagagagagactgatgagaaagaagaaggagtacaccgacgtggccaccggcatctag

SEQ ID NO: 19788 - DNA, 1467 bp, Artificial Sequence
  Description of Artificial Sequence: Synthetic coding sequence
atgcccaagtacagcgagggcatcccctacaaggagcacgagagaaacagctacccccagaaggtgcagggcggccacagccccgacgaccacagagtgagaggcagcggcaagggcggcaagcccccccagagaagcatcgccgacagcttcagattcgagggcaagtggcacgaggacgagctgagacaccagagaatccaggaggagaagtacagccagagcaccagaagaggcagcgaggacttcgagaccagaagcagcttccagaagagataccccgaggacagagacttcagaaagtacggccacaccagcaagagacccaaggacgtggagagatacgagagcagagagcccgccagaaaccccaagtggaagcccgagcacagcctgcccccctaccaggaggacaccgaccagtggaacctgggcccccagacctacagacacgccgagagagagcaccccgagaccagcagcgccaccaaggtgagctacgactacagacacaagagacccaagctgctggacggcgaccaggacttcagcgacggcagaacccagaagtactgcaaggaggaggacagaaagtacagcttccagaagggccccctgaacagagagctggactgcttcaacaccggcagaggcagagagacccaggacggccaggtgaaggagcccttcaagcccagcaagaaggacagcatcgcctgcacctacagcaacaagaacgacgtggacctgagaagcagcaacgacaagtggaaggagaagatcaagaaggagggcgactgcagaaaggagagcaacagcagcagcaaccagctggacaagagccagaagctgcccgacgtgaagcccagccccatcaacctgagaaagaagagcctgaccgtgaaggtggacgtgaagaagaccgtggacaccttcagagtggccagcagctacagcaccgagagacagatgagccacgacctggtggccgtgggcagaaagagcgagaacttccaccccgtgttcgagcacctggacagcacccagaacaccgagaacaagcccaccggcgagttcgcccaggagatcatcaccatcatccaccaggtgaaggccaactacttccccagccccggcatcaccctgcacgagagattcagcaccatgcaggacatccacaaggccgacgtgaacgagatccccctgaacagcgaccccgagatccacagaagaatcgacatgagcctggccgagctgcagagcaagcaggccgtgatctacgagagcgagcagaccctgatcaagatcatcgaccccaacgacctgagacacgacatcgagagaagaagaaaggagagactgcagaacgaggacgagcacatcttccacatcgccagcgccgccgagagagacgaccagaacagcagcttcagcaaggtgaacaccagcaagtgcgccggcatctag

SEQ ID NO: 19789 - DNA, 285 bp, Artificial Sequence
  Description of Artificial Sequence: Synthetic coding sequence
atgggcgccctgttcagactgctgctgcaggagagaggcaaggccgccgagttctacagcagaggcagaaagcagagaagacccagcgccagctgcaccttcggcggcatctggagcagcggcgtggacatgctgcccaacggcgccgtgggcagcctgacccagctgggccccagcagacccgtgctgggcatcgactacagcaagaaggagttcagaggcaccgccgagaacgtgaccggcctgaacaccatcctgcacttcagaaagagaaccagaagctag

SEQ ID NO: 19790 - DNA, 699 bp, Artificial Sequence
  Description of Artificial Sequence: Synthetic coding sequence
atggccgccaccagcggcaccgacgagcccgtgagcggcgagctggtgagcgtggcccacgccctgagcctgcccgccgagagctacggcaacgaccccgacatcgagatggcctgggccatgagagccatgcagcacgccgaggtgtactacaagctgatcagcagcgtggacccccagttcctgaagctgaccaaggtggacgaccagatctacagcgagttcagaaagaacttcgagaccctgagaatcgacgtgctggaccccgaggagctgaagagcgagagcgccaaggagccccccggctacaacagcctgcccctgaagctgctgggcaccggcaaggccatcaccaagctgttcatcagcgtgttcagaaccaagaaggagagaaaggagagcaccatggaggagaagaaggagctgaccgtggagaagaagagaacccccagaatggaggagagaaaggagctgatcgtggagaagaagaagagaaaggagagcaccgagaagaccaagctgaccaaggaggagaagaagggcaagaagctgaccaagaagagcaccaaggtggtgaagaagctgtgcaaggtgtacagagagcagcacagcagaagctacgacagcatcgagaccaccagcaccaccgtgctgctggcccagacccccctggtgaagtgcaagttcctgtacaactag

SEQ ID NO: 19791 - DNA, 702 bp, Artificial Sequence
  Description of Artificial Sequence: Synthetic coding sequence
atggccgccaccagcggcaccgacgagcccgtgagcggcgagctggtgagcgtggcccacgccctgagcctgcccgccgagagctacggcaacgaccccgacatcgagatggcctgggccatgagagccatgcagcacgccgaggtgtactacaagctgatcagcagcgtggacccccagttcctgaagctgaccaaggtggacgaccagatctacagcgagttcagaaagaacttcgagaccctgagaatcgacgtgctggaccccgaggagctgaagagcgagagcgccaaggagaagtggagacccttctgcctgaagttcaacggcatcgtggaggacttcaactacggcaccctgctgagactggactgcagccagggctacaccgaggagaacaccatcttcgcccccagaatccagttcttcgccatcgagatcgccagaaacagagagggctacaacaaggccgtgtacatcagcgtgcaggacaaggagggcgagaagggcgtgaacaacggcggcgagaagagagccgacagcggcgaggaggagaacaccaagaacggcggcgagaagggcgccgacagcggcgaggagaaggaggagggcatcaacagagaggacaagaccgacaagggcggcgagaagggcaaggaggccgacaaggagatcaacaagagcggcgagaaggccatgtag

SEQ ID NO: 19792 - DNA, 354 bp, Artificial Sequence
  Description of Artificial Sequence: Synthetic coding sequence
atgagcgagaagaagaactgcaagaacagcagcaccaacaacaaccagacccaggaccccagcagaaacgagctgcaggtgcccagaagcttcgtggacagagtggtgcaggacgagagagacgtgcagagccagagcagcagcaccatcaacaccctgctgaccctgctggactgcctggccgactacatcatggagagagtgggcctggaggccagcaacaacggcagcatgagaaacaccagccaggacagagagagagaggtggacaacaacagagagccccacagcgccgagagcgacgtgaccagattcctgttcgacgagatgcccaagagcagaaagaacgactag

SEQ ID NO: 19793 - DNA, 270 bp, Artificial Sequence
  Description of Artificial Sequence: Synthetic coding sequence
atgggcgagctggccgccagcgccaaccacggccacagcccctgctaccccgagagaaagggcacccccggcgacctgagcaagagaaagatgctggtgcacttctaccccagaagacacagccaccccagagccacccagcagtggatcctgaagaacaagacccaggagggcagccacctgcagaccaagagaagagtgctgagcagaccctggatctgctggcaccccgacctgggcctgcccgccagcagaaccatgagaaactag

SEQ ID NO: 19794 - DNA, 189 bp, Artificial Sequence
  Description of Artificial Sequence: Synthetic coding sequence
atgggcgagctggccgccagcgccaaccacggccacagcccctgctaccccgagagaaagggcacccccggcgacctgagcaagagaaagatgctggtgcacttctaccccagaagacacagccaccccagagccacccagcagtggatcctgaagaacaagaccctgtgcagaagaatcaaggagtag

SEQ ID NO: 19795 - DNA, 2757 bp, Artificial Sequence
  Description of Artificial Sequence: Synthetic coding sequence
atcctgatcgccagcgacggcagcgtgcccctgcccctgcagttcctgcccctgcagagcggcagatacccctgcaagatcctgctgaagagcagatacgacgtgagagcctactacgtggagggcatcgtgaacgaggagcagcccgaggccaagttcgagttcgagacccccgccttcgaggccctgacccagaacatccccatcaagaaccagaccaacgacaagtggaccttccaggtgaccatcgagggcgagtggttctacggccccgtggacctgcacgtgggccccgacgagatcgtggagtaccccctgaccttcaagcccatcttcgagtgcgtgatcaccggcaagctgatcctgcagaacgaggtggacggcagagagcacatcttcgacatcaagggcgtgggcaagaagcccagcgccctggagcacatcaccgtggagtgccaggtgggcaacgtgacccagaagcacatcaccctgccccacttcaccaacaccgccctgaccttcaaggtgaccgccgacctgcccatcgtgtggggcaacccccagatcaccgtgtacccctacaaggagatcctgtacctgatccacgtgagaccctggaagagaggcatcctgaagggcaccatcaccttcagcaccaccagaagatgcaccaccagaagaaagcacgacgactacgaggaggacaccgaccaggaccaggccctgagctgcctggacagcatcaccgagcagagcagcatcctggacgacgccgacacctacggcaacttcaacaacctgagattctggtacaacctggagatccacagcacccccggcccccccatcgagatcatggagatgacctgcatcgccctggacagcacctgcatcgagatccccctgagcaaccccaaggacagaggcctgcacctggaggtgcagctgaccagcgccgccctgaacggcgacaacgagatcatcctgagccccctgcagtgcaccaagtacatcgtgtggtacagccccgccaccaccggctacagcgacgagagcatcatcttccagcccgagatggccgaggagttctggtacctgctgaagctgaccatcgagctgcccaagcccaccaccatgcccgagatccagtgcgacctgggcaagcacgtgacccagatcatccccctggtgaactgcacccacgagaccctgaagctgcaggtgaccaacagcaaccccgagaacttcgtgctggacatcaacagaaagagccagctgatcatcagcccccacagcaccaccgagctgcccgtgctgttctaccccagcgccctgggcagagccgaccaccaggcctgcatcaacttctactgcacccagttcaccgagtggaagttctacctgagcggcgtgggcctgttcccccagcccctggacaccgagagaatcaccaccagaatcggcctgcagagcaccatcgtgatccccttcaagaaccccaccatggaggacgtgctgatcgacatcatcctgaccagcgtggagcaccccagaaacctggtgatggaccactgctgggacagcttcatctacgagagcagcgccttcagattcagcagccccagcgagatccagggcatcgccctgccccccaagggcaacatcgacatcagcctgctgttcatcccccagatcatgaagctgcacaagaccatggtgatcatcgagatgaccaaggccaacggcaagtactggcccatcgacaacttcgacgagctggacatcaagttcaagagcatcgtgggcatcgacagcgaggagatccaggccatccactggatctaccccatcgtgggcctgccccaggcccccccccccaagagcccccccgtggtgatccagtgccagagcagaaagagagccgaggagaaggtggagatcatcctgaacgccggcttcttcggcttcagcctgacccccgacctgaccgaggtgctggtgatccccaagagaaacagccacaacttctgcgaggaccccaacgagatccccaagatccacgagttcgagtacgagatccagttcgagagcgaggccatgaagagcaagctggagagctgcgtggccctgtacatgatcgagaagagctacgacatcatggccaagagaatcaccttcatcttcaacctggtgttcacccccaagaagcccctgagaagccacatcaccctgaagatcgagtgcgtgaccgagggcatctggaagttccccatcatgctgatcgccaccgagcccgacaccgacgccgtgatcgacatcgagggcgtgggcctgttcaaggagagcgtgttcgagctgagactgaagagccagaccagaaaccccgagcccttcaccgcccacttcctgcccggcagcgacctggagttcttcgtgaagccccaggccggcgagctgctgcccttcaacaccaacggcaccctgatcaccgtgggcttcaagcccaagatgtactgcagaaagtacaaggccaccctggtgatccagaccgaggagatgtactggaagtacgagatcaacggcctgacccccaccaccgtgccccccaagaacgccaaggccaagatcgacgccacccacaagacccacgacaacatgcccgtgagaccccacaacttcgtgagagagaacaccaagctgatcagaaccggcgtgagcagcaccatcaagggcgcccccctggtgaagaaccagtag

SEQ ID NO: 19796 - DNA, 1902 bp, Artificial Sequence
  Description of Artificial Sequence: Synthetic coding sequence
atggagatgacctgcatcgccctggacagcacctgcatcgagatccccctgagcaaccccaaggacagaggcctgcacctggaggtgcagctgaccagcgccgccctgaacggcgacaacgagatcatcctgagccccctgcagtgcaccaagtacatcgtgtggtacagccccgccaccaccggctacagcgacgagagcatcatcttccagcccgagatggccgaggagttctggtacctgctgaagctgaccatcgagctgcccaagcccaccaccatgcccgagatccagtgcgacctgggcaagcacgtgacccagatcatccccctggtgaactgcacccacgagaccctgaagctgcaggtgaccaacagcaaccccgagaacttcgtgctggacatcaacagaaagagccagctgatcatcagcccccacagcaccaccgagctgcccgtgctgttctaccccagcgccctgggcagagccgaccaccaggcctgcatcaacttctactgcacccagttcaccgagtggaagttctacctgagcggcgtgggcctgttcccccagcccctggacaccgagagaatcaccaccagaatcggcctgcagagcaccatcgtgatccccttcaagaaccccaccatggaggacgtgctgatcgacatcatcctgaccagcgtggagcaccccagaaacctggtgatggaccactgctgggacagcttcatctacgagagcagcgccttcagattcagcagccccagcgagatccagggcatcgccctgccccccaagggcaacatcgacatcagcctgctgttcatcccccagatcatgaagctgcacaagaccatggtgatcatcgagatgaccaaggccaacggcaagtactggcccatcgacaacttcgacgagctggacatcaagttcaagagcatcgtgggcatcgacagcgaggagatccaggccatccactggatctaccccatcgtgggcctgccccaggcccccccccccaagagcccccccgtggtgatccagtgccagagcagaaagagagccgaggagaaggtggagatcatcctgaacgccggcttcttcggcttcagcctgacccccgacctgaccgaggtgctggtgatccccaagagaaacagccacaacttctgcgaggaccccaacgagatccccaagatccacgagttcgagtacgagatccagttcgagagcgaggccatgaagagcaagctggagagctgcgtggccctgtacatgatcgagaagagctacgacatcatggccaagagaatcaccttcatcttcaacctggtgttcacccccaagaagcccctgagaagccacatcaccctgaagatcgagtgcgtgaccgagggcatctggaagttccccatcatgctgatcgccaccgagcccgacaccgacgccgtgatcgacatcgagggcgtgggcctgttcaaggagagcgtgttcgagctgagactgaagagccagaccagaaaccccgagcccttcaccgcccacttcctgcccggcagcgacctggagttcttcgtgaagccccaggccggcgagctgctgcccttcaacaccaacggcaccctgatcaccgtgggcttcaagcccaagatgtactgcagaaagtacaaggccaccctggtgatccagaccgaggagatgtactggaagtacgagatcaacggcctgacccccaccaccgtgccccccaagaacgccaaggccaagatcgacgccacccacaagacccacgacaacatgcccgtgagaccccacaacttcgtgagagagaacaccaagctgatcagaaccggcgtgagcagcaccatcaagggcgcccccctggtgaagaaccagtag

SEQ ID NO: 19797 - DNA, 543 bp, Artificial Sequence
  Description of Artificial Sequence: Synthetic coding sequence
ctggagatccccaagatccacgagttcgagtacgagatccagttcgagagcgaggccatgaagagcaagctggagagctgcgtggccctgtacatgatcgagaagagctacgacatcatggccaagagaatcaccttcatcttcaacctggtgttcacccccaagaagcccctgagaagccacatcaccctgaagatcgagtgcgtgaccgagggcatctggaagttccccatcatgctgatcgccaccgagcccgacaccgacgccgtgatcgacatcgagggcgtgggcctgttcaaggagagcgtgttcgagctgagactgaagagccagaccagaaaccccgagcccttcaccgcccacttcctgcccggcagcgacctggagttcttcgtgaagccccaggccggcgagctgctgcccttcaacaccaacggcaccctgatcaccgtgggcttcaagcccaagatgtactgcagaaagtacaaggccaccctggtgatccaggtgagcagcatcagagccatcgccaaggacgtgtag

SEQ ID NO: 19798 - DNA, 240 bp, Artificial Sequence
  Description of Artificial Sequence: Synthetic coding sequence
atgtacagaatgaagagaagccaggtgagaacccccatcagaagactgatcagaaacgtgaacctggactgggaggacagcatggccctgggctgcaccaccgtgatcgagagaggcaccctgagaagactgaagagagccaccctgaacaccttcctggacagccccgtgcacgtgctgctggtgatgcccaagctgatccccgagcactgggagaagtgggaggacgtgaagagatag

SEQ ID NO: 19799 - DNA, 960 bp, Artificial Sequence
  Description of Artificial Sequence: Synthetic coding sequence
atggtgctgagcgagctggccgccagactgaactgcgccgagtacaagaactgggtgaaggccggccactgcctgctgctgctgagaagctgcctgcagggcttcgtgggcagagaggtgctgagcttccacagaggcctgctggccgccgcccccggcctgggccccagagccgtgtgcagaggcggcagcagatgcagccccagagccagacagttccagccccagtgccaggtgtgcgccgagtggaagagagagatcctgagacaccacgtgaacagaaacggcgacgtgcactggggcaactgcagacccggcagatggcccgtggacgcctgggaggtggccaaggccttcatgcccagaggcctggccgacaagcagggccccgaggagtgcgacgccgtggccctgctgagcctgatcaacagctgcgaccacttcgtggtggacagaaagaaggtgaccgaggtgatcaagtgcagaaacgagatcatgcacagcagcgagatgaaggtgagcagcacctggctgagagacttccagatgaagatccagaacttcctgaacgagttcaagaacatccccgagatcgtggccgtgtacagcagaatcgagcagctgctgaccagcgactgggccgtgcacatccccgaggaggaccagagagacggctgcgagtgcgagatgggcacctacctgagcgagagccaggtgaacgagatcgagatgcagctgctgaaggagaagctgcaggagatctacctgcaggccgaggagcaggaggtgctgcccgaggagctgagcaacagactggaggtggtgaaggagttcctgagaaacaacgaggacctgagaaacggcctgaccgaggacatgcagaagctggacagcctgtgcctgcaccagaagctggacagccaggagcccggcagacagacccccgacagaaaggcctag

SEQ ID NO: 19800 - DNA, 468 bp, Artificial Sequence
  Description of Artificial Sequence: Synthetic coding sequence
atggtgctgagcgagctggccgccagactgaactgcgccgagtacaagaactgggtgaaggccggccactgcctgctgctgctgagaagctgcctgcagggcttcgtgggcagagaggtgctgagcttccacagaggcctgctggccgccgcccccggcctgggccccagagccgtgtgcagaggcggcagcagatgcagccccagagccagacagttccagccccagtgccaggtgtgcgccgagtggaagagagagatcctgagacaccacgtgaacagaaacggcgacgtgcactggggcaactgcagacccggcagatggcccgtggacgcctgggaggtggccaagggcctggacctgctgagcagactggagtgcagcggcgagagcgagctgatcgccaccctgaacagctgggcccaggccatcctgctgccccagcccctggagtacctgggcctgtag

SEQ ID NO: 19801 - DNA, 603 bp, Artificial Sequence
  Description of Artificial Sequence: Synthetic coding sequence
atgcccagaggcctggccgacaagcagggccccgaggagtgcgacgccgtggccctgctgagcctgatcaacagctgcgaccacttcgtggtggacagaaagaaggtgaccgaggtgatcaagtgcagaaacgagatcatgcacagcagcgagatgaaggtgagcagcacctggctgagagacttccagatgaagatccagaacttcctgaacgagttcaagaacatccccgagatcgtggccgtgtacagcagaatcgagcagctgctgaccagcgactgggccgtgcacatccccgaggaggaccagagagacggctgcgagtgcgagatgggcacctacctgagcgagagccaggtgaacgagatcgagatgcagctgctgaaggagaagctgcaggagatctacctgcaggccgaggagcaggaggtgctgcccgaggagctgagcaacagactggaggtggtgaaggagttcctgagaaacaacgaggacctgagaaacggcctgaccgaggacatgcagaagctggacagcctgtgcctgcaccagaagctggacagccaggagcccggcagacagacccccgacagaaaggcctag

SEQ ID NO: 19802 - DNA, 603 bp, Artificial Sequence; identical to SEQ ID NO: 19801
  Description of Artificial Sequence: Synthetic coding sequence

SEQ ID NO: 19803 - DNA, 705 bp, Artificial Sequence
  Description of Artificial Sequence: Synthetic coding sequence
atggtgctgagcgagctggccgccagactgaactgcgccgagtacaagaactgggtgaaggccggccactgcctgctgctgctgagaagctgcctgcagggcttcgtgggcagagaggtgctgagcttccacagaggcctgctggccgccgcccccggcctgggccccagagccgtgtgcagaggcggcagcagatgcagccccagagccagacaggtgatcaagtgcagaaacgagatcatgcacagcagcgagatgaaggtgagcagcacctggctgagagacttccagatgaagatccagaacttcctgaacgagttcaagaacatccccgagatcgtggccgtgtacagcagaatcgagcagctgctgaccagcgactgggccgtgcacatccccgaggaggaccagagagacggctgcgagtgcgagatgggcacctacctgagcgagagccaggtgaacgagatcgagatgcagctgctgaaggagaagctgcaggagatctacctgcaggccgaggagcaggaggtgctgcccgaggagctgagcaacagactggaggtggtgaaggagttcctgagaaacaacgaggacctgagaaacggcctgaccgaggacatgcagaagctggacagcctgtgcctgcaccagaagctggacagccaggagcccggcagacagacccccgacagaaaggcctag

SEQ ID NO: 19804 - DNA, 477 bp, Artificial Sequence
  Description of Artificial Sequence: Synthetic coding sequence
atgaagttcggctgcctgagcttcagacagccctacgccggcttcgtgctgaacggcatcaagaccgtggagaccagatggagacccctgctgagcagccagagaaactgcaccatcgccgtgcacatcgcccacagagactgggagggcgacgcctggagagagctgctggtggagagactgggcatgacccccgcccagatccagaccctgctgagaaagggcgagaagttcggcagaggcgtgatcgccggcctggtggacatcggcgagaccctgcagtgccccgaggacctgacccccgacgaggtggtggagctggagaaccaggccgtgctgaccaacctgaagcagaagtacctgaccgtgatcagcaaccccagatggctgctggagcccatccccagaaagggcggcaaggacgtgttccaggtggacatccccgagcacctgatccccctgggccacgaggtgtag

SEQ ID NO: 19805 - DNA, 477 bp, Artificial Sequence; identical to SEQ ID NO: 19804
  Description of Artificial Sequence: Synthetic coding sequence

SEQ ID NO: 19806 - DNA, 477 bp, Artificial Sequence; identical to SEQ ID NO: 19804
  Description of Artificial Sequence: Synthetic coding sequence

SEQ ID NO: 19807 - DNA, 477 bp, Artificial Sequence; identical to SEQ ID NO: 19804
  Description of Artificial Sequence: Synthetic coding sequence

SEQ ID NO: 19808 - DNA, 93 bp, Artificial Sequence
  Description of Artificial Sequence: Synthetic coding sequence
atgaagttcggctgcctgagcttcagacagccctacgccggcttcgtgctgaacggcatcaagaccgtggagaccagatggagacccctgtag

SEQ ID NO: 19809 - DNA, 477 bp, Artificial Sequence; identical to SEQ ID NO: 19804
  Description of Artificial Sequence: Synthetic coding sequence

SEQ ID NO: 19810 - DNA, 477 bp, Artificial Sequence; identical to SEQ ID NO: 19804
  Description of Artificial Sequence: Synthetic coding sequence

SEQ ID NO: 19811 - DNA, 441 bp, Artificial Sequence
  Description of Artificial Sequence: Synthetic coding sequence
atgaagttcggctgcctgagcttcagacagccctacgccggcttcgtgctgaacggcatcaagaccgtggagaccagatggagacccctgctgagcagccagagaaactgcaccatcgccgtgcacatcgcccacagagactgggagggcgacgcctggagagagctgctggtggagagactgggcatgacccccgcccagatccagaccctgctgagaaagggcgagaagttcggcagaggcgtgatcgccggcctggtggacatcggcgagaccctgcagtgccccgaggacctgacccccgacgaggtggtggagctggagaaccaggccgtgctgaccaacctgaagcagaagtacctgaccgtgatcagcaaccccagatggctgctggagcccatccccagaaagggcggcaaggacgtgttccagaacccctag

SEQ ID NO: 19812 - DNA, 477 bp, Artificial Sequence
  Description of Artificial Sequence: Synthetic coding sequence
atgaagttcggctgcctgagcttcagacagccctacgccggcttcgtgctgaacggcatcaagaccgtggagaccagatggagacccctgctgagcagccagagaaactgcaccatcgccgtgcacatcgcccacagagactgggagggcgacgcctggagagagctgctggtggagagactgggcatgacccccgcccagatccaggccctgctgagaaagggcgagaagttcggcagaggcgtgatcgccggcctggtggacatcggcgagaccctgcagtgccccgaggacctgacccccgacgaggtggtggagctggagaaccaggccgtgctgaccaacctgaagcagaagtacctgaccgtgatcagcaaccccagatggctgctggagcccatccccagaaagggcggcaaggacgtgttccaggtggacatccccgagcacctgatccccctgggccacgaggtgtag

SEQ ID NO: 19813 - DNA, 477 bp, Artificial Sequence; identical to SEQ ID NO: 19812
  Description of Artificial Sequence: Synthetic coding sequence

SEQ ID NO: 19814 - DNA, 477 bp, Artificial Sequence
  Description of Artificial Sequence: Synthetic coding sequence
atgaagttcggctgcctgagcttcagacagccctacgccggcttcgtgctgaacggcatcaagaccgtggagaccagatggagacccctgctgagcagccagagaaactgcaccatcgccgtgcacatcgcccacagagactgggagggcgacgcctgcagagagctgctggtggagagactgggcatgacccccgcccagatccaggccctgctgagaaagggcgagaagttcggcagaggcgtgatcgccggcctggtggacatcggcgagaccctgcagtgccccgaggacctgacccccgacgaggtggtggagctggagaaccaggccgccctgaccaacctgaagcagaagtacctgaccgtgatcagcaaccccagatggctgctggagcccatccccagaaagggcggcaaggacgtgttccaggtggacatccccgagcacctgatccccctgggccacgaggtgtag

SEQ ID NO: 19815 - DNA, 477 bp, Artificial Sequence; identical to SEQ ID NO: 19814
  Description of Artificial Sequence: Synthetic coding sequence

SEQ ID NO: 19816 - DNA, 477 bp, Artificial Sequence; identical to SEQ ID NO: 19814
  Description of Artificial Sequence: Synthetic coding sequence

SEQ ID NO: 19817 - DNA, 441 bp, Artificial Sequence
  Description of Artificial Sequence: Synthetic coding sequence
atgaagttcggctgcctgagcttcagacagccctacgccggcttcgtgctgaacggcatcaagaccgtggagaccagatggagacccctgctgagcagccagagaaactgcaccatcgccgtgcacatcgcccacagagactgggagggcgacgcctgcagagagctgctggtggagagactgggcatgacccccgcccagatccaggccctgctgagaaagggcgagaagttcggcagaggcgtgatcgccggcctggtggacatcggcgagaccctgcagtgccccgaggacctgacccccgacgaggtggtggagctggagaaccaggccgccctgaccaacctgaagcagaagtacctgaccgtgatcagcaaccccagatggctgctggagcccatccccagaaagggcggcaaggacgtgttccagaacccctag

SEQ ID NO: 19818 - DNA, 477 bp, Artificial Sequence; identical to SEQ ID NO: 19814
  Description of Artificial Sequence: Synthetic coding sequence

SEQ ID NO: 19819 - DNA, 645 bp, Artificial Sequence
  Description of Artificial Sequence: Synthetic coding sequence
atggagagcgagaacatggacagcgagaacatgaagaccgagaacatggagagccagaacgtggacttcgagagcgtgagcagcgtgaccgccctggaggccctgagcaagctgctgaaccccgaggaggaggacgacagcgactacggccagaccaacggcctgagcaccatcggcgccatgggccccggcaacatcggccccccccagatcgaggagctgaaggtgatccccgagaccagcgaggagaacaacgaggacatctggaacagcgaggagatccccgagggcgccgagtacgacgacatgtgggacgtgagagagatccccgagtacgagatcatcttcagacagcaggtgggcaccgaggacatcttcctgggcctgagcaagaaggacagcagcaccggctgctgcagcgagctggtggccaagatcaagctgcccaacaccaaccccagcgacatccagatcgacatccaggagaccatcctggacctgagaaccccccagaagaagctgctgatcaccctgcccgagctggtggagtgcaccagcgccaaggccttctacatccccgagaccgagaccctggagatcaccatgaccatgaagagagagctggacatcgccaacttcttctag

SEQ ID NO: 19820 - DNA, 645 bp, Artificial Sequence; identical to SEQ ID NO: 19819
  Description of Artificial Sequence: Synthetic coding sequence

SEQ ID NO: 19821 - DNA, 645 bp, Artificial Sequence; identical to SEQ ID NO: 19819
  Description of Artificial Sequence: Synthetic coding sequence

SEQ ID NO: 19822 - DNA, 795 bp, Artificial Sequence
  Description of Artificial Sequence: Synthetic coding sequence
atgctgagactgctgagactggccctggccttctacggcagaaccgccgaccccgccgagagacagggcccccagcagcagggcctgccccagggcgacacccagctgaccaccgtgcagggcgtggtgaccagcttctgcggcgactacggcatgatcgacgagagcatctacttcagcagcgacgtggtgaccggcaacgtgcccctgaaggtgggccagaaggtgaacgtggtggtggaggaggacaagccccactacggcctgagagccatcaaggtggacgtggtgcccagacacctgtacggcgccggccccagcgacagcggcaccagagtgctgatcggctgcgtgaccagcatcaacgaggacaacatctacatcagcaacagcatctacttcagcatcgccatcgtgagcgaggacttcgtgccctacaagggcgacctgctggaggtggagtacagcaccgagcccggcatcagcaacatcaaggccaccagcgtgaagcccatcagatgcatccacaccgaggaggtgtgcatcaccagcgtgcacggcagaaacggcgtgatcgactacaccatcttcttcaccctggacagcgtgaagctgcccgacggctacgtgccccaggtggacgacatcgtgaacgtggtgatggtggagagcatccagttctgcttcatctggagagccatcagcatcacccccgtgcacaagagcagcagcggcttccaggacgacggcggcctgggcagacccaagagagagagaagaagccagagcatctag

SEQ ID NO: 19823 - DNA, 729 bp, Artificial Sequence
  Description of Artificial Sequence: Synthetic coding sequence
atgctgagactgctgagactggccctggccttctacggcagaaccgccgaccccgccgagagacagggcccccagcagcagggcctgccccagggcgacacccagctgaccaccgtgcagggcgtggtgaccagcttctgcggcgactacggcatgatcgacgagagcatctacttcagcagcgacgtggtgaccggcaacgtgcccctgaaggtgggccagaaggtgaacgtggtggtggaggaggacaagccccactacggcctgagagccatcaaggtggacgtggtgcccagacacctgtacggcgccggccccagcgacagcggcaccagagtgctgatcggctgcgtgaccagcatcaacgaggacaacatctacatcagcaacagcatctacttcagcatcgccatcgtgagcgaggacttcgtgccctacaagggcgacctgctggaggtggagtacagcaccgagcccggcatcagcaacatcaaggccaccagcgtgaagcccatcagatgcatccacaccgaggaggtgtgcatcaccagcgtgcacggcagaaacggcgtgatcgactacaccatcttcttcaccctggacagcgtgaagctgcccgacggctacgtgccccaggtggacgacatcgtgaacgtggtgatggtggagagcatccagttctgcttcatctggagagccatcagcatcacccccgtgcacaagagctag

SEQ ID NO: 19824 - DNA, 522 bp, Artificial Sequence
  Description of Artificial Sequence: Synthetic coding sequence
atgagacccagagacagaagcagagtgatcgacgccgccaagcacgcccacaagttctgcaacaccgaggacgaggagaccatgtacctgagaagacccgagggcatcgagagacagtacagaaagaagtgcgccaagtgcggcctgcccctgttctaccagagccagcccaagaacgcccccgtgaccttcatcgtggacggcgccgtggtgaagttcggccagggcttcggcaagaccaacatctacacccagaagcaggagccccccaagaaggtgatgatgaccaagagaaccaaggacatgggcaagttcagcagcgtgaccgtgagcaccatcgacgaggaggaggaggagatcgaggccagagaggtggccgacagctacgcccagaacgccaaggtgatcgagaagcagctggagagaaagggcatgagcaagagaagactgcaggagctggccgagctggaggccaagaaggccaagatgaagggcaccctgatcgacaaccagttcaagtag

SEQ ID NO: 19825 - DNA, 669 bp, Artificial Sequence
  Description of Artificial Sequence: Synthetic coding sequence
atgcccaaggtggtgagcagaagcgtggtgtgcagcgacaccagagacagagaggagtacgacgacggcgagaagcccctgcacgtgtactactgcctgtgcggccagatggtgctggtgctggactgccagctggagaagctgcccatgagacccagagacagaagcagagtgatcgacgccgccaagcacgcccacaagttctgcaacaccgaggacgaggagaccatgtacctgagaagacccgagggcatcgagagacagtacagaaagaagtgcgccaagtgcggcctgcccctgttctaccagagccagcccaagaacgcccccgtgaccttcatcgtggacggcgccgtggtgaagttcggccagggcttcggcaagaccaacatctacacccagaagcaggagccccccaagaaggtgatgatgaccaagagaaccaaggacatgggcaagttcagcagcgtgaccgtgagcaccatcgacgaggaggaggaggagatcgaggccagagaggtggccgacagctacgcccagaacgccaaggtgatcgagaagcagctggagagaaagggcatgagcaagagaagactgcaggagctggccgagctggaggccaagaaggccaagatgaagggcaccctgatcgacaaccagttcaagtag

SEQ ID NO: 19826 - DNA, 669 bp, Artificial Sequence; identical to SEQ ID NO: 19825
  Description of Artificial Sequence: Synthetic coding sequence

SEQ ID NO: 19827 - DNA, 669 bp, Artificial Sequence; identical to SEQ ID NO: 19825
  Description of Artificial Sequence: Synthetic coding sequence

SEQ ID NO: 19828 - DNA, 627 bp, Artificial Sequence
  Description of Artificial Sequence: Synthetic coding sequence
atgcccaaggtggtgagcagaagcgtggtgtgcagcgacaccagagacagagaggagtacgacgacggcgagaagcccctgcacgtgtactactgcctgtgcggccagatggtgctggtgctggactgccagctggagaagctgcccatgagacccagagacagaagcagagtgatcgacgccgccaagcacgcccacaagttctgcaacaccgaggacgaggagaccatgtacctgagaagatgcggcctgcccctgttctaccagagccagcccaagaacgcccccgtgaccttcatcgtggacggcgccgtggtgaagttcggccagggcttcggcaagaccaacatctacacccagaagcaggagccccccaagaaggtgatgatgaccaagagaaccaaggacatgggcaagttcagcagcgtgaccgtgagcaccatcgacgaggaggaggaggagatcgaggccagagaggtggccgacagctacgcccagaacgccaaggtgatcgagaagcagctggagagaaagggcatgagcaagagaagactgcaggagctggccgagctggaggccaagaaggccaagatgaagggcaccctgatcgacaaccagttcaagtag

SEQ ID NO: 19829 - DNA, 2277 bp, Artificial Sequence
  Description of Artificial Sequence: Synthetic coding sequence
atgagcggcgagagcggccagcccgaggccggccccagccacgccggcctggactggcccaaccccgagagaaacagagccggcgtgcccggcggcgtgatcagaagagccggcagccagggccccagaagctggatccagaaggtgctggagcagatcatggacagccccagacagtgcgtgacccccagcgaggtggtgcccgtgaccgtgctggccgtgcagagatacctgctggaggacgagcccagagacaccgtgcccaagccccccctgtactgctacgacgtgaccatcagcgacggcgtgtaccaggagaagtgctacctggaccccagcctgaacagcctggtgtaccagaacatcctgaaggtgggcatccagatgagaatcagcagagtgagctgcctgtacaacgagaagagaatcggccagggcatcctgtgcatcgacaacgtgcactgcggcgagaccagcgacagcatcagcctggagacccccttcagaaacagagcccaccaggagaagcccgagagacccctgagaggcggcaagagccactacctggccctgtggaacaacgaggacccctacggcgacatctggctgaccgacaagcagcccgaggagcacaacttcagcgacaccaagatcatcagcctgagccacctggagatgacctggaccaacagaagaaacttccccgccctgctggtgagaatcctgcacaagagcaagctgagatactacggcaagcccgacaagaagatgatcgagccctaccagaccttcctggaggtggccgacagcagcggcaccgtgagcgtgatcatgtggaacgccctgtgccccgagtggtacaagagcctgagagtgggcctggtgctgctgctgcaggactacagcgtgaagaagagctaccccttcagaatccagcccgtgcccgtggacccccagatcaagctgatcagcaccatggagatctgcctgaacctgagagacccccccaccaacatcatcatcatccccgagaagcaggtgaagcccgagtggagactgcccaagctgaaccacagattcaccaccagaagcgagctggacgacatgcccgagaactgcatctgcgacgtgatcggcctgctggtgttcgtgggcagagtgcagagaagcaagaagaaggagaacagagaggacttctggagctacagatggatccacatcgccgacggcaccagcgagcagcccttcatcgtggagctgttcagcaccagccagcccgagatcttcgagaacatctaccccatggcctacttcgtgtgcacccagctgaaggtggtgagaaacgacaaccaggtgcccaagctgctgtacctgaccaccaccaacgagagcggcgtgttcatcaccggccacagaggccagccctacacctacgacgccaagaacgccaacagacccagcaccagccaggccgccagagtggagatccaggagagaaacggcaagagacaccaggacgacgagcccgtgaacagccagtacttccagaccaccagcaccaacctgagcctgagcaacaagatcagaatcctgcagggcccccacgccaaccccgtggccgtgccccagcccggcgccagcgtgcagaccaagggcatcaagcccggcatgcccagcatcttcaacagaagagccaacatcaacgccaacctgcagggcaaggccagaaagaccatcagcgacagatgggagagccagctgtggagagagaagaagttcggcctgatcgaccacctgcactacagcagagtgtaccccgagagcatccccagaaagttcatgttcgagcacagaaagttcctgagcgaccagtacaacagccagcccgccaagtacgtgccccccgagggcagaccccccaagctggacgacttcaagagcgccagaagcctgggccacttcgaggtgaccatcctgggcctgaaccacgagatcgccatcgacgtggccttcctgcccatgtactgccccgaggacatcagaaccagccagatcgacaccctgctgaccagcatgaactacagctgcgcctacccccaggacaccaccggcaacgacagactgcccggccccagagccgtggccggcgacatcatcaaggccgccaccgagctggacagagtgcacatcgtgggcatcctggacatctgcaacctgggcaacaacaaggtggaggtgtacctgcacaagatctacagccccgagaacaccagctag

SEQ ID NO: 19830 - DNA, 2568 bp, Artificial Sequence
  Description of Artificial Sequence: Synthetic coding sequence
atgagcggcgagagcggccagcccgaggccggccccagccacgccggcctggactggcccaaccccgagagaaacagagccggcgtgcccggcggcgtgatcagaagagccggcagccagggccccagaagctggatccagaaggtgctggagcagatcatggacagccccagacagtgcgtgacccccagcgaggtggtgcccgtgaccgtgctggccgtgcagagatacctgctggaggacgagcccagagacaccgtgcccaagccccccctgtactgctacgacgtgaccatcagcgacggcgtgtaccaggagaagtgctacctggaccccagcctgaacagcctggtgtaccagaacatcctgaaggtgggcatccagatgagaatcagcagagtgagctgcctgtacaacgagaagagaatcggccagggcatcctgtgcatcgacaacgtgcactgcggcgagaccagcgacagcatcagcctggagacccccttcagaaacagagcccaccaggagaagcccgagagacccctgagaggcggcaagagccactacctggccctgtggaacaacgaggacccctacggcgacatctggctgaccgacaagcagcccgaggagcacaacttcagcgacaccaagatcatcagcctgagccacctggagatgacctggaccaacagaagaaacttccccgccctgctggtgagaatcctgcacaagagcaagctgagatactacggcaagcccgacaagaagatgatcgagccctaccagaccttcctggaggtggccgacagcagcggcaccgtgagcgtgatcatgtggaacgccctgtgccccgagtggtacaagagcctgagagtgggcctggtgctgctgctgcaggactacagcgtgaagaagagctaccccttcagaatccagcccgtgcccgtggacccccagatcaagctgatcagcaccatggagatctgcctgaacctgagagacccccccaccaacatcatcatcatccccgagaagcaggtgaagcccgagtggagactgcccaagctgaaccacagattcaccaccagaagcgagctggacgacatgcccgagaactgcatctgcgacgtgatcggcctgctggtgttcgtgggcagagtgcagagaagcaagaagaaggagaacagagaggacttctggagctacagatggatccacatcgccgacggcaccagcgagcagcccttcatcgtggagctgttcagcaccagccagcccgagatcttcgagaacatctaccccatggcctacttcgtgtgcacccagctgaaggtggtgagaaacgacaaccaggtgcccaagctgctgtacctgaccaccaccaacgagagcggcgtgttcatcaccggccacagaggccagccctacacctacgacgccaaggtgaagaacttcatccagtggatcagaaccaagagcgacagcggcgagcagaagaacatggtgatcggcggctactacccctacccccccgtgcccgagaccttcagcaagtacagcagcagcatcaaggtggagagcctgctgaccgccatcagcgaggtgagaaaggagatcgaggacctgcagtacagagagcagaagagaatcgccatccagggcatcatcaccgccatcaagtacatcccccacagcagcgccaccgagagcgccagcgccagcgagaccctgagaaacgccaacagacccagcaccagccaggccgccagagtggagatccaggagagaaacggcaagagacaccaggacgacgagcccgtgaacagccagtacttccagaccaccagcaccaacctgagcctgagcaacaagatcagaatcctgcagggcccccacgccaaccccgtggccgtgccccagcccggcgccagcgtgcagaccaagggcatcaagcccggcatgcccagcatcttcaacagaagagccaacatcaacgccaacctgcagggcaaggccagaaagaccatcagcgacagatgggagagccagctgtggagagagaagaagttcggcctgatcgaccacctgcactacagcagagtgtaccccgagagcatccccagaaagttcatgttcgagcacagaaagttcctgagcgaccagtacaacagccagcccgccaagtacgtgccccccgagggcagaccccccaagctggacgacttcaagagcgccagaagcctgggccacttcgaggtgaccatcctgggcctgaaccacgagatcgccatcgacgtggccttcctgcccatgtactgccccgaggacatcagaaccagccagatcgacaccctgctgaccagcatgaactacagctgcgcctacccccaggacaccaccggcaacgacagactgcccggccccagagccgtggccggcgacatcatcaaggccgccaccgagctggacagagtgcacatcgtgggcatcctggacatctgcaacctgggcaacaacaaggtggaggtgtacctgcacaagatctacagccccgagaacaccagctag

SEQ ID NO: 19831 - DNA, 1701 bp, Artificial Sequence
  Description of Artificial Sequence: Synthetic coding sequence
aacaacgaggacccctacggcgacatctggctgaccgacaagcagcccgaggagcacaacttcagcgacaccaagatcatcagcctgagccacctggagatgacctggaccaacagaagaaacttccccgccctgctggtgagaatcctgcacaagagcaagctgagatactacggcaagcccgacaagaagatgatcgagccctaccagaccttcctggaggtggccgacagcagcggcaccgtgagcgtgatcatgtggaacgccctgtgccccgagtggtacaagagcctgagagtgggcctggtgctgctgctgcaggactacagcgtgaagaagagctaccccttcagaatccagcccgtgcccgtggacccccagatcaagctgatcagcaccatggagatctgcctgaacctgagagacccccccaccaacatcatcatcatccccgagaagcaggtgaagcccgagtggagactgcccaagctgaaccacagattcaccaccagaagcgagctggacgacatgcccgagaactgcatctgcgacgtgatcggcctgctggtgttcgtgggcagagtgcagagaagcaagaagaaggagaacagagaggacttctggagctacagatggatccacatcgccgacggcaccagcgagcagcccttcatcgtggagctgttcagcaccagccagcccgagatcttcgagaacatctaccccatggcctacttcgtgtgcacccagctgaaggtggtgagaaacgacaaccaggtgcccaagctgctgtacctgaccaccaccaacgagagcggcgtgttcatcaccggccacagaggccagccctacacctacgacgccaagaacgccaacagacccagcaccagccaggccgccagagtggagatccaggagagaaacggcaagagacaccaggacgacgagcccgtgaacagccagtacttccagaccaccagcaccaacctgagcctgagcaacaagatcagaatcctgcagggcccccacgccaaccccgtggccgtgccccagcccggcgccagcgtgcagaccaagggcatcaagcccggcatgcccagcatcttcaacagaagagccaacatcaacgccaacctgcagggcaaggccagaaagaccatcagcgacagatgggagagccagctgtggagagagaagaagttcggcctgatcgaccacctgcactacagcagagtgtaccccgagagcatccccagaaagttcatgttcgagcacagaaagttcctgagcgaccagtacaacagccagcccgccaagtacgtgccccccgagggcagaccccccaagctggacgacttcaagagcgccagaagcctgggccacttcgaggtgaccatcctgggcctgaaccacgagatcgccatcgacgtggccttcctgcccatgtactgccccgaggacatcagaaccagccagatcgacaccctgctgaccagcatgaactacagctgcgcctacccccaggacaccaccggcaacgacagactgcccggccccagagccgtggccggcgacatcatcaaggccgccaccgagctggacagagtgcacatcgtgggcatcctggacatctgcaacctgggcaacaacaaggtggaggtgtacctgcacaagatctacagccccgagaacaccagctag

SEQ ID NO: 19832 - DNA, 999 bp, Artificial Sequence
  Description of Artificial Sequence: Synthetic coding sequence
atgaacagaagcagcaacgtgcccagaaagggcatcctgaagagcggcaccagaagcctgcagaaggtgagaagagtgcacttcgccaacgccagaaacgccagaagcctgctgagcatgctgaaggacatcagcgcccagatcatccagagagcctggctgagccacaccaacaagatgatcttcagactgctgaagcacgccatctgcgccgccgagttctacgtgacccacgagatcctgaagaaggtggcccccctggaggccaagctgatcaaggaccccaccatgcagtgcaagatcagattcagattcagaggcgagaccttcccccccttcatcgtgttcaagatcttcctgcacaccgacggccacggctacaagtacttcagcggcaagaacgtgctgatgcccagcagcaaggccgtggacgacgcctgcaagctgatgggcgagagaaagttccacagaatcatcatggaggacgagagaatcttccccaagagcaaggtgaccgacatcatggacgtggtgaccatgcaggactacgtgcagtacagaagcttcttcgacgaggcccccgccttcagcggcggcagaaacaacagctggagaaagctgaacctggagaacatccccagaaccatgctgatgtacgacatcgtgcactacagcgagagcggcgtgatcagcaacagactgagaaacgagatgaagttcctgctgcagagacccgtgacccaggagatccacaagcaccagctgagaatcgtgagcgagatcagaggcccctacctgaccgtgcagcccctgtacagaccctacaagcagcagaaccaggtgaagttcctgggcagaagaagcaagcaggcccagatgaaggtggagaagatgagaaaggtgtacctggccaaggagaagaacaccagcgaggtgaccgagcccaagaccggccccagcggcaccaaggacaactaccacctgcacagcatcttctag

SEQ ID NO: 19833 - DNA, 381 bp, Artificial Sequence
  Description of Artificial Sequence: Synthetic coding sequence
tgattcgccaacgccagaaacgccagaagcctgctgagcatgctgaaggacatcagcgcccagatcatccagagagcctggctgagccacaccaacaagatgatcttcagactgctgaagcacgccatctgcgccgccgagttctacgtgacccacgagatcctgaagaaggtggcccccctggaggccaagctgatcaaggaccccaccatgcagtgcaagatcagattcagattcagaggcgagaccttcccccccttcatcgtgttcaagatcttcctgcacaccgacggccacggctacaagtacttcagcggcaagaacgtgctgatgcccagcagcaaggtgaccttccacgacgtgcacttcatgctgacctag

SEQ ID NO: 19834 - DNA, 897 bp, Artificial Sequence
  Description of Artificial Sequence: Synthetic coding sequence
atggcctgcatcgagaacgtgctgggcggccacgcccccagccccctggtggtgagcgtggacaagaacggcaaccaggagctgcaccacgacatgcccctgcagtgcctgagcagcaagcccgaggacgacgccgagccctggggccagccccaggtgcccctgagacccagcgtgaacgtgctgaccgacctggacagcaagcagctggagtggcccagcgagagaaccggcagctgcatccccctgcacagcctgagagcccacagacacccctacggccccccccccgccgtggccgaggagagcctggccaccgccgaggtgaacagcagcgacgccctggccggctggagacaggagggccaggacgccatcaacgtgagctgggaggtgagcggcggcccccccgccctgatcgtgggcggcaccaaggtgaacaacggcggcaccgagagaggcagcaacaacgccagactgcacgtggccctgccccagggcaagggcttcttcccccccagaggcccccaggtgagaggccccagccacatccccaccctgagaagcggcatcgtgatggaggtgccccccggcaacaccagaatcgcctgcagaggcaagctggcccacgtgagcttccccctgagaggcccctgccaccccatgcacaactggcccagacccatccccctgagcagcagcacccccggcctgcccagctgcagcaccgtgcactgcttcatcccccccagaccccccatcttcaaccccttcctgaccatgcccctgcccttcgcccccccccccatcttcggcccccccctgcccagctacttcgcccacttccacagcggcggcatgcccgcccccgccagccccaacagagagcacagctag

SEQ ID NO: 19835 - DNA, 552 bp, Artificial Sequence
  Description of Artificial Sequence: Synthetic coding sequence
atgttcatcttcatcaagcacggcgacaaccagcagttcctggtgaacaccaactgcgccgtggtggtgctgctgtactacatcagaagcaaggtgaagctgcccaagaccaacaccatcgacctgtgcgagcagaccggcaagatgaagatgctgttcctgatgaagcccaaccacgccgagtacgccagcaagtacctgaccgccagaagcacctactacgtgtgcaaggtggagagaggcccccccggcaccagactggagaacgcctacagagccttcgtgcccctgctgaagaaccccgagccctggctgctggtggccctgagaatccagtgcgacgccctggagagaagaagaatccagatgctgaagatgaaggaggccaagaaggtggtgatcatcgagccccccgccagcgtgcccagcaagcagagcggcagaagcgacaagaagaagagcaccagaaagagccccaccttcagaaacagacccgacttcagaaagaacaagggcagacagctgaacaagaccaccaagcagaagaagtag

SEQ ID NO: 19836 - DNA, 612 bp, Artificial Sequence
  Description of Artificial Sequence: Synthetic coding sequence
atgttcatcttcatcaagcacggcgacaaccagcagttcctggtgaacaccaactgcgccgtggtggtgctgctgtactacatcagaagcaaggtgaagctgcccaagaccaacaccatcgacctgtgcgagcagaccggcaagatgaagatgctgttcctgatgaagcccaaccacgccgagtacgccagcaagtacctgaccgccagaagcacctactacgtgtgcaaggtggagagaggcccccccggcaccagactggagaacgcctacagagccttcgtgcccctgctgaagaaccccgagccctggctgctggtggccctgagaatccagtgcgacgccctggagagaagaagaatccagatgctgaagatgaaggaggccaagaaggtggtgatcatcgagccccccgccagcgtgcccgtgagactggccaagtgcgacctgccccagcacccccccctgcccaccagcagactgaacagcaagcagagcggcagaagcgacaagaagaagagcaccagaaagagccccaccttcagaaacagacccgacttcagaaagaacaagggcagacagctgaacaagaccaccaagcagaagaagtag

SEQ ID NO: 19837 - DNA, 1512 bp, Artificial Sequence
  Description of Artificial Sequence: Synthetic coding sequence
atggccacccagagcgacatggagaaggagcagaagcaccagcaggacgagggccagggcggcctgaacaacgagaccgccctggccagcggcgacgcctgcggcaccggcaaccaggaccccgccgccagcgtgaccaccgtgagcagccaggccagccccagcggcggcgccgccctgagcagcagcaccgccggcagcagcgccgccgccgccaccagcgccgccatcttcatcaccgacgaggccagcggcctgcccatcatcgccgccgtgctgaccgagagacacagcgacagacaggactgcagaagcccccacgaggtgttcggctgcgtggtgcccgagggcggcagccaggccgccgtgggcccccagaaggccaccggccacgccgacgagcacctggcccagaccaagagccccggcaacagcagaagaagaaagcagccctgcagaaaccaggccgcccccgcccagaagccccccggcagaagactgttccccgagcccctgccccccagcagccccggcttcagacccagcagctacccctgcagcggcgccagcaccagcagccaggccacccagcccggccccgccctgctgagccacgccagcgaggccagacccgccaccagaagcagaatcaccctggtggccagcgccctgagaagaagagccagcggccccggccccgtgatcagaggctgcaccgcccagcccggccccgccttcccccacagagccacccacctggaccccgccagactgagccccgagagcgcccccggccccgccagaagaggcagagccagcgtgcccggccccgccagaagaggctgcgacagcgcccccggccccgccagaagaggcagagacagcgcccccgtgagcgcccccagaggcagagacagcgcccccggcagcgccagaagaggcagagacagcgcccccggccccgccctgagagtgagaaccgccagaagcgacgccggccacagaagcaccagcaccacccccggcaccggcctgagaagcagaagcacccagcagagaagcgccctgctgagcagaagaagcctgagcggcagcgccgacgagaaccccagctgcggcaccggcagcgagagactggccttccagagcagaagcggcagccccgaccccgaggtgcccagcagagccagcccccccgtgtggcacgccgtgagaatgagagccagcagccccagcccccccggcagattcttcctgcccatcccccagcagtgggacgagagcagcagcagcagctacgccagcaacagcagcagccccagcagaagccccggcctgagccccagcagccccagccccgagttcctgggcctgagaagcatcagcacccccagccccgagagcctgagatacgccctgatgcccgagttctacgccctgagccccgtgccccccgaggagcaggccgagatcgagagcaccgcccaccccgccaccccccccgagccctag

SEQ ID NO: 19838 - DNA, 252 bp, Artificial Sequence
  Description of Artificial Sequence: Synthetic coding sequence
atggaggccctgggcagcggccactacgtgggcggcagcatcagaagcatggccgccgccgccctgagcggcctggccgtgagactgagcagaccccagggcaccagaggcagctacggcgccttctgcaagaccctgaccagaaccctgctgaccttcttcgacctggcctggagactgagaaagaacttcttctacttctacatcctggccagcgtgatcctgaacgtgcacctgcaggtgtacatctag

SEQ ID NO: 19839 - DNA, 549 bp, Artificial Sequence
  Description of Artificial Sequence: Synthetic coding sequence
atgatgagaagaagccccagcggcctgaagagccccagagtgagccagggcagaaagcccagagaccccgagagcctgctgttcctgagatgctgcctgggcagcgagccccacaacctgagcagcctgctgagccccgaggccggccaggagcccctgcccaagctgctgccccagcccctggccggccacgccgcctggggcatccacggcgtgcccaccagcctgctgctggccggcgagtgctggggccagggcatggccgtgcccgccgaccccccccccgccagcccctacagaaccagccccagacccccccccggccccctgcccagatacagaccccagcagcacctgctgctgcccctgggcagactgcacgccctgtgccccggctgccccctgcagcagagcctgcagttcgagagaggcaccctgagcgcccccagactgtggagctggatgaagctggagaccatcatcctgagcaagctgagccagggccagaagaccaagcacagaatgttcagcctgatcagcgagagctag

SEQ ID NO: 19840 - DNA, 549 bp, Artificial Sequence; identical to SEQ ID NO: 19839
  Description of Artificial Sequence: Synthetic coding sequence

SEQ ID NO: 19841 - DNA, 306 bp, Artificial Sequence
  Description of Artificial Sequence: Synthetic coding sequence
atgaacaagctgggccacaacgagctgaaggagtgcctgaagaccgccaccgacagcctgcagaccgtgcagcccagcatcagccagacctgcaccagctacggccccgccctgggcgcccccctgcccggcagaaacgaggtggccctgctgaccagcctgccccccaactacgagatcagcgagggcaagcccagagccatcagcgcctacgtgagagccggcaagggcaacgtgaccagaagaagaaagaagacccacctgggcaacgacgacggcaagaaggaggcccaggagaagatgtag

SEQ ID NO: 19842 - DNA, 306 bp, Artificial Sequence; identical to SEQ ID NO: 19841
  Description of Artificial Sequence: Synthetic coding sequence

SEQ ID NO: 19843 - DNA, 1416 bp, Artificial Sequence
  Description of Artificial Sequence: Synthetic coding sequence
atgtgcggcgactgcgtggagaaggagtaccccaacagaggcaacacctgcctggagaacggcagcttcctgctgaacttcaccggctgcgccgtgtgcagcaagagagacttcatgctgatcaccaacaagagcctgaaggaggaggacggcgaggagatcgtgacctacgaccacctgtgcaagaactgccaccacgtgatcgccagacacgagtacaccttcagcatcatggacgagttccaggccaaggtggaggagaagatccaggaggtgttcagcagctacaagttcaaccacctggtgcccagactggtgctgcagagagagaagcacttccactacctgaagagaggcctgagacagctgaccgacgcctacgagtgcctggacgccagcagaccctggctgtgctactggatcctgcacagcctggagctgctggacgagcccatcccccagatcgtggccaccgacgtgtgccagttcctggagctgtgccagagccccgagggcggcttcggcggcggccccggccagtacccccacctggcccccacctacgccgccgtgaacgccctgtgcatcatcggcaccgaggaggcctacgacatcatcaacagagagaagctgctgcagtacctgtacagcctgaagcagcccgacggcagcttcctgatgcacgtgggcggcgaggtggacgtgagaagcgcctactgcgccgccagcgtggccagcctgaccaacatcatcacccccgacctgttcgagggcaccgccgagtggatcgccagatgccagaactgggagggcggcatcggcggcgtgcccggcatggaggcccacggcggctacaccttctgcggcctggccgccctggtgatcctgaagagagagagaagcctgaacctgaagagcctgctgcagtgggtgaccagcagacagatgagattcgagggcggcttccagggcagatgcaacaagctggtggacggctgctacagcttctggcaggccggcctgctgcccctgctgcacagagccctgcacgcccagggcgaccccgccctgagcatgagccactggatgttccaccagcaggccctgcaggagtacatcctgatgtgctgccagtgccccgccggcggcctgctggacaagcccggcaagagcagagacttctaccacacctgctactgcctgagcggcctgagcatcgcccagcacttcggcagcggcgccatgctgcacgacgtggtgctgggcgtgcccgagaacgccctgcagcccacccaccccgtgtacaacatcggccccgacaaggtgatccaggccaccacctacttcctgcagaagcccgtgcccggcttcgaggagctgaaggacgagaccagcgccgagcccgccaccgactag

SEQ ID NO: 19844 - DNA, 582 bp, Artificial Sequence
  Description of Artificial Sequence: Synthetic coding sequence
atggaggcccacggcggctacaccttctgcggcctggccgccctggtgatcctgaagagagagagaagcctgaacctgaagagcctgctgcagtgggtgaccagcagacagatgagattcgagggcggcttccagggcagatgcaacaagctggtggacggctgctacagcttctggcaggccggcctgctgcccctgctgcacagagccctgcacgcccagggcgaccccgccctgagcatgagccactggatgttccaccagcaggccctgcaggagtacatcctgatgtgctgccagtgccccgccggcggcctgctggacaagcccggcaagagcagagacttctaccacacctgctactgcctgagcggcctgagcatcgcccagcacttcggcagcggcgccatgctgcacgacgtggtgctgggcgtgcccgagaacgccctgcagcccacccaccccgtgtacaacatcggccccgacaaggtgatccaggccaccacctacttcctgcagaagcccgtgcccggcttcgaggagctgaaggacgagaccagcgccgagcccgccaccgactag

SEQ ID NO: 19845 - DNA, 1176 bp, Artificial Sequence
  Description of Artificial Sequence: Synthetic coding sequence
atgatcgccaaggtggaggagaagatccaggaggtgttcagcagctacaagttcaaccacctggtgcccagactggtgctgcagagagagaagcacttccactacctgaagagaggcctgagacagctgaccgacgcctacgagtgcctggacgccagcagaccctggctgtgctactggatcctgcacagcctggagctgctggacgagcccatcccccagatcgtggccaccgacgtgtgccagttcctggagctgtgccagagccccgagggcggcttcggcggcggccccggccagtacccccacctggcccccacctacgccgccgtgaacgccctgtgcatcatcggcaccgaggaggcctacgacatcatcaacagagagaagctgctgcagtacctgtacagcctgaagcagcccgacggcagcttcctgatgcacgtgggcggcgaggtggacgtgagaagcgcctactgcgccgccagcgtggccagcctgaccaacatcatcacccccgacctgttcgagggcaccgccgagtggatcgccagatgccagaactgggagggcggcatcggcggcgtgcccggcatggaggcccacggcggctacaccttctgcggcctggccgccctggtgatcctgaagagagagagaagcctgaacctgaagagcctgctgcagtgggtgaccagcagacagatgagattcgagggcggcttccagggcagatgcaacaagctggtggacggctgctacagcttctggcaggccggcctgctgcccctgctgcacagagccctgcacgcccagggcgaccccgccctgagcatgagccactggatgttccaccagcaggccctgcaggagtacatcctgatgtgctgccagtgccccgccggcggcctgctggacaagcccggcaagagcagagacttctaccacacctgctactgcctgagcggcctgagcatcgcccagcacttcggcagcggcgccatgctgcacgacgtggtgctgggcgtgcccgagaacgccctgcagcccacccaccccgtgtacaacatcggccccgacaaggtgatccaggccaccacctacttcctgcagaagcccgtgcccggcttcgaggagctgaaggacgagaccagcgccgagcccgccaccgactag

SEQ ID NO: 19846 - DNA, 1419 bp, Artificial Sequence
  Description of Artificial Sequence: Synthetic coding sequence
gccatgtgcggcgactgcgtggagaaggagtaccccaacagaggcaacacctgcctggagaacggcagcttcctgctgaacttcaccggctgcgccgtgtgcagcaagagagacttcatgctgatcaccaacaagagcctgaaggaggaggacggcgaggagatcgtgacctacgaccacctgtgcaagaactgccaccacgtgatcgccagacacgagtacaccttcagcatcatggacgagttccaggccaaggtggaggagaagatccaggaggtgttcagcagctacaagttcaaccacctggtgcccagactggtgctgcagagagagaagcacttccactacctgaagagaggcctgagacagctgaccgacgcctacgagtgcctggacgccagcagaccctggctgtgctactggatcctgcacagcctggagctgctggacgagcccatcccccagatcgtggccaccgacgtgtgccagttcctggagctgtgccagagccccgagggcggcttcggcggcggccccggccagtacccccacctggcccccacctacgccgccgtgaacgccctgtgcatcatcggcaccgaggaggcctacgacatcatcaacagagagaagctgctgcagtacctgtacagcctgaagcagcccgacggcagcttcctgatgcacgtgggcggcgaggtggacgtgagaagcgcctactgcgccgccagcgtggccagcctgaccaacatcatcacccccgacctgttcgagggcaccgccgagtggatcgccagatgccagaactgggagggcggcatcggcggcgtgcccggcatggaggcccacggcggctacaccttctgcggcctggccgccctggtgatcctgaagagagagagaagcctgaacctgaagagcctgctgcagtgggtgaccagcagacagatgagattcgagggcggcttccagggcagatgcaacaagctggtggacggctgctacagcttctggcaggccggcctgctgcccctgctgcacagagccctgcacgcccagggcgaccccgccctgagcatgagccactggatgttccaccagcaggccctgcaggagtacatcctgatgtgctgccagtgccccgccggcggcctgctggacaagcccggcaagagcagagacttctaccacacctgctactgcctgagcggcctgagcatcgcccagcacttcggcagcggcgccatgctgcacgacgtggtgctgggcgtgcccgagaacgccctgcagcccacccaccccgtgtacaacatcggccccgacaaggtgatccaggccaccacctacttcctgcagaagcccgtgcccggcttcgaggagctgaaggacgagaccagcgccgagcccgccaccgactag

SEQ ID NO: 19847 - DNA, 342 bp, Artificial Sequence
  Description of Artificial Sequence: Synthetic coding sequence
atgtgcggcgactgcgtggagaaggagtaccccaacagaggcaacacctgcctggagaacggcagcttcctgctgaacttcaccggctgcgccgtgtgcagcaagagagacttcatgctgatcaccaacaagagcctgaaggaggaggacggcgaggagatcgtgacctacgaccccgacctgtgcaagaactgccaccacgtgatcgccagacacgagtacaccttcagcatcatggacgagttccaggagtacaccatgctgtgcctgctgtgcggcaaggccgaggacaccatcagcatcctgcccgacgaccccagacagatgaccctgctgttctag

SEQ ID NO: 19848 - DNA, 318 bp, Artificial Sequence
  Description of Artificial Sequence: Synthetic coding sequence
atgagacagccctacctgagcagcagagaggtgagcagcagcagaaagagatggagaaccttccccgtggactgcgtggccatgtgcggcgactgcgtggagaaggagtaccccaacagaggcaacacctgcctggagaacggcagcttcctgctgaacttcaccggctgcgccgtgtgcagcaagagagacttcatgctgatcaccaacaagagcctgaaggaggaggacggcgaggagatcgtgacctacgacagagtgtaccacgccgtgagcgtgatgagacagagcagaagatactaccagtacagcccctag

SEQ ID NO: 19849 - DNA, 420 bp, Artificial Sequence
  Description of Artificial Sequence: Synthetic coding sequence
atgagacagccctacctgagcagcagagaggtgagcagcagcagaaagagatggagaaccttccccgtggactgcgtggccatgtgcggcgactgcgtggagaaggagtaccccaacagaggcaacacctgcctggagaacggcagcttcctgctgaacttcaccggctgcgccgtgtgcagcaagagagacttcatgctgatcaccaacaagagcctgaaggaggaggacggcgaggagatcgtgacctacgaccacctgtgcaagaactgccaccacgtgatcgccagacacgagtacaccttcagcatcatggacgagttccaggagtacaccatgctgtgcctgctgtgcggcaaggccgaggacaccatcagcatcctgcccgacgaccccagacagatgaccctgctgttctag

SEQ ID NO: 19850 - DNA, 423 bp, Artificial Sequence
  Description of Artificial Sequence: Synthetic coding sequence
atgagacagccctacctgagcagcagagaggtgagcagcagcagaaagagatggagaaccttccccgtggactgcgtggccatgtgcggcgactgcgtggagaaggagtaccccaacagaggcaacacctgcctggagaacggcagcttcctgctgaacttcaccggctgcgccgtgtgcagcaagagagacttcatgctgatcaccaacaagagcctgaaggaggaggacggcgaggagatcgtgacctacgaccccgacctgtgcaagaactgccaccacgtgatcgccagacacgagtacaccttcagcatcatggacgagttccaggagtacaccatgctgtgcctgctgtgcggcaaggccgaggacaccatcagcatcctgcccgacgaccccagacagatgaccctgctgttctag

SEQ ID NO: 19851 - DNA, 381 bp, Artificial Sequence
  Description of Artificial Sequence: Synthetic coding sequence
tgcggcgtgagcacctacgcccccgacatgagcagaatgctgggcggcgaggaggccagacccaacagctggccctggcaggtgagcctgcagtacagcagcaacggccagtggtaccacacctgcggcggcagcctgatcgccaacagctgggtgctgaccgccgcccactgcatcagacagatcatcaaggcccacaaggtgctgcagagatgcagcctgatcctgttcttcgtgagagacctgtgcagcagccagctggagctgaccggcgtgagcgccggcagcagcggcatctacagagtgatgctgggccagcacaacctgtacgtggccgagagcggcagcctggccgtgagcgtgagcaagatcgtggtgtag

SEQ ID NO: 19852 - DNA, 813 bp, Artificial Sequence
  Description of Artificial Sequence: Synthetic coding sequence
atgatgctgagactgctgagcagcctgctgctggtggccgtggccagcggctacggcccccccagcagccacagcagcagcagagtggtgcacggcgaggacgccgtgccctacagctggccctggcaggtgagcctgcagtacgagaagagcggcagcttctaccacacctgcggcggcagcctgatcgcccccgactgggtggtgaccgccggccactgcatcagcagagacctgacctaccaggtggtgctgggcgagtacaacctggccgtgaaggagggccccgagcaggtgatccccatcaacagcgaggagctgttcgtgcaccccctgtggaacagaagctgcgtggcctgcggcaacgacatcgccctgatcaagctgagcagaagcgcccagctgggcgacgccgtgcagctggccagcctgccccccgccggcgacatcctgcccaacaagaccccctgctacatcaccggctggggcagactgtacaccaacggccccctgcccgacaagctgcagcaggccagactgcccgtggtggactacaagcactgcagcagatggaactggtggggcagcaccgtgaagaagaccatggtgtgcgccggcggctacatcagaagcggctgcaacggcgacagcggcggccccctgaactgccccaccgaggacggcggctggcaggtgcacggcgtgaccagcttcgtgagcgccttcggctgcaacttcatctggaagcccaccgtgttcaccagagtgagcgccttcatcgactggatcgaggagaccatcgccagccactag

SEQ ID NO: 19853 - DNA, 495 bp, Artificial Sequence
  Description of Artificial Sequence: Synthetic coding sequence
atgagaagctgctacgtggcccaggccggcctgaagctgcccggcagcagcgacccccccgccagcgccagccagagcaccagaatcaccgccagcggctacggcccccccagcagccacagcagcagcagagtggtgcacggcgaggacgccgtgccctacagctggccctggcaggtgagcctgcagtacgagaagagcggcagcttctaccacacctgcggcggcagcctgatcgcccccgactgggtggtgaccgccggccactgcatcagcagagacctgacctaccaggtggtgctgggcgagtacaacctggccgtgaaggagggccccgagcaggtgatccccatcaacagcgaggagctgttcgtgcaccccctgtggaacagaagctgcgtggcctgcggcaacgacatcgccctgatcaagctgagcagaagcgcccagctgggcgacgccgtgcagctggccagcctgccccccgccggctag

SEQ ID NO: 19854 - DNA, 366 bp, Artificial Sequence
  Description of Artificial Sequence: Synthetic coding sequence
atgatgctgagactgctgagcagcctgctgctggtggccgtggccagcggctacggcccccccagcagccacagcagcagcagagtggtgcacggcgaggacgccgtgccctacagctggccctggcaggtgagcctgcagtacgagaagagcggcagcttctaccacacctgcggcggcagcctgatcgcccccgactgggtggtgaccgccggccactgcatcagcagagacctgacctaccaggtggtgctgggcgagtacaacctggccgtgaaggagggccccgagcaggtgatccccatcaacagcgaggagctgttcgtgcaccccctgtggaacagaagctgcgtggcctgcggctag

SEQ ID NO: 19855 - DNA, 228 bp, Artificial Sequence
  Description of Artificial Sequence: Synthetic coding sequence
tggtggggcagcaccgtgaagaagaccatggtgtgcgccggcggctacatcagaagcggctgcaacggcgacagcggcggccccctgaactgccccaccgaggacggcggctggcaggtgcacggcgtgaccagcttcgtgagcgccttcggctgcaacttcatctggaagcccaccgtgttcaccagagtgagcgccttcatcgactggatcgaggagggcggctag

SEQ ID NO: 19856 - DNA, 348 bp, Artificial Sequence
  Description of Artificial Sequence: Synthetic coding sequence
atggacaacgtgcagcccaagatcaagcacagacccttctgcttcagcgtgaagggccacgtgaagatgctgagactggacctgaccaacagcatcatcaccgccgtgttcctgagcgtggtggccatcctggccatgcaggagaagaagagaagacacctgctgtacgtgggcggcagcctgtgcctgaccgccgtgatcgtgtgctgcatcgacgccttcgtggtgaccaccaagatgagaaccaacctgaagagattcctgggcgtggaggtggagagaaagctgagccccgccaaggacgcctaccccgagaccggccccgacgccccccagagacccgcctag

SEQ ID NO: 19857 - DNA, 195 bp, Artificial Sequence
  Description of Artificial Sequence: Synthetic coding sequence
atcaacagcctggtgaccaccgtgttcatgctgatcgtgagcgtgctggccctgatccccgagaccaccaccctgaccgtgggcggcggcgacctgaccaacagcatcatcaccgccgtgttcctgagcgtggtggccatcctggccatgcaggagaagaagagaagacacctgctgtacgtgggcggcagatag

SEQ ID NO: 19858 - DNA, 1395 bp, Artificial Sequence
  Description of Artificial Sequence: Synthetic coding sequence
atgagaatcatcgagagcaacagcagcaagatccagagccagatcgaccacatcaagcagtgcagagccgagtacgacaccaaggaggtgaagtactgcaccttcagcaaggaccccagcaagcccatccccggcatgaccctgcaggagagcatgaacctggacgccctgaccaagtacatgaagcacctggaggacaagtacgccgagatcaagcaggccatgctgatcaagtacgtgcccgcccagagaaaggccgacctggacgaggagatgatcgtgctgctgaagagaagagacgtggccgagaacctgaacaagaagctgcagttctgccaccagagactgcagatcatcagccaggccctgagcagctgggtgaagagcgacatgagcagccccttccaggacttcgtggagcagatccagaagaccaagtacctgcagggcgaccagggcatcgtggaggagctgatggaggacgaccccagaagagccaaggaggccgagatcatgctgcactacatcgagagattcaacgagctgatcagcctgggcgagtacgagaaggccgcctgctacgccgccaacagccccagaagaatcctgagaaacatcggcaccatgaacaccttcaaggccgtgggcaagatcagaggcaagcccctgcccctgctgctgttcttcgaggccctgttcatcaccagccacgccttcccctgccccgtggacgccgccctgaccctggagggcatcaagtgcggcctgagcgagaagagactggacctggtgaccaactgggtgacccaggagagactgaccttcagcgaggaggccggcgacgtgatctgcgactacggcgagcaggacacctacaacaaggccaagtgcctggccctggcccagatcgtgtacagcgagtgcggcctgcacaagaaggccatcctgtgcctgtgcaagcagggccagacccacagagtgatggagtacatccagcagctgaaggacttcaccaccgacgacctgctgcagctgctgatgagctgcccccaggtggagctgatccagtgcctgaccaaggagctgaacgagaagcagcccagcctgagcttcggcctggccatcctgcacctgttcagcgccgacatgaagaaggtgggcatcaagctgctgcaggagatcaacaagggcggcatcgacgccgtggagagcctgatgatcaacgacagcttctgcagcatcgagaagtggcaggaggtggccaacatctgcagccagaacggcttcgacaagctgagcaacgacatcaccagcatcctgagaagccaggccgccgtgaccgagatcagcgaggaggacgacgccgtgaacctgatggagcacgtgttctggtag

SEQ ID NO: 19859 - DNA, 663 bp, Artificial Sequence
  Description of Artificial Sequence: Synthetic coding sequence
atggccctgatcttcagaaccgccatgcagagcgtgggcctgctgctgagcctgctgggctggatcctgagcatcatcaccacctacctgccccactggaagaacctgaacctggacctgaacgagatggagaactggaccatgggcctgtggcagacctgcgtgatccaggaggaggtgggcatgcagtgcaaggacttcgacagcttcctggccctgcccgccgagctgagagtgagcagaatcctgatgttcctgagcaacggcctgggcttcctgggcctgctggtgagcggcttcggcctggactgcctgagaatcggcgagagccagagagacctgaagagaagactgctgatcctgggcggcatcctgagctgggccagcggcatcaccgccctggtgcccgtgagctgggtggcccacaagaccgtgcaggagttctgggacgagaacgtgcccgacttcgtgcccagatgggagttcggcgaggccctgttcctgggctggttcgccggcctgagcctgctgctgggcggctgcctgctgaactgcgccgcctgcagcagccacgcccccctggccctgggccactacgccgtggcccagatgcagacccagtgcccctacctggaggacggcaccgccgacccccaggtgtag

SEQ ID NO: 19860 - DNA, 630 bp, Artificial Sequence
  Description of Artificial Sequence: Synthetic coding sequence
atggccagcatgggcctgcaggtgatgggcatcgccctggccgtgctgggctggctggccgtgatgctgtgctgcgccctgcccatgtggagagtgaccgccttcatcggcagcaacatcgtgaccagccagaccatctgggagggcctgtggatgaactgcgtggtgcagagcaccggccagatgcagtgcaaggtgtacgacagcctgctggccctgccccaggacctgcaggccgccagagccctggtgatcatcagcatcatcgtggccgccctgggcgtgctgctgagcgtggtgggcggcaagtgcaccaactgcctggaggacgagagcgccaaggccaagaccatgatcgtggccggcgtggtgttcctgctggccggcctgatggtgatcgtgcccgtgagctggaccgcccacaacatcatccaggacttctacaaccccctggtggccagcggccagaagagagagatgggcgccagcctgtacgtgggctgggccgccagcggcctgctgctgctgggcggcggcctgctgtgctgcaactgcccccccagaaccgacaagccctacagcgccaagtacagcgccgccagaagcgccgccgccagcaactacgtgtag

SEQ ID NO: 19861 - DNA, 630 bp, Artificial Sequence; identical to SEQ ID NO: 19860
  Description of Artificial Sequence: Synthetic coding sequence

SEQ ID NO: 19862 - DNA, 540 bp, Artificial Sequence
  Description of Artificial Sequence: Synthetic coding sequence
atgcaggaggtgatcgccggcctggagagattcaccttcgccttcgagaaggacgtggagatgcagaagggcaccggcctgctgcccttccagggcatggacaagagcgccagcgccgtgtgcaacttcttcaccaagggcctgtgcgagaagggcaagctgtgccccttcagacacgacagaggcgagaagatggtggtgtgcaagcactggctgagaggcctgtgcaagaagggcgaccactgcaagttcctgcaccagtacgacctgaccagaatgcccgagtgctacttctacagcaagttcggcgactgcagcaacaaggagtgcagcttcctgcacgtgaagcccgccttcaagagccaggactgcccctggtacgaccagggcttctgcaaggacggccccctgtgcaagtacagacacgtgcccagaatcatgtgcctgaactacctggtgggcttctgccccgagggccccaagtgccagttcgcccagaagatcagagagttcaagctgctgcccggcagcaagatctag

SEQ ID NO: 19863 - DNA, 459 bp, Artificial Sequence
  Description of Artificial Sequence: Synthetic coding sequence
atggtggtgtgcaagcactggctgagaggcctgtgcaagaagggcgaccactgcaagttcctgcaccagtacgacctgaccagaatgcccgagtgctacttctacagcaagttcggcgactgcagcaacaaggagtgcagcttcctgcacgtgaagcccgccttcaagagccaggactgcccctggtacgaccagggcttctgcaaggacgccggccccctgtgcaagtacagacacgtgcccagaatcatgtgcctgaactacctggtgggcttctgccccgagggccccaagtgccagttcgcccactgcagcctgcccgccggccccggcatccagcacctgctgttcctgctgtggaagctgggcaacccccacccccagcagagcgcctgcagccccgcctggggcagcggcgtgaagggcagagcctgcgccaccggccccctgtgccagtag

SEQ ID NO: 19864 - DNA, 678 bp, Artificial Sequence
  Description of Artificial Sequence: Synthetic coding sequence
atgagcaaggagatcttccccttctgcagagtgggcaacatcccctacgaggccaccgaggagcagctgaaggacatcttcagcgaggtgggccccgtggtgagcttcagactggtgtacgacagagagaccggcaagcccaagggctacggcttctgcgagtaccaggaccaggagaccgccctgagcgccatgagaaacctgaacggcagagagttcagcggcagagccctgagagtggacaacgccgccagcgagaagaacaaggaggagctgaagagcctgggcaccggcgcccccgtgatcgagagcccctacggcgagaccatcagccccgaggacgcccccgagagcatcagcaaggccgtggccagcctgccccccgagcagatgttcgagctgatgaagcagatgaagctgtgcgtgcagaacagcccccaggaggccagaaacatgctgctgcagaacccccagctggcctacgccctgctgcaggcccaggtggtgatgagaatcgtggaccccgagatcgccctgaagatcctgcacagacagaccaacatccccaccctgatcgccggcaacccccagcccgtgcacggcgccggccccggcagcggcagcaacgtgagcatgaaccagcagaacccccaggccccccaggcccagagcctgtag

SEQ ID NO: 19865 - DNA, 1794 bp, Artificial Sequence
  Description of Artificial Sequence: Synthetic coding sequence
atggccggcctgaccgtgagagaccccgccgtggacagaagcctgagaagcgtgttcgtgggcaacatcccctacgaggccaccgaggagcagctgaaggacatcttcagcgaggtgggccccgtggtgagcttcagactggtgtacgacagagagaccggcaagcccaagggctacggcttctgcgagtaccaggaccaggagaccgccctgagcgccatgagaaacctgaacggcagagagttcagcggcagagccctgagagtggacaacgccgccagcgagaagaacaaggaggagctgaagagcctgggcaccggcgcccccgtgatcgagagcccctacggcgagaccatcagccccgaggacgcccccgagagcatcagcaaggccgtggccagcctgccccccgagcagatgttcgagctgatgaagcagatgaagctgtgcgtgcagaacagcccccaggaggccagaaacatgctgctgcagaacccccagctggcctacgccctgctgcaggcccaggtggtgatgagaatcgtggaccccgagatcgccctgaagatcctgcacagacagaccaacatccccaccctgatcgccggcaacccccagcccgtgcacggcgccggccccggcagcggcagcaacgtgagcatgaaccagcagaacccccaggccccccaggcccagagcctgggcggcatgcacgtgaacggcgccccccccctgatgcaggccagcatgcagggcggcgtgcccgcccccggccagatgcccgccgccgtgaccggccccggccccggcagcctggcccccggcggcggcatgcaggcccaggtgggcatgcccggcagcggccccgtgagcatggagagaggccagggcaccctgcagcacagccccgtgggccccgccggccccgccagcatcgagagagtgcaggtgcccatgcaggaccccagagccgccatgcagagaggcagcctgcccgccaacgtgcccacccccagaggcctgctgggcgacgcccccaacgaccccagaggcggcaccctgctgagcgtgaccggcgaggtggagcccagaggctacctgggccccccccaccagggcccccccatgcaccacgtgcccggccacgagagcagaggcccccccccccacgagctgagaggcggccccctgcccgagcccagacccctgatggccgagcccagaggccccatgctggaccagagaggcccccccctggacggcagaggcggcagagaccccagaggcatcgacgccagaggcatggaggccagagccatggaggccagaggcctggacgccagaggcctggaggccagagccatggaggccagagccatggaggccagagccatggaggccagagccatggaggccagagccatggaggtgagaggcatggaggccagaggcatggacaccagaggccccgtgcccggccccagaggccccatccccagcggcatgcagggccccagccccatcaacatgggcgccgtggtgccccagggcagcagacaggtgcccgtgatgcagggcaccggcatgcagggcgccagcatccagggcggcagccagcccggcggcttcagccccggccagaaccaggtgaccccccaggaccacgagaaggccgccctgatcatgcaggtgctgcagctgaccgccgaccagatcgccatgctgccccccgagcagagacagagcatcctgatcctgaaggagcagatccagaagagcaccggcgccccctag

SEQ ID NO: 19866 - DNA, 786 bp, Artificial Sequence
  Description of Artificial Sequence: Synthetic coding sequence
atgcacggcgaggccagcgacggcgagggcgagggcgacaccgaggtgatgcagcaggagaccgtgcccgtgcccgtgcccagcgagaagaccaagcagcccaaggagtgcttcctgatccagcccaaggagagaaaggagaacaccaccaagaccagaaagagaagaaagaagaagatcaccgacgtgctggccaagagcgagcccaagcccggcctgcccgaggacctgcagaagctgatgaaggactactacagcagcagaagactggtgatcgagctggaggagctgaacctgcccgacagctgcttcctgaaggccaacgacctgacccacagcctgagcagctacctgaaggagatctgccccaagtgggtgaagctgagaaagaaccacagcgagaagaagagcgtgctgatgctgatcatctgcagcagcgccgtgagagccctggagctgatcagaagcatgaccgccttcagaggcgacggcaaggtgatcaagctgttcgccaagcacatcaaggtgcaggcccaggtgaagctgctggagaagagagtggtgcacctgggcgtgggcacccccggcagaatcaaggagctggtgaagcagggcggcctgaacctgagccccctgaagttcctggtgttcgactggaactggagagaccagaagctgagaagaatgatggacatccccgagatcagaaaggaggtgttcgagctgctggagatgggcgtgctgagcctgtgcaagagcgagagcctgaagctgggcctgttctag

SEQ ID NO: 19867 - DNA, 732 bp, Artificial Sequence
  Description of Artificial Sequence: Synthetic coding sequence
atgagccccgaccagttcctgctgaccgtgagcgccctgcagcacgccagaaacagcggcgagttcgcctacccctgcagaccccagaccgagatcaccgacgtgtggggccccagcatcagctaccccagaaaggtgctgaacttcaagggcaagagcatccagagagccgtggacagactgagactgagcaacccccccatcgacgtgaagagaaccagcatccccctggagatccagaagctgcagcccaacctgaagatcagcctgcacagccccagagcccagagcaccatccccgagcccatgatcatcagaagcagattcagcggcagcctgaagggcggcgaccaggtgaccagcagcatcgagagagccgtgtgcagcaccggccccctgaccagcatgcaggtgatcaagcccaacagaatgctggccccccaggtgggcaccgccaccctgagcctgaagaaggagagacccagaatctacaccgccctggaccccttcagagtgaacgccgagttcgtgctgctgaccgtgaaggaggagaaggagcaccaggaggccaagatgaaggagtaccaggccagagagagcaccggcgtggtggaccccggcaaggccagcaaggccgcctggatcagaaagatcaagggcctgcccatcgacaacttcaccaagcagggcaagaccgccgcccccgagctgggccagaacgtgttcatctag

SEQ ID NO: 19868 - DNA, 759 bp, Artificial Sequence
  Description of Artificial Sequence: Synthetic coding sequence
atggacctgtgcaagaacagactggtgagcggcggcagagactgccaggtgaaggtgtgggacgtggacaccggcaagtgcctgaagaccttcagacacaaggaccccatcctggccaccagaatcaacgacacctacatcgtgagcagctgcgagagaggcctggtgaaggtgtggcacatcgccatggcccagctggtgaagaccctgagcggccacgagggcgccgtgaagtgcctgttcttcgaccagtggcacctgctgagcggcagcaccgacggcctggtgatggcctggagcatggtgggcaagtacgagagatgcctgatggccttcaagcaccccaaggaggtgctggacgtgagcctgctgttcctgagagtgatcagcgcctgcgccgacggcaagatcagaatctacaacttcttcaacggcaactgcatgaaggtgatcaaggccaacggcagaggcgaccccgtgctgagcttcttcatccagggcaacagaatcagcgtgtgccacatcagcaccttcgccaagagaatcaacgtgggctggaacggcatcgagcccagcgccaccgcccagggcggcaacgccagcctgaccgagtgcgcccacgtgagactgcacatcgccggccacctgcccgccagcagactgcccgtggccgccgtgcagcccatgaccggcggcatggcccccaccaccgcccccacccacgtgctggccatgctgatcctgttcagcggcgtgtag

SEQ ID NO: 19869 - DNA, 2259 bp, Artificial Sequence
  Description of Artificial Sequence: Synthetic coding sequence
atggagaacctggagagcagactgaagaacgccccctacttcagatgcgagaagggcaccgacagcatccccctgtgcagaaagtgcgagaccagagtgctggcctggaagatcttcagcaccaaggagtggttctgcagaatcaacgacatcagccagagaagattcctggtgggcatcctgaagcagctgaacagcctgtacctgctgcactacttccagaacatcctgcagaccacccagggcaaggacttcatctacaacagaagcagaatcgacctgagcaagaaggagggcaaggtggtgaagagcagcctgaaccagatgctggacaagaccgtggagcagaagatgaaggagatcctgtactggttcgccaacagcacccagtggaccaaggccaactacaccctgctgctgctgcagatgtgcaaccccaagctgctgctgaccgccgccaacgtgatcagagtgctgttcctgagagaggagaacaacatcagcggcctgaaccaggacatcaccgacgtgtgcttcagccccgagaaggaccacagcagcaagagcgccaccagccaggtgtactggaccgccaagacccagcacaccagcctgcccctgagcaaggcccccgagaacgagcacttcctgggcgccgccagcaaccccgaggagccctggagaaacagcctgagatgcatcagcgagatgaacagactgttcagcggcaaggccgacatcaccaagcccggctacgacccctgcaacctgctggtggacctggacgacatcagagacctgagcagcggcttcagcaagtacagagacttcatcagatacctgcccatccacctgagcaagtacatcctgagaatgctggacagacacaccctgaacaagtgcgccagcgtgagccagcactgggccgccatggcccagcaggtgaagatggacctgagcgcccacggcttcatccagaaccagatcaccttcctgcagggcagctacaccagaggcatcgaccccaactacgccaacaaggtgagcatccccgtgcccaagatggtggacgacggcaagagcatgagagtgaagcaccccaagtggaagctgagaaccaagaacgagtacaacctgtggaccgcctaccagaacgaggagacccagcaggtgctgatggaggagagaaacgtgttctgcggcacctacaacgtgagaatcctgagcgacacctgggaccagaacagagtgatccactacagcggcggcgacctgatcgccgtgagcagcaacagaaagatccacctgctggacatcatccaggtgaaggccatccccgtggagttcagaggccacgccggcagcgtgagagccctgttcctgtgcgaggaggagaacttcctgctgagcggcagctacgacctgagcatcagatactgggacctgaagagcggcgtgtgcaccagaatcttcggcggccaccagggcaccatcacctgcatggacctgtgcaagaacagactggtgagcggcggcagagactgccaggtgaaggtgtgggacgtggacaccggcaagtgcctgaagaccttcagacacaaggaccccatcctggccaccagaatcaacgacacctacatcgtgagcagctgcgagagaggcctggtgaaggtgtggcacatcgccatggcccagctggtgaagaccctgagcggccacgagggcgccgtgaagtgcctgttcttcgaccagtggcacctgctgagcggcagcaccgacggcctggtgatggcctggagcatggtgggcaagtacgagagatgcctgatggccttcaagcaccccaaggaggtgctggacgtgagcctgctgttcctgagagtgatcagcgcctgcgccgacggcaagatcagaatctacaacttcttcaacggcaactgcatgaaggtgatcaaggccaacggcagaggcgaccccgtgctgagcttcttcatccagggcaacagaatcagcgtgtgccacatcagcaccttcgccaagagaatcaacgtgggctggaacggcatcgagcccagcgccaccgcccagggcggcaacgccagcctgaccgagtgcgcccacgtgagactgcacatcgccggccacctgcccgccagcagactgcccgtggccgccgtgcagcccatgaccggcggcatggcccccaccaccgcccccacccacgtgctggccatgctgatcctgttcagcggcgtgtag

SEQ ID NO: 19870 - DNA, 567 bp, Artificial Sequence
  Description of Artificial Sequence: Synthetic coding sequence
atgttcagctgctgcttccccaccagcagaggctgctgcttcagaaacggcggcagcgagagcctgttcagaagatgcagaagaagactgatcccccaccccagaagactgagccccgtggtgatcagaagaatccaggtgccccaggacagcctgggccaggccctggccggccaggccacccccgagatccccctgggcctgcagctgcacaccgtgctggtgcaggagatccaggagctgatcgaggcccagaccctggcccccggcccctgcgccgaggtgagagccctgcccgcccccgccgccgagcccgagcccgcctgggaggaggccccccccgagagagccctggagctggagggcgcccccgccaaggaccagaccaacgaggagctgcccgagatcaccgaggtgcccgagagcatcaagagaagactgggcagaagagtgcccgccgccacccccgcccccagaggcaacctgctgctgcaggcctggatgagagtgcacagctgggccagcagactgttcgcccccaacgtgctgcccggcaccggcccctag

SEQ ID NO: 19871 - DNA, 369 bp, Artificial Sequence
  Description of Artificial Sequence: Synthetic coding sequence
atgcccaagaaggcccaccccagcccccagacccccgtggccagatgcaacaaggcccaccccgcccccggcccctgcgccgaggtgagagccctgcccgcccccgccgccgagcccgagcccgcctgggaggaggccccccccgagagagccctggagctggagggcgcccccgccaaggaccagaccaacgaggagctgcccgagatcaccgaggtgcccgagagcatcaagagaagactgggcagaagagtgcccgccgccacccccgcccccagaggcaacctgctgctgcaggcctggatgagagtgcacagctgggccagcagactgttcgcccccaacgtgctgcccggcaccggcccctag

SEQ ID NO: 19872 - DNA, 846 bp, Artificial Sequence
  Description of Artificial Sequence: Synthetic coding sequence
atgttcagctgctgcttccccaccagcagaggctgctgcttcagaaacggcggcagcgagagcctgttcagacagtgcagaagaagactgatcccccaccccagaagactgtggcccttcgtgagaagaagaacccaggtgccccaggacagccccggccaggccctggccggccaggccacccccgagatccccagcggcctgcccctgcacatcgtgctggtgcaggaggagatcagagagcccatggaggcccagacccacgcccccggcccctacgccgacatcgccgccctggccgcccccgccgtggagcccaagcccgcctgggaggagcccccccccgagagagccctggaggtggagggcgcccccgccaaggaccagcccagccaggagctgcccgagatcatggcccccaccgtggccaccggcctgaacgccggcgccgagaacgtggccggcgagagaagcggcagagagggcgtgaccagcaccgcccccgccagcagaagccacgccgcccccagccccggccacggcggcaagcacggcggcggcgaccagggcatccagaccggcctgctgtacctggccggcgagagactgctgagcttcgccggcaccaccgccctgctgctgcagggcctgttcatcgtgctgatcctggtgggctacatcagcgtgaaggtgatgctgaagagcatcaagaccagactgggcagaagagtgcccgccgccccccccgccctgagaagaaacctgctgctgcaggcctggaagtgcgtgtgcaactgggccagcagactgttcgcccccaacgtgctgcccagaaccggcagctag

SEQ ID NO: 19873 - DNA, 456 bp, Artificial Sequence
  Description of Artificial Sequence: Synthetic coding sequence
atggacgccagaagaatgaagaaggagggcctgaccgagaacaccggcctgcccagaaagctgctggagaagcacgacccctggcccgcctacgtgacctacaccagccagaccgtgaagagactgatcgagaagagcaagaccagagagctggagtgcatgagagccctggaggagagaccctgggccagcagacagaacaagcccagcagcgtgatccagcccaagagaagaaagagcagcaagagcagcggcaaggccgtgttcagagacaccctgagcgagagcaccctgagcatgtggggcgcctacagcgtgctggccatggcccccaccatgatccccgagcccacccacctgcacgccgacagcagagactgccccaccgagaactacaacaagatcatcttcgccagaaagcccatgatgagaatgctgcccaccgtgagatactag

SEQ ID NO: 19874 - DNA, 459 bp, Artificial Sequence
  Description of Artificial Sequence: Synthetic coding sequence
atggacgccagaagaatgaagaaggaggagggcctgaccgagaacaccggcctgcccagaaagctgctggagaagcacgacccctggcccgcctacgtgacctacaccagccagaccgtgaagagactgatcgagaagagcaagaccagagagctggagtgcatgagagccctggaggagagaccctgggccagcagacagaacaagcccagcagcgtgatccagcccaagagaagaaagagcagcaagagcagcggcaaggccgtgttcagagacaccctgagcgagagcaccctgagcatgtggggcgcctacagcgtgctggccatggcccccaccatgatccccgagcccacccacctgcacgccgacagcagagactgccccaccgagaactacaacaagatcatcttcgccagaaagcccatgatgagaatgctgcccaccgtgagatactag

SEQ ID NO: 19875 - DNA, 75 bp, Artificial Sequence
  Description of Artificial Sequence: Synthetic coding sequence
atggacgccagaagaatgaagaaggaggagggcctgaccgagaacaccggcctgcccagaaagctgctggagtag

SEQ ID NO: 19876 - DNA, 627 bp, Artificial Sequence
  Description of Artificial Sequence: Synthetic coding sequence
atgcagagacccgagtggcccagaccccaccccggcgagggcgccgccgccgccggcagaggccccgccccccccgccagagccggcgagcccagcggcctgagactgcaggagcccagcctgtacaccatcaaggccgtgttcatcctggacaacgacggcagaagactgctggccaagtactacgacgacaccttccccagcatgaaggagcagatggtgttcgagaagaacgtgttcaacaagaccagcagaaccgagagcgagatcgccttcttcggcggcatgaccatcgtgtacaagaacagcatcgacctgttcctgtacgtggtgggcagcagctacgagaacgagctgatgctgatgagcgtgctgacctgcctgttcgagagcctgaaccacatgctgagaaagaacgtggagaagagatggctgctggagaacatggacggcgccttcctggtgctggacgagatcgtggacggcggcgtgatcctggagagcgacccccagcaggtgatccagaaggtgaacttcagagccgacgacggcggcctgaccgagcagagcgtggcccaggtgctgcagagcgccaaggagcagatcaagtggagcctgctgaagtag

SEQ ID NO: 19877 - DNA, 3702 bp, Artificial Sequence
  Description of Artificial Sequence: Synthetic coding sequence
atgccccccagctggagccccctgatgtgcggcagagccgccgaggccgccgccagcagcagaacccccggcagagagatgggccaggccgtgaccagaagactgggcgccggcgccagagccgcccccagaagagccatggacggcagaacccccagaccccaggacgcccccgccagaagagagatcgccggcagctggagaaagcccaaggccaaggcccccctgccccccgccgagaccaagtacaccgacgtgagcagcgccgccgacagcgtggagagcaccgccttcatcatggagcagaaggagaacatgatcgacaaggacgtggagctgagcgtggtgctgcccggcgacatcatcaagagcaccaccgtgcacggcagcaagcccatgatggacctgctgatcttcctgtgcgcccagtaccacctgaaccccagcagctacaccatcgacctgctgagcgccgagcagaaccacatcaagttcaagcccaacacccccatcggcatgctggaggtggagaaggtgatcctgaagcccaagatgctggacaagaagaagcccacccccatcatccccgagaagaccgtgagagtggtgatcaacttcaagaagacccagaagaccatcgtgagagtgagcccccacgccagcctgcaggagctggcccccatcatctgcagcaagtgcgagttcgaccccctgcacaccctgctgctgaaggactaccagagccaggagcccctggacctgaccaagagcctgaacgacctgggcctgagagagctgtacgccatggacgtgaacagagccaccagcgtgaccgtgttcagcaagagcagcctgcaggagagctgccagatcagccagaacctggacatcatgaaggagaaggagaacaagggcttcttcagcttcttccagagaagcaagaagaagagagaccagaccgccagcgcccccgccacccccctggtgaacaagcacagacccaccttcaccagaagcaacaccatcagcaagccctacatcagcaacaccctgcccagcgacgcccccaagaagagaagagcccccctgccccccatgcccgccagccagagcgtgccccaggacctggcccacatccaggagagacccgccagctgcatcgtgaagagcatgagcgtggacgagaccgacaagagcccctgcgaggccggcagagtgagagccggcagcctgcagctgagcagcatgagcgccggcaacagcagcctgagaagaaccaagagaaaggcccccagcccccccagcaagatccccccccaccagagcgacgagaacagcagagtgaccgccctgcagcccgtggacggcgtgccccccgacagcgccagcgaggccaacagccccgaggagctgagcagccccgagaccttccaccccggcctgagcagccaggagcagtgcaccgcccccaagctgatggaggagaccagcgtgttcgagtgccccggcacccccgaggccgccatcaccagcctgaccagcggcatcagcagcgactacagcctggaggagatcgacgagaaggaggagctgagcgaggtgcccaaggtggaggccgagaacatcagccccaagagccaggacatccccttcgtgagcaccgacatcatcaacaccctgaagaacgaccccgacagcgccctgggcaacggcagcggcgagttcagccagaacagcatggaggagaagcaggagaccaagagcaccgacggccaggagccccacagcgtggtgtacgacaccagcaacggcaagaaggtggtggacagcatcagaaacctgaagagcctgggccccaaccaggagaacgtggtgcagaacgagatcatcgtgtaccccgagaacaccgaggacaacatgaagaacggcgtgaagaagaccgagatcaacgtggagggcgtggccaagaacaacaacatcgacatggaggtggagagacccagcaacagcgaggcccacgagaccgacaccgccatcagctacaaggagaaccacctggccgccagcagcgtgcccgaccagaagctgaaccagcccagcgccgagaagaccaaggacgccgccatccagaccacccccagctgcaacagcttcgacggcaagcaccaggaccacaacctgagcgacagcaaggtggaggagtgcgtgcagaccagcaacaacaacatcagcacccagcacagctgcctgagcagccaggacagcgtgaacaccagcagagagttcagaagccagggcaccctgatcatccacagcgaggaccccctgaccgtgaaggaccccatctgcgcccacggcaacgacgacctgctgccccccgtggacagaatcgacaagaacagcaccgccagctacctgaagaactaccccctgtacagacaggactacaaccccaagcccaagcccagcaacgagatcaccagagagtacatccccaagatcggcatgaccacctacaagatcgtgccccccaagagcctggagatcagcaaggactggcagagcgagaccatcgagtacaaggacgaccaggacatgcacgccctgggcaagaagcacacccacgagaacgtgaaggagaccgccatccagaccgaggacagcgccatcagcgagagccccgaggagcccctgcccaacctgaagcccaagcccaacctgagaaccgagcaccaggtgcccagcagcgtgagcagccccgacgacgccatggtgagccccctgaagcccgcccccaagatgaccagagacaccggcaccgcccccttcgcccccaacctggaggagatcaacaacatcctggagagcaagttcaagagcagagccagcaacgcccaggccaagcccagcagcttcttcctgcagatgcagaagagagtgagcggccactacgtgaccagcgccgccgccaagagcgtgcacgccgcccccaaccccgcccccaaggagctgaccaacaaggaggccgagagagacatgctgcccagccccgagcagaccctgagccccctgagcaagatgccccacagcgtgccccagcccctggtggagaagaccgacgacgacgtgatcggccaggcccccgccgaggccagccccccccccatcgcccccaagcccgtgaccatccccgccagccaggtgagcacccagaacctgaagaccctgaagaccttcggcgcccccagaccctacagcagcagcggccccagccccttcgccctggccgtggtgaagagaagccagagcttcagcaaggagagaaccgagagccccagcgccagcgccctggtgcagccccccgccaacaccgaggagggcaagacccacagcgtgaacaagttcgtggacatcccccagctgggcgtgagcgacaaggagaacaacagcgcccacaacgagcagaacagccagatccccacccccaccgacggccccagcttcaccgtgatgagacagagcagcctgaccttccagagcagcgaccccgagcagatgagacagagcctgctgaccgccatcagaagcggcgaggccgccgccaagctgaagagagtgaccatccccagcaacaccatcagcgtgaacggcagaagcagactgagccacagcatgagccccgacgcccaggacggccactag

SEQ ID NO: 19878 - DNA, 3501 bp, Artificial Sequence
  Description of Artificial Sequence: Synthetic coding sequence
atggacggcagaacccccagaccccaggacgcccccgccagaagaaagcccaaggccaaggcccccctgccccccgccgagaccaagtacaccgacgtgagcagcgccgccgacagcgtggagagcaccgccttcatcatggagcagaaggagaacatgatcgacaaggacgtggagctgagcgtggtgctgcccggcgacatcatcaagagcaccaccgtgcacggcagcaagcccatgatggacctgctgatcttcctgtgcgcccagtaccacctgaaccccagcagctacaccatcgacctgctgagcgccgagcagaaccacatcaagttcaagcccaacacccccatcggcatgctggaggtggagaaggtgatcctgaagcccaagatgctggacaagaagaagcccacccccatcatccccgagaagaccgtgagagtggtgatcaacttcaagaagacccagaagaccatcgtgagagtgagcccccacgccagcctgcaggagctggcccccatcatctgcagcaagtgcgagttcgaccccctgcacaccctgctgctgaaggactaccagagccaggagcccctggacctgaccaagagcctgaacgacctgggcctgagagagctgtacgccatggacgtgaacagagagagctgccagatcagccagaacctggacatcatgaaggagaaggagaacaagggcttcttcagcttcttccagagaagcaagaagaagagagaccagaccgccagcgcccccgccacccccctggtgaacaagcacagacccaccttcaccagaagcaacaccatcagcaagccctacatcagcaacaccctgcccagcgacgcccccaagaagagaagagcccccctgccccccatgcccgccagccagagcgtgccccaggacctggcccacatccaggagagacccgccagctgcatcgtgaagagcatgagcgtggacgagaccgacaagagcccctgcgaggccggcagagtgagagccggcagcctgcagctgagcagcatgagcgccggcaacagcagcctgagaagaaccaagagaaaggcccccagcccccccagcaagatccccccccaccagagcgacgagaacagcagagtgaccgccctgcagcccgtggacggcgtgccccccgacagcgccagcgaggccaacagccccgaggagctgagcagccccgagaccttccaccccggcctgagcagccaggagcagtgcaccgcccccaagctgatggaggagaccagcgtgttcgagtgccccggcacccccgaggccgccatcaccagcctgaccagcggcatcagcagcgactacagcctggaggagatcgacgagaaggaggagctgagcgaggtgcccaaggtggaggccgagaacatcagccccaagagccaggacatccccttcgtgagcaccgacatcatcaacaccctgaagaacgaccccgacagcgccctgggcaacggcagcggcgagttcagccagaacagcatggaggagaagcaggagaccaagagcaccgacggccaggagccccacagcgtggtgtacgacaccagcaacggcaagaaggtggtggacagcatcagaaacctgaagagcctgggccccaaccaggagaacgtgcagaacgagatcatcgtgtaccccgagaacaccgaggacaacatgaagaacggcgtgaagaagaccgagatcaacgtggagggcgtggccaagaacaacaacatcgacatggaggtggagagacccagcaacagcgaggcccacgagaccgacaccgccatcagctacaaggagaaccacctggccgccagcagcgtgcccgaccagaagctgaaccagcccagcgccgagaagaccaaggacgccgccatccagaccacccccagctgcaacagcttcgacggcaagcaccaggaccacaacctgagcgacagcaaggtggaggagtgcgtgcagaccagcaacaacaacatcagcacccagcacagctgcctgagcagccaggacagcgtgaacaccagcagagagttcagaagccagggcaccctgatcatccacagcgaggaccccctgaccgtgaaggaccccatctgcgcccacggcaacgacgacctgctgccccccgtggacagaatcgacaagaacagcaccgccagctacctgaagaactaccccctgtacagacaggactacaaccccaagcccaagcccagcaacgagatcaccagagagtacatccccaagatcggcatgaccacctacaagatcgtgccccccaagagcctggagatcagcaaggactggcagagcgagaccatcgagtacaaggacgaccaggacatgcacgccctgggcaagaagcacacccacgagaacgtgaaggagaccgccatccagaccgaggacagcgccatcagcgagagccccgaggagcccctgcccaacctgaagcccaagcccaacctgagaaccgagcaccaggtgcccagcagcgtgagcagccccgacgacgccatggtgagccccctgaagcccgcccccaagatgaccagagacaccggcaccgcccccttcgcccccaacctggaggagatcaacaacatcctggagagcaagttcaagagcagagccagcaacgcccaggccaagcccagcagcttcttcctgcagatgcagaagagagtgagcggccactacgtgaccagcgccgccgccaagagcgtgcacgccgcccccaaccccgcccccaaggagctgaccaacaaggaggccgagagagacatgctgcccagccccgagcagaccctgagccccctgagcaagatgccccacagcgtgccccagcccctggtggagaagaccgacgacgacgtgatcggccaggcccccgccgaggccagccccccccccatcgcccccaagcccgtgaccatccccgccagccaggtgagcacccagaacctgaagaccctgaagaccttcggcgcccccagaccctacagcagcagcggccccagccccttcgccctggccgtggtgaagagaagccagagcttcagcaaggagagaaccgagagccccagcgccagcgccctggtgcagccccccgccaacaccgaggagggcaagacccacagcgtgaacaagttcgtggacatcccccagctgggcgtgagcgacaaggagaacaacagcgcccacaacgagcagaacagccagatccccacccccaccgacggccccagcttcaccgtgatgagacagagcagcctgaccttccagagcagcgaccccgagcagatgagacagagcctgctgaccgccatcagaagcggcgaggccgccgccaagctgaagagagtgaccatccccagcaacaccatcagcgtgaacggcagaagcagactgagccacagcatgagccccgacgcccaggacggccactag

SEQ ID NO: 19879 - DNA, 3387 bp, Artificial Sequence
  Description of Artificial Sequence: Synthetic coding sequence
atggacggcagaacccccagaccccaggacgcccccgccagaagaaagcccaaggccaaggcccccctgccccccgccgagaccaagtacaccgacgtgagcagcgccgccgacagcgtggagagcaccgccttcatcatggagcagaaggagaacatgatcgacaaggacgtggagctgagcgtggtgctgcccggcgacatcatcaagagcaccaccgtgcacggcagcaagcccatgatggacctgctgatcttcctgtgcgcccagtaccacctgaaccccagcagctacaccatcgacctgctgagcgccgagcagaaccacatcaagttcaagcccaacacccccatcggcatgctggaggtggagaaggtgatcctgaagcccaagatgctggacaagaagaagcccacccccatcatccccgagaagaccgtgagagtggtgatcaacttcaagaagacccagaagaccatcgtgagagtgagcccccacgccagcctgcaggagctggcccccatcatctgcagcaagtgcgagttcgaccccctgcacaccctgctgctgaaggactaccagagccaggagcccctggacctgaccaagagcctgaacgacctgggcctgagagagctgtacgccatggacgtgaacagagagagctgccagatcagccagaacctggacatcatgaaggagaaggagaacaagggcttcttcagcttcttccagagaagcaagaagaagagagaccagaccgccagcgcccccgccacccccctggtgaacaagcacagacccaccttcaccagaagcaacaccatcagcaagccctacatcagcaacaccctgcccagcgacgcccccaagaagagaagagcccccctgccccccatgcccgccagccagagcgtgccccaggacctggcccacatccaggagagacccgccagctgcatcgtgaagagcatgagcgtggacgagaccgacaagagcccctgcgaggccggcagagtgagagccggcagcctgcagctgagcagcatgagcgccggcaacagcagcctgagaagaaccaagagaaaggcccccagcccccccagcaagatccccccccaccagagcgacgagaacagcagagtgaccgccctgcagcccgtggacggcgtgccccccgacagcgccagcgaggccaacagccccgaggagctgagcagccccgccggcatcagcagcgactacagcctggaggagatcgacgagaaggaggagctgagcgaggtgcccaaggtggaggccgagaacatcagccccaagagccaggacatccccttcgtgagcaccgacatcatcaacaccctgaagaacgaccccgacagcgccctgggcaacggcagcggcgagttcagccagaacagcatggaggagaagcaggagaccaagagcaccgacggccaggagccccacagcgtggtgtacgacaccagcaacggcaagaaggtggtggacagcatcagaaacctgaagagcctgggccccaaccaggagaacgtggtgcagaacgagatcatcgtgtaccccgagaacaccgaggacaacatgaagaacggcgtgaagaagaccgagatcaacgtggagggcgtggccaagaacaacaacatcgacatggaggtggagagacccagcaacagcgaggcccacgagaccgacaccgccatcagctacaaggagaaccacctggccgccagcagcgtgcccgaccagaagctgaaccagcccagcgccgagaagaccaaggacgccgccatccagaccacccccagctgcaacagcttcgacggcaagcaccaggaccacaacctgagcgacagcaaggtggaggagtgcgtgcagaccagcaacaacaacatcagcacccagcacagctgcctgagcagccaggacagcgtgaacaccagcagagagttcagaagccagggcaccctgatcatccacagcgaggaccccctgaccgtgaaggaccccatctgcgcccacggcaacgacgacctgctgccccccgtggacagaatcgacaagaacagcaccgccagctacctgaagaactaccccctgtacagacaggactacaaccccaagcccaagcccagcaacgagatcaccagagagtacatccccaagatcggcatgaccacctacaagatcgtgccccccaagagcctggagatcagcaaggactggcagagcgagaccatcgagtacaaggacgaccaggacatgcacgccctgggcaagaagcacacccacgagaacgtgaaggagaccgccatccagaccgaggacagcgccatcagcgagagccccgaggagcccctgcccaacctgaagcccaagcccaacctgagaaccgagcaccaggtgcccagcagcgtgagcagccccgacgacgccatggtgagccccctgaagcccgcccccaagatgaccagagacaccggcaccgcccccttcgcccccaacctggaggagatcaacaacatcctggagagcaagttcaagagcagagccagcaacgcccaggccaagcccagcagcttcttcctgcagatgcagaagagagtgagcggccactacgtgaccagcgccgccgccaagagcgtgcacgccgcccccaaccccgcccccaaggagctgaccaacaaggaggccgagagagacatgctgcccagccccgagcagaccctgagccccctgagcaagatgccccacagcgtgccccagcccctggtggagaagaccgacgacgacgtgatcggccaggcccccgccgaggccagccccccccccatcgcccccaagcccgtgaccatccccgccagccaggtgagcacccagaacctgaagaccctgaagaccttcggcgcccccagaccctacagcagcagcggccccagccccttcgccctggccgtggtgaagagaagccagagcttcagcaaggagagaaccgagagccccagcgccagcgccctggtgcagccccccgccaacaccgaggagggcaagacccacagcgtgaacaagttcgtggacatcccccagctgggcgtgagcgacaaggagaacaacagcgcccacaacgagcagaacagccagatccccacccccaccgacggccccagcttcaccgtgatgagacagagcagcctgaccttccagagcagcgaccccgagcagatgagacagagcctgctgaccgccatcagaagcggcgaggccgccgccaagctgaagagagtgaccatccccagcaacaccatcagcgtgaacggcagaagcagactgagccacagcatgagccccgacgcccaggacggccactag

SEQ ID NO: 19880 - DNA, 3615 bp, Artificial Sequence
  Description of Artificial Sequence: Synthetic coding sequence
atgtgcggcagagccgccgaggccgccgccagcagcagaacccccggcagagagatgggccaggccgtgaccagaagactgggcgccggcgccagagccgcccccagaagagccatggacggcagaacccccagaccccaggacgcccccgccagaagaaagcccaaggccaaggcccccctgccccccgccgagaccaagtacaccgacgtgagcagcgccgccgacagcgtggagagcaccgccttcatcatggagcagaaggagaacatgatcgacaaggacgtggagctgagcgtggtgctgcccggcgacatcatcaagagcaccaccgtgcacggcagcaagcccatgatggacctgctgatcttcctgtgcgcccagtaccacctgaaccccagcagctacaccatcgacctgctgagcgccgagcagaaccacatcaagttcaagcccaacacccccatcggcatgctggaggtggagaaggtgatcctgaagcccaagatgctggacaagaagaagcccacccccatcatccccgagaagaccgtgagagtggtgatcaacttcaagaagacccagaagaccatcgtgagagtgagcccccacgccagcctgcaggagctggcccccatcatctgcagcaagtgcgagttcgaccccctgcacaccctgctgctgaaggactaccagagccaggagcccctggacctgaccaagagcctgaacgacctgggcctgagagagctgtacgccatggacgtgaacagagagagctgccagatcagccagaacctggacatcatgaaggagaaggagaacaagggcttcttcagcttcttccagagaagcaagaagaagagagaccagaccgccagcgcccccgccacccccctggtgaacaagcacagacccaccttcaccagaagcaacaccatcagcaagccctacatcagcaacaccctgcccagcgacgcccccaagaagagaagagcccccctgccccccatgcccgccagccagagcgtgccccaggacctggcccacatccaggagagacccgccagctgcatcgtgaagagcatgagcgtggacgagaccgacaagagcccctgcgaggccggcagagtgagagccggcagcctgcagctgagcagcatgagcgccggcaacagcagcctgagaagaaccaagagaaaggcccccagcccccccagcaagatccccccccaccagagcgacgagaacagcagagtgaccgccctgcagcccgtggacggcgtgccccccgacagcgccagcgaggccaacagccccgaggagctgagcagccccgagaccttccaccccggcctgagcagccaggagcagtgcaccgcccccaagctgatggaggagaccagcgtgttcgagtgccccggcacccccgaggccgccatcaccagcctgaccagcggcatcagcagcgactacagcctggaggagatcgacgagaaggaggagctgagcgaggtgcccaaggtggaggccgagaacatcagccccaagagccaggacatccccttcgtgagcaccgacatcatcaacaccctgaagaacgaccccgacagcgccctgggcaacggcagcggcgagttcagccagaacagcatggaggagaagcaggagaccaagagcaccgacggccaggagccccacagcgtggtgtacgacaccagcaacggcaagaaggtggtggacagcatcagaaacctgaagagcctgggccccaaccaggagaacgtgcagaacgagatcatcgtgtaccccgagaacaccgaggacaacatgaagaacggcgtgaagaagaccgagatcaacgtggagggcgtggccaagaacaacaacatcgacatggaggtggagagacccagcaacagcgaggcccacgagaccgacaccgccatcagctacaaggagaaccacctggccgccagcagcgtgcccgaccagaagctgaaccagcccagcgccgagaagaccaaggacgccgccatccagaccacccccagctgcaacagcttcgacggcaagcaccaggaccacaacctgagcgacagcaaggtggaggagtgcgtgcagaccagcaacaacaacatcagcacccagcacagctgcctgagcagccaggacagcgtgaacaccagcagagagttcagaagccagggcaccctgatcatccacagcgaggaccccctgaccgtgaaggaccccatctgcgcccacggcaacgacgacctgctgccccccgtggacagaatcgacaagaacagcaccgccagctacctgaagaactaccccctgtacagacaggactacaaccccaagcccaagcccagcaacgagatcaccagagagtacatccccaagatcggcatgaccacctacaagatcgtgccccccaagagcctggagatcagcaaggactggcagagcgagaccatcgagtacaaggacgaccaggacatgcacgccctgggcaagaagcacacccacgagaacgtgaaggagaccgccatccagaccgaggacagcgccatcagcgagagccccgaggagcccctgcccaacctgaagcccaagcccaacctgagaaccgagcaccaggtgcccagcagcgtgagcagccccgacgacgccatggtgagccccctgaagcccgcccccaagatgaccagagacaccggcaccgcccccttcgcccccaacctggaggagatcaacaacatcctggagagcaagttcaagagcagagccagcaacgcccaggccaagcccagcagcttcttcctgcagatgcagaagagagtgagcggccactacgtgaccagcgccgccgccaagagcgtgcacgccgcccccaaccccgcccccaaggagctgaccaacaaggaggccgagagagacatgctgcccagccccgagcagaccctgagccccctgagcaagatgccccacagcgtgccccagcccctggtggagaagaccgacgacgacgtgatcggccaggcccccgccgaggccagccccccccccatcgcccccaagcccgtgaccatccccgccagccaggtgagcacccagaacctgaagaccctgaagaccttcggcgcccccagaccctacagcagcagcggccccagccccttcgccctggccgtggtgaagagaagccagagcttcagcaaggagagaaccgagagccccagcgccagcgccctggtgcagccccccgccaacaccgaggagggcaagacccacagcgtgaacaagttcgtggacatcccccagctgggcgtgagcgacaaggagaacaacagcgcccacaacgagcagaacagccagatccccacccccaccgacggccccagcttcaccgtgatgagacagagcagcctgaccttccagagcagcgaccccgagcagatgagacagagcctgctgaccgccatcagaagcggcgaggccgccgccaagctgaagagagtgaccatccccagcaacaccatcagcgtgaacggcagaagcagactgagccacagcatgagccccgacgcccaggacggccactag

SEQ ID NO: 19881 - DNA, 3501 bp, Artificial Sequence
  Description of Artificial Sequence: Synthetic coding sequence
atgtgcggcagagccgccgaggccgccgccagcagcagaacccccggcagagagatgggccaggccgtgaccagaagactgggcgccggcgccagagccgcccccagaagagccatggacggcagaacccccagaccccaggacgcccccgccagaagaaagcccaaggccaaggcccccctgccccccgccgagaccaagtacaccgacgtgagcagcgccgccgacagcgtggagagcaccgccttcatcatggagcagaaggagaacatgatcgacaaggacgtggagctgagcgtggtgctgcccggcgacatcatcaagagcaccaccgtgcacggcagcaagcccatgatggacctgctgatcttcctgtgcgcccagtaccacctgaaccccagcagctacaccatcgacctgctgagcgccgagcagaaccacatcaagttcaagcccaacacccccatcggcatgctggaggtggagaaggtgatcctgaagcccaagatgctggacaagaagaagcccacccccatcatccccgagaagaccgtgagagtggtgatcaacttcaagaagacccagaagaccatcgtgagagtgagcccccacgccagcctgcaggagctggcccccatcatctgcagcaagtgcgagttcgaccccctgcacaccctgctgctgaaggactaccagagccaggagcccctggacctgaccaagagcctgaacgacctgggcctgagagagctgtacgccatggacgtgaacagagagagctgccagatcagccagaacctggacatcatgaaggagaaggagaacaagggcttcttcagcttcttccagagaagcaagaagaagagagaccagaccgccagcgcccccgccacccccctggtgaacaagcacagacccaccttcaccagaagcaacaccatcagcaagccctacatcagcaacaccctgcccagcgacgcccccaagaagagaagagcccccctgccccccatgcccgccagccagagcgtgccccaggacctggcccacatccaggagagacccgccagctgcatcgtgaagagcatgagcgtggacgagaccgacaagagcccctgcgaggccggcagagtgagagccggcagcctgcagctgagcagcatgagcgccggcaacagcagcctgagaagaaccaagagaaaggcccccagcccccccagcaagatccccccccaccagagcgacgagaacagcagagtgaccgccctgcagcccgtggacggcgtgccccccgacagcgccagcgaggccaacagccccgaggagctgagcagccccgccggcatcagcagcgactacagcctggaggagatcgacgagaaggaggagctgagcgaggtgcccaaggtggaggccgagaacatcagccccaagagccaggacatccccttcgtgagcaccgacatcatcaacaccctgaagaacgaccccgacagcgccctgggcaacggcagcggcgagttcagccagaacagcatggaggagaagcaggagaccaagagcaccgacggccaggagccccacagcgtggtgtacgacaccagcaacggcaagaaggtggtggacagcatcagaaacctgaagagcctgggccccaaccaggagaacgtggtgcagaacgagatcatcgtgtaccccgagaacaccgaggacaacatgaagaacggcgtgaagaagaccgagatcaacgtggagggcgtggccaagaacaacaacatcgacatggaggtggagagacccagcaacagcgaggcccacgagaccgacaccgccatcagctacaaggagaaccacctggccgccagcagcgtgcccgaccagaagctgaaccagcccagcgccgagaagaccaaggacgccgccatccagaccacccccagctgcaacagcttcgacggcaagcaccaggaccacaacctgagcgacagcaaggtggaggagtgcgtgcagaccagcaacaacaacatcagcacccagcacagctgcctgagcagccaggacagcgtgaacaccagcagagagttcagaagccagggcaccctgatcatccacagcgaggaccccctgaccgtgaaggaccccatctgcgcccacggcaacgacgacctgctgccccccgtggacagaatcgacaagaacagcaccgccagctacctgaagaactaccccctgtacagacaggactacaaccccaagcccaagcccagcaacgagatcaccagagagtacatccccaagatcggcatgaccacctacaagatcgtgccccccaagagcctggagatcagcaaggactggcagagcgagaccatcgagtacaaggacgaccaggacatgcacgccctgggcaagaagcacacccacgagaacgtgaaggagaccgccatccagaccgaggacagcgccatcagcgagagccccgaggagcccctgcccaacctgaagcccaagcccaacctgagaaccgagcaccaggtgcccagcagcgtgagcagccccgacgacgccatggtgagccccctgaagcccgcccccaagatgaccagagacaccggcaccgcccccttcgcccccaacctggaggagatcaacaacatcctggagagcaagttcaagagcagagccagcaacgcccaggccaagcccagcagcttcttcctgcagatgcagaagagagtgagcggccactacgtgaccagcgccgccgccaagagcgtgcacgccgcccccaaccccgcccccaaggagctgaccaacaaggaggccgagagagacatgctgcccagccccgagcagaccctgagccccctgagcaagatgccccacagcgtgccccagcccctggtggagaagaccgacgacgacgtgatcggccaggcccccgccgaggccagccccccccccatcgcccccaagcccgtgaccatccccgccagccaggtgagcacccagaacctgaagaccctgaagaccttcggcgcccccagaccctacagcagcagcggccccagccccttcgccctggccgtggtgaagagaagccagagcttcagcaaggagagaaccgagagccccagcgccagcgccctggtgcagccccccgccaacaccgaggagggcaagacccacagcgtgaacaagttcgtggacatcccccagctgggcgtgagcgacaaggagaacaacagcgcccacaacgagcagaacagccagatccccacccccaccgacggccccagcttcaccgtgatgagacagagcagcctgaccttccagagcagcgaccccgagcagatgagacagagcctgctgaccgccatcagaagcggcgaggccgccgccaagctgaagagagtgaccatccccagcaacaccatcagcgtgaacggcagaagcagactgagccacagcatgagccccgacgcccaggacggccactag

SEQ ID NO: 19882 - DNA, 420 bp, Artificial Sequence
  Description of Artificial Sequence: Synthetic coding sequence
atggacggcagaacccccagaccccaggacgcccccgccagaagaaagcccaaggccaaggcccccctgccccccgccgagaccaagtacaccgacgtgagcagcgccgccgacagcgtggagagcaccgccttcatcatggagcagaaggagaacatgatcgacaaggacgtggagctgagcgtggtgctgcccggcgacatcatcaagagcaccaccgtgcacggcagcaagcccatgatggacctgctgatcttcctgtgcgcccagtaccacctgaaccccagcagctacaccatcgacctgctgagcgccgagcagaaccacatcaagttcaagcccaacacccccatcggcatgctggaggtggagaaggtgatcctgaagcccaagatgctggacaagaagaagcccacctag

SEQ ID NO: 19883 - DNA, 474 bp, Artificial Sequence
  Description of Artificial Sequence: Synthetic coding sequence
atggacggcagaacccccagaccccaggacgcccccgccagaagaaagcccaaggccaaggcccccctgccccccgccgagaccaagtacaccgacgtgagcagcgccgccgacagcgtggagagcaccgccttcatcatggagcagaaggagaacatgatcgacaaggacgtggagctgagcgtggtgctgcccggcgacatcatcaagagcaccaccgtgcacggcagcaagcccatgatggacctgctgatcttcctgtgcgcccagtaccacctgaaccccagcagctacaccatcgacctgctgagcgccgagcagaaccacatcaagttcaagcccaacacccccatcggcatgctggaggtggagaaggtgatcctgaagcccaagatgctggacaagaagaagcccacccccatcatccccgagaagaccgtgagagtggtgatcaacttcaagaagacccagtag

SEQ ID NO: 19884 - DNA, 1080 bp, Artificial Sequence
  Description of Artificial Sequence: Synthetic coding sequence
atgtacttcaagagagcccccagagccttccccgtgctgctgaccggcgccggcaagaccaccctgctgaactacatcctgaccgagcagcacagcaagagagtggccgtgatcctgaacgagagcggcgagggcagcgccctggagaagagcctggccgtgagccagggcggcgagctgtacgaggagtggctggagctgagaaacggctgcctgtgctgcagcgtgaaggacaacggcctgagagccatcgagaacctgatgcagaagaagggcaagttcgacgacatcctgctggagaccaccggcctggccgaccccggcgccgtgaccagcatgttctgggtggacgccgagctgggcagcgacatctacctggacggcatcatcaccatcgtggacagcaagtacggcctgaagcacctgaccgaggagaagcccgacggcctgatcaacgaggccaccagacaggtggccctggccgacatcatcctgatcaacaagaccgacctggtgcccgaggaggacgtgaagaagctgagaaccaccatcagaagcatcaacggcctgggccagatcctggagacccagagaagcagagtggacctgagcaacgtgctggacctgcacgccttcgacagcctgagcggcatcagcctgcagaagaagctgcagcacgtgcccggcacccagccccacctggaccagagcatcgtgaccatcaccttcgaggtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtacgacctggaggagacccccgtgagctggaaggacgacaccgagagaaccaacagactggtgctgatcggcagaaacctggacaaggacatcctgaagcagctgttcatcgccaccgtgaccgagaccgagaagcagtggaccacccacttcaaggaggaccaggtgtgcacctag

SEQ ID NO: 19885 - DNA, 1188 bp, Artificial Sequence
  Description of Artificial Sequence: Synthetic coding sequence
atgctgcccgccgtgggcagcgtggacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagagcggcgagggcagcgccctggagaagagcctggccgtgagccagggcggcgagctgtacgaggagtggctggagctgagaaacggctgcctgtgctgcagcgtgaaggacaacggcctgagagccatcgagaacctgatgcagaagaagggcaagttcgacgacatcctgctggagaccaccggcctggccgaccccggcgccgtgaccagcatgttctgggtggacgccgagctgggcagcgacatctacctggacggcatcatcaccatcgtggacagcaagtacggcctgaagcacctgaccgaggagaagcccgacggcctgatcaacgaggccaccagacaggtggccctggccgacatcatcctgatcaacaagaccgacctggtgcccgaggaggacgtgaagaagctgagaaccaccatcagaagcatcaacggcctgggccagatcctggagacccagagaagcagagtggacctgagcaacgtgctggacctgcacgccttcgacagcctgagcggcatcagcctgcagaagaagctgcagcacgtgcccggcacccagccccacctggaccagagcatcgtgaccatcaccttcgaggtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtacgacctggaggagacccccgtgagctggaaggacgacaccgagagaaccaacagactggtgctgatcggcagaaacctggacaaggacatcctgaagcagctgttcatcgccaccgtgaccgagaccgagaagcagtggaccacccacttcaaggaggaccaggtgtgcacctag

SEQ ID NO: 19886 - DNA, 1044 bp, Artificial Sequence
  Description of Artificial Sequence: Synthetic coding sequence
atgctgcccgccgtgggcagcgtggacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagagcggcgagggcagcgccctggagaagagcctggccgtgagccagggcggcgagctgtacgaggagtggctggagctgagaaacggctgcctgtgctgcagcgtgaaggacaacggcctgagagccatcgagaacctgatgcagaagaagggcaagttcgacgacatcctgctggagaccaccggcctggccgaccccggcgccgtgaccagcatgttctgggtggacgccgagctgggcagcgacatctacctggacggcatcatcaccatcgtggacagcaagtacggcctgaagcacctgaccgaggagaagcccgacggcctgatcaacgaggccaccagaagcatcaacggcctgggccagatcctggagacccagagaagcagcctgcagaagaagctgcagcacgtgcccggcacccagccccacctggaccagagcatcgtgaccatcaccttcgaggtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtacgacctggaggagacccccgtgagctggaaggacgacaccgagagaaccaacagactggtgctgatcggcagaaacctggacaaggacatcctgaagcagctgttcatcgccaccgtgaccgagaccgagaagcagtggaccacccacttcaaggaggaccaggtgtgcacctag

SEQ ID NO: 19887 - DNA, 249 bp, Artificial Sequence
  Description of Artificial Sequence: Synthetic coding sequence
atgctgcccgccgtgggcagcgtggacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagagcggcgagggcaagtag

SEQ ID NO: 19888 - DNA, 342 bp, Artificial Sequence
  Description of Artificial Sequence: Synthetic coding sequence
atgctgcccgccgtgggcagcgtggacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagagcggcgagggcagcgccctggagaagagcctggccgtgagccagggcggcgagctgtacgaggagtggctggagctgagaaacggctgcctgtgctgcagcgtgaagtag

SEQ ID NO: 19889 - DNA, 729 bp, Artificial Sequence
  Description of Artificial Sequence: Synthetic coding sequence
atgctgcccgccgtgggcagcgtggacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagagcggcgagggcagcgccctggagaagagcctggccgtgagccagggcggcgagctgtacgaggagtggctggagctgagaaacggctgcctgtgctgcagcgtgaaggacaacggcctgagagccatcgagaacctgatgcagaagaagggcaagttcgacgacatcctgctggagaccaccggcctggccgaccccggcgccgtggccagcatgttctgggtggacgccgagctgggcagcgacatctacctggacggcatcatcaccatcgtggacagcaagtacggcctgaagcacctgaccgaggagaagcccgacggcctgatcaacgaggccaccagacaggtggccctggccgacatcatcctgatcaacaagaccgacctggtgcccgaggaggacgtgaagaagctgagaaccaccctgagatacaagatgatgtgcgtgaagtgcctgcagatccacatcgtgtacaccgagtgcttcctgctgtag

SEQ ID NO: 19890 - DNA, 1080 bp, Artificial Sequence
  Description of Artificial Sequence: Synthetic coding sequence
atgtacttcaagagagcccccagagccttccccgtgctgctgaccggcgccggcaagaccaccctgctgaactacatcctgaccgagcagcacagcaagagagtggccgtgatcctgaacgagagcggcgagggcagcgccctggagaagagcctggccgtgagccagggcggcgagctgtacgaggagtggctggagctgagaaacggctgcctgtgctgcagcgtgaaggacaacggcctgagagccatcgagaacctgatgcagaagaagggcaagttcgacgacatcctgctggagaccaccggcctggccgaccccggcgccgtggccagcatgttctgggtggacgccgagctgggcagcgacatctacctggacggcatcatcaccatcgtggacagcaagtacggcctgaagcacctgaccgaggagaagcccgacggcctgatcaacgaggccaccagacaggtggccctggccgacatcatcctgatcaacaagaccgacctggtgcccgaggaggacgtgaagaagctgagaaccaccctgagaagcatcaacggcctgggccagatcctggagacccagagaagcagagtggacctgagcaacgtgctggacctgcacgccttcgacagcctgagcggcatcagcctgcagaagaagctgcagcacgtgcccggcacccagccccacctggaccagagcatcgtgaccatcaccttcgacgtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtgcgacctggaggagacccccgtgagctggaaggacgacaccgagagaaccaacagactggtgctgatcggcagaaacctggacaaggacatcctgaagcagctgttcatcgccaccgtgaccgagaccgagaagcagtggaccacccacttcaaggaggaccaggtgtgcacctag

SEQ ID NO: 19891 - DNA, 1044 bp, Artificial Sequence
  Description of Artificial Sequence: Synthetic coding sequence
atgctgcccgccgtgggcagcgtggacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagagcggcgagggcagcgccctggagaagagcctggccgtgagccagggcggcgagctgtacgaggagtggctggagctgagaaacggctgcctgtgctgcagcgtgaaggacaacggcctgagagccatcgagaacctgatgcagaagaagggcaagttcgacgacatcctgctggagaccaccggcctggccgaccccggcgccgtggccagcatgttctgggtggacgccgagctgggcagcgacatctacctggacggcatcatcaccatcgtggacagcaagtacggcctgaagcacctgaccgaggagaagcccgacggcctgatcaacgaggccaccagaagcatcaacggcctgggccagatcctggagacccagagaagcagcctgcagaagaagctgcagcacgtgcccggcacccagccccacctggaccagagcatcgtgaccatcaccttcgacgtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtgcgacctggaggagacccccgtgagctggaaggacgacaccgagagaaccaacagactggtgctgatcggcagaaacctggacaaggacatcctgaagcagctgttcatcgccaccgtgaccgagaccgagaagcagtggaccacccacttcaaggaggaccaggtgtgcacctag

SEQ ID NO: 19892 - DNA, 1188 bp, Artificial Sequence
  Description of Artificial Sequence: Synthetic coding sequence
atgctgcccgccgtgggcagcgtggacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagagcggcgagggcagcgccctggagaagagcctggccgtgagccagggcggcgagctgtacgaggagtggctggagctgagaaacggctgcctgtgctgcagcgtgaaggacaacggcctgagagccatcgagaacctgatgcagaagaagggcaagttcgacgacatcctgctggagaccaccggcctggccgaccccggcgccgtggccagcatgttctgggtggacgccgagctgggcagcgacatctacctggacggcatcatcaccatcgtggacagcaagtacggcctgaagcacctgaccgaggagaagcccgacggcctgatcaacgaggccaccagacaggtggccctggccgacatcatcctgatcaacaagaccgacctggtgcccgaggaggacgtgaagaagctgagaaccaccctgagaagcatcaacggcctgggccagatcctggagacccagagaagcagagtggacctgagcaacgtgctggacctgcacgccttcgacagcctgagcggcatcagcctgcagaagaagctgcagcacgtgcccggcacccagccccacctggaccagagcatcgtgaccatcaccttcgacgtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtgcgacctggaggagacccccgtgagctggaaggacgacaccgagagaaccaacagactggtgctgatcggcagaaacctggacaaggacatcctgaagcagctgttcatcgccaccgtgaccgagaccgagaagcagtggaccacccacttcaaggaggaccaggtgtgcacctag

SEQ ID NO: 19893 - DNA, 1128 bp, Artificial Sequence
  Description of Artificial Sequence: Synthetic coding sequence
atgctgcccgccgtgggcagcgtggacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagagcggcgagggcagcgccctggagaagagcctggccgtgagccagggcggcgagctgtacgaggagtggctggagctgagaaacggctgcctgtgctgcagcgtgaaggacaacggcctgagagccatcgagaacctgatgcagaagaagggcaagttcgacgacatcctgctggagaccaccggcctggccgaccccggcatcatcaccatcgtggacagcaagtacggcctgaagcacctgaccgaggagaagcccgacggcctgatcaacgaggccaccagacaggtggccctggccgacatcatcctgatcaacaagaccgacctggtgcccgaggaggacgtgaagaagctgagaaccaccctgagaagcatcaacggcctgggccagatcctggagacccagagaagcagagtggacctgagcaacgtgctggacctgcacgccttcgacagcctgagcggcatcagcctgcagaagaagctgcagcacgtgcccggcacccagccccacctggaccagagcatcgtgaccatcaccttcgacgtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtgcgacctggaggagacccccgtgagctggaaggacgacaccgagagaaccaacagactggtgctgatcggcagaaacctggacaaggacatcctgaagcagctgttcatcgccaccgtgaccgagaccgagaagcagtggaccacccacttcaaggaggaccaggtgtgcacctag

SEQ ID NO: 19894 - DNA, 282 bp, Artificial Sequence
  Description of Artificial Sequence: Synthetic coding sequence
tgactggacctgcacgccttcgacagcctgagcggcatcagcctgcagaagaagctgcagcacgtgcccggcacccagccccacctggaccagagcatcgtgaccatcaccttcgacgtgcccggcaacgccaaggaggagcacctgaacatgttcatccagaacctgctgtgggagaagaacgtgagaaacaaggacaaccactgcatggaggtgatcagactgaaggtgcagttcaccgtggccgacttctggaccaagagcttcagctggctgctgtag

SEQ ID NO: 19895 - DNA, 543 bp, Artificial Sequence
  Description of Artificial Sequence: Synthetic coding sequence
atgctgcccgccgtgggcagcgtggacgaggaggaggaccccgccgaggaggactgccccgagctggtgcccatcgagaccacccagagcgaggaggaggagaagagcggcctgggcgccaagatccccgtgaccatcatcaccggctacctgggcgccggcaagaccaccctgctgaactacatcctgaccgagcagcacagcaagagagtggccgtgatcctgaacgagagcggcgagggcagcgccctggagaagagcctggccgtgagccagggcggcgagctgtacgaggagtggctggagctgagaaacggctgcctgtgctgcagcgtgaaggacaacggcctgagagccatcgagaacctgatgcagaagaagggcaagttcgacgacatcctgctggagaccaccggcctggccgaccccggcgccgtggccagcatgttctgggtggacgccgagctgggcagcgacatctacctggacggcatcatcaccatcgtggacagcaagtacggcctgaaggtgagccaccactag

SEQ ID NO: 19896 - DNA, 759 bp, Artificial Sequence
  Description of Artificial Sequence: Synthetic coding sequence
tgagccgtgaccagcatgttctgggtggacgccgagctgggcagcgacatctacctggacggcatcatcaccatcgtggacagcaagtacggcctgaagcacctgaccgaggagaagcccgacggcctgatcaacgaggccaccagacaggtggccctggccgacatcatcctgatcaacaagaccgacctggtgcccgaggaggacgtgaagaagctgagaaccaccatcagaagcatcaacggcctgggccagatcctggagacccagagaagcagagtggacctgagcaacgtgctggacctgcacgccttcgacagcctgagcggcatcagcctgcagaagaagctgcagcacgtgcccggcacccagccccacctggaccagagcatcgtgaccatcaccttcgaggtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtacgacctggaggagacccccgtgagctggaaggacgacaccgagagaaccaacagactggtgctgatcggcagaaacctggacaaggacatcctgaagcagctgttcatcgccaccgtgaccgagaccgagaagcagtggaccacccacttcaaggaggaccaggtgtgcacctag

SEQ ID NO: 19897 - DNA, 702 bp, Artificial Sequence
  Description of Artificial Sequence: Synthetic coding sequence
tgagccgtgaccagcatgttctgggtggacgccgagctgggcagcgacatctacctggacggcatcatcaccatcgtggacagcaagtacggcctgaagcacctgaccgaggagaagcccgacggcctgatcaacgaggccaccagacaggtggccctggccgacatcatcctgatcaacaagaccgacctggtgcccgaggaggacgtgaagaagctgagaaccaccatcagaagcatcaacggcctgggccagatcctggagacccagagaagcagcctgcagaagaagctgcagcacgtgcccggcacccagccccacctggaccagagcatcgtgaccatcaccttcgaggtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtacgacctggaggagacccccgtgagctggaaggacgacaccgagagaaccaacagactggtgctgatcggcagaaacctggacaaggacatcctgaagcagctgttcatcgccaccgtgaccgagaccgagaagcagtggaccacccacttcaaggaggaccaggtgtgcacctag

SEQ ID NO: 19898 - DNA, 420 bp, Artificial Sequence
  Description of Artificial Sequence: Synthetic coding sequence
tgagaggaggtgagaaagagagccatcagaatgttcaagaacgagaagagcatcgtgaccatcaccttcgaggtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtacgacctggaggagacccccgtgagctggaaggacgacaccgagagaaccaacagactggtgctgatcggcagaaacctggacaaggacatcctgaagcagctgttcatcgccaccgtgaccgagaccgagaagcagtggaccacccacttcaaggaggaccaggtgtgcacctag

SEQ ID NO: 19899 - DNA, 531 bp, Artificial Sequence
  Description of Artificial Sequence: Synthetic coding sequence
atgtacttcaccgagttccccaccgcccacgtgagcttcctgcccttcagagtggacctgagcaacgtgctggacctgcacgccttcgacagcctgagcggcatcagcctgcagaagaagctgcagcacgtgcccggcacccagccccacctggaccagagcatcgtgaccatcaccttcgaggtgcccggcaacgccaaggaggagcacctgaacatgttcatccagaacctgctgtgggagaagaacgtgagaaacaaggacaaccactgcatggaggtgatcagactgaagggcctggtgagcatcaaggacaagagccagcaggtgatcgtgcagggcgtgcacgagctgtacgacctggaggagacccccgtgagctggaaggacgacaccgagagaaccaacagactggtgctgatcggcagaaacctggacaaggacatcctgaagcagctgttcatcgccaccgtgaccgagaccgagaagcagtggaccacccacttcaaggaggaccaggtgtgcacctag

SEQ ID NO: 19900 - DNA, 2559 bp, Artificial Sequence
  Description of Artificial Sequence: Synthetic coding sequence
atgatgcccggccccagacccagaaagggcccccaggccagaggccagggcgtggccgccgccaagcagatgggcctgttcatggagttcggccccgaggacatgctgctgggcatggacgaggccgaggacgacgaggacctggaggccgagctgctggccctgaccggcgaggcccagaccaccggcaagaagcccgcccccaagggccaggcccccctgcccatggcccacatcgagaagctggccgccgactgcatgagagacgtggaggaggaggaggaggaggagggcctggaggaggacgccgagctgctgaccgagctgcaggaggtgctgggcgtggacgaggagaccgagcccctggacggcgacgaggtggccgaccccggcggcagcgaggaggagaacggcctggaggacaccgagccccccgtgcagaccgccgtgctgaccgccagcgcccccgccgcccaggccggcgccagccagggcctgcacgccctgctggaggagagaatccacaactacagagaggccgccgccagcgccaaggaggccggcgaggccgccaaggccagaagatgcgagagaggcctgaagaccctggagagccagctggccagcgtgagaagaggcagaaagatcaacgaggacgagatccccccccccgtggccctgggcaagagacccctggccccccaggagcccgccaacagaagccccgagaccgacccccccgccccccccgccctggagagcgacaaccccagccagcccgagaccagcctgcccggcatcagcgcccagcccgtgagcgacctggaccccgaccccagagccctgctgagcagcagacagagagagtacaaggtggccgccctgagcgccaagagagccggcgagctggacagagccagagagctgatgagaatcggcaagagattcggcgccgtgctggaggccctggagaagggccagcccgtggacctgagcgccatgccccccgcccccgaggacctgaagccccagcaggccagccaggcccccaccgcccccagcgtgatcccccccgccgtggagagagtgcagcccgtgatggcccccgacgtgcccgccacccccgtggcccccaccgagagccagaccgtgctggacgccctgcagcagagactgaacaagtacagagaggccggcatccaggccagaagcggcggcgacgagagaaaggccagaatgcacgagagaatcgccaagcagtaccaggacgccatcagagcccacagagccggcagaaaggtgaacttcgccgagctgcccgtgccccccggcttcccccccatccccggcctggagagcaccatgggcgtggaggaggacgccgtggccgccaccctggccgccgccgagaagctggccagcgccgaggacagcgcccccgccgacaaggacgaggacgagggcgagccccccgcccaggcccccgtggccaagaagcccgccagacccaccgtgcccagcagccagagactgcccgagcccagagccagcagcagcaaggagagccccagccccagcgtgagagagcagctggccctgctggaggccagaaagctgcagtaccagagagccgccctgcaggccaagagaagccaggacctggagcaggccaaggcctacctgagagtggccaagtggctggaggcccagatcatccaggccagaagcggcagacccgtggacctgagcaaggtgcccagccccctgaccgacgaggagggcgacttcatcctgatccaccacgaggacctgagactgagccagaaggccgaggaggtgtacgcccagctgcagaagatgctgctggagcagcaggagaagtgcctgctgttcagcaagcagttcatgcaccagggcaacgtggccgagaccaccagattcgagaagctggcccaggacagaaagaagcagctggagatcctgcagctggcccaggcccagggcctggacccccccacccaccacttcgagctgaagaccttccagaccgtgagaatcttcagcgagctgaacagcaccgagatgcacctgatcatcgtgagaggcatgaacctgcccgccccccccggcgtgacccccgacgacctggacgccttcgtgagattcgagttccactaccccaacagcgaccaggcccagaagagcaagaccgccgtggtgaagaacaccaacagccccgagttcgaccagctgttcaagctgaacatcaacagaaaccacagaggcttcaagagagtgatccagagcaagggcatcaagttcgagatcttccacaagggcagcttcttcagaagcgacaagctggtgggcaccgcccacctgaagctggagagactggagaacgagtgcgagatcagagagatcgtggaggtgctggacggcagaaagcccaccggcggcaagctggaggtgaaggtgagactgagagagcccctgagcggccaggacgtgcagatggtgaccgagaactggctggtgctggagcccagaggcctgtag

SEQ ID NO: 19901 - DNA, 2268 bp, Artificial Sequence
  Description of Artificial Sequence: Synthetic coding sequence
atgagagacgtggaggaggaggaggaggaggagggcctggaggaggacgccgagctgctgaccgagctgcaggaggtgctgggcgtggacgaggagaccgagcccctggacggcgacgaggtggccgaccccggcggcagcgaggaggagaacggcctggaggacaccgagccccccgtgcagaccgccgtgctgaccgccagcgcccccgccgcccaggccggcgccagccagggcctgcacgccctgctggaggagagaatccacaactacagagaggccgccgccagcgccaaggaggccggcgaggccgccaaggccagaagatgcgagagaggcctgaagaccctggagagccagctggccagcgtgagaagaggcagaaagatcaacgaggacgagatccccccccccgtggccctgggcaagagacccctggccccccaggagcccgccaacagaagccccgagaccgacccccccgccccccccgccctggagagcgacaaccccagccagcccgagaccagcctgcccggcatcagcgcccagcccgtgagcgacctggaccccgaccccagagccctgctgagcagcagacagagagagtacaaggtggccgccctgagcgccaagagagccggcgagctggacagagccagagagctgatgagaatcggcaagagattcggcgccgtgctggaggccctggagaagggccagcccgtggacctgagcgccatgccccccgcccccgaggacctgaagccccagcaggccagccaggcccccaccgcccccagcgtgatcccccccgccgtggagagagtgcagcccgtgatggcccccgacgtgcccgccacccccgtggcccccaccgagagccagaccgtgctggacgccctgcagcagagactgaacaagtacagagaggccggcatccaggccagaagcggcggcgacgagagaaaggccagaatgcacgagagaatcgccaagcagtaccaggacgccatcagagcccacagagccggcagaaaggtgaacttcgccgagctgcccgtgccccccggcttcccccccatccccggcctggagagcaccatgggcgtggaggaggacgccgtggccgccaccctggccgccgccgagaagctggccagcgccgaggacagcgcccccgccgacaaggacgaggacgagggcgagccccccgcccaggcccccgtggccaagaagcccgccagacccaccgtgcccagcagccagagactgcccgagcccagagccagcagcagcaaggagagccccagccccagcgtgagagagcagctggccctgctggaggccagaaagctgcagtaccagagagccgccctgcaggccaagagaagccaggacctggagcaggccaaggcctacctgagagtggccaagtggctggaggcccagatcatccaggccagaagcggcagacccgtggacctgagcaaggtgcccagccccctgaccgacgaggagggcgacttcatcctgatccaccacgaggacctgagactgagccagaaggccgaggaggtgtacgcccagctgcagaagatgctgctggagcagcaggagaagtgcctgctgttcagcaagcagttcatgcaccagggcaacgtggccgagaccaccagattcgagaagctggcccaggacagaaagaagcagctggagatcctgcagctggcccaggcccagggcctggacccccccacccaccacttcgagctgaagaccttccagaccgtgagaatcttcagcgagctgaacagcaccgagatgcacctgatcatcgtgagaggcatgaacctgcccgccccccccggcgtgacccccgacgacctggacgccttcgtgagattcgagttccactaccccaacagcgaccaggcccagaagagcaagaccgccgtggtgaagaacaccaacagccccgagttcgaccagctgttcaagctgaacatcaacagaaaccacagaggcttcaagagagtgatccagagcaagggcatcaagttcgagatcttccacaagggcagcttcttcagaagcgacaagctggtgggcaccgcccacctgaagctggagagactggagaacgagtgcgagatcagagagatcgtggaggtgctggacggcagaaagcccaccggcggcaagctggaggtgaagcccatggccagcaccagaagaggcgtgagacccagactgtgcagaagatag

SEQ ID NO: 19902 - DNA, 372 bp, Artificial Sequence
  Description of Artificial Sequence: Synthetic coding sequence
atgatgcccggccccagacccagaaagggcccccaggccagaggccagggcgtggccgccgccaagcagatgggcctgttcatggagttcggccccgaggacatgctgctgggcatggacgaggccgaggacgacgaggacctggaggccgagctgctggccctgaccggcgaggcccagaccaccggcaagaagcccgcccccaagggccaggcccccctgcccatggcccacatcgagaagctggccgccgactgcatgagagacgtggaggaggaggaggaggaggagggcctggaggaggacgccggcagagactgcgccggcgacgacttccccagcttcgccggcttcagaagcctgtgcacctag

SEQ ID NO: 19903 - DNA, 2577 bp, Artificial Sequence
  Description of Artificial Sequence: Synthetic coding sequence
atgatgcccggccccagacccagaaagggcccccaggccagaggccagggcgtggccgccgccaagcagatgggcctgttcatggagttcggccccgaggacatgctgctgggcatggacgaggccgaggacgacgaggacctggaggccgagctgctggccctgaccggcgaggcccagaccaccggcaagaagcccgcccccaagggccaggcccccctgcccatggcccacatcgagaagctggccgccgactgcatgagagacgtggaggaggaggaggaggaggagggcctggaggaggacgccgagctgctgaccgagctgcaggaggtgctgggcgtggacgaggagaccgagcccctggacggcgacgaggtggccgaccccggcggcagcgaggaggagaacggcctggaggacaccgagccccccgtgcagaccgccgtgctgaccgccagcgcccccgccgcccaggccggcgccagccagggcctgcacgccctgctggaggagagaatccacaactacagagaggccgccgccagcgccaaggaggccggcgaggccgccaaggccagaagatgcgagagaggcctgaagaccctggagagccagctggccagcgtgagaagaggcagaaagatcaacgaggacgagatccccccccccgtggccctgggcaagagacccctggccccccaggagcccgccaacagaagccccgagaccgacccccccgccccccccgccctggagagcgacaaccccagccagcccgagaccagcctgcccggcatcagcgcccagcccgtgagcgacctggaccccgaccccagagccctgctgagcagcagacagagagagtacaaggtggccgccctgagcgccaagagagccggcgagctggacagagccagagagctgatgagaatcggcaagagattcggcgccgtgctggaggccctggagaagggccagcccgtggacctgagcgccatgccccccgcccccgaggacctgaagccccagcaggccagccaggcccccaccgcccccagcgtgatcccccccgccgtggagagagtgcagcccgtgatggcccccgacgtgcccgccacccccgtggcccccaccgagagccagaccgtgctggacgccctgcagcagagactgaacaagtacagagaggccggcatccaggccagaagcggcggcgacgagagaaaggccagaatgcacgagagaatcgccaagcagtaccaggacgccatcagagcccacagagccggcagaaaggtgaacttcgccgagctgcccgtgccccccggcttcccccccatccccggcctggagagcaccatgggcgtggaggaggacgccgtggccgccaccctggccgccgccgagaagctggccagcgccgaggacagcgcccccgccgacaaggacgaggacgagccccccggccacctgcagggcgagccccccgcccaggcccccgtggccaagaagcccgccagacccaccgtgcccagcagccagagactgcccgagcccagagccagcagcagcaaggagagccccagccccagcgtgagagagcagctggccctgctggaggccagaaagctgcagtaccagagagccgccctgcaggccaagagaagccaggacctggagcaggccaaggcctacctgagagtggccaagtggctggaggcccagatcatccaggccagaagcggcagacccgtggacctgagcaaggtgcccagccccctgaccgacgaggagggcgacttcatcctgatccaccacgaggacctgagactgagccagaaggccgaggaggtgtacgcccagctgcagaagatgctgctggagcagcaggagaagtgcctgctgttcagcaagcagttcatgcaccagggcaacgtggccgagaccaccagattcgagaagctggcccaggacagaaagaagcagctggagatcctgcagctggcccaggcccagggcctggacccccccacccaccacttcgagctgaagaccttccagaccgtgagaatcttcagcgagctgaacagcaccgagatgcacctgatcatcgtgagaggcatgaacctgcccgccccccccggcgtgacccccgacgacctggacgccttcgtgagattcgagttccactaccccaacagcgaccaggcccagaagagcaagaccgccgtggtgaagaacaccaacagccccgagttcgaccagctgttcaagctgaacatcaacagaaaccacagaggcttcaagagagtgatccagagcaagggcatcaagttcgagatcttccacaagggcagcttcttcagaagcgacaagctggtgggcaccgcccacctgaagctggagagactggagaacgagtgcgagatcagagagatcgtggaggtgctggacggcagaaagcccaccggcggcaagctggaggtgaaggtgagactgagagagcccctgagcggccaggacgtgcagatggtgaccgagaactggctggtgctggagcccagaggcctgtag

SEQ ID NO: 19904 - DNA, 1887 bp, Artificial Sequence
  Description of Artificial Sequence: Synthetic coding sequence
tgaaagatcaacgaggacgagatccccccccccgtggccctgggcaagagacccctggccccccaggagcccgccaacagaagccccgagaccgacccccccgccccccccgccctggagagcgacaaccccagccagcccgagaccagcctgcccggcatcagcgcccagcccgtgagcgacctggaccccgaccccagagccctgctgagcagcagacagagagagtacaaggtggccgccctgagcgccaagagagccggcgagctggacagagccagagagctgatgagaatcggcaagagattcggcgccgtgctggaggccctggagaagggccagcccgtggacctgagcgccatgccccccgcccccgaggacctgaagccccagcaggccagccaggcccccaccgcccccagcgtgatcccccccgccgtggagagagtgcagcccgtgatggcccccgacgtgcccgccacccccgtggcccccaccgagagccagaccgtgctggacgccctgcagcagagactgaacaagtacagagaggccggcatccaggccagaagcggcggcgacgagagaaaggccagaatgcacgagagaatcgccaagcagtaccaggacgccatcagagcccacagagccggcagaaaggtgaacttcgccgagctgcccgtgccccccggcttcccccccatccccggcctggagagcaccatgggcgtggaggaggacgccgtggccgccaccctggccgccgccgagaagctggccagcgccgaggacagcgcccccgccgacaaggacgaggacgagggcgagccccccgcccaggcccccgtggccaagaagcccgccagacccaccgtgcccagcagccagagactgcccgagcccagagccagcagcagcaaggagagccccagccccagcgtgagagagcagctggccctgctggaggccagaaagctgcagtaccagagagccgccctgcaggccaagagaagccaggacctggagcaggccaaggcctacctgagagtggccaagtggctggaggcccagatcatccaggccagaagcggcagacccgtggacctgagcaaggtgcccagccccctgaccgacgaggagggcgacttcatcctgatccaccacgaggacctgagactgagccagaaggccgaggaggtgtacgcccagctgcagaagatgctgctggagcagcaggagaagtgcctgctgttcagcaagcagttcatgcaccagggcaacgtggccgagaccaccagattcgagaagctggcccaggacagaaagaagcagctggagatcctgcagctggcccaggcccagggcctggacccccccacccaccacttcgagctgaagaccttccagaccgtgagaatcttcagcgagctgaacagcaccgagatgcacctgatcatcgtgagaggcatgaacctgcccgccccccccggcgtgacccccgacgacctggacgccttcgtgagattcgagttccactaccccaacagcgaccaggcccagaagagcaagaccgccgtggtgaagaacaccaacagccccgagttcgaccagctgttcaagctgaacatcaacagaaaccacagaggcttcaagagagtgatccagagcaagggcatcaagttcgagatcttccacaagggcagcttcttcagaagcgacaagctggtgggcaccgcccacctgaagctggagagactggagaacgagtgcgagatcagagagatcgtggaggtgctggacggcagaaagcccaccggcggcaagctggaggtgaagcccatggccagcaccagaagaggcgtgagacccagactgtgcagaagatag

SEQ ID NO: 19905 - DNA, 645 bp, Artificial Sequence
  Description of Artificial Sequence: Synthetic coding sequence
atgctgctggagcagcaggagaagtgcctgctgttcagcaagcagttcatgcaccagggcaacgtggccgagaccaccagattcgagaagctggcccaggacagaaagaagcagctggagatcctgcagctggcccaggcccagggcctggacccccccacccaccacttcgagctgaagaccttccagaccgtgagaatcttcagcgagctgaacagcaccgagatgcacctgatcatcgtgagaggcatgaacctgcccgccccccccggcgtgacccccgacgacctggacgccttcgtgagattcgagttccactaccccaacagcgaccaggcccagaagagcaagaccgccgtggtgaagaacaccaacagccccgagttcgaccagctgttcaagctgaacatcaacagaaaccacagaggcttcaagagagtgatccagagcaagggcatcaagttcgagatcttccacaagggcagcttcttcagaagcgacaagctggtgggcaccgcccacctgaagctggagagactggagaacgagtgcgagatcagagagatcgtggagatggagagattcagaagaagcgagaagagccacagaggcacccaggagaaggccgccagcctgttcccctag

SEQ ID NO: 19906 - DNA, 2319 bp, Artificial Sequence
  Description of Artificial Sequence: Synthetic coding sequence
tgaaccaccggcaagaagcccgcccccaagggccaggcccccctgcccatggcccacatcgagaagctggccgccgactgcatgagagacgtggaggaggaggaggaggaggagggcctggaggaggacgccgagctgctgaccgagctgcaggaggtgctgggcgtggacgaggagaccgagcccctggacggcgacgaggtggccgaccccggcggcagcgaggaggagaacggcctggaggacaccgagccccccgtgcagaccgccgtgctgaccgccagcgcccccgccgcccaggccggcgccagccagggcctgcacgccctgctggaggagagaatccacaactacagagaggccgccgccagcgccaaggaggccggcgaggccgccaaggccagaagatgcgagagaggcctgaagaccctggagagccagctggccagcgtgagaagaggcagaaagatcaacgaggacgagatccccccccccgtggccctgggcaagagacccctggccccccaggagcccgccaacagaagccccgagaccgacccccccgccccccccgccctggagagcgaccccgaccccagagccctgctgagcagcagacagagagagtacaaggtggccgccctgagcgccaagagagccggcgagctggacagagccagagagctgatgagaatcggcaagagattcggcgccgtgctggaggccctggagaagggccagcccgtggacctgagcgccatgccccccgcccccgaggacctgaagccccagcaggccagccaggcccccaccgcccccagcgtgatcccccccgccgtggagagagtgcagcccgtgatggcccccgacgtgcccgccacccccgtggcccccaccgagagccagaccgtgctggacgccctgcagcagagactgaacaagtacagagaggccggcatccaggccagaagcggcggcgacgagagaaaggccagaatgcacgagagaatcgccaagcagtaccaggacgccatcagagcccacagagccggcagaaaggtgaacttcgccgagctgcccgtgccccccggcttcccccccatccccggcctggagagcaccatgggcgtggaggaggacgccgtggccgccaccctggccgccgccgagaagctggccagcgccgaggacagcgcccccgccgacaaggacgaggacgagggcgagccccccgcccaggcccccgtggccaagaagcccgccagacccaccgtgcccagcagccagagactgcccgagcccagagccagcagcagcaaggagagccccagccccagcgtgagagagcagctggccctgctggaggccagaaagctgcagtaccagagagccgccctgcaggccaagagaagccaggacctggagcaggccaaggcctacctgagagtggccaagtggctggaggcccagatcatccaggccagaagcggcagacccgtggacctgagcaaggtgcccagccccctgaccgacgaggagggcgacttcatcctgatccaccacgaggacctgagactgagccagaaggccgaggaggtgtacgcccagctgcagaagatgctgctggagcagcaggagaagtgcctgctgttcagcaagcagttcatgcaccagggcaacgtggccgagaccaccagattcgagaagctggcccaggacagaaagaagcagctggagatcctgcagctggcccaggcccagggcctggacccccccacccaccacttcgagctgaagaccttccagaccgtgagaatcttcagcgagctgaacagcaccgagatgcacctgatcatcgtgagaggcatgaacctgcccgccccccccggcgtgacccccgacgacctggacgccttcgtgagattcgagttccactaccccaacagcgaccaggcccagaagagcaagaccgccgtggtgaagaacaccaacagccccgagttcgaccagctgttcaagctgaacatcaacagaaaccacagaggcttcaagagagtgatccagagcaagggcatcaagttcgagatcttccacaagggcagcttcttcagaagcgacaagctggtgggcaccgcccacctgaagctggagagactggagaacgagtgcgagatcagagagatcgtggaggtgctggacggcagaaagcccaccggcggcaagctggaggtgaaggtgagactgagagagcccctgagcggccaggacgtgcagatggtgaccgagaactggctggtgctggagcccagaggcctgtag

SEQ ID NO: 19907 - DNA, 969 bp, Artificial Sequence
  Description of Artificial Sequence: Synthetic coding sequence
atgatgaccgagaagcacgaggaccactgcctgaagagctgcagcggccacagctacatcagaaagaactggctgggctgcatcgtgttccccttcagcgccctgctgcagcagagcgagttcctggaccagaccgaggtgctgcagagagcccagatcttcaagaagaactgcaaggccatgttccccaacagaagaatcgtgaccaccgtgttcaacgacgagggcatccagttcctggtgaccagatacatcaaggccctgaaccccccccagcagctgctggacatcttcctgcacaacagcaacgccaccttcgacctgatcgccagattcgtgagcctgatccccttcgtgcccaacacccccgacgagaacgacggcagcgacatctggatgaccagcgagcactgcatcagcctggccatcggcaacaaggaggagcacgccatcctgctgtgcaacttcttcctgtacttcggcaagaaggccctggtgctgctgggcaccagcgtgctggagggccacgtggcctacgtggtgacccaggagaccaacgagtacctgctgtggaaccccagcaccggccagtgctacaagcagttcgaccccttctgccccctgaagagcgtggactgcctgttcgacgacagaaacgtgtggttcaacatccagcagaacaacacccccatggccgtgttcttcgactacagcaaggagagcttctggaagcagctgctgcccaagaacgtgcagggcaccaagatccagagcatccaggtgaccggcttccccatccagatgccctacatcgacgtgcagagcatcatcgacgccgtgtaccagaccggcatccacagcgccgagttcccccagaccgagttcgccctggccgtgtacatccacccctaccccaacaacatcctgagcgtgtgggtgtacctggccagcctggtgcagcaccagtag

SEQ ID NO: 19908 - DNA, 417 bp, Artificial Sequence
  Description of Artificial Sequence: Synthetic coding sequence
atgcccacctgcctgaagagcagcatcagctgcctgagacacagagagaccatcaagagcgtggccagcgacgagaccctgcacgaggacaccgtgcaccccttcgtggaggtgagcttccagcacaccgtgtacaagaccaacaccgccagcggcagccacccctgctggaacgaggagatcaaggtggacttcgtgagccccggccacgactacagcttcagcagcctgagcaagatcaaggacaacatctacatcaacatcttcgacgagatgatgaccgagaagcacgaggaccactgcctgaagagctgcagcggccacagctacatcagaaagaactggctgggctgcatcgtgttccccttcagcgccctgctgcagcagagcgaggacagaaaggacagcgaggagtag

SEQ ID NO: 19909 - DNA, 1206 bp, Artificial Sequence
  Description of Artificial Sequence: Synthetic coding sequence
atgatgaccgagaagcacgaggaccactgcctgaagagctgcagcggccacagctacatcagaaagaactggctgggctgcatcgtgttccccttcagcgccctgctgcagcagagcgagttcctggaccagaccgaggtgctgcagagagcccagatcttcaagaagaactgcaaggccatgttccccaacagaagaatcgtgaccaccgtgttcaacgacgagggcatccagttcctggtgaccagatacatcaaggccctgaaccccccccagcagctgctggacatcttcctgcacaacagcaacgccaccttcgacctgatcgccagattcgtgagcctgatccccttcgtgcccaacacccccgacgagaacgacggcagcgacatctggatgaccagcgagcactgcatcagcctggccatcggcaacaaggaggagcacgccatcctgctgtgcaacttcttcctgtacttcggcaagaaggccctggtgctgctgggcaccagcgtgctggagggccacgtggcctacgtggtgacccaggagaccaacgagtacctgctgtggaaccccagcaccggccagtgctacaagcagttcgaccccttctgccccctgaagagcgtggactgcctgttcgacgacagaaacgtgtggttcaacatccagcagaacaacacccccatggccgtgttcttcgactacagcaaggagagcttctggaagcagctgctgcccaagaacgtgcagggcaccaagatccagagcatccagcccgaggagatcatctacttcgagaccgacaagagcatggtggaggacctgagaaacagaatcgagagaaccctgaagagcaaggtgatggagtggagacccaagcaccccacccactggaacagacagtgcaccttcatcctgagacagatcctgcccaagctggagttcggcatcggcagcttcgtgagcagcgagggcgacaacgagttcgagagaatcctgcagttctactgggtgaccggcttccccatccagatgccctacatcgacgtgcagagcatcatcgacgccgtgtaccagaccggcatccacagcgccgagttcccccagaccgagttcgccctggccgtgtacatccacccctaccccaacaacatcctgagcgtgtgggtgtacctggccagcctggtgcagcaccagtag

SEQ ID NO: 19910 - DNA, 1653 bp, Artificial Sequence
  Description of Artificial Sequence: Synthetic coding sequence
atgagccacggccccagccccagactggccgagagcccccagctgagcaagggcagcctgctgaccatcctgggcagccccagccccgagagaatgggccccgccgacagcctgccccccaccccccccagcggcacccccagccccggccccccccccgccctgcccctgccccccgcccccgccctgctggccgacggcgactgggagagcagagaggagctgagactgagagagctggaggaggccagagccagagccgcccagatggagaagaccatgagaagatggagcgactgcaccgccaactggagagagaagtggagcaaggtgagagccgagagaaacagagccagagaggaggtgagacagctgagacagagactggacgccctgaccaaggagctggccggcgccagaagagagagacaggaggcccagggcgagtgcgaggccagaggcagagagctggccagactgagaggcgccagaggcgtggccgaccagaccagagacggccccgagcccgaggccgagagagagcccgtgagagacgtgggcagcgagagaccccccggcagccaggagctggagctggtggagagcctgctgaagagcatgcccgaggagagcgaggactgctgggaggccagaagcctgggcgccggcggccccagaggcagcagcggcagacaggagagaagcagactgccctgggaggacaccgccgccaccgaggaggaggccagcaagctgaccgccctgagactgagactggacgagagccagaaggtgctgctgaaggagagagaggacaagctggccctgagcagaaacatcgagaagctggagggcgagctgagccagtggaagatcaagtacgaggagctgagcaagaccaagcaggagatgctgaagcagctgagcatcctgaaggaggcccaccaggacgagctgggcagaatgagcgaggacctggaggacgagctgggcgccagaagcagcatggacagaaagatggccgagctgagaggcgagatggagagactgcaggccgagaacgccgccgagtggggcagaagagagagactggagaccgagaagctgggcctggagagagagaacaagaagctgagagcccaggtgggcgacctggaggaggccctggccagaagaagaagacagaccgccagcgccctggactgcgacctgagagccagccaggccgccctgttcgagaagaacaaggagctggccgacctgaagcacgtgcacggcaagctgaagaagcagttccaggagaaggtggccgagctggcccacgccaacagaagagtggagcagcacgaggccgaggtgaagaagctgagactgagagtggaggagctgaagaaggagctggcccaggccgaggacgagctggacgaggcccacaaccaggccagaaagctgcagagaagcctggacgagcagaccgagcagagcgagaacctgcaggtgcagctggagcacctgcagagcagactgagaagacagcagcagaacgcccccctgttcggcaagatcagaagcgccagattcggcaccgaggaggccgaggacggcaccagcgacctggacgaggacgaggacctgcagatccaggtggcctag

SEQ ID NO: 19911 - DNA, 1542 bp, Artificial Sequence
  Description of Artificial Sequence: Synthetic coding sequence
atgaacctggacagcatccacagactgatcgaggagacccagatcttccagatgcagcagagcagcatcaagagcagaggcgacatggtggcccccgccagcccccccagagacacctgcaacacctgcttccccctgcacggcctgcagagccacgccgcccacaacttctgcgcccacagctacaacaccaacaagtgggacatctgcgaggagctgagactgagagagctggaggaggtgaaggccagagccgcccagatggagaagaccatgagatggtggagcgactgcaccgccaactggagagagaagtggagcaaggtgagagccgagagaaacagcgccagagaggagggcagacagctgagaatcaagctggagatggccatgaaggagctgagcaccctgaagaagaagcagagcctgcccccccagaaggaggccctggaggccaaggtgacccaggacctgaagctgcccggcttcgtggaggagagctgcgagcacaccgaccagttccagctgagcagccagatgcacgagagcatcagagagtacctggtgaagagacagttcagcaccaaggaggacaccaacaacaaggagcagggcgtggtgatcgacagcctgaagctgagcgaggagatgaagcccaacctggacggcgtggacctgttcaacaacggcggcagcggcaacggcgagaccaagaccggcctgagactgaaggccatcaacctgcccctggagaacgaggtgaccgagatcagcgccctgcaggtgcacctggacgagttccagaagatcctgtggaaggagagagagatgagaaccgccctggagaaggagatcgagagactggagagcgccctgagcctgtggaagtggaagtacgaggagctgaaggagagcaagcccaagaacgtgaaggagttcgacatcctgctgggccagcacaacgacgagatgcaggagctgagcggcaacatcaaggaggagagcaagagccagaacagcaaggacagagtgatctgcgagctgagagccgagctggagagactgcaggccgagaacaccagcgagtgggacaagagagagatcctggagagagagaagcagggcctggagagagagaacagaagactgaagatccaggtgaaggagatggaggagctgctggacaagaagaacagactgagcgccaacagccagagccccgacttcaagatgagccagatcgacctgcaggagaagaaccaggagctgctgaacctgcagcacgcctactacaagctgaacagacagtaccaggccaacatcgccgagctgacccacgccaacaacagagtggaccagaacgaggccgaggtgaagaagctgagactgagagtggaggagctgaagcagggcctgaaccagaaggaggacgagctggacgacagcctgaaccagatcagaaagctgcagagaagcctggacgaggagaaggagagaaacgagaacctggagaccgagctgagacacctgcagaactggtag

SEQ ID NO: 19912 - DNA, 1275 bp, Artificial Sequence
  Description of Artificial Sequence: Synthetic coding sequence
atgaacctggacagcatccacagactgatcgaggagacccagatcttccagatgcagcagagcagcatcaagagcagaggcgacatggtggcccccgccagcccccccagagacacctgcaacacctgcttccccctgcacggcctgcagagccacgccgcccacaacttctgcgcccacagctacaacaccaacaagtgggacatctgcgaggagctgagactgagagagctggaggaggtgaaggccagagccgcccagatggagaagaccatgagatggtggagcgactgcaccgccaactggagagagaagtggagcaaggtgagagccgagagaaacagcgccagagaggagggcagacagctgagaatcaagctggagatggccatgaaggagctgagcaccctgaagaagaagcagagcctgcccccccagaaggaggccctggaggccaaggtgacccaggacctgaagctgcccggcttcgtggaggagagctgcgagcacaccgaccagttccagctgagcagccagatgcacgagagcatcagagagtacctggtgaagagacagttcagcaccaaggaggacaccaacaacaaggagcagggcgtggtgatcgacagcctgaagctgagcgaggagatgaagcccaacctggacggcgtggacctgttcaacaacggcggcagcggcaacggcgagaccaagaccggcctgagactgaaggccatcaacctgcccctggagaacgaggtgaccgagatcagcgccctgcaggtgcacctggacgagttccagaagatcctgtggaaggagagagacctgagcttcaagagcctgaagatcgtgaacaccgacagactgaacgcccacagcttcggcaagagaaacagagagaccggcgtgggcttcgtgagcgtggaggtggagttcgacatcctgctgggccagcacaacgacgagatgcaggagctgagcggcaacatcaaggaggagagcaagagccagaacagcaaggacagagtgatctgcgagctgagagccgagctggagagactgcaggccgagaacaccagcgagtgggacaagagagagatcctggagagagagaagcagggcctggagagagagaacagaagactgaagatccaggtgaaggagatggaggagctgctggacaagaagaacagactgagcgccaacagccagagccccgacttcaagatgagccagatcgacctgcaggagaagaaccaggacgtgaagtag

SEQ ID NO: 19913 - DNA, 1542 bp, Artificial Sequence; identical to SEQ ID NO: 19911
  Description of Artificial Sequence: Synthetic coding sequence

SEQ ID NO: 19914 - DNA, 714 bp, Artificial Sequence
  Description of Artificial Sequence: Synthetic coding sequence
atggagagaaacgacatcatcaacttcaaggccctggagaaggagctgcaggccgccctgaccgccgacgagaagtacaagagagagaacgccgccaagctgagagccgtggagcagagagtggccagctacgaggagttcagaggcatcgtgctggccagccacctgaagcccctggagagaaaggacaagatgggcggcaagagaaccgtgccctggaactgccacaccatccagggcagaaccttccaggacgtggccaccgagatcagccccgagaaggcccccctgcagcccgagaccagcgccgacttctacagagactggagaagacacctgcccagcggccccgagagataccaggccctgctgcagctgggcggccccagactgggctgcctgttccagaccgacgtgggcttcggcctgctgggcgagctgctggtggccctggccgaccacgtgggccccgccgacagagccgccgtgctgggcatcctgtgcagcctggccagcaccggcagattcaccctgaacctgagcctgctgagcagagccgagagagagagctgcaagggcctgttccagaagctgcaggccatgggcaaccccagaagcgtgaaggagggcctgagctgggaggagcagggcctggaggagcagagcggcggcctgcaggaggaggagagactgctgcaggagctgctggagtag

SEQ ID NO: 19915 - DNA, 729 bp, Artificial Sequence
  Description of Artificial Sequence: Synthetic coding sequence
atggagagaaacgacatcatcaacttcaaggccctggagaaggagctgcaggccgccctgaccgccgacgagaagtacaagagagagaacgccgccaagctgagagccgtggagcagagagtggccagctacgaggagttcagaggcatcgtgctggccagccacctgaagcccctggagagaaaggacaagatgggcggcaagagaaccgtgccctggaactgccacaccatccagggcagaaccttccaggacgtggccaccgagatcagccccgagaaggcccccctgcagcccgagaccagcgccgacttctacagagactggagaagacacctgcccagcggccccgagagataccaggccctgctgcagctgggcggccccagactgggctgcctgttccagaccgacgtgggcttcggcctgctgggcgagctgctggtggccctggccgaccacgtgggccccgccgacagagccgccgtgctgggcatcctgtgcagcctggccagcaccggcagattcaccctgaacctgagcctgctgagcagagccgagagagagagctgcaagggcctgttccagaagctgcaggccatgggcaaccccagaagcgtgaaggagggcctgagctgggaggagcagggcctggaggagcagagcggcggcctgcaggaggaggagagactgctgcaggagctgctggagctgtaccaggtggactag

SEQ ID NO: 19916 - DNA, 729 bp, Artificial Sequence; identical to SEQ ID NO: 19915
  Description of Artificial Sequence: Synthetic coding sequence

SEQ ID NO: 19917 - DNA, 1104 bp, Artificial Sequence
  Description of Artificial Sequence: Synthetic coding sequence
atggccgccgaggaggaggacgaggtggagtgggtggtggagagcatcgccggcttcctgagaggccccgactggagcatccccatcctggacttcgtggagcagaagtgcgaggtgaactgcaagggcggccacgtgatcacccccggcagccccgagcccgtgatcctggtggcctgcgtgcccctggtgttcgacgacgaggaggagagcaagctgacctacaccgagatccaccaggagtacaaggagctggtggagaagctgctggagggctacctgaaggagatcggcatcaacgaggaccagttccaggaggcctgcaccagccccctggccaagacccacaccagccaggccatcctgcagcccgtgctggccgccgaggacttcaccatcttcaaggccatgatggtgcagaagaacatcgagatgcagctgcaggccatcagaatcatccaggagagaaacggcgtgctgcccgactgcctgaccgacggcagcgacgtggtgagcgacctggagcacgaggagatgaagatcctgagagaggtgctgagaaagagcaaggaggagtacgaccaggaggaggagagaaagagaaagaagcagctgagcgaggccaagaccgaggagcccaccgtgcacagcagcgaggccgccatcatgaacaacagccagggcgacggcgagcacttcgcccacccccccagcgaggtgaagatgcacttcgccaaccagagcatcgagcccctgggcagaaaggtggagagaagcgagaccagcagcctgccccagaaggacctgaagatccccggcctggagcacgccagcatcgagggccccatcgccaacctgagcgtgctgggcaccgaggagctgagacagagagagcactacctgaagcagaagagagacaagctgatgagcatgagaaaggacatgagaaccaagcagatccagaacatggagcagaagggcaagcccaccggcgaggtggaggagatgaccgagaagcccgagatgaccgccgaggagaagcagaccctgctgaagagaagactgctggccgagaagctgaaggaggaggtgatcaacaagtag

SEQ ID NO: 19918 - DNA, 1029 bp, Artificial Sequence
  Description of Artificial Sequence: Synthetic coding sequence
atggccgccgaggaggaggacgaggtggagtgggtggtggagagcatcgccggcttcctgagaggccccgactggagcatccccatcctggacttcgtggagcagaagtgcgaggtgttcgacgacgaggaggagagcaagctgacctacaccgagatccaccaggagtacaaggagctggtggagaagctgctggagggctacctgaaggagatcggcatcaacgaggaccagttccaggaggcctgcaccagccccctggccaagacccacaccagccaggccatcctgcagcccgtgctggccgccgaggacttcaccatcttcaaggccatgatggtgcagaagaacatcgagatgcagctgcaggccatcagaatcatccaggagagaaacggcgtgctgcccgactgcctgaccgacggcagcgacgtggtgagcgacctggagcacgaggagatgaagatcctgagagaggtgctgagaaagagcaaggaggagtacgaccaggaggaggagagaaagagaaagaagcagctgagcgaggccaagaccgaggagcccaccgtgcacagcagcgaggccgccatcatgaacaacagccagggcgacggcgagcacttcgcccacccccccagcgaggtgaagatgcacttcgccaaccagagcatcgagcccctgggcagaaaggtggagagaagcgagaccagcagcctgccccagaaggacctgaagatccccggcctggagcacgccagcatcgagggccccatcgccaacctgagcgtgctgggcaccgaggagctgagacagagagagcactacctgaagcagaagagagacaagctgatgagcatgagaaaggacatgagaaccaagcagatccagaacatggagcagaagggcaagcccaccggcgaggtggaggagatgaccgagaagcccgagatgaccgccgaggagaagcagaccctgctgaagagaagactgctggccgagaagctgaaggaggaggtgatcaacaagtag

SEQ ID NO: 19919 - DNA, 1545 bp, Artificial Sequence
  Description of Artificial Sequence: Synthetic coding sequence
atgtacagccagagattcggcaccgtgcagagagaggtgaagggccccacccccaaggtggtgatcgtgagaagcaagccccccaagggccagggcgccgagcaccacctggagagaatcagaagaagccaccagaagcacaacgccatcctggccagcatcaagagcagcgagagagacagactgaaggccgagtgggaccagcacaacgactgcaagatcctggacagcctggtgagagccagaatcaaggacgccgtgcagggcttcatcatcaacatcgaggagagaagaaacaagctgagagagctgctggccctggaggagaacgagtacttcaccgagatgcagctgaagaaggagaccatcgaggagaagaaggacagaatgagagagaagaccaagctgctgaaggagaagaacgagaaggagagacaggacttcgtggccgagaagctggaccagcagttcagagagagatgcgaggagctgagagtggagctgctgagcatccaccagaagaaggtgtgcgaggagagaaaggcccagatcgccttcaacgaggagctgagcagacagaagctggtggaggagcagatgttcagcaagctgtgggaggaggacagactggccaaggagaagagagaggcccaggaggccagaagacagaaggagctgatggagaacaccagactgggcctgaacgcccagatcaccagcatcaaggcccagagacaggccacccagctgctgaaggaggaggaggccagactggtggagagcaacaacgcccagatcaagcacgagaacgagcaggacatgctgaagaagcagaaggccaagcaggagaccagaaccatcctgcagaaggccctgcaggagagaatcgagcacatccagcaggagtacagagacgagcaggacctgaacatgaagctggtgcagagagccctgcaggacctgcaggaggaggccgacaagaagaagcagaagagagaggacatgatcagagagcagaagatctaccacaagtacctggcccagagaagagaggaggagaaggcccaggagaaggagttcgacagaatcctggaggaggacaaggccaagaagctggccgagaaggacaaggagctgagactggagaaggaggccagaagacagctggtggacgaggtgatgtgcaccagaaagctgcaggtgcaggagaagctgcagagagaggccaaggagcaggaggagagagccatggagcagaagcacatcaacgagagcctgaaggagctgaactgcgaggagaaggagaacttcgccagaagacagagactggcccaggagtacagaaagcagctgcagatgcagatcgcctaccagcagcagagccaggaggccgagaaggaggagaagagaagagagttcgaggccggcgtggccgccaacaagatgtgcctggacaaggtgcaggaggtgctgagcacccaccaggtgctgccccagaacatccaccccatgagaaaggcctgccccagcaagctgcccccctag

SEQ ID NO: 19920 - DNA, 1683 bp, Artificial Sequence
  Description of Artificial Sequence: Synthetic coding sequence
atgaacagaaagtgggaggccaagctgaagcagatcgaggagagagccagccactacgagagaaagcccctgagcagcgtgtacagacccagactgagcaagcccgaggagccccccagcatctggagactgttccacagacaggcccaggccttcaacttcgtgaagagctgcaaggaggacgtgcacgtgttcgccctggagtgcaaggtgggcgacggccagagaatctacctggtgaccacctacgccgagttctggttctactacaagagcagaaagaacctgctgcactgctacgaggtgatccccgagaacgccgtgtgcaagctgtacttcgacctggagttcaacaagcccgccaaccccggcgccgacggcaagaagatggtggccctgctgatcgagtacgtgtgcaaggccctgcaggagctgtacggcgtgaactgcagcgccgaggacgtgctgaacctggacagcagcaccgacgagaagttcagccagcacctgatcttccagctgcacgacgtggccttcaaggacaacatccacgtgggcaacttcctgagaaagatcctgcagcccgccctggacctgctgggcagcgaggacgacgacagcgcccccgagaccaccggccacggcttcccccacttcagcgaggcccccgccagacagggcttcagcttcaacaagatgttcaccgagaaggccaccgaggagagctggaccagcaacagcaagaagctggagagactgggcagcgccgagcagagcagccccgacctgagcttcctggtggtgaagaacaacatgggcgagaagcacctgttcgtggacctgggcgtgtacaccagaaacagaaacttcagactgtacaagagcagcaagatcggcaagagagtggccctggaggtgaccgaggacaacaagttcttccccatccagagcaaggacgtgagcgacgagtaccagtacttcctgagcagcctggtgagcaacgtgagattcagcgacaccctgagaatcctgacctgcgagcccagccagaacaagcagaagggcgtgggctacttcaacagcatcggcaccagcgtggagaccatcgagggcttccagtgcagcccctaccccgaggtggaccacttcgtgctgagcctggtgaacaaggacggcatcaagggcggcatcagaagatggaactacttcttccccgaggagctgctggtgtacgacatctgcaagtacagatggtgcgagaacatcggcagagcccacaagagcaacaacatcatgatcctggtggacctgaagaacgaggtgtggtaccagaagtgccacgaccccgtgtgcaaggccgagaacttcaagagcgactgcttccccctgcccgccgaggtgtgcctgctgttcctgttcaaggaggaggaggagttcaccaccgacgaggccgacgagaccagaagcaacgagacccagaacccccacaagcccagccccagcagactgagcaccggcgccagcgccgacgccgtgtgggacaacggcatcgacgacgcctacttcctggaggccaccgaggacgccgagctggccgaggccgccgagaacagcctgctgagctacaacagcgaggtggacgagatccccgacgagctgatcatcgaggtgctgcaggagtag

SEQ ID NO: 19921 - DNA, 1590 bp, Artificial Sequence
  Description of Artificial Sequence: Synthetic coding sequence
atggccgccctgaccaccgtggtggtggccgccgccgccaccgccgtggccggcgccgtggccggcgccggcgccgccaccggcaccggcgtgggcgccacccccgccccccagcagagcgacggctgcttcagcaccagcggcggcatcagacccttccacctgcagaactggaagcagaaggtgaaccagaccaagaaggccgagttcgtgagaaccgccgagaagttcaagaaccaggtgatcaacatggagaaggacaagcacagccacttctacaaccagaagagcgacttcagaatcgagcacagcatgctggaggagctggagaacaagctgatccacagcagaaagaccgagagagccaagatccagcagcagctggccaagatccacaacaacgtgaagaagctgcagcaccagctgaaggacgtgaagcccacccccgacttcgtggagaagctgagagagatgatggaggagatcgagaacgccatcaacaccttcaaggaggagcagagactgatctacgaggagctgatcaaggaggagaagaccaccaacaacgagctgagcgccatcagcagaaagatcgacacctgggccctgggcaacagcgagaccgagaaggccttcagagccatcagcagcaaggtgcccgtggacaaggtgacccccagcaccctgcccgaggaggtgctggacttcgagaagttcctgcagcagaccggcggcagacagggcgcctgggacgactacgaccaccagaacttcgtgaaggtgagaaacaagcacaagggcaagcccaccttcatggaggaggtgctggagcacctgcccggcaagacccaggacgaggtgcagcagcacgagaagtggtaccagaagttcctggccctggaggagagaaagaaggagagcatccagatctggaagaccaagaagcagcagaagagagaggagatcttcaagctgaaggagaaggccgacaacacccccgtgctgttccacaacaagcaggaggacaaccagaagcagaaggaggagcagagaaagaagcagaagctggccgtggaggcctggaagaagcagaagagcatcgagatgagcatgaagtgcgccagccagctgaaggaggaggaggagaaggagaagaagcaccagaaggagagacagagacagttcaagctgaagctgctgctggagagctacacccagcagaagaaggagcaggaggagttcctgagactggagaaggagatcagagagaaggccgagaaggccgagaagagaaagaacgccgccgacgagatcagcagattccaggagagagacctgcacaagctggagctgaagatcctggacagacaggccaaggaggacgagaagagccagaagcagagaagactggccaagctgaaggagaaggtggagaacaacgtgagcagagaccccagcagactgtacaagcccaccaagggctgggaggagagaaccaagaagatcggccccaccggcagcggccccctgctgcacatcccccacagagccatccccacctggagacagggcatccagagaagagtgtag

SEQ ID NO: 19922 - DNA, 1341 bp, Artificial Sequence
  Description of Artificial Sequence: Synthetic coding sequence
atggagaaggacaagcacagccacttctacaaccagaagagcgacttcagaatcgagcacagcatgctggaggagctggagaacaagctgatccacagcagaaagaccgagagagccaagatccagcagcagctggccaagatccacaacaacgtgaagaagctgcagcaccagctgaaggacgtgaagcccacccccgacttcgtggagaagctgagagagatgatggaggagatcgagaacgccatcaacaccttcaaggaggagcagagactgatctacgaggagctgatcaaggaggagaagaccaccaacaacgagctgagcgccatcagcagaaagatcgacacctgggccctgggcaacagcgagaccgagaaggccttcagagccatcagcagcaaggtgcccgtggacaaggtgacccccagcaccctgcccgaggaggtgctggacttcgagaagttcctgcagcagaccggcggcagacagggcgcctgggacgactacgaccaccagaacttcgtgaaggtgagaaacaagcacaagggcaagcccaccttcatggaggaggtgctggagcacctgcccggcaagacccaggacgaggtgcagcagcacgagaagtggtaccagaagttcctggccctggaggagagaaagaaggagagcatccagatctggaagaccaagaagcagcagaagagagaggagatcttcaagctgaaggagaaggccgacaacacccccgtgctgttccacaacaagcaggaggacaaccagaagcagaaggaggagcagagaaagaagcagaagctggccgtggaggcctggaagaagcagaagagcatcgagatgagcatgaagtgcgccagccagctgaaggaggaggaggagaaggagaagaagcaccagaaggagagacagagacagttcaagctgaagctgctgctggagagctacacccagcagaagaaggagcaggaggagttcctgagactggagaaggagatcagagagaaggccgagaaggccgagaagagaaagaacgccgccgacgagatcagcagattccaggagagagacctgcacaagctggagctgaagatcctggacagacaggccaaggaggacgagaagagccagaagcagagaagactggccaagctgaaggagaaggtggagaacaacgtgagcagagaccccagcagactgtacaagcccaccaagggctgggaggagagaaccaagaagatcggccccaccggcagcggccccctgctgcacatcccccacagagccatccccacctggagacagggcatccagagaagagtgtag

SEQ ID NO: 19923 - DNA, 798 bp, Artificial Sequence
  Description of Artificial Sequence: Synthetic coding sequence
atgagcgccgcccccctggtgggctacagcagcagcggcagcgaggacgagagcgaggacggcatgagaaccagacccggcgacggcagccacagaagaggccagagccccctgcccagacagagattccccgtgcccgacagcgtgctgaacatgttccccggcaccgaggagggccccgaggacgacagcaccaagcacggcggcagagtgagaaccttcccccacgagagaggcaactgggccacccacgtgtacgtgccctacgaggccaaggaggagttcctggacctgctggacgtgctgctgccccacgcccagacctacgtgcccagactggtgagaatgaaggtgttccacctgagcctgagccagagcgtggtgctgagacaccactggatcctgcccttcgtgcaggccctgaaggccagaatgaccagcttccacagattcttcttcaccgccaaccaggtgaagatctacaccaaccaggagaagaccagaaccttcatcggcctggaggtgaccagcggccacgcccagttcctggacctggtgagcgaggtggacagagtgatggaggagttcaacctgaccaccttctaccaggaccccagcttccacctgagcctggcctggtgcgtgggcgacgccagactgcagctggagggccagtgcctgcaggagctgcaggccatcgtggacggcttcgaggacgccgaggtgctgctgagagtgcacaccgagcaggtgagatgcaagagcggcaacaagttcttcagcatgcccctgaagtag

SEQ ID NO: 19924 - DNA, 972 bp, Artificial Sequence
  Description of Artificial Sequence: Synthetic coding sequence
atgaccgacgacgagagcgagagcgtgctgagcgacagccacgagggcagcgagctggagctgcccgtgatccagctgtgcggcctggtggaggagctgagctacgtgaacagcgccctgaagaccgagaccgagatgttcgagaagtactacgccaagctggagcccagagaccagagaccccccagactgagcgagatcaagatcagcgccgccgactacgcccaggccatcatcgaggaggccgagatcagatggagcgaggtgagcagagaggtgcacgagttcgagaaggacatcctgaaggccatcagcaagaagaagggcagcatcctggccacccagaaggtgatgaagtacatcgaggacatgaacagaagaagagacaacatgaaggagaagctgagactgaagaacgtgagcctgaaggtgcagagaaagaagatgctgctgcagctgagacagaaggaggaggtgagcgaggccctgcacgacgtggacttccagcagctgaagatcgagaacgcccagttcctggagaccatcgaggccagaaaccaggagctgacccagctgaagctgagcagcggcaacaccctgcaggtgctgaacgcctacaagagcaagctgcacaaggccatggagatctacctgaacctggacaaggagatcctgctgagaaaggagctgctggagaagatcgagaaggagaccctgcaggtggaggaggacagagccaaggccgaggccgtgaacaagagactgagaaagcagctggccgagttcagagccccccaggtgatgacctacgtgagagagaagatcctgaacgccgacctggagaagagcatcagaatgtgggagagaaaggtggagatcgccgagatgagcctgaagggccacagaaaggcctggaacagaatgaagatcaccaacgagcagctgcaggccgactacctggccggcaagtag

SEQ ID NO: 19925 - DNA, 2013 bp, Artificial Sequence
  Description of Artificial Sequence: Synthetic coding sequence
atggagggcgagagaagagcctacagcaaggaggtgcaccagagaatcaacaagcagctggaggagatcagaagactggaggaggtgagaggcgacctgcaggtgcagatcagcgccgcccagaaccaggtgaagagactgagagacagccagagactggagaacatggacagactgctgaagggcagagcccaggtgcaggccgagatcgaggagctgcaggagcagaccagagccctggacaagcagatccaggagtgggagaccagaatcttcacccacagcaagaacgtgagaagccccggcttcatcctggaccagaaggtgaagatcagaagaagaatcagaatcctggagaaccagctggacagagtgacctgccacttcgacaaccagctggtgagaaacgccgccctgagagaggagctggacctgctgagaatcgacagaaacagatacctgaacgtggacagaaagctgaagaaggagatccaccacctgcaccacctggtgagcaccctgatcctgagcagcaccagcgcctacgccgtgagagaggaggccaaggccaagatgggcctgctgagagagagagccgagaaggaggaggcccagagcgagatggaggcccaggtgctgcagagacagatcctgcacctggagcagctgcaccacttcctgaagctgaagaacaacgacagacagcccgaccccgacgtgctggagaagagagagaagcaggccggcgaggtggccgagggcgtgtggaagaccagccaggagagactggtgctgtgctacgaggacgccctgaacaagctgagccagctgatgggcgagagcgaccccgacctgctggtgcagaagtacctggagatcgaggagagaaacttcgccgagttcaacttcatcaacgagcagaacctggagctggagcacgtgcaggaggagatcaaggagatgcaggaggccctggtgagcgccagagccagcaaggacgaccagcacctgctgcaggagcagcagcagaaggtgctgcagcagagaatggacaaggtgcacagcgaggccgagagactggaggccagattccaggacgtgagaggccagctggagaagctgaaggccgacatccagctgctgttcaccaaggcccactgcgacagcagcatgatcgacgacctgctgggcgtgaagaccagcatgggcgacagagacatgggcctgttcctgagcctgatcgagaagagactggtggagctgctgaccgtgcaggccttcctgcacgcccagagcttcaccagcctggccgacgccgccctgctggtgctgggccagagcctggaggacctgcccaagaagatggcccccctgcagccccccgacaccctggaggacccccccggcttcgaggccagcgacgactaccccatgagcagagaggagctgctgagccaggtggagaagctggtggagctgcaggagcaggccgaggcccagagacagaaggacctggccgccgccgccgccaagctggacggcaccctgagcgtggacctggccagcacccagagagccggcagcagcaccgtgctggtgcccaccagacacccccacgccatccccggcagcatcctgagccacaagaccagcagagacagaggcagcctgggccacgtgaccttcggcggcctgagcagcagcaccggccacctgcccagccacatcacccacggcgaccccaacaccggccacgtgaccttcggcagcaccagcgccagcagcggcggccacgtgaccttcagacccgtgagcgccagcagctacctgggcagcaccggctacgtgggcagcagcagaggcggcgagaacaccgagggcggcgtggagagcggcggcaccgccagcgacagcagcggcggcctgggcagcagcagagaccacgtgagcagcaccggccccgccagcagcaccggccccggcagcagcaccagcaaggacagcagaggctag

SEQ ID NO: 19926 - DNA, 1842 bp, Artificial Sequence
  Description of Artificial Sequence: Synthetic coding sequence
atggccagatgcagacaccacagcggctacctggccgacgacgaggccagccacagcatgtgcagcgccagagtgcagctgcccaagaagcccctggtgcccgagatgagacccgcctgcaagcccggcagagtgccccacccccccagcacctgcggcagcagcgccctgcagggccagagaagaaacaagagacacccccagcccttcggccacttcctggacttcctgaccgagagccaggtgctggacagcctggagaccgtggtggagaaggccaccgagagaatggccgccatgaagaccgaggccggcgtgcccctggtggaggtgcaggaccccgtggaggtgcccagcggcggcagaagagcccacgccagacccagcctgagcaccgtgcacagacacagagtgagacccaccctgtgcaccggccaccccaacaactaccccagcagcagcagcagcatgagcaactgccacagcagcctgatggccggctgcctgggcagccacagcagagacagcgacctgggcgcccagggcagcctgccccccgtgagagacaagctgctgctggagaagaacctgaagagactgctgcagctggagagagagggcaagggcctgagccagagctgcagccagagagacagcctgctgtgggacagcctgggcagccagaccagcttccagtggacccaggagcagcccctgagctggttcagcggcctgctgggcagcagcagcggcgtgcccgaggccagcgagcccagacccggcgagcaggagcccatcttcagaaagagagagttcaacaaggagatcaagagcctgctgagccagctggagagcctggacctgcccggctactgccccctgagagagccccacagaaccctgaacttcctggccgaccacagactgttccccgccctgcagagcgtggtgagccaggccgtggacaagctgagaggcgcccactgcagagacggcagacccctgttccccaccagcctggagcccaccagcgacctgccccccctgggcagcgagcccgccaagcccaccaacggcggccagccctacgccagccccagacccaccgtgagcagccccaagatgctgcagagaaagagaaaggacagaggcggcagccccagcatgagcagcgcccaggtggccaccagattcaagctgaagagcccctgcagcagcagcagattcaccaagaagaagcccctgcccagcatcagcagcaagagcagcatgagccacttcagcaacagactgtacgaggagctggccgacttcctgacccagcaggccgccagcctggtgatcagaaagtacgagttcgagaaggacctgagcaagcagctgggcttcttcagcttccccatcacccacgtgctgagagacctgagcctgggcctgaagaaggtgaagggcagcagaatccacctgagcagcgagacccacagaagctgcctgctgagaaagctggaggagagcaagagagccagacaggccagcagactgagcaccagccactgcagcaccgagacccccagcgtgcagcaggagcccgccacccacaccgcccaggaccaggccaccgagccctgcagaagcctgtacaccaacctgcccgccagcagacagctgagccccctggagcccaagctgtacatgagcgcctgcaccggcatgggcagcagcccccccaagagcaaggacatggacaacgagggcagagacaaggccgagatcgaggacgaggacgaggacgagttcaaggacgaggaccaggacgaggacaaggacgaggacggcgtgtag

SEQ ID NO: 19927 - DNA, 840 bp, Artificial Sequence
  Description of Artificial Sequence: Synthetic coding sequence
atggccgccctgggcagacccttcagcggcctgcccctgagcggcggcagcgacttcctgcagcccccccagcccgccttccccggcagagccttcccccccggcgccgacggcgccgagctggcccccagacccggccccagagccgtgcccagcagccccgccggcagcgccgccagaggcagagtgagcgtgcactgcaagaagaagcacaagagagaggaggaggaggacgacgactgccccgtgagaaagaagagaatcaccgaggccgagctgtgcgccggccccaacgactggatcctgtgcgcccaccaggacgtggagggccacggcgtgaaccccagcgtgagcggcctgagcatccccggcatcctggacgtgatctgcgaggagatggaccagaccaccggcgagccccagtgcgaggtggccagaagaaagctgcaggagatcgaggacagaatcatcgacgaggacgaggaggtggaggccgacagaaacgtgaaccacctgcccagcctggtgctgagcgacaccatgaagaccggcctgaagagagagttcgacgaggtgttcaccaagaagatgatcgagagcatgagcagacccagcatggagctggtgctgtggaagcccctgcccgagctgctgagcgacaagcccaagcccagcagcaacaccaagaactacaccggcgagagccaggccaagcacgtggccgccggcaccgccttcccccagagaaccgagctgttcagcgagcccagacccaccggcatgagcctgtacaacagcctggagaccgccaccagcaccgaggaggagatggagctgtag

SEQ ID NO: 19928 - DNA, 615 bp, Artificial Sequence
  Description of Artificial Sequence: Synthetic coding sequence
atggccgccctgggcagacccttcagcggcctgcccctgagcggcggcagcgacttcctgcagcccccccagcccgccttccccggcagagccttcccccccggcgccgacggcgccgagctggcccccagacccggccccagagccgtgcccagcagccccgccggcagcgccgccagaggcagagtgagcgtgcactgcaagaagaagcacaagagagaggaggaggaggacgacgagatcatcgacgaggacgaggaggtggaggccgacagaaacgtgaaccacctgcccagcctggtgctgagcgacaccatgaagaccggcctgaagagagagttcgacgaggtgttcaccaagaagatgatcgagagcatgagcagacccagcatggagctggtgctgtggaagcccctgcccgagctgctgagcgacaagcccaagcccagcagcaacaccaagaactacaccggcgagagccaggccaagcacgtggccgccggcaccgccttcccccagagaaccgagctgttcagcgagcccagacccaccggcatgagcctgtacaacagcctggagaccgccaccagcaccgaggaggagatggagctgtag

SEQ ID NO: 19929 - DNA, 444 bp, Artificial Sequence
  Description of Artificial Sequence: Synthetic coding sequence
atggaccagaccaccggcgagccccagtgcgaggtggccagaagaaagctgcaggagatcgaggacagaatcatcgacgaggacgaggaggtggaggccgacagaaacgtgaaccacctgcccagcctggtgctgagcgacaccatgaagaccggcctgaagagagagttcgacgaggtgttcaccaagaagatgatcgagagcatgagcagacccagcatggagctggtgctgtggaagcccctgcccgagctgctgagcgacaagcccaagcccagcagcaacaccaagaactacaccggcgagagccaggccaagcacgtggccgccggcaccgccttcccccagagaaccgagctgttcagcgagcccagacccaccggcatgagcctgtacaacagcctggagaccgccaccagcaccgaggaggagatggagctgtag

SEQ ID NO: 19930 - DNA, 786 bp, Artificial Sequence
  Description of Artificial Sequence: Synthetic coding sequence
atggccgccctgggcagacccttcagcggcctgcccctgagcggcggcagcgacttcctgcagcccccccagcccgccttccccggcagagccttcccccccggcgccgacggcgccgagctggcccccagacccggccccagagccgtgcccagcagccccgccggcagcgccgccagaggcagatgccccgtgagaaagaagagaatcaccgaggccgagctgtgcgccggccccaacgactggatcctgtgcgcccaccaggacgtggagggccacggcgtgaaccccagcgtgagcggcctgagcatccccggcatcctggacgtgatctgcgaggagatggaccagaccaccggcgagccccagtgcgaggtggccagaagaaagctgcaggagatcgaggacagaatcatcgacgaggacgaggaggtggaggccgacagaaacgtgaaccacctgcccagcctggtgctgagcgacaccatgaagaccggcctgaagagagagttcgacgaggtgttcaccaagaagatgatcgagagcatgagcagacccagcatggagctggtgctgtggaagcccctgcccgagctgctgagcgacaagcccaagcccagcagcaacaccaagaactacaccggcgagagccaggccaagcacgtggccgccggcaccgccttcccccagagaaccgagctgttcagcgagcccagacccaccggcatgagcctgtacaacagcctggagaccgccaccagcaccgaggaggagatggagctgtag

SEQ ID NO: 19931 - DNA, 540 bp, Artificial Sequence
  Description of Artificial Sequence: Synthetic coding sequence
atgcaggacggcagaaagggcggcgcctacgccggcaagatggaggccaccaccgccggcgtgggcagactggaggaggaggccctgagaagaaaggagagactgaaggccctgagagagaagaccggcagaaaggacaaggaggacggcgagcccaagaccaagcacctgagagaggaggaggaggagggcgagaagcacagagagctgagactgagaaactacgtgcccgaggacgaggacctgaagaagagaagagtgccccaggccaagcccgtggccgtggaggagaaggtgaaggagcagctggaggccgccaagcccgagcccgtgatcgaggaggtggacctggccaacctggcccccagaaagcccgactgggacctgaagagagacgtggccaagaagctggagaagctgaagaagagaacccagagagccatcgccgagctgatcagagagagactgaagggccaggaggacagcctggccagcgccgtggacgccgccaccgagcagaagacctgcgacagcgactag

SEQ ID NO: 19932 - DNA, 540 bp, Artificial Sequence; identical to SEQ ID NO: 19931
  Description of Artificial Sequence: Synthetic coding sequence

SEQ ID NO: 19933 - DNA, 309 bp, Artificial Sequence
  Description of Artificial Sequence: Synthetic coding sequence
atgcaggacggcagaaagggcggcgcctacgccggcaagatggaggccaccaccgccggcgtgggcagactggaggaggaggccctgagaagaaaggagagactgaaggccctgagagagaagaccggcagaaaggacaaggaggacggcgagcccaagaccaagcacctgagagaggaggaggaggagggcgagaagcacagagagctgagactgagaaactacgtgcccgaggacgaggacctgaagaagagaagagtgccccaggccaagcccgtggccgtggaggagaaggtgaaggagcagtag

SEQ ID NO: 19934 - DNA, 501 bp, Artificial Sequence
  Description of Artificial Sequence: Synthetic coding sequence
atggaggccaccaccgccggcgtgggcagactggaggaggaggccctgagaagaaaggagagactgaaggccctgagagagaagaccggcagaaaggacaaggaggacggcgagcccaagaccaagcacctgagagaggaggaggaggagggcgagaagcacagagagctgagactgagaaactacgtgcccgaggacgaggacctgaagaagagaagagtgccccaggccaagcccgtggccgtggaggagaaggtgaaggagcagctggaggccgccaagcccgagcccgtgatcgaggaggtggacctggccaacctggcccccagaaagcccgactgggacctgaagagagacgtggccaagaagctggagaagctgaagaagagaacccagagagccatcgccgagctgatcagagagagactgaagggccaggaggacagcctggccagcgccgtggacgccgccaccgagcagaagacctgcgacagcgactag

SEQ ID NO: 19935 - DNA, 1893 bp, Artificial Sequence
  Description of Artificial Sequence: Synthetic coding sequence
atggaggtgaagggccagctgatcagcagccccaccttcaacgcccccgccgccctgttcggcgaggccgccccccaggtgaagagcgagagactgagaggcctgctggacagacagagaaccctgcaggaggccctgagcctgaagctgcaggagctgagaaaggtgtgcctgcaggaggccgagctgaccggccagctgccccccgagtgccccctggagcccggcgagagaccccagctggtgagaagaagaccccccaccgccagagcctacccccccccccaccccaaccaggcccaccacagcctgtgccccgccgaggagctggccctggaggccctggagagagaggtgagcgtgcagcagcagatcgccgccgccgccagaagactggccctggcccccgacctgagcaccgagcagagaagaagaagaagacaggtgcaggccgacgccctgagaagactgcacgagctggaggagcagctgagagacgtgagagccagactgggcctgcccgtgctgcccctgccccagcccctgcccctgagcaccggcagcgtgatcaccacccagggcgtgtgcctgggcatgagactggcccagctgagccaggaggacgtggtgctgcacagcgagagcagcagcctgagcgagagcggcgccagccacgacaacgaggagccccacggctgcttcagcctggccgagagacccagcccccccaaggcctgggaccagctgagagccgtgagcggcggcagccccgagagaagaaccccctggaagcccccccccagcgacctgtacggcgacctgaagagcagaagaaacagcgtggccagccccaccagccccaccagaagcctgcccagaagcgccagcagcttcgagggcagaagcgtgcccgccacccccgtgctgaccagaggcgccggcccccagctgtgcaagcccgagggcctgcacagcagacagtggagcggcagccaggacagccagatgggcttccccagagccgaccccgccagcgacagagccagcctgttcgtggccagaaccagaagaagcaacagcagcgaggccctgctggtggacagagccgccggcggcggcgccggcagcccccccgcccccctggcccccagcgccagcggcccccccgtgtgcaagagcagcgaggtgctgtacgagagaccccagcccacccccgccttcagcagcagaaccgccggcccccccgacccccccagagccgccagacccagcagcgccgcccccgccagcagaggcgcccccagactgccccccgtgtgcggcgacttcctgctggactacagcctggacagaggcctgcccagaagcggcggcggcaccggctggggcgagctgccccccgccgccgaggtgcccggccccctgagcagaagagacggcctgctgaccatgctgcccggccccccccccgtgtacgccgccgacagcaacagccccctgctgagaaccaaggacccccacaccagagccaccagaaccaagccctgcggcctgccccccgaggccgccgagggccccgaggtgcaccccaaccccctgctgtggatgcccccccccaccagaatccccagcgccggcgagagaagcggccacaagaacctggccctggagggcctgagagactggtacatcagaaacagcggcctggccgccggcccccagagaagacccgtgctgcccagcgtgggccccccccacccccccttcctgcacgccagatgctacgaggtgggccaggccctgtacggcgcccccagccaggcccccctgccccacagcagaagcttcaccgccccccccgtgagcggcagatacggcggctgcttctactag

SEQ ID NO: 19936 - DNA, 1986 bp, Artificial Sequence
  Description of Artificial Sequence: Synthetic coding sequence
atggaggtgaagggccagctgatcagcagccccaccttcaacgcccccgccgccctgttcggcgaggccgccccccaggtgaagagcgagagactgagaggcctgctggacagacagagaaccctgcaggaggccctgagcctgaagctgcaggagctgagaaaggtgtgcctgcaggaggccgagctgaccggccagctgccccccgagtgccccctggagcccggcgagagaccccagctggtgagaagaagaccccccaccgccagagcctacccccccccccaccccaaccaggcccaccacagcctgtgccccgccgaggagctggccctggaggccctggagagagaggtgagcgtgcagcagcagatcgccgccgccgccagaagactggccctggcccccgacctgagcaccgagcagagaagaagaagaagacaggtgcaggccgacgccctgagaagactgcacgagctggaggagcagctgagagacgtgagagccagactgggcctgcccgtgctgcccctgccccagcccctgcccctgagcaccggcagcgtgatcaccacccagggcgtgtgcctgggcatgagactggcccagctgagccaggaggacgtggtgctgcacagcgagagcagcagcctgagcgagagcggcgccagccacgacaacgaggagccccacggctgcttcagcctggccgagagacccagcccccccaaggcctgggaccagctgagagccgtgagcggcggcagccccgagagaagaaccccctggaagcccccccccagcgacctgtacggcgacctgaagagcagaagaaacagcgtggccagccccaccagccccaccagaagcctgcccagaagcgccagcagcttcgagggcagaagcgtgcccgccacccccgtgctgaccagaggcgccggcccccagctgtgcaagcccgagggcctgcacagcagacagtggagcggcagccaggacagccagatgggcttccccagagccgaccccgccagcgacagagccagcctgttcgtggccagaaccagaagaagcaacagcagcgaggccctgctggtggacagagccgccggcggcggcgccggcagcccccccgcccccctggcccccagcgccagcggcccccccgtgtgcaagagcagcgaggtgctgtacgagagaccccagcccacccccgccttcagcagcagaaccgccggcccccccgacccccccagagccgccagacccagcagcgccgcccccgccagcagaggcgcccccagactgccccccgtgtgcggcgacttcctgctggactacagcctggacagaggcctgcccagaagcggcggcggcaccggctggggcgagctgccccccgccgccgaggtgcccggccccctgagcagaagagacggcctgctgaccatgctgcccggccccccccccgtgtacgccgccgacagcaacagccccctgctgagaaccaaggacccccacaccagagccaccagaaccaagccctgcggcctgccccccgaggccgccgagggccccgaggtgcaccccaaccccctgctgtggatgcccccccccaccagaatccccagcgccggcgagagaagcggccacaagaacctggccctggagggcctgagagactggtacatcagaaacagcggcctggccgccggcccccagagaagacccgtgctgcccagcgtgggccccccccacccccccttcctgcacgccagatgctacgaggtgggccaggccctgtacggcgcccccagccaggcccccctgccccacagcagaagcttcaccgccccccccgtgagcggcagatactacgccgacttcctgtacccccccgagctgagcgccagactgagcgacctgaccctggagggcgagcagagcagcagcagcgacacccagacccccggcaccctggtgtag

SEQ ID NO: 19937 - DNA, 1857 bp, Artificial Sequence
  Description of Artificial Sequence: Synthetic coding sequence
atggaggtgaaggccgccctgttcggcgaggccgccccccaggtgaagagcgagagactgagaggcctgctggacagacagagaaccctgcaggaggccctgagcctgaagctgcaggagctgagaaaggtgtgcctgcaggaggccgagctgaccggccagctgccccccgagtgccccctggagcccggcgagagaccccagctggtgagaagaagaccccccaccgccagagcctacccccccccccaccccaaccaggcccaccacagcctgtgccccgccgaggagctggccctggaggccctggagagagaggtgagcgtgcagcagcagatcgccgccgccgccagaagactggccctggcccccgacctgagcaccgagcagagaagaagaagaagacaggtgcaggccgacgccctgagaagactgcacgagctggaggagcagctgagagacgtgagagccagactgggcctgcccgtgctgcccctgccccagcccctgcccctgagcaccggcagcgtgatcaccacccagggcgtgtgcctgggcatgagactggcccagctgagccaggaggacgtggtgctgcacagcgagagcagcagcctgagcgagagcggcgccagccacgacaacgaggagccccacggctgcttcagcctggccgagagacccagcccccccaaggcctgggaccagctgagagccgtgagcggcggcagccccgagagaagaaccccctggaagcccccccccagcgacctgtacggcgacctgaagagcagaagaaacagcgtggccagccccaccagccccaccagaagcctgcccagaagcgccagcagcttcgagggcagaagcgtgcccgccacccccgtgctgaccagaggcgccggcccccagctgtgcaagcccgagggcctgcacagcagacagtggagcggcagccaggacagccagatgggcttccccagagccgaccccgccagcgacagagccagcctgttcgtggccagaaccagaagaagcaacagcagcgaggccctgctggtggacagagccgccggcggcggcgccggcagcccccccgcccccctggcccccagcgccagcggcccccccgtgtgcaagagcagcgaggtgctgtacgagagaccccagcccacccccgccttcagcagcagaaccgccggcccccccgacccccccagagccgccagacccagcagcgccgcccccgccagcagaggcgcccccagactgccccccgtgtgcggcgacttcctgctggactacagcctggacagaggcctgcccagaagcggcggcggcaccggctggggcgagctgccccccgccgccgaggtgcccggccccctgagcagaagagacggcctgctgaccatgctgcccggccccccccccgtgtacgccgccgacagcaacagccccctgctgagaaccaaggacccccacaccagagccaccagaaccaagccctgcggcctgccccccgaggccgccgagggccccgaggtgcaccccaaccccctgctgtggatgcccccccccaccagaatccccagcgccggcgagagaagcggccacaagaacctggccctggagggcctgagagactggtacatcagaaacagcggcctggccgccggcccccagagaagacccgtgctgcccagcgtgggccccccccacccccccttcctgcacgccagatgctacgaggtgggccaggccctgtacggcgcccccagccaggcccccctgccccacagcagaagcttcaccgccccccccgtgagcggcagatacggcggctgcttctactag

SEQ ID NO: 19938 - DNA, 837 bp, Artificial Sequence
  Description of Artificial Sequence: Synthetic coding sequence
atgaccgacctgaacaagcacatcaagcaggcccagacccagagaaagcagctgctggaggagagcagagagctgcacagagagaagctgctggtgcaggccgagaacagattcttcctggagtacctgaccaacaagaccgaggagtacaccgagcagcccgagaaggtgtggaacagctacctgcagaagagcggcgagatcgagagaagaagacaggagagcgccagcagatacgccgagcagatcagcgtgctgaagaccgccctgctgcagaaggagaacatccagagcagcctgaagagaaagctgcaggccatgagagacatcgccatcctgaaggagaagcaggagaaggagatccagaccctgcaggaggagaccaagaaggtgcaggccgagaccgccagcaagaccagagaggtgcaggcccagctgctgcaggagaagagactgctggagaagcagctgagcgagcccgacagaagactgctgggcaagagaaagagaagagagctgaacatgaaggcccaggccctgaagctggccgccaagagattcatcttcgagtacagctgcggcatcaacagagagaaccagcagttcaagaaggagctgctgcagctgatcgagcaggcccagaagctgaccgccacccagagccacctggagaacagaaagcagcagctgcagcaggagcagtggtacctggagagcctgatccaggccagacagagactgcagggcagccacaaccagtgcctgaacagacaggacgtgcccaagaccacccccagcctgccccagggcaccaagagcagaatcaaccccaagtag

SEQ ID NO: 19939 - DNA, 1323 bp, Artificial Sequence
  Description of Artificial Sequence: Synthetic coding sequence
atgggcagcagaggccagggcagccacagcaagaagaccagaagcatgcccgtgatcctgagcccccagagaaccggcagcggcgccaccggcggccccgccgccagagcctacagcgtggccgaggccgtgaagcagttcagagccggccccgccggcaccggcgccggctgcagcctgcagggctgctgggccgcccccagacccttcgagcacagaaccaacaagctgagagagctgagcaccctggcccactgcagcagagagctgcagacccaggtgcccgacgccagcgcccacagcctggccgtgaccctgagcgagctgcacagctgcagagacctgcaggacgagtgcctggacagcagattcgccgagggccccagaagactgctgcccccctaccacagcctgatcaacaacttcgtgaagcccgagaagctgaccaaggtggagaccagactgaaggagaagatcgtggccgagatgaccgacctgaacaagcacatcaagcaggcccagacccagagaaagcagctgctggaggagagcagagagctgcacagagagaagctgctggtgcaggccgagaacagattcttcctggagtacctgaccaacaagaccgaggagtacaccgagcagcccgagaaggtgtggaacagctacctgcagaagagcggcgagatcgagagaagaagacaggagagcgccagcagatacgccgagcagatcagcgtgctgaagaccgccctgctgcagaaggagaacatccagagcagcctgaagagaaagctgcaggccatgagagacatcgccatcctgaaggagaagcaggagaaggagatccagaccctgcaggaggagaccaagaaggtgcaggccgagaccgccagcaagaccagagaggtgcaggcccagctgctgcaggagaagagactgctggagaagcagctgagcgagcccgacagaagactgctgggcaagagaaagagaagagagctgaacatgaaggcccaggccctgaagctggccgccaagagattcatcttcgagtacagctgcggcatcaacagagagaaccagcagttcaagaaggagctgctgcagctgatcgagcaggcccagaagctgaccgccacccagagccacctggagaacagaaagcagcagctgcagcaggagcagtggtacctggagagcctgatccaggccagacagagactgcagggcagccacaaccagtgcctgaacagacaggacgtgcccaagaccacccccagcctgccccagggcaccaagagcagaatcaaccccaagtag

SEQ ID NO: 19940 - DNA, 672 bp, Artificial Sequence
  Description of Artificial Sequence: Synthetic coding sequence
atgcccaagaagttccagggcgagaacaccaagagcgccgccgccagagccagaagagccgaggccaaggccgccgccgacgccaagaagcagaaggagctggaggacgcctactggaaggacgacgacaagcacgtgatgagaaaggagcagagaaaggaggagaaggagaagagaagactggaccagctggagagaaagaaggagacccagagactgctggaggaggaggacagcaagctgaagggcggcaaggcccccagagtggccaccagcagcaaggtgaccagagcccagatcgaggacaccctgagaagagaccaccagctgagagaggcccccgacaccgccgagaaggccaagagccacctggaggtgcccctggaggagaacgtgaacagaagagtgctggaggagggcagcgtggaggccagaaccatcgaggacgccatcgccgtgctgagcgtggccgaggaggccgccgacagacaccccgagagaagaatgagagccgccttcaccgccttcgaggaggcccagctgcccagactgaagcaggagaaccccaacatgagactgagccagctgaagcagctgctgaagaaggagtggctgagaagccccgacaaccccatgaaccagagagccgtgcccttcaacgcccccaagtag

SEQ ID NO: 19941 - DNA, 672 bp, Artificial Sequence; identical to SEQ ID NO: 19940
  Description of Artificial Sequence: Synthetic coding sequence

SEQ ID NO: 19942 - DNA, 783 bp, Artificial Sequence
  Description of Artificial Sequence: Synthetic coding sequence
atgaacaacctgaacgacccccccaactggaacatcagacccaacagcagagccgacggcggcgacggcagcagatggaactacgccctgctggtgcccatgctgggcctggccgccttcagatggatctggagcagagagagccagaaggaggtggagaaggagagagaggcctacagaagaagaaccgccgccttccagcaggacctggaggccaagtaccacgccatgatcagcgagaacagaagagccgtggcccagctgagcctggagctggagaaggagcagaacagaaccgccagctacagagaggccctgatcagccagggcagaaagctggtggaggagaagaagctgctggagcaggagagagcccaggtgatgcaggagaagagacaggtgcagcccctgagaagcgcctacctgagctgcctgcagagagaggagaactggcagagaagagccagactgctgctgaaggagttcgaggccgtgctgaccgagagacagaacatctactgcagcctgttcctgcccagaagcaagagactggagatcgagaagagcctgctggtgagagccagcgtggaccccgtggccgccgacctggagatggccgccggcctgaccgacatcttccagcacgacacctactgcggcgacgtgtggaacaccaacaagagacagaacggcagactgatgtggctgtacctgaagtactgggagctggtggtggagctgaagaagttcaagagagtggaggaggccatcctggagaagtag

SEQ ID NO: 19943 - DNA, 210 bp, Artificial Sequence
  Description of Artificial Sequence: Synthetic coding sequence
atgaacaacctgaacgacccccccaactggaacatcagacccaacagcagagccgacggcggcgacggcagcagatggaactacgccctgctggtgcccatgctgggcctggccgccttcagatggatctggagcagagagagccagaaggaggtggagaaggagagagaggcctacagaagaagaaccgccgccttccagcaggactag

SEQ ID NO: 19944 - DNA, 2691 bp, Artificial Sequence
  Description of Artificial Sequence: Synthetic coding sequence
atgatggcccagaagagccagggcagcgacaacctgcaggagggccaggagaagagcaagagagagatcctgaagtgcaccaagagcgcctgggcccccctggacgagtggctgccccccgaccccgaggaggagagccagagcctgaccatccccatgctggaggacagcaagcaggagagcatccagcagtggctggacagcggcttcttcgtgagcgccaacgagaacttccagcaggtgatcgacagaaccgtgagcctgtacgagcagggcatggtgcagatgaccgtgaaggactacatgagaagcctgcaccagttcagcgagacccccatcctgagcagaggcaccagcttcaacagctgctacagcaccgccagcgtgccccagagcatccccgagtggctggagttctgggagatcgaccccgtggagatcctgctggacctgggcttcggcgccgacgagcccgacatctgcatgcagatccccgccagattcctgggctgcggcagcgccgccagaggcatcaacatcagagtgttcctggaggcccagaagcagagaatggacatcgagaaccccaacctgtacggcagattcagacagctggagatcctggaccacgtgaccaacgccttcagcagcctgctgagcgacgtgagcatcctgcccaacagagccgaggagaaggccggcggcgagagcgtgcagagaaccagcgtgcagagcttcgaggaggagaccggcaaccccctggacatgaccagcggcaccgtgggcgccagagtggacagagccaacagctgccagagcgacagcagcggcttcctggaggagcccctggagcccctgcccctgcagatgcccagcctgcccaacagccagagccccgccgagaacggcggcagaaagcccagagaccagagccacagcctggtgagcagccaggactgccagctggagagcgacggccccgacagcaagagcagagccagcatgagcttcagcagccaggaggccaacgccctggagcagagagccagcgtgagcgtgatggaggaggagttcctgctggaggccatggagggcccccccgagctgtacatccccgacatggcctgcgccaagaccaccaccagaggcgagtgccccagaaaggacagccacctgtggcagctgctgcccatgccccacgccgagtacgaggtgaccagacccaccgccaccagcaagtacgaccaccccctgggcttcatggtgacccacgtgaccgagatgcaggacagcttcgtgagacccgagggcgccggcaaggtgcagagccaccacaacgagagccagagaagccccggcaacgaccacacccaggacaagttcctgcacgtggacagcgaggcccccagagaggaggagagcagcggcttctgcccccacaccaaccacagcctgctggtgcccgagagcagcagccagtgcatccccaagcacagcgagatcaccccctacgccaccgacctggcccagaccagcgagaagctgatcccccacctgcacaagctgcccggcgaccccgcccaggtgaagagcagaagcggcaccctgggccagatcctgcccggcaccgaggccgagatggagaacctgcccctgaacaccggcagcagcagaagcgtgatgacccagatgagcagcagcctggtgagcgccgcccagagagccgtggccctgggcaccggccccagaggcaccagcctggagtgcaccgtgtgcgaccccgtgaccgccaccgagaccagactgggcaccaaggccagacagctgaacgacgccagcatccagaccagcgccctgagcaacaagaccctgacccacggcccccagcccctgaccaagagcgtgagcctggacagcggcttcagcagcatctgccccatgggcacctgccacgccatccccgcccactgctgcatctgctgccaccaccacccccactgccacggcgagagacagagccccggccccgagcccagcgtgtgcagacactgcctgtgcagcctgaccggccaccaggaggcccagttcatgaccaccctgaaggccctgcaggacaccaccgtgagagagctgtgcagctgcaccgtgcacgagatggaggccatgaagaccatctgccagagcttcagagagtacctggaggagatcgagcagcacctgatgggccagcaggccctgttcagcagagacatgagcgaggaggagagagaggaggccgagcagctgcagaccctgagagaggccctgagacagcaggtggccgagctggagttccagctgggcgacagagcccagcagatcagagagggcatcctgctgcagctggaggtgctgaccgccgagccccccgagcactacagcaacctgcaccagtacaactggatcgaggagagcaacggccagaccagctgcagcaagatccaccccggcatggcccccagaaccgtgttcccccccgacgacggccaggaggccccctgcagcggcggcacccagctggccgccttcaccccccccaccctggagaacagcaccagaatgagccccagcagcagcgcctgggccaagctgggccccacccccctgagcaactgccccgtgggcgagaaggacgccgacgtgttcctgtag

SEQ ID NO: 19945 - DNA, 3135 bp, Artificial Sequence
  Description of Artificial Sequence: Synthetic coding sequence
atgatggcccagaagagccagggcagcgacaacctgcaggagggccaggagaagagcaagagagagatcctgaagtgcaccaagagcgcctgggcccccctggacgagtggctgccccccgaccccgaggaggagagccagagcctgaccatccccatgctggaggacagcaagcaggagagcatccagcagtggctggacagcggcttcttcgtgagcgccaacgagaacttccagcaggtgatcgacagaaccgtgagcctgtacgagcagggcatggtgcagatgaccgtgaaggactacatgagaagcctgcaccagttcagcgagacccccatcctgagcagaggcaccagcttcaacagctgctacagcaccgccagcgtgccccagagcatccccgagtggctggagttctgggagatcgaccccgtggagatcctgctggacctgggcttcggcgccgacgagcccgacatctgcatgcagatccccgccagattcctgggctgcggcagcgccgccagaggcatcaacatcagagtgttcctggaggcccagaagcagagaatggacatcgagaaccccaacctgtacggcagattcagacagctggagatcctggaccacgtgaccaacgccttcagcagcctgctgagcgacgtgagcatcctgcccaacagagccgaggagaaggccggcggcgagagcgtgcagagaaccagcgtgagcgccgccaaggagcacagaagaagaatgggcaagctgctgagaagagccagcaagcagaacatcagaagagactgcaaccccgaggtgagcgagagcttcaaggtgaaggacgaggtgttcgtgcccttcaccaagccctgggactgcggcgccgagctggccgccaccagcatcaaccacaagcagaaccacctgagcctgagcgtggagcaccagagcctgcaggcctgcgacgacctgctgccctaccccccccacggcctgctgagcaagcagtggccctgcagcagcatgcccgccaagcaggccccccccagctgcgtgagcgagggcagcgtgaagggcagaacccagaaggagaacctgttccagaccaacaagctgaagagcctgagccacctggccggcaagggccccgacagcttcgagatggaggaggtgcagagcttcgaggaggagaccggcaaccccctggacatgaccagcggcaccgtgggcgccagagtggacagagccaacagctgccagagcgacagcagcggcttcctggaggagcccctggagcccctgcccctgcagatgcccagcctgcccaacagccagagccccgccgagaacggcggcagaaagcccagagaccagagccacagcctggtgagcagccaggactgccagctggagagcgacggccccgacagcaagagcagagccagcatgagcttcagcagccaggaggccaacgccctggagcagagagccagcgtgagcgtgatggaggaggagttcctgctggaggccatggagggcccccccgagctgtacatccccgacatggcctgcgccaagaccaccaccagaggcgagtgccccagaaaggacagccacctgtggcagctgctgcccatgccccacgccgagtacgaggtgaccagacccaccgccaccagcaagtacgaccaccccctgggcttcatggtgacccacgtgaccgagatgcaggacagcttcgtgagacccgagggcgccggcaaggtgcagagccaccacaacgagagccagagaagccccggcaacgaccacacccaggacaagttcctgcacgtggacagcgaggcccccagagaggaggagagcagcggcttctgcccccacaccaaccacagcctgctggtgcccgagagcagcagccagtgcatccccaagcacagcgagatcaccccctacgccaccgacctggcccagaccagcgagaagctgatcccccacctgcacaagctgcccggcgaccccgcccaggtgaagagcagaagcggcaccctgggccagatcctgcccggcaccgaggccgagatggagaacctgcccctgaacaccggcagcagcagaagcgtgatgacccagatgagcagcagcctggtgagcgccgcccagagagccgtggccctgggcaccggccccagaggcaccagcctggagtgcaccgtgtgcgaccccgtgaccgccaccgagaccagactgggcaccaaggccagacagctgaacgacgccagcatccagaccagcgccctgagcaacaagaccctgacccacggcccccagcccctgaccaagagcgtgagcctggacagcggcttcagcagcatctgccccatgggcacctgccacgccatccccgcccactgctgcatctgctgccaccaccacccccactgccacggcgagagacagagccccggccccgagcccagcgtgtgcagacactgcctgtgcagcctgaccggccaccaggaggcccagttcatgaccaccctgaaggccctgcaggacaccaccgtgagagagctgtgcagctgcaccgtgcacgagatggaggccatgaagaccatctgccagagcttcagagagtacctggaggagatcgagcagcacctgatgggccagcaggccctgttcagcagagacatgagcgaggaggagagagaggaggccgagcagctgcagaccctgagagaggccctgagacagcaggtggccgagctggagttccagctgggcgacagagcccagcagatcagagagggcatcctgctgcagctggaggtgctgaccgccgagccccccgagcactacagcaacctgcaccagtacaactggatcgaggagagcaacggccagaccagctgcagcaagatccaccccggcatggcccccagaaccgtgttcccccccgacgacggccaggaggccccctgcagcggcggcacccagctggccgccttcaccccccccaccctggagaacagcaccagaatgagccccagcagcagcgcctgggccaagctgggccccacccccctgagcaactgccccgtgggcgagaaggacgccgacgtgttcctgtag

SEQ ID NO: 19946 - DNA, 429 bp, Artificial Sequence
  Description of Artificial Sequence: Synthetic coding sequence
atgatggcccagaagagccagggcagcgacaacctgcaggagggccaggagaagagcaagagagagatcctgaagtgcaccaagagcgcctgggcccccctggacgagtggctgccccccgaccccgaggaggagagccagagcctgaccatccccatgctggaggacagcaagcaggagagcatccagcagtggctggacagcggcttcttcgtgagcgccaacgagaacttccagcaggtgatcgacagaaccgtgagcctgtacgagcagggcatggtgcagatgaccgtgaaggactacatgagaagcctgcaccagttcagcgagacccccatcctgagcagaggcaccagcttcaacagctgctacagcaccgccagcgtgccccagagcatccccgagtggctggagttctgggagatctag

SEQ ID NO: 19947 - DNA, 3189 bp, Artificial Sequence
  Description of Artificial Sequence: Synthetic coding sequence
atgcccaccaccgccagctgcaagaccatcagcctgctgaagctgctgtacagcgtgagcctgcagaactacagccccatgatggcccagaagagccagggcagcgacaacctgcaggagggccaggagaagagcaagagagagatcctgaagtgcaccaagagcgcctgggcccccctggacgagtggctgccccccgaccccgaggaggagagccagagcctgaccatccccatgctggaggacagcaagcaggagagcatccagcagtggctggacagcggcttcttcgtgagcgccaacgagaacttccagcaggtgatcgacagaaccgtgagcctgtacgagcagggcatggtgcagatgaccgtgaaggactacatgagaagcctgcaccagttcagcgagacccccatcctgagcagaggcaccagcttcaacagctgctacagcaccgccagcgtgccccagagcatccccgagtggctggagttctgggagatcgaccccgtggagatcctgctggacctgggcttcggcgccgacgagcccgacatctgcatgcagatccccgccagattcctgggctgcggcagcgccgccagaggcatcaacatcagagtgttcctggaggcccagaagcagagaatggacatcgagaaccccaacctgtacggcagattcagacagctggagatcctggaccacgtgaccaacgccttcagcagcctgctgagcgacgtgagcatcctgcccaacagagccgaggagaaggccggcggcgagagcgtgcagagaaccagcgtgagcgccgccaaggagcacagaagaagaatgggcaagctgctgagaagagccagcaagcagaacatcagaagagactgcaaccccgaggtgagcgagagcttcaaggtgaaggacgaggtgttcgtgcccttcaccaagccctgggactgcggcgccgagctggccgccaccagcatcaaccacaagcagaaccacctgagcctgagcgtggagcaccagagcctgcaggcctgcgacgacctgctgccctaccccccccacggcctgctgagcaagcagtggccctgcagcagcatgcccgccaagcaggccccccccagctgcgtgagcgagggcagcgtgaagggcagaacccagaaggagaacctgttccagaccaacaagctgaagagcctgagccacctggccggcaagggccccgacagcttcgagatggaggaggtgcagagcttcgaggaggagaccggcaaccccctggacatgaccagcggcaccgtgggcgccagagtggacagagccaacagctgccagagcgacagcagcggcttcctggaggagcccctggagcccctgcccctgcagatgcccagcctgcccaacagccagagccccgccgagaacggcggcagaaagcccagagaccagagccacagcctggtgagcagccaggactgccagctggagagcgacggccccgacagcaagagcagagccagcatgagcttcagcagccaggaggccaacgccctggagcagagagccagcgtgagcgtgatggaggaggagttcctgctggaggccatggagggcccccccgagctgtacatccccgacatggcctgcgccaagaccaccaccagaggcgagtgccccagaaaggacagccacctgtggcagctgctgcccatgccccacgccgagtacgaggtgaccagacccaccgccaccagcaagtacgaccaccccctgggcttcatggtgacccacgtgaccgagatgcaggacagcttcgtgagacccgagggcgccggcaaggtgcagagccaccacaacgagagccagagaagccccggcaacgaccacacccaggacaagttcctgcacgtggacagcgaggcccccagagaggaggagagcagcggcttctgcccccacaccaaccacagcctgctggtgcccgagagcagcagccagtgcatccccaagcacagcgagatcaccccctacgccaccgacctggcccagaccagcgagaagctgatcccccacctgcacaagctgcccggcgaccccgcccaggtgaagagcagaagcggcaccctgggccagatcctgcccggcaccgaggccgagatggagaacctgcccctgaacaccggcagcagcagaagcgtgatgacccagatgagcagcagcctggtgagcgccgcccagagagccgtggccctgggcaccggccccagaggcaccagcctggagtgcaccgtgtgcgaccccgtgaccgccaccgagaccagactgggcaccaaggccagacagctgaacgacgccagcatccagaccagcgccctgagcaacaagaccctgacccacggcccccagcccctgaccaagagcgtgagcctggacagcggcttcagcagcatctgccccatgggcacctgccacgccatccccgcccactgctgcatctgctgccaccaccacccccactgccacggcgagagacagagccccggccccgagcccagcgtgtgcagacactgcctgtgcagcctgaccggccaccaggaggcccagttcatgaccaccctgaaggccctgcaggacaccaccgtgagagagctgtgcagctgcaccgtgcacgagatggaggccatgaagaccatctgccagagcttcagagagtacctggaggagatcgagcagcacctgatgggccagcaggccctgttcagcagagacatgagcgaggaggagagagaggaggccgagcagctgcagaccctgagagaggccctgagacagcaggtggccgagctggagttccagctgggcgacagagcccagcagatcagagagggcatcctgctgcagctggaggtgctgaccgccgagccccccgagcactacagcaacctgcaccagtacaactggatcgaggagagcaacggccagaccagctgcagcaagatccaccccggcatggcccccagaaccgtgttcccccccgacgacggccaggaggccccctgcagcggcgagctgctgagcgccgagctggaccccttcttcttcagcagcaaggccaacaacagcgccaaggacgagaagatcaagagcaaggacttcctgaagacccaggacagcggcctgctgtag

SEQ ID NO: 19948 - DNA, 492 bp, Artificial Sequence
  Description of Artificial Sequence: Synthetic coding sequence
atgatggcccagaagagccagggcagcgacaacctgcaggagggccaggagaagagcaagagagagatcctgaagtgcaccaagagcgcctgggcccccctggacgagtggctgccccccgaccccgaggaggagagccagagcctgaccatccccatgctggaggacagcaagcaggagagcatccagcagtggctggacagcggcttcttcgtgagcgccaacgagaacttccagcaggtgatcgacagaaccgtgagcctgtacgagcagggcatggtgcagatgaccgtgaaggactacatgagaagcctgcaccagttcagcgagacccccatcctgagcagaggcaccagcttcaacagctgctacagcaccgccagcgtgccccagagcatccccgagtggctggagttctgggagatcgaccccgtggagatcctgctggacctgggcttcggcgccgacgagcccgacatctgcatgcagtag

SEQ ID NO: 19949 - DNA, 507 bp, Artificial Sequence
  Description of Artificial Sequence: Synthetic coding sequence
atgatggcccagaagagccagggcagcgacaacctgcaggagggccaggagaagagcaagagagagatcctgaagtgcaccaagagcgcctgggcccccctggacgagtggctgccccccgaccccgaggaggagagccagagcctgaccatccccatgctggaggacagcaagcaggagagcatccagcagtggctggacagcggcttcttcgtgagcgccaacgagaacttccagcaggtgatcgacagaaccgtgagcctgtacgagcagggcatggtgcagatgaccgtgaaggactacatgagaagcctgcaccagttcagcgagacccccatcctgagcagaggcaccagcttcaacagctgctacagcaccgccagcgtgccccagagcatccccgagtggctggagttctgggagatcgaccccgtggagatcctgctggacctgggcttcggcgccgacgagcccgacatctgcatgcagatccccgccagattctag

SEQ ID NO: 19950 - DNA, 3165 bp, Artificial Sequence
  Description of Artificial Sequence: Synthetic coding sequence
atgagcttcagcctgcagaactacagccccatgatggcccagaagagccagggcagcgacaacctgcaggagggccaggagaagagcaagagagagatcctgaagtgcaccaagagcgcctgggcccccctggacgagtggctgccccccgaccccgaggaggagagccagagcctgaccatccccatgctggaggacagcaagcaggagagcatccagcagtggctggacagcggcttcttcgtgagcgccaacgagaacttccagcaggtgatcgacagaaccgtgagcctgtacgagcagggcatggtgcagatgaccgtgaaggactacatgagaagcctgcaccagttcagcgagacccccatcctgagcagaggcaccagcttcaacagctgctacagcaccgccagcgtgccccagagcatccccgagtggctggagttctgggagatcgaccccgtggagatcctgctggacctgggcttcggcgccgacgagcccgacatctgcatgcagatccccgccagattcctgggctgcggcagcgccgccagaggcatcaacatcagagtgttcctggaggcccagaagcagagaatggacatcgagaaccccaacctgtacggcagattcagacagctggagatcctggaccacgtgaccaacgccttcagcagcctgctgagcgacgtgagcatcctgcccaacagagccgaggagaaggccggcggcgagagcgtgcagagaaccagcgtgagcgccgccaaggagcacagaagaagaatgggcaagctgctgagaagagccagcaagcagaacatcagaagagactgcaaccccgaggtgagcgagagcttcaaggtgaaggacgaggtgttcgtgcccttcaccaagccctgggactgcggcgccgagctggccgccaccagcatcaaccacaagcagaaccacctgagcctgagcgtggagcaccagagcctgcaggcctgcgacgacctgctgccctaccccccccacggcctgctgagcaagcagtggccctgcagcagcatgcccgccaagcaggccccccccagctgcgtgagcgagggcagcgtgaagggcagaacccagaaggagaacctgttccagaccaacaagctgaagagcctgagccacctggccggcaagggccccgacagcttcgagatggaggaggtgcagagcttcgaggaggagaccggcaaccccctggacatgaccagcggcaccgtgggcgccagagtggacagagccaacagctgccagagcgacagcagcggcttcctggaggagcccctggagcccctgcccctgcagatgcccagcctgcccaacagccagagccccgccgagaacggcggcagaaagcccagagaccagagccacagcctggtgagcagccaggactgccagctggagagcgacggccccgacagcaagagcagagccagcatgagcttcagcagccaggaggccaacgccctggagcagagagccagcgtgagcgtgatggaggaggagttcctgctggaggccatggagggcccccccgagctgtacatccccgacatggcctgcgccaagaccaccaccagaggcgagtgccccagaaaggacagccacctgtggcagctgctgcccatgccccacgccgagtacgaggtgaccagacccaccgccaccagcaagtacgaccaccccctgggcttcatggtgacccacgtgaccgagatgcaggacagcttcgtgagacccgagggcgccggcaaggtgcagagccaccacaacgagagccagagaagccccggcaacgaccacacccaggacaagttcctgcacgtggacagcgaggcccccagagaggaggagagcagcggcttctgcccccacaccaaccacagcctgctggtgcccgagagcagcagccagtgcatccccaagcacagcgagatcaccccctacgccaccgacctggcccagaccagcgagaagctgatcccccacctgcacaagctgcccggcgaccccgcccaggtgaagagcagaagcggcaccctgggccagatcctgcccggcaccgaggccgagatggagaacctgcccctgaacaccggcagcagcagaagcgtgatgacccagatgagcagcagcctggtgagcgccgcccagagagccgtggccctgggcaccggccccagaggcaccagcctggagtgcaccgtgtgcgaccccgtgaccgccaccgagaccagactgggcaccaaggccagacagctgaacgacgccagcatccagaccagcgccctgagcaacaagaccctgacccacggcccccagcccctgaccaagagcgtgagcctggacagcggcttcagcagcatctgccccatgggcacctgccacgccatccccgcccactgctgcatctgctgccaccaccacccccactgccacggcgagagacagagccccggccccgagcccagcgtgtgcagacactgcctgtgcagcctgaccggccaccaggaggcccagttcatgaccaccctgaaggccctgcaggacaccaccgtgagagagctgtgcagctgcaccgtgcacgagatggaggccatgaagaccatctgccagagcttcagagagtacctggaggagatcgagcagcacctgatgggccagcaggccctgttcagcagagacatgagcgaggaggagagagaggaggccgagcagctgcagaccctgagagaggccctgagacagcaggtggccgagctggagttccagctgggcgacagagcccagcagatcagagagggcatcctgctgcagctggaggtgctgaccgccgagccccccgagcactacagcaacctgcaccagtacaactggatcgaggagagcaacggccagaccagctgcagcaagatccaccccggcatggcccccagaaccgtgttcccccccgacgacggccaggaggccccctgcagcggcggcacccagctggccgccttcaccccccccaccctggagaacagcaccagaatgagccccagcagcagcgcctgggccaagctgggccccacccccctgagcaactgccccgtgggcgagaaggacgccgacgtgttcctgtag

SEQ ID NO: 19951 - DNA, 2148 bp, Artificial Sequence
  Description of Artificial Sequence: Synthetic coding sequence
atggccgccgacgagagcagccagaacaccctgagactgcagttcaaggccatgcaggagatgcagcacaagagactgcagaagcagatggagaagaagagagagaaggagctgagcctgaagagcagagccgacgaccaggaggagcccctggaggtgagcgacggcctgagcctgctgcacgccggcgagcccaacagcaagaacagcttcgagaagagagtgctggaggacgagatcgagcacctgagaaacgagctgagagagaccgtggacgagaacggcagactgtacaagctgctgaaggagagagacttcgagatcaagcacctgaagaagaagatcgaggaggacagattcgccttcaccggcaccgccggcgtggccggcgacgtggtggccaccaagatcgtggagctgagcaagaagaacagactgctgatggccgagagcgagggcgccaagaccagagtgaagcagctgaccaacagaatccaggagctggagagagagctgcagaccgccctgaccagactgagcgccaagggcgccaccgacgccggcgccaagccccccagagcccagatgggcgacagagccctgctggagacccccgaggtgaaggccctgcaggacagactggtggccaccaacctgaagatgagcgacctgagaaaccagatccagagcgtgaagcaggagctgagaatggcccagaaggtgctggccagagaggtgggcgaggacatcaacgtgcagcagctgctgagcagccccggcacctggagaggcagagcccagcagatcctggtgctgcagagcaaggtgcaggagctggagaagcagctgggccaggccagaagccagagcgccggcaccgccagcgacgagctgagcgtgtaccccgaccccagaaagctgagcgcccaggagaagaacctgctgagaatcagaagcctggagagagagaagcaggagggcctggagaagctggccagcgagagagacgtgctgcagagagagctggaggagctgaagaagaagttcgagggcatgagaagcagaaacaagctgctgagcagcgagatgaagaccctgaagagccagatgggcaccctggtggagaagggcagacacgacgacgagctgatcgacgccctgatggaccagctgaagcagctgcaggagatcctgggcagcctgagcctgcaggaggagaagaccagagtgagccagcaccacctggaccagcagctgaacagcgaggcccagagaagcaacagcctggtggcccagctgcaggccatggtggccgagagagaggccaaggtgagacagctggagatggagatcggccagctgaacgtgcactacctgagaaacaagggcgtgggcgagggcagcagcggcagagaggtgagccccgcctacacccagttcctggaggaccccggcctgaccaagagccccgccagcgccggcgaccacgtgggcagactgggcagcagcagaagcgtgaccagcctgggccacaccctggtggagagcgccctgaccagacccagcctgcccagcccccacagaaccagccccagattcagcgacagccccgagcagaagggctggcaggcccaggtgagcgagatcaaggccctgtggcaggccgccgaggtggagagagacagactgaccgagttcgtgaccgtgctgcagaagagagtggaggagagcaacagcaagctgctggagagcgagagaaagctgcaggaggagagacacagaaccgtggtgctggagcagcacctggagaagatcagactggagcccggcaaggccagcgccagccagagagccgcccccagaaccaagaccggcctgcccaccagcaacaacagacacaaccccaccggcagcgagaagaaggaccccagcttcgcccagctgagcgacgtgcccgtggagagccagatggaggagctgaccaccagactggccatccaggtggaggagaacgagatgctgaaggccgccctgggcagcgccctgagaggcaaggaggaggacttcagaatgtaccacgagatcctgggccaggtgaagagcgtgttcctgcaggccctgagacagcagaagaccggcaagcagtag

SEQ ID NO: 19952 - DNA, 1947 bp, Artificial Sequence
  Description of Artificial Sequence: Synthetic coding sequence
atggagggcgccggctacagagtggtgttcgagaagggcggcgtgtacctgcacaccagcgccaagaagtaccaggacagagacagcctgatcgccggcgtgatcagagtggtggagaaggacaacgacgtgctgctgcactgggcccccgtggaggaggccggcgacagcacccagatcctgttcagcaagaaggacagcagcggcggcgacagctgcgccagcgaggaggagcccaccttcgaccccgactacgagcccgactgggccgtgatcagcaccgtgagaccccagctgtgccacagcgagcccaccagaggcgccgagcccagctgcccccagggcagctgggccttcagcgtgagcctgggcgagctgaagagcatcagaagaagcaagcccggcctgagctgggcctacctggtgctggtgacccaggccggcggcagcctgcccgccctgcacttccacagaggcggcaccagagccctgctgagagtgctgagcagatacctgctgctggccagcagcccccaggacagcagactgtacctggtgttcccccacgacagcagcgccctgagcaacagcttccaccacctgcagctgttcgaccaggacagcagcaacgtggtgagcagattcctgcaggacccctacagcaccaccttcagcagcttcagcagagtgaccaacttcttcagaggcgccctgcagccccagcccgagggcgccgccagcgacctgccccccccccccgacgacgagcccgagcccggcttcgaggtgatcagctgcgtggagctgggccccagacccaccgtggagagaggcccccccgtgaccgaggaggagtgggccagacacgtgggccccgagggcagactgcagcaggtgcccgagctgaagaacagaatcttcagcggcggcctgagccccagcctgagaagagaggcctggaagttcctgctgggctacctgagctgggagggcaccgccgaggagcacaaggcccacatcagaaagaagaccgacgagtacttcagaatgaagctgcagtggaagagcgtgagccccgagcaggagagaagaaacagcctgctgcacggctacagaagcctgatcgagagagacgtgagcagaaccgacagaaccaacaagttctacgagggccccgagaaccccggcctgggcctgctgaacgacatcctgctgacctactgcatgtaccacttcgacctgggctacgtgcagggcatgagcgacctgctgagccccatcctgtacgtgatccagaacgaggtggacgccttctggtgcttctgcggcttcatggagctggtgcagggcaacttcgaggagagccaggagaccatgaagagacagctgggcagactgctgctgctgctgagagtgctggaccccctgctgtgcgacttcctggacagccaggacagcggcagcctgtgcttctgcttcagatggctgctgatctggttcaagagagagttccccttccccgacgtgctgagactgtgggaggtgctgtggaccggcctgcccggccccaacctgcacctgctggtggcctgcgccatcctggacatggagagagacaccctgatgctgagcggcttcggcagcaacgagatcctgaagcacatcaacgagctgaccatgaagctgagcgtggaggacgtgctgaccagagccgaggccctgcacagacagctgaccgcctgccccgagctgccccacaacgtgcaggagatcctgggcctggccccccccgccgagccccacagccccagccccaccgccagccccctgcccctgagccccaccagagccccccccacccccccccccagcaccgacaccgccccccagcccgacagcagcctggagatcctgcccgaggaggaggacgagggcgccgacagctag

SEQ ID NO: 19953 - DNA, 480 bp, Artificial Sequence
  Description of Artificial Sequence: Synthetic coding sequence
atgggcgagagaaagggcgtgaacaagtactacccccccgacttcaaccccgagaagcacggcagcctgaacagataccacaacagccaccccctgagagagagagccagaaagctgagccagggcatcctgatcatcagattcgagatgccctacaacatctggtgcgacggctgcaagaaccacatcggcatgggcgtgagatacaacgccgagaagaagaaggtgggcaactactacaccacccccatctacagattcagaatgaagtgccacctgtgcgtgaactacatcgagatgcagaccgaccccgccaactgcgactacgtgatcgtgagcggcgcccagagaaaggaggagagatgggacatggccgacaacgagcaggtgctgaccaccggcgagagacaccccctgacctgcctgggcgccctggccctgagcctgagatggggcccccagagccccgccgagctgtag

SEQ ID NO: 19954 - DNA, 984 bp, Artificial Sequence
  Description of Artificial Sequence: Synthetic coding sequence
atgcagaagatcaagagcctgatgaccagacagggcctgaagagcccccaggagagcctgagcgacctgggcgccatcgagagcctgagagtgcccggcaaggaggagttcagagagctgagagagcagcccagcgacccccaggccgagcaggagctgatcaacagcatcgagcaggtgtacttcagcgtggacagcttcgacatcgtgaagtacgagctggagaagctgccccccgtgctgaacctgcaggagctggaggcctacagagacaagctgaagcagcagcaggccgccgtgagcaagaaggtggccgacctgatcctggagaagcagcccgcctacgtgaaggagctggagagagtgaccagcctgcagaccggcctgcagctggccgccgtgatctgcaccaacggcagaagacacctgaacatcgccaaggagggcttcacccaggccagcctgggcctgctggccaaccagagaaagagacagctgctgatcggcctgctgaagagcctgagaaccatcaagaccctgcagagaaccgacgtgagactgagcgagatgctggaggaggaggactaccccggcgccatccagctgtgcctggagtgccagaaggccgccagcaccttcaagcactacagctgcatcagcgagctgaacagcaagctgcaggacaccctggagcagatcgaggagcagctggacgtggccctgagcaagatctgcaagaacttcgacatcaaccactacaccaaggtgcagcaggcctacagactgctgggcaagacccagaccgccatggaccagctgcacatgcacttcacccaggccatccacaacaccgtgttccaggtggtgctgggctacgtggagctgtgcgccggcaacaccgacaccaagttccagaagctgcagtacaaggacctgtgcaccgtgtgcagcgacctgatcaccatccacatcagcctgctgtag

SEQ ID NO: 19955 - DNA, 2895 bp, Artificial Sequence
  Description of Artificial Sequence: Synthetic coding sequence
atgcagaagatcaagagcctgatgaccagacagggcctgaagagcccccaggagagcctgagcgacctgggcgccatcgagagcctgagagtgcccggcaaggaggagttcagagagctgagagagcagcccagcgacccccaggccgagcaggagctgatcaacagcatcgagcaggtgtacttcagcgtggacagcttcgacatcgtgaagtacgagctggagaagctgccccccgtgctgaacctgcaggagctggaggcctacagagacaagctgaagcagcagcaggccgccgtgagcaagaaggtggccgacctgatcctggagaagcagcccgcctacgtgaaggagctggagagagtgaccagcctgcagaccggcctgcagctggccgccgtgatctgcaccaacggcagaagacacctgaacatcgccaaggagggcttcacccaggccagcctgggcctgctggccaaccagagaaagagacagctgctgatcggcctgctgaagagcctgagaaccatcaagaccctgcagagaaccgacgtgagactgagcgagatgctggaggaggaggactaccccggcgccatccagctgtgcctggagtgccagaaggccgccagcaccttcaagcactacagctgcatcagcgagctgaacagcaagctgcaggacaccctggagcagatcgaggagcagctggacgtggccctgagcaagatctgcaagaacttcgacatcaaccactacaccaaggtgcagcaggcctacagactgctgggcaagacccagaccgccatggaccagctgcacatgcacttcacccaggccatccacaacaccgtgttccaggtggtgctgggctacgtggagctgtgcgccggcaacaccgacaccaagttccagaagctgcagtacaaggacctgtgcacccacgtgacccccgacagctacatcccctgcctggccgacctgtgcaaggccctgtgggaggtgatgctgagctactacagaaccatggagtggcacgagaagcacgacaacgaggacaccgccagcgccagcgagggcagcaacatgatcggcaccgaggagaccaacttcgacagaggctacatcaagaagaagctggagcacggcctgaccagaatctggcaggacgtgcagctgaaggtgaagacctacctgctgggcaccgacctgagcatcttcaagtacgacgacttcatcttcgtgctggacatcatcagcagactgatgcaggtgggcgaggagttctgcggcagcaagagcgaggtgctgcaggagagcatcagaaagcagagcgtgaactacttcaagaactaccacagaaccagactggacgagctgagaatgttcctggagaacgagacctgggagctgtgccccgtgaagagcaacttcagcatcctgcagctgcacgagttcaagttcatggagcagagcagaagccccagcgtgagccccagcaagcagcccgtgagcaccagcagcaagaccgtgaccctgttcgagcagtactgcagcggcggcaaccccttcgagatccaggccaaccacaaggacgaggagaccgaggacgtgctggccagcaacggctacgagagcgacgagcaggagaagagcgcctaccaggagtacgacagcgacagcgacgtgcccgaggagctgaagagagactacgtggacgagcagaccggcgacggccccgtgaagagcgtgagcagagagaccctgaagagcagaaagaagagcgactacagcctgaacaaggtgaacgcccccatcctgaccaacaccaccctgaacgtgatcagactggtgggcaagtacatgcagatgatgaacatcctgaagcccatcgccttcgacgtgatccacttcatgagccagctgttcgactactacctgtacgccatctacaccttcttcggcagaaacgacagcctggagagcaccggcctgggcctgagcagcagcagactgagaaccaccctgaacagaatccaggagagcctgatcgacctggaggtgagcgccgaccccaccgccaccctgaccgccgccgaggagagaaaggagaaggtgcccagcccccacctgagccacctggtggtgctgaccagcggcgacaccctgtacggcctggccgagagagtggtggccaccgagagcctggtgttcctggccgagcagttcgagttcctgcagccccacctggacgccgtgatgcccgccgtgaagaagcccttcctgcagcagttctacagccagaccgtgagcaccgccagcgagctgagaaagcccatctactggatcgtggccggcaaggccctggactacgagcagatgctgctgctgatggccaacgtgaagtgggacgtgaaggagatcatgagccagcacaacatctacgtggacgccctgctgaaggagttcgagcagttcaacagaagactgaacgaggtgagcaagagagtgagaatccccctgcccgtgagcaacatcctgtgggagcactgcatcagactggccaacagaaccatcgtggagggctacgccaacgtgaagaagtgcagcaacgagggcagagccctgatgcagctggacttccagcagttcctgatgaagctggagaagctgaccgacatcagacccatccccgacaaggagttcgtggagacctacatcaaggcctactacctgaccgagaacgacatggagagatggatcaaggagcacagagagtacagcaccaagcagctgaccaacctggtgaacgtgtgcctgggcagccacatcaacaagaaggccagacagaagctgctggccgccatcgacgacatcgacagacccaagagatag

SEQ ID NO: 19956 - DNA, 1242 bp, Artificial Sequence
  Description of Artificial Sequence: Synthetic coding sequence
atggaccagctgcacatgcacttcacccaggccatccacaacaccgtgttccaggtggtgctgggctacgtggagctgtgcgccggcaacaccgacaccaagttccagaagctgcagtacaaggacctgtgcacccacgtgacccccgacagctacatcccctgcctggccgacctgtgcaaggccctgtgggaggtgatgctgagctactacagaaccatggagtggcacgagaagcacgacaacgaggacaccgccagcgccagcgagggcagcaacatgatcggcaccgaggagaccaacttcgacagaggctacatcaagaagaagctggagcacggcctgaccagaatctggcaggacgtgcagctgaaggtgaagacctacctgctgggcaccgacctgagcatcttcaagtacgacgacttcatcttcgtgctggacatcatcagcagactgatgcaggtgggcgaggagttctgcggcagcaagagcgaggtgctgcaggagagcatcagaaagcagagcgtgaactacttcaagaactaccacagaaccagactggacgagctgagaatgttcctggagaacgagacctgggagctgtgccccgtgaagagcaacttcagcatcctgcagctgcacgagttcaagttcatggagcagagcagaagccccagcgtgagccccagcaagcagcccgtgagcaccagcagcaagaccgtgaccctgttcgagcagtactgcagcggcggcaaccccttcgagatccaggccaaccacaaggacgaggagaccgaggacgtgctggccagcaacggctacgagagcgacgagcaggagaagagcgcctaccaggagtacgacagcgacagcgacgtgcccgaggagctgaagagagactacgtggacgagcagaccggcgacggccccgtgaagagcgtgagcagagagaccctgaagagcagaaagaagagcgactacagcctgaacaaggtgaacgcccccatcctgaccaacaccaccctgaacgtgatcagactggtggacggcgtgagcctgtgctgcctgggctggagcaccgtggcccacctgcacagcctgcaggcccccccccccggcttcaagcccttcagctgcctgagcctgcccagaagctgggactacagaagacccccccccagacccgccaacttcctgtacttcctgttcttcagcagagacggcgtgagcccctgctag

SEQ ID NO: 19957 - DNA, 2055 bp, Artificial Sequence
  Description of Artificial Sequence: Synthetic coding sequence
atgcagaagatcaagagcctgatgaccagacagggcctgaagagcccccaggagagcctgagcgacctgggcgccatcgagagcctgagagtgcccggcaagcacgtgacccccgacagctacatcccctgcctggccgacctgtgcaaggccctgtgggaggtgatgctgagctactacagaaccatggagtggcacgagaagcacgacaacgaggacaccgccagcgccagcgagggcagcaacatgatcggcaccgaggagaccaacttcgacagaggctacatcaagaagaagctggagcacggcctgaccagaatctggcaggacgtgcagctgaaggtgaagacctacctgctgggcaccgacctgagcatcttcaagtacgacgacttcatcttcgtgctggacatcatcagcagactgatgcaggtgggcgaggagttctgcggcagcaagagcgaggtgctgcaggagagcatcagaaagcagagcgtgaactacttcaagaactaccacagaaccagactggacgagctgagaatgttcctggagaacgagacctgggagctgtgccccgtgaagagcaacttcagcatcctgcagctgcacgagttcaagttcatggagcagagcagaagccccagcgtgagccccagcaagcagcccgtgagcaccagcagcaagaccgtgaccctgttcgagcagtactgcagcggcggcaaccccttcgagatccaggccaaccacaaggacgaggagaccgaggacgtgctggccagcaacggctacgagagcgacgagcaggagaagagcgcctaccaggagtacgacagcgacagcgacgtgcccgaggagctgaagagagactacgtggacgagcagaccggcgacggccccgtgaagagcgtgagcagagagaccctgaagagcagaaagaagagcgactacagcctgaacaaggtgaacgcccccatcctgaccaacaccaccctgaacgtgatcagactggtgggcaagtacatgcagatgatgaacatcctgaagcccatcgccttcgacgtgatccacttcatgagccagctgttcgactactacctgtacgccatctacaccttcttcggcagaaacgacagcctggagagcaccggcctgggcctgagcagcagcagactgagaaccaccctgaacagaatccaggagagcctgatcgacctggaggtgagcgccgaccccaccgccaccctgaccgccgccgaggagagaaaggagaaggtgcccagcccccacctgagccacctggtggtgctgaccagcggcgacaccctgtacggcctggccgagagagtggtggccaccgagagcctggtgttcctggccgagcagttcgagttcctgcagccccacctggacgccgtgatgcccgccgtgaagaagcccttcctgcagcagttctacagccagaccgtgagcaccgccagcgagctgagaaagcccatctactggatcgtggccggcaaggccctggactacgagcagatgctgctgctgatggccaacgtgaagtgggacgtgaaggagatcatgagccagcacaacatctacgtggacgccctgctgaaggagttcgagcagttcaacagaagactgaacgaggtgagcaagagagtgagaatccccctgcccgtgagcaacatcctgtgggagcactgcatcagactggccaacagaaccatcgtggagggctacgccaacgtgaagaagtgcagcaacgagggcagagccctgatgcagctggacttccagcagttcctgatgaagctggagaagctgaccgacatcagacccatccccgacaaggagttcgtggagacctacatcaaggcctactacctgaccgagaacgacatggagagatggatcaaggagcacagagagtacagcaccaagcagctgaccaacctggtgaacgtgtgcctgggcagccacatcaacaagaaggccagacagaagctgctggccgccatcgacgacatcgacagacccaagagatag

SEQ ID NO: 19958 - DNA, 1782 bp, Artificial Sequence
  Description of Artificial Sequence: Synthetic coding sequence
atgctggaggaggaggactaccccggcgccatccagctgtgcctggagtgccagaaggccgccagcaccttcaagcactacagctgcatcagcgagctgaacagcaagctgcaggacaccctggagcagatcgaggagcagctggacgtggccctgagcaagatctgcaagaacttcgacatcaaccactacaccaaggtgcagcaggcctacagactgctgggcaagacccagaccgccatggaccagctgcacatgcacttcacccaggccatccacaacaccgtgttccaggtggtgctgggctacgtggagctgtgcgccggcaacaccgacaccaagttccagaagctgcagtacaaggacctgtgcacccacgtgacccccgacagctacatcccctgcctggccgacctgtgcaaggccctgtgggaggtgatgctgagctactacagaaccatggagtggcacgagaagcacgacaacgaggacaccgccagcgccagcgagggcagcaacatgatcggcaccgaggagaccaacttcgacagaggctacatcaagaagaagctggagcacggcctgaccagaatctggcaggacgtgcagctgaaggtgaagacctacctgctgggcaccgacctgagcatcttcaagtacgacgacttcatcttcgtgctggacatcatcagcagactgatgcaggtgggcgaggagttctgcggcagcaagagcgaggtgctgcaggagagcatcagaaagcagagcgtgaactacttcaagaactaccacagaaccagactggacgagctgagaatgttcctggagaacgagacctgggagctgtgccccgtgaagagcaacttcagcatcctgcagctgcacgagttcaagttcatggagcagagcagaagccccagcgtgagccccagcaagcagcccgtgagcaccagcagcaagaccgtgaccctgttcgagcagtactgcagcggcggcaaccccttcgagatccaggccaaccacaaggacgaggagaccgaggacgtgctggccagcaacggctacgagagcgacgagcaggagaagagcgcctaccaggagtacgacagcgacagcgacgtgcccgaggagctgaagagagactacgtggacgagcagaccggcgacggccccgtgaagagcgtgagcagagagaccctgaagagcagaaagaagagcgactacagcctgaacaaggtgaacgcccccatcctgaccaacaccaccctgaacgtgatcagactggtgggcaagtacatgcagatgatgaacatcctgaagcccatcgccttcgacgtgatccacttcatgagccagctgttcgactactacctgtacgccatctacaccttcttcggcagaaacgacagcctggagagcaccggcctgggcctgagcagcagcagactgagaaccaccctgaacagaatccaggagagcctgatcgacctggaggtgagcgccgaccccaccgccaccctgaccgccgccgaggagagaaaggagaaggtgcccagcccccacctgagccacctggtggtgctgaccagcggcgacaccctgtacggcctggccgagagagtggtggccaccgagagcctggtgttcctggccgagcagttcgagttcctgcagccccacctggacgccgtgatgcccgccgtgaagaagcccttcctgcagcagttctacagccagagccagccccccgtgaactacggcaaccagttcaccggcctgtag

SEQ ID NO: 19959 - DNA, 2805 bp, Artificial Sequence
  Description of Artificial Sequence: Synthetic coding sequence
atgctgaccctggaggagttcagagagctgagagagcagcccagcgacccccaggccgagcaggagctgatcaacagcatcgagcaggtgtacttcagcgtggacagcttcgacatcgtgaagtacgagctggagaagctgccccccgtgctgaacctgcaggagctggaggcctacagagacaagctgaagcagcagcaggccgccgtgagcaagaaggtggccgacctgatcctggagaagcagcccgcctacgtgaaggagctggagagagtgaccagcctgcagaccggcctgcagctggccgccgtgatctgcaccaacggcagaagacacctgaacatcgccaaggagggcttcacccaggccagcctgggcctgctggccaaccagagaaagagacagctgctgatcggcctgctgaagagcctgagaaccatcaagaccctgcagagaaccgacgtgagactgagcgagatgctggaggaggaggactaccccggcgccatccagctgtgcctggagtgccagaaggccgccagcaccttcaagcactacagctgcatcagcgagctgaacagcaagctgcaggacaccctggagcagatcgaggagcagctggacgtggccctgagcaagatctgcaagaacttcgacatcaaccactacaccaaggtgcagcaggcctacagactgctgggcaagacccagaccgccatggaccagctgcacatgcacttcacccaggccatccacaacaccgtgttccaggtggtgctgggctacgtggagctgtgcgccggcaacaccgacaccaagttccagaagctgcagtacaaggacctgtgcacccacgtgacccccgacagctacatcccctgcctggccgacctgtgcaaggccctgtgggaggtgatgctgagctactacagaaccatggagtggcacgagaagcacgacaacgaggacaccgccagcgccagcgagggcagcaacatgatcggcaccgaggagaccaacttcgacagaggctacatcaagaagaagctggagcacggcctgaccagaatctggcaggacgtgcagctgaaggtgaagacctacctgctgggcaccgacctgagcatcttcaagtacgacgacttcatcttcgtgctggacatcatcagcagactgatgcaggtgggcgaggagttctgcggcagcaagagcgaggtgctgcaggagagcatcagaaagcagagcgtgaactacttcaagaactaccacagaaccagactggacgagctgagaatgttcctggagaacgagacctgggagctgtgccccgtgaagagcaacttcagcatcctgcagctgcacgagttcaagttcatggagcagagcagaagccccagcgtgagccccagcaagcagcccgtgagcaccagcagcaagaccgtgaccctgttcgagcagtactgcagcggcggcaaccccttcgagatccaggccaaccacaaggacgaggagaccgaggacgtgctggccagcaacggctacgagagcgacgagcaggagaagagcgcctaccaggagtacgacagcgacagcgacgtgcccgaggagctgaagagagactacgtggacgagcagaccggcgacggccccgtgaagagcgtgagcagagagaccctgaagagcagaaagaagagcgactacagcctgaacaaggtgaacgcccccatcctgaccaacaccaccctgaacgtgatcagactggtgggcaagtacatgcagatgatgaacatcctgaagcccatcgccttcgacgtgatccacttcatgagccagctgttcgactactacctgtacgccatctacaccttcttcggcagaaacgacagcctggagagcaccggcctgggcctgagcagcagcagactgagaaccaccctgaacagaatccaggagagcctgatcgacctggaggtgagcgccgaccccaccgccaccctgaccgccgccgaggagagaaaggagaaggtgcccagcccccacctgagccacctggtggtgctgaccagcggcgacaccctgtacggcctggccgagagagtggtggccaccgagagcctggtgttcctggccgagcagttcgagttcctgcagccccacctggacgccgtgatgcccgccgtgaagaagcccttcctgcagcagttctacagccagaccgtgagcaccgccagcgagctgagaaagcccatctactggatcgtggccggcaaggccctggactacgagcagatgctgctgctgatggccaacgtgaagtgggacgtgaaggagatcatgagccagcacaacatctacgtggacgccctgctgaaggagttcgagcagttcaacagaagactgaacgaggtgagcaagagagtgagaatccccctgcccgtgagcaacatcctgtgggagcactgcatcagactggccaacagaaccatcgtggagggctacgccaacgtgaagaagtgcagcaacgagggcagagccctgatgcagctggacttccagcagttcctgatgaagctggagaagctgaccgacatcagacccatccccgacaaggagttcgtggagacctacatcaaggcctactacctgaccgagaacgacatggagagatggatcaaggagcacagagagtacagcaccaagcagctgaccaacctggtgaacgtgtgcctgggcagccacatcaacaagaaggccagacagaagctgctggccgccatcgacgacatcgacagacccaagagatag

SEQ ID NO: 19960 - DNA, 1998 bp, Artificial Sequence
  Description of Artificial Sequence: Synthetic coding sequence
atggagcccagagtggtgaagccccccggccaggacctggtggtggagagcctgaagagcagatacggcctgggcggcagctgccccgacgagtacgacttcagcaacttctaccagagcaagtacaagagaagaaccctgaccagccccggcgacctggacatctacagcggcgacaaggtgggcagcagcctgaagtacagcgacgagagcaagcactgcagaacccccctgggcagcctgttcaagcacgtgaacgtgaactgcctggacgacgagctggacagcttccacgacctgaagaagcaggagaccgaggaggagctgatcgagaacgactacagagtgagcaccagcaagatcaccaagcagagcttcaaggagatcgagaaggtggccctgcccaccaacaccaccagcagcagacccagaaccgagtgctgcagcgacgccggcgacagccccctgaagcccgtgagctgccccaagagcaaggccagcgacaagagaagcctgctgccccaccagatcagccagatctacgacgagctgttccagatccacctgaagctgcagtgcgagaccgccgcccagcagaagttcgccgaggagctgcagaagagagagagattcctgctggagagagagcagctgctgttcagacacgagaacgccctgagcaagatcaagggcgtggaggaggaggtgctgaccagattccagatcatcaaggagcagcacgacgccgaggtggagcacctgaccgaggtgctgaaggagaagaacaaggagaccaagagactgagaagcagcttcgacgccctgaaggagctgaacgacaccctgaagaagcagctgaacgaggccagcgaggagaacagaaagatcgacatccaggccaagagagtgcaggccagactggacaacctgcagagaaagtacgagttcatgaccatccagagactgaagggcagcagccacgccgtgcacgagatgaagagcctgaagcaggagaaggcccccgtgagcaagacctacaaggtgcccctgaacggccaggtgtacgagctgctgaccgtgttcatggactggatcagcgaccaccacctgagcaaggtgaagcacgaggagagcggcatggacggcaagaagccccagctgaagttcgccagccagagaaacgacatccaggagaagtgcgtgaagctgctgcccctgatgaccgagcagctgcagtggatgcccttcgtgaacatcaagctgcacgagcccttcgtgaagttcatctactggagcctgagacagctggacgccggcgcccagcacagcaccatgaccagcaccctgagaagactgggcgaggacatcttcaagggcgtggtgaccaagggcatccaggacaacagcccccagcacagcgtggagaacaagcccaagaccgccgccttcttcaagagcagcaacctgcccctgagattcctgagcaccctgatcgtgctgaagaccgtgacccaggccgactacctggcccaggccttcgacagcctgtgcctggacctgaagaccgaggagggcaagaccctgttcctggagtaccaggccgtgcccgtgatcctgagccacctgagaatcagcagcaagggcctgctgagcaacgtgatcgacagcctgctgcagatgaccgtggagagcaagagcctgcagcccttcctggaggcctgcagcaacagcctgttcttcagaacctgcagcgtgctgctgagagcccccaagctggacctgcagatcctggagaagctgagcatcatcctgcagaagctgagcaagatcaagagcaacaagaagctgttcgagctgttcaccatccacctgatgctgcaggagatccagagaaccaccaaccccgagcacgccttcctgtgcatcaacctgaacagcaccctgttcaacctgggcctgaccaagtgcaacagcctggtgagcagcgccagcccctag

SEQ ID NO: 19961 - DNA, 1734 bp, Artificial Sequence
  Description of Artificial Sequence: Synthetic coding sequence
atggagcccagagtggtgaagccccccggccaggacctggtggtggagagcctgaagagcagatacggcctgggcggcagctgccccgacgagtacgacttcagcaacttctaccagagcaagtacaagagaagaaccctgaccagccccggcgacctggacatctacagcggcgacaaggtgggcagcagcctgaagtacagcgacgagagcaagcactgcagaacccccctgggcagcctgttcaagcacgtgaacgtgaactgcctggacgacgagctggacagcttccacgacctgaagaagcaggagaccgaggaggagctgatcgagaacgactacagagtgagcaccagcaagatcaccaagcagagcttcaaggagatcgagaaggtggccctgcccaccaacaccaccagcagcagacccagaaccgagtgctgcagcgacgccggcgacagccccctgaagcccgtgagctgccccaagagcaaggccagcgacaagagaagcctgctgccccaccagatcagccagatctacgacgagctgttccagatccacctgaagctgcagtgcgagaccgccgcccagcagaagttcgccgaggagctgcagaagagagagagattcctgctggagagagagcagctgctgttcagacacgagaacgccctgagcaagatcaagggcgtggaggaggaggtgctgaccagattccagatcatcaaggagcagcacgacgccgaggtggagcacctgaccgaggtgctgaaggagaagaacaaggagaccaagagactgagaagcagcttcgacgccctgaaggagctgaacgacaccctgaagaagcagctgaacgaggccagcgaggagaacagaaagatcgacatccaggccaagagagtgcaggccagactggacaacctgcagagaaagtacgagttcatgaccatccagagactgaagggcagcagccacgccgtgcacgagatgaagagcctgaagcaggagaaggcccccgtgagcaagacctacaaggtgcccctgaacggccaggtgtacgagctgctgaccgtgttcatggactggatcagcgaccaccacctgagcaaggtgaagcacgaggagagcggcatggacggcaagaagccccagctgaagttcgccagccagagaaacgacatccaggagaagtgcgtgaagctgctgcccctgatgaccgagcagctgcagtggatgcccttcgtgaacatcaagctgcacgagcccttcgtgaagttcatctactggagcctgagacagctggacgccggcgcccagcacagcaccatgaccagcaccctgagaagactgggcgaggacatcttcaagggcgtggtgaccaagggcatccaggacaacagcccccagcacagcgtggagaacaagcccaagaccgccgccttcttcaagagcagcaacctgcccctgagattcctgagcaccctgatcgtgctgaagaccgtgacccaggccgactacctggcccaggccttcgacagcctgtgcctggacctgaagaccgaggagggcaagaccctgttcctggagtaccaggccgtgcccgtgatcctgagccacctgagaatcagcagcaagggcctgctgagcaacgtgatcgacagcctgctgcagatgaccgtggagagcagagtgatcagaagcagcctgaacttcctgagattcatctag

SEQ ID NO: 19962 - DNA, 492 bp, Artificial Sequence
  Description of Artificial Sequence: Synthetic coding sequence
atgggcgacgagtgcagcaaccccgacctgctggccgagcccggcagcagccccccctgggaccacggcaaccagagacaggaggccgccaacgagagcaacaccagagtgcccagagtgctgaaggcccacctgggccccgagaccgcccagcccaccaagagaagcaagagaaacagatggagaagacagagctgccagggccccagccccgccagaagcggccagttcctgggcagcgccgacctgggcctgcagagaggcgtgctgaagagcgccgccagaacctgcctgagcgagatcagcaacagcaccagagccagccccgagagcgcccagagcaccgaccccggcagagccgccagacccagaaccagaaccctgcccaccccccacagcttcaagatcggcgaggaggccgaggagatgaagaagaagaaggagagaaagagaagaaaggagagaaagaaggagagaaacttcaagaagtag

SEQ ID NO: 19963 - DNA, 54 bp, Artificial Sequence
  Description of Artificial Sequence: Synthetic coding sequence
atgggcgacgagtgcagcaaccccgacctgctggccgagcccggcagcagctag

SEQ ID NO: 19964 - DNA, 2628 bp, Artificial Sequence
  Description of Artificial Sequence: Synthetic coding sequence
atgcagttccagagcctgaaggagttctacgagaccgagatcccccagaaggagcaggacgacgccaaggccaagcactgcagcgacagcgccgagaagcagtggcagctgttcctgaagaagagcttcatcacccaggacctgggcctggagttcctgaacctgatcaacatggccaaggagaacgagatcctggacgtgaagaacgaggtgtacctgatgaagaacaccatggagaaccagaaggccgagagagaggagctgagcctgctgagactggcctggcagctgaaggccaccgagagcaagcccggcaagcagcagtgggccgccttcaaggagcagctgaagaagaccagccacaacctgaagctgctgcaggaggccctgatgcccgtgagcgccctggacctgggcggcagcctgcagttcatcctggacctgagacagaagtggaacgacatgaagccccagttccagcagctgaacgacgaggtgcagtacatcatgaaggagagcgaggagctgaccggcagaggcgcccccgtgaaggagaagagccagcagctgaaggacctgatccacttccaccagaagcagaaggagagaatccaggactacgaggacatcctgtacaaggtggtgcagttccaccaggtgaaggaggagctgggcagactgatcaagagcagagagctggagttcgtggagcagcccaaggagctgggcgacgcccacgacgtgcagatccacctgagatgcagccaggagaagcaggccagagtggaccacctgcacagactggccctgagcctgggcgtggacatcatcagcagcgtgcagagaccccactgcagcaacgtgagcgccaagaacctgcagcagcagctggagctgctggaggaggacagcatgaagtggagagccaaggccgaggagtacggcagaaccctgagcagaagcgtggagtactgcgccatgagagacgagatcaacgagctgaaggacagcttcaaggacatcaagaagaagttcaacaacctgaagttcaactacaccaagaagaacgagaagagcagaaacctgaaggccctgaagtaccagatccagcaggtggacatgtacgccgagaagatgcaggccctgaagagaaagatggagaaggtgagcaacaagaccagcgacagcttcctgaactaccccagcgacaaggtgaacgtgctgctggaggtgatgaaggacctgcagaagcacgtggacgacttcgacaaggtggtgaccgactacaagaagaacctggacctgaccgagcacttccaggaggtgatcgaggagtgccacttctggtacgaggacgccagcgccaccgtggtgagagtgggcaagtacagcaccgagtgcaagaccaaggaggccgtgaagatcctgcaccagcagttcaacaagttcatcgcccccagcgtgccccagcaggaggagagaatccaggaggccaccgacctggcccagcacctgtacggcctggaggagggccagaagtacatcgagaagatcgtgaccaagcacaaggaggtgctggagagcgtgaccgagctgtgcgagagcctgaccgagctggaggagaagctgaagcagggcgacgtgctgaagatgaaccccaacctggaggacttccactacgactacatcgacctgctgaaggagcccgccaagaacaagcagaccatcttcaacgaggagagaaacaagggccaggtgcaggtggccgacctgctgggcatcaacggcaccggcgaggagagactgccccaggacctgaaggtgagcaccgacaaggagggcggcgtgcaggacctgctgctgcccgaggacatgctgagcggcgaggagtacgagtgcgtgagccccgacgacatcagcctgccccccctgcccggcagccccgagagccccctggcccccagcgacatggaggtggaggagcccgtgagcagcagcctgagcctgcacatcagcagctacggcgtgcaggccggcaccagcagccccggcgacgcccaggagagcgtgctgcccccccccgtggccttcgccgacgcctgcaacgacaagagagagaccttcagcagccacttcgagagaccctacctgcagttcaaggccgagccccccctgaccagcagaggcttcgtggagaagagcaccgccctgcacagaatcagcgccgagcaccccgagagcatgatgagcgaggtgcacgagagagccctgcagcagcacccccaggcccagggcggcctgctggagaccagagagaagatgcacgccgacaacaacttcaccaagacccaggacagactgcacgccagcagcgacgccttcagcggcctgagattccagagcggcaccagcagaggctaccagagacagatggtgcccagagaggagatcaagagcaccagcgccaagagcagcgtggtgagcctggccgaccaggcccccaacttcagcagactgctgagcaacgtgaccgtgatggagggcagccccgtgaccctggaggtggaggtgaccggcttccccgagcccaccctgacctggtgggtggcctacaacgacaagccctag

SEQ ID NO: 19965 - DNA, 2685 bp, Artificial Sequence
  Description of Artificial Sequence: Synthetic coding sequence
agaagccaggtgctgcagacctacgtggccttcctgaagagcagcgaggaggtggagatgcagttccagagcctgaaggagttctacgagaccgagatcccccagaaggagcaggacgacgccaaggccaagcactgcagcgacagcgccgagaagcagtggcagctgttcctgaagaagagcttcatcacccaggacctgggcctggagttcctgaacctgatcaacatggccaaggagaacgagatcctggacgtgaagaacgaggtgtacctgatgaagaacaccatggagaaccagaaggccgagagagaggagctgagcctgctgagactggcctggcagctgaaggccaccgagagcaagcccggcaagcagcagtgggccgccttcaaggagcagctgaagaagaccagccacaacctgaagctgctgcaggaggccctgatgcccgtgagcgccctggacctgggcggcagcctgcagttcatcctggacctgagacagaagtggaacgacatgaagccccagttccagcagctgaacgacgaggtgcagtacatcatgaaggagagcgaggagctgaccggcagaggcgcccccgtgaaggagaagagccagcagctgaaggacctgatccacttccaccagaagcagaaggagagaatccaggactacgaggacatcctgtacaaggtggtgcagttccaccaggtgaaggaggagctgggcagactgatcaagagcagagagctggagttcgtggagcagcccaaggagctgggcgacgcccacgacgtgcagatccacctgagatgcagccaggagaagcaggccagagtggaccacctgcacagactggccctgagcctgggcgtggacatcatcagcagcgtgcagagaccccactgcagcaacgtgagcgccaagaacctgcagcagcagctggagctgctggaggaggacagcatgaagtggagagccaaggccgaggagtacggcagaaccctgagcagaagcgtggagtactgcgccatgagagacgagatcaacgagctgaaggacagcttcaaggacatcaagaagaagttcaacaacctgaagttcaactacaccaagaagaacgagaagagcagaaacctgaaggccctgaagtaccagatccagcaggtggacatgtacgccgagaagatgcaggccctgaagagaaagatggagaaggtgagcaacaagaccagcgacagcttcctgaactaccccagcgacaaggtgaacgtgctgctggaggtgatgaaggacctgcagaagcacgtggacgacttcgacaaggtggtgaccgactacaagaagaacctggacctgaccgagcacttccaggaggtgatcgaggagtgccacttctggtacgaggacgccagcgccaccgtggtgagagtgggcaagtacagcaccgagtgcaagaccaaggaggccgtgaagatcctgcaccagcagttcaacaagttcatcgcccccagcgtgccccagcaggaggagagaatccaggaggccaccgacctggcccagcacctgtacggcctggaggagggccagaagtacatcgagaagatcgtgaccaagcacaaggaggtgctggagagcgtgaccgagctgtgcgagagcctgaccgagctggaggagaagctgaagcagggcgacgtgctgaagatgaaccccaacctggaggacttccactacgactacatcgacctgctgaaggagcccgccaagaacaagcagaccatcttcaacgaggagagaaacaagggccaggtgcaggtggccgacctgctgggcatcaacggcaccggcgaggagagactgccccaggacctgaaggtgagcaccgacaaggagggcggcgtgcaggacctgctgctgcccgaggacatgctgagcggcgaggagtacgagtgcgtgagccccgacgacatcagcctgccccccctgcccggcagccccgagagccccctggcccccagcgacatggaggtggaggagcccgtgagcagcagcctgagcctgcacatcagcagctacggcgtgcaggccggcaccagcagccccggcgacgcccaggagagcgtgctgcccccccccgtggccttcgccgacgcctgcaacgacaagagagagaccttcagcagccacttcgagagaccctacctgcagttcaaggccgagccccccctgaccagcagaggcttcgtggagaagagcaccgccctgcacagaatcagcgccgagcaccccgagagcatgatgagcgaggtgcacgagagagccctgcagcagcacccccaggcccagggcggcctgctggagaccagagagaagatgcacgccgacaacaacttcaccaagacccaggacagactgcacgccagcagcgacgccttcagcggcctgagattccagagcggcaccagcagaggctaccagagacagatggtgcccagagaggagatcaagagcaccagcgccaagagcagcgtggtgagcctggccgaccaggcccccaacttcagcagactgctgagcaacgtgaccgtgatggagggcagccccgtgaccctggaggtggaggtgaccggcttccccgagcccaccctgacctggtgggtggcctacaacgacaagccctag

SEQ ID NO: 19966 - DNA, 4593 bp, Artificial Sequence
  Description of Artificial Sequence: Synthetic coding sequence
atgagcagccagggcagccccagcgtggccctgagcaccaccaccgtgagcagcgtggccgtgcaggccggcgacagcaagatcgtgatcgccgtgatcaagtgcggcaagtgggtgcagctgcagctggccgagagccagcccaacctgctggagatcggcagcagccaggacgagaccaagaagctgctgcacgaccacgagctgctgctggccaagctgaaggccctggaggacagagtgtgggagctgctgcaggaggccgacaagaccgccgaggagaacaaggaccagagccaggtgtacgacgccatggccgagaccctgggcgaggcctgggccgccctggtgagcatgctggagagaagaaccgagctgctgagactgaccagcgagttcttcgagaacgccctggagttcgccatcaagatcgaccaggccgaggacttcctgcagaacacccacgagttcgagagcgccgagagcctgaagagcctgctgcagctgcacgagcaccacaccaaggagctgctggagagaagcctggccctgctgaacaagagccagcagctgaccgacttcatcgagaagttcaagtgcgagggccccaacgtgaaccccgagctgacccagggcgcccacagcagctgcctgaaggtggacagactgctggagctgctgcaggacagaagaagacagctggacaagtacctgaagcagcagtggcaggagctgagccaggtgctgcagatctgccagtgggaccagcaggagaaccaggtgacctgctggttccagaagaccatcagaaacctgcaggagcagagcctgggcagcagcctgagcgacaacgaggacagaatccacaagcaggaggagctgatcatcaaggccaaggagtggaacagcgccgtggagaagctgaagagcgaggccctgagaatcctgctgagcaaggactacgtggagaaggagcacctgcagctgagccaccagaagctgagccagctgcaggaggagttcggccagctgatggtggagagaaacacctggctgaagaaggccaacgagttcttcaacagcgccaacaaggccttcgacgtgctgggcagagtggaggcctacctgaagctgctgaagagcgagggcctgagcctggccgtgctggccgtgagacacgaggagctgcacagaaagatcaaggactgcaccaccgacgccctgcagaagggccagaccctgatcagccaggtggacagctgcagcagccaggtgagcggcatccacgagatgatgggctgcatcaagagaagagtggaccacctgaccgagcagtgcagcgcccacaaggagtacgccctgaagaagcagcagctgaccgccagcgtggagggctacctgagaaaggtggagatgagcatccagaagatcagccccgtgctgagcaacgccatggacgtgggcagcaccagaagcgagagcgagaagatcctgaacaagtacctggagctggacatccaggccaaggagaccagccacgagctggaggccgccgccaagaccatgatggagaagaacgagttcgtgagcgacgagatggtgagcctgagcagcaaggccagatggctggccgaggagctgaacctgttcggccagagcatcgactacagaagccaggtgctgcagacctacgtggccttcctgaagagcagcgaggaggtggagatgcagttccagagcctgaaggagttctacgagaccgagatcccccagaaggagcaggacgacgccaaggccaagcactgcagcgacagcgccgagaagcagtggcagctgttcctgaagaagagcttcatcacccaggacctgggcctggagttcctgaacctgatcaacatggccaaggagaacgagatcctggacgtgaagaacgaggtgtacctgatgaagaacaccatggagaaccagaaggccgagagagaggagctgagcctgctgagactggcctggcagctgaaggccaccgagagcaagcccggcaagcagcagtgggccgccttcaaggagcagctgaagaagaccagccacaacctgaagctgctgcaggaggccctgatgcccgtgagcgccctggacctgggcggcagcctgcagttcatcctggacctgagacagaagtggaacgacatgaagccccagttccagcagctgaacgacgaggtgcagtacatcatgaaggagagcgaggagctgaccggcagaggcgcccccgtgaaggagaagagccagcagctgaaggacctgatccacttccaccagaagcagaaggagagaatccaggactacgaggacatcctgtacaaggtggtgcagttccaccaggtgaaggaggagctgggcagactgatcaagagcagagagctggagttcgtggagcagcccaaggagctgggcgacgcccacgacgtgcagatccacctgagatgcagccaggagaagcaggccagagtggaccacctgcacagactggccctgagcctgggcgtggacatcatcagcagcgtgcagagaccccactgcagcaacgtgagcgccaagaacctgcagcagcagctggagctgctggaggaggacagcatgaagtggagagccaaggccgaggagtacggcagaaccctgagcagaagcgtggagtactgcgccatgagagacgagatcaacgagctgaaggacagcttcaaggacatcaagaagaagttcaacaacctgaagttcaactacaccaagaagaacgagaagagcagaaacctgaaggccctgaagtaccagatccagcaggtggacatgtacgccgagaagatgcaggccctgaagagaaagatggagaaggtgagcaacaagaccagcgacagcttcctgaactaccccagcgacaaggtgaacgtgctgctggaggtgatgaaggacctgcagaagcacgtggacgacttcgacaaggtggtgaccgactacaagaagaacctggacctgaccgagcacttccaggaggtgatcgaggagtgccacttctggtacgaggacgccagcgccaccgtggtgagagtgggcaagtacagcaccgagtgcaagaccaaggaggccgtgaagatcctgcaccagcagttcaacaagttcatcgcccccagcgtgccccagcaggaggagagaatccaggaggccaccgacctggcccagcacctgtacggcctggaggagggccagaagtacatcgagaagatcgtgaccaagcacaaggaggtgctggagagcgtgaccgagctgtgcgagagcctgaccgagctggaggagaagctgaagcagggcgacgtgctgaagatgaaccccaacctggaggacttccactacgactacatcgacctgctgaaggagcccgccaagaacaagcagaccatcttcaacgaggagagaaacaagggccaggtgcaggtggccgacctgctgggcatcaacggcaccggcgaggagagactgccccaggacctgaaggtgagcaccgacaaggagggcggcgtgcaggacctgctgctgcccgaggacatgctgagcggcgaggagtacgagtgcgtgagccccgacgacatcagcctgccccccctgcccggcagccccgagagccccctggcccccagcgacatggaggtggaggagcccgtgagcagcagcctgagcctgcacatcagcagctacggcgtgcaggccggcaccagcagccccggcgacgcccaggagagcgtgctgcccccccccgtggccttcgccgacgcctgcaacgacaagagagagaccttcagcagccacttcgagagaccctacctgcagttcaaggccgagccccccctgaccagcagaggcttcgtggagaagagcaccgccctgcacagaatcagcgccgagcaccccgagagcatgatgagcgaggtgcacgagagagccctgcagcagcacccccaggcccagggcggcctgctggagaccagagagaagatgcacgccgacaacaacttcaccaagacccaggacagactgcacgccagcagcgacgccttcagcggcctgagattccagagcggcaccagcagaggctaccagagacagatggtgcccagagaggagatcaagagcaccagcgccaagagcagcgtggtgagcctggccgaccaggcccccaacttcagcagactgctgagcaacgtgaccgtgatggagggcagccccgtgaccctggaggtggaggtgaccggcttccccgagcccaccctgacctggtacaagaagggccagaagctgagcgccgacggccacctgcaggtgctgcacaaggagaccagacacagcgtgttcatccccaaggtgtgcaaggccgacgccggcctgtacgtggccagagcccagaacagcagcggcgccctgagcagcaacgtgatcctgcacgtgaccggcaactgcagactgcccatcaccagagtgaactggatcaccctgtgcgtggtgtacgtgagcgtgagcctgatgtactggctgctgacccagtag

SEQ ID NO: 19967 - DNA, 2253 bp, Artificial Sequence
  Description of Artificial Sequence: Synthetic coding sequence
atggcccaggccagcagaagcggcagcctgccccccctggtgatcgtgccccccctgagagcccagcccggcggcaccggcgaggagcagtgggagagaagcagaaccggcggcctgagatgggaggtgcactgctggcccagcggcaccagcggcggcaccccctggtggcccacccccgccgacgtgagcgaggactacgaggccgacgccgccgcctggagaagaggccccgccggcggcggccccatcccccccgccctgcagagactgagagccgtgctgctgagactgcacagagagagagagcagctgctgcaggccagagactgcgcctaccacctgcagagcgccgtgagactgatgaagaccctgagccccggcagccccagcggcggccccagccccctgccccagtggtgcagagacctgcagctgcaccccagccagggcgccgtgctgagaatcggccccggcgagaccctggagcccctgctgctggccagacccatcggcctggccgcccagtgcctggaggccgtgatcgagatgcagctgagagccctgggcagagagcccgccagccccggcctgagcagccagctggccgagctgctgttcgccctgcccgcctaccacaccctgcagagaaaggccctgagccacgtgcccggcgccgccagacccttccccaccagcagagtgctgagactgctgaccggcgagagaggctgccaggtggccagcagactggacgaggccctgcagggcagcgccctgagagaccagctgagaagaagatgccaggaggagggcgacctgctgcccggcctgctgggcctggtgggcggcgtggccggcagcgccagctgcggcctgggcctgggcggcgccggcgccctgtggagccagtactggaccctgctgtgggccgcctgcgcccagagcctggacctgaacctgggcccctggagagaccccagagccaccgcccagcagctgagccaggccctgggccaggccagcctgccccaggagtgcgagaaggagctggccagcctgtgccacagactgctgcaccagagcctgatctggagctgggaccagggcttctgccaggccctgggcagcgccctgggcggccagagcagcctgcccaccagcagcggcaccgccgagctgctgcagcagctgttcccccccctgctggacgccctgagagagcccagactgagaagaatcttctgccagcccgccgaccccgcccccgtggccctgggcctgtgcaccctgcagaccaccctgctgtggttcctgggcagagcccagcagtacctggccgcctgggaccccgccagcttcctgctgctgatccagaaggacctgccccccctgctgcacgaggccgaggccctgtacagcctggccagcgaggagagcctggccctggaggtggagcagcagctgggcctggagatccagaagctgaccgcccagatccagctgctgcccgaggagagcctgagcgtgttcagccaggagtgccacaagcaggccatgcagggcttcaagctgtacatgcccagaggcagatactggagactgagactgtgccccgagccccccagcgcccccagcgagtacgccggcctggtggtgagaaccgtgctggagcccgtgctgcagggcctgcagggcctgcccccccaggcccaggcccccgccctgggccaggccctgaccgccatcgtgggcgcctggctggaccacatcctgacccacggcatcagattcagcctgcagggcgccctgcagctgaagcaggacttcggcgtggtgagagagctgctggaggaggagcagtggagcctgagccccgacctgagacagaccctgctgatgctgagcatcttccagcagctggacggcgccctgctgtgcctgctgcagcagcccctgcccaagagccaggtgcacagaagacccccctgctgctgcgcctgccaggaggtgcagaccaccaagctgcccagcagctgcctgaacagcctggagagcctggagccccccctgcagcccggcaccagccccgcccagaccggccagctgcagagcaccctgggcggcagaggccccagccccgagggctacctggtgggcaaccagcaggcctggctggccctgagacagcaccagagacccagatggcacctgcccttcttcagctgcctgggcaccagccccgagagctag

SEQ ID NO: 19968 - DNA, 2232 bp, Artificial Sequence
  Description of Artificial Sequence: Synthetic coding sequence
atggcccaggccagcagaagcggcagcctgccccccctggtgatcgtgccccccctgagagcccagcccggcggcaccggcgaggagcagtgggagagaagcagaaccggcggcctgagatgggaggtgcactgctggcccagcggcaccagcggcggcaccccctggtggcccacccccgccgacgtgagcgaggactacgaggccgacgccgccgcctggagaagaggccccgccggcggcggccccatcccccccgccctgcagagactgagagccgtgctgctgagactgcacagagagagagagcagctgctgcaggccagagactgcgcctaccacctgcagagcgccgtgagactgatgaagaccctgagccccggcagccccagcggcggccccagccccctgccccagtggtgcagagacctgcagctgcaccccagccagggcgccgtgctgagaatcggccccggcgagaccctggagcccctgctgctggccagacccatcggcctggccgcccagtgcctggaggccgtgatcgagatgcagctgagagccctgggcagagagcccgccagccccggcctgagcagccagctggccgagctgctgttcgccctgcccgcctaccacaccctgcagagaaaggccctgagccacgtgcccggcgccgccagacccttccccaccagcagagtgctgagactgctgaccggcgagagaggctgccaggtggccagcagactggacgaggccctgcagggcagcgccctgagagaccagctgagaagaagatgccaggaggagggcgacctgctgcccggcctgctgggcctggtgggcggcgtggccggcagcgccagctgcggcctgggcctgggcggcgccggcgccctgtggagccagtactggaccctgctgtgggccgcctgcgcccagagcctggacctgaacctgggcccctggagagaccccagagccaccgcccagcagctgagccaggccctgggccaggccagcctgccccaggagtgcgagaaggagctggccagcctgtgccacagactgctgcaccagagcctgatctggagctgggaccagggcttctgccaggccctgggcagcgccctgggcggccagagcagcctgcccaccagcagcggcaccgccgagctgctgcagcagctgttcccccccctgctggacgccctgagagagcccagactgagaagaatcttctgccagcccgccggcctgtgcaccctgcagaccaccctgctgtggttcctgggcagagcccagcagtacctggccgcctgggaccccgccagcttcctgctgctgatccagaaggacctgccccccctgctgcacgaggccgaggccctgtacagcctggccagcgaggagagcctggccctggaggtggagcagcagctgggcctggagatccagaagctgaccgcccagatccagctgctgcccgaggagagcctgagcgtgttcagccaggagtgccacaagcaggccatgcagggcttcaagctgtacatgcccagaggcagatactggagactgagactgtgccccgagccccccagcgcccccagcgagtacgccggcctggtggtgagaaccgtgctggagcccgtgctgcagggcctgcagggcctgcccccccaggcccaggcccccgccctgggccaggccctgaccgccatcgtgggcgcctggctggaccacatcctgacccacggcatcagattcagcctgcagggcgccctgcagctgaagcaggacttcggcgtggtgagagagctgctggaggaggagcagtggagcctgagccccgacctgagacagaccctgctgatgctgagcatcttccagcagctggacggcgccctgctgtgcctgctgcagcagcccctgcccaagagccaggtgcacagaagacccccctgctgctgcgcctgccaggaggtgcagaccaccaagctgcccagcagctgcctgaacagcctggagagcctggagccccccctgcagcccggcaccagccccgcccagaccggccagctgcagagcaccctgggcggcagaggccccagccccgagggctacctggtgggcaaccagcaggcctggctggccctgagacagcaccagagacccagatggcacctgcccttcttcagctgcctgggcaccagccccgagagctag

SEQ ID NO: 19969 - DNA, 666 bp, Artificial Sequence
  Description of Artificial Sequence: Synthetic coding sequence
atggccagctggggcggcgagaagagaggcggcgccggcggcagccccaagcccgccgtgtacgccaccagaaagacccccagcgtgggcagccaggaggaccagtggtacctggactaccccggcgaccagtggagcctgggcttcagctacagctggtggaagaacagcgtgggcagcgagagcaagcacggcgagggcgccctggaccagctgcagcacgacgtgagactggaggacctgggcgagctgcacagagccgccagaagcggcgacgtgcccggcgtggagcacgtgctggcccccggcgacaccggcgtggacaagagagacagaaagaagagcatccagcagctggtgcccgagtacaaggagaagcagacccccgagagcctgccccagaacaacaaccccgccgcccccagccaggccgagggcggcgagggcggcgtggcctgcggcaccgtggagcagatgacctggctgtgcagcctgccccacgccgtgggcggcggcgacggcgaccacagcagcaccggcgccgtgggcggccaccccagaggccccggcgagtactgccacctgcacgagcagagagtgcaccaccacatcttcgccagaggcaagagaaagggcaagaaccacgtgagcaacgtggtgagatag

SEQ ID NO: 19970 - DNA, 2757 bp, Artificial Sequence
  Description of Artificial Sequence: Synthetic coding sequence
tgaaagggctgcgagaacaagcagccccaggtggaggaggagatggagaagcacagaagcaacagcaccgagctgagcggcaccctgaccgacggcaccaccgtgggcaacgacgacgacggcctgaaccagcagatccccagaaaggagaacggcgagcacgacagacccgccgacaagaccagcaacgagaagaacgaggtgaagaaccagatctaccccgaggccgacttcgccgacagcatggagcccagcgagatcgccagcgaggactgcgagctgagccacagcgtgtacgagaacttcatgctgctgatcgagcagctgagaatggagtacaaggacagcgccagcctgcccagaatccaggacaccttctgcctgtgcgagcacctgctgaagctgaagaacaaccactgcgaccagctgaccgtgaagctgaagcagatggagaacatggtgagcgtgctgcagaacgagctgagcgagaccaagaagaccaagctgcagctggagctgcagaagatcgagtgggagaaggagctgtacgacctgagactggccctgaagcaggagaacgaggagaagagaaacgccgacatgctgtacaacaaggacagcgagcagctgagaatcaaggaggaggagtgcggcaaggtggtggagaccaagcagcagctgaagtggaacctgagaagactggtgaaggagctgagaaccgtgagaaacaacctggacctggtggtgcaggagagaaacgacgcccagaagcagctgagcgaggagcaggacgccagaatcctgcaggaccagatcctgaccagcaagcagaaggagctggagatggccagaaagaagatgaacagcgagatcagccacagacaccagaaggagaaggacctgttccacgaggactgcatgctgcaggaggagatcgccctgctgagactggagatcgacaccatcaagaaccagaacaagcagaaggagaagaagtacttcgaggacatcgaggccgtgaaggagaagaacgacaacctgcagaagatcatcaagctgaacgaggagaccctgaccgagaccatcctgcagtacagcggccagctgaacaacctgaccgccgagaacaagatcctgaacagcgagctggagaacggcaagcagaaccaggagagactggagatcgagatggagagctacagatgcagactggccgccgccgtgagagactgcgaccagagccagaccgccagagacctgaagctggacttccagagaaccagacaggagtgggtgagactgcacgacaagatgaaggtggacatgagcggcctgcaggccaagaacgagatcctgagcgagaagctgagcaacgccgagagcaagatcaacagcctgcagatccagctgcacaacaccagagacgccctgggcagagagagcctgatcctggagagagtgcagagagacctgagccagacccagtgccagaagaaggagaccgagcagatgtaccagatcgagcagagcaagctgaagaagtacatcgccaagcaggagagcgtggaggagagactgagccagctgcagagcgagaacatgctgctgagacagcagctggacgacgcccacaagaaggccaacagccaggagaagaccagcagcaccatccaggaccagttccacagcgccgccaagaacctgcaggccgagagcgagaagcagatcctgagcctgcaggagaagaacaaggagctgatggacgagtacaaccacctgaaggagagaatggaccagtgcgagaaggagaaggccggcagaaaggtggtgatgagagagttccagcaggagtggaccgacctgctgaagcagcagcccaccagcgaggccaccagcagatgccacatcaacctggacgagacccaggacagcaagaagaagctgggccagatcagaagcgagatcgacctgaccgaggcccaggagaccgtgcccagcagatgcctgcacctggacgccgagaacgaggtgctgcagctgcagcagaccctgttcagcatgaaggccatccagaagcagtgcgagaccctgcagaagaacaagaagcagctgaagcaggaggtggtgaacctgaagagctacatggagagaaacatgctggagagaggcaaggccgagtggcacaagctgctgatcgaggagagagccagaaaggagatcgaggagaagctgaacgaggccatcctgaccctgcagaagcaggccgccgtgagccacgagcagctggtgcagctgagagaggacaacaccaccagcatcaagacccagatggagctgaccatcaaggacctggagagcgagatcagcagaatcaagaccagccaggccgacttcaacaagaccgagctggagagatacaaggagctgtacctggaggaggtgaaggtgagagagagcctgagcaacgagctgagcagaaccaacgagatgatcgccgaggtgagcacccagctgaccgtggagaaggagcagaccagaagcagaagcctgttcaccgcctacgccaccagacccgtgctggagagcccctgcgtgggcaacctgaacgacagcgagggcctgaacagaaagcacatccccagaaagaagagaagcgccctgaaggacatggagagctacctgctgaaggtgagctacctgttcagcttcggcgtgcagatcagcgacagaatcctggtgtgctacctggtgaagtag

SEQ ID NO: 19971 - DNA, 1716 bp, Artificial Sequence
  Description of Artificial Sequence: Synthetic coding sequence
atggccagctggggcggcgagaagagaggcggcgccgagggcagccccaagcccgccgtgtacgccaccagaaagacccccagcgtgggcagccagggcgaccagtggtacctgggctaccccggcgaccagtggagcagcggcttcccctacagctggtggaagaacagcgtgggcagcgagagcaagcacggcgagggcgccctggaccagccccagcacgacgtgagactggaggacctgggcgagctgcacagagccgccagaagcggcgacgtgcccggcgtggagcacatcctggcccccggcgacaccggcgtggacaagagagacagaaagaagagcatccagcagctggtgcccgagtacaaggagaagcagacccccgagagcctgccccagaacaacaaccccgactggcaccccaccaacctgaccctgagcgacgagacctgccagagaagcaagaacctgaaggtggacgacaagtgccccagcgtgagccccagcatgcccgagaaccagagcgccaccaaggagctgggccagatgaacctgaccgagagagagaagatggacaccggcgtggtgctgctgagcggcaacgacaccctgcacgacctgtgccagagccagctgcccgagaacaaggagagcaaggaggagcaggacagcgagctgaccagcgaggaggagcaggagagactgaagggctgcgagaacaagcagccccagaagaccagccaggagcccgagatggccaaggactgcgacagagaggacatccccatctaccccgtgctgccccacgtgcagaagagcgaggagatgtggatcgagcagggcaagctggagtggaagaaccagctgaagctggtgatcaacgagctgaagcagagattcggcgagatctacgagaagtacaagatccccgcctgccccgaggaggagcccctgctggacaacagcaccagaggcaccgacgtgaaggacatccccttcaacctgaccaacaacatccccggctgcgaggaggaggacgccagcgagatcagcgtgagcgtggtgttcgagaccttccccgagcagaaggagcccagcctgaagaacatcatccacccctactaccacccctacagcggcagccaggagcacgtgtgccagagcagcagcaagttccacctgcacgagaacaagctggactgcgacaacgacaacaagcccggcatcggccacatcttcagcaccgacaagaacttccacaacgacgccagcaccaagaaggccagaaaccccgaggtggtgatggtggagatgaaggaggaccaggagttcgacctgcagatgaccaagaacatgaaccagaacagcgacagcggcagcaccaacaactacaagagcctgaagcccaagctggagaacctgagcagcctgccccccgacagcgacagaaccagcgaggtgtacctgcacgaggagctgcagcaggacatgcagaagttcaagaacgaggtgaacaccctggaggaggagttcctggccctgaagaaggaggacgtgcagctgcacaaggacgtggaggaggagatggagaagcacagaagcaacagcaccgagctgagcggcaccctgaccgacggcaccaccgtgggcaacgacgacgacggcctgaaccagcagatccccagaaaggagaacggcgagcacgacagatag

SEQ ID NO: 19972 - DNA, 2181 bp, Artificial Sequence
  Description of Artificial Sequence: Synthetic coding sequence
atggccagctggggcggcgagaagagaggcggcgccgagggcagccccaagcccgccgtgtacgccaccagaaagacccccagcgtgggcagccagggcgaccagtggtacctgggctaccccggcgaccagtggagcagcggcttcccctacagctggtggaagaacagcgtgggcagcgagagcaagcacggcgagggcgccctggaccagccccagcacgacgtgagactggaggacctgggcgagctgcacagagccgccagaagcggcgacgtgcccggcgtggagcacatcctggcccccggcgacaccggcgtggacaagagagacagaaagaagagcatccagcagctggtgcccgagtacaaggagaagcagacccccgagagcctgccccagaacaacaaccccgactggcaccccaccaacctgaccctgagcgacgagacctgccagagaagcaagaacctgaaggtggacgacaagtgccccagcgtgagccccagcatgcccgagaaccagagcgccaccaaggagctgggccagatgaacctgaccgagagagagaagatggacaccggcgtggtgctgctgagcggcaacgacaccctgcacgacctgtgccagagccagctgcccgagaacaaggagagcaaggaggccgagcaggacagcgagctgaccagcgaggaggagcaggagagactgaagggctgcgagaacaagcagccccagaagaccagccaggagcccgagatggccaaggactgcgacagagaggacatccccatctaccccgtgctgccccacgtgcagaagagcgaggagatgtggatcgagcagggcaagctggagtggaagaaccagctgaagctggtgatcaacgagctgaagcagagattcggcgagatctacgagaagtacaagatccccgcctgccccgaggaggagcccctgctggacaacagcaccagaggcaccgacgtgaaggacatccccttcaacctgaccaacaacatccccggctgcgaggaggaggacgccagcgagatcagcgtgagcgtggtgttcgagaccttccccgagcagaaggagcccagcctgaagaacatcatccacccctactaccacccctacagcggcagccaggagcacgtgtgccagagcagcagcaagttccacctgcacgagaacaagctggactgcgacaacgacaacaagcccggcatcggccacatcttcagcaccgacaagaacttccacaacgacgccagcaccaagaaggccagaaaccccgaggtggtgatggtggagatgaaggaggaccaggagttcgacctgcagatgaccaagaacatgaaccagaacagcgacagcggcagcaccaacaactacaagagcctgaagcccaagctggagaacctgagcagcctgccccccgacagcgacagaaccagcgaggtgtacctgcacgaggagctgcagcaggacatgcagaagttcaagaacgaggtgaacaccctggaggaggagttcctggccctgaagaaggaggacgtgcagctgcacaaggacgtggaggaggagatggagaagcacagaagcaacagcaccgagctgagcggcaccctgaccgacggcaccaccgtgggcaacgacgacgacggcctgaaccagcagatccccagaaaggagaacggcgagcacgacagacccgccgacaagaccagcaacgagaagaacgaggtgaagaaccagatctaccccgaggccgacttcgccgacagcatggagcccagcgagatcgccagcgaggactgcgagctgagccacagcgtgtacgagaacttcatgctgctgatcgagcagctgagaatggagtacaaggacagcgccagcctgcccagaatccaggacaccttctgcctgtgcgagcacctgctgaagctgaagaacaaccactgcgaccagctgaccgtgaagctgaagcagatggagaacatggtgagcgtgctgcagaacgagctgagcgagaccaagaagaccaagctgcagctggagctgcagaagatcgagtgggagaaggagctgtacgacctgagattcctgatcggcatcagaaagaagagaatcagcttcatgaagatcgcctgctgcagaaagaagctgccctgctag

SEQ ID NO: 19973 - DNA, 4284 bp, Artificial Sequence
  Description of Artificial Sequence: Synthetic coding sequence
atggccagctggggcggcgagaagagaggcggcgccgagggcagccccaagcccgccgtgtacgccaccagaaagacccccagcgtgggcagccagggcgaccagtggtacctgggctaccccggcgaccagtggagcagcggcttcccctacagctggtggaagaacagcgtgggcagcgagagcaagcacggcgagggcgccctggaccagccccagcacgacgtgagactggaggacctgggcgagctgcacagagccgccagaagcggcgacgtgcccggcgtggagcacatcctggcccccggcgacaccggcgtggacaagagagacagaaagaagagcatccagcagctggtgcccgagtacaaggagaagcagacccccgagagcctgccccagaacaacaaccccgactggcaccccaccaacctgaccctgagcgacgagacctgccagagaagcaagaacctgaaggtggacgacaagtgccccagcgtgagccccagcatgcccgagaaccagagcgccaccaaggagctgggccagatgaacctgaccgagagagagaagatggacaccggcgtggtgctgctgagcggcaacgacaccctgcacgacctgtgccagagccagctgcccgagaacaaggagagcaaggaggccgagcaggacagcgagctgaccagcgaggaggagcaggagagactgaagggctgcgagaacaagcagccccagaagaccagccaggagcccgagatggccaaggactgcgacagagaggacatccccatctaccccgtgctgccccacgtgcagaagagcgaggagatgtggatcgagcagggcaagctggagtggaagaaccagctgaagctggtgatcaacgagctgaagcagagattcggcgagatctacgagaagtacaagatccccgcctgccccgaggaggagcccctgctggacaacagcaccagaggcaccgacgtgaaggacatccccttcaacctgaccaacaacatccccggctgcgaggaggaggacgccagcgagatcagcgtgagcgtggtgttcgagaccttccccgagcagaaggagcccagcctgaagaacatcatccacccctactaccacccctacagcggcagccaggagcacgtgtgccagagcagcagcaagttccacctgcacgagaacaagctggactgcgacaacgacaacaagcccggcatcggccacatcttcagcaccgacaagaacttccacaacgacgccagcaccaagaaggccagaaaccccgaggtggtgatggtggagatgaaggaggaccaggagttcgacctgcagatgaccaagaacatgaaccagaacagcgacagcggcagcaccaacaactacaagagcctgaagcccaagctggagaacctgagcagcctgccccccgacagcgacagaaccagcgaggtgtacctgcacgaggagctgcagcaggacatgcagaagttcaagaacgaggtgaacaccctggaggaggagttcctggccctgaagaaggaggacgtgcagctgcacaaggacgtggaggaggagatggagaagcacagaagcaacagcaccgagctgagcggcaccctgaccgacggcaccaccgtgggcaacgacgacgacggcctgaaccagcagatccccagaaaggagaacggcgagcacgacagacccgccgacaagaccagcaacgagaagaacgaggtgaagaaccagatctaccccgaggccgacttcgccgacagcatggagcccagcgagatcgccagcgaggactgcgagctgagccacagcgtgtacgagaacttcatgctgctgatcgagcagctgagaatggagtacaaggacagcgccagcctgcccagaatccaggacaccttctgcctgtgcgagcacctgctgaagctgaagaacaaccactgcgaccagctgaccgtgaagctgaagcagatggagaacatggtgagcgtgctgcagaacgagctgagcgagaccaagaagaccaagctgcagctggagctgcagaagatcgagtgggagaaggagctgtacgacctgagactggccctgaagcaggagaacgaggagaagagaaacgccgacatgctgtacaacaaggacagcgagcagctgagaatcaaggaggaggagtgcggcaaggtggtggagaccaagcagcagctgaagtggaacctgagaagactggtgaaggagctgagaaccgtgagaaacaacctggacctggtggtgcaggagagaaacgacgcccagaagcagctgagcgaggagcaggacgccagaatcctgcaggaccagatcctgaccagcaagcagaaggagctggagatggccagaaagaagatgaacagcgagatcagccacagacaccagaaggagaaggacctgttccacgaggactgcatgctgcaggaggagatcgccctgctgagactggagatcgacaccatcaagaaccagaacaagcagaaggagaagaagtacttcgaggacatcgaggccgtgaaggagaagaacgacaacctgcagaagatcatcaagctgaacgaggagaccctgaccgagaccatcctgcagtacagcggccagctgaacaacctgaccgccgagaacaagatcctgaacagcgagctggagaacggcaagcagaaccaggagagactggagatcgagatggagagctacagatgcagactggccgccgccgtgagagactgcgaccagagccagaccgccagagacctgaagctggacttccagagaaccagacaggagtgggtgagactgcacgacaagatgaaggtggacatgagcggcctgcaggccaagaacgagatcctgagcgagaagctgagcaacgccgagagcaagatcaacagcctgcagatccagctgcacaacaccagagacgccctgggcagagagagcctgatcctggagagagtgcagagagacctgagccagacccagtgccagaagaaggagaccgagcagatgtaccagatcgagcagagcaagctgaagaagtacatcgccaagcaggagagcgtggaggagagactgagccagctgcagagcgagaacatgctgctgagacagcagctggacgacgcccacaagaaggccaacagccaggagaagaccagcagcaccatccaggaccagttccacagcgccgccaagaacctgcaggccgagagcgagaagcagatcctgagcctgcaggagaagaacaaggagctgatggacgagtacaaccacctgaaggagagaatggaccagtgcgagaaggagaaggccggcagaaagatcgacctgaccgaggcccaggagaccgtgcccagcagatgcctgcacctggacgccgagaacgaggtgctgcagctgcagcagaccctgttcagcatgaaggccatccagaagcagtgcgagaccctgcagaagaacaagaagcagctgaagcaggaggtggtgaacctgaagagctacatggagagaaacatgctggagagaggcaaggccgagtggcacaagctgctgatcgaggagagagccagaaaggagatcgaggagaagctgaacgaggccatcctgaccctgcagaagcaggccgccgtgagccacgagcagctggtgcagctgagagaggacaacaccaccagcatcaagacccagatggagctgaccatcaaggacctggagagcgagatcagcagaatcaagaccagccaggccgacttcaacaagaccgagctggagagatacaaggagctgtacctggaggaggtgaaggtgagagagagcctgagcaacgagctgagcagaaccaacgagatgatcgccgaggtgagcacccagctgaccgtggagaaggagcagaccagaagcagaagcctgttcaccgcctacgccaccagacccgtgctggagagcccctgcgtgggcaacctgaacgacagcgagggcctgaacagaaagcacatccccagaaagaagagaagcgccctgaaggacatggagagctacctgctgaagatgcagcagaagctgcagaacgacctgaccgccgaggtggccggcagcagccagaccggcctgcacagaatcccccagtgcagcagcttcagcagcagcagcctgcacctgctgctgtgcagcatctgccagcccttcttcctgatcctgcagctgctgctgaacatgaacctggaccccatctag

SEQ ID NO: 19974 - DNA, 681 bp, Artificial Sequence
  Description of Artificial Sequence: Synthetic coding sequence
atggccagctggggcggcgagaagagaggcggcgccgagggcagccccaagcccgccgtgtacgccaccagaaagacccccagcgtgggcagccagggcgaccagtggtacctgggctaccccggcgaccagtggagcagcggcttcccctacagctggtggaagaacagcgtgggcagcgagagcaagcacggcgagggcgccctggaccagccccagcacgacgtgagactggaggacctgggcgagctgcacagagccgccagaagcggcgacgtgcccggcgtggagcacatcctggcccccggcgacaccggcgtggacaagagagacagaaagaagagcatccagcagctggtgcccgagtacaaggagaagcagacccccgagagcctgccccagaacaacaaccccgactggcaccccaccaacctgaccctgagcgacgagacctgccagagaagcaagaacctgaaggtggacgacaagtgccccagcgtgagccccagcatgcccgagaaccagagcgccaccaaggagctgggccagatgaacctgaccgagagagagaagatggacaccggcgtggtgctgctgagcggcaacgacaccctgcacgacctgtgccagagccagctgcccgagaacaaggagagcaaggagggcaacaaggaggcctag

SEQ ID NO: 19975 - DNA, 4278 bp, Artificial Sequence
  Description of Artificial Sequence: Synthetic coding sequence
atggccagctggggcggcgagaagagaggcggcgccgagggcagccccaagcccgccgtgtacgccaccagaaagacccccagcgtgggcagccagggcgaccagtggtacctgggctaccccggcgaccagtggagcagcggcttcccctacagctggtggaagaacagcgtgggcagcgagagcaagcacggcgagggcgccctggaccagccccagcacgacgtgagactggaggacctgggcgagctgcacagagccgccagaagcggcgacgtgcccggcgtggagcacatcctggcccccggcgacaccggcgtggacaagagagacagaaagaagagcatccagcagctggtgcccgagtacaaggagaagcagacccccgagagcctgccccagaacaacaaccccgactggcaccccaccaacctgaccctgagcgacgagacctgccagagaagcaagaacctgaaggtggacgacaagtgccccagcgtgagccccagcatgcccgagaaccagagcgccaccaaggagctgggccagatgaacctgaccgagagagagaagatggacaccggcgtggtgctgctgagcggcaacgacaccctgcacgacctgtgccagagccagctgcccgagaacaaggagagcaaggaggccgagcaggacagcgagctgaccagcgaggaggagcaggagagactgaagggctgcgagaacaagcagccccagaagaccagccaggagcccgagatggccaaggactgcgacagagaggacatccccatctaccccgtgctgccccacgtgcagaagagcgaggagatgtggatcgagcagggcaagctggagtggaagaaccagctgaagctggtgatcaacgagctgaagcagagattcggcgagatctacgagaagtacaagatccccgcctgccccgaggaggagcccctgctggacaacagcaccagaggcaccgacgtgaaggacatccccttcaacctgaccaacaacatccccggctgcgaggaggaggacgccagcgagatcagcgtgagcgtggtgttcgagaccttccccgagcagaaggagcccagcctgaagaacatcatccacccctactaccacccctacagcggcagccaggagcacgtgtgccagagcagcagcaagttccacctgcacgagaacaagctggactgcgacaacgacaacaagcccggcatcggccacatcttcagcaccgacaagaacttccacaacgacgccagcaccaagaaggccagaaaccccgaggtggtgatggtggagatgaaggaggaccaggagttcgacctgcagatgaccaagaacatgaaccagaacagcgacagcggcagcaccaacaactacaagagcctgaagcccaagctggagaacctgagcagcctgccccccgacagcgacagaaccagcgaggtgtacctgcacgaggagctgcagcaggacatgcagaagttcaagaacgaggtgaacaccctggaggaggagttcctggccctgaagaaggaggacgtgcagctgcacaaggacgtggaggaggagatggagaagcacagaagcaacagcaccgagctgagcggcaccctgaccgacggcaccaccgtgggcaacgacgacgacggcctgaaccagcagatccccagaaaggagaacggcgagcacgacagacccgccgacaagaccagcaacgagaagaacgaggtgaagaaccagatctaccccgaggccgacttcgccgacagcatggagcccagcgagatcgccagcgaggactgcgagctgagccacagcgtgtacgagaacttcatgctgctgatcgagcagctgagaatggagtacaaggacagcgccagcctgcccagaatccaggacaccttctgcctgtgcgagcacctgctgaagctgaagaacaaccactgcgaccagctgaccgtgaagctgaagcagatggagaacatggtgagcgtgctgcagaacgagctgagcgagaccaagaagaccaagctgcagctggagctgcagaagatcgagtgggagaaggagctgtacgacctgagactggccctgaagcaggagaacgaggagaagagaaacgccgacatgctgtacaacaaggacagcgagcagctgagaatcaaggaggaggagtgcggcaaggtggtggagaccaagcagcagctgaagtggaacctgagaagactggtgaaggagctgagaaccgtgagaaacaacctggacctggtggtgcaggagagaaacgacgcccagaagcagctgagcgaggagcaggacgccagaatcctgcaggaccagatcctgaccagcaagcagaaggagctggagatggccagaaagaagatgaacagcgagatcagccacagacaccagaaggagaaggacctgttccacgaggactgcatgctgcaggaggagatcgccctgctgagactggagatcgacaccatcaagaaccagaacaagcagaaggagaagaagtacttcgaggacatcgaggccgtgaaggagaagaacgacaacctgcagaagatcatcaagctgaacgaggagaccctgaccgagaccatcctgcagtacagcggccagctgaacaacctgaccgccgagaacaagatcctgaacagcgagctggagaacggcaagcagaaccaggagagactggagatcgagatggagagctacagatgcagactggccgccgccgtgagagactgcgaccagagccagaccgccagagacctgaagctggacttccagagaaccagacaggagtgggtgagactgcacgacaagatgaaggtggacatgagcggcctgcaggccaagaacgagatcctgagcgagaagctgagcaacgccgagagcaagatcaacagcctgcagatccagctgcacaacaccagagacgccctgggcagagagagcctgatcctggagagagtgcagagagacctgagccagacccagtgccagaagaaggagaccgagcagatgtaccagatcgagcagagcaagctgaagaagtacatcgccaagcaggagagcgtggaggagagactgagccagctgcagagcgagaacatgctgctgagacagcagctggacgacgcccacaagaaggccaacagccaggagaagaccagcagcaccatccaggaccagttccacagcgccgccaagaacctgcaggccgagagcgagaagcagatcctgagcctgcaggagaagaacaaggagctgatggacgagtacaaccacctgaaggagagaatggaccagtgcgagaaggagaaggccggcagaaagatcgacctgaccgaggcccaggagaccgtgcccagcagatgcctgcacctggacgccgagaacgaggtgctgcagctgcagcagaccctgttcagcatgaaggccatccagaagcagtgcgagaccctgcagaagaacaagaagcagctgaagcaggaggtggtgaacctgaagagctacatggagagaaacatgctggagagaggcaaggccgagtggcacaagctgctgatcgaggagagagccagaaaggagatcgaggagaagctgaacgaggccatcctgaccctgcagaagcaggccgccgtgagccacgagcagctggtgcagctgagagaggacaacaccaccagcatcaagacccagatggagctgaccatcaaggacctggagagcgagatcagcagaatcaagaccagccaggccgacttcaacaagaccgagctggagagatacaaggagctgtacctggaggaggtgaaggtgagagagagcctgagcaacgagctgagcagaaccaacgagatgatcgccgaggtgagcacccagctgaccgtggagaaggagcagaccagaagcagaagcctgttcaccgcctacgccaccagacccgtgctggagagcccctgcgtgggcaacctgaacgacagcgagggcctgaacagaaagcacatccccagaaagaagagaagcgccctgaaggacatggagagctacctgctgaagatgcagcagaagctgcagaacgacctgaccgccgaggtggccgccgccaccaagtacgagcccggcagctacatcgccagccccctgggcttcacccacaaggagaacctgaaccaggaccccgtgctggaggtgaccaaggagtacgcccagatcctgagaagaaagtacatcctgtag

SEQ ID NO: 19976 - DNA, 984 bp, Artificial Sequence
  Description of Artificial Sequence: Synthetic coding sequence
atggccagctggggcggcgagaagagaggcggcgccgagggcagccccaagcccgccgtgtacgccaccagaaagacccccagcgtgggcagccagggcgaccagtggtacctgggctaccccggcgaccagtggagcagcggcttcccctacagctggtggaagaacagcgtgggcagcgagagcaagcacggcgagggcgccctggaccagccccagcacgacgtgagactggaggacctgggcgagctgcacagagccgccagaagcggcgacgtgcccggcgtggagcacatcctggcccccggcgacaccggcgtggacaagagagacagaaagaagagcatccagcagctggtgcccgagtacaaggagaagcagacccccgagagcctgccccagaacaacaaccccgactggcaccccaccaacctgaccctgagcgacgagacctgccagagaagcaagaacctgaaggtggacgacaagtgccccagcgtgagccccagcatgcccgagaaccagagcgccaccaaggagctgggccagatgaacctgaccgagagagagaagatggacaccggcgtggtgctgctgagcggcaacgacaccctgcacgacctgtgccagagccagctgcccgagaacaaggagagcaaggaggccgagcaggacagcgagctgaccagcgaggaggagcaggagagactgaagggctgcgagaacaagcagccccagaagaccagccaggagcccgagatggccaaggactgcgacagagaggacatccccatctaccccgtgctgccccacgtgcagaagagcgaggagatcagcctgccccccgacagcgacagaaccagcgaggtgtacctgcacgaggagctgcagcaggacatgcagaagttcaagaacgaggtgaacaccctggaggaggagttcctggccctgaagaaggaggacgtgcagctgcacaaggactag

SEQ ID NO: 19977 - DNA, 783 bp, Artificial Sequence
  Description of Artificial Sequence: Synthetic coding sequence
atggccagctggggcggcgagaagagaggcggcgccgagggcagccccaagcccgccgtgtacgccaccagaaagacccccagcgtgggcagccagggcgaccagtggtacctgggctaccccggcgaccagtggagcagcggcttcccctacagctggtggaagaacagcgtgggcagcgagagcaagcacggcgagggcgccctggaccagccccagcacgacgtgagactggaggacctgggcgagctgcacagagccgccagaagcggcgacgtgcccggcgtggagcacatcctggcccccggcgacaccggcgtggacaagagagacagaaagaagagcatccagcagctggtgcccgagtacaaggagaagcagacccccgagagcctgccccagaacaacaaccccgactggcaccccaccaacctgaccctgagcgacgagacctgccagagaagcaagaacctgaaggtggacgacaagtgccccagcgtgagccccagcatgcccgagaaccagagcgccaccaaggagctgggccagatgaacctgaccgagagagagaagatggacaccggcgtggtgctgctgagcggcaacgacaccctgcacgacctgtgccagagccagctgcccgagaacaaggagagcaaggaggccgagcaggacagcgagctgaccagcgaggaggagcaggagagactgaagggctgcgagaacaagcagccccaggacaaggccatcttcaagacctgcagccccaccgagaagacctag

SEQ ID NO: 19978 - DNA, 4284 bp, Artificial Sequence; identical to SEQ ID NO: 19973
  Description of Artificial Sequence: Synthetic coding sequence

SEQ ID NO: 19979 - DNA, 2178 bp, Artificial Sequence
  Description of Artificial Sequence: Synthetic coding sequence
atggccagctggggcggcgagaagagaggcggcgccgagggcagccccaagcccgccgtgtacgccaccagaaagacccccagcgtgggcagccagggcgaccagtggtacctgggctaccccggcgaccagtggagcagcggcttcccctacagctggtggaagaacagcgtgggcagcgagagcaagcacggcgagggcgccctggaccagccccagcacgacgtgagactggaggacctgggcgagctgcacagagccgccagaagcggcgacgtgcccggcgtggagcacatcctggcccccggcgacaccggcgtggacaagagagacagaaagaagagcatccagcagctggtgcccgagtacaaggagaagcagacccccgagagcctgccccagaacaacaaccccgactggcaccccaccaacctgaccctgagcgacgagacctgccagagaagcaagaacctgaaggtggacgacaagtgccccagcgtgagccccagcatgcccgagaaccagagcgccaccaaggagctgggccagatgaacctgaccgagagagagaagatggacaccggcgtggtgctgctgagcggcaacgacaccctgcacgacctgtgccagagccagctgcccgagaacaaggagagcaaggaggccgagcaggacagcgagctgaccagcgaggaggagcaggagagactgaagggctgcgagaacaagcagccccagaagaccagccaggagcccgagatggccaaggactgcgacagagaggacatccccatctaccccgtgctgccccacgtgcagaagagcgaggagatgtggatcgagcagggcaagctggagtggaagaaccagctgaagctggtgatcaacgagctgaagcagagattcggcgagatctacgagaagtacaagatccccgcctgccccgaggaggagcccctgctggacaacagcaccagaggcaccgacgtgaaggacatccccttcaacctgaccaacaacatccccggctgcgaggaggaggacgccagcgagatcagcgtgagcgtggtgttcgagaccttccccgagcagaaggagcccagcctgaagaacatcatccacccctactaccacccctacagcggcagccaggagcacgtgtgccagagcagcagcaagttccacctgcacgagaacaagctggactgcgacaacgacaacaagcccggcatcggccacatcttcagcaccgacaagaacttccacaacgacgccagcaccaagaaggccagaaaccccgaggtggtgatggtggagatgaaggaggaccaggagttcgacctgcagatgaccaagaacatgaaccagaacagcgacagcggcagcaccaacaactacaagagcctgaagcccaagctggagaacctgagcagcctgccccccgacagcgacagaaccagcgaggtgtacctgcacgaggagctgcagcaggacatgcagaagttcaagaacgaggtgaacaccctggaggaggagttcctggccctgaagaaggaggacgtgcagctgcacaaggaggtggaggaggagatggagaagcacagaagcaacagcaccgagctgagcggcaccctgaccgacggcaccaccgtgggcaacgacgacgacggcctgaaccagcagatccccagaaaggagaacggcgagcacgacagacccgccgacaagaccagcaacgagaagaacgaggtgaagaaccagatctaccccgaggccgacttcgccgacagcatggagcccagcgagatcgccagcgaggactgcgagctgagccacagcgtgtacgagaacttcatgctgctgatcgagcagctgagaatggagtacaaggacagcgccagcctgcccagaatccaggacaccttctgcctgtgcgagcacctgctgaagctgaagaacaaccactgcgaccagctgaccgtgaagctgaagcagatggagaacatggtgagcgtgctgcagaacgagctgagcgagaccaagaagaccaagctgcagctggagctgcagaagatcgagtgggagaaggagctgtacgacctgagactggccctgaagcaggagaacagaagaaaggagatgcccatctgctgcatcatcaagatcgtgaacagctag

SEQ ID NO: 19980 - DNA, 3465 bp, Artificial Sequence
  Description of Artificial Sequence: Synthetic coding sequence
atggccagctggggcggcgagaagagaggcggcgccgagggcagccccaagcccgccgtgtacgccaccagaaagacccccagcgtgggcagccagggcgaccagtggtacctgggctaccccggcgaccagtggagcagcggcttcccctacagctggtggaagaacagcgtgggcagcgagagcaagcacggcgagggcgccctggaccagccccagcacgacgtgagactggaggacctgggcgagctgcacagagccgccagaagcggcgacgtgcccggcgtggagcacatcctggcccccggcgacaccggcgtggacaagagagacagaaagaagagcatccagcagctggtgcccgagtacaaggagaagcagacccccgagagcctgccccagaacaacaaccccgactggcaccccaccaacctgaccctgagcgacgagacctgccagagaagcaagaacctgaaggtggacgacaagtgccccagcgtgagccccagcatgcccgagaaccagagcgccaccaaggagctgggccagatgaacctgaccgagagagagaagatggacaccggcgtggtgctgctgagcggcaacgacaccctgcacgacctgtgccagagccagctgcccgagaacaaggagagcaaggaggccgagcaggacagcgagctgaccagcgaggaggagcaggagagactgaagggctgcgagaacaagcagccccaggtggaggaggagatggagaagcacagaagcaacagcaccgagctgagcggcaccctgaccgacggcaccaccgtgggcaacgacgacgacggcctgaaccagcagatccccagaaaggagaacggcgagcacgacagacccgccgacaagaccagcaacgagaagaacgaggtgaagaaccagatctaccccgaggccgacttcgccgacagcatggagcccagcgagatcgccagcgaggactgcgagctgagccacagcgtgtacgagaacttcatgctgctgatcgagcagctgagaatggagtacaaggacagcgccagcctgcccagaatccaggacaccttctgcctgtgcgagcacctgctgaagctgaagaacaaccactgcgaccagctgaccgtgaagctgaagcagatggagaacatggtgagcgtgctgcagaacgagctgagcgagaccaagaagaccaagctgcagctggagctgcagaagatcgagtgggagaaggagctgtacgacctgagactggccctgaagcaggagaacgaggagaagagaaacgccgacatgctgtacaacaaggacagcgagcagctgagaatcaaggaggaggagtgcggcaaggtggtggagaccaagcagcagctgaagtggaacctgagaagactggtgaaggagctgagaaccgtgagaaacaacctggacctggtggtgcaggagagaaacgacgcccagaagcagctgagcgaggagcaggacgccagaatcctgcaggaccagatcctgaccagcaagcagaaggagctggagatggccagaaagaagatgaacagcgagatcagccacagacaccagaaggagaaggacctgttccacgaggactgcatgctgcaggaggagatcgccctgctgagactggagatcgacaccatcaagaaccagaacaagcagaaggagaagaagtacttcgaggacatcgaggccgtgaaggagaagaacgacaacctgcagaagatcatcaagctgaacgaggagaccctgaccgagaccatcctgcagtacagcggccagctgaacaacctgaccgccgagaacaagatcctgaacagcgagctggagaacggcaagcagaaccaggagagactggagatcgagatggagagctacagatgcagactggccgccgccgtgagagactgcgaccagagccagaccgccagagacctgaagctggacttccagagaaccagacaggagtgggtgagactgcacgacaagatgaaggtggacatgagcggcctgcaggccaagaacgagatcctgagcgagaagctgagcaacgccgagagcaagatcaacagcctgcagatccagctgcacaacaccagagacgccctgggcagagagagcctgatcctggagagagtgcagagagacctgagccagacccagtgccagaagaaggagaccgagcagatgtaccagatcgagcagagcaagctgaagaagtacatcgccaagcaggagagcgtggaggagagactgagccagctgcagagcgagaacatgctgctgagacagcagctggacgacgcccacaagaaggccaacagccaggagaagaccagcagcaccatccaggaccagttccacagcgccgccaagaacctgcaggccgagagcgagaagcagatcctgagcctgcaggagaagaacaaggagctgatggacgagtacaaccacctgaaggagagaatggaccagtgcgagaaggagaaggccggcagaaaggtggtgatgagagagttccagcaggagtggaccgacctgctgaagcagcagcccaccagcgaggccaccagcagatgccacatcaacctggacgagacccaggacagcaagaagaagctgggccagatcagaagcgagatcgacctgaccgaggcccaggagaccgtgcccagcagatgcctgcacctggacgccgagaacgaggtgctgcagctgcagcagaccctgttcagcatgaaggccatccagaagcagtgcgagaccctgcagaagaacaagaagcagctgaagcaggaggtggtgaacctgaagagctacatggagagaaacatgctggagagaggcaaggccgagtggcacaagctgctgatcgaggagagagccagaaaggagatcgaggagaagctgaacgaggccatcctgaccctgcagaagcaggccgccgtgagccacgagcagctggtgcagctgagagaggacaacaccaccagcatcaagacccagatggagctgaccatcaaggacctggagagcgagatcagcagaatcaagaccagccaggccgacttcaacaagaccgagctggagagatacaaggagctgtacctggaggaggtgaaggtgagagagagcctgagcaacgagctgagcagaaccaacgagatgatcgccgaggtgagcacccagctgaccgtggagaaggagcagaccagaagcagaagcctgttcaccgcctacgccaccagacccgtgctggagagcccctgcgtgggcaacctgaacgacagcgagggcctgaacagaaagcacatccccagaaagaagagaagcgccctgaaggacatggagagctacctgctgaaggtgagctacctgttcagcttcggcgtgcagatcagcgacagaatcctggtgtgctacctggtgaagtag

SEQ ID NO: 19981 - DNA, 681 bp, Artificial Sequence
  Description of Artificial Sequence: Synthetic coding sequence
atggtgagctggggcggcgagaagagaggcggcgccgagggcagccccaagcccgccgtgtacgccaccagaaagaccggcagcgtgagaagccaggaggaccagtggtacctgggctaccccggcgaccagtggagcagcggcttcagctacagctggtggaagaacagcgtgggcagcgagagcaagcacggcgagggcgccctggaccagccccagcacgacgtgagactggaggacctgggcgagctgcacagagccgccagaagcggcgacgtgcccggcgtggagcacgtgctggtgcccggcgacaccggcgtggacaagagagacagaaagaagagcatccagcagctggtgcccgagtacaaggagaagcagacccccgagagcctgccccagaacaacaaccccgactggcaccccaccaacctgaccctgagcgacgagacctgccagagaagcaagaacctgaaggtggacgacaagtgccccagcgtgagccccagcatgcccgagaaccagagcgccaccaaggagctgggccagatgaacctgaccgagagagagaagatggacaccggcgtggtgctgctgagcggcaacgacaccctgcacgacctgtgccagagccagctgcccgagaacaaggagagcaaggagggcaacaaggaggcctag

SEQ ID NO: 19982 - DNA, 3714 bp, Artificial Sequence
  Description of Artificial Sequence: Synthetic coding sequence
atggtgagctggggcggcgagaagagaggcggcgccgagggcagccccaagcccgccgtgtacgccaccagaaagaccggcagcgtgagaagccaggaggaccagtggtacctgggctaccccggcgaccagtggagcagcggcttcagctacagctggtggaagaacagcgtgggcagcgagagcaagcacggcgagggcgccctggaccagccccagcacgacgtgagactggaggacctgggcgagctgcacagagccgccagaagcggcgacgtgcccggcgtggagcacgtgctggtgcccggcgacaccggcgtggacaagagagacagaaagaagagcatccagcagctggtgcccgagtacaaggagaagcagacccccgagagcctgccccagaacaacaaccccgactggcaccccaccaacctgaccctgagcgacgagacctgccagagaagcaagaacctgaaggtggacgacaagtgccccagcgtgagccccagcatgcccgagaaccagagcgccaccaaggagctgggccagatgaacctgaccgagagagagaagatggacaccggcgtgaagaccagccaggagcccgagatggccaaggactgcgacagagaggacatccccatctaccccgtgctgccccacgtgcagaagagcgaggagatgagaatcgagcagggcaagctggagtggaagaaccagctgaagctggtgatcaacgagctgaagcagagattcggcgagatctacgagaagtacaagatccccgcctgccccgaggaggagcccctgctggacaacagcaccagaggcaccgacgtgaaggacatccccttcaacctgaccaacaacatccccggctgcgaggaggaggacgccagcgagatcagcgtgagcgtggtgttcgagaccttccccgagcagaaggagcccagcctgaagaacatcatccacagctactaccacccctacagcggcagccaggagcacgtgtgccagagcagcagcaagctgcacctgcacgagaacaagctggactgcgacaacgacaacaagcccggcatcggccacatcttcagcaccgacaagaacttccacaacgacgccagcaccaagaaggccagaaaccccgaggtggtgaccgtggagatgaaggaggaccaggagttcgacctgcagatgaccaagaacatgaaccagaacagcgacagcggcagcaccaacaactacaagagcctgaagcccaagctggagaacctgagcagcctgccccccgacagcgacagaaccagcgaggtgtacctgcacgaggagctgcagcaggacatgcagaagttcaagaacgaggtgaacaccctggaggaggagttcctggccctgaagaaggagaacgtgcagctgcacaaggaggtggaggaggagatggagaagcacagaagcaacagcaccgagctgagcggcaccctgaccgacggcaccaccgtgggcaacgacgacgacggcctgaaccagcagatccccagaaaggagaacggcgagcacgacagactggccctgaagcaggagaacgaggagaagagaaacgccgacatgctgtacaacaaggacagcgagcagctgagaatcaaggaggaggagtgcggcaaggtggtggagaccaagcagcagctgaagtggaacctgagaagactggtgaaggagctgagaaccgtggtgcaggagagaaacgacgcccagaagcagctgagcgaggagcaggacgccagaatcctgcaggaccagatcctgaccagcaagcagaaggagctggagatggcccagaagaagagaaaccccgagatcagccacagacaccagaaggagaaggacctgttccacgagaactgcatgctgcaggaggagatcgccctgctgagactggagatcgacaccatcaagaaccagaacaagcagaaggagaagaagtacttcgaggacatcgaggtggtgaaggagaagaacgacaacctgcagaagatcatcaagagaaacgaggagaccctgaccgagaccatcctgcagtacagcggccagctgaacaacctgaccgccgagaacaagatgctgaacagcgagctggagaacggcaaggagaaccaggagagactggagatcgagatggagagctacagatgcagactggccgccgccgtgcacgactgcgaccagagccagaccgccagagacctgaagctggacttccagagaaccagacaggagtgggtgagactgcacgacaagatgaaggtggacatgagcggcctgcaggccaagaacgagatcctgagcgagaagctgagcaacgccgagagcaagatcaacagcctgcagatccagctgcacaacaccagagacgccctgggcagagagagcctgatcctggagagagtgcagagagacctgagccagacccagtgccagaagaaggagaccgagcagatgtaccagagcaagctgaagaagtacatcgccaagcaggagagcgtggaggagagactgagccagctgcagagcgagaacatgctgctgagacagcagctggacgacgtgcacaagaaggccaacagccaggagaagaccatcagcaccatccaggaccagttccacagcgccgccaagaacctgcaggccgagagcgagaagcagatcctgagcctgcaggagaagaacaaggagctgatggacgagtacaaccacctgaaggagagaatggaccagtgcgagaaggagaaggccggcagaaagatcgacctgaccgaggcccaggagaccgtgcccagcagatgcctgcacctggacgccgagaacgaggtgctgcagctgcagcagaccctgttcagcatgaaggccatccagaagcagtgcgagaccctgcagaagaacaagaagcagctgaagcaggaggtggtgaacctgaagagctacatggagagaaacatgctggagagaggcgaggccgagtggcacaagctgctgatcgaggagagagccagaaaggagatcgaggagaagctgaacgaggccatcctgaccctgcagaagcaggccgccgtgagccacgagcagctggcccagctgagagaggacaacaccaccagcatcaagacccagatggagctgaccgtgatcgacctggagagcgagatcagcagaatcaagaccagccaggccgacttcaacaagaccaagctggagagatacaaggagctgtacctggaggaggtgaaggtgagagagagcctgagcaacgagctgagcagaaccaacgagatgatcgccgaggtgagcacccagctgaccgtggagaaggagcagaccagaagcagaagcctgttcaccgcctacgccaccagacccgtgctggagagcccctgcgtgggcaacctgaacgacagcgagggcctgaacagaaagcacatccccagaaagaagagaagcgccctgaaggacatggagagctacctgctgaagatgcagcagaagctgcagaacgacctgaccgccgaggtggccggcagcagccagaccggcctgcacagaatcccccagtgcagcagcttcagcagcagcagcctgcacctgctgctgtgcagcatctgccagcccttcttcctgatcctgcagctgctgctgaacatgaacctggaccccatctag

SEQ ID NO: 19983 - DNA, 2868 bp, Artificial Sequence
  Description of Artificial Sequence: Synthetic coding sequence
atggaggacagcagcaccgacaccgagaaggaggaggaggaggagaaggacgagaaggaccaggagcccatctacgccatcgtgcccaccatcaacatccaggacgagagattcgtggacctgagcgagacccccgccttcatcttcctgcacgagctgcacgccatgggcaagctgcccggcaccagaatggccgccctgaaggccaagtacaccctgctgcacgacgccgtgatgagcacccaggagagcgaggtgcagctgctgcagaacgccaagagattcaccgagcagatccagcagcagcagttccacctgcagcaggccgacaacttccccgaggccttcagcaccgaggtgagcaagatgagagagcagctgctgaagtaccagaacgagtacaacgccgtgaaggagagagagttccacaaccagtacagactgaacagcctgaaggaggagaagatcatcatcgtgaaggagttcgagaagatcaccaagcccggcgagatggagaagaagatgaagatcctgagagagagcaccgaggagctgagaaaggagatcatgcagaagaagctggagatcaagaacctgagagaggacctggccagcaagcagaagcagctgctgaaggagcagaaggagctggaggagctgctgggccaccaggtggtgctgaaggacgaggtggcccaccaccagaccatccccgtgcagatcggcaaggagatcgagaagatcaccagaaagaaggtggagatggagaagaagaagatcgtgctggagcaggaggtgaagaccctgaacgacagcctgaagaaggtggagaacaaggtgagcgccatcgtggacgagaaggagaacgtgatcaaggaggtggagggcaagagagccctgctggagatcaaggagagagagcacaaccagctggtgaagctgctggagctggccagagagaacgaggccaccagcctgaccgagagaggcatcctggacctgaacctgagaaacagcctgatcgacaagcagaactaccacgacgagctgagcagaaagcagagagagaaggagagagacttcagaaacctgagaaagatggagctgctgctgaaggtgagctgggacgccctgagacagacccaggccctgcaccagagactgctgctggagatggaggccatccccaaggacgacagcaccctgagcgagagaagaagagagctgcacaaggaggtggaggtggccaagagaaacctggcccagcagaagatcatcagcgagatggagagcaagctggtggagcagcagctggccgaggagaacaagctgctgaaggagcaggagaacatgaaggagctggtggtgaacctgctgagaatgacccagatcaagatcgacgagaaggagcagaagagcaaggacttcctgaaggcccagcagaagtacaccaacatcgtgaaggagatgaaggccaaggacctggagatcagaatccacaagaagaagaagtgcgagatctacagaagactgagagagttcgccaagctgtacgacaccatcagaaacgagagaaacaagttcgtgaacctgctgcacaaggcccaccagaaggtgaacgagatcaaggagagacacaagatgagcctgaacgagctggagatcctgagaaacagcgccgtgagccaggagagaaagctgcagaacagcatgctgaagcacgccaacaacgtgaccatcagagagagcatgcagaacgacgtgagaaagatcgtgagcaagctgcaggagatgaaggagaagaaggaggcccagctgaacaacatcgacagactggccaacaccatcaccatgatcgaggaggagatggtgcagctgagaaagagatacgagaaggccgtgcagcacagaaacgagagcggcgtgcagctgatcgagagagaggaggagatctgcatcttctacgagaagatcaacatccaggagaagatgaagctgaacggcgagatcgagatccacctgctggaggagaagatccagttcctgaagatgaagatcgccgagaagcagagacagatctgcgtgacccagaagctgctgcccgccaagagaagcctggacgccgacctggccgtgctgcagatccagttcagccagtgcaccgacagaatcaaggacctggagaagcagttcgtgaagcccgacggcgagaacagagccagattcctgcccggcaaggacctgaccgagaaggagatgatccagaagctggacaagctggagctgcagctggccaagaaggaggagaagctgctggagaaggacttcatctacgagcaggtgagcagactgaccgacagactgtgcagcaagacccagggctgcaagcaggacaccctgctgctggccaagaagatgaacggctaccagagaagaatcaagaacgccaccgagaagatgatggccctggtggccgagctgagcatgaagcaggccctgaccatcgagctgcagaaggaggtgagagagaaggaggacttcatcttcacctgcaacagcagaatcgagaagggcctgcccctgaacaaggagatcgagaaggagtggctgaaggtgctgagagacgaggagatgcacgccctggccatcgccgagaagagccaggagttcctggaggccgacaacagacagctgcccaacggcgtgtacaccaccgccgagcagagacccaacgcctacatccccgaggccgacgccaccctgcccctgcccaagccctacggcgccctggcccccttcaagcccagcgagcccggcgccaacatgagacacatcagaaagcccgtgatcaagcccgtggagatctag

SEQ ID NO: 19984 - DNA, 513 bp, Artificial Sequence
  Description of Artificial Sequence: Synthetic coding sequence
atggaggacagcagcaccgacaccgagaaggaggaggaggaggagaaggacgagaaggaccaggagcccatctacgccatcgtgcccaccatcaacatccaggacgagagattcgtggacctgagcgagacccccgccttcatcttcctgcacgagctgcacgccatgggcaagctgcccggcaccagaatggccgccctgaaggccaagtacaccctgctgcacgacgccgtgatgagcacccaggagagcgaggtgcagctgctgcagaacgccaagagattcaccgagcagatccagcagcagcagttccacctgcagcaggccgacaacttccccgaggccttcagcaccgaggtgagcaagatgagagagcagctgctgaagtaccagaacgagtacaacgccgtgaaggagagagagttccacaaccagtacagactgaacagcctgaaggaggagaagatcatcatcgtgaaggagttcgagaagatcaccaagcccggcgtgtag

SEQ ID NO: 19985 - DNA, 2010 bp, Artificial Sequence
  Description of Artificial Sequence: Synthetic coding sequence
atggagaagaagaagatcgtgctggagcaggaggtgaagaccctgaacgacagcctgaagaaggtggagaacaaggtgagcgccatcgtggacgagaaggagaacgtgatcaaggaggtggagggcaagagagccctgctggagatcaaggagagagagcacaaccagctggtgaagctgctggagctggccagagagaacgaggccaccagcctgaccgagagaggcatcctggacctgaacctgagaaacagcctgatcgacaagcagaactaccacgacgagctgagcagaaagcagagagagaaggagagagacttcagaaacctgagaaagatggagctgctgctgaaggtgagctgggacgccctgagacagacccaggccctgcaccagagactgctgctggagaagatcatcagcgagatggagagcaagctggtggagcagcagctggccgaggagaacaagctgctgaaggagcaggagaacatgaaggagctggtggtgaacctgctgagaatgacccagatcaagatcgacgagaaggagcagaagagcaaggacttcctgaaggcccagcagaagtacaccaacatcgtgaaggagatgaaggccaaggacctggagatcagaatccacaagaagaagaagtgcgagatctacagaagactgagagagttcgccaagctgtacgacaccatcagaaacgagagaaacaagttcgtgaacctgctgcacaaggcccaccagaaggtgaacgagatcaaggagagacacaagatgagcctgaacgagctggagatcctgagaaacagcgccgtgagccaggagagaaagctgcagaacagcatgctgaagcacgccaacaacgtgaccatcagagagagcatgcagaacgacgtgagaaagatcgtgagcaagctgcaggagatgaaggagaagaaggaggcccagctgaacaacatcgacagactggccaacaccatcaccatgatcgaggaggagatggtgcagctgagaaagagatacgagaaggccgtgcagcacagaaacgagagcggcgtgcagctgatcgagagagaggaggagatctgcatcttctacgagaagatcaacatccaggagaagatgaagctgaacggcgagatcgagatccacctgctggaggagaagatccagttcctgaagatgaagatcgccgagaagcagagacagatctgcgtgacccagaagctgctgcccgccaagagaagcctggacgccgacctggccgtgctgcagatccagttcagccagtgcaccgacagaatcaaggacctggagaagcagttcgtgaagcccgacggcgagaacagagccagattcctgcccggcaaggacctgaccgagaaggagatgatccagaagctggacaagctggagctgcagctggccaagaaggaggagaagctgctggagaaggacttcatctacgagcaggtgagcagactgaccgacagactgtgcagcaagacccagggctgcaagcaggacaccctgctgctggccaagaagatgaacggctaccagagaagaatcaagaacgccaccgagaagatgatggccctggtggccgagctgagcatgaagcaggccctgaccatcgagctgcagaaggaggtgagagagaaggaggacttcatcttcacctgcaacagcagaatcgagaagggcctgcccctgaacaaggagatcgagaaggagtggctgaaggtgctgagagacgaggagatgcacgccctggccatcgccgagaagagccaggagttcctggaggccgacaacagacagctgcccaacggcgtgtacaccaccgccgagcagagacccaacgcctacatccccgaggccgacgccaccctgcccctgcccaagccctacggcgccctggcccccttcaagcccagcgagcccggcgccaacatgagacacatcagaaagcccgtgatcaagcccgtggagatctag

SEQ ID NO: 19986 - DNA, 279 bp, Artificial Sequence
  Description of Artificial Sequence: Synthetic coding sequence
atggacgagctgctgagagagagagacatcctgaacaagaacatgctgaaggccgtgaacgccacccagaagcagaccgacctggtgaagctgcacgagcaggccaagagaaacctggagggcgagatccagaactacaaggacgaggcccagaagcagagaaagatcatcttccacctggagaaggagagagacagatacatcaaccaggccagcgacctgacccagaaggccgacagcgtgagaatgccctggcccctggacaagggcaagtggtag

SEQ ID NO: 19987 - DNA, 279 bp, Artificial Sequence; identical to SEQ ID NO: 19986
  Description of Artificial Sequence: Synthetic coding sequence

SEQ ID NO: 19988 - DNA, 2619 bp, Artificial Sequence
  Description of Artificial Sequence: Synthetic coding sequence
atggccgaggagaagggcggcaagcaggtgctggaggagagcgccttcgaggagatggagagagacttccagggcgtgctgcacgagctgagcggcgacaagagcctggagaagttcagaatcgagtacgagagactgcacgccgtgatgaagaagagctacgacaacgagaagagactgatggccaagtgcagagagctgaacgccgagatcgtggtgaacagcgccaaggtggccaccgccctgaagctgagccaggacgaccagaccaccatcgccagcctgaagaaggagatcgagaaggcctggaagatggtggacagcgcctacgacaaggagcagaaggccaaggagaccatcctggccctgaaggaggagatcgtgaacctgaccaagctggtggagcagggcagcggcctgagcatggaccagcacagcaacatcagagacctgctgagattcaaggaggaggtgaccaaggagagagaccagctgctgagcgaggtggtgaagctgagagagagcctggcccagaccaccgagcagcagcaggagaccgagagaagcaaggaggaggccgagcacgccatcagccagttccagcaggagatccagcagagacagaacgaggccagcagagagttcagaaagaaggagaagctggagaaggagctgaagcagatccaggccgacatggacagcagacagaccgagatcaaggccctgcagcagtacgtgcagaagagcaaggaggagctgcagaagctggagcagcagctgaaggagcagaagatcctgaacgagagagccgccaaggagctggagcagttccagatgagaaacgccaagctgcagcaggagaacgagcagcacagcctggtgtgcgagcagctgagccaggagaaccagcagaaggccctggagctgaaggccaaggaggaggaggtgcaccagatgagactggacatcggcaagctgaacaagatcagagagcagatccacaagaagctgcaccacaccgaggaccagaaggccgaggtggagcagcacaaggagaccctgaagaaccagatcgtgggcctggagagagaggtggaggccagcaagaagcaggccgagctggacagaaaggccatggacgagctgctgagagagagagacatcctgaacaagaacatgctgaaggccgtgaacgccacccagaagcagaccgacctggtgaagctgcacgagcaggccaagagaaacctggagggcgagatccagaactacaaggacgaggcccagaagcagagaaagatcatcttccacctggagaaggagagagacagatacatcaaccaggccagcgacctgacccagaaggtgctgatgaacatggaggacatcaaggtgagagagacccagatcttcgactacagaaagaagatcgccgagagcgagatcaagctgaagcagcagcagaacctgtacgaggccgtgagaagcgacagaaacctgtacagcaagaacctggtggaggcccaggacgagatcaccgacatgaagagaaagctgaagatcatgatccaccaggtggacgagctgaaggaggacatcagcgccaaggagagcgccctggtgaagctgcacctggagcagcagagaatcgagaaggagaaggagaccctgaaggccgagctgcagaagctgagacagcaggccctggagaccaagcacttcatcgagaagcaggaggccgaggagagaaagctgctgagaatcatcgccgaggccgacggcgagagactgagacagaagaaggagctggaccaggtgatcagcgagagagacatcctgggcagccagctggtgagaagaaacgacgagctggccctgctgtacgagaagatcaagatccagcagagcgtgctgaacaagggcgagagccagtacaaccagagactggaggacatgagaatcctgagactggagatcaagaagctgagaagagagaagggcatcctggccagaagcatggccaacgtggaggagctgagacaggagttcttccacatgcagagagagctgctgaaggagagaaccagatgcagagccctggaggaggagctggagaaccccctgaacgtgcacagatggagaaagctggaggccagcgaccccaacgcctacgagctgatccagaagatccacaccctgcagaagagactgatcagcaagaccgaggaggtggtggagaaggagctgctgctgcaggagaaggagaagctgtacatggagctgaagcacgtgctggccagacagcccggccccgaggccgccgagcagctgaagctgtacagaagaaccctgcacgacaagaagcagcagctgaaggtgctgagcagcgagctgaacatgtacgaggtgcagagcaaggagtacaagtacgaggtggagaagctgaccaacgagctgcagaacctgaagaagaagtacctggcccagaagagaaaggagcagctgcagaagaacaaggacaccgcccccatggacaacaccttcctgatggtgaagcccaacggccccggcttcaccggcggcggcttccccctgagaagcaccaagatgaccttctag

SEQ ID NO: 19989 - DNA, 1776 bp, Artificial Sequence
  Description of Artificial Sequence: Synthetic coding sequence
atgtgcgccgccagcgccagccccgacaacctggtgttccacatgaagaacgagatgagaaacatcaagtacaagcccgtggactaccagcagctgagagccctgaccgaggccaagaagctggccagcgccagcgccaagctgaagatcagaaaggccatgctgaccagcaagctgagcaaggagcagaccctgatcaagcagcacaagcaggtgtggtggcaggagtaccagagactgaacgaggtgagatgcaagatggagagcgagatcaagagcctgctgaacgaggagaacatcggcaacgagtgcctgtgcgacctgaccaacttcgagcaggagctgagcgagcagcagtgcacctacctgaagaacgtgatcaaccccatccagcagctgagagccgacctgaagtacagacagcaccacaccctgcagcacagccacccccacatcgagttcaacagcatgaaggtgctggaggaggtggacttcgtgaagaagcagctgaagaccgtgttcgagagactgagactggagcagcagagaatcgagaacgacctgagcgactggagcatcaagatcctggaccacagcctggaggagaagaccaaccccctgagcgagctgcccatcgagctggagagcctggagtgcccctaccccgacctgaagagcagcatcctgagcgagttctacaagttcacccagaagtaccagaagaagctgcaggacttcaacctgcagctggaggacatctacagaaactgccagctgagcgaggaggaccactggatctaccaggccatcctggaccagtaccccggcgacctgttcggcagaagaaccctgtacctggacatgctgcagagatacttcccccacaagagcagacacgacctggtggagcacgagaagtactgcgaccagtacagattcgccatcgagcagcagaacatcctgatcagcaactggaacaagaacaagaaggacttcatccagaaggccgtgctgaccctgaccgaggcctgcgccacccacgagatggagagcatgctggccaaggacaagaagaagcagcaggagctgtgcgccgacctgaaggccaaggtgagacagtggagagcccaccaggaggaggtggccagactggagatggagatcagcgccagaagaagagagaaggaggaggagaaggagaagctgtggaagaagaaggagctgctgcagagagccgagaagaagaagaagatcaagaagtactgggccaagaagaagcagaagtggcaggagatggagatgagagacctgcagagactggaggagctgaagaagctgatcgccgagcagagcctgaaggacagagagagagtgaagtacagacaggagctgctggagagaagactgatggagaagaaggaggtggccctgcaggaggcccacgaggacaaggagagagccagaagactggaggccctgagaaagcaggtggccgtggtggcccagttcgaccccgtgagaatgatgagcgacaccatggccagcaaggccagaatgggcatcgagatcgaggaggagttcatcctgcagaagcccctgttcaccctgaacacctacaacgagcagcagatcatcagcgaccccagactgagattcgagctggccctgagagaggccggcctgcacagaaccctgtacgccaaggagatcctgcccaagatcagcccccagaagccccccagaaaggacatggagagcaccgtgttcaagatctag

SEQ ID NO: 19990 - DNA, 795 bp, Artificial Sequence
  Description of Artificial Sequence: Synthetic coding sequence
atgaacgtgttcgtgaccctgcagatcctggtggacttcgtgaagaagcagctgaagaccgtgttcgagagactgagactggagcagcagagaatcgagaacgacctgagcgactggagcatcaagatcctggaccacagcctggaggagaagaccaaccccctgagcgagctgcccatcgagctggagagcctggagtgcccctaccccgacctgaagagcagcatcctgagcgagttctacaagttcacccagaagtaccagaagaagctgcaggacttcaacctgcagctggaggacatctacagaaactgccagctgagcgaggaggaccactggatctaccaggccatcctggaccagtaccccggcgacctgttcggcagaagaaccctgtacctggacatgctgcagagatacttcccccacaagagcagacacgacctggtggagcacgagaagtactgcgaccagtacagattcgccatcgagcagcagaacatcctgatcagcaactggaacaagaacaagaaggacttcatccagaaggccgtgctgaccctgaccgaggcctgcgccacccacgagatggagagcatgctggccaaggacaagaagaagcagcaggagctgtgcgccgacctgaaggccaaggtgagacagtggagagcccaccaggaggaggtggccagactggagatggagatcagcgccagaagaagagagaaggaggaggagaaggagaagctgtggaagaagaaggagctgctgcagagagccgagaagaagaagtag

SEQ ID NO: 19991 - DNA, 900 bp, Artificial Sequence
  Description of Artificial Sequence: Synthetic coding sequence
atggagagcgagatcaagagcctgctgaacgaggagaacatcggcaacgagtgcctgtgcgacctgaccaacttcgagcaggagctgagcgagcagcagtgcacctacctgaagaacgtgatcaaccccatccagcagctgagagccgacctgaagtacagacagcaccacaccctgcagcacagccacccccacatcgagttcaacagcatgaaggtgctggaggaggtggacttcgtgaagaagcagctgaagaccgtgttcgagagactgagactggagcagcagagaatcgagaacgacctgagcgactggagcatcaagatcctggaccacagcctggaggagaagaccaaccccctgagcgagctgcccatcgagctggagagcctggagtgcccctaccccgacctgaagagcagcatcctgagcgagttctacaagttcacccagaagtaccagaagaagctgcaggacttcaacctgcagctggaggacatctacagaaactgccagctgagcgaggaggaccactggatctaccaggccatcctggaccagtaccccggcgacctgttcggcagaagaaccctgtacctggacatgctgcagagatacttcccccacaagagcagacacgacctggtggagcacgagaagtactgcgaccagtacagattcgccatcgagcagcagaacatcctgatcagcaactggaacaagaacaagaaggacttcatccagaaggccgtgctgaccctgaccgaggcctgcgccacccacgagatggagagcatgctggccaaggacaagaagaagcagcaggagctgtgcgccgacctgaaggccaagagccaggtgtgcctgtaccagcagcacgagaacggcctgatccagtag

SEQ ID NO: 19992 - DNA, 1362 bp, Artificial Sequence
  Description of Artificial Sequence: Synthetic coding sequence
atggagatccaccacttcctgctgaagagaaagcaggccaacctggcccagctgctgagagacagccaggacagaaacaagcacctgggcgaggagatcaaggagctgcagcagagactgggcgaggtgcagggcgacaacaagctgctgagaatgaccatcgccaagcagagactgggcgacgaggccatcggcgtgagacacttcgccgcccacgagagagaggacctggtgcagcagctggagagagccaaggagcagatcgagagcctggagcacgacctgcaggccagcgtggacgagctgcaggacgtgaaggaggagagaagcagctaccaggacaaggtggagagactgaaccaggagctgaaccacatcctgagcggccacgagaacagaatcatcgacgtggacgccctgtgcatggagaacagatacctgcaggagagactgaagcagctgcacgaggaggtgaacctgctgaagagcaacatcgccaagtacaagaacgccctggagagaagaaagaacagcaagggccagggcaagagcagcagcagcgccctgaccggcgtgctgagcgccaagcaggtgcaggacctgctgagcgaggaccacggctgcagcctgcccgccaccccccagagcatcagcgacctgaagagcctggccaccgccctgctggagaccatccacgagaagaacatggtgatccagcaccagagacagaccaacaagatcctgggcaacagagtggccgagctggagaagaagctgagaaccctggaggtgagcggcctgtggagcctgcccggcggcaaggacaccatcctgttcagcgaccccaccctgcccagcggccagagaagcagaagccccctgctgaagttcgtggagcagcccaccgagaacaaggccgaccccaaggacggcgaggcccagaagcaggaggaggacgagagctgcgccgccgccgaggccctgaccgcccccgaggacgccggcagacccgccgtgaacagccccgccaaccagagcagaggcaaccagtgcaagctgttccaccccagcctgccccagctgcccagcgaggaggaggtgaacagcctgggcagagagatcatcaagctgaccaaggagcaggccgccgccgagctggaggaggtgagaagagagagccccatcgagggccagagaagcgagaccggccccgccccccccggcctggccatccagggcgagctgcccaagagccacctggacagcttcgaggccagcagacccgccgccaaggccagcacccccgaggacggcaagggcatccccgagggcggcggcatgagaagcaccgtgaagacctag

SEQ ID NO: 19993 - DNA, 261 bp, Artificial Sequence
  Description of Artificial Sequence: Synthetic coding sequence
atggccaaccagctgagagagagacaccagagcctgaagaagaagtacagagagctgatcgacggcgaccccagcctgccccccgagaagagaaagcaggccaacctggcccagctgctgagagacagccaggacagaaacaagcacctgggcgaggagatcaaggagctgcagcagagactgggcgaggtgcagggcgacaacaagggcagactgagaagcaagaagaagatgaaggtggtgcccctgctgagaagatag

SEQ ID NO: 19994 - DNA, 1590 bp, Artificial Sequence
  Description of Artificial Sequence: Synthetic coding sequence
atggaggaggaggccatgaacggcgacagaaccgagagcgactggcagggcctggtgagcgagtacctggtgtgcaagagaaagctggagagcaagaaggaggccctgctgatcctgagcaaggagctggacacctgccagcaggagagagaccagtacaagctgatggccaaccagctgagagagagacaccagagcctgaagaagaagtacagagagctgatcgacggcgaccccagcctgccccccgagaagagaaagcaggccaacctggcccagctgctgagagacagccaggacagaaacaagcacctgggcgaggagatcaaggagctgcagcagagactgggcgaggtgcagggcgacaacaagctgctgagaatgaccatcgccaagcagagactgggcgacgaggccatcggcgtgagacacttcgccgcccacgagagagaggacctggtgcagcagctggagagagccaaggagcagatcgagagcctggagcacgacctgcaggccagcgtggacgagctgcaggacgtgaaggaggagagaagcagctaccaggacaaggtggagagactgaaccaggagctgaaccacatcctgagcggccacgagaacagaatcatcgacgtggacgccctgtgcatggagaacagatacctgcaggagagactgaagcagctgcacgaggaggtgaacctgctgaagagcaacatcgccaagtacaagaacgccctggagagaagaaagaacagcaagggccagggcaagagcagcagcagcgccctgaccggcgtgctgagcgccaagcaggtgcaggacctgctgagcgaggaccacggctgcagcctgcccgccaccccccagagcatcagcgacctgaagagcctggccaccgccctgctggagaccatccacgagaagaacatggtgatccagcaccagagacagaccaacaagatcctgggcaacagagtggccgagctggagaagaagctgagaaccctggaggtgagcggcctgtggagcctgcccggcggcaaggacaccatcctgttcagcgaccccaccctgcccagcggccagagaagcagaagccccctgctgaagttcgtggagcagcccaccgagaacaaggccgaccccaaggacggcgaggcccagaagcaggaggaggacgagagctgcgccgccgccgaggccctgaccgcccccgaggacgccggcagacccgccgtgaacagccccgccaaccagagcagaggcaaccagtgcaagctgttccaccccagcctgccccagctgcccagcgaggaggaggtgaacagcctgggcagagagatcatcaagctgaccaaggagcaggccgccgccgagctggaggaggtgagaagagagagccccatcgagggccagagaagcgagaccggccccgccccccccggcctggccatccagggcgagctgcccaagagccacctggacagcttcgaggccagcagacccgccgccaaggccagcacccccgaggacggcaagggcatccccgagggcggcggcatgagaagcaccgtgaagacctag

SEQ ID NO: 19995 - DNA, 1590 bp, Artificial Sequence
  Description of Artificial Sequence: Synthetic coding sequence
atggtggtgatcgtggtggtgatcatcatcatcatcgccagagccgccacctgggacagcgagtacctggtgtgcaagagaaagctggagagcaagaaggaggccctgctgatcctgagcaaggagctggacacctgccagcaggagagagaccagtacaagctgatggccaaccagctgagagagagacaccagagcctgaagaagaagtacagagagctgatcgacggcgaccccagcctgccccccgagaagagaaagcaggccaacctggcccagctgctgagagacagccaggacagaaacaagcacctgggcgaggagatcaaggagctgcagcagagactgggcgaggtgcagggcgacaacaagctgctgagaatgaccatcgccaagcagagactgggcgacgaggccatcggcgtgagacacttcgccgcccacgagagagaggacctggtgcagcagctggagagagccaaggagcagatcgagagcctggagcacgacctgcaggccagcgtggacgagctgcaggacgtgaaggaggagagaagcagctaccaggacaaggtggagagactgaaccaggagctgaaccacatcctgagcggccacgagaacagaatcatcgacgtggacgccctgtgcatggagaacagatacctgcaggagagactgaagcagctgcacgaggaggtgaacctgctgaagagcaacatcgccaagtacaagaacgccctggagagaagaaagaacagcaagggccagggcaagagcagcagcagcgccctgaccggcgtgctgagcgccaagcaggtgcaggacctgctgagcgaggaccacggctgcagcctgcccgccaccccccagagcatcagcgacctgaagagcctggccaccgccctgctggagaccatccacgagaagaacatggtgatccagcaccagagacagaccaacaagatcctgggcaacagagtggccgagctggagaagaagctgagaaccctggaggtgagcggcctgtggagcctgcccggcggcaaggacaccatcctgttcagcgaccccaccctgcccagcggccagagaagcagaagccccctgctgaagttcgtggagcagcccaccgagaacaaggccgaccccaaggacggcgaggcccagaagcaggaggaggacgagagctgcgccgccgccgaggccctgaccgcccccgaggacgccggcagacccgccgtgaacagccccgccaaccagagcagaggcaaccagtgcaagctgttccaccccagcctgccccagctgcccagcgaggaggaggtgaacagcctgggcagagagatcatcaagctgaccaaggagcaggccgccgccgagctggaggaggtgagaagagagagccccatcgagggccagagaagcgagaccggccccgccccccccggcctggccatccagggcgagctgcccaagagccacctggacagcttcgaggccagcagacccgccgccaaggccagcacccccgaggacggcaagggcatccccgagggcggcggcatgagaagcaccgtgaagacctag

SEQ ID NO: 19996 - DNA, 2247 bp, Artificial Sequence
  Description of Artificial Sequence: Synthetic coding sequence
atgagcctgcacgaggccagcgagaaggcccaggtgctgaacgaccagctgaccaagaagtgcagcgagctgagctgcatgctgcagaccgtgaccatggagaaggccagaatcatcgccgaccaccaggccatcctgcaggtggagcagaagatgatgacccagaccttccaggagcagaacctgctgctggacgccgcccacgccagcatcaccaacgagctgcagaccgtgcagaacgagaagacccagctgcaggcccacctggaccacctgatcctggagcacaaccagtgcatccagaaggcccaggacgccgagaagagaaccgccgtgcagaaggagctgctggagagcaccatcgccagactgagaggcgagctggaggccagcatgcaggagaagaagagcctgctggaggagaaggagagattccagagagaggtgaacaagaccgagaaggagatcgtgcaggagagatgcaacctggagaaggagctggccaagaacaaggtggacatcaacaccctgacccacaacctgcagaccctggaggaggagaacaagcacctggccgaccagatggccagcctggagctgcagcaggtgaccagcgactaccacggcctggcccagcagaaggtggagaagatcaccgagagcaagaacaagctggcctacgagaacggcaagctgcagatcaaggtgaagcagctggaggagcaggtgcagagcttcaccgacaccagcctgcagaacgaccacctgagaaagatgaacaagtacctgcagaccaagtacgcccaggtgaagagcatcctggagagaagcaaggaggagctgagcagaaccgtgaagtgcagaaacgccgccctgaaggagagccagaagctgaaggaggacctggaggccgtggaggacagagagaacaagaaggtgggcaacttccagagacagctggccgaggccaaggaggacaactgcaaggtgaccatcatgctggagaacgtgctggccagccacagcaagatgcagggcgccctggagaaggtgcagatcgagctgggcagaagagacagcgagatcgccggcctgaagaaggagagagacctgaaccagcagagagtgcagaagctggaggccgaggtggaccagtggcaggccagaatgctggtgatggaggaccagcacaacagcgagatcgagagcctgcagaaggccctgggcgtggccagagaggacaacagaaagctggccatgagcctggagcaggccctgcagaccaacaaccacctgcagaccaagctggaccacatccaggagcagctggagagcaaggagctggagagacagaacctggagaccttcaaggacagaatgaccgaggagagcaaggtggaggccgagctgcacgccgagagaatcgaggccctgagaaagcagttccagaccgagagagagaccaccaagaaggtggcccagagagaggtggccgagctgaagaaggccctggacgaggccaacttcagaagcgtggaggtgagcagaaccaacagagagctgagacagaagctggccgagctggagaagatcctggagagcaacaaggagaagatcaagaaccagaagacccagatcaagctgcacctgagcgccaaggccaacaacgcccagaacatcgagagaatgaagcagatcgagaaggagctgaagcagatggagctgatcaaggaccagtaccagaagaagaactacgagcagagcctgagcatccagagattcgtgtgcgagatgaccaacctgcagaaggagatgcagatgctggccaagagccagtacgacgccagcgtgagaaacaagcagcaggagctgcacctggaggccgagagaaagatcagacaggagctggagaacagatgccaggagctggaggagaccgtgagacacctgaagaagtgcaaggaggccaccgagaacaccctgaaggaggccagcgtggagagcgagcagatcaccgccaacctggaggaggcccacagatggttcaagcacagattcgacggcctgcagctggagctgaccaagaacagactgcagagacccagcggcgaggacagatggcaggagaaggaccaggacgtgaagcacgacgtgatgagcaaccagagcgtgctgcacagatgggagagaaagcagaacctgagacccatgcccaagaagtaccacagcgaggtgcagagaaagtag

SEQ ID NO: 19997 - DNA, 3306 bp, Artificial Sequence
  Description of Artificial Sequence: Synthetic coding sequence
atggactgcaaggtgcacatggagaccaccgtgagcagacccgtgctgagccccacccacatcaacgccaccgccagcgagaccttcaccgtgctgcagcagagaatgagaatcgtggaggagcagaccagcagcctgagagacgacctgatcatgctggacttcggcgagaagagaggctacctggaggcccccgactgcctggaggacctggacagccagaaggtgatcagccccatccagaacgaggccatctgcgccggcaagaccgacatcctgtggaagaactgcgagttcctggtgaacagaatgtgcagactggagagcctgatgcagagcctgaagatgaacatcttcagactgcagaccgagaaggacctgaacccccagaagaccgccttcctgaaggacagactgaacgccatccaggaggagcacagcaaggacctgaagctgctgcacctggaggtgatgaacctgagacagcagctgagagccgtgaaggaggaggaggacaaggcccaggacgaggtgcagagactgaccgccaccctgaagatcgccagccagaccaagaagaacgccgccatcatcgaggaggagctgaagaccaccaagagaaagatgaacctgaagatccaggagctgagaagacagctggcccaggagaagtacctgagagagagcctggagaagagcgccagcgccatgctgctgaagatccaggagatgggcagcaccgtggaggtggagagaaagcaggtgcacatcctgcagcagaactgcatcgccctgagagacagcatccagagcgcccaggagctgctggcccaggagcagaagaagaaggaggagctggagatcgccaccagccagctgaagagcgacctgaccagcagagacgacctgatcagcaagctggtggaggagaacaagaacctgcagatcagcttcaacaaggagcacgaggagaacgcctacctgagaagcgagatcatgagcctgcacgaggccagcgagaaggcccaggtgctgaacgaccagctgaccaagaagtgcagcgagctgagctgcatgctgcagaccgtgaccatggagaaggccagaatcatcgccgaccaccaggccatcctgcaggtggagcagaagatgatgacccagaccttccaggagcagaacctgctgctggacgccgcccacgccagcatcaccaacgagctgcagaccgtgcagaacgagaagacccagctgcaggcccacctggaccacctgatcctggagcacaaccagtgcatccagaaggcccaggacgccgagaagagaaccgccgtgcagaaggagctgctggagagcaccatcgccagactgagaggcgagctggaggccagcatgcaggagaagaagagcctgctggaggagaaggagagattccagagagaggtgaacaagaccgagaaggagatcgtgcaggagagatgcaacctggagaaggagctggccaagaacaaggtggacatcaacaccctgacccacaacctgcagaccctggaggaggagaacaagcacctggccgaccagatggccagcctggagctgcagcaggtgaccagcgactaccacggcctggcccagcagaaggtggagaagatcaccgagagcaagaacaagctggcctacgagaacggcaagctgcagatcaaggtgaagcagctggaggagcaggtgcagagcttcaccgacaccagcctgcagaacgaccacctgagaaagatgaacaagtacctgcagaccaagtacgcccaggccaacagcgagctgagcgccaagagagtgcacctgcagcaggccgacgcccacctgaaggaggtgaagagcatcctggagagaagcaaggaggagctgagcagaaccgtgaagtgcagaaacgccgccctgaaggagagccagaagctgaaggaggacctggaggccgtggaggacagagagaacaagaaggtgggcaacttccagagacagctggccgaggccaaggaggacaactgcaaggtgaccatcatgctggagaacgtgctggccagccacagcaagatgcagggcgccctggagaaggtgcagatcgagctgggcagaagagacagcgagatcgccggcctgaagaaggagagagacctgaaccagcagagagtgcagaagctggaggccgaggtggaccagtggcaggccagaatgctggtgatggaggaccagcacaacagcgagatcgagagcctgcagaaggccctgggcgtggccagagaggacaacagaaagctggccatgagcctggagcaggccctgcagaccaacaaccacctgcagaccaagctggaccacatccaggagcagctggagagcaaggagctggagagacagaacctggagaccttcaaggacagaatgaccgaggagagcaaggtggaggccgagctgcacgccgagagaatcgaggccctgagaaagcagttccagaccgagagagagaccaccaagaaggtggcccagagagaggtggccgagctgaagaaggccctggacgaggccaacttcagaagcgtggaggtgagcagaaccaacagagagctgagacagaagctggccgagctggagaagatcctggagagcaacaaggagaagatcaagaaccagaagacccagatcaagctgcacctgagcgccaaggccaacaacgcccagaacatcgagagaatgaagcagatcgagaaggagctgaagcagatggagctgatcaaggaccagtaccagaagaagaactacgagcagagcctgagcatccagagattcgtgtgcgagatgaccaacctgcagaaggagatgcagatgctggccaagagccagtacgacgccagcgtgagaaacaagcagcaggagctgcacctggaggccgagagaaagatcagacaggagctggagaacagatgccaggagctggaggagaccgtgagacacctgaagaagtgcaaggaggccaccgagaacaccctgaaggaggccagcgtggagagcgagcagatcaccgccaacctggaggaggcccacagatggttcaagcacagattcgacggcctgcagctggagctgaccaagaacagactgcagagacccagcggcgaggacagatggcaggagaaggaccaggacgtgaagcacgacgtgatgagcaaccagagcgtgctgcacagatgggagagaaagcagaacctgagacccatgcccaagaagtaccacagcgaggtgcagagaaagtag

SEQ ID NO: 19998 - DNA, 1767 bp, Artificial Sequence
  Description of Artificial Sequence: Synthetic coding sequence
atgcccctgagaaagagaaagagccccgagagaaccgccagcagcaagagccccgagatcagcagaagccacgtgaacagcatcaaggagagaaccagcagcgtgggcctgcccagcgtgatccccaacagcaccagaagagtgagcttcgcccccaacctgcccagcatgaagaccagccaggacatcggcgacagcagaatcagcctgaagaccctgctgaacgccatcaagaccatggagggcagactggagggcaagatcgagatcctggccagcagacccctgatcaacgacgagagccccaacttcctgaagcaggacagcgtgaagagcatcctggagagaagcaaggaggagctgagcagaaccgtgaagtgcagaaacgccgccctgaaggagagccagaagctgaaggaggacctggaggccgtggaggacagagagaacaagaaggtgggcaacttccagagacagctggccgaggccaaggaggacaactgcaaggtgaccatcatgctggagaacgtgctggccagccacagcaagatgcagggcgccctggagaaggtgcagatcgagctgggcagaagagacagcgagatcgccggcctgaagaaggagagagacctgaaccagcagagagtgcagaagctggaggccgaggtggaccagtggcaggccagaatgctggtgatggaggaccagcacaacagcgagatcgagagcctgcagaaggccctgggcgtggccagagaggacaacagaaagctggccatgagcctggagcaggccctgcagaccaacaaccacctgcagaccaagctggaccacatccaggagcagctggagagcaaggagctggagagacagaacctggagaccttcaaggacagaatgaccgaggagagcaaggtggaggccgagctgcacgccgagagaatcgaggccctgagaaagcagttccagaccgagagagagaccaccaagaaggtggcccagagagaggtggccgagctgaagaaggccctggacgaggccaacttcagaagcgtggaggtgagcagaaccaacagagagctgagacagaagctggccgagctggagaagatcctggagagcaacaaggagaagatcaagaaccagaagacccagatcaagctgcacctgagcgccaaggccaacaacgcccagaacatcgagagaatgaagcagatcgagaaggagctgaagcagatggagctgatcaaggaccagtaccagaagaagaactacgagcagagcctgagcatccagagattcgtgtgcgagatgaccaacctgcagaaggagatgcagatgctggccaagagccagtacgacgccagcgtgagaaacaagcagcaggagctgcacctggaggccgagagaaagatcagacaggagctggagaacagatgccaggagctggaggagaccgtgagacacctgaagaagtgcaaggaggccaccgagaacaccctgaaggaggccagcgtggagagcgagcagatcaccgccaacctggaggaggcccacagatggttcaagcacagattcgacggcctgcagctggagctgaccaagaacagactgcagagacccagcggcgaggacagatggcaggagaaggaccaggacgtgaagcacgacgtgatgagcaaccagagcgtgctgcacagatgggagagaaagcagaacctgagacccatgcccaagaagtaccacagcgaggtgcagagaaagtag

SEQ ID NO: 19999 - DNA, 456 bp, Artificial Sequence
  Description of Artificial Sequence: Synthetic coding sequence
atgagcctgcacgaggccagcgagaaggcccaggtgctgaacgaccagctgaccaagaagtgcagcgagctgagctgcatgctgcagaccgtgaccatggagaaggccagaatcatcgccgaccaccaggccatcctgcaggtggagcagaagatgatgacccagaccttccaggagcagaacctgctgctggacgccgcccacgccagcatcaccaacgagctgcagaccgtgcagaacgagaagacccagctgcaggcccacctggaccacctgatcctggagcacaaccagtgcatccagaaggcccaggacgccgagaagagaaccgccgtgcagaaggagctgctggagagcaccatcgccagactgagaggcgagctggaggccagcatgcaggagaagaagagcctgctggaggagaaggagagattccagagagagggctacctgtag

SEQ ID NO: 20000 - DNA, 387 bp, Artificial Sequence
  Description of Artificial Sequence: Synthetic coding sequence
atgtgcagactggagagcctgatgcagagcctgaagatgaacatcttcagactgcagaccgagaaggacctgaacccccagaagaccgccttcctgaaggacagactgaacgccatccaggaggagcacagcaaggacctgaagctgctgcacctggaggtgatgaacctgagacagcagctgagagccgtgaaggaggaggaggacaaggcccaggacgaggtgcagagactgaccgccaccctgaagatcgccagccagaccaagaagaacgccgccatcatcgaggaggagctgaagaccaccaagagaaagatgaacctgaagatccaggagctgctggagatgaccagcttccccagctggctgaagaagatcagattctag

SEQ ID NO: 20001 - DNA, 891 bp, Artificial Sequence
  Description of Artificial Sequence: Synthetic coding sequence
atggactgcaaggtgcacatggagaccaccgtgagcagacccgtgctgagccccacccacatcaacgccaccgccagcgagaccttcaccgtgctgcagcagagaatgagaatcgtggaggagcagaccagcagcctgagagacgacctgatcatgctggacttcggcgagaagagaggctacctggaggcccccgactgcctggaggacctggacagccagaaggtgatcagccccatccagaacgaggccatctgcgccggcaagaccgacatcctgtggaagaactgcgagttcctggtgaacagaatgtgcagactggagagcctgatgcagagcctgaagatgaacatcttcagactgcagaccgagaaggacctgaacccccagaagaccgccttcctgaaggacagactgaacgccatccaggaggagcacagcaaggacctgaagctgctgcacctggaggtgatgaacctgagacagcagctgagagccgtgaaggaggaggaggacaaggcccaggacgaggtgcagagactgaccgccaccctgaagatcgccagccagaccaagaagaacgccgccatcatcgaggaggagctgaagaccaccaagagaaagatgaacctgaagatccaggagctgagaagacagctggcccaggagaagtacctgagagagagcctggagaagagcgccagcgccatgctgctgaagatccaggagatgggcagcaccgtggaggtggagagaaagcaggtgcacatcctgcagcagaactgcatcgccctgagagacagcatccagagcgcccaggagctgctggcccaggagcagaagaagaagaagagctggagactgctgctgcacagcagcaacctgatctag

SEQ ID NO: 20002 - DNA, 1788 bp, Artificial Sequence
  Description of Artificial Sequence: Synthetic coding sequence
atgaccagccccctgtgcagagccgccagcgccaacgccctgcccccccaggaccaggccagcacccccagcagcagagtgaagggcagagaggccagcggcaagcccagccacctgagaggcaagggcaccgcccaggcctggacccccggcagaagcaagggcggcagcttccacagaggcgccggcaagcccagcgtgcacagccaggtggccgagctgcacaagaagatccagctgctggagggcgacagaaaggccttcttcgagagcagccagtggaacatcaagaagaaccaggagaccatcagccagctgagaaaggagaccaaggccctggagctgaagctgctggacctgctgaagggcgacgagaaggtggtgcaggccgtgatcagagagtggaagtgggagaagccctacctgaagaacagaaccggccaggccctggagcacctggaccacagactgagagagaaggtgaagcagcagaacgccctgagacaccaggtggtgctgagacagagaagactggaggagctgcagctgcagcacagcctgagactgctggagatggccgaggcccagaacagacacaccgaggtggccaagaccatgagaaacctggagaacagactggagaaggcccagatgaaggcccaggaggccgagcacatcaccagcgtgtacctgcagctgaaggcctacctgatggacgagagcctgaacctggagaacagactggacagcatggaggccgaggtggtgagaaccaagcacgagctggaggccctgcacgtggtgaaccaggaggccctgaacgccagagacatcgccaagaaccagctgcagtacctggaggagaccctggtgagagagagaaagaagagagagagatacatcagcgagtgcaagaagagagccgaggagaagaagctggagaacgagagaatggagagaaagacccacagagagcacctgctgctgcagagcgacgacaccatccaggacagcctgcacgccaaggaggaggagctgagacagagatggagcatgtaccagatggaggtgatcttcggcaaggtgaaggacgccaccggcaccgacgagacccacagcctggtgagaagattcctggcccagggcgacaccttcgcccagctggagaccctgaagagcgagaacgagcagaccctggtgagactgaagcaggagaagcagcagctgcagagagagctggaggacctgaagtacagcggcgaggccaccctggtgagccagcagaagctgcaggccgaggcccaggagagactgaagaaggaggagagaagacacgccgaggccaaggaccagctggagagagccctgagagccatgcaggtggccaaggacagcctggagcacctggccagcaagctgatccacatcaccgtggaggacggcagattcgccggcaaggagctggacccccaggccgacaactacgtgcccaacctgctgggcctggtggaggagaagctgctgaagctgcaggcccagctgcagggccacgacgtgcaggagatgctgtgccacatcgccaacagagagttcctggccagcctggagggcagactgcccgagtacaacaccagaatcgccctgcccctggccaccagcaaggacaagttcttcgacgaggagagcgaggaggaggacaacgaggtggtgaccagagccagcctgaagatcagaagccagaagctgatcgagagccacaagaagcacagaagaagcagaagaagctag

SEQ ID NO: 20003 - DNA, 1725 bp, Artificial Sequence
  Description of Artificial Sequence: Synthetic coding sequence
ctgcccccccaggaccaggccagcacccccagcagcggcaagcccagccacctgagaggcaagggcaccgcccaggcctggacccccggcagaagcaagggcggcagcttccacagaggcgccggcaagcccagcgtgcacagccaggtggccgagctgcacaagaagatccagctgctggagggcgacagaaaggccttcttcgagagcagccagtggaacatcaagaagaaccaggagaccatcagccagctgagaaaggagaccaaggccctggagctgaagctgctggacctgctgaagggcgacgagaaggtggtgcaggccgtgatcagagagtggaagtgggagaagccctacctgaagaacagaaccggccaggccctggagcacctggaccacagactgagagagaaggtgaagcagcagaacgccctgagacaccaggtggtgctgagacagagaagactggaggagctgcagctgcagcacagcctgagactgctggagatggccgaggcccagaacagacacaccgaggtggccaagaccatgagaaacctggagaacagactggagaaggcccagatgaaggcccaggaggccgagcacatcaccagcgtgtacctgcagctgaaggcctacctgatggacgagagcctgaacctggagaacagactggacagcatggaggccgaggtggtgagaaccaagcacgagctggaggccctgcacgtggtgaaccaggaggccctgaacgccagagacatcgccaagaaccagctgcagtacctggaggagaccctggtgagagagagaaagaagagagagagatacatcagcgagtgcaagaagagagccgaggagaagaagctggagaacgagagaatggagagaaagacccacagagagcacctgctgctgcagagcgacgacaccatccaggacagcctgcacgccaaggaggaggagctgagacagagatggagcatgtaccagatggaggtgatcttcggcaaggtgaaggacgccaccggcaccgacgagacccacagcctggtgagaagattcctggcccagggcgacaccttcgcccagctggagaccctgaagagcgagaacgagcagaccctggtgagactgaagcaggagaagcagcagctgcagagagagctggaggacctgaagtacagcggcgaggccaccctggtgagccagcagaagctgcaggccgaggcccaggagagactgaagaaggaggagagaagacacgccgaggccaaggaccagctggagagagccctgagagccatgcaggtggccaaggacagcctggagcacctggccagcaagctgatccacatcaccgtggaggacggcagattcgccggcaaggagctggacccccaggccgacaactacgtgcccaacctgctgggcctggtggaggagaagctgctgaagctgcaggcccagctgcagggccacgacgtgcaggagatgctgtgccacatcgccaacagagagttcctggccagcctggagggcagactgcccgagtacaacaccagaatcgccctgcccctggccaccagcaaggacaagttcttcgacgaggagagcgaggaggaggacaacgaggtggtgaccagagccagcctgaagatcagaagccagaagctgatcgagagccacaagaagcacagaagaagcagaagaagctag

SEQ ID NO: 20004 - DNA, 1626 bp, Artificial Sequence
  Description of Artificial Sequence: Synthetic coding sequence
atgcacccccccgtggccccctgcaagaagctgagatgcccccccaccagaagcttcacccccaccagaggcagaagcaaggagggcgacagaaaggccttcttcgagagcagccagtggaacatcaagaagaaccaggagaccatcagccagctgagaaaggagaccaaggccctggagctgaagctgctggacctgctgaagggcgacgagaaggtggtgcaggccgtgatcagagagtggaagtgggagaagccctacctgaagaacagaaccggccaggccctggagcacctggaccacagactgagagagaaggtgaagcagcagaacgccctgagacaccaggtggtgctgagacagagaagactggaggagctgcagctgcagcacagcctgagactgctggagatggccgaggcccagaacagacacaccgaggtggccaagaccatgagaaacctggagaacagactggagaaggcccagatgaaggcccaggaggccgagcacatcaccagcgtgtacctgcagctgaaggcctacctgatggacgagagcctgaacctggagaacagactggacagcatggaggccgaggtggtgagaaccaagcacgagctggaggccctgcacgtggtgaaccaggaggccctgaacgccagagacatcgccaagaaccagctgcagtacctggaggagaccctggtgagagagagaaagaagagagagagatacatcagcgagtgcaagaagagagccgaggagaagaagctggagaacgagagaatggagagaaagacccacagagagcacctgctgctgcagagcgacgacaccatccaggacagcctgcacgccaaggaggaggagctgagacagagatggagcatgtaccagatggaggtgatcttcggcaaggtgaaggacgccaccggcaccgacgagacccacagcctggtgagaagattcctggcccagggcgacaccttcgcccagctggagaccctgaagagcgagaacgagcagaccctggtgagactgaagcaggagaagcagcagctgcagagagagctggaggacctgaagtacagcggcgaggccaccctggtgagccagcagaagctgcaggccgaggcccaggagagactgaagaaggaggagagaagacacgccgaggccaaggaccagctggagagagccctgagagccatgcaggtggccaaggacagcctggagcacctggccagcaagctgatccacatcaccgtggaggacggcagattcgccggcaaggagctggacccccaggccgacaactacgtgcccaacctgctgggcctggtggaggagaagctgctgaagctgcaggcccagctgcagggccacgacgtgcaggagatgctgtgccacatcgccaacagagagttcctggccagcctggagggcagactgcccgagtacaacaccagaatcgccctgcccctggccaccagcaaggacaagttcttcgacgaggagagcgaggaggaggacaacgaggtggtgaccagagccagcctgaagatcagaagccagaagctgatcgagagccacaagaagcacagaagaagcagaagaagctag

SEQ ID NO: 20005 - DNA, 765 bp, Artificial Sequence
  Description of Artificial Sequence: Synthetic coding sequence
atggaccagagcagcgagggctgcatgaagaagatcagcagcgtgaacctggacaagctgatcaacgacttcagccagatcgagaagaagatggtggagaccaacggcaagaacaacatcctggacatccagctggagaagagcaactgcctgctgaaggtgatgcaggccaaggaggtgagcatcaaggaggagtgcgccaccctgcacaacatcatcaagggcctgcagcagaccatcgagtaccagcagaacctgaagggcgagaacgagcagctgaagatcagcgccgacctgatcaaggagaagctgaagagccacgagcaggagtacaagaacaacatcgccaagctggtgagcgagatgaagatcaaggaggagggctacaagaaggagatcagcaagctgtaccaggacatgcagagaaaggtggagctgaacgaggagaagcacaaggagctgatcgagaagaaggagatggagatcagcgagctgaacgccaagctgagaagccaggagaaggagaagcagaacgagatcatcaagctgcagctggagttcgacgccaagctggccagagtgcagaccaagagcaagagctaccaggacagcaccgtgctgccccagagcatctacagaagaaagctgcagcacttccaggaggagaagaacaaggagatcgccatcctgagaaacaccatcagagacctggagcagagactgagcgtgggcaaggacagccacctgaagagaagaagattctag

SEQ ID NO: 20006 - DNA, 633 bp, Artificial Sequence
  Description of Artificial Sequence: Synthetic coding sequence
atgccccccaagaacaaggagaagggcaagaagagcggcgcccagaagaagaagaagaactggggcgccgacgtggtggccgagagcagacacagactggtggtgctggagaaggagctgctgagagaccacctggccctgagaagagacgaggccagaagagccaaggccagcgaggaccagctgagacagagactgcagggcgtggaggccgagctggagggcgccagaagcgagggcaaggccatctacgccgagatgagcagacagtgccacgccctgcaggaggacatgcagaccagaagcaagcagctggaggaggaggtgaagggcctgagaggccagctggaggcctgccagagagaggccgccgccgccagagaggaggccgagcaggccctgggcgagagagaccaggccctggcccagctgagagcccacatggccgacatggaggccaagtacgaggagatcctgcacgacagcctggacagactgctggccaagctgagagccatcaagcagcagtgggacggcgccgccctgagactgcacgccagacacaaggagcagcagagacagttcggcctgaccccccccggcagcctgagaccccccgcccccagcctgtag

SEQ ID NO: 20007 - DNA, 633 bp, Artificial Sequence; identical to SEQ ID NO: 20006
  Description of Artificial Sequence: Synthetic coding sequence

SEQ ID NO: 20008 - DNA, 2025 bp, Artificial Sequence
  Description of Artificial Sequence: Synthetic coding sequence
atgagcgagctggccgacagcggccccagcggcgccagcgcccccagccagctgagagccgtgaccctggaggacctgggcctgctgctggccggcggcctggccagccccgagcccctgagcctggaggagctgagcgagagatacgagagcagccaccccaccagcaccgccagcgtgcccgagcaggacaccgccaagcactggaaccagctggagcagtgggtggtggagctgcaggccgaggtggcctgcctgagagagcacaagcagagatgcgagagagccaccagaagcctgctgagagagctgctgcaggtgagagccagagtgcagctgcagggcagcgagctgagacagctgcagcaggaggccagacccgccgcccaggcccccgagaaggaggcccccgagttcagcggcctgcagaaccagatgcaggccctggacaagagactggtggaggtgagagaggccctgaccagactgagaagaagacaggtgcagcaggaggccgagagaagaggcgccgagcaggaggccggcctgagactggccaagctgaccgacctgctgcagcaggaggagcagggcagagaggtggcctgcggcgccctgcagaagaaccaggaggacagcagcagaagagtggacctggaggtggccagaatgcaggcccaggtgaccaagctgggcgaggaggtgagcctgagattcctgaagagagaggccaagctgtgcggcttcctgcagaagagcttcctggccctggagaagagaatgaaggccagcgagagcagcagactgaagctggagggcagcctgagaggcgagctggagagcagatgggagaagctgagaggcctgatggaggagagactgagagccctgcagggccagcacgaggtgggccccggcggcagaagagccgaggagagccacctgctggagcagtgccagggcctggacgccgccgtggcccagctgaccaagttcgtgcagcagaaccaggccagcctgaacagagtgctgctggccgaggagaaggcctgggacgccaagggcagactggaggagagcagagccggcgagctggccgcctacgtgcaggagaacctggaggccgcccagctggccggcgagctggccagacaggagatgcacggcgagctggtgctgctgagagagaagagcagagccctggaggccagcgtggcccagctggccggccagctgaaggagctgagcggccacctgcccgccctgagcagcagactggacctgcaggagcagatgctgggcctgagactgagcgaggccaagaccgagtgggagggcgccgagagaaagagcctggaggacctggccagatggagaaaggaggtgaccgagcacctgagaggcgtgagagagaaggtggacggcctgccccagcagatcgagagcgtgagcgacaagtgcctgctgcacaagagcgacagcgacctgagaatcagcgccgagggcaaggccagagagttcaaggtgggcgccctgagacaggagctggccaccctgctgagcagcgtgcagctgctgaaggaggacaaccccggcagaaagatcgccgagatgcagggcaagctggccaccaaccagatcatgaagctggagaactgcgtgcaggccaacaagaccatccagaacctgagattcaacaccgaggccagactgagaacccaggagatggccaccctgtgggagagcgtgctgagactgtggagcgaggagggccccagaacccccctgggcagctggaaggccctgcccagcctggtgagacccagagtgttcatcaaggacatggcccccggcaaggtggtgcccatgaactgctggggcgtgtaccaggccgtgagatggctgagatggaaggccagcctgatcaagctgagagccctgagaagacccggcggcgtgctggagaagccccacagccaggagcaggtgcagcagctgacccccagcctgttcatccagaagtag

SEQ ID NO: 20009 - DNA, 1569 bp, Artificial Sequence
  Description of Artificial Sequence: Synthetic coding sequence
atgcaggccctggacaagagactggtggaggtgagagaggccctgaccagactgagaagaagacaggtgcagcaggaggccgagagaagaggcgccgagcaggaggccggcctgagactggccaagctgaccgacctgctgcagcaggaggagcagggcagagaggtggcctgcggcgccctgcagaagaaccaggaggacagcagcagaagagtggacctggaggtggccagaatgcaggcccaggtgaccaagctgggcgaggaggtgagcctgagattcctgaagagagaggccaagctgtgcggcttcctgcagaagagcttcctggccctggagaagagaatgaaggccagcgagagcagcagactgaagctggagggcagcctgagaggcgagctggagagcagatgggagaagctgagaggcctgatggaggagagactgagagccctgcagggccagcacgaggagagccacctgctggagcagtgccagggcctggacgccgccgtggcccagctgaccaagttcgtgcagcagaaccaggccagcctgaacagagtgctgctggccgaggagaaggcctgggacgccaagggcagactggaggagagcagagccggcgagctggccgcctacgtgcaggagaacctggaggccgcccagctggccggcgagctggccagacaggagatgcacggcgagctggtgctgctgagagagaagagcagagccctggaggccagcgtggcccagctggccggccagctgaaggagctgagcggccacctgcccgccctgagcagcagactggacctgcaggagcagatgctgggcctgagactgagcgaggccaagaccgagtgggagggcgccgagagaaagagcctggaggacctggccagatggagaaaggaggtgaccgagcacctgagaggcgtgagagagaaggtggacggcctgccccagcagatcgagagcgtgagcgacaagtgcctgctgcacaagagcgacagcgacctgagaatcagcgccgagggcaaggccagagagttcaaggtgggcgccctgagacaggagctggccaccctgctgagcagcgtgcagctgctgaaggaggacaaccccggcagaaagatcgccgagatgcagggcaagctggccaccttccagaaccagatcatgaagctggagaactgcgtgcaggccaacaagaccatccagaacctgagattcaacaccgaggccagactgagaacccaggagatggccaccctgtgggagagcgtgctgagactgtggagcgaggagggccccagaacccccctgggcagctggaaggccctgcccagcctggtgagacccagagtgttcatcaaggacatggcccccggcaaggtggtgcccatgaactgctggggcgtgtaccaggccgtgagatggctgagatggaaggccagcctgatcaagctgagagccctgagaagacccggcggcgtgctggagaagccccacagccaggagcaggtgcagcagctgacccccagcctgttcatccagaagtag

SEQ ID NO: 20010 - DNA, 2259 bp, Artificial Sequence
  Description of Artificial Sequence: Synthetic coding sequence
atggcccacctgctgggcagccaggcctgcatggagagcctgagaaccgacctgaccgacctgcagggcgccatcgtggacgtgttcagcagagccggccccgtgagattccccagctggaagttccccgacagaatggcctgcgacctggacatggtggccctgctggagcactacgaccacgtgcccggcgaccccgagttcacccagctgagccacgccgtgctgctggagctggtgatcgacagactgctgctgctgctgcagagctgcatgagctacctggagaacctgggcagcgagcagatgatgccccccgcccaggccgccggcccctgcatgagcgtgggcctgaccgtgagaagattctgggacagcctgctgagactgggcaccctgcaccagcagcccctgccccagaagggcgccaaccagagagagacccccaccagcaagcccaccaccaagggcgagcccgccagaagccccgagtacctgaccaccaagctgatcaagcccagcagccccgtgctgggcctgccccagacctgccaggagcccgagagcatccccgtgagagccagcctgcagttccccgccaccaccttcaagaacaccagaagcgtgcacagccagaccatcgagaccgccctggtgccctgcgacgcctgcgccagcgtgcagggcagcctgcagaaggtgggcaaggtggtgatcagcctgtgccagagccagaacctgcccagcagcctgggccagttccagcagctggtgcaggacagcatgggcctgagacccctgcccgccgccaccgtgggcagatgggccgccgagcagagaaaggacctgaccagactgagcaagcacgtggaggccctgagagcccagctggaggaggccgagggccagaaggacggcctgagaaagcaggccggcaagctggagcaggccctgaagcaggagcagggcgccagaagaagacaggccgaggaggacgagcagtgcctgagcgagtgggagcacgacaagcagcagctgctgaccgagaccagcgacctgaagaccaagatggccaccctggagagagagctgaagcagcagagagagagcacccaggccgtggaggccaaggcccagcagctgcaggaggagggcgagagaagagccgccgccgagagacaggtgcagcagctggaggagcaggtgcagcagctggaggcccaggtgcagctgctggtgggcagactggagggcgccggccagcaggtgtgctgggccagcaccgagctggacaaggagaaggccagagtggacagcatggtgagacaccaggagagcctgcaggccaagcagagagccctgctgaagcagctggacagcctggaccaggagagagaggagctgagaggcagcctggacgaggccgaggcccagagagccagagtggaggagcagctgcagagcgagagagagcagggccagtgccagctgagagcccagcaggagctgctgcagagcctgcagagagagaagcagggcctggagcaggccaccaccgacctgagactgaccatcctggagctggagagagagctggaggagctgaaggagagagagagactgctggtggccttccccgacctgcacagacccaccgagacccagatccacggcggcagaagcagcagcgtggagagccagatcacctgccccaccgacagcggcaacgtgaccgaccacatggagagacaggtgcagagcaacgacatcagaatcagagtgctgcaggaggagaacggcagactgcagagcatgctgagcaagatcagagaggtggcccagcagggcggcctgaagctgatcccccaggacagactgtggagccccagcagcaagggcacccagggcgccaccccccccgtgcaggccaagagcaccagccccggccccctgggcagacagcacctgcccagcagcagaaccggcagaaccctgctgggccagccctgcaccagcccccccagacagccctgcaccagcccccccagacagccctgcaccagcccccccagacagccctgcaccagccccagcagacagccctgcagccagcccagcaagagcctgctggagggcgtgacccacctggacacctgcacccagaaccccatcaaggtgctggtgagactgagaaagagactgagccccggcagaggccaggccagcagcgcccaccagccccaggagagacccatgtag

SEQ ID NO: 20011 - DNA, 2259 bp, Artificial Sequence; identical to SEQ ID NO: 20010
  Description of Artificial Sequence: Synthetic coding sequence

SEQ ID NO: 20012 - DNA, 1602 bp, Artificial Sequence
  Description of Artificial Sequence: Synthetic coding sequence
atggagagcaaggcctgggagagcaacaacgaggacctgctgagcagcagcggcgtgaccagcaacggcggcagcagcagcagcttcttcgtgagcagcatcagaggcaccatcatcgagaacaccagcagcgccggcaccctgacccaggtgcccttcttccccaagtacgaggtggagctggacagccccagaaagatcatccccagccccggcaaggagcacttcgagagagtgctggaggagtacagccaccaggtgaaggacctgcagagaagactgaacgagagcaacgagctgcacgagaagcagaagttctacctgagacagagcgtgatcgacctgcagaccaagctgcaggagatgcagatggagagagacgccatggccgacatcagaagaagagagagccagagccaggaggacctgagaaaccagctgcagaacaccgtgcacgagctggaggccgccaagtgcctgaaggaggacatgctgaaggacagcaacacccagatcgagcagctgagaaagatgatgctgagccacgagggcgtgctgcaggagatcagaagcatcctggtggacttcgaggaggccagcggcaagaagatctgcgagcacgacagcatgagcaccctgcacttcagaagcctgggcagcgccatcagcaagatcctgagagagctggacaccgagatcagctacctgaagggcagaatcttccccgtggaggaccagctggaggccctgaagagcgagagccagaacaagatcgagctgctgctgcagcagcaccaggacagaatcgagcagctgatcagcgagcacgaggtggagatcaccggcctgaccgagaaggccagcagcgccagaagccaggccaacagcatccagagccagatggagatcatccaggagcaggccagaaaccagaacagcatgtacatgagacagctgagcgacctggagagcaccgtgagccagctgagaagcgagctgagagaggccaagagaatgtacgaggacaagaccgaggagctggagaagcagctggtgctggccaacagcgagctgaccgaggccagaaccgagagagaccagagcagcctgagaagcgacatgtgccacagaagcaacaacagcctgagagacagcaccgagggcagcaagagcagcgagaccctgagcagagagcccgtgaccctgcacgccggcgacagagaggaccccagcggctgcttcaccttcaccagcgccgccagccccagcgtgaagaacagcgccagcagaagcttcaacagcagccccaagaagagccccgtgcacagcctgctgaccagcagcgtggagggcagcatcggcagcaccagccagtacagaagcgccaagcccatccacagcagcgacagcgtgaaggacagccagagcccccccatcgagaccaccggcaagacctgcagaaagctgcagaacagactggagagcctgcagaccctggtggaggacctgcagctgaagaaccaggccatgagcagcatgatcagaaaccaggagaagagaatccagaaggtgaaggaccaggagaagatgctgctgaagtag

SEQ ID NO: 20013 - DNA, 3342 bp, Artificial Sequence
  Description of Artificial Sequence: Synthetic coding sequence
atggagagcaaggcctgggagagcaacaacgaggacctgctgagcagcagcggcgtgaccagcaacggcggcagcagcagcagcttcttcgtgagcagcatcagaggcaccatcatcgagaacaccagcagcgccggcaccctgacccaggtgcccttcttccccaagtacgaggtggagctggacagccccagaaagatcatccccagccccggcaaggagcacttcgagagagtgctggaggagtacagccaccaggtgaaggacctgcagagaagactgaacgagagcaacgagctgcacgagaagcagaagttctacctgagacagagcgtgatcgacctgcagaccaagctgcaggagatgcagatggagagagacgccatggccgacatcagaagaagagagagccagagccaggaggacctgagaaaccagctgcagaacaccgtgcacgagctggaggccgccaagtgcctgaaggaggacatgctgaaggacagcaacacccagatcgagcagctgagaaagatgatgctgagccacgagggcgtgctgcaggagatcagaagcatcctggtggacttcgaggaggccagcggcaagaagatctgcgagcacgacagcatgagcaccctgcacttcagaagcctgggcagcgccatcagcaagatcctgagagagctggacaccgagatcagctacctgaagggcagaatcttccccgtggaggaccagctggaggccctgaagagcgagagccagaacaagatcgagctgctgctgcagcagcaccaggacagaatcgagcagctgatcagcgagcacgaggtggagatcaccggcctgaccgagaaggccagcagcgccagaagccaggccaacagcatccagagccagatggagatcatccaggagcaggccagaaaccagaacagcatgtacatgagacagctgagcgacctggagagcaccgtgagccagctgagaagcgagctgagagaggccaagagaatgtacgaggacaagaccgaggagctggagaagcagctggtgctggccaacagcgagctgaccgaggccagaaccgagagagaccagttcagccaggagagcggcaacctggacgaccagctgcagaagctgctggccgacctgcacaagagagagaaggagctgagcctggagaaggagcagaacaagagactgtgggacagagacaccggcaacagcatcaccatcgaccacctgagaagagagctggacaacagaaacatggaggtgcagagactggaggccctgctgaaggccctgaagagcgagtgccagggccagatggagagacagatggccgccatccagggcaagaacgagagcctggagaaggtgagcagcctgaccgcccagctggagagcaccaaggagatgctgagaaaggtggtggaggagctgaccgccaagaagatgaccctggagagcagcgagagaaccatcagcgacctgaccaccagcctgcaggagaaggagagagccatcgaggccaccaacgccgagatcaccaagctgagaagcagagtggacctgaagctgcaggagctgcagcacctgaagaacgagggcgaccacctgagaaacgtgcagaccgagtgcgaggccctgaagctgcagatgaccgagaaggacaaggtgatcgagatcctgagacagcagatcgagaacatgacccagctggtgggccagcacggcagaaccgccggcgccatgcaggtggagaaggcccagctggagaaggagatcaacgacagaagaatggagctgaaggagctgaagatcctgaaggacaagaaggacgccaagatcagagagctggaggccagagtgagcgacctggagctggagaaggtgaagctggtgaacgccggcagcgagagactgagagccgtgaaggacatcaagcaggagagagaccagctgctgaacgaggtgaagaccagcagaagcgagctgaacaacctgagcgaggagtacgaggtgctgaagagaaacttcagaaacaagagcgaggagatggagatgaccaccaacaagctgaagatgcagctgaagagcgcccagagcgagctggagcagaccagaaacaccctgaagagcatggagggcagcgacggccacgccatgaaggtggccatgggcatgcagaagcagatcaccgccaagagaggccagatcgacgccctgcagagcaagatccagttcctggaggaggccatgaccaacgccaacaaggagaagcacttcctgaaggaggagaagagcaagctgagccaggagctgagcaccgtggccaccgagaagaacaagatggccggcgagctggaggtgctgagaagccaggagagaagactgaaggagaaggtgaccaacatggaggtggccctggacaaggccagcctgcagttcgccgagtgccaggacatcatccagagacaggagcaggagagcgtgagactgaagctgcagcacaccctggacatcaaggagctgcagggccccggctacaccagcaacagcagcctgaagcccagactgctgcagcccgccagcgtgaccagaagccacagcaacgtgcccagcagccagagcaccgccagcttcctgagccaccacagcaccaaggccaacaccctgaaggaggaccccaccagagacctgaagcagctgctgcaggagctgagaagcgtgatcaacgaggagcccgccgtgagcctgagcaagaccgaggaggacggcagaaccagcctgggcgccctggaggacagagtgagagactgcatcaccgagagcagcctgagaagcgacatgtgccacagaagcaacaacagcctgagagacagcaccgagggcagcaagagcagcgagaccctgagcagagagcccgtgaccctgcacgccggcgacagagaggaccccagcggctgcttcaccttcaccagcgccgccagccccagcgtgaagaacagcgccagcagaagcttcaacagcagccccaagaagagccccgtgcacagcctgctgaccagcagcgtggagggcagcatcggcagcaccagccagtacagaagcgccaagcccatccacagcagcgacagcgtgaaggacagccagagcccccccatcgagaccaccggcaagacctgcagaaagctgcagaacagactggagagcctgcagaccctggtggaggacctgcagctgaagaaccaggccatgagcagcatgatcagaaaccaggagaagagaatccagaaggtgaaggaccaggagaagatgctgctgaagtag

SEQ ID NO: 20014 - DNA, 1239 bp, Artificial Sequence
  Description of Artificial Sequence: Synthetic coding sequence
atgctgctgcccgccagcgaccccctgctggccggcctgcccagagaccccgactacagcgtgagctgcctgtacagcccccccagccccagcagcatgtgcctgcccgccaacatgaagtgcgacaagtactggggcagcagcagcgacaaggccctggagagaaccgcccactggagcagaacccccgagcccgagaccctgggctgccccgccagcggcgacaccgtgagaaccgccgactgcagacccggctggggcagcggccccagcccccacgaggccgcccccagccccagccccgacctgcagaagcagtgctgcaacgaccaggacatcctgaagagacaccacaacgtggccaagaagcccctggagaccagcagcagcaaggtgaaggccaagaccatcgtgatgatccccgacagccagaagctgctgagatgcgagctggagagcctgaagagccagctgcaggcccagaccaaggccttcgagttcctgaaccacagcgtgaccatgctggagaaggagagctgcctgcagcagatcaagatccagcagctggaggaggtgctgagccccaccggcagacagggcgagaaggaggagcacaagtggggcatggagcagggcagacaggagctgtacggcgccctgacccagggcctgcagggcctggagaagaccctgagagacagcgaggagatgcagagagccagaaccaccagatgcctgcagctgctggcccaggagatcagagacagcaagaagttcctgtgggaggagctggagctggtgagagaggaggtgaccttcatctaccagaagctgcaggcccaggaggacgagatcagcgagaacctggtgaacatccagaagatgcagaagacccaggtgaagtgcagaaagatcctgaccaagatgaagcagcagggccacgagaccgccgcctgccccgagaccgaggagatcccccagggcgccagcggctgctggaaggacgacctgcagaaggagctgagcgacatctggagcgccgtgcacgtgctgcagaacagcatcgacagcctgaccctgtgcagcggcgcctgccccaaggccagcagcctgagaggccacaagggccaccagtgcctgagcccccccctgcccagctgggacagcgacagcgactgcgaccaggacctgagccagccccccttcagcaagagcggcagaagcttcccccccggctag

SEQ ID NO: 20015 - DNA, 894 bp, Artificial Sequence
  Description of Artificial Sequence: Synthetic coding sequence
atgggcgagcacgagcaggtgaagcccctggagaccagcagcagcaaggtgaaggccaagaccatcgtgatgatccccgacagccagaagctgctgagatgcgagctggagagcctgaagagccagctgcaggcccagaccaaggccttcgagttcctgaaccacagcgtgaccatgctggagaaggagagctgcctgcagcagatcaagatccagcagctggaggaggtgctgagccccaccggcagacagggcgagaaggaggagcacaagtggggcatggagcagggcagacaggagctgtacggcgccctgacccagggcctgcagggcctggagaagaccctgagagacagcgaggagatgcagagagccagaaccaccagatgcctgcagctgctggcccaggagatcagagacagcaagaagttcctgtgggaggagctggagctggtgagagaggaggtgaccttcatctaccagaagctgcaggcccaggaggacgagatcagcgagaacctggtgaacatccagaagatgcagaagacccaggtgaagtgcagaaagatcctgaccaagatgaagcagcagggccacgagaccgccgcctgccccgagaccgaggagatcccccagggcgccagcggctgctggaaggacgacctgcagaaggagctgagcgacatctggagcgccgtgcacgtgctgcagaacagcatcgacagcctgaccctgtgcagcggcgcctgccccaaggccagcagcctgagaggccacaagggccaccagtgcctgagcccccccctgcccagctgggacagcgacagcgactgcgaccaggacctgagccagccccccttcagcaagagcggcagaagcttcccccccgcctag

SEQ ID NO: 20016 - DNA, 894 bp, Artificial Sequence; identical to SEQ ID NO: 20015
  Description of Artificial Sequence: Synthetic coding sequence

SEQ ID NO: 20017 - DNA, 978 bp, Artificial Sequence
  Description of Artificial Sequence: Synthetic coding sequence
atggacgccagaagaaagcactggaaggagaacatgttcacccccttcttcagcgcccaggacgtgctggaggagaccagcgagcccgagagcagcagcgagcagaccaccgccgacagcagcaagggcatggaggagatctacaacctgagcagcagaaagttccaggaggagagcaagttcaagagaaagaagtacatcttccagctgaacgagatcgagcaggagcagaacctgagagagaacaagagaaacatcagcaagaacgagaccgacaccaacagcgccagctacgagagcagcaacgtggacgtgaccaccgaggagagcttcaacagcaccgaggacaacagcacctgcagcaccgacaacctgcccgccctgctgagacaggacatcagaaagaagttcatggagagaatgagccccaagctgtgcctgaacctgctgaacgaggagctggaggagctgaacatgaagtacagaaagatcgaggaggagttcgagaacgccgagaaggagctgctgcactacaagaaggagatcttcaccaagcccctgaacttccaggagaccgagaccgacgccagcaagagcgactacgagctgcaggccctgagaaacgacctgagcgagaaggccaccaacgtgaagaacctgagcgagcagctgcagcaggccaaggaggtgatccacaagctgaacctggagaacagaaacctgaaggaggccgtgagaaagctgaagcaccagaccgaggtgggcaacgtgctgctgaaggaggagatgaagagctactacgagctggagatggccaagatcagaggcgagctgagcgtgatcaagaacgagctgagaaccgagaagaccctgcaggccagaaacaacagagccctggagctgctgagaaagtactacgccagcagcatggtgaccagcagcagcatcctggaccacttcaccggcgacttcttctag

SEQ ID NO: 20018 - DNA, 978 bp, Artificial Sequence; identical to SEQ ID NO: 20017
  Description of Artificial Sequence: Synthetic coding sequence

SEQ ID NO: 20019 - DNA, 2223 bp, Artificial Sequence
  Description of Artificial Sequence: Synthetic coding sequence
atgaacccccccggcagcctggaggccctggaccccaacgtggacgagcacctgagcacccagatcctggcccccagcgtgcacagcgacaacagccaggagagaatccaggccagaagactgagaatcgccgccagactggaggccagaagaagagaggccctgggcgagtacctggacggcaagaaggagagcgaggaggaccagagcaagagctacaagcagaaggaggagagcagactgaagctggccaagctgctgctgtgcggcaccgagctggtgaccaacatccaggtggccatcgacatcagagagatccacagaagagtggaggaggaggagatcaagagacagagaatcgagaagctggagaacgaggtgaagaccagccaggacaagttcgacgagatcaccagcaagtgggaggagggcaagcagaagagaatcccccaggagctgtgggagatgctgaacacccagcagctgcactgcgccggcctgctggaggacaagaacaagctgatcagcgagctgcagcaggagctgaagaccaaggacgaccagtacgtgaaggacctgaagaagcagagcgacgacatctgcctgctgctggagagaatggaggagcaggtgaagaacgtgatgaagaccttcagagaggagctgtacaacatcgagaaggccttcgaggtggagagacaggagctgctggccagcaacaagaagaagtgggagcaggccctgcaggcccacaacgccaaggagctggagtacctgaacaacagaatgaagaaggtggaggactacgagaagcagctgaacagacagagaatctgggactgcgaggagtacaacatgatcaagatcaagctggagcaggacgtgcagatcctggagcagcagctgcagcagagaaaggccatctaccagctgaaccaggagaagctggagtacaacctgcaggtgctgaagaagagagacgaggagagcaccgtgatcaagagccagcagaagagaaagatcaacagactgcacgacatcctgaacaacctgagaagcaagtacgccaagcagatcaagcagttccaggaggagaaccagagcctgaccagcgactacaagagactggtgatgcagttcaaggagctgcagaaggccatgagacacttcgccctgatcgacgacgagaagttctgggagatctggctgatgaacgaggaggaggccaaggacctgatcgccagagccttcgacgtggacagaatcatccacacccaccacctgggcctgccctgggccgcccccgacttctggttcctgaacaacgtgggccccatcagccagcagccccagaagagcgccacccagatcgtggaggagatgctgatgagaagcgaggaggaggaggccgaggaggccgccgccgagcccgagagctacctggacctgcccaagcagatcagcgagaagaccaccaagagaatcctgatgctgctgtgcgacgagagcggcttcctgatcgagagcaagctgctgagcctgctgctgcccctggagcagaacgagtgctacctgctgagactggacgccatcttcagcgccctgggcatcgagagcgaggacgacctgtacaagctggtgaacttcttcctgaagtacagagcccacagactgagcagcagcctgcagatcaagccctgcagccaggccagcatggagaaggccagcatggaggagaccagcaccagaagcgagctggagctggccgagcagaccgagatggagggcgagaaggaggagagcctggtggagggcgagaaggaggaggaggaggagaccccccccagcccctgggtgatccaccccaacgacgtgctgaagatcctggaggccttcgtgatgggcctgaagaagcccagagacagcagagcccccctgagagtgcagaagaacgtgagagacaacagcaaggacagcgagtactggcaggccctgaccaccgtgatccccagcagcaagcagaacctgtgggacgccctgtacaccgccctggagaagtaccacctggtgctgacccagagagccaagctgctgctggagaacagcagcctggagcagcagaacaccgagctgcaggccctgctgcagcagtacctgaacagcaagatcaacagcgagctgcaggtgccccccacccaggtgctgagagtgcccaccaagtag

SEQ ID NO: 20020 - DNA, 522 bp, Artificial Sequence
  Description of Artificial Sequence: Synthetic coding sequence
atgggcagccacagccccagccacttcctggtgcacggctggatcctgagcatgatgttccccgaggaggaggaggccgaggaggccgccgccgagcccgagagctacctggacctgcccaagcagatcagcgagaagaccaccaagagaatcctgatgctgctgtgcgacgagagcggcttcctgatcgagagcaagctgctgagcctgctgctgcccctggagcagaacgagtgctacctgctgagactggacgccatcttcagcgccctgggcatcgagagcgaggacgacctgtacaagctggtgaacttcttcctgaagtacagagcccacagactgagcagcagcctgcagatcaagccctgcagccaggccagcatggagaaggccagcatggaggagaccagcaccagaagcgagctggagctggccgagcagaccgagatggagggcgagaaggaggagagcctggtggagggcgagaaggaggaggaggaggagaccccccccagcccctag

SEQ ID NO: 20021 - DNA, 2931 bp, Artificial Sequence
  Description of Artificial Sequence: Synthetic coding sequence
atgcacagcctggccctgcagaacaccctgcacgagagaacctggagcgacgagaagaacctgatgcagcaggagctgagaagcctgaagcagaacatcttcctgttctacgtgaagctgagatggctgctgaagcactggagacagggcaagcagatggaggaggagggcgaggagttcaccgagggcgagcaccccgagaccctgagcagactgggcgagctgggcgtgcagggcggccaccaggccgacggccccgaccacgacagcgacagaggctgcggcttccccgtgggcgagcacagcccccacagcagagtgcagatcggcgaccacagcctgagactgcagaccgccgacagaggccagccccacaagcaggtggtggagaaccagcagctgttcagcgccttcaaggccctgctggaggacttcagagccgagctgagagaggacgagagagccagactgagactgcagcagcagtacgccagcgacaaggccgcctgggacgtggagtgggccgtgctgaagtgcagactggagcagaactgctgcggctaccccagaatcaacatcgaggaggagaccctgggcttcaccagactgcccgccggcagcaccgtgaagaccctgaagagcctgggcctgcagagactggagctggaggagaagaccgagaacaagctgggcgagctgggcagcagcgccgagagcaagggcgccctgaagaaggagagagaggtgcaccagaagctgctggccgacagccacagcctggtgatggacctgagatggcagatccaccacagcgagaagaactggaacagagagaaggtggagctgctggacagactggacagagacagacaggagtgggagagacagaagaaggagttcctgtggagaatcgagcagggcagcctgagaatgcccagacccgtggccatgtggccctgcgccgacgccgacagcatccccttcgaggacagacccctgagcaagctgaaggagagcgacagatgcagcgccagcgagaacctgtacctggacgccctgagcctggacgacgagcccgaggagccccccgcccacagacccgagagagagttcagaaacagactgcccgaggaggaggagaaccacaagggcaacctgcagagagccgtgagcgtgagcagcatgagcgagttccagagactgatggacatcagccccttcctgcccgagaagggcctgcccagcaccagcagcaaggaggacgtgaccccccccctgagccccgacgacctgaagtacatcgaggagttcaacaagagctgggactacacccccaacagaggccacaacggcggcggccccgacctgtgggccgacagaaccgaggtgggcagagccggccacgaggacagcaccgagcccttccccgacagcagctggtacctgaccaccagcgtgaccatgaccaccgacaccatgaccagccccgagcactgccagaagcagcccctgagaagccacgtgctgaccgagcagagcggcctgagagtgctgcacagcccccccgccgtgagaagagtggacagcatcaccgccgccggcggcgagggccccttccccaccagcagagccagaggcagccccggcgacaccaagggcggcccccccgagcccatgctgagcagatggccctgcaccagccccagacacagcagagactacgtggagggcgccagaagacccctggacagccccctgtgcaccagcctgggcttcgccagccccctgcacagcctggagatgagcaagaacctgagcgacgacatgaaggaggtggccttcagcgtgagaaacgccatctgcagcggccccggcgagctgcaggtgaaggacatggcctgccagaccaacggcagcagaaccatgggcacccagaccgtgcagaccatcagcgtgggcctgcagaccgaggccctgagaggcagcggcgtgaccagcagcccccacaagtgcctgacccccaaggccggcggcggcgccacccccgtgagcagccccagcagaagcctgagaagcagacaggtggcccccgccatcgagaaggtgcaggccaagttcgagagaacctgctgcagccccaagtacggcagccccaagctgcagagaaagcccctgcccaaggccgaccagcccaacaacagaaccagccccggcatggcccagaagggctacagcgagagcgcctgggccagaagcaccaccaccagagagagccccgtgcacaccaccatcaacgacggcctgagcagcctgttcaacatcatcgaccacagccccgtggtgcaggaccccttccagaagggcctgagagccggcagcagaagcagaagcgccgagcccagacccgagctgggccccggccaggagaccggcaccaacagcagaggcagaagccccagccccatcggcgtgggcagcgagatgtgcagagaggagggcggcgagggcacccccgtgaagcaggacctgagcgccccccccggctacaccctgaccgagaacgtggccagaatcctgaacaagaagctgctggagcacgccctgaaggaggagagaagacaggccgcccacggcccccccggcctgcacagcgacagccacagcctgggcgacaccgccgagcccggccccatggaggagctgccctgcagcgccctggcccccagcctggagccctgcttcagcagacccgagagacccgccaacagaagaccccccagcagatgggccccccacagccccaccgccagccagccccagagccccggcgaccccaccagcctggaggagcacggcggcgaggagccccccgaggagcagccccacagagacgccagcctgcacggcctgagccagtacaacagcctgtag

SEQ ID NO: 20022 - DNA, 4761 bp, Artificial Sequence
  Description of Artificial Sequence: Synthetic coding sequence
atggaggagatgagagacagctacctggaggaggacgtgtaccagctgcaggagctgagaagagagctggacagagccaacaagaactgcagaatcctgcagtacagactgagaaaggccgagcagaagagcctgaaggtggccgagaccggccaggtggacggcgagctgatcagaagcctggagcaggacctgaaggtggccaaggacgtgagcgtgagactgcaccacgagctgaagaccgtggaggagaagagagccaaggccgaggacgagaacgagaccctgagacagcagatgatcgaggtggagatcagcaagcaggccctgcagaacgagctggagagactgaaggagagcagcctgaagagaagaagcaccagagagatgtacaaggagaagaagaccttcaaccaggacgacagcgccgacctgagatgccagctgcagttcgccaaggaggaggccttcctgatgagaaagaagatggccaagctgggcagagagaaggacgagctggagcaggagctgcagaagtacaagagcctgtacggcgacgtggacagccccctgcccaccggcgaggccggcggcccccccagcaccagagaggccgagctgaagctgagactgaagctggtggaggaggaggccaacatcctgggcagaaagatcgtggagctggaggtggagaacagaggcctgaaggccgagatggaggacatgagaggccagcaggagagagagggccccggcagagaccacgcccccagcatccccaccagccccttcggcgacagcctggagagcagcaccgagctgagaagacacctgcagttcgtggaggaggaggccgagctgctgagaagaagcatcagcgagatcgaggaccacaacagacagctgacccacgagctgagcaagttcaagttcgagccccccagagagcccggctggctgggcgagggcgccagccccggcgccggcggcggcgcccccctgcaggaggagctgaagagcgccagactgcagatcagcgagctgagcggcaaggtgctgaagctgcagcacgagaaccacgccctgctgagcaacatccagagatgcgacctggccgcccacctgggcctgagagcccccagccccagagacagcgacgccgagagcgacgccggcaagaaggagagcgacggcgaggagagcagactgccccagcccaagagagagggccccgtgggcggcgagagcgacagcgaggagatgttcgagaagaccagcggcttcggcagcggcaagcccagcgaggccagcgagccctgccccaccgagctgctgaaggccagagaggacagcgagtacctggtgaccctgaagcacgaggcccagagactggagagaaccgtggagagactgatcaccgacaccgacagcttcctgcacgacgccggcctgagaggcggcgcccccctgcccggccccggcctgcagggcgaggaggagcagggcgagggcgaccagcaggagccccagctgctgggcaccatcaacgccaagatgaaggccttcaagaaggagctgcaggccttcctggagcaggtgaacagaatcggcgacggcctgagccccctgccccacctgaccgagagcagcagcttcctgagcaccgtgaccagcgtgagcagagacagccccatcggcaacctgggcaaggagctgggccccgacctgcagagcagactgaaggagcagctggagtggcagctgggccccgccagaggcgacgagagagagagcctgagactgagagccgccagagagctgcacagaagagccgacggcgacaccggcagccacggcctgggcggccagacctgcttcagcctggagctgagaggcccccccgtgctgcccgagcagagcgtgagcatcgaggagctgcagggccagctggtgcaggccgccagactgcaccaggaggagaccgagaccttcaccaacaagatccacaagatggaggaggagcacctgtacgccctgagatggaaggagctggagatgcacagcctggccctgcagaacaccctgcacgagagaacctggagcgacgagaagaacctgatgcagcaggagctgagaagcctgaagcagaacatcttcctgttctacgtgaagctgagatggctgctgaagcactggagacagggcaagcagatggaggaggagggcgaggagttcaccgagggcgagcaccccgagaccctgagcagactgggcgagctgggcgtgcagggcggccaccaggccgacggccccgaccacgacagcgacagaggctgcggcttccccgtgggcgagcacagcccccacagcagagtgcagatcggcgaccacagcctgagactgcagaccgccgacagaggccagccccacaagcaggtggtggagaaccagcagctgttcagcgccttcaaggccctgctggaggacttcagagccgagctgagagaggacgagagagccagactgagactgcagcagcagtacgccagcgacaaggccgcctgggacgtggagtgggccgtgctgaagtgcagactggagcagctggaggagaagaccgagaacaagctgggcgagctgggcagcagcgccgagagcaagggcgccctgaagaaggagagagaggtgcaccagaagctgctggccgacagccacagcctggtgatggacctgagatggcagatccaccacagcgagaagaactggaacagagagaaggtggagctgctggacagactggacagagacagacaggagtgggagagacagaagaaggagttcctgtggagaatcgagcagctgcagaaggagaacagccccagaagaggcggcagcttcctgtgcgaccagaaggacggcaacgtgagacccttcccccaccagggcagcctgagaatgcccagacccgtggccatgtggccctgcgccgacgccgacagcatccccttcgaggacagacccctgagcaagctgaaggagagcgacagatgcagcgccagcgagaacctgtacctggacgccctgagcctggacgacgagcccgaggagccccccgcccacagacccgagagagagttcagaaacagactgcccgaggaggaggagaaccacaagggcaacctgcagagagccgtgagcgtgagcagcatgagcgagttccagagactgatggacatcagccccttcctgcccgagaagggcctgcccagcaccagcagcaaggaggacgtgaccccccccctgagccccgacgacctgaagtacatcgaggagttcaacaagagctgggactacacccccaacagaggccacaacggcggcggccccgacctgtgggccgacagaaccgaggtgggcagagccggccacgaggacagcaccgagcccttccccgacagcagctggtacctgaccaccagcgtgaccatgaccaccgacaccatgaccagccccgagcactgccagaagcagcccctgagaagccacgtgctgaccgagcagagcggcctgagagtgctgcacagcccccccgccgtgagaagagtggacagcatcaccgccgccggcggcgagggccccttccccaccagcagagccagaggcagccccggcgacaccaagggcggcccccccgagcccatgctgagcagatggccctgcaccagccccagacacagcagagactacgtggagggcgccagaagacccctggacagccccctgtgcaccagcctgggcttcgccagccccctgcacagcctggagatgagcaagaacctgagcgacgacatgaaggaggtggccttcagcgtgagaaacgccatctgcagcggccccggcgagctgcaggtgaaggacatggcctgccagaccaacggcagcagaaccatgggcacccagaccgtgcagaccatcagcgtgggcctgcagaccgaggccctgagaggcagcggcgtgaccagcagcccccacaagtgcctgacccccaaggccggcggcggcgccacccccgtgagcagccccagcagaagcctgagaagcagacaggtggcccccgccatcgagaaggtgcaggccaagttcgagagaacctgctgcagccccaagtacggcagccccaagctgcagagaaagcccctgcccaaggccgaccagcccaacaacagaaccagccccggcatggcccagaagggctacagcgagagcgcctgggccagaagcaccaccaccagagagagccccgtgcacaccaccatcaacgacggcctgagcagcctgttcaacatcatcgaccacagccccgtggtgcaggaccccttccagaagggcctgagagccggcagcagaagcagaagcgccgagcccagacccgagctgggccccggccaggagaccggcaccaacagcagaggcagaagccccagccccatcggcgtgggcagcgagatgtgcagagaggagggcggcgagggcacccccgtgaagcaggacctgagcgccccccccggctacaccctgaccgagaacgtggccagaatcctgaacaagaagctgctggagcacgccctgaaggaggagagaagacaggccgcccacggcccccccggcctgcacagcgacagccacagcctgggcgacaccgccgagcccggccccatggagaaccagaccgtgctgctgaccgccccctggggcctgtag

SEQ ID NO: 20023 - DNA, 4638 bp, Artificial Sequence
  Description of Artificial Sequence: Synthetic coding sequence
atggaggagatgagagacagctacctggaggaggacgtgtaccagctgcaggagctgagaagagagctggacagagccaacaagaactgcagaatcctgcagtacagactgagaaaggccgagcagaagagcctgaaggtggccgagaccggccaggtggacggcgagctgatcagaagcctggagcaggacctgaaggtggccaaggacgtgagcgtgagactgcaccacgagctgaagaccgtggaggagaagagagccaaggccgaggacgagaacgagaccctgagacagcagatgatcgaggtggagatcagcaagcaggccctgcagaacgagctggagagactgaaggagagcagcctgaagagaagaagcaccagagagatgtacaaggagaagaagaccttcaaccaggacgacagcgccgacctgagatgccagctgcagttcgccaaggaggaggccttcctgatgagaaagaagatggccaagctgggcagagagaaggacgagctggagcaggagctgcagaagtacaagagcctgtacggcgacgtggacagccccctgcccaccggcgaggccggcggcccccccagcaccagagaggccgagctgaagctgagactgaagctggtggaggaggaggccaacatcctgggcagaaagatcgtggagctggaggtggagaacagaggcctgaaggccgagatggaggacatgagaggccagcaggagagagagggccccggcagagaccacgcccccagcatccccaccagccccttcggcgacagcctggagagcagcaccgagctgagaagacacctgcagttcgtggaggaggaggccgagctgctgagaagaagcatcagcgagatcgaggaccacaacagacagctgacccacgagctgagcaagttcaagttcgagccccccagagagcccggctggctgggcgagggcgccagccccggcgccggcggcggcgcccccctgcaggaggagctgaagagcgccagactgcagatcagcgagctgagcggcaaggtgctgaagctgcagcacgagaaccacgccctgctgagcaacatccagagatgcgacctggccgcccacctgggcctgagagcccccagccccagagacagcgacgccgagagcgacgccggcaagaaggagagcgacggcgaggagagcagactgccccagcccaagagagagggccccgtgggcggcgagagcgacagcgaggagatgttcgagaagaccagcggcttcggcagcggcaagcccagcgaggccagcgagccctgccccaccgagctgctgaaggccagagaggacagcgagtacctggtgaccctgaagcacgaggcccagagactggagagaaccgtggagagactgatcaccgacaccgacagcttcctgcacgacgccggcctgagaggcggcgcccccctgcccggccccggcctgcagggcgaggaggagcagggcgagggcgaccagcaggagccccagctgctgggcaccatcaacgccaagatgaaggccttcaagaaggagctgcaggccttcctggagcaggtgaacagaatcggcgacggcctgagccccctgccccacctgaccgagagcagcagcttcctgagcaccgtgaccagcgtgagcagagacagccccatcggcaacctgggcaaggagctgggccccgacctgcagagcagactgaaggagcagctggagtggcagctgggccccgccagaggcgacgagagagagagcctgagactgagagccgccagagagctgcacagaagagccgacggcgacaccggcagccacggcctgggcggccagacctgcttcagcctggagatggaggaggagcacctgtacgccctgagatggaaggagctggagatgcacagcctggccctgcagaacaccctgcacgagagaacctggagcgacgagaagaacctgatgcagcaggagctgagaagcctgaagcagaacatcttcctgttctacgtgaagctgagatggctgctgaagcactggagacagggcaagcagatggaggaggagggcgaggagttcaccgagggcgagcaccccgagaccctgagcagactgggcgagctgggcgtgcagggcggccaccaggccgacggccccgaccacgacagcgacagaggctgcggcttccccgtgggcgagcacagcccccacagcagagtgcagatcggcgaccacagcctgagactgcagaccgccgacagaggccagccccacaagcaggtggtggagaaccagcagctgttcagcgccttcaaggccctgctggaggacttcagagccgagctgagagaggacgagagagccagactgagactgcagcagcagtacgccagcgacaaggccgcctgggacgtggagtgggccgtgctgaagtgcagactggagcagctggaggagaagaccgagaacaagctgggcgagctgggcagcagcgccgagagcaagggcgccctgaagaaggagagagaggtgcaccagaagctgctggccgacagccacagcctggtgatggacctgagatggcagatccaccacagcgagaagaactggaacagagagaaggtggagctgctggacagactggacagagacagacaggagtgggagagacagaagaaggagttcctgtggagaatcgagcagctgcagaaggagaacagccccagaagaggcggcagcttcctgtgcgaccagaaggacggcaacgtgagacccttcccccaccagggcagcctgagaatgcccagacccgtggccatgtggccctgcgccgacgccgacagcatccccttcgaggacagacccctgagcaagctgaaggagagcgacagatgcagcgccagcgagaacctgtacctggacgccctgagcctggacgacgagcccgaggagccccccgcccacagacccgagagagagttcagaaacagactgcccgaggaggaggagaaccacaagggcaacctgcagagagccgtgagcgtgagcagcatgagcgagttccagagactgatggacatcagccccttcctgcccgagaagggcctgcccagcaccagcagcaaggaggacgtgaccccccccctgagccccgacgacctgaagtacatcgaggagttcaacaagagctgggactacacccccaacagaggccacaacggcggcggccccgacctgtgggccgacagaaccgaggtgggcagagccggccacgaggacagcaccgagcccttccccgacagcagctggtacctgaccaccagcgtgaccatgaccaccgacaccatgaccagccccgagcactgccagaagcagcccctgagaagccacgtgctgaccgagcagagcggcctgagagtgctgcacagcccccccgccgtgagaagagtggacagcatcaccgccgccggcggcgagggccccttccccaccagcagagccagaggcagccccggcgacaccaagggcggcccccccgagcccatgctgagcagatggccctgcaccagccccagacacagcagagactacgtggagggcgccagaagacccctggacagccccctgtgcaccagcctgggcttcgccagccccctgcacagcctggagatgagcaagaacctgagcgacgacatgaaggaggtggccttcagcgtgagaaacgccatctgcagcggccccggcgagctgcaggtgaaggacatggcctgccagaccaacggcagcagaaccatgggcacccagaccgtgcagaccatcagcgtgggcctgcagaccgaggccctgagaggcagcggcgtgaccagcagcccccacaagtgcctgacccccaaggccggcggcggcgccacccccgtgagcagccccagcagaagcctgagaagcagacaggtggcccccgccatcgagaaggtgcaggccaagttcgagagaacctgctgcagccccaagtacggcagccccaagctgcagagaaagcccctgcccaaggccgaccagcccaacaacagaaccagccccggcatggcccagaagggctacagcgagagcgcctgggccagaagcaccaccaccagagagagccccgtgcacaccaccatcaacgacggcctgagcagcctgttcaacatcatcgaccacagccccgtggtgcaggaccccttccagaagggcctgagagccggcagcagaagcagaagcgccgagcccagacccgagctgggccccggccaggagaccggcaccaacagcagaggcagaagccccagccccatcggcgtgggcagcgagatgtgcagagaggagggcggcgagggcacccccgtgaagcaggacctgagcgccccccccggctacaccctgaccgagaacgtggccagaatcctgaacaagaagctgctggagcacgccctgaaggaggagagaagacaggccgcccacggcccccccggcctgcacagcgacagccacagcctgggcgacaccgccgagcccggccccatggagaaccagaccgtgctgctgaccgccccctggggcctgtag

SEQ ID NO: 20024 - DNA, 1320 bp, Artificial Sequence
  Description of Artificial Sequence: Synthetic coding sequence
atggcccccaagaagaagagaggccccagcgccggcagccagcccggcggcgccgccgccgccggcgccgagcagcccctgagcgagagagcccagtacctgcagagagagcacgccctgctgagcgagcagctggacacctgcgaggagagcgtggaccaggtgctgagagagaacgccttcctggacagagaggccctgagactgagagaggagaacagactgtacgccagctacgtgagcgccagagcccagagatgcgccaaggccatcgtgagactggacgagcagaacagagtggacctggcccagatccactggcagagagccgagctggccagcctgtaccacggcagagaggacggcgtgagagcccagctgctggagatggaggccagagccgcccagatggcccagcaggtgcaggagctgcagccctacaaggtgctgcagctggagcagctggccagaatcagagccctggagagagagctgctgcacatgagagtggagcacacccagctgctgcacagagtgaagagaagattcctggaggacaaggccgccttcgagagagaggccagacagagagtgcagagcctggccagaagagccgagagagaggccgtgagagccctggtggcccacacccaggccatcaaggccgacaacggcagactgagacaggagctgctgctgctgctgagaagaacccagctgctgcaccacaccagaagacagctgctggagcagagagagcagctgcacagagagcacgaggacaccagagacctggccagagtgcacggctggctgagaagaggccccggcggcccccccctgtgggagagacccgccttcagccagcccaccagcagacccggcagcctggccgcccccatcagccccagcagagccgccagccagacccccagcgtggtgcccagcagagccgcccccagagccagcagcgtggtgcccagcagagaggccagcagagtgcccagcctggtgctgagcagcatggacagcagagtgcccagcctggccaccagcaaggtgggcagcagaatgcccagcctgaccgccagcagagccggcagcagagccctgagcctggtgcagagcctggagggcagcggcatcagcagcggcagcagccccagagtgagcagccaggacaccctgagaagcaccaagagcggccccaagctgctgagcggcctgagcagagacagagaccccgccctgctgcccccccagagcgaggacagcgtgaacgccgaggccgccgccgaggccagccccggcagagcctag

SEQ ID NO: 20025 - DNA, 7359 bp, Artificial Sequence
  Description of Artificial Sequence: Synthetic coding sequence
atggcccagatccagaaggacaaggccaacatcagcgagaagagcgtgatgcaccccgagtacatcgccgtgaaggccgagaagagccccctgagccacatcctgaagaccaaggagctgcaggtgaacatcagccagcagggcgagaaggcccaggagggcgaggtggagatcgtggtgctgctgagcaagacctgccccttcgtgaccagcagcgccttcctggagctggacagcatcaaggaggaggagggcgagcccagaatcaccagaagcttcatgccccacctggagatccaggagagcctgcccagcagacagaccgcccccaccaagcccaccgagagcctggtgaagaaggagaagcagctgctgccccagaaggaggacagagtgcagaccgtgagcatgcacggcctgatgcaccccaacggcgccgtgttcaaggccaagaccagcgcccccccccaggtgttcagcatcaccgagcacagccccctgagcaagagaaaggagccccagtggggcatgaaggagagagccggccagaagcaggacagaaccggcagaccccacgtgatcctgaccaagacccaccccttcatgcccagcctgagccaccacagattcagccccagccagcccaagctgcccatcagcagcggcgccggcaagagcagactggccaacagcaacgagggcatcagcagccacaaggtgatcctgaaggccaaccagcagatgccctacaaggaggccaaggacagagtgaagatcgagggcagagagggcagaatcctgcccaagagaatccacctgagagccgaggccctgcccctggccctgctgtgcaacggcaagaactacagcctgcacatcgaggagcagggcgagggcgtgcaggagagcaagaaggagcccggcgtggtgcccagaaagagcgccagcttcccccccccccccttctacctgaactgcgacaccagaagaaacgagaaggagggcaccctgggcaagacccagttcagcttcccccccctgaagatccaggacagcagcgacagcggcaagaaggcctacaccgagagcctgcacggctacaccctgagcaacagcaagggccccgtgcagcccaccgcccagggcgaggagaagggcggcctgagaatcgacatggaggacaagatgctgcccaagtgcaccgacctgaaggccaagcagctgctgctgagcgacatcctgaacaccaagaagctgcagtggaagagcaaggagcagaagagaaagatccaggaggacaagaacaagcaggtgaagggcctgcccagcatcaacaccagcctgctgacccccccctacctgaagttcgacaccaccgagggccaggagaacgtgatcagaatcgccaaggtgagcctgccccagagcagaagcaaggagagcagcgacgccggcagaatcgcctgccccgaggccacccacggcgagctgagcagcgacgtgaagcagctgaaggcccacctgctgcagaaggaggagaaggacagagagaaggtggccgacatgaccagcgtgctggaccccaacaagatgtacctgaaggccaagaagagccccgtgctgcacacccacagcttcagcgacctgcagtggaagaccagagagcaggaggaggagaaggtgcagaaggtgaagagcggccccggcgtgatgctgagcaagagccccagcagaagcagccccctgcacctgaacgtgaacaccggcttccaggaggagagcatccccatcctgaccagacccagcttccccctggtgaagctgcaggtgagccccgacaccgagggcggcacctgcatcagacccatcgccggcgacatcctgatctacctgcagaagggcaagcacgtgagccagaacaaggaggaggacgacgtgcagatcgtgagcatcctgatcttccccaagcaccaggaggagaaggtgcaggagtgcgagggcgagcccggcgtggtgctgaccaagagcaccagcctgcccagcctgagccagctggagctggacaaggagacccacctgggcaacgagatgctgagactgaagagacccatcctgagaagaatcagccacatcggcgagaccgtgcacagagagagcgtggtgggcgacatccccaaggacgtgaagaacgagaagcagcacatcccccagaaggaggagagaaaccagaagaagatcatcgacatgagaggcaccgacatcaccctgaagagcaagaagagccccagaagctgcatgctgcacagaaccgagctgcacgtgaacatcggcggccagggcagaaaggagcacgagggccaggacaagccccccggcatgatccagagaaagatgtgcatcctgttcagcaagcccctgcccagcaacctgaagctggagagagccacccacgccgacgaggagagactgggcggcaagaccagcttcgtgctgcccctgatgcccagcgccctgcccgacaccgagaagaccgccgacgccgaggccagaagcggcgacgtgagaaagggcaagccccacagaagccagaaggagaacagacacgaggtgaagaccatcgacatgagattcagaatccactgccaggaggccagaatcagccccatgagccacatcctgaacgccaaggagctggtgctgaacatcaacaagctggagaagaaggtgcacaaggacaaggacgaggcctgcgtggtgctgagcagaaccttcctgagcatccccagcgccccccccctgtacctggacagcggcaacaagaccgacaaggacacccccggcatcaccggcagcagctgcccccagagaaccctgcacgtgcccagcaacacccagaagatcaccaacagagacagcgtggagggcgtggacaagaacgtggtgaagcaggccgagcagtacgtgcccagacccgaggccgagcagcagctgaccagcaacttcatgatcagcgtgcagcagagaaaccagcccagcagagtgagaagcgaggaggacctgaaccagctggtgctgaacagcagagacgaggacatctacttcaccggcttcggcaccatcagaagcggcaagagacccgagtggctgttcaccggcaagaaggcccagcccgtgaagtacaagaccgagaccctgaccgccttcctgagctaccccaccatggacgccaccaagatgggcggcctggaggaggacaccgagatcatggacaacctgaaccacaagatcagccccaaggccagcgtgagcctgatcagaaagatcagcaaggagctgtacgtgaccctgggcacccccgccaacagcaagggcttcagcgtgagcgagagatacgcccaccagcaggagaccagcagcaaggtgagccccgagctggccggcagctgcaagttcgacaagcccaaggaggacggccagagcaacgacagaatcagcaagatgttcagccccaaggtgctggccccccagaccaagggcagcctgaagaagatcagcatcgtgaccaactggaacgccccccagaacatcgaggagcaggacatcgtgatgaagaagcaggtgatcagaagatgcgagcacggccacaagaccagaaccaacaccatcctgagcaagttccccctgcagagcggcaagcagaagacccccagcgagaccgacgtggacaagaagaccaccgcccacctgagcctgcagatgctgcccggcatccacatggacatgaccgagatcgaccccgccaagggcggcagaaagcaggccctgctgatcagcgagcaggaggagggcgtgctggagttcctgcccaagagcctgttccccccctggaccttccagttccagagcggcgacctggaggagaagcaccagaccgacgccaacaccaacatcaacctggagcagaagaagctggagatggacaacgacagcaccgtgaaccagaaggagggcaagctgaagatcggcaccaacagagccctgcacctgcaggaggagaagaccgagatgcacaaggccagaaccgccaacctggagaaggagagaggcagaatggacaccagcagcagcgcccacccccacctgctgagcctgaaggccgaggagagccagatgaagacccaggtgatcacccacagagagaacagcagactgatcatgcagaagcagaagaaggagctggaggccagcaacgccaagcagagcatccagctgcagaagctgttccagagaaacgtgctggacagcttctacagctacgtgcccctgagccccaagagaaaggaccagaagggcagactgaccatcagagacctgaagagagagctgagcaccaagtacctgaccatgaagatccagaaccaccccatcccccagatgctgaacatcaccggcagaggcacccccagcaacagaaagaagctggagtacgacgtgaagctgaagaacatcgccagctggagcaaggacgtgagcggcatcttcatcagaagcctgagcatcagcatcatgagaagcccccacaccgaccccaagaccaacctggagagagagaagagaatctgcctgcccaagttccaggagaagagccccaacaccagcgagatgagcaagagagacaccctgaccatcgtgaagggcgagcagaacttcaccaacaccgtgccccaggacccccagcccttcgccgtggacaagcagcagatgcagaagctgcccaacgtgaagagcgaggccaacctgagaagcgagatgaacaagaagtacctgaaggcccagaccaaggagagaatcgtgcccgagcacgacgtgagcagaatcatcaagaagcccgacctgagaatcatcgagcaggaggagaagatcctgaagagaatcctgacccccaccgagtgccccagcatgctggaggaccccaagctgcccaagcagagagaccagagcgagcccgtgtgggacatgaccacccagaaggtgcagcagcagaaggccttccccggcaccgtgcccatccccccccaggtgaagagcagcgaggtgaagatcgtggccgacagcaccaacgccgagcacctgctgcccatctgcgaggccaccaaggccatcagcgagagccaggtgaagaacatgatccaggacaaggtgagcagcgacaagctggacaacatccaggcctacaagcccgacgacctgaagagcccccccttccccgagggccccgacaccatcagcaccgccatctaccccaagacccagcacaagagcctgctggagcagttcacccccaaggagaagaacaagctgaccagccacctggagagcaaggccctggagatccagctgaacctgatccccgagatggccagaaagagcctgcagatgttcaacttctaccccaagggcaccatcagcaaggacaacagctggagattctacagcagacacaagaccatgaacttcatgagcctggagggcaccgacaccatcgagcccaacagcaagcacaagcaccagaaggacagccccctggccagcaacatgaagaccctgatcgtggacgtgagcagcgacagcgaggagaccatcaccaagctgcagagcatcaacaagctggagaacggcaccagcgccgtgaccagcgccagcgagatgctgctgccccacaccctgcagaaccacagcgtgaaggagaagggcaagctgctgatgcacttcagcgtgaagaccctggagatccagatgaaggccttccccagaatcgtgagagagagctacgccatgaccagcgcccacgagagaaagaagcccctgagcaactgcatccaccccggcttcaccggccccaagagacagaacagaatcctgctgctgagcgaggagaagagcctgcaccagatcgacctggacctgcagtacaagtacctgagattcctgctgggcctgcccgtgggcagcaccttccccaagcccaacgtgctgcccaagcacagcaagctgaacaccatcgccgtgtgcaagaacgtgaacgccggcggccagagcggcagcctgagcatcgacaccgagctgctggagcagcacatcagcttcaagaagcagagcccccacgagaacagcagcctgatcagaaagttcccccagcccaccctggtgtgcgccagcgacagagacctgcacagccccagaaagaaggacacccaggtgctgagcgagagcgagttccacgtgacccccgagaagaacaagcagtaccacgtgtggttccaggagagaaacacctgcgagagcgtggacctgagaacccagagaaacgccaccggcagcgccgtgagctgcgagacccagatcagcgaggacttcgtggacatccagaccgacatcgagagccccgccgacctggacgagtgcagctgcctggaggtgagcgagagcgaggagtgcgtgttcctggaggccaacagctacctgagccaggagagcgagaacatcctgttcgagctgcagaccggcatccccctggagaacgtgtacaagatcaccaccgacctgaagagcttctacagcgaggacagcggcagccactgcaccagagagtgcagaaaggagaccctgatcatcaccccccccagctgcaagagccacaagagcagaaagtacagaagcagcagcaagatgaagagccccgactggctgtgccacagcagcagcaacaccgccgagatccagagcagaagcagcagcgtgagcttcagcgaggagaagatcagctggaccaccaagagcagaaccagctacagcagcgcccccctgaccgagagcaacatcaagagccacctggccaagaaccagggcaagagccacagacaccccgagagccaggagagaaagaaggccagaagcgacctgttcagaaagaacagcagccactgggaccacgactacagctgcacccacagcaagggcaagagagacagaaagaagagagtgtacgactacgagagcgagagactggactgcttccagagcaagcacaagagcgccagcaagccccaccacgacgacatcaacttctacagcgagagaaagcagaacagacccttcttcttcgcctgcgtgcccgccgacagcctggaggtgatccccaagaccatcagatggaccatcccccccgagaccctgagaaagagaaacttcagaatccccctggtggccaagatcagcagcagctggaacatctggagcagcagcaagaagctgctgggcagcctgagcggcagcctgaccaccgtgttccacagctag

SEQ ID NO: 20026 - DNA, 645 bp, Artificial Sequence
  Description of Artificial Sequence: Synthetic coding sequence
atgaaggaggagagaaactacaacttcgacggcgtgagcaccaacagactgaagcagcagctgctggaggaggtgagaaagaaggacgccgtgcagctgagcatcttcgagctgagacacaagatcaccgagctggaggccaagctgaacaccgacaacgagggcagcgagtggaagaccagatacgagacccagctggagctgaacgacgagctggagaagcagatcgtgtacctgaaggagaaggtggagaagatccacggcaacagcagcgacagactgagcagcatcagagtgtacgagagaatgcccgtggagagcctgaacaccctgctgaagcagctggaggaggagaagaagaccctggagagccaggtgaagtactacgccctgaagctggagcaggagagcaaggcctaccagaagatcaacaacgagagaagaacctacctggccgagatgagccagggcagcggcctgcaccaggtgagcaagagacagcaggtggaccagctgcccagaatgcaggagaacctggtgaagaccggcagatacaaccccgccaagcagaagaccgtgagcgccaagagaggccccgtgaagaagatcaccagacccaaccacctgcccgagctgcacccctag

SEQ ID NO: 20027 - DNA, 426 bp, Artificial Sequence
  Description of Artificial Sequence: Synthetic coding sequence
atggagaccctgcaggagagcctgaacaccctgctgaagcagctggaggaggagaagaagaccctggagagccaggtgaagtactacgccctgaagctggagcaggagagcaaggcctaccagaagatcaacaacgagagaagaacctacctggccgagatgagccagggcagcggcctgcaccaggtgagcaagagacagcaggtggaccagctgcccagaatgcaggagaacctggtgaagaccctgctgctgaaggaggagctggaccccctgaaggtgagctgcctggagaccctgggcttcagcgccgccggcgtggccggccccgagaacagaacctgcctgggccagaaggccctgtggcccgcctgcctgcacggcagcagcaccctggccgtgtgccagacccacctgaagagctag

SEQ ID NO: 20028 - DNA, 339 bp, Artificial Sequence
  Description of Artificial Sequence: Synthetic coding sequence
atgcccgtggagagcctgaacaccctgctgaagcagctggaggaggagaagaagaccctggagagccaggtgaagtactacgccctgaagctggagcaggagagcaaggcctaccagaagatcaacaacgagagaagaacctacctggccgagatgagccagggcagcggcctgcaccaggtgagcaagagacagcaggtggaccagctgcccagaatgcaggagaacctggtgaagaccggcagatacaaccccgccaagcagaagaccgtgagcgccaagagaggccccgtgaagaagatcaccagacccaaccacctgcccgagctgcacccctag

SEQ ID NO: 20029 - DNA, 420 bp, Artificial Sequence
  Description of Artificial Sequence: Synthetic coding sequence
atgcccgtggagagcctgaacaccctgctgaagcagctggaggaggagaagaagaccctggagagccaggtgaagtactacgccctgaagctggagcaggagagcaaggcctaccagaagatcaacaacgagagaagaacctacctggccgagatgagccagggcagcggcctgcaccaggtgagcaagagacagcaggtggaccagctgcccagaatgcaggagaacctggtgaagaccctgctgctgaaggaggagctggaccccctgaaggtgagctgcctggagaccctgggcttcagcgccgccggcgtggccggccccgagaacagaacctgcctgggccagaaggccctgtggcccgcctgcctgcacggcagcagcaccctggccgtgtgccagacccacctgaagagctag

SEQ ID NO: 20030 - DNA, 420 bp, Artificial Sequence; identical to SEQ ID NO: 20029
  Description of Artificial Sequence: Synthetic coding sequence

SEQ ID NO: 20031 - DNA, 339 bp, Artificial Sequence; identical to SEQ ID NO: 20028
  Description of Artificial Sequence: Synthetic coding sequence

SEQ ID NO: 20032 - DNA, 726 bp, Artificial Sequence
  Description of Artificial Sequence: Synthetic coding sequence
atgaaggaggagagaaactacaacttcgacggcgtgagcaccaacagactgaagcagcagctgctggaggaggtgagaaagaaggacgccgtgcagctgagcatcttcgagctgagacacaagatcaccgagctggaggccaagctgaacaccgacaacgagggcagcgagtggaagaccagatacgagacccagctggagctgaacgacgagctggagaagcagatcgtgtacctgaaggagaaggtggagaagatccacggcaacagcagcgacagactgagcagcatcagagtgtacgagagaatgcccgtggagagcctgaacaccctgctgaagcagctggaggaggagaagaagaccctggagagccaggtgaagtactacgccctgaagctggagcaggagagcaaggcctaccagaagatcaacaacgagagaagaacctacctggccgagatgagccagggcagcggcctgcaccaggtgagcaagagacagcaggtggaccagctgcccagaatgcaggagaacctggtgaagaccctgctgctgaaggaggagctggaccccctgaaggtgagctgcctggagaccctgggcttcagcgccgccggcgtggccggccccgagaacagaacctgcctgggccagaaggccctgtggcccgcctgcctgcacggcagcagcaccctggccgtgtgccagacccacctgaagagctag

SEQ ID NO: 20033 - DNA, 1773 bp, Artificial Sequence
  Description of Artificial Sequence: Synthetic coding sequence
atggacagccacagcggcgagcccgccctgctgccctgcggcacctgcgacatggtgttcagaagcagcgccctgctggccacccacacccagagattctgcatcggccaccccacccaggagatgaccttcggcgcccaggccagcgtggccaccgagccccagagagccgccgtgcagtggctgagactgagcctgcaggagatgagaccctggatcaccgaggtgcccagagtgttcgccggcccctggaccagaagcgaggccagaccccagagccccatgagcgaggccgtgggcagccccagcgagagactgagagccctgttcagaaccagagccagaagagtggccgagatggaggcccagagcagagccctgcagctgagaggcgaggagctgagcagaagactgcaggtggtggcctgcaccagaggcggcatgagcagactgttcggcctggagcaggagatcagagagctgcaggccgaggccggcagaaccagaggcgccctggaggtgctgggcgccagaatccaggagctgcaggccgagcccggcaaccccctgagcagcagaagagaggccgagctgtacagccccgtgcagaaggccaaccccggcaccctggccgccgagatcagagccctgagagaggcctacatcagagacggcggcagagaccccggcgtgctgggccagatctggcagctgcaggtggaggccagcgccctggagctgcagagaagccagaccagaagaggcagagccggcgccaccagcggcgagctgcccgtggtggaggccgagaacagaagactggaggccgagatcctggccctgcagatgcagagaggcagagcccccctgggcccccaggacctgagactgctgggcgacgccagcctgcagcccaagggcagaagagacccccccctgctgcccccccccgtggccccccccctgccccccctgcccggcttcagcgagccccagctgcccggcaccatgaccagaaacctgggcctggacagccacttcctgctgcccaccagcgacatgctgggccccgccccctacgaccccggcgccggcctggtgatcttctacgacttcctgagaggcctggaggccagctggatctgggtgcagctgagaaccggcctggccagagacggcagagacaccggcagaaccaccgccctgccccccgccctgtgcctgccccccccccccgcccccggccccatgggcaactgcgccatcctggccagcagacagcccgtgcccagactgccccccagcagcagcgtgagcctggtgtgcgagctgcaggtgtggcagggcctggcctgggccagagccccccagcccaaggcctgggtgagcctgggcctgttcgaccaggaccagagagtgctgagcggcagatggagactgcccctgagagccctgcccctggaccccagcctgagcctgggccagctgaacggcatcccccaggccggccaggccgagctgttcctgagactggtgaacgccagagacgccgccgtgcagaccctggccgagatcaaccccgccagcgtgcacgagtaccagtaccccccccccgtgagcagcaccagcagcctggaggccagcttcctgacccccgccgtgggcttcgccgaccccccccccagaaccgaggagcccctgagcggcgtgaaggacagagacgagggcctgggcccccaccacagcagcgacctgccccccgtgagcttctag

SEQ ID NO: 20034 - DNA, 333 bp, Artificial Sequence
  Description of Artificial Sequence: Synthetic coding sequence
atggacagccacagcggcgagcccgccctgctgccctgcggcacctgcgacatggtgttcagaagcagcgccctgctggccacccacacccagagattctgcatcggccaccccacccaggagatgaccttcggcgcccaggccagcgtggccaccgagccccagagagccgccgtgagcagcaccagcagcctggaggccagcttcctgacccccgccgtgggcttcgccgaccccccccccagaaccgaggagcccctgagcggcgtgaaggacagagacgagggcctgggcccccaccacagcagcgacctgccccccgtgagcttctag

SEQ ID NO: 20035 - DNA, 1842 bp, Artificial Sequence
  Description of Artificial Sequence: Synthetic coding sequence
atggacagccacagcggcgagcccgccctgctgccctgcggcacctgcgacatggtgttcagaagcagcgccctgctggccacccacacccagagattctgcatcggccaccccacccaggagatgaccttcggcgcccaggccagcgtggccaccgagccccagagagccgccgtggtgccccaggagcaccagggcgtgccccaggagccccagggcctgcccgaccagcaggccagcagaagcgccctgaagagactgaccgaggaggagatgagaccctggatcaccgaggtgcccagagtgttcgccggcccctggaccagaagcgaggccagaccccagagccccatgagcgaggccgtgggcagccccagcgagagactgagagccctgttcagaaccagagccagaagagtggccgagatggaggcccagagcagagccctgcagctgagaggcgaggagctgagcagaagactgcaggtggtggcctgcaccagaggcggcatgagcagactgttcggcctggagcaggagatcagagagctgcaggccgaggccggcagaaccagaggcgccctggaggtgctgggcgccagaatccaggagctgcaggccgagcccggcaaccccctgagcagcagaagagaggccgagctgtacagccccgtgcagaaggccaaccccggcaccctggccgccgagatcagagccctgagagaggcctacatcagagacggcggcagagaccccggcgtgctgggccagatctggcagctgcaggtggaggccagcgccctggagctgcagagaagccagaccagaagaggcagagccggcgccaccagcggcgagctgcccgtggtggaggccgagaacagaagactggaggccgagatcctggccctgcagatgcagagaggcagagcccccctgggcccccaggacctgagactgctgggcgacgccagcctgcagcccaagggcagaagagacccccccctgctgcccccccccgtggccccccccctgccccccctgcccggcttcagcgagccccagctgcccggcaccatgaccagaaacctgggcctggacagccacttcctgctgcccaccagcgacatgctgggccccgccccctacgaccccggcgccggcctggtgatcttctacgacttcctgagaggcctggaggccagctggatctgggtgcagctgagaaccggcctggccagagacggcagagacaccggcagaaccaccgccctgccccccgccctgtgcctgccccccccccccgcccccggccccatgggcaactgcgccatcctggccagcagacagcccgtgcccagactgccccccagcagcagcgtgagcctggtgtgcgagctgcaggtgtggcagggcctggcctgggccagagccccccagcccaaggcctgggtgagcctgggcctgttcgaccaggaccagagagtgctgagcggcagatggagactgcccctgagagccctgcccctggaccccagcctgagcctgggccagctgaacggcatcccccaggccggccaggccgagctgttcctgagactggtgaacgccagagacgccgccgtgcagaccctggccgagatcaaccccgccagcgtgcacgagtaccagtaccccccccccgtgagcagcaccagcagcctggaggccagcttcctgacccccgccgtgggcttcgccgaccccccccccagaaccgaggagcccctgagcggcgtgaaggacagagacgagggcctgggcccccaccacagcagcgacctgccccccgtgagcttctag

SEQ ID NO: 20036 - DNA, 1869 bp, Artificial Sequence
  Description of Artificial Sequence: Synthetic coding sequence
atggacagccacagcggcgagcccgccctgctgccctgcggcacctgcgacatggtgttcagaagcagcgccctgctggccacccacacccagagattctgcatcggccaccccacccaggagatgaccttcggcgcccaggccagcgtggccaccgagccccagagagccgccgtggtgccccaggagcaccagggcgtgccccaggagccccagggcctgcccgaccagcaggccagcagaagcgccctgaagagactgaccgaggaggtgcagtggctgagactgagcctgcaggagatgagaccctggatcaccgaggtgcccagagtgttcgccggcccctggaccagaagcgaggccagaccccagagccccatgagcgaggccgtgggcagccccagcgagagactgagagccctgttcagaaccagagccagaagagtggccgagatggaggcccagagcagagccctgcagctgagaggcgaggagctgagcagaagactgcaggtggtggcctgcaccagaggcggcatgagcagactgttcggcctggagcaggagatcagagagctgcaggccgaggccggcagaaccagaggcgccctggaggtgctgggcgccagaatccaggagctgcaggccgagcccggcaaccccctgagcagcagaagagaggccgagctgtacagccccgtgcagaaggccaaccccggcaccctggccgccgagatcagagccctgagagaggcctacatcagagacggcggcagagaccccggcgtgctgggccagatctggcagctgcaggtggaggccagcgccctggagctgcagagaagccagaccagaagaggcagagccggcgccaccagcggcgagctgcccgtggtggaggccgagaacagaagactggaggccgagatcctggccctgcagatgcagagaggcagagcccccctgggcccccaggacctgagactgctgggcgacgccagcctgcagcccaagggcagaagagacccccccctgctgcccccccccgtggccccccccctgccccccctgcccggcttcagcgagccccagctgcccggcaccatgaccagaaacctgggcctggacagccacttcctgctgcccaccagcgacatgctgggccccgccccctacgaccccggcgccggcctggtgatcttctacgacttcctgagaggcctggaggccagctggatctgggtgcagctgagaaccggcctggccagagacggcagagacaccggcagaaccaccgccctgccccccgccctgtgcctgccccccccccccgcccccggccccatgggcaactgcgccatcctggccagcagacagcccgtgcccagactgccccccagcagcagcgtgagcctggtgtgcgagctgcaggtgtggcagggcctggcctgggccagagccccccagcccaaggcctgggtgagcctgggcctgttcgaccaggaccagagagtgctgagcggcagatggagactgcccctgagagccctgcccctggaccccagcctgagcctgggccagctgaacggcatcccccaggccggccaggccgagctgttcctgagactggtgaacgccagagacgccgccgtgcagaccctggccgagatcaaccccgccagcgtgcacgagtaccagtaccccccccccgtgagcagcaccagcagcctggaggccagcttcctgacccccgccgtgggcttcgccgaccccccccccagaaccgaggagcccctgagcggcgtgaaggacagagacgagggcctgggcccccaccacagcagcgacctgccccccgtgagcttctag

SEQ ID NO: 20037 - DNA, 852 bp, Artificial Sequence
  Description of Artificial Sequence: Synthetic coding sequence
atgaagaaggacgaggccctgaaggccctgcagaaccaggtgagcgaggagaccatcaaggtgagacagctggacagcgccctggagatctgcaaggaggagctggtgctgcacctgaaccagctggagggcaacaaggagaagttcgagaagcagctgaagaagaagagcgaggaggtgtactgcctgcagaaggagctgaagatcaagaaccacagcctgcaggagaccagcgagcagaacgtgatcctgcagcacaccctgcagcagcagcagcagatgctgcagcaggagaccatcagaaacggcgagctggaggacacccagaccaagctggagaagcaggtgagcaagctggagcaggagctgcagaagcagagagagagcagcgccgagaagctgagaaagatggaggagaagtgcgagagcgccgcccacgaggccgacctgaagagacagaaggtgatcgagctgaccggcaccgccagacaggtgaagatcgagatggaccagtacaaggaggagctgagcaagatggagaaggagatcatgcacctgaagagagacggcgagaacaaggccatgcacctgagccagctggacatgatcctggaccagaccaagaccgagctggagaagaagaccaacgccgtgaaggagctggagaagctgcagcacagcaccgagaccgagctgaccgaggccaagaacggcaagtacctgagaaccaccaagtgcagctggagaatcaagaagtacttcaagaccacccccggcatcgagagatgcaccaccgagggcagcatcatcatcagaggcaagatccactactacaagggcagccacagctag

SEQ ID NO: 20038 - DNA, 2412 bp, Artificial Sequence
  Description of Artificial Sequence: Synthetic coding sequence
atggtgatcgagaaggagcagagcctgcaggagagcaaggaggagtgcatcaagctgaaggtggacctgctggagcagaccaagcagggcaagagagccgagagacagagaaacgaggccctgtacaacgccgaggagctgagcaaggccttccagcagtacaagaagaaggtggccgagaagctggagaaggtgcaggccgaggaggagatcctggagagaaacctgaccaactgcgagaaggagaacaagagactgcaggagagatgcggcctgtacaagagcgagctggagatcctgaaggagaagctgagacagctgaaggaggagaacaacaacggcaaggagaagctgagaatcatggccgtgaagaacagcgaggtgatggcccagctgaccgagagcagacagagcatcctgaagctggagagcgagctggagaacaaggacgagatcctgagagacaagttcagcctgatgaacgagaacagagagctgaaggtgagagtggccgcccagaacgagagactggacctgtgccagcaggagatcgagagcagcagagtggagctgagaagcctggagaagatcatcagccagctgcccctgaagagagagctgttcggcttcaagagctacctgagcaagtaccagatgagcagcttcagcaacaaggaggacagatgcatcggctgctgcgaggccaacaagctggtgatcagcgagctgagaatcaagctggccatcaaggaggccgagatccagaagctgcacgccaacctgaccgccaaccagctgagccagagcctgatcacctgcaacgacagccaggagagcagcaagctgagcagcctggagaccgagcccgtgaagctgggcggccaccaggtggccgagagcgtgaaggaccagaaccagcacaccatgaacaagcagtacgagaaggagagacagagactggtgaccggcatcgaggagctgagaaccaagctgatccagatcgaggccgagaacagcgacctgaaggtgaacatggcccacagaaccagccagttccagctgatccaggaggagctgctggagaaggccagcaacagcagcaagctggagagcgagatgaccaagaagtgcagccagctgctgaccctggagaagcagctggaggagaagatcgtggcctacagcagcatcgccgccaagaacgccgagctggagcaggagctgatgctggaggcccagctggagaagaaggaccagcagttcaaggagcaggagaagaccatgagcatgctgcagcaggacatcatctgcaagcagcaccacctggagagcctggacagactgctgaccgagagcaagggcgagatgaagaaggagaacatgaagaaggacgaggccctgaaggccctgcagaaccaggtgagcgaggagaccatcaaggtgagacagctggacagcgccctggagatctgcaaggaggagctggtgctgcacctgaaccagctggagggcaacaaggagaagttcgagaagcagctgaagaagaagagcgaggaggtgtactgcctgcagaaggagctgaagatcaagaaccacagcctgcaggagaccagcgagcagaacgtgatcctgcagcacaccctgcagcagcagcagcagatgctgcagcaggagaccatcagaaacggcgagctggaggacacccagaccaagctggagaagcaggtgagcaagctggagcaggagctgcagaagcagagagagagcagcgccgagaagctgagaaagatggaggagaagtgcgagagcgccgcccacgaggccgacctgaagagacagaaggtgatcgagctgaccggcaccgccagacaggtgaagatcgagatggaccagtacaaggaggagctgagcaagatggagaaggagatcatgcacctgaagagagacggcgagaacaaggccatgcacctgagccagctggacatgatcctggaccagaccaagaccgagctggagaagaagaccaacgccgtgaaggagctggagaagctgcagcacagcaccgagaccgagctgaccgaggccctgcagaagagagaggtgctggagaccgagctgcagaacgcccacggcgagctgaagagcaccctgagacagctgcaggagctgagagacgtgctgcagaaggcccagctgagcctggaggagaagtacaccaccatcaaggacctgaccgccgagctgagagagtgcaagatggagatcgaggacaagaagcaggagctgctggagatggaccaggccctgaaggagagaaactgggagctgaagcagagagccgcccaggtgacccacctggacatgaccatcagagagcacagaggcgagatggagcagaagatcatcaagtag

SEQ ID NO: 20039 - DNA, 3900 bp, Artificial Sequence
  Description of Artificial Sequence: Synthetic coding sequence
atggagagcagcagcagcgactactacaacaaggacaacgaggaggagagcctgctggccaacgtggccagcctgagacacgagctgaagatcaccgagtggagcctgcagagcctgggcgaggagctgagcagcgtgagccccagcgagaacagcgactacgcccccaaccccagcagaagcgagaagctgatcctggacgtgcagcccagccaccccggcctgctgaactacagcccctacgagaacgtgtgcaagatcagcggcagcagcaccgacttccagaagaagcccagagacaagatgttcagcagcagcgcccccgtggaccaggagatcaagagcctgagagagaagctgaacaagctgagacagcagaacgcctgcctggtgacccagaaccacagcctgatgaccaagttcgagagcatccacttcgagctgacccagagcagagccaaggtgagcatgctggagagcgcccagcagcaggccgccagcgtgcccatcctggaggagcagatcatcaacctggaggccgaggtgagcgcccaggacaaggtgctgagagaggccgagaacaagctggagcagagccagaagatggtgatcgagaaggagcagagcctgcaggagagcaaggaggagtgcatcaagctgaaggtggacctgctggagcagaccaagcagggcaagagagccgagagacagagaaacgaggccctgtacaacgccgaggagctgagcaaggccttccagcagtacaagaagaaggtggccgagaagctggagaaggtgcaggccgaggaggagatcctggagagaaacctgaccaactgcgagaaggagaacaagagactgcaggagagatgcggcctgtacaagagcgagctggagatcctgaaggagaagctgagacagctgaaggaggagaacaacaacggcaaggagaagctgagaatcatggccgtgaagaacagcgaggtgatggcccagctgaccgagagcagacagagcatcctgaagctggagagcgagctggagaacaaggacgagatcctgagagacaagttcagcctgatgaacgagaacagagagctgaaggtgagagtggccgcccagaacgagagactggacctgtgccagcaggagatcgagagcagcagagtggagctgagaagcctggagaagatcatcagccagctgcccctgaagagagagctgttcggcttcaagagctacctgagcaagtaccagatgagcagcttcagcaacaaggaggacagatgcatcggctgctgcgaggccaacaagctggtgatcagcgagctgagaatcaagctggccatcaaggaggccgagatccagaagctgcacgccaacctgaccgccaaccagctgagccagagcctgatcacctgcaacgacagccaggagagcagcaagctgagcagcctggagaccgagcccgtgaagctgggcggccaccaggtggccgagagcgtgaaggaccagaaccagcacaccatgaacaagcagtacgagaaggagagacagagactggtgaccggcatcgaggagctgagaaccaagctgatccagatcgaggccgagaacagcgacctgaaggtgaacatggcccacagaaccagccagttccagctgatccaggaggagctgctggagaaggccagcaacagcagcaagctggagagcgagatgaccaagaagtgcagccagctgctgaccctggagaagcagctggaggagaagatcgtggcctacagcagcatcgccgccaagaacgccgagctggagcaggagctgatggagaagaacgagaagatcagaagcctggagaccaacatcaacaccgagcacgagaagatctgcctggccttcgagaaggccaagaagatccacctggagcagcacaaggagatggagaagcagatcgagagactggaggcccagctggagaagaaggaccagcagttcaaggagcaggagaagaccatgagcatgctgcagcaggacatcatctgcaagcagcaccacctggagagcctggacagactgctgaccgagagcaagggcgagatgaagaaggagaacatgaagaaggacgaggccctgaaggccctgcagaaccaggtgagcgaggagaccatcaaggtgagacagctggacagcgccctggagatctgcaaggaggagctggtgctgcacctgaaccagctggagggcaacaaggagaagttcgagaagcagctgaagaagaagagcgaggaggtgtactgcctgcagaaggagctgaagatcaagaaccacagcctgcaggagaccagcgagcagaacgtgatcctgcagcacaccctgcagcagcagcagcagatgctgcagcaggagaccatcagaaacggcgagctggaggacacccagaccaagctggagaagcaggtgagcaagctggagcaggagctgcagaagcagagagagagcagcgccgagaagctgagaaagatggaggagaagtgcgagagcgccgcccacgaggccgacctgaagagacagaaggtgatcgagctgaccggcaccgccagacaggtgaagatcgagatggaccagtacaaggaggagctgagcaagatggagaaggagatcatgcacctgaagagagacggcgagaacaaggccatgcacctgagccagctggacatgatcctggaccagaccaagaccgagctggagaagaagaccaacgccgtgaaggagctggagaagctgcagcacagcaccgagaccgagctgaccgaggccctgcagaagagagaggtgctggagaccgagctgcagaacgcccacggcgagctgaagagcaccctgagacagctgcaggagctgagagacgtgctgcagaaggcccagctgagcctggaggagaagtacaccaccatcaaggacctgaccgccgagctgagagagtgcaagatggagatcgaggacaagaagcaggagctgctggagatggaccaggccctgaaggagagaaactgggagctgaagcagagagccgcccaggtgacccacctggacatgaccatcagagagcacagaggcgagatggagcagaagatcatcaagctggagggcaccctggagaagagcgagctggagctgaaggagtgcaacaagcagatcgagagcctgaacgacaagctgcagaacgccaaggagcagctgagagagaaggagttcatcatgctgcagaacgagcaggagatcagccagctgaagaaggagatcgagagaacccagcagagaatgaaggagatggagagcgtgatgaaggagcaggagcagtacatcgccacccagtacaaggaggccatcgacctgggccaggagctgagactgaccagagagcaggtgcagaacagccacaccgagctggccgaggccagacaccagcaggtgcaggcccagagagagatcgagagactgagcagcgagctggaggacatgaagcagctgagcaaggagaaggacgcccacggcaaccacctggccgaggagctgggcgccagcaaggtgagagaggcccacctggaggccagaatgcaggccgagatcaagaagctgagcgccgaggtggagagcctgaaggaggcctaccacatggagatgatcagccaccaggagaaccacgccaagtggaagatcagcgccgacagccagaagagcagcgtgcagcagctgaacgagcagctggagaaggccaagctggagctggaggaggcccaggacaccgtgagcaacctgcaccagcaggtgcaggacagaaacgaggtgatcgaggccgccaacgaggccctgctgaccaagggcgagaacgtgtag

SEQ ID NO: 20040 - DNA, 4254 bp, Artificial Sequence
  Description of Artificial Sequence: Synthetic coding sequence
atggccagccccaccaacggccaccacggcggcaactgcggcaagtgcagccccggcagagcccccctggtgggcagcggcgccctggccgaccacgaccccagacaggcccccagactgagaagaagactgacccagagcgcccccggcagaggcagcgacagagtgggcgccagccagagactgcccagaagattcgagttctgcgccgccggcgtgagatggttcagcgagctgtgccccagactgcccagagccggcgccagagagagagtgagaggcttcctgacccagaccagagtgagaagcgcccagagccccggcggcagcctgcccagcgacgacctgggcgagatggagagcagcagcagcgactactacaacaaggacaacgaggaggagagcctgctggccaacgtggccagcctgagacacgagctgaagatcaccgagtggagcctgcagagcctgggcgaggagctgagcagcgtgagccccagcgagaacagcgactacgcccccaaccccagcagaagcgagaagctgatcctggacgtgcagcccagccaccccggcctgctgaactacagcccctacgagaacgtgtgcaagatcagcggcagcagcaccgacttccagaagaagcccagagacaagatgttcagcagcagcgcccccgtggaccaggagatcaagagcctgagagagaagctgaacaagctgagacagcagaacgcctgcctggtgacccagaaccacagcctgatgaccaagttcgagagcatccacttcgagctgacccagagcagagccaaggtgagcatgctggagagcgcccagcagcaggccgccagcgtgcccatcctggaggagcagatcatcaacctggaggccgaggtgagcgcccaggacaaggtgctgagagaggccgagaacaagctggagcagagccagaagatggtgatcgagaaggagcagagcctgcaggagagcaaggaggagtgcatcaagctgaaggtggacctgctggagcagaccaagcagggcaagagagccgagagacagagaaacgaggccctgtacaacgccgaggagctgagcaaggccttccagcagtacaagaagaaggtggccgagaagctggagaaggtgcaggccgaggaggagatcctggagagaaacctgaccaactgcgagaaggagaacaagagactgcaggagagatgcggcctgtacaagagcgagctggagatcctgaaggagaagctgagacagctgaaggaggagaacaacaacggcaaggagaagctgagaatcatggccgtgaagaacagcgaggtgatggcccagctgaccgagagcagacagagcatcctgaagctggagagcgagctggagaacaaggacgagatcctgagagacaagttcagcctgatgaacgagaacagagagctgaaggtgagagtggccgcccagaacgagagactggacctgtgccagcaggagatcgagagcagcagagtggagctgagaagcctggagaagatcatcagccagctgcccctgaagagagagctgttcggcttcaagagctacctgagcaagtaccagatgagcagcttcagcaacaaggaggacagatgcatcggctgctgcgaggccaacaagctggtgatcagcgagctgagaatcaagctggccatcaaggaggccgagatccagaagctgcacgccaacctgaccgccaaccagctgagccagagcctgatcacctgcaacgacagccaggagagcagcaagctgagcagcctggagaccgagcccgtgaagctgggcggccaccaggtggccgagagcgtgaaggaccagaaccagcacaccatgaacaagcagtacgagaaggagagacagagactggtgaccggcatcgaggagctgagaaccaagctgatccagatcgaggccgagaacagcgacctgaaggtgaacatggcccacagaaccagccagttccagctgatccaggaggagctgctggagaaggccagcaacagcagcaagctggagagcgagatgaccaagaagtgcagccagctgctgaccctggagaagcagctggaggagaagatcgtggcctacagcagcatcgccgccaagaacgccgagctggagcaggagctgatggagaagaacgagaagatcagaagcctggagaccaacatcaacaccgagcacgagaagatctgcctggccttcgagaaggccaagaagatccacctggagcagcacaaggagatggagaagcagatcgagagactggaggcccagctggagaagaaggaccagcagttcaaggagcaggagaagaccatgagcatgctgcagcaggacatcatctgcaagcagcaccacctggagagcctggacagactgctgaccgagagcaagggcgagatgaagaaggagaacatgaagaaggacgaggccctgaaggccctgcagaaccaggtgagcgaggagaccatcaaggtgagacagctggacagcgccctggagatctgcaaggaggagctggtgctgcacctgaaccagctggagggcaacaaggagaagttcgagaagcagctgaagaagaagagcgaggaggtgtactgcctgcagaaggagctgaagatcaagaaccacagcctgcaggagaccagcgagcagaacgtgatcctgcagcacaccctgcagcagcagcagcagatgctgcagcaggagaccatcagaaacggcgagctggaggacacccagaccaagctggagaagcaggtgagcaagctggagcaggagctgcagaagcagagagagagcagcgccgagaagctgagaaagatggaggagaagtgcgagagcgccgcccacgaggccgacctgaagagacagaaggtgatcgagctgaccggcaccgccagacaggtgaagatcgagatggaccagtacaaggaggagctgagcaagatggagaaggagatcatgcacctgaagagagacggcgagaacaaggccatgcacctgagccagctggacatgatcctggaccagaccaagaccgagctggagaagaagaccaacgccgtgaaggagctggagaagctgcagcacagcaccgagaccgagctgaccgaggccctgcagaagagagaggtgctggagaccgagctgcagaacgcccacggcgagctgaagagcaccctgagacagctgcaggagctgagagacgtgctgcagaaggcccagctgagcctggaggagaagtacaccaccatcaaggacctgaccgccgagctgagagagtgcaagatggagatcgaggacaagaagcaggagctgctggagatggaccaggccctgaaggagagaaactgggagctgaagcagagagccgcccaggtgacccacctggacatgaccatcagagagcacagaggcgagatggagcagaagatcatcaagctggagggcaccctggagaagagcgagctggagctgaaggagtgcaacaagcagatcgagagcctgaacgacaagctgcagaacgccaaggagcagctgagagagaaggagttcatcatgctgcagaacgagcaggagatcagccagctgaagaaggagatcgagagaacccagcagagaatgaaggagatggagagcgtgatgaaggagcaggagcagtacatcgccacccagtacaaggaggccatcgacctgggccaggagctgagactgaccagagagcaggtgcagaacagccacaccgagctggccgaggccagacaccagcaggtgcaggcccagagagagatcgagagactgagcagcgagctggaggacatgaagcagctgagcaaggagaaggacgcccacggcaaccacctggccgaggagctgggcgccagcaaggtgagagaggcccacctggaggccagaatgcaggccgagatcaagaagctgagcgccgaggtggagagcctgaaggaggcctaccacatggagatgatcagccaccaggagaaccacgccaagtggaagatcagcgccgacagccagaagagcagcgtgcagcagctgaacgagcagctggagaaggccaagctggagctggaggaggcccaggacaccgtgagcaacctgcaccagcaggtgcaggacagaaacgaggtgatcgaggccgccaacgaggccctgctgaccaagggcgagaacgtgtag

SEQ ID NO: 20041 - DNA, 201 bp, Artificial Sequence
  Description of Artificial Sequence: Synthetic coding sequence
atggacccccccgccagaaaggagaagaccaaggtgaaggagagcgtgagcagagtggagaaggccaagcagaagagcgcccagcaggagctgaagcagagacagagagccgagatctacgccctgaacagagtgatgaccgagctggagcagcagcagttcgacgagttctgcaagcagatgcagccccccggcgagtag

SEQ ID NO: 20042 - DNA, 201 bp, Artificial Sequence; identical to SEQ ID NO: 20041
  Description of Artificial Sequence: Synthetic coding sequence

SEQ ID NO: 20043 - DNA, 201 bp, Artificial Sequence; identical to SEQ ID NO: 20041
  Description of Artificial Sequence: Synthetic coding sequence

SEQ ID NO: 20044 - DNA, 924 bp, Artificial Sequence
  Description of Artificial Sequence: Synthetic coding sequence
atgctgagacacagccccagcctgtgggagctggtggaggagcacgtgcccctgagagagagaagagaggtgaagagaatcctgggcgaggccgccgtggacctgagcctggagctgagagccgaggtggccatgctgagagccctgctgcaggaggccagaagcagccaggcccccagcagcagacccatcagcgaccccagcagcctgctggcccccccccccctgctgaaggacctgctgagacaggagctgagacagctgctgcagggcctgagacacaaggccatctgcgagggcagagaccaggcccaggcctgggtgcagtacagccccagagtgctgcacttcgccctggaggagcccagatgcgacctgcccgagcaggagatcttccagatgagaggcggcggccccagcagcggccacagagacctgagcatcatcaaggaccagctgaacgtgagcaacatcgaccaggtggccagacacctgagaggcctgctggaggaggagtgccacaccctggagagagagatcctgatcctgcagagatgcctggaggaggagtacctgagaccctgccaccccagcgaggccgccctggagcccaccctggccgagctgaaggagcagaagaaggccatggagcaggagctgcaggccagcgtgggccccagctgcgtgagccccaaccacagacagagacccctgggcagcagcacccagggcctgagaccccccctgcccctgtgcggcgtggcccccctgcagtgctgcctgcccgccccccccctggagccctacctgagacccagaggccagagcgccacccacagatggggcagacagctgcagtgcagccccagagagggccccgccagcacccccatgagcagcgccgccccccaggcccccgcctag

SEQ ID NO: 20045 - DNA, 627 bp, Artificial Sequence
  Description of Artificial Sequence: Synthetic coding sequence
atggtgttctacttcaccagcagcagcgtgaacagcagcgcctacaccatctacatgggcaaggacaagtacgagaacgaggacctgatcaagcacggctggcccgaggacatctggttccacgtggacaagctgagcagcgcccacgtgtacctgagactgcacaagggcgagaacatcgaggacatccccaaggaggtgctgatggactgcgcccacctggtgaaggccaacagcatccagggctgcaagatgaacaacgtgaacgtggtgtacaccccctggagcaacctgaagaagaccgccgacatggacgtgggccagatcggcttccacagacagaaggacgtgaagatcgtgaccgtggagaagaaggtgaacgagatcctgaacagactggagaagaccaaggtggagagattccccgacctggccgccgagaaggagtgcagagacagagaggagagaaacgagaagaaggcccagatccaggagatgaagaagagagagaaggaggagatgaagaagaagagagagatggacgagctgagaagctacagcagcctgatgaaggtggagaacatgagcagcaaccaggacggcaacgacagcgacgagttcatgtag

SEQ ID NO: 20046 - DNA, 423 bp, Artificial Sequence
  Description of Artificial Sequence: Synthetic coding sequence
atggactgcgcccacctggtgaaggccaacagcatccagggctgcaagatgaacaacgtgaacgtggtgtacaccccctggagcaacctgaagaagaccgccgacatggacgtgggccagatcggcttccacagacagaaggacgtgaagatcgtgaccgtggagaagaaggtgaacgagatcctgaacagactggagaagaccaaggtggagagattccccgacctggccgccgagaaggagtgcagagacagagaggagagaaacgagaagaaggcccagatccaggagatgaagaagagagagaaggaggagatgaagaagaagagagagatggacgagctgagaagctacagcagcctgatgaaggtggagaacatgagcagcaaccaggacggcaacgacagcgacgagttcatgtag

SEQ ID NO: 20047 - DNA, 1971 bp, Artificial Sequence
  Description of Artificial Sequence: Synthetic coding sequence
atgttcgaggccatcttccccagcaccccccaggccagactgaagagagaccccagagagaagcccggcctgagcagcttcagaagcaccttcagacagcagagcagcctgggcctgtgcatccccagactgatgctgcccaaggaggccagccccagccagagacacagcagcatgagcagcagcatggccagagccctggtgctgctgcagagcatggccagcagagacgccagatgccccgagtggaagccccaccagaagcccagaaccctgagcaagagcgtgcagaccatcagcagatactacagaaagaccagcgagcccaaggacgccgccagcctgaccggcttcatgagcaagatggagctgagaagagtgttccccacccaccccgactgcccccagttcagcaccagagccaccagcatgagccactgcggcagccccaccgaggccgacctgagcggcgagatcgacaacagcagcgagacctggagaggcacccaggacctgttcctggccagaagaggcagcgacaccaacgtggacggctacctgctgcccttcagcaagagcatctgcgagttcgactacctgagaaagagaagaaagagccagaccctgagccccgtgaccagcagcagcgtggccagccagagctgcctgagaaagagaatgccctggtacctgagcgtgatccacgagaaggaccactgcctgagcgagctggagatccaggtgcagaagaaggacgaggagatcctgctgctgcaggaggagagagaggccctgaagatgcagctgaagtgcctgctgaagggcaagggccaggagaccagcatgagccccggcagaagagagcagctgagcgacgccagcctgaagctgggcagactgagcctgctgaaggccttcagcagacacgaggaggagctgcagcactggtggcagatgcaggaggagagcgccgcccccgagagaggcaaggagcccgacctgggcggcggcgaggaggacgagggcctggagggcgagcccgacggcgtggaggacaccggcgcctggggcggcgtgagccagatgggcagcgtgcacgaggagggcagcgaggaggaggaggaggaggagggcgacagagacgaggacagcgaggagagagagctgcccgaggaggaggagatccccagaagaagagccagcagcctggccgagagcttcgaggaggagctgctggcccagctggaggagtacgagcaggtgatcctggacttccagttcaacctggaggccaccagaaccagatacagcctggccaccggcgtgatcgccagcctgcagcagcaggtggacttccaggagacccagctgagaaagatcaacaccgagaacgagaccctgcagaaggagctgagagagagaagacagcagctgcaggccatgaccgacaagttcagcaacctgagagaggacaagaagcaccaggagatgatgggcctgatcgagaaggacaaccagctgctgagacagcaggtgagcgagctggagagaaagctgaccaagagagactgcgtgatcagcgagctggacaccaaggtgagccagctgcaggagcaggtggagctggaccagaaccacctgcagagatggaagcagctgcaggaggacctgcagagcaagaaggagatgatccagcaggccgagcagcacaccagagtggccctggagagcagccagagcagactggagagactgagaaacaagatcatccaggccaccttcagcatcagcggcaccaagagcctggccaacgagatcagcgacaacgacatcctggaggccctgcagagaatcatcagcgagagaagcgactactacaaccagctgaagcagaagggcgtgaaggtgccccccctgcagcagagcgaggccttcctgaccagcaagagcaagaagggcaccagcaagtag

SEQ ID NO: 20048 - DNA, 486 bp, Artificial Sequence
  Description of Artificial Sequence: Synthetic coding sequence
atgcccaagaacgccatccccgtgagcaagagcaccggcttcagcaaccccgccagccagagcaccagccagagacccaagctgaagagagtgatgaaggagaagaccaagccccagggcggcgagggcaagggcgcccagagcacccccatccagcacagcttcctgaccgacgtgagcgacgtgcaggagatggagagaggcctgctgagcctgctgaacgacttccacagcggcaagctgcaggccttcggcaacgagtgcagcatcgagcagatggagcacgtgagaggcatgcaggagaagctggccagactgaacctggagctgtacggcgagctggaggagctgcccgaggacaagagaaagaccgccagcgacagcaacctggacagactgctgagcgacctggaggagctgaacagcagcatccagaagctgcacctggccgacgcccaggacgtgcccaacaccagcgccagctag

SEQ ID NO: 20049 - DNA, 825 bp, Artificial Sequence
  Description of Artificial Sequence: Synthetic coding sequence
atgcccagagccgagcccagagccaccctgggcgagcaggagaaggccggcctgcccctgggcgcctggagactgtacctgctgagacacttcagaaagcagaccgagctgagaagaagcggcagcagagacgtgaccggcgccctgctggtggccgccgccgtggccagcgaggccgtgggcagcctgagagtggccgagggcggccccaacaccctgctgctgcaggtgctgagaagctggccctggtgcaacaaggagctgaagaccatggaggagagaaaggtgaagagaagaagccccaagagcttcagcgcccactgcacccaggtggtgaacgccaagaagaacgccatccccgtgagcaagagcaccggcttcagcaaccccgccagccagagcaccagccagagacccaagctgaagagagtgatgaaggagaagaccaagccccagggcggcgagggcaagggcgcccagagcacccccatccagcacagcttcctgaccgacgtgagcgacgtgcaggagatggagagaggcctgctgagcctgctgaacgacttccacagcggcaagctgcaggccttcggcaacgagtgcagcatcgagcagatggagcacgtgagaggcatgcaggagaagctggccagactgaacctggagctgtacggcgagctggaggagctgcccgaggacaagagaaagaccgccagcgacagcaacctggacagactgctgagcgacctggaggagctgaacagcagcatccagaagctgcacctggccgacgcccaggacgtgcccaacaccagcgccagctag

SEQ ID NO: 20050 - DNA, 2352 bp, Artificial Sequence
  Description of Artificial Sequence: Synthetic coding sequence
atgagccaggagaagaacgagatgttcgagagcgagtggagcaaggagagagagagagagaagcagctggccagcggcctggacaccgccgagaaggccctgaaggtggagagcgaggagctgcagaagagcaagagcgagctgatctgcctgtacaacgaggtgcacaacctgcccggcgagagcgagagcaaggaccacttcctgatcgcctgcgacctgctgcagagagagaacagcgagctggagaccaaggtgctgaagctgagccaggagttcgcccagctgaaccacttcaccctgggcggcaagaccgcccccagcaacctgatcaccagcgagaacacctgcaaggaccccgagagcaacgagcccatcctggagaccgagatccagagcagaaaggaggagaccgaggagctgtgccccaagctgggcgagagaaagcagaaggagatccccgaggagagcgtgaaggagggcagcttccccagagagggccagaaggaggagggcagccagcagaacagagacatgaaggacgaggagaaggagcagcagctgaccatgaagcccgaggagatcgtgagactgagagaggagctgagccacatcaaccagagcctgctgcagagccagagcagcggcgacagcagcgacgacagcggcgcccagcaccccagcagcggcgagaagctgaagtacaaccagcagggcgaggtgcagcagctgcaccagaacctgcacagactgcagatcctgtgcaacagcgccgagaacgagctgagatacgagagaggccagaacctggacctgaagcagcacaacagcctgctgcaggaggagaacatcaagatcaagatcgagctgaagcacgcccagcagaagctgctggacagcaccaagatgtgcagcagcctgaccgccgagtacaagcactgccagcagaagatcaaggagctggagctggaggtgctgaagcacacccagagcatcaagagccagaacaacctgcaggagaagctggtgcaggagaagagcaaggtggccgacgccgaggagaagatcctggacctgcagagaaagctggagcacgcccacaaggtgtgcctgaccgacacctgcatcagcgagaagcagcagctggaggagaagatcaaggaggccacccagaacgaggccaaggtgaagcagcagtaccaggaggagcagcagaagagaaagctgctgtaccagaacgtggacgagctgcacagacaggtgagaaccctgcaggacaaggagaacctgctggagatgacctgcagccagcagcagagcagaatccagcagcaggaggccctgctgaagcagctggagaacgagaagagaaagtacgacgagcacgtgaagagcaaccaggagctgagcgagaagctgagcaagctgcagcaggagaaggaggccctgagagaggagtacctgagactgctgaagctgctgaacgtgcacgtgagaaactacaacgagaagcaccaccagcagaaggtgaagctgcagaaggtgaagtacagactgaccaacgaggtggagctgagagacaagagaatcaaccagttcgaggacgagatcggcatcctgcagcacaagatcgagaaggagaaggccatccaggaccagatcaccgcccagaacgacaccctgctgctggagaagagaaagctgcaggagcaggtgatcgagcaggagcagctgatccacagcaacaagtggaccatcagcagcatccagagcagagtgctgtacatggacaaggagaacaagcagctgcaggagaacagcctgagactgacccagcagatcggcttcctggagagaatcatcagaagcatccacatcagaagaggcgagaacctgaaggagttccccgtgcccaagtggtggcacagaggcaagctggccagcctgccccccaccaagaagcagaaggagatctacagcaccgaggtgttcaccagcaacaacgccgagctgcagcacgaggacgagagcgtgcccgaggccaccgagaagtggaagcacagcgagcagatggagaccaccatcagcgacatcctggagagcgaggtggtgaacgagatcctgcccctgagcaacagcagcttcagcggcaagggcctggtggagagcttcgccagcctgcaggagaccgaggagatcaagagcaaggaggccatggccagcagcaagagccccgagaagagccccgagaacctggtgtgcagccagaacagcgaggccggctacatcaacgtggccagcctgaaggagacccacggcatccaggagcaggaccagaagagcgagctgtag

SEQ ID NO: 20051 - DNA, 2352 bp, Artificial Sequence; identical to SEQ ID NO: 20050
  Description of Artificial Sequence: Synthetic coding sequence

SEQ ID NO: 20052 - DNA, 1719 bp, Artificial Sequence
  Description of Artificial Sequence: Synthetic coding sequence
atgatccacccccccagaccccccaaggtgctgggcctgcagcaccccagcagcggcgagaagctgaagtacaaccagcagggcgaggtgcagcagctgcaccagaacctgcacagactgcagatcctgtgcaacagcgccgagaacgagctgagatacgagagaggccagaacctggacctgaagcagcacaacagcctgctgcaggaggagaacatcaagatcaagatcgagctgaagcacgcccagcagaagctgctggacagcaccaagatgtgcagcagcctgaccgccgagtacaagcactgccagcagaagatcaaggagctggagctggaggtgctgaagcacacccagagcatcaagagccagaacaacctgcaggagaagctggtgcaggagaagagcaaggtggccgacgccgaggagaagatcctggacctgcagagaaagctggagcacgcccacaaggtgtgcctgaccgacacctgcatcagcgagaagcagcagctggaggagaagatcaaggaggccacccagaacgaggccaaggtgaagcagcagtaccaggaggagcagcagaagagaaagctgctgtaccagaacgtggacgagctgcacagacaggtgagaaccctgcaggacaaggagaacctgctggagatgacctgcagccagcagcagagcagaatccagcagcaggaggccctgctgaagcagctggagaacgagaagagaaagtacgacgagcacgtgaagagcaaccaggagctgagcgagaagctgagcaagctgcagcaggagaaggaggccctgagagaggagtacctgagactgctgaagctgctgaacgtgcacgtgagaaactacaacgagaagcaccaccagcagaaggtgaagctgcagaaggtgaagtacagactgaccaacgaggtggagctgagagacaagagaatcaaccagttcgaggacgagatcggcatcctgcagcacaagatcgagaaggagaaggccatccaggaccagatcaccgcccagaacgacaccctgctgctggagaagagaaagctgcaggagcaggtgatcgagcaggagcagctgatccacagcaacaagtggaccatcagcagcatccagagcagagtgctgtacatggacaaggagaacaagcagctgcaggagaacagcctgagactgacccagcagatcggcttcctggagagaatcatcagaagcatccacatcagaagaggcgagaacctgaaggagttccccgtgcccaagtggtggcacagaggcaagctggccagcctgccccccaccaagaagcagaaggagatctacagcaccgaggtgttcaccagcaacaacgccgagctgcagcacgaggacgagagcgtgcccgaggccaccgagaagtggaagcacagcgagcagatggagaccaccatcagcgacatcctggagagcgaggtggtgaacgagatcctgcccctgagcaacagcagcttcagcggcaagggcctggtggagagcttcgccagcctgcaggagaccgaggagatcaagagcaaggaggccatggccagcagcaagagccccgagaagagccccgagaacctggtgtgcagccagaacagcgaggccggctacatcaacgtggccagcctgaaggagacccacggcatccaggagcaggaccagaagagcgagctgtag

SEQ ID NO: 20053 - DNA, 2352 bp, Artificial Sequence; identical to SEQ ID NO: 20050
  Description of Artificial Sequence: Synthetic coding sequence

SEQ ID NO: 20054 - DNA, 120 bp, Artificial Sequence
  Description of Artificial Sequence: Synthetic coding sequence
atgagccaggagaagaacgagatgttcgagagcgagtggagcaaggagagagagagagagaagcagctggccagcggcctggacaccgccgagaaggccctgaaggtggagagcgagtag

SEQ ID NO: 20055 - DNA, 1104 bp, Artificial Sequence
  Description of Artificial Sequence: Synthetic coding sequence
atgggcgagcccggcccccccagcccccccgcccccaaggccgcccccggcctgatcgacagcttcagcgagatgaacaactacagaagagccatgcagaagatggccgaggacatcctgagcctgagaagacaggccagcatcctggagggcgagaacagaatcctgagaagcagactggcccagcaggaggaggaggagggccagggcaaggccagcgaggcccagaacaccgtgagcatgaagcagaagctgctgctgagcgagctggacatgaagaagctgagagacagagtgcagcacctgcagaacgagctgatcagaaagaacgacagagagaaggagctgctgctgctgtaccaggcccagcagccccaggccgccctgctgaagcagtaccagggcaagctgcagaagatgaaggccctggaggagaccgtgagacaccaggagaaggtgatcgagaagatggagagagtgctggaggacagactgcaggacagaagcaagcccccccccctgaacagacagcagggcaagccctacaccggcttccccatgctgagcgccagcggcctgcccctgggcagcatgggcgagaacctgcccgtggagctgtacagcgtgctgctggccgagaacgccaagctgagaaccgagctggacaagaacagacaccagcaggcccccatcatcctgcagcagcaggccctgcccgtggaccccggcgagctgggcgccggcggcgacctgaccgagagactgcaggagacccacggccccggccacagcgagtgcaccgagaccctgcccgcccaggacctgctgagcggcaccagcgacaagttcaacctgctggccaagctggagcacgcccagagcagaatcctgagcctggagagccagctggaggacagcgccagaagatggggcagagagaagcaggacctggccaccagactgcaggagcaggagaagggcttcagacaccccagcaacagcatcatcatcgagcagcccgtgagcgacccccccggcgtggcccccagaggcagcggcggcggcgccggcagccacagaacccccaaggtgaccggcccctag

SEQ ID NO: 20056 - DNA, 3072 bp, Artificial Sequence
  Description of Artificial Sequence: Synthetic coding sequence
atggccttcagaggccccgagccctgggtgagcgccagcctgctgagacagagactgaaggccgaggagaagaccctggacctggagttcgaggtgctgagcgtgggcttcaacgaggccggcagatacgccctgagactgagcgccgagaaccccctgcaggtgggcagcggcgccggcgtgcagctgcaggtgaacgacggcgaccccttccccgcctgcagcgccatcaccgacgtgatcgagcagcaggagcccggccagagcctgaccctgaccagaagcaagttcatcttcaccctgcccaagggcttctgcaagaacgacggccagcacgacgcccagctgcacgtggaggccctgagactggacgagcccctgggcagagccgcccagagagtgggcgaggccatcttccccatctaccccagacccgaccagcccagaatgaaccccaaggcccaggaccacgaggacctgtacagatactgcggcaacctggccctgctgagagccagcaccgaccccaccgccagacactgcggcagcctggcctacagcgtggccttccacgtgcacagaggcccccagccccccgtgagcgacagcccccccagagccggccagcccgagctgatcagccccgaggagcccctgatcgccagccagagcaccgagcccgagatcggccacctgagccccagcaagaaggagaccatcatggtgaccctgcacggcgccaccaacctgcccgcctgcaaggacggcagcgagccctggccctacgtggtggtgaagagcaccagcgaggagaagaacaaccagagcagcaaggccgtgaccagcgtgaccagcgagcccaccagagcccccatctggggcgacaccgtgaacgtggagatccaggccgaggacgccggccaggaggacgtgatcctgaaggtggtggacaacagaaagaagcaggagctgctgagctacaagatccccatcaagtacctgagagtgttccacccctaccacttcgagctggtgaagcccaccgagagcggcaaggccgacgaggccaccgccaagacccagctgtacgccaccgtggtgagaaagagcagcttcatccccagatacatcggctgcaaccacatggccctggagatcttcctgagaggcgtgaacgagcccctggccaacaaccccaaccccatcgtggtgatcgccagagtggtgcccaactacaaggagttcaaggtgagccaggccaacagagacctggccagcgtgggcctgcccatcacccccctgagcttccccatccccagcatgatgaacttcgacgtgcccagagtgagccagaacggctgcccccagctgagcaagcccggcggcccccccgagcagcccctgtggaaccagagcttcctgttccagggcagagacggcgccaccagcttcagcgaggacaccgccctggtgctggagtactacagcagcaccagcatgaagggcagccagccctggaccctgaaccagcccctgggcatcagcgtgctgcccctgaagagcagactgtaccagaagatgctgaccggcaagggcctggacggcctgcacgtggagagactgcccatcatggacaccagcctgaagaccatcaacgacgaggcccccaccgtggccctgagcttccagctgctgagcagcgagagacccgagaacttcctgacccccaacaacagcaaggccctgcccaccctggaccccaagatcctggacaagaagctgagaaccatccaggagagctggagcaaggacaccgtgagcagcaccatggacctgagcaccagcacccccagagaggccgaggaggagcccctggtgcccgagatgagccacgacaccgagatgaacaactacagaagagccatgcagaagatggccgaggacatcctgagcctgagaagacaggccagcatcctggagggcgagaacagaatcctgagaagcagactggcccagcaggaggaggaggagggccagggcaaggccagcgaggcccagaacaccgtgagcatgaagcagaagctgctgctgagcgagctggacatgaagaagctgagagacagagtgcagcacctgcagaacgagctgatcagaaagaacgacagagagaaggagctgctgctgctgtaccaggcccagcagccccaggccgccctgctgaagcagtaccagggcaagctgcagaagatgaaggccctggaggagaccgtgagacaccaggagaaggtgatcgagaagatggagagagtgctggaggacagactgcaggacagaagcaagcccccccccctgaacagacagcagggcaagccctacaccggcttccccatgctgagcgccagcggcctgcccctgggcagcatgggcgagaacctgcccgtggagctgtacagcgtgctgctggccgagaacgccaagctgagaaccgagctggacaagaacagacaccagcaggcccccatcatcctgcagcagcaggccctgcccgtggaccccggcgagctgggcgccggcggcgacctgaccgagagactgcaggagacccacggccccggccacagcgagtgcaccgagaccctgcccgcccaggacctgctgagcggcaccagcgacaagttcaacctgctggccaagctggagcacgcccagagcagaatcctgagcctggagagccagctggaggacagcgccagaagatggggcagagagaagcaggacctggccaccagactgcaggagcaggagaagggcttcagacaccccagcaacagcatcatcatcgagcagcccccctacagcctgccccccgcccccggcgccagcatcttcggcaagcccagagccaccgtggaccccggcggctggagagaggaggccttccagagcagaggccagggcgacggccccctgcccgaccccgagaagaagcagggccaccagagacccgccctgctgggcaacaccagagaggcctgccccttccacctgccccagaacatctaccacgtgtag

SEQ ID NO: 20057 - DNA, 2268 bp, Artificial Sequence
  Description of Artificial Sequence: Synthetic coding sequence
atgggcctgaagaacaagaagaacaccgaggaccccgaggagcccctgatcgccagccagagcaccgagcccgagatcggccacctgagccccagcaagaaggagaccatcatggtgaccctgcacggcgccaccaacctgcccgcctgcaaggacggcagcgagccctggccctacgtggtggtgaagagcaccagcgaggagaagaacaaccagagcagcaaggccgtgaccagcgtgaccagcgagcccaccagagcccccatctggggcgacaccgtgaacgtggagatccaggccgaggacgccggccaggaggacgtgatcctgaaggtggtggacaacagaaagaagcaggagctgctgagctacaagatccccatcaagtacctgagagtgttccacccctaccacttcgagctggtgaagcccaccgagagcggcaaggccgacgaggccaccgccaagacccagctgtacgccaccgtggtgagaaagagcagcttcatccccagatacatcggctgcaaccacatggccctggagatcttcctgagaggcgtgaacgagcccctggccaacaaccccaaccccatcgtggtgatcgccagagtggtgcccaactacaaggagttcaaggtgagccaggccaacagagacctggccagcgtgggcctgcccatcacccccctgagcttccccatccccagcatgatgaacttcgacgtgcccagagtgagccagaacggctgcccccagctgagcaagcccggcggcccccccgagcagcccctgtggaaccagagcttcctgttccagggcagagacggcgccaccagcttcagcgaggacaccgccctggtgctggagtactacagcagcaccagcatgaagggcagccagccctggaccctgaaccagcccctgggcatcagcgtgctgcccctgaagagcagactgtaccagaagatgctgaccggcaagggcctggacggcctgcacgtggagagactgcccatcatggacaccagcctgaagaccatcaacgacgaggcccccaccgtggccctgagcttccagctgctgagcagcgagagacccgagaacttcctgacccccaacaacagcaaggccctgcccaccctggaccccaagatcctggacaagaagctgagaaccatccaggagagctggagcaaggacaccgtgagcagcaccatggacctgagcaccagcacccccagagaggccgaggaggagcccctggtgcccgagatgagccacgacaccgagatgaacaactacagaagagccatgcagaagatggccgaggacatcctgagcctgagaagacaggccagcatcctggagggcgagaacagaatcctgagaagcagactggcccagcaggaggaggaggagggccagggcaaggccagcgaggcccagaacaccgtgagcatgaagcagaagctgctgctgagcgagctggacatgaagaagctgagagacagagtgcagcacctgcagaacgagctgatcagaaagaacgacagagagaaggagctgctgctgctgtaccaggcccagcagccccaggccgccctgctgaagcagtaccagggcaagctgcagaagatgaaggccctggaggagaccgtgagacaccaggagaaggtgatcgagaagatggagagagtgctggaggacagactgcaggacagaagcaagcccccccccctgaacagacagcagggcaagccctacaccggcttccccatgctgagcgccagcggcctgcccctgggcagcatgggcgagaacctgcccgtggagctgtacagcgtgctgctggccgagaacgccaagctgagaaccgagctggacaagaacagacaccagcaggcccccatcatcctgcagcagcaggccctgcccgacctgctgagcggcaccagcgacaagttcaacctgctggccaagctggagcacgcccagagcagaatcctgagcctggagagccagctggaggacagcgccagaagatggggcagagagaagcaggacctggccaccagactgcaggagcaggagaagggcttcagacaccccagcaacagcatcatcatcgagcagcccagcgccctgacccacagcatggacctgaagcagcccagcgagctggagcccctgctgcccagcagcgacagcaagctgaacaagcccctgagcccccagaaggagaccgccaacagccagcagacctag

SEQ ID NO: 20058 - DNA, 1002 bp, Artificial Sequence
  Description of Artificial Sequence: Synthetic coding sequence
atgggcgagcccggcccccccagcccccccgcccccaaggccgcccccggcctgatcgacagcttcagcgagatgaacaactacagaagagccatgcagaagatggccgaggacatcctgagcctgagaagacaggccagcatcctggagggcgagaacagaatcctgagaagcagactggcccagcaggaggaggaggagggccagggcaaggccagcgaggcccagaacaccgtgagcatgaagcagaagctgctgctgagcgagctggacatgaagaagctgagagacagagtgcagcacctgcagaacgagctgatcagaaagaacgacagagagaaggagctgctgctgctgtaccaggcccagcagccccaggccgccctgctgaagcagtaccagggcaagctgcagaagatgaaggccctggaggagaccgtgagacaccaggagaaggtgatcgagaagatggagagagtgctggaggacagactgcaggacagaagcaagcccccccccctgaacagacagcagggcaagccctacaccggcttccccatgctgagcgccagcggcctgcccctgggcagcatgggcgagaacctgcccgtggagctgtacagcgtgctgctggccgagaacgccaagctgagaaccgagctggacaagaacagacaccagcaggcccccatcatcctgcagcagcaggccctgcccgacctgctgagcggcaccagcgacaagttcaacctgctggccaagctggagcacgcccagagcagaatcctgagcctggagagccagctggaggacagcgccagaagatggggcagagagaagcaggacctggccaccagactgcaggagcaggagaagggcttcagacaccccagcaacagcatcatcatcgagcagcccgtgagcgacccccccggcgtggcccccagaggcagcggcggcggcgccggcagccacagaacccccaaggtgaccggcccctag

SEQ ID NO: 20059 - DNA, 1785 bp, Artificial Sequence
  Description of Artificial Sequence: Synthetic coding sequence
atgaacttcaacgtgtggaacatcaaggagatgctgagcatccccagcggcagcggcaacaagaagagcagcaactggaacaacaaccagaacgactacagcagcctgagcgacagccagttcctgttcggcagccagttctgccccgagaacagcgagaccctgagcgcccccctggacttcggcgcccacctgagacacagcaagcagagccagcagaactacctggagggcgagcccagcatcttcaccaagtaccagaccaagccccagctgttcggcggcgacatcaaggacggcggcctgttccccccccccctgagcgtgggcaagagcaagggcctgctggagcagttcgaggagaagaagaagagagccaaggacaagtgcgacagcgagaccctgtacaacttcgtgagcaacgtgagagagagcatcctgagactgcagaccagcgtggagaagagcgaggaccacctgagcagcagaagccagagcatcctggacagcctggagaccgtggccaagaccctgcaggagaccatccaggcccagaacgacctggtgttcgaggccgtgcaggacaagggcaacatggagcaggccatcctggagatgaagaagagattcgaggccagacagggcgagttcatcgagatgaagagcaacctgaagcacctggaggtgctggtggcccagcagagccaggagttccagcagctgtgcgagcagctgggccagctgaacgtgcccagcgtgctggccgagctgaagagactgatcagcgtgccccccgtgaaggacagcgccagccagaccagcccccccctggcccagagcctgaacctgaccagacaggagaagtacaccagcgagaagcccgtgctgtggcaggcccaggccctgcccgccgcctggaaccccggcatgggcagcctgcagcccggcgagttcgacgtgtggggcgagggcgccaagaacgacgacctgcaggaggaggccgccctgcccgccttcggcagccacgagagaaacagacacgtgaaggacaaggtggtgcagaccaactgcaagaactgggccgtgaccaagaccggcgccaagaaccacggcagcagcgtgcccggccacaagatccccagcgacagagacctggtgagccagggcgccagccagctgaccagcctggagatcaacttcagcaccagcatcaagaacgcctgccagaagtaccaggcccagagcatgttcctgtgcgaccccagagagcacctggtgatcaagcagaaggacggcaccgtggagatgagaggcaaggacaagaagcagcagcccagaaaggcccacagagcccacagaggcagactgatcgccagcaagcagaagcagatccccatccagacctgcaagttcaacagcaagtaccagagcccccagcccgccatcagcgtgccccagagccccttcctgggccagcaggagcccagagcccagcccctgcacctgcagtgccccagaagccccagaaagcccgtgtgccccatcctgggcggcaccgtgatgcccaacaagaccgtgagagccgtgcagggcagactgctgcagctgagcagatgcagcagccaggacaactggctgctgagcagcagcagccagggcgaccaccagatgagctggttcagcgacctgaacctgggctgcagcgagacccccctgtgcaaggaggccggcaagaacctgctgtacgacctgggcttcgacagcagcgacgacgacggcttctag

SEQ ID NO: 20060 - DNA, 1725 bp, Artificial Sequence
  Description of Artificial Sequence: Synthetic coding sequence
atggccagagtggacgccaaggccaaggaggcccccagagccagcgagggctgccagcacgccgtgaccagccagagaaacaagaagagcagcaactggaacaacaaccagaacgactacagcagcctgagcgacagccagttcctgttcggcagccagttctgccccgagaacagcgagaccctgagcgcccccctggacttcggcgcccacctgagacacagcaagcagagccagcagaactacctggagggcgagcccagcatcttcaccaagtaccagaccaagccccagttcgaggagaagaagaagagagccaaggacaagtgcgacagcgagaccctgtacaacttcgtgagcaacgtgagagagagcatcctgagactgcagaccagcgtggagaagagcgaggaccacctgagcagcagaagccagagcatcctggacagcctggagaccgtggccaagaccctgcaggagaccatccaggcccagaacgacctggtgttcgaggccgtgcaggacaagggcaacatggagcaggccatcctggagatgaagaagagattcgaggccagacagggcgagttcatcgagatgaagagcaacctgaagcacctggaggtgctggtggcccagcagagccaggagttccagcagctgtgcgagcagctgggccagctgaacgtgcccagcgtgctggccgagctgaagagactgatcagcgtgccccccgtgaaggacagcgccagccagaccagcccccccctggcccagagcctgaacctgaccagacaggagaagtacaccagcgagaagcccgtgctgtggcaggcccaggccctgcccgccgcctggaaccccggcatgggcagcctgcagcccggcgagttcgacgtgtggggcgagggcgccaagaacgacgacctgcaggaggaggccgccctgcccgccttcggcagccacgagagaaacagacacgtgaaggacaaggtggtgcagaccaactgcaagaactgggccgtgaccaagaccggcgccaagaaccacggcagcagcgtgcccggccacaagatccccagcgacagagacctggtgagccagggcgccagccagctgaccagcctggagatcaacttcagcaccagcatcaagaacgcctgccagaagtaccaggcccagagcatgttcctgtgcgaccccagagagcacctggtgatcaagcagaaggacggcaccgtggagatgagaggcaaggacaagaagcagcagcccagaaaggcccacagagcccacagaggcagactgatcgccagcaagcagaagcagatccccatccagacctgcaagttcaacagcaagtaccagagcccccagcccgccatcagcgtgccccagagccccttcctgggccagcaggagcccagagcccagcccctgcacctgcagtgccccagaagccccagaaagcccgtgtgccccatcctgggcggcaccgtgatgcccaacaagaccgtgagagccgtgcagggcagactgctgcagctgagcagatgcagcagccaggacaactggctgctgagcagcagcagccagggcgaccaccagatgagctggttcagcgacctgaacctgggctgcagcgagacccccctgtgcaaggaggccggcaagaacctgctgtacgacctgggcttcgacagcagcgacgacgacggcttctag

SEQ ID NO: 20061 - DNA, 612 bp, Artificial Sequence
  Description of Artificial Sequence: Synthetic coding sequence
atgaacttcaacgtgtggaacatcaaggagatgctgagcatccccagcggcagcggcaacaagaagagcagcaactggaacaacaaccagaacgactacagcagcctgagcgacagccagttcctgttcggcagccagttctgccccgagaacagcgagaccctgagcgcccccctggacttcggcgcccacctgagacacagcaagcagagccagcagaactacctggagggcgagcccagcatcttcaccaagtaccagaccaagccccagctgttcggcggcgacatcaaggacggcggcctgttccccccccccctgagcgtgggcaagagcaagggcctgctggagcagttcgaggagaagaagaagagagccaaggacaagtgcgacagctgcagaagactgtggaagagcctgagaaccatcagcgtgcaggaggccaacctgttctggatcctgtggagactgtggcccagacacgtgagcgccagctgcctgagataccagcagagagccctggtgaacgacgagcacgagctgagcgaccccagcctggtgagcagcggcgaggtgccccacagagtgagcgacgagagaatgggcatctag

SEQ ID NO: 20062 - DNA, 1785 bp, Artificial Sequence; identical to SEQ ID NO: 20059
  Description of Artificial Sequence: Synthetic coding sequence

SEQ ID NO: 20063 - DNA, 582 bp, Artificial Sequence
  Description of Artificial Sequence: Synthetic coding sequence
atgctgagcacccccaagagccagggcaacaagaagagcagcaactggaacaacaaccagaacgactacagcagcctgagcgacagccagttcctgttcggcagccagttctgccccgagaacagcgagaccctgagcgcccccctggacttcggcgcccacctgagacacagcaagcagagccagcagaactacctggagggcgagcccagcatcttcaccaagtaccagaccaagccccagctgttcggcggcgacatcaaggacggcggcctgttccccccccccctgagcgtgggcaagagcaagggcctgctggagcagttcgaggagaagaagaagagagccaaggacaagtgcgacagctgcagaagactgtggaagagcctgagaaccatcagcgtgcaggaggccaacctgttctggatcctgtggagactgtggcccagacacgtgagcgccagctgcctgagataccagcagagagccctggtgaacgacgagcacgagctgagcgaccccagcctggtgagcagcggcgaggtgccccacagagtgagcgacgagagaatgggcatctag

SEQ ID NO: 20064 - DNA, 1785 bp, Artificial Sequence; identical to SEQ ID NO: 20059
  Description of Artificial Sequence: Synthetic coding sequence

SEQ ID NO: 20065 - DNA, 1836 bp, Artificial Sequence
  Description of Artificial Sequence: Synthetic coding sequence
atgagcgagatccccagcaccatcgtgagcaagaacatgaccaacgacaagaacagcctggagagcatgaacatcagcagcagcagcagcaccgaggagaaccccaagaagcaggccagaaagaacgaggagcacggccccgaccccagcgccaaccccttccacctgagcggcgacgtggacttcttcctgctgagagaccaggagagaaacaaggccctgagcgagagacagcagcagaagaccatgagagtgcaccagaagatgacctacagcagcaaggtgagcgccaagcacaccagcctgagaagacagctgcagctggaggacaagcaggaggacctggaggccagagccgaggccgagcaccagagagccttcagagactacaccacctggaagctgaccctgaccaaggagaagaacgtggagcccgagaacatgagcggctacatcaagcagaagagacagatgttcctgctgcagtacgccctggacgtgaagagaagagagatccagagactggagaccctggccaccaaggaggaggccagactggagagagccgagaagagcctggagaaggacgccgccctgttcgacgagttcgtgagagagaacgactgcagcagcgtgcaggccatgagagccgccgagaaggagaccaaggccaagatcgagaagatcctggagatcagagacctgaccacccagatcgtgaacatcaagagcgagatcagcagattcgaggacaccctgaagcactacaaggtgtacaaggacttcctgtacaagctgagccccaaggagtggctggaggagcaggagaagaagcacagcttcctgaagaaggccaaggaggtgagcgaggccagcaaggagagcagcgtgaacagcacccccggcgacaagggccccggcatcaagggcaaggccagcagcatgtgggccaaggagggccagggcaccaagaagccctggagattcctgcagaccatgagactgggcagaagccccagctacctgagcagcccccagcagggcagccagcccagcgagagcagcggcggcgacagcagaggcagcaacagccccatcccccccacccaggaggacaccgacagcgacggcgaggagccccagctgtacttcaccgagccccagcagctgctggacgtgttcagagagctggaggagcagaacctgagcctgatccagaacagccaggagaccgagaagaccctggaggagctgagccacaccctgaagcacacccagatcagaatggacagagaggtgaaccagctgaagcagtgggtgaccaccatgatgatgagcatcaccaaggaggaggacaccgccgccgagctggagctgaaggccagagtgttccacttcggcgagtacaagggcgaccagcaggacaagctgctggagagcctgaactgcaaggtgctggacgtgtacagacactgcaccggcacccagcaggaggccaacctgggcaccgtgcagatgctgaccatcatcgagcaccagctggacgagctgctggagaacctggagcacgtgccccaggtgaagatcgagcaggccgagagagccaaggagaaggagagaagaatcagactgagagaggagaagctgcagatgcagaagatcctgcaggaggagcacctgcagagagccagagccagagcccaggccgagatcaagaagaagagaggcagaaccctggtgtgcagaagcagaccccccgcccacagaatcaagcagcagagcgagcacaccctgatggacaaggaggaggaggagctgctgttcttcttcacctag

SEQ ID NO: 20066 - DNA, 1839 bp, Artificial Sequence
  Description of Artificial Sequence: Synthetic coding sequence
atgagcgagatccccagcaccatcgtgagcaagaacatgaccaacgacaagaacagcctggagagcatgaacatcagcagcagcagcagcaccgaggagaaccccaagaagcaggccagaaagaacgaggagcacggccccgaccccagcgccaaccccttccacctgagcggcgacgtggacttcttcctgctgagagaccaggagagaaacaaggccctgagcgagagacagcagcagaagaccatgagagtgcaccagaagatgacctacagcagcaaggtgagcgccaagcacaccagcctgagaagacagctgcagctggaggacaagcaggaggacctggaggccagagccgaggccgagcaccagagagccttcagagactacaccacctggaagctgaccctgaccaaggccgagaagaacgtggagcccgagaacatgagcggctacatcaagcagaagagacagatgttcctgctgcagtacgccctggacgtgaagagaagagagatccagagactggagaccctggccaccaaggaggaggccagactggagagagccgagaagagcctggagaaggacgccgccctgttcgacgagttcgtgagagagaacgactgcagcagcgtgcaggccatgagagccgccgagaaggagaccaaggccaagatcgagaagatcctggagatcagagacctgaccacccagatcgtgaacatcaagagcgagatcagcagattcgaggacaccctgaagcactacaaggtgtacaaggacttcctgtacaagctgagccccaaggagtggctggaggagcaggagaagaagcacagcttcctgaagaaggccaaggaggtgagcgaggccagcaaggagagcagcgtgaacagcacccccggcgacaagggccccggcatcaagggcaaggccagcagcatgtgggccaaggagggccagggcaccaagaagccctggagattcctgcagaccatgagactgggcagaagccccagctacctgagcagcccccagcagggcagccagcccagcgagagcagcggcggcgacagcagaggcagcaacagccccatcccccccacccaggaggacaccgacagcgacggcgaggagccccagctgtacttcaccgagccccagcagctgctggacgtgttcagagagctggaggagcagaacctgagcctgatccagaacagccaggagaccgagaagaccctggaggagctgagccacaccctgaagcacacccagatcagaatggacagagaggtgaaccagctgaagcagtgggtgaccaccatgatgatgagcatcaccaaggaggaggacaccgccgccgagctggagctgaaggccagagtgttccacttcggcgagtacaagggcgaccagcaggacaagctgctggagagcctgaactgcaaggtgctggacgtgtacagacactgcaccggcacccagcaggaggccaacctgggcaccgtgcagatgctgaccatcatcgagcaccagctggacgagctgctggagaacctggagcacgtgccccaggtgaagatcgagcaggccgagagagccaaggagaaggagagaagaatcagactgagagaggagaagctgcagatgcagaagatcctgcaggaggagcacctgcagagagccagagccagagcccaggccgagatcaagaagaagagaggcagaaccctggtgtgcagaagcagaccccccgcccacagaatcaagcagcagagcgagcacaccctgatggacaaggaggaggaggagctgctgttcttcttcacctag

SEQ ID NO: 20067 - DNA, 1692 bp, Artificial Sequence
  Description of Artificial Sequence: Synthetic coding sequence
atgagcagcaacctgctgcccaccctgaacagcggcggcaaggtgaaggacggcagcaccaaggaggacagaccctacaagatcttcttcagagacctgttcctggtgaaggagaacgagatggccgccaaggagaccgagaagttcatgaacagaaacatgaaggtgtaccagaagaccaccttcagcagcagaatgaagagccacagctacctgagccagctggccttctaccccaagagaagcggcagaagcttcgagaagttcggccccggccccgcccccatccccagactgatcgagggcagcgacaccaagagaaccgtgcacgagttcatcaacgaccagagagacagattcctgctggagtacgccctgagcaccaagagaaacaccatcaagaagttcgagaaggacatcgccatgagagagagacagctgaagaaggccgagaagaagctgcaggacgacgccctggccttcgaggagttcctgagagagaacgaccagagaagcgtggacgccctgaagatggccgcccaggagaccatcaacaagctgcagatgaccgccgagctgaagaaggccagcatggaggtgcaggccgtgaagagcgagatcgccaagaccgagttcctgctgagagagtacatgaagtacggcttcttcctgctgcagatgagccccaagcactggcagatccagcaggccctgaagagagcccaggccagcaagagcaaggccaacatcatcctgcccaagatcctggccaagctgagcctgcacagcagcaacaaggagggcatcctggaggagagcggcagaaccgccgtgctgagcgaggacgccagccagggcagagacagccagggcaagcccagcagaagcctgaccagaacccccgagaagaagaagagcaacctggccgagagcttcggcagcgaggacagcctggagttcctgctggacgacgagatggacgtggacctggagcccgccctgtacttcaaggagcccgaggagctgctgcaggtgctgagagagctggaggagcagaacctgaccctgttccagtacagccaggacgtggacgagaacctggaggaggtgaacaagagagagaaggtgatccaggacaagaccaacagcaacatcgagttcctgctggagcaggagaagatgctgaaggccaactgcgtgagagaggaggagaaggccgccgagctgcagctgaagagcaagctgttcagcttcggcgagttcaacagcgacgcccaggagatcctgatcgacagcctgagcaagaagatcacccaggtgtacaaggtgtgcatcggcgacgccgaggacgacggcctgaaccccatccagaagctggtgaaggtggagagcagactggtggagctgtgcgacctgatcgagagcatccccaaggagaacgtggaggccatcgagagaatgaagcagaaggagtggagacagaagttcagagacgagaagatgaaggagaagcagagacaccagcaggagagactgaaggccgccctggagaaggccgtggcccagcccaagaagaagctgggcagaagactggtgttccacagcaagccccccagcggcaacaagcagcagctgcccctggtgaacgagaccaagaccaagagccaggaggaggagtacttcttcacctag

SEQ ID NO: 20068 - DNA, 2106 bp, Artificial Sequence
  Description of Artificial Sequence: Synthetic coding sequence
atggtggtgagcaccttcaccgacatggacaccttccccaacaacttcccccccggcggcgacagcggcctgaccggcagccagagcgagttccagaagatgctgatcgacgagagactgagatgcgagcaccacaaggccaactaccagaccctgaaggccgagcacaccagactgcagaacgagcacgtgaagctgcagaacgagctgaagcacctgttcaacgagaagcagacccagcaggagaagctgcagctgctgctggaggagctgagaggcgagctggtggagaagaccaaggacctggaggagatgaagctgcagatcctgaccccccagaagctggagctgctgagagcccagatccagcaggagctggagacccccatgagagagagattcagaaacctggacgaggaggtggagaagtacagagccgtgtacaacaagctgagatacgagcacaccttcctgaagagcgagttcgagcaccagaaggaggagtacgccagaatcctggacgagggcaagatcaagtacgagagcgagatcgccagactggaggaggacaaggaggagctgagaaaccagctgctgaacgtggacctgaccaaggacagcaagagagtggagcagctggccagagagaaggtgtacctgtgccagaagctgaagggcctggaggccgaggtggccgagctgaaggccgagaaggagaacagcgaggcccaggtggagaacgcccagagaatccaggtgagacagctggccgagatgcaggccaccgtgagaagcctggaggccgagaagcagagcgccaacctgagagccgagagactggagaaggagctgcagagcagcagcgagcagaacaccttcctgatcaacaagctgcacaaggccgagagagagatcaacaccctgagcagcaaggtgaaggagctgaagcacagcaacaagctggagatcaccgacatcaagctggagaccgccagagccaagagcgagctggagagagagagaaacaagatccagagcgagctggacggcctgcagagcgacaacgagatcctgaaggccgccgtggagcaccacaaggtgctgctggtggagaaggacagagagctgatcagaaaggtgcaggccgccaaggaggagggctaccagaagctggtggtgctgcaggacgagaagctggagctggagaacagactggccgacctggagaagatgaaggtggagcacgacgtgtggagacagagcgagaaggaccagtacgaggagaagctgagagccagccagatggccgaggagatcaccagaaaggagctgcagagcgtgagactgaagctgcagcagcagatcgtgaccatcgagaacgccgagaaggagaagaacgagaacagcgacctgaagcagcagatcagcagcctgcagatccaggtgaccagcctggcccagagcgagaacgacctgctgaacagcaaccagatgctgaaggagatggtggagagactgaagcaggagtgcagaaacttcagaagccaggccgagaaggcccagctggaggccgagaagaccctggaggagaagcagatccagtggctggaggagaagcacaagctgcacgagagaatcaccgacagagaggagaagtacaaccaggccaaggagaagctgcagagagccgccatcgcccagaagaagagaaagagcctgcacgagaacaagctgaagagactgcaggagaaggtggaggtgctggaggccaagaaggaggagctggagaccgagaaccaggtgctgaacagacagaacgtgcccttcgaggactacaccagactgcagaagagactgaaggacatccagagaagacacaacgagttcagaagcctgatcctggtgcccaacatgccccccaccgccagcatcaaccccgtgagcttccagagcagcgccatggtgcccagcatggagctgcccttccccccccacatgcaggaggagcagcaccagagagagctgagcctgctgagaaagagactggaggagctggagaccacccagagaaagcagctggaggagctgggcagcagcggcgagtag

SEQ ID NO: 20069 - DNA, 1707 bp, Artificial Sequence
  Description of Artificial Sequence: Synthetic coding sequence
atgctgatcgacgagagactgagatgcgagcaccacaaggccaactaccagaccctgaaggccgagcacaccagactgcagaacgagcacgtgaagctgcagaacgagctgaagcacctgttcaacgagaagcagacccagcaggagaagctgcagctgctgctggaggagctgagaggcgagctggtggagaagaccaaggacctggaggagatgaagctgcagatcctgaccccccagaagctggagctgctgagagcccagatccagcaggagctggagacccccatgagagagagattcagaaacctggacgaggaggtggagaagtacagagccgtgtacaacaagctgagatacgagcacaccttcctgaagagcgagttcgagcaccagaaggaggagtacgccagaatcctggacgagggcaagatcaagtacgagagcgagatcgccagactggaggaggacaaggaggagctgagaaaccagctgctgaacgtggacctgaccaaggacagcaagagagtggagcagctggccagagagaaggtgtacctgtgccagaagctgaagggcctggaggccgaggtggccgagctgaaggccgagaaggagaacagcgaggcccaggtggagaacgcccagagaatccaggtgagacagctggccgagatgcaggccaccgtgagaagcctggaggccgagaagcagagcgccaacctgagagccgagagactggagaaggagctgcagagcagcagcgagcagaacaccttcctgatcaacaagctgcacaaggccgagagagagatcaacaccctgagcagcaaggtgaaggagctgaagcacagcaacaagctggagatcaccgacatcaagctggagaccgccagagccaagagcgagctggagagagagagaaacaagatccagagcgagctggacggcctgcagagcgacaacgagatcctgaaggccgccgtggagcaccacaaggtgctgctggtggagaaggacagagagctgatcagaaaggtgcaggccgccaaggaggagggctaccagaagctggtggtgctgcaggacgagaagctggagctggagaacagactggccgacctggagaagatgaaggtggagcacgacgtgtggagacagagcgagaaggaccagtacgaggagaagctgagagccagccagatggccgaggagatcaccagaaaggagctgcagagcgtgagactgaagctgcagcagcagatcgtgaccatcgagaacgccgagaaggagaagaacgagaacagcgacctgaagcagcagatcagcagcctgcagatccaggtgaccagcctggcccagagcgagaacgacctgctgaacagcaaccagatgctgaaggagatggtggagagactgaagcaggagtgcagaaacttcagaagccaggccgagaaggcccagctggaggccgagaagaccctggaggagaagcagatccagtggctggaggagaagcacaagctgcacgagagaatcaccgacagagaggagaagtacaaccaggccaaggagaagctgcagagagccgccatcgcccagaagaagctggagcaggacctggagctgggctgccccagcgtgaccgacacctacagagagagcgtgttcccccccccccccctgaagagagacctgctgaagtag

SEQ ID NO: 20070 - DNA, 2106 bp, Artificial Sequence; identical to SEQ ID NO: 20068
  Description of Artificial Sequence: Synthetic coding sequence

SEQ ID NO: 20071 - DNA, 9 bp, Artificial Sequence
  Description of Artificial Sequence: Synthetic coding sequence
atggtgtag

SEQ ID NO: 20072 - DNA, 951 bp, Artificial Sequence
  Description of Artificial Sequence: Synthetic coding sequence
atgagcctgggcatcatggaggaggaggacctggccgagtacttcagactgcagtacggcgagagactgctgcagatgctgcagaagctgcccaacgtggagggcgccagcgagagccccagcatctggctgctggagaagaagaaggagaccgagatcatgcaccagaccatggtgcagaagaagaagatgttccagagaagaatggagaccctgaacctgagatgggaggagctgggcgtgaaggaggcccagctgaaggcccacatccagaagagcgagcagttcatccaggagaacgaccagaagagaatcagagccatgaagaaggccaacaaggagagagagctgaagtgccagcacatgcaggagctgaccaagagaaagcaggagatggtggccctgagactggagcaccagagactgagcgccaagctgaaggactactacatcttcaacaagtacctggagaaggtggtggagaacagcgagttcgaggagatccacgaggtgatcgccagatacaagaccctggtgagcatgagacacgacctgatgcagagcgcccaggagggccaggagaagatcgagagagccaaggccagactggccagatacatggaggagaaggacgacgagatcctgcagcagaacaacgagctggccagactgcagatgagattcgacagagccagaagcaacgtgatcttctgggagagcagatgggcccacatccagaacaccgccgccaagaagaccctgctgctgggcaccatcaagatggccaccctgaacctgttccagatcgtgagcaagcacctgaaggaggtgaccgaggtggccctggaggacacccacaagcagctggacatgatccagcagttcatccaggacagaagcgacatctgggccgaggtgaagaagaaggagcagcagagagtgagaatctag

SEQ ID NO: 20073 - DNA, 729 bp, Artificial Sequence
  Description of Artificial Sequence: Synthetic coding sequence
atgagcctgggcatcatggaggaggaggacctggccgagtacttcagactgcagtacggcgagagactgctgcagatgctgcagaagctgcccaacgtggagggcgccagcgagagccccagcatctggctgctggagaagaagaaggagaccgagatcatgcaccagaccatggtgcagaagaagaagatgttccagagaagaatggagaccctgaacctgagatgggaggagctgggcgtgaaggaggcccagctgaaggcccacatccagaagagcgagcagttcatccaggagaacgaccagaagagaatcagagccatgaagaaggccaacaaggagagagagctgaagtgccagcacatgcaggagctgaccaagagaaagcaggagatggtggccctgagactggagcaccagagactgagcgccaagctgaaggactactacatcttcaacaagtacctggagaaggtggtggagaacagcgaggagagcagatgggcccacatccagaacaccgccgccaagaagaccctgctgctgggcaccatcaagatggccaccctgaacctgttccagatcgtgagcaagcacctgaaggaggtgaccgaggtggccctggaggacacccacaagcagctggacatgatccagcagttcatccaggacagaagcgacatctgggccgaggtgaagaagaaggagcagcagagagtgagaatctag

SEQ ID NO: 20074 - DNA, 927 bp, Artificial Sequence
  Description of Artificial Sequence: Synthetic coding sequence
atggccgtgccctgggaggagtacttcagactggccctgcaggagaagctgagcaccaagctgcccgagcaggccgaggaccacgtgccccccgtgctgagactgctggagaagagacaggagctggtggacgccgaccaggccctgcaggcccagaaggaggtgttcagaaccaagaccgccgccctgaagcagagatgggagcagctggagcagaaggagagagagctgaagggcagcttcatcagattcgacaagttcctgcaggacagcgaggccagaagaaacagagccctgagaagagccgccgaggagagacaccaggccggcagaagagaggtggaggccctgagactgtggacccagctgcaggagctgagaagagagcacgccagactgcagagaagactgaagagactggagccctgcgccagactgctggagcaggccctggagctgctgcccggcttccaggaggtgcccgagctggtggccagattcgacggcctggccgagacccaggccgccctgagactgagagagagagagcagctggccgagctggaggccgccagagccagactgcagcagctgagagacgcctggcccgacgaggtgctggcccagggccagagaagagcccagctgcaggagagactggaggccgccagagagagaaccctgcagtgggagagcaagtggatccagatccagaacaccgccgccgagaagaccctgctgctgggcagaagcagaatggccgtgctgaacctgttccagctggtgtgccagcaccagggccagccccccaccctggacatcgaggacaccgagggccagctggagcacgtgaagctgttcatgcaggacctgagcgccatgctggccggcctgggccaggccgagcccgccgcccccgccagctag

SEQ ID NO: 20075 - DNA, 675 bp, Artificial Sequence
  Description of Artificial Sequence: Synthetic coding sequence
atggccgcccccagcgaggtggccgccatcgcccccggcgagggcgacggcggcggcggcggcttcggcagctggctggacggcagactggaggccctgggcgtggacagagccgtgtacggcgcctacatcctgggcatcctgcaggaggaggaggaggaggagaagctggacgccctgcagggcatcctgagcgccttcctggaggaggacagcctgctgaacatctgcaaggagatcgtggagagatggagcgagacccagaacgtggtgaccaaggtgaagaaggaggacgaggtgcaggccatcgccaccctgatcgagaagcaggcccagatcgtggtgaagcccagaatggtgagcgaggaggagaagcagagaaaggccgccctgctggcccagtacgccgacgtgaccgacgaggaggacgaggccgacgagaaggacgacagcggcgccaccaccatgaacatcggcagcgacaagctgctgttcagaaacaccaacgtggaggacgtgctgaacgccagaaagctggagagagacagcctgagagacgagagccagagaaagaaggagcaggacaagctgcagagagagagagacaagctggccaagcaggagagaaaggagaaggagaagaagagaacccagagaggcgagagaaagagatag

SEQ ID NO: 20076 - DNA, 465 bp, Artificial Sequence
  Description of Artificial Sequence: Synthetic coding sequence
atggccgcccccagcgaggtggccgccatcgcccccggcgagggcgacggcggcggcggcggcttcggcagctggctggacggcagactggaggccctgggcgtggacagagccgtgtacggcgcctacatcctgggcatcctgcaggaggaggaggaggaggagaagctggacgccctgcagggcatcctgagcgccttcctggaggaggacagcctgctgaacatctgcaaggagatcgtggagagatggagcgagacccagaacgtggtgaccaaggtgaagaaggaggacgaggtgcaggccatcgccaccctgatcgagaagcaggcccagatcgtggtgaagcccagaatggtgagcgaggaggagaagcagagaaaggccgccctgctggcccagtacgccgacgtgaccgacgaggaggacagcgtgcccaagcaccagtgcggcagatgcccctag

SEQ ID NO: 20077 - DNA, 486 bp, Artificial Sequence
  Description of Artificial Sequence: Synthetic coding sequence
atgacctacttcggccacttcggcggcgccaaccacgcccacaccctgggcgagctggaggcctgcatcgccatgctggtggagcagctgagaacccagggctgcggcggcagaaccctgggcaccagcgaggaggaggccgagctgcagcagaaggtggaggagaacgagcacctgagactggagctgcagatggtggagaccgagagagtgagactgagcctgctggaggagaagctggtggacgtgctgcagctgctgcagagactgagagacctgaacatcagcaagagagccctgggcaagatcctgctgagcaccctggacgccttcagagaccccacccacgagggcagacccagccccgccgccatcctggacgccctgcaccaggccctggccgcctgccagctgctgagaagacagcccagcgcccccgccagcgccgccgccgccctgaccaaccccctgctggtgagctgctag

SEQ ID NO: 20078 - DNA, 987 bp, Artificial Sequence
  Description of Artificial Sequence: Synthetic coding sequence
atgtacaccctgcacaccaagagagtgaaggccgccgccagacagatgtggaccagcaacctgagcaaggtgagacagagcctgaagaacgtgtaccacaagtgcaagatcagacaccaggacagcaccggctaccccaccgtgaccagcgacgactgcaaccaggacgacgacagctacgacggcaagatgaacctgcccgtggtgctgcaggacgtgaagaccgcccaggtggagctgttcagccagatgaccgacatcgtgcacatgatccccaaggtgcaggagaagaccgacctgtaccagaagcagatggaggtgctggagaccagaatgaacgtgaacgaggacaagcagtgcaccaccaccaaggacatcctgagcatgaaggaggacatcaaggccctgaagaagaaggtgaccgagctggagatccagaacagctgcagcaccatccactgcctggagatcctggagggcgagagaggcaaggagatcaccgagctgctgtacaagctgatccagcccgccaccctgaagaacaccctggccagcaccgacatggagatcagcagcgccgagcccgagaaggtgcccagctaccccaagagcaccgaccacctggagaagaagaccatcagcccccagatgaagaccctgaagaagagaaaccaccagaacgccagcagaagcttcgagaaggccaagcccaacatctacatctaccccgacttcagcacctggatcaagctgaccttcgtgcacggcggcaagtggaccttcttcctgagcgccaccaagctggaggagttcatccagtggctgctgagcagacccaccatcctgcccgaggagccccaggtgatcacccagagatactgccccttcaccggccccatcctgagcctgaccaccatctgcctgagcatcttcaacaacatctacggcttcatctgcagcctgaaggaggaggtgaccagactgtag

SEQ ID NO: 20079 - DNA, 906 bp, Artificial Sequence
  Description of Artificial Sequence: Synthetic coding sequence
atgggcaacagactgagagccgagctgggcagacccgagagatggctgctgcaccacgccctgccccccgcccccgaggccagaaagcccggcgaggagcccagaagacccctggacagaagcccccccctgggccaggtgcagccccacttcaccagccaggacgccaagagcgccgaggacgaggcccccagcagacacctgggcaagcaccagcccagaagcgcccaggtgggcagcagactggacgccctgcagggccccaagacccagcacagcatccacaccgtgacctgcaagagccccagacagaaggaggacagaagccccaagcccccccaggccccccagcaccccgaggagcacggcagacagagccacagcagcagcagcttcgccagcggcaccctgcaggacatgtggagactgctggacctgggcagcagccccagcggcgtgaccagccagggcgacagcacccccgagatgggcagccactacgtgacccaggccggcctggagctgctgggcagcagcagccccgccgccctggccagccagagcgccgagatgaccggcgtgggccccacccccagcctggcctggagcggcgccctgcaccccaacatgaaccaggaggccagcctggtgagaagcacctgggcccccggcatgagaggcggcatgaacggcggcagcagcagcgtgtgcaagaacatgcagagaggcccccactggagccccagccagcagccctgcagcggcatcagaaccgtgctgctgagcagaaaggagagaaccctgctgagctgcttcagcctgcccgcccccgtggtgctggtgcccctgctgctgagcggccaggccgtgaccgagagagccggccacgccggcgacatcctgtag

SEQ ID NO: 20080 - DNA, 2751 bp, Artificial Sequence
  Description of Artificial Sequence: Synthetic coding sequence
atgctgcccctgggcagcgagcccgccctgaacgagctgctgctgagaaaggaggaggagtggagagccctgcaggcccacagaacccagctgcaggaggccgccctgcaggacaccagaagccagctggaggaggcccagggcaagctgagatgcctgcaggaggacttcgtgtacaacctgcaggtgctggaggagagagacctggagctggagagatacgacgccgccttcgcccaggccagagagtgggaggaggccagaagagccgaggtgagcgagctgaagatcgaggccgccaagctgagacaggccctggccagagaggccagaaaggtggaggagctgcagcagcagcagcagctggccttccaggagcacagactggagctggagagagtgcacagcgacaagaacggcgagatcgaccaccacagagagcagtacgagaacctgaagtggaccctggagagaaagctggaggagctggacggcgagctggccctgcagagacaggagctgctgctggagttcgagagcaagatgagaaagagagagcacgagttcagactgcaggccgacaacatgagcaacaccgccctgagcagagagctgaaggtgaagctgctgcacaaggagctggaggccctgaaggaggccggcgccaaggccgccgagagcctgcagagagccgaggccaccaacgccgagctggagagaaagctgcagagcagagccggcgagctgcaggacctggaggccatgagcagagccagagtgaaggacctggaggacaagctgcacagcgtgcagctgaccagaaagaaggaggaggagaccttcaagagaaagcacgaggagctggacagactggccagagagaaggacgccgtgctggtggccgtgaagggcgcccacgtggagcagctgcaggagctgcagaccagagtgctggagctgcaggcccactgcgagaccctggaggcccagctgagaagagccgagtggagacaggccgacaccgccaaggagaaggacgccgccatcgaccagctgagagaggacgccagcaccgtgaagagcgcctgggacgcccagatcgcccagctgagcaaggagatggtgagcagagacctgcagatccagaccctgcaggaggaggaggtgaagctgaaggcccaggtggccagaagccagcaggacatcgagagatacaagcagcagctgagcctggccgtggagagagagagaagcctggagagagaccaggtgcagctgggcctggactggcagagaagatgcgacgacatcgagagagaccagatccagaagagcgaggccctgatccagggcctgagcatggccaagagccaggtggccgccaagctgcaggagaccgagcaggccctgcaggagcaggaggtggtgctgaaggccgtgaccctggagagagaccaggccgtgcaggccctgagaatgcacggcctgcccagacccggcgcccagatgctgctgagacagcacgaggaggagatcagcaaggacttccccagcagcgagatccagagactgagagagcagaacaccagcctgagaaacgccatcgcccagatgagaaaggagatggaggccctgagccaccagatccccccccccatccagaccgccgccgagagcaccgacgccaaccagcccgaccccgaggccggcggcgacgccgccacccccgactacgtgctggccctggaggccgagatcagaaccctgaagcacaagttcaagaccctggagaagcacctggaggacgtgctggaccccctgaagatgagcagcccccacgccgagagccagcccagcgtgagaaccagcaccgagaccaccggcggcagcgcccaggccggccaggccggcggcagcgtgcaggccggccaggccggcggcagcgtgcaggccggccccgtgagcagcggcctggccctgagaaagctgggcgacagagtgcagctgctgaacctgctggtgaccagactgagacagaaggtgctgagagagcccctggagcccgccgccctgcagagagagctgcccagagaggtggaccaggtgcacctggaggtgctggagctgagaaagcaggtggccgagctgggcaagcacctgagaatcgcccagcacggcggcgccgagcccagcggcagaaagcagccccccgccagcgacgccgtggccctgggcagagagcaggacgccaagagcgccgaggacgaggcccccagcagacacctgggcaagcaccagcccagaagcgcccaggtgggcagcagactggacgccctgcagggccccaagacccagcacagcatccacaccgtgacctgcaagagccccagacagaaggaggacagaagccccaagcccccccaggccccccagcaccccgaggagcacggcagacagagccacagcagcagcagcttcgccagcggcaccctgcaggacatgtggagactgctggacctgggcagcagccccagcggcgtgaccagccagggcgacagcacccccgagctgcccgccccccccgccgccgacagaagacccgtgaagatgcaggccggcatcgccacccccggcatgaagaccgccgcccaggccaaggccaagaccaccggcgccagcagaagccaccccgccaaggccaagggctgccagagaccccccaagatcagaaactacaacatcatggactag

SEQ ID NO: 20081 - DNA, 2751 bp, Artificial Sequence; identical to SEQ ID NO: 20080
  Description of Artificial Sequence: Synthetic coding sequence

SEQ ID NO: 20082 - DNA, 1653 bp, Artificial Sequence
  Description of Artificial Sequence: Synthetic coding sequence
atgaccaaggtgcccgccaccaagaagctgcagagcagccccaacagcggcgccgtgagacccttctacgccagcgagaacctgagacaggtgcccgacaagcccatgaagagcatcaagtacatggacaaggagatcatcaacctgaagaaggacctgatcagaagcagattcctgatccagagcgtgaagatcggcagaggctacttcgccatcctgagagaggagaccgccaagaagaagaagcagcagcagctgcagaagctgaaggaggaggagagaaacaagttccagcccgccgagaagatcagcgagatccactacggcgacaccctgctgagcacctacgacgacgagaagctgaagaccctgggcgccagagtgaccagaagacccttcacccccatccacagctgcatcatcagccccagcctgaccgaggcccacgtggagcccctgttcagacagctgtgcgccctgcactggctgctggaggccctgaccatcgaccacacccaccacaccatgaagcccgtgatcacctgctggaaccccaaggaccccggcggcagcaagagcaccatcaagaagatcaacaaggacaagagcatgggccagaagtgggagcacttcatcaccgcccccaagaccaagaagttcaagatccccaccatgagagtgaccaacagaaagcccagcagaagaggcagcaccctgagcctgagcagagccagcggcggcagcagcccccagagcagcatgatcagcgtgaaccccggcagcgacgagccccccagcgtgaacacccaggtgaccagcagcaaggacatcgaggacaacgagagcagcagcaccaagcccgacgaggagcccctgtacatgaacctgcagaagctgctggagatggtgagagaggacgccagaagaaccgtgaccatcgagaacggcatgcagagaaaggcccccagcatcctgagcgtgctgaagcagaacaagagcaacagcgcctacaaggagatgcagaccaccctgaagagcagcgagagaagcagcagcaccagcgccgagagccacatccagcccgtgcagaagaagagcaagaacagaaccaactgcgacatcaacatccactacaagagcggcgtgtgcaacaccatgagagccaagttctacagcgtggcccaggaggccggcttctgcctgcaggacaagatggagatcctgatgaagagacaggaggagagaggcatccagaagttcagagccttcgtgctggtgagcaacttccagaaggacatcgccaagatgagacaccacatcagcgtggtgaagggcgacgccgaggagatcgccgaccactggtacttcgacctgctgagcaagctgcccgaggacctgaagaacttcagacccgccaagaagatcctggtgaagctgcagaagttcggcgagaacctggacctgagaatcagaccccacgtgctgctgaaggtgctgcaggacctgagaatctgggagctgtgcagccccgacatcgccgtggccatcgagttcgtgagagagcacatcatccacatgccccaggaggactacatcagctggctgcagagcagaatcaacatccccatcggcccctacagcgccctgagatag

SEQ ID NO: 20083 - DNA, 1692 bp, Artificial Sequence
  Description of Artificial Sequence: Synthetic coding sequence
atgagcgtgctgaagaagaacagaagaaaggacagcgacaccccccaggagcccagcgagaaggccaaggagcagcaggccgaggccgagctgagaaagctgagacagcagttcagaaagatggtggagagcagaaagagcttcaagttcagaaaccagcagaagatcgccagccagtacaaggagatcaagaccctgaagaccgagcaggacgagatcaccctgctgctgagcctgatgaagagcagcagaaacatgaacagaagcgagaagaactacatggagctgagactgctgctgcagaccaaggaggactacgaggccctgatcaagagcctgaaggtgctgctggccgagctggacgagaagatcctgcagatggagaagaagatcgccaaccagaagcagatcttcgccaagatgcaggaggccaacaaccccagaaagctgcagaagcagatccacatcctggagaccagactgaacctggtgaccgtgcacttcgacaagatgctgaccaccaacgccaagctgagaaaggagatcgaggacctgagattcgagaaggccgcctacgacaacgtgtaccagcagctgcagcactgcctgctgatggagaagaagaccatgaacctggccatcgagcagagcagccaggcctacgagcagagagtggaggccatggccagaatggccgccatgaaggacagacagaagaaggacaccagccagtacaacctggagatcagagagctggagagactgtacgcccacgagagcaagctgaagagcttcctgctggtgaagctgaacgacagaaacgagttcgaggagcaggccaagagagaggaggccctgaaggccaagaagcacgtgaagaagaacagaggcgagagcttcgagagctacgaggtggcccacctgagactgctgaagctggccgagagcggcaacctgaaccagctgatcgaggacttcctggccaaggaggagaagaacttcgccagattcacctacgtgaccgagctgaacaacgacatggagatgatgcacaagagaacccagagaatccaggacgagatcatcctgctgagaagccagcagaagctgagccacgacgacaaccacagcgtgctgagacagctggaggacaagctgagaaagaccaccgaggaggccgacatgtacgagagcaagtacggcgaggtgagcaagaccctggacctgctgaagaacagcgtggagaagctgttcaagaagatcaactgcgacgccaccaagatcctggtgcagctgggcgagaccggcaaggtgaccgacatcaacctgccccagtacttcgccatcatcgagaagaagaccaacgacctgctgctgctggagacctacagaagaatcctggaggtggagggcgccgaggccgagatccccccccccttcatcaaccccttctggggcggcagcgccctgctgaagccccccgagcccatcaaggtgatcccccccgtgctgggcgccgaccccttcagcgacagactggacgacgtggagcagcccctggaccacagcagcctgagacagctggtgctggacaactacatcctgaaggagaacagaagcaaggaggtgagaggcgacagcctgcccgagaaggtggacgacttcagaagcagaaagaaggtgaccatgtag

SEQ ID NO: 20084 - DNA, 1527 bp, Artificial Sequence
  Description of Artificial Sequence: Synthetic coding sequence
atgagcagccccgacggccccagcttccccagcggccccctgagcggcggcgccagccccagcggcgacgagggcttcttccccttcgtgctggagagaagagacagcttcctgggcggcggccccggccccgaggagcccgaggacctggccctgcagctgcagcagaaggagaaggacctgctgctggccgccgagctgggcaagatgctgctggagagaaacgaggagctgagaagacagctggagaccctgagcgcccagcacctggagagagaggagagactgcagcaggagaaccacgagctgagaagaggcctggccgccagaggcgccgagtgggaggccagagccgtggagctggagggcgacgtggaggccctgagagcccagctgggcgagcagagaagcgagcagcaggacagcggcagagagagagccagagccctgagcgagctgagcgagcagaacctgagactgagccagcagctggcccaggccagccagaccgagcaggagctgcagagagagctggacgccctgagaggccagtgccaggcccaggccctggccggcgccgagctgagaaccagactggagagcctgcagggcgagaaccagatgctgcagagcagaagacaggacctggaggcccagatcagaggcctgagagaggaggtggagaagggcgagggcagactgcagaccacccacgaggagctgctgctgctgagaagagagagaagagagcacagcctggagctggagagagccagaagcgaggccggcgaggccctgagcgccctgagaagactgcagagaagagtgagcgagctggaggaggagagcagactgcaggacgccgacgtgagcgccgccagcctgcagagcgagctggcccacagcctggacgacggcgaccagggccagggcgccgacgcccccggcgacacccccaccaccagaagccccaagaccagaaaggccagcagcccccagcccagcccccccgaggagatcctggagccccccaagaagagaaccagcctgagccccgccgagatcctggaggagaaggaggtggaggtggccaagctgcaggacgagatcagcctgcagcaggccgagctgcagagcctgagagaggagctgcagagacagaaggagctgagagcccaggaggaccccggcgaggccctgcacagcgccctgagcgacagagacgaggccgtgaacaaggccctggagctgagcctgcagctgaacagagtgagcctggagagagacagcctgagcagagagctgctgagagccatcagacagaaggtggccctgacccaggagctggaggcctggcaggacgacatgcaggtggtgatcggccagcagctgagaagccagagacagaaggagctgagcgccagcgccagcagcagcacccccagaagagccgcccccagattcagcctgagactgggccccggccccgccggcggcttcctgagcaacctgttcagaagaacctag

SEQ ID NO: 20085 - DNA, 2745 bp, Artificial Sequence
  Description of Artificial Sequence: Synthetic coding sequence
atgggcaacaaggccaagatcgccaagtgccccctgagaaccaagaccggccacatcctgaagagcacccaggacacctgcatcggcagcgagaagctgctgcagaagaagcccgtgggcagcgagaccagccaggccaagggcgagaagaacggcatgaccttcagcagcaccaaggacctgtgcaagcagtgcatcgacaaggactgcctgcacatccagaaggagatcagccccgccacccccaacatgcagaagaccagaaacaccgtgaacaccagcctggtgggcaagcagaagccccacaagaagcacatcaccgccgagaacatgaagagcagcctggtgtgcctgacccaggaccagctgcagcagatcctgatgaccgtgaaccagggcaacagaagcctgagcctgaccgagaacggcaaggaggccaagagccagtacagcctgtacctgaacagcatcagcaaccagcccaaggacgagaacatcatgggcctgttcaagaagaccgagatggtgagcagcgtgcccgccgagaacaagagcgtgctgaacgagcaccaggagaccagcaagcagtgcgagcagaagatcgccatcgagaacgagtggaagcccgccgacatcttcagcaccctgggcgagagagagtgcgacagaagcagcctggaggccaagaaggcccagtggagaaaggagctggacgagcaggtggccctgaagaagaaggagaaggaggtgagcgagaagtggaacgacccctggaagaagagcgagagcgacaagatcatctgggagaagcaccagatcctggaccagagcagagagaccgtgctgctggagcaccccttcagcgccgtgaagcaggagctgcagagaaagtggatcgaggagctgaacaagcagatcgaggacgacagacagagaaagatcgaggagaagatcatctacagcaagggcgaggagcacgacagatgggccatgcacttcgacagcctgaagagctaccccggcagccagagccagctgttcagccagagcacccacaagcagcccgagtacttctgcgtgagccccgacacccaggagctggccgacgtgagcagcgtgtgcacccccaccaccggcagccaggtggagcccagcgaggaggagcacatcgccaagcccatcaaggacgtggtgatggccaacagcaagaagaccaacttcctgagaagcatgaccgccctgctggaccccgcccagatcgaggagagagacagaagaagacagaagcagctggagcaccagaaggccatcaccgcccaggtggaggagaagagaagaaagaagcagctggaggaggagcagagaaagaaggaggagcaggaggaggagctgagactggcccaggagagagaggagatgcagaagcagtacgaggaggacatcctgaagcagaagcagaaggaggagatcatgaccctgaagaccaacgagctgttccagaccatgcagagagcccaggagctggcccagagactgaagcaggagcagagaatcagagagctggcccagaagggccacgacaccagcagactgatcaagaacctgggcgtggacaccatccagatggagtacaacgccagcaacatcagcaacagcagacacgacagcgacgagatcagcggcaagatgaacacctacatgaacagcaccaccagcaagaaggacaccggcgtgcagaccgacgacctgaacatcggcatcttcaccaacgccgagagccactgcggcagcctgatggagagagacatcaccaactgcagcagccccgagatcagcgccgagctgatcggccagttcagcaccaagaagaacaagcaggagctgacccaggacaagggcgccagcctggagaaggagaacaacagatgcaacgaccagtgcaaccagttcaccagaatcgagaagcagaccaagcacatgaagaagtaccccaagagacccgactggaacatcaacaagccccccaagagatacatccccgccagcgagaagtaccccaagcagctgcagaagcagagagaggagaagaaggtgagaagacagatggagctgctgcacctggtggagaagaacaaccccggccacctgagccagaacagaggcatcagccccgagatcttccacagcagccaccaggagaccgagagcaagctgagatggcacctggtgaagaaggaggaggagcccctgaacatccacagcttcagcaaggagagaagccccagcagccccgtgcccgtggtgaagaacagaacccagcagacccagaacaccctgcacctgcccctgaagaacagcagctacgagagagagaacctgatcagcggcagcaaccagaccgagctgagcagcggcatcagcgagagcagccacttcatcccctacgtgagaaccaacgagatctactacctggaccccgacgcccccctgagcggccccagcacccaggacccccagtaccagaacagccaggactgcggccagaagagacagctgttcgacagcgactgcgtgagagaccccctgctgaaccccaacatggtgaagaacagagacagacagcaggccatcctgaagggcctgagcgagctgagacagggcctgctgcagaagcagaaggagctggagagcagcctgctgcccctggccgagaaccaggaggagagcttcggcagcagcttctag

SEQ ID NO: 20086 - DNA, 2847 bp, Artificial Sequence
  Description of Artificial Sequence: Synthetic coding sequence
atgaacctgggcgacggcctgaagctggagaccgagctgctggacggcaagaccaagctgatcctgagcccctacgagcacaagagcaagatcagcgtgaagatgggcaacaaggccaagatcgccaagtgccccctgagaaccaagaccggccacatcctgaagagcacccaggacacctgcatcggcagcgagaagctgctgcagaagaagcccgtgggcagcgagaccagccaggccaagggcgagaagaacggcatgaccttcagcagcaccaaggacctgtgcaagcagtgcatcgacaaggactgcctgcacatccagaaggagatcagccccgccacccccaacatgcagaagaccagaaacaccgtgaacaccagcctggtgggcaagcagaagccccacaagaagcacatcaccgccgagaacatgaagagcagcctggtgtgcctgacccaggaccagctgcagcagatcctgatgaccgtgaaccagggcaacagaagcctgagcctgaccgagaacggcaaggaggccaagagccagtacagcctgtacctgaacagcatcagcaaccagcccaaggacgagaacatcatgggcctgttcaagaagaccgagatggtgagcagcgtgcccgccgagaacaagagcgtgctgaacgagcaccaggagaccagcaagcagtgcgagcagaagatcgccatcgagaacgagtggaagcccgccgacatcttcagcaccctgggcgagagagagtgcgacagaagcagcctggaggccaagaaggcccagtggagaaaggagctggacgagcaggtggccctgaagaagaaggagaaggaggtgagcgagaagtggaacgacccctggaagaagagcgagagcgacaagatcatctgggagaagcaccagatcctggaccagagcagagagaccgtgctgctggagcaccccttcagcgccgtgaagcaggagctgcagagaaagtggatcgaggagctgaacaagcagatcgaggacgacagacagagaaagatcgaggagaagatcatctacagcaagggcgaggagcacgacagatgggccatgcacttcgacagcctgaagagctaccccggcagccagagccagctgttcagccagagcacccacaagcagcccgagtacttctgcgtgagccccgacacccaggagctggccgacgtgagcagcgtgtgcacccccaccaccggcagccaggtggagcccagcgaggaggagcacatcgccaagcccatcaaggacgtggtgatggccaacagcaagaagaccaacttcctgagaagcatgaccgccctgctggaccccgcccagatcgaggagagagacagaagaagacagaagcagctggagcaccagaaggccatcaccgcccaggtggaggagaagagaagaaagaagcagctggaggaggagcagagaaagaaggaggagcaggaggaggagctgagactggcccaggagagagaggagatgcagaagcagtacgaggaggacatcctgaagcagaagcagaaggaggagatcatgaccctgaagaccaacgagctgttccagaccatgcagagagcccaggagctggcccagagactgaagcaggagcagagaatcagagagctggcccagaagggccacgacaccagcagactgatcaagaacctgggcgtggacaccatccagatggagtacaacgccagcaacatcagcaacagcagacacgacagcgacgagatcagcggcaagatgaacacctacatgaacagcaccaccagcaagaaggacaccggcgtgcagaccgacgacctgaacatcggcatcttcaccaacgccgagagccactgcggcagcctgatggagagagacatcaccaactgcagcagccccgagatcagcgccgagctgatcggccagttcagcaccaagaagaacaagcaggagctgacccaggacaagggcgccagcctggagaaggagaacaacagatgcaacgaccagtgcaaccagttcaccagaatcgagaagcagaccaagcacatgaagaagtaccccaagagacccgactggaacatcaacaagccccccaagagatacatccccgccagcgagaagtaccccaagcagctgcagaagcagagagaggagaagaaggtgagaagacagatggagctgctgcacctggtggagaagaacaaccccggccacctgagccagaacagaggcatcagccccgagatcttccacagcagccaccaggagaccgagagcaagctgagatggcacctggtgaagaaggaggaggagcccctgaacatccacagcttcagcaaggagagaagccccagcagccccgtgcccgtggtgaagaacagaacccagcagacccagaacaccctgcacctgcccctgaagaacagcagctacgagagagagaacctgatcagcggcagcaaccagaccgagctgagcagcggcatcagcgagagcagccacttcatcccctacgtgagaaccaacgagatctactacctggaccccgacgcccccctgagcggccccagcacccaggacccccagtaccagaacagccaggactgcggccagaagagacagctgttcgacagcgactgcgtgagagaccccctgctgaaccccaacatggtgaagaacagagacagacagcaggccatcctgaagggcctgagcgagctgagacagggcctgctgcagaagcagaaggagctggagagcagcctgctgcccctggccgagaaccaggaggagagcttcggcagcagcttctag

SEQ ID NO: 20087 - DNA, 2847 bp, Artificial Sequence
  Description of Artificial Sequence: Synthetic coding sequence
atggacctgctggacggcctgaagctggagaccgagctgctggacggcaagaccaagctgatcctgagcccctacgagcacaagagcaagatcagcgtgaagatgggcaacaaggccaagatcgccaagtgccccctgagaaccaagaccggccacatcctgaagagcacccaggacacctgcatcggcagcgagaagctgctgcagaagaagcccgtgggcagcgagaccagccaggccaagggcgagaagaacggcatgaccttcagcagcaccaaggacctgtgcaagcagtgcatcgacaaggactgcctgcacatccagaaggagatcagccccgccacccccaacatgcagaagaccagaaacaccgtgaacaccagcctggtgggcaagcagaagccccacaagaagcacatcaccgccgagaacatgaagagcagcctggtgtgcctgacccaggaccagctgcagcagatcctgatgaccgtgaaccagggcaacagaagcctgagcctgaccgagaacggcaaggaggccaagagccagtacagcctgtacctgaacagcatcagcaaccagcccaaggacgagaacatcatgggcctgttcaagaagaccgagatggtgagcagcgtgcccgccgagaacaagagcgtgctgaacgagcaccaggagaccagcaagcagtgcgagcagaagatcgccatcgagaacgagtggaagcccgccgacatcttcagcaccctgggcgagagagagtgcgacagaagcagcctggaggccaagaaggcccagtggagaaaggagctggacgagcaggtggccctgaagaagaaggagaaggaggtgagcgagaagtggaacgacccctggaagaagagcgagagcgacaagatcatctgggagaagcaccagatcctggaccagagcagagagaccgtgctgctggagcaccccttcagcgccgtgaagcaggagctgcagagaaagtggatcgaggagctgaacaagcagatcgaggacgacagacagagaaagatcgaggagaagatcatctacagcaagggcgaggagcacgacagatgggccatgcacttcgacagcctgaagagctaccccggcagccagagccagctgttcagccagagcacccacaagcagcccgagtacttctgcgtgagccccgacacccaggagctggccgacgtgagcagcgtgtgcacccccaccaccggcagccaggtggagcccagcgaggaggagcacatcgccaagcccatcaaggacgtggtgatggccaacagcaagaagaccaacttcctgagaagcatgaccgccctgctggaccccgcccagatcgaggagagagacagaagaagacagaagcagctggagcaccagaaggccatcaccgcccaggtggaggagaagagaagaaagaagcagctggaggaggagcagagaaagaaggaggagcaggaggaggagctgagactggcccaggagagagaggagatgcagaagcagtacgaggaggacatcctgaagcagaagcagaaggaggagatcatgaccctgaagaccaacgagctgttccagaccatgcagagagcccaggagctggcccagagactgaagcaggagcagagaatcagagagctggcccagaagggccacgacaccagcagactgatcaagaacctgggcgtggacaccatccagatggagtacaacgccagcaacatcagcaacagcagacacgacagcgacgagatcagcggcaagatgaacacctacatgaacagcaccaccagcaagaaggacaccggcgtgcagaccgacgacctgaacatcggcatcttcaccaacgccgagagccactgcggcagcctgatggagagagacatcaccaactgcagcagccccgagatcagcgccgagctgatcggccagttcagcaccaagaagaacaagcaggagctgacccaggacaagggcgccagcctggagaaggagaacaacagatgcaacgaccagtgcaaccagttcaccagaatcgagaagcagaccaagcacatgaagaagtaccccaagagacccgactggaacatcaacaagccccccaagagatacatccccgccagcgagaagtaccccaagcagctgcagaagcagagagaggagaagaaggtgagaagacagatggagctgctgcacctggtggagaagaacaaccccggccacctgagccagaacagaggcatcagccccgagatcttccacagcagccaccaggagaccgagagcaagctgagatggcacctggtgaagaaggaggaggagcccctgaacatccacagcttcagcaaggagagaagccccagcagccccgtgcccgtggtgaagaacagaacccagcagacccagaacaccctgcacctgcccctgaagaacagcagctacgagagagagaacctgatcagcggcagcaaccagaccgagctgagcagcggcatcagcgagagcagccacttcatcccctacgtgagaaccaacgagatctactacctggaccccgacgcccccctgagcggccccagcacccaggacccccagtaccagaacagccaggactgcggccagaagagacagctgttcgacagcgactgcgtgagagaccccctgctgaaccccaacatggtgaagaacagagacagacagcaggccatcctgaagggcctgagcgagctgagacagggcctgctgcagaagcagaaggagctggagagcagcctgctgcccctggccgagaaccaggaggagagcttcggcagcagcttctag

SEQ ID NO: 20088 - DNA, 864 bp, Artificial Sequence
  Description of Artificial Sequence: Synthetic coding sequence
atggacctgctggacggcctgaagctggagaccgagctgctggacggcaagaccaagctgatcctgagcccctacgagcacaagagcaagatcagcgtgaagatgggcaacaaggccaagatcgccaagtgccccctgagaaccaagaccggccacatcctgaagagcacccaggacacctgcatcggcagcgagaagctgctgcagaagaagcccgtgggcagcgagaccagccaggccaagggcgagaagaacggcatgaccttcagcagcaccaaggacctgtgcaagcagtgcatcgacaaggactgcctgcacatccagaaggagatcagccccgccacccccaacatgcagaagaccagaaacaccgtgaacaccagcctggtgggcaagcagaagccccacaagaagcacatcaccgccgagaacatgaagagcagcctggtgtgcctgacccaggaccagctgcagcagatcctgatgaccgtgaaccagggcaacagaagcctgagcctgaccgagaacggcaaggaggccaagagccagtacagcctgtacctgaacagcatcagcaaccagcccaaggacgagaacatcatgggcctgttcaagaagaccgagatggtgagcagcgtgcccgccgagaacaagagcgtgctgaacgagcaccaggagaccagcaagcagtgcgagcagaagatcgccatcgagaacgagtggaagcccgccgacatcttcagcaccctgggcgagagagagtgcgacagaagcagcctggaggccaagaaggcccagtggagaaaggagctggtgctgcagaccgtgcaggcctggtaccagcacctgctgggcttctggtag

SEQ ID NO: 20089 - DNA, 1815 bp, Artificial Sequence
  Description of Artificial Sequence: Synthetic coding sequence
atggagaaccaggcccacaacaccatgggcaccagcccctgcgaggccgagctgcaggagctgatggagcagatcgacatcatggtgagcaacaagaagatggactgggagagaaagatgagagccctggagaccagactggacctgagagaccaggagctggccaacgcccagacctgcctggaccagaagggccaggaggtgggcctgctgagacagaagctggacagcctggagaagtgcaacctggccatgacccagaactacgagggccagctgcagagcctgaaggcccagttcagcaagctgaccaacaacttcgagaagctgagactgcaccagatgaagcagaacaaggtgcccagaaaggagctgccccacctgaaggaggagatccccttcgagctgagcaacctgaaccagaagctggaggagttcagagccaagagcagagagtgggacaagcaggagatcctgtaccagacccacctgatcagcctggacgcccagcagaagctgctgagcgagaagtgcaaccagttccagaagcaggcccagagctaccagacccagctgaacggcaagaagcagtgcctggaggacagcagcagcgagatccccagactgatctgcgaccccgaccccaactgcgagatcaacgagagagacgagttcatcatcgagaagctgaagagcgccgtgaacgagatcgccctgagcagaaacaagctgcaggacgagaaccagaagctgctgcaggagctgaagatgtaccagagacagtgccaggccatggaggccggcctgagcgaggtgaagagcgagctgcagagcagagacgacctgctgagaatcatcgagatggagagactgcagctgcacagagagctgctgaagatcggcgagtgccagaacgcccagggcaacaagaccagactggagagcagctacctgcccagcatcaaggagcccgagagaaagatcaaggagctgttcagcgtgatgcaggaccagcccaaccacgagaaggagctgaacaagatcagaagccagctgcagcaggtggaggagtaccacaacagcgagcaggagagaatgagaaacgagatcagcgacctgaccgaggagctgcaccagaaggagatcaccatcgccaccgtgaccaagaaggccgccctgctggagaagcagctgaagatggagctggagatcaaggagaagatgctggccaagcagaaggtgagcgacatgaagtacaaggccgtgagaaccgagaacacccacctgaagggcatgatgggcgacctggaccccggcgagtacatgagcatggacttcaccaacagagagcagagcagacacaccagcatcaacaagctgcagtacgagaacgagagactgagaaacgacctggccaagctgcacgtgaacggcaagagcacctggaccaaccagaacacctacgaggagaccggcagatacgcctaccagagccagatcaaggtggagcagaacgaggagagactgagccacgactgcgagcccaacagaagcaccatgccccccctgccccccagcaccttccaggccaaggagatgaccagccccctggtgagcgacgacgacgtgttccccctgagcccccccgacatgagcttccccgccagcctggccgcccagcacttcctgctggaggaggagaagagagccaaggagctggagaagctgctgaacacccacatcgacgagctgcagagacacaccgagttcaccctgaacaagtacagcaagctgaagcagaacagacacatctag

SEQ ID NO: 20090 - DNA, 990 bp, Artificial Sequence
  Description of Artificial Sequence: Synthetic coding sequence
atggagaaccaggcccacaacaccatgggcaccagcccctgcgaggccgagctgcaggagctgatggagcagatcgacatcatggtgagcaacaagaagatggactgggagagaaagatgagagccctggagaccagactggacctgagagaccaggagctggccaacgcccagacctgcctggaccagaagggccaggaggtgggcctgctgagacagaagctggacagcctggagaagtgcaacctggccatgacccagaactacgagggccagctgcagagcctgaaggcccagttcagcaagctgaccaacaacttcgagaagctgagactgcaccagatgaagcagaacaaggtgcccagaaaggagctgccccacctgaaggaggagatccccttcgagctgagcaacctgaaccagaagctggaggagttcagagccaagagcagagagtgggacaagcaggagatcctgtaccagacccacctgatcagcctggacgcccagcagaagctgctgagcgagaagtgcaaccagttccagaagcaggcccagagctaccagacccagctgaacggcaagaagcagtgcctggaggacagcagcagcgagatccccagactgatctgcgaccccgaccccaactgcgagatcaacgagagagacgagttcatcatcgagaagctgaagagcgccgtgaacgagatcgccctgagcagaaacaagctgcaggacgagaaccagaagctgctgcaggagctgaagatgtaccagagacagtgccaggccatggaggccggcctgagcgaggtgaagagcgagctgcagagcagagacgacctgctgagaatcatcgagatggagagactgcagctgcacagagagctgctgaagatcggcgagtgccagaacgcccagggcaacaagaccagactggagagcagctacctgcccagcatcaaggagcccgagagaaagatcaagtag

SEQ ID NO: 20091 - DNA, 1815 bp, Artificial Sequence; identical to SEQ ID NO: 20089
  Description of Artificial Sequence: Synthetic coding sequence

SEQ ID NO: 20092 - DNA, 1008 bp, Artificial Sequence
  Description of Artificial Sequence: Synthetic coding sequence
atgaccaccgtgaccgtgaccaccgagatcccccccagagacaagatggaggacaacagcgccctgtacgagagcaccagcgcccacatcatcgaggagaccgagtacgtgaagaagatcagaaccaccctgcagaagatcagaacccagatgttcaaggacgagatcagacacgacagcaccaaccacaagctggacgccaagcactgcggcaacctgcagcagggcagcgacagcgagatggaccccagctgctgcagcctggacctgctgatgaagaagatcaagggcaaggacctgcagctgctggagatgaacaaggagaacgaggtgctgaagatcaagctgcaggccagcagagaggccggcgccgccgccctgagaaacgtggcccagagactgttcgagaactaccagacccagagcgaggaggtgagaaagaagcaggaggacagcaagcagctgctgcaggtgaacaagctggagaaggagcagaagctgaagcagcacgtggagaacctgaaccaggtggccgagaagctggaggagaagcacagccagatcaccgagctggagaacctggtgcagagaatggagaaggagaagagaaccctgctggagagaaagctgagcctggagaacaagctgctgcagctgaagagcagcgccacctacggcaagagctgccaggacctgcagagagagatcagcatcctgcaggagcagatcagccacctgcagttcgtgatccacagccagcaccagaacctgagaagcgtgatccaggagatggagggcctgaagaacaacctgaaggagcaggacaagagaatcgagaacctgagagagaaggtgaacatcctggaggcccagaacaaggagctgaagacccaggtggccctgagcagcgagacccccagaaccaaggtgagcaaggccgtgagcaccagcgagctgaagaccgagggcgtgagcccctacctgatgctgatcagactgagaaagtag

SEQ ID NO: 20093 - DNA, 1008 bp, Artificial Sequence; identical to SEQ ID NO: 20092
  Description of Artificial Sequence: Synthetic coding sequence

SEQ ID NO: 20094 - DNA, 1008 bp, Artificial Sequence; identical to SEQ ID NO: 20092
  Description of Artificial Sequence: Synthetic coding sequence

SEQ ID NO: 20095 - DNA, 891 bp, Artificial Sequence
  Description of Artificial Sequence: Synthetic coding sequence
atgggctgcagacacagcagactgagcagctgcaagccccccaagaagaagagacaggagcccgagcccgagcagccccccagacccgagccccacgagctgggccccctgaacggcgacaccgccatcaccgtgcagctgtgcgccagcgaggaggccgagagacaccagaaggacatcaccagaatcctgcagcagcacgaggaggagaagaagaagtgggcccagcaggtggagaaggagagagagctggagctgagagacagactggacgagcagcagagagtgctggagggcaagaacgaggaggccctgcaggtgctgagagccagctacgagcaggagaaggaggccctgacccacagcttcagagaggccagcagcacccagcaggagaccatcgacagactgaccagccagctggaggccttccaggccaagatgaagagagtggaggagagcatcctgagcagaaactacaagaagcacatccaggactacggcagccccagccagttctgggagcaggagctggagagcctgcacttcgtgatcgagatgaagaacgagagaatccacgagctggacagaagactgatcctgatggagaccgtgaaggagaagaacctgatcctggaggagaagatcaccaccctgcagcaggagaacgaggacctgcacgtgagaagcagaaaccaggtggtgctgagcagacagctgagcgaggacctgctgctgaccagagaggccctggagaaggaggtgcagctgagaagacagctgcagcaggagaaggaggagctgctgtacagagtgctgggcgccaacgccagccccgccttccccctggcccccgtgacccccaccgaggtgagcttcctggccacctag

SEQ ID NO: 20096 - DNA, 609 bp, Artificial Sequence
  Description of Artificial Sequence: Synthetic coding sequence
atgagaaccagcatgagcgaggccgccaccagatggagctgccagggcagctgccagaagacctgcttcagcagagtgagaccctggagaagaagatgcagctgcggcgacagcagcagcagaagaagaagaagctgctgcaccggcagcctgggccccatgcccagactgcccagcctgtggcccctgagcctgcccctgagaagcctgagcagcccccacagagtgcagggcctgggcccccccagaagactgaagagccagctgctgcccagattcttctggagaagacagcaggagcccctgagcagcttccccggcagaaacgagggcggcagcgagatggagatcctgggcgtgtgccccgtgagccccggcgccctgagctacatggagagccccaccggcttctggagacccagagaggccagcagcctggagctggccaagggcatcagcaagagaagacacttcctgcccgcccccgccctgtgccccaaccccagaagcagcgaggccttccccggccagagcgtgagcagatggcccttcgacatcaaggagaccgcccccggccccagcctgagcgccctgctgcccacctgctag

SEQ ID NO: 20097 - DNA, 1461 bp, Artificial Sequence
  Description of Artificial Sequence: Synthetic coding sequence
atgaagcccgtgaagcacctgctgaccaccagcaacaagagcgccaacgtgcccgccctgaccaccaagaagggcctgcacaacctgcccctgagccccgagctgaaggagaagcacaacgccaagctgatccacgacaagatcgagcccatggtgctgagaagcccccccaccggcgagagcatcctgagatacgccctgcccatccccagcagcaagaccaagaacctgctgcccgaggacgagatgatcggcaagatcatcaagcacctgaagatggtggtgagcaccctggaggagacctacggccactgcgaccagaacggcgaggagcccttcgtgaagcacgagcacgaggagctgagcctgagcgtgggcgacgacatgaacagcttcctgacctactgcagccagttcgccgcccagctggaggaggccctgaaggaggagcagaacatcctggagagcctgttcaagtggttccagtggcaggtgaaccagatggaggagatcagcaaggaccagaccctgctgcaggccgagccccccaagcccgacaagaccgtgatcctgaacatcgccgagatcgtgagactggtgcagagattcgaggagctgaagaacagactgaagcagagaagcaagagcagcgtgaaggtgatgctgagcaagaccatggacaaggagaacagacccgaggccgtgaagagctgcgaggccctggcccagaagatcgaggagttcctggaggcccacagcaccgacgagttcaaggacgtgagcgccaccgagccccagaccgcccacagcatgaccaacagattcaacgccatgctgaaggtgttcgagaaccaggccaacatgctggagagagccgtgaacgaccaggtgctgctggacgccgagtacaagcagatgcagtgcgacttccagctgctgagcgaggagaagctggtgctggagaacgagctgcagaagctgaaggacaaggagaagaccaagcccaccaacaacagaaccaagaaggccgtgaagaccgtgaagaagaaggacaagggcaagagcgaggacagcgagaagaagatgagccccgagaaggagttcaagatcaaggaggacctggaccaggtgcagaaggtggccagactggagatcgagaacaaggtgctgcaggagcagctgaagcaggccctgcaggaggccgagaaggccaagcaccagctgaactacttcctgaaccaggagaagctgctgaagagcgagggcaagaccgagaccaccatgcaggtgggcaacagccagaccaaggtgaagggcgaggacagcaagaacatccccctggagaaggagaccagaaagagcctggtgagcgacagcggcggccagagaaccagcgacaagatccaggagtacccccagatcaccgcccagagcggcagactgatcgagaagagatgctag

SEQ ID NO: 20098 - DNA, 840 bp, Artificial Sequence
  Description of Artificial Sequence: Synthetic coding sequence
atgaagcccgtgaagcacctgctgaccaccagcaacaagagcgccaacgtgcccgccctgaccaccaagaagggcctgcacaacctgcccctgagccccgagctgaaggagaagcacaacgccaagctgatccacgacaagatcgagcccatggtgctgagaagcccccccaccggcgagagcatcctgagatacgccctgcccatccccagcagcaagaccaagaacctgctgcccgaggacgagatgatcggcaagatcatcaagcacctgaagatggtggtgagcaccctggaggagacctacggccactgcgaccagaacggcgaggagcccttcgtgaagcacgagcacgaggagctgagcctgagcgtgggcgacgacatgaacagcttcctgacctactgcagccagttcgccgcccagctggaggaggccctgaaggaggagcagaacgtgtgcatcctgtacatcctgagcatcttcctgaagtggttccagtggcaggtgaaccagatggaggagatcagcaaggaccagaccctgctgcaggccgagccccccaagcccgacaagaccgtgatcctgaacatcgccgagatcgtgagactggtgcagagattcgaggagctgaagaacagactgaagcagagaagcaagagcagcgtgaaggtgatgctgagcaagaccatggacaaggagaacagacccgaggccgtgaagagctgcgaggccctggcccagaagatcgaggagttcctggaggcccacagcaccgacgagttcaaggacgtgagcgccaccgagcccagaaagttccccctgatcaaggccctgtag

SEQ ID NO: 20099 - DNA, 1461 bp, Artificial Sequence; identical to SEQ ID NO: 20097
  Description of Artificial Sequence: Synthetic coding sequence

SEQ ID NO: 20100 - DNA, 483 bp, Artificial Sequence
  Description of Artificial Sequence: Synthetic coding sequence
aagaccaagcccaccaacaacagaaccaagaaggccgtgaagaccgtgaagaagaaggacaagggcaagagcgaggacagcgagaagaagatgagccccgagaaggagttcaagatcaaggaggacctggaccaggtgcagaaggtggccagactggagatcgagaacaaggtgctgcaggagcagctgaagcaggccctgcaggaggccgagaaggccaagcaccagctgaactacttcctgaaccaggagaagctgctgaagagcgagggcaagaccgagaccaccatgcaggtgggcaacagccagaccaaggtgaagggcgaggacagcaagaacatccccctggagaaggagaccagaaagagcctggtgagcgacagcggcggccagagaaccagcgacaagatccaggagtacccccagatgctgatcgagttcctgaagtacttcggcaaggtgagccagaccttcagagagtag

SEQ ID NO: 20101 - DNA, 516 bp, Artificial Sequence
  Description of Artificial Sequence: Synthetic coding sequence
atgaagcccgtgaagcacctgctgaccaccagcaacaagagcgccaacgtgcccgccctgaccaccaagaagggcctgcacaacctgcccctgagccccgagctgaaggagaagcacaacgccaagctgatccacgacaagatcgagcccatggtgctgagaagcccccccaccggcgagagcatcctgagatacgccctgcccatccccagcagcaagaccaagaacctgctgcccgaggacgagatgatcggcaagatcatcaagcacctgaagatggtggtgagcaccctggaggagacctacggccactgcgaccagaacggcgaggagcccttcgtgaagcacgagcacgaggagctgagcctgagcgtgggcgacgacatgaacagcttcctgacctactgcagccagttcgccgcccagctggaggaggccctgaaggaggagcagaacatcctggagagcctgttcaagtggttccagtggcaggtgaaccagatggaggagggctag

SEQ ID NO: 20102 - DNA, 528 bp, Artificial Sequence
  Description of Artificial Sequence: Synthetic coding sequence
atgaagcccgtgaagcacctgctgaccaccagcaacaagagcgccaacgtgcccgccctgaccaccaagaagggcctgcacaacctgcccctgagccccgagctgaaggagaagcacaacgccaagctgatccacgacaagatcgagcccatggtgctgagaagcccccccaccggcgagagcatcctgagatacgccctgcccatccccagcagcaagaccaagaacctgctgcccgaggacgagatgatcggcaagatcatcaagcacctgaagatggtggtgagcaccctggaggagacctacggccactgcgaccagaacggcgaggagcccttcgtgaagcacgagcacgaggagctgagcctgagcgtgggcgacgacatgaacagcttcctgacctactgcagccagttcgccgcccagctggaggaggccctgaaggaggagcagaacatcctggagagcctgttcaagtggttccagtggcaggtgaaccagatggaggagaagctgctgatccagtag

SEQ ID NO: 20103 - DNA, 522 bp, Artificial Sequence
  Description of Artificial Sequence: Synthetic coding sequence
atgaagcccgtgaagcacctgctgaccaccagcaacaagagcgccaacgtgcccgccctgaccaccaagaagggcctgcacaacctgcccctgagccccgagctgaaggagaagcacaacgccaagctgatccacgacaagatcgagcccatggtgctgagaagcccccccaccggcgagagcatcctgagatacgccctgcccatccccagcagcaagaccaagaacctgctgcccgaggacgagatgatcggcaagatcatcaagcacctgaagatggtggtgagcaccctggaggagacctacggccactgcgaccagaacggcgaggagcccttcgtgaagcacgagcacgaggagctgagcctgagcgtgggcgacgacatgaacagcttcctgacctactgcagccagttcgccgcccagctggaggaggccctgaaggaggagcagaacatcctggagagcctgttcaagtggttccagtggcaggtgaaccagatggaggagagctgcaagtag

SEQ ID NO: 20104 - DNA, 516 bp, Artificial Sequence; identical to SEQ ID NO: 20101
  Description of Artificial Sequence: Synthetic coding sequence

SEQ ID NO: 20105 - DNA, 1404 bp, Artificial Sequence
  Description of Artificial Sequence: Synthetic coding sequence
atgagcgtggtggtgcagcacgtggaggagaaggccgtgcacagctggagcagaatcagcaccgccggcaagaaggccctggaggaggccctgctggtgttcaaccccatgagccaggacctgagcgccaccgaggcccagctggtggccttcctgcagggcctgagagacgacggcttccagcccaccatcctgagaagcggcgacgtgtacggctacagcagctgcaccgccaacccccccagccagaccaagctgcaggccagagcccccaaccccaccgccaccagcccccccgccagcgcccccagaaccgccatgagactgcccgccggcagagccaccctgctgcccatgcccctgagcggcagactggccaaggccagcacccccgccctggccaagcacgccaccaccaacctgctgctgagcagcctgaagcagagcagcgccagccacgccagaggcgccgccgtgggcttccccacccacctgtaccccggcgtgtaccccgccatgagactgagcgtggtgctggaggccctggtgcccctgaagacccccatgccctgcctgggcgccaagcacaaggcccagagcctgcagctgagcctggccgacagccccctgaagctgagaaagagcagcggcaagggccccggcaaccccagacccaaggcccccagaaagaccaccagcaagggccccaagtgcctgaccagaaagggccccggcgccggccccagaagaggcagcggccaccagagcaagaccaacagagccaccggcagccccagcgtgagaagaatgaagggcggcagcgccctgggcaccaagaccgcccaggccaaggtggccagaaccctggccaaggccgccagagcccaggccaaggtggccagaacccaggccaaggccgccaaggccagagccaaggccaaggccgcccaggtgaaggccaaggccaaggccaaggccgcccaggtgaaggccaaggccaaggtgatggccgcctgggccaaggccaaggccaaggccaaggccgtgagagccaaggccaaggtggccagaacccagcccagaggcagaggcagacccaagggcagcgccaaggccagaaccaccagaaagggccagaagaacagacccgagaccgtgggccagaagagaaagagagccgaggaggccaaggacctgccccccaagaagagaaccagactgggccccagaagccccaaggcctggctgggccccggcaccgccaagctgctgaagttcagagccatcaaggtggacagaagaagcagcgacgacgaggtgagacagagagcccagagaatcctgagagtgaacctgagccccgtgatcagactgcagcccctgctgccctacagcgccgtgtag

SEQ ID NO: 20106 - DNA, 708 bp, Artificial Sequence
  Description of Artificial Sequence: Synthetic coding sequence
atgagaagaagcatgaagagaagaagaagaagaagacccgtggcccccgccaccgccgccagaggcggcgacttcagagccgaggacggcgccggcctggaggccagagaggagaaggtggtgtacagcagaagccagctgagcctggccgacagcaccaaggccctgggcgacgccttcaagctgttcatgcccagaagcaccgagttcatgagcagcgacgccgagctgtggagcttcctgtgcagcctgaagcaccagttcagcccccacatcctgagaagcaaggacgtgtacggctacagcagctgcagagccctggtgcccgacccccccggcccccccaccgccagaggccaggccagaagacccgtgcccagagccgccgccagaagaagaagaagaggcgccagagccgccgccgccagaagaagaaagcccagacccccccccccccccccccccccccccgaggagagctgccccgccaagcccgtggcccccggcccctgcttcggcggcagaaccctggaggagatctggagagccgccacccccaccctgaccaccttccccaccatcagagtgggcagcgacgtgtggggcgagagaagcctggccgccgccagaagaagagccagacaggtgctgagagtgaacctggagcccatggtgagactgagaagattccccgtgcccagagcctag

SEQ ID NO: 20107 - DNA, 195 bp, Artificial Sequence
  Description of Artificial Sequence: Synthetic coding sequence
atgagcggcagagagggcggcaagaagaagcccctgaagcagcccaagaagcaggccaaggagatggacgaggaggacaaggccttcaagcagaagcagaaggaggagcagaagaagctggaggagctgaaggccaaggccgccggcaagggccccctggccaccggcggcatcaagaagagcggcaagaagtag

SEQ ID NO: 20108 - DNA, 1137 bp, Artificial Sequence
  Description of Artificial Sequence: Synthetic coding sequence
atgagcggcgccggcgtggccgccggcaccagaccccccagcagccccacccccggcagcagaagaagaagacagagacccagcgtgggcgtgcagagcctgagaccccagagcccccagctgagacagagcgacccccagaagagaaacctggacctggagaagagcctgcagttcctgcagcagcagcacagcgagatgctggccaagctgcacgaggagatcgagcacctgaagagagagaacaaggacctgcactacaagctgatcatgaaccagaccagccagaagaaggacggccccagcggcaaccacctgagcagagccagcgcccccctgggcgccagatgggtgtgcatcaacggcgtgtgggtggagcccggcggccccagccccgccagactgaaggagggcagcagcagaacccacagacccggcggcaagagaggcagactggccggcggcagcgccgacaccgtgagaagccccgccgacagcctgagcatgagcagcttccagagcgtgaagagcatcagcaacagcggcaaggccagaccccagcccggcagcttcaacaagcaggacagcaaggccgacgtgagccagaaggccgacctggaggaggagcccctgctgcacaacagcaagctggacaaggtgcccggcgtgcagggccaggccagaaaggagaaggccgaggccagcaacgccggcgccgcctgcatgggcaacagccagcaccagggcagacagatgggcgccggcgcccacccccccatgatcctgcccctgcccctgagaaagcccaccaccctgagacagtgcgaggtgctgatcagagagctgtggaacaccaacctgctgcagacccaggagctgagacacctgaagagcctgctggagggcagccagagaccccaggccgcccccgaggaggccagcttccccagagaccaggaggccacccacttccccaaggtgagcaccaagagcctgagcaagaagtgcctgagcccccccgtggccgagagagccatcctgcccgccctgaagcagacccccaagaacaacttcgccgagagacagaagagactgcaggccatgcagaagagaagactgcacagaagcgtgctgtag

SEQ ID NO: 20109 - DNA, 993 bp, Artificial Sequence
  Description of Artificial Sequence: Synthetic coding sequence
atgggcagaaacccctgggacagcccctgccccgccagaagcctgccccagatcgccgccgtggccagacccagaatcagcagccccatggccctgagcccccacatgctgggcgcccagggcctgtggacccacagcatccagggcagcctgcccgccatctgggccgccaccatgggcaccaagggcggcagcagagtgctgttcccctgccacctgagcaaggccctgccccaccccgacagcggcccccaccccgcccaggaccccggcctgtggagccaggcccacttccccctgagcctgggcctgggcctgaccagcggcggccacctgaccggcggctggagccagcccggcaacatcgccgccggcgccgtgcccagagccctgcccagccagggcgacatggagaagggcgtggagggcggccccttccccagcagatgcggcaacagcagcgagctgttctgggccaagtgcggccccagcagacagccccagccctgcagcgccggcgacgccgacagaaccagagaggaggccatgctgagcctgggcacctgctgcagcatgtgccccaagcccagctgcttccccgacggccccagcggcaaccacctgagcagagccagcgcccccctgggcgccagatgggtgtgcatcaacggcgtgtgggtggagcccggcggccccagccccgccagactgaaggagggcagcagcagaacccacagacccggcggcaagagaggcagactggccggcggcagcgccgacaccgtgagaagccccgccgacagcctgagcatgagcagcttccagagcgtgaagagcatcagcaacagcggcaaggccagaccccagcccggcagcttcaacaagcaggacagcaaggccgacgtgagccagaaggccgacctggaggaggagcccctgctgcacaacagcaagctggacaaggtgcccggcgtgcagggccaggccagatag

SEQ ID NO: 20110 - DNA, 939 bp, Artificial Sequence
  Description of Artificial Sequence: Synthetic coding sequence
atgagcggcgccggcgtggccgccggcaccagaccccccagcagccccacccccggcagcagaagaagaagacagagacccagcgtgggcgtgcagagcctgagaccccagagcccccagctgagacagagcgacccccagaagagaaacctggacctggagaagagcctgcagttcctgcagcagcagcacagcgagatgctggccaagctgcacgaggagatcgagcacctgaagagagagaacaaggacctgcactacaagctgatcatgaaccagaccagccagaagaaggacagcctgagcatgagcagcttccagagcgtgaagagcatcagcaacagcggcaaggccagaccccagcccggcagcttcaacaagcaggacagcaaggccgacgtgagccagaaggccgacctggaggaggagcccctgctgcacaacagcaagctggacaaggtgcccggcgtgcagggccaggccagaaaggagaaggccgaggccagcaacgccggcgccgcctgcatgggcaacagccagcaccagggcagacagatgggcgccggcgcccacccccccatgatcctgcccctgcccctgagaaagcccaccaccctgagacagtgcgaggtgctgatcagagagctgtggaacaccaacctgctgcagacccaggagctgagacacctgaagagcctgctggagggcagccagagaccccaggccgcccccgaggaggccagcttccccagagaccaggaggccacccacttccccaaggtgagcaccaagagcctgagcaagaagtgcctgagcccccccgtggccgagagagccatcctgcccgccctgaagcagacccccaagaacaacttcgccgagagacagaagagactgcaggccatgcagaagagaagactgcacagaagcgtgctgtag

SEQ ID NO: 20111 - DNA, 1143 bp, Artificial Sequence
  Description of Artificial Sequence: Synthetic coding sequence
atgagcggcgccggcgtggccgccggcaccagaccccccagcagccccacccccggcagcagaagaagaagacagagacccagcgtgggcgtgcagagcctgagaccccagagcccccagctgagacagagcgacccccagaagagaaacctggacctggagaagagcctgcagttcctgcagcagcagcacagcgagatgctggccaagctgcacgaggagatcgagcacctgaagagagagaacaaggacctgagatacaagctgatcatgaaccagaccagccagaagaaggacggccccagcggcaaccacctgagcagagccagcgcccccctgggcgccagatgggtgtgcatcaacggcgtgtgggtggagcccggcggccccagccccgccagactgaaggagggcagcagcagaacccacagacccggcggcaagcacggcagactggccggcggcagcgccgacaccgtgagaagccccgccgacagcctgagcaccagcagcttccagagcgtgaagagcatcagcaacagcggcaaggccagaccccagcccggcagcttcaacaagcaggacagcaaggccgacgtgccccagaaggccgacctggaggaggagcccctgctgcacaacagcaagctggacaaggtgcccggcgtgcagggccaggccagaaaggagaaggccgaggccagcaacgccggcgccgcctgcatgggcaacagccagcaccagggcagacagatgggcgccgccgcccacccccccatgatcctgcccctgcccctgagaaagcccaccaccctgagacagtgcgaggtgctgatcagagagctgtggaacaccaacctgctgcagacccaggagctgcagcacctgaagagcctgctggagggcagccagagaccccaggccgtgcccgaggaggccagcttccccagagaccaggaggccacccacttccccaaggtgagcaccaagagcctgagcaagaagtgcctgctgctgagcccccccgtggccgagagagccatcctgcccgccctgaagcagacccccaagaacaacttcgccgagagacagaagagactgcaggccatgcagaagagaagactgcacagaagcgtgctgtag

SEQ ID NO: 20112 - DNA, 1449 bp, Artificial Sequence
  Description of Artificial Sequence: Synthetic coding sequence
atgggcagaaacccctgggacagcccctgccccgccagaagcctgccccagatcgccgccgtggccagacccagaatcagcagccccatggccctgagccccgacatgctgggcgcccagggcctgtggacccacagcatccagggcagcctgcccgccatctgggccgccaccatgggcaccaagggcggcagcagagtgctgttcccctgccacctgagcaaggccctgccccaccccgacagcggcccccaccccgcccaggacagcggcctgtggagcagagcccacttccccctgagcctgggcctgggcctgaccagcggcggccacctgaccggcggctggagccagcccggcaacatcgtggccggcgccgtgcccagagccctgcccagccagagagacatggagaacggcgtggagggcggccccttccccagcagatgcggcaacagcagcgagctgttctgggccaagtgcggccccagcagacagccccagccctgcagcgccggcgacgccgacagaaccagagaggaggccatgctgagcctgggcacctgctgcagcatgtgccccaagcccagctgcttccccgacggccccagcggcaaccacctgagcagagccagcgcccccctgggcgccagatgggtgtgcatcaacggcgtgtgggtggagcccggcggccccagccccgccagactgaaggagggcagcagcagaacccacagacccggcggcaagcacggcagactggccggcggcagcgccgacaccgtgagaagccccgccgacagcctgagcaccagcagcttccagagcgtgaagagcatcagcaacagcggcaaggccagaccccagcccggcagcttcaacaagcaggacagcaaggccgacgtgccccagaaggccgacctggaggaggagcccctgctgcacaacagcaagctggacaaggtgcccggcgtgcagggccaggccagaaaggagaaggccgaggccagcaacgccggcgccgcctgcatgggcaacagccagcaccagggcagacagatgggcgccgccgcccacccccccatgatcctgcccctgcccctgagaaagcccaccaccctgagacagtgcgaggtgctgatcagagagctgtggaacaccaacctgctgcagacccaggagctgcagcacctgaagagcctgctggagggcagccagagaccccaggccgtgcccgaggaggccagcttccccagagaccaggaggccacccacttccccaaggtgagcaccaagagcctgagcaagaagtgcctgctgctgagcccccccgtggccgagagagccatcctgcccgccctgaagcagacccccaagaacaacttcgccgagagacagaagagactgcaggccatgcagaagagaagactgcacagaagcgtgctgtag

SEQ ID NO: 20113 - DNA, 945 bp, Artificial Sequence
  Description of Artificial Sequence: Synthetic coding sequence
atgagcggcgccggcgtggccgccggcaccagaccccccagcagccccacccccggcagcagaagaagaagacagagacccagcgtgggcgtgcagagcctgagaccccagagcccccagctgagacagagcgacccccagaagagaaacctggacctggagaagagcctgcagttcctgcagcagcagcacagcgagatgctggccaagctgcacgaggagatcgagcacctgaagagagagaacaaggacctgagatacaagctgatcatgaaccagaccagccagaagaaggacagcctgagcaccagcagcttccagagcgtgaagagcatcagcaacagcggcaaggccagaccccagcccggcagcttcaacaagcaggacagcaaggccgacgtgccccagaaggccgacctggaggaggagcccctgctgcacaacagcaagctggacaaggtgcccggcgtgcagggccaggccagaaaggagaaggccgaggccagcaacgccggcgccgcctgcatgggcaacagccagcaccagggcagacagatgggcgccgccgcccacccccccatgatcctgcccctgcccctgagaaagcccaccaccctgagacagtgcgaggtgctgatcagagagctgtggaacaccaacctgctgcagacccaggagctgcagcacctgaagagcctgctggagggcagccagagaccccaggccgtgcccgaggaggccagcttccccagagaccaggaggccacccacttccccaaggtgagcaccaagagcctgagcaagaagtgcctgctgctgagcccccccgtggccgagagagccatcctgcccgccctgaagcagacccccaagaacaacttcgccgagagacagaagagactgcaggccatgcagaagagaagactgcacagaagcgtgctgtag

SEQ ID NO: 20114 - DNA, 618 bp, Artificial Sequence
  Description of Artificial Sequence: Synthetic coding sequence
tgaagcggcgccggcgtggccgccggcaccagaccccccagcagccccacccccggcagcagaagaagaagacagagacccagcgtgggcgtgcagagcctgagaccccagagcccccagctgagacagagcgacccccagaagagaaacctggacctggagaagagcctgcagttcctgcagcagcagcacagcgagatgctggccaagctgcacgaggagatcgagcacctgaagagagagaacaagggcgagcccgccagaggccccagacccgccctgcccccccaggcccacagcaccctgcccctgccccagcacagaaacaccgccatcaacagcagcaccagactgggcagcggcggcacccaggacgacctgagatacaagctgatcatgaaccagaccagccagaagaaggacggccccagcggcaaccacctgagcagagccagcgcccccctgggcgccagatgggtgtgcatcaacggcgtgtgggtggagcccggcggccccagccccgccagactgaaggagggcagcagcagaacccacagacccggcggcaagcacggcagactggccggcggcagcgccgacaccgtgagaagcccctag

SEQ ID NO: 20115 - DNA, 471 bp, Artificial Sequence
  Description of Artificial Sequence: Synthetic coding sequence
atgagcagaaagagcggcatcggccacgaggccagcctgaagagaaaggccgaggagaagctggagagctacagaaagaagatccacatgaagaaccaggccgaggagaaggccgccgagcagttcagaatgagactgaagaacaagcaggacgagatgaagctggagggcgacctgagaagaagccagagagcctgccagcagctggacgtgcagaagaacatccaggtgcccagagaggcctggtactggctgagactggaggaggagaccgaggaggacgaggaggagaaggagcaggacgaggacgagtacaagagcgaggacctgagcgtgctggagaagctgcagatcctgaccagctacctgagagaggagcacctgtactgcatctggtgcggcaccgcctacgaggacaaggaggacctgagcagcaactgccccggccccaccagcgccgaccacgactag

SEQ ID NO: 20116 - DNA, 780 bp, Artificial Sequence
  Description of Artificial Sequence: Synthetic coding sequence
atggccgaggaggaggactacatgagcgacagcttcatcaacgtgcaggaggacatcagacccggcctgcccatgctgagacagatcagagaggccagaagaaaggaggagaagcagcaggaggccaacctgaagaacagacagaagagcctgaaggaggaggagcaggagagaagagacatcggcctgaagaacgccctgggctgcgagaacaagggcttcgccctgctgcagaagatgggctacaagagcggccaggccctgggcaagagcggcggcggcatcgtggagcccatccccctgaacatcaagaccggcaagagcggcatcggccacgaggccagcctgaagagaaaggccgaggagaagctggagagctacagaaagaagatccacatgaagaaccaggccgaggagaaggccgccgagcagttcagaatgagactgaagaacaagcaggacgagatgaagctggagggcgacctgagaagaagccagagagcctgccagcagctggacgtgcagaagaacatccaggtgcccagagaggcctggtactggctgagactggaggaggagaccgaggaggacgaggaggagaaggagcaggacgaggacgagtacaagagcgaggacctgagcgtgctggagaagctgcagatcctgaccagctacctgagagaggagcacctgtactgcatctggtgcggcaccgcctacgaggacaaggaggacctgagcagcaactgccccggccccaccagcgccgaccacgactag

SEQ ID NO: 20117 - DNA, 393 bp, Artificial Sequence
  Description of Artificial Sequence: Synthetic coding sequence
atggtggtggccgccggcaagagattctgcggcgagcacgccggcgccgccgaggaggaggacgccagaaagagaatcctgtgccccctggaccccaagcacaccgtgtacgaggaccagctggccaagcacctgaagaagtgcaacagcagagagaagcccaagcccgacttctacatccaggacatcaacgccggcctgagagacgagaccgagatccccgagcagctggtgcccatcagcagcctgagcgaggagcagctggagaagctgatcaagaagctgagaaaggccagcgaggccctgcacgacgccctgaacgaccccaagaacggcgacagcgccaccaagcacctgaagcagcaggtgtgcctgggctacagcaactactag

SEQ ID NO: 20118 - DNA, 1446 bp, Artificial Sequence
  Description of Artificial Sequence: Synthetic coding sequence
atggccaccagcgccaccagcccccacgcccccggcttccccgccgagggcagatgcggctactacgtggagaagaagaagagattctgcagaatggtggtggccgccggcaagagattctgcggcgagcacgccggcgccgccgaggaggaggacgccagaaagagaatcctgtgccccctggaccccaagcacaccgtgtacgaggaccagctggccaagcacctgaagaagtgcaacagcagagagaagcccaagcccgacttctacatccaggacatcaacgccggcctgagagacgagaccgagatccccgagcagctggtgcccatcagcagcctgagcgaggagcagctggagaagctgatcaagaagctgagaaaggccagcgagggcctgaacagcaccctgaaggaccacatcatgagccaccccgccctgcacgacgccctgaacgaccccaagaacggcgacagcgccaccaagcacctgaagcagcaggccagcatcctgggcaacatcgagaacctgaagctgctgggccccagaagatgcttcgtggagttcggcgccggcaagggcaagctgagccactgggtggacatcgccctgaaggacgccgagaaggtgcacttcatcctggtggagaaggtgaccaccagattcaaggtggacggcaagcacagaaagaagaacagcgtgttcgagagactgcagatcgacatccagcacctgtgcctgaacaagatccccgtgctgagagaggagaagctgcccgtggtgggcatcggcaagcacctgtgcggcatggccaccgacctggccctgagatgcctggtggagacctacgccgccagcttcgaggagagaaacgaggagcccctggccaagagaatcaagaacgacaagaccgagaaggagatctacaccctggccaaggagggcaacgagaagaacgtgcccgagaagtggaaccccgtggccggcatcgtgatcgccctgtgctgccaccacagatgcgactggagacactacgtgggcaaggagtacttcagagccctgggcctgggcgccgtggagttccactacttccagagaatgagcagctgggccacctgcggcatgagaaagaccagcctggagaccagcaacagcaccaccaagagacaggacaaccagaacgacgacagcgaggagcacgacgacggcggctacagaatcaccgacgacggcgccgactgcctgcccggcctgctgagcgtggaggagaagaagaagatcggccacctgtgcaagctgctgatcgaccagggcagaatccagtacctgcagcagaagggcttcagccccgccctgcagtactacaccgaccccctggtgagcctggagaacgtgctgctgaccgccctgcccaaccacagcagcagccccgagaccaccgcctag

SEQ ID NO: 20119 - DNA, 330 bp, Artificial Sequence
  Description of Artificial Sequence: Synthetic coding sequence
atggccaccagcgccaccagcccccacgcccccggcttccccgccgagggcagatgcggctactacgtggagaagaagaagagattctgcagaatggtggtggccgccggcaagagattctgcggcgagcacgccggcgccgccgaggaggaggacgccagaaagagaatcctgtgccccctggaccccaagcacaccgtgtacgaggaccagctggccaagcacctgaagaagtgcaacagcagagagaagcccaagcccgacttctacatccaggacatcaacgccggcctgagagacgagaccgagatccccgagcagctggcctag

SEQ ID NO: 20120 - DNA, 1317 bp, Artificial Sequence
  Description of Artificial Sequence: Synthetic coding sequence
atggagcacgccgccaccaccggccccagacccggcccccccagcagaagagtggagaacgtggtgctgagagccaaggactggctgcccggcgcccccggcggcaccgccgtgtgggccaccagcctggaggccgaggtgccccccgacctggccctgaacaaggagcagcagctgcagatcagcaaggagctggtggacatccagatcaccacccaccacctgcacgagcagcacgaggccgagatcttccagctgaagagcgagatcctgagactggagagcagagtgctggagctggagctgagaggcgacggcaccagccagggctgcgccgtgcccgtggagagcgaccccagacaccccagagccgccgcccaggagctgagacacaaggcccaggtgcccggccacagcgacgaccacagattccaggtgcagcccaagaacaccatgaaccccgagaacgagcagcacagactgggcagcggcctgcagggcgaggtgaagtgggccctggagcaccaggaggccagacagcaggccctggtgaccagagtggccaccctgggcagacagctgcagggcgccagagaggaggccagagccgccggccagagactggccacccaggccgtggtgctgtgcagctgccagggccagctgagacaggccgaggccgagaacgccagactgcagctgcagctgaagaagctgaaggacgagtacgtgctgagactgcagcactgcgcctggcaggccgtggagcacgccgacggcgccggccaggcccccgccaccaccgccctgagaaccttcctggaggccaccctggaggacatcagagccgcccacagaagcagagagcagcagctggccagagccgccagaagctaccacaagagactggtggacctgagcagaagacacgaggagctgctggtggcctacagagcccccggcaacccccaggccatcttcgacatcgccagcctggacctggagcccctgcccgtgcccctggtgaccgacttcagccacagagaggaccagcacggcggccccggcgccctgctgagcagccccaagaagagacccggcggcgccagccagggcggcaccagcgagccccagggcctggacgccgccagctgggcccagatccaccagaagctgagagacttcagcagaagcacccagagctggaacggcagcggccacagctgctggagcggccccagatggctgaagagcaacttcctgagctacagaagcacctggaccagcacctgggccggcaccagcaccaagagctag

SEQ ID NO: 20121 - DNA, 864 bp, Artificial Sequence
  Description of Artificial Sequence: Synthetic coding sequence
atgcacagcgtggcccacccccaccccggcgtgcccccctgggtgcccgccaccctgatcatcaccggcaagagaagaggcgccgccgccggcggcgccggcctggagcacggcggcagcggcagagcccacctgagagaggtgagcgccgagacctggagaaccagaggcgtgggcgccggcagactggtgaccggccccgccctggccagcggccccccctgcagccagctgtacaacggccagggcagccccagaaccatcagctggggcctgggccacaccagagtgggcgtggccagcctgctgatgctggagagcctgagcggcctggccctgtggttcagccccccccccgccgccagcagaccccccggccccggcctgagcctgtacaccgacggcagcaaggcctggggcgccccccaggagcacggcggcgcccacgccagcctgacccacagccaggtgagcccccccggcagcggcaacctgacccagcacggccacgtgtgcccctgcgtgaccatgcccgccctgaagaccaccccccccttcctgagcccccacagaggcctggacgccgccagctgggcccagatccaccagaagctgagagacttcagcagaagcacccaggtgggcggcaagggctggcccagacccatcctgaccccctgccccagcagctggctgaccagcccctgccaggccgagctggagagagagagagcccagctgctggtgagagccaccatggccgaggagcagctgagcgagctgcaggagtacgtggaccagcacctgggcagatgggccgagggcgccggctgcgaccccagagccctggtgtggctggagtag

SEQ ID NO: 20122 - DNA, 1527 bp, Artificial Sequence
  Description of Artificial Sequence: Synthetic coding sequence
atggagagcgaggacaccaagaagacccaggagatgaagaccgacctgaacctgctgctggagtgcctgaagtaccagatggacaacgccttcagccagaaggaggccctggtgaccatccacagcatctgccagcagaacagcaacgccagcgtgtacttcagagagatcggcggcctgatgttcgtgaagaacctggccaagagcagcgagcacagcatggtgaaggaggccgccctgtacaccctgggcgccatcgccgagaagaacgtgtactgccagcagaccctgtgcaccagcgagctgttcgaggacctgacctggttcctgagcaacgacagcaacatcaacctgaagagaatgagcgtgtacgtgatcctggtgctggtgagcaacaacagaaccggccagaccctggtgagagagaccggctgcatcaccgtgctgagcagactgttcagaaccgtgatcagcaagcacgagctggacctgagcgacaagaacgtgttccagagctaccagctgtggagcagcgtgtgcagcaccctgtgcgtgtgcgtgaacaacccccagaacgacgagaaccagatgttctgctgcagcctgttcccccacgccaacgagtggctgaagaactgcaccacccccgagatcatcagacccatctgcagcttcatcggcctgaccctggccaacaacacctacgtgcagaagtacttcgtgagcgtgggcggcctggacgtgctgagccaggtgctgatgcagctggagagcgacagccacgagaccctgagcagcgccaagctggccgtggtggtgaccaagaccgtggacgcctgcatcgccgacaaccccaccttcggcatcgtgctgagcaagtaccacatcgtgagcaagctgctggccctgctgctgcacgagagcctggacagcggcgagaagttcagcatcatgctgaccctgggccactgcaccgaggactgcgccgagaagctgagcctgagcctgggcgagtaccccttcgacgagaacgagacccagcagctgaaggacatcagcgtgaaggagaacaacctggaggagcactggagaaaggccaaggagatcctgcacagaatcgagcagctggagagagagggcaacgaggaggagatccagagagagaactaccaggacaacatcagcagcatgaacatcagcatccagaacacctggaagcacctgcacgccgacagaatcggcagaggcagcaaggccgaggacgaggacaagagccacagcagacagctgcagagctacaagagccacggcgtgatgagcaaggcctgcaccaacgacgaccagatgaagacccccctgaagagcgccaaccccgtgcacgcctgctacagagagagcgagcagaacaagaccctgtacaaggccaagagcagctgcaaccagaacctgcacgaggagaccaccttcgagaagaacttcgtgagccagagcagaagcatctacatcatgttcagatacaacaagtag

SEQ ID NO: 20123 - DNA, 2043 bp, Artificial Sequence
  Description of Artificial Sequence: Synthetic coding sequence
atggagagcgaggacaccaagaagacccaggagatgaagaccgacctgaacctgctgctggagtgcctgaagtaccagatggacaacgccttcagccagaaggaggccctggtgaccatccacagcatctgccagcagaacagcaacgccagcgtgtacttcagagagatcggcggcctgatgttcgtgaagaacctggccaagagcagcgagcacagcatggtgaaggaggccgccctgtacaccctgggcgccatcgccgagaagaacgtgtactgccagcagaccctgtgcaccagcgagctgttcgaggacctgacctggttcctgagcaacgacagcaacatcaacctgaagagaatgagcgtgtacgtgatcctggtgctggtgagcaacaacagaaccggccagaccctggtgagagagaccggctgcatcaccgtgctgagcagactgttcagaaccgtgatcagcaagcacgagctggacctgagcgacaagaacgtgttccagagctaccagctgtggagcagcgtgtgcagcaccctgtgcgtgtgcgtgaacaacccccagaacgacgagaaccagatgttctgctgcagcctgttcccccacgccaacgagtggctgaagaactgcaccacccccgagatcatcagacccatctgcagcttcatcggcctgaccctggccaacaacacctacgtgcagaagtacttcgtgagcgtgggcggcctggacgtgctgagccaggtgctgatgcagctggagagcgacagccacgagaccctgagcagcgccaagctggccgtggtggtgaccaagaccgtggacgcctgcatcgccgacaaccccaccttcggcatcgtgctgagcaagtaccacatcgtgagcaagctgctggccctgctgctgcacgagagcctggacagcggcgagaagttcagcatcatgctgaccctgggccactgcaccgaggactgcgaggagaaccagtacgacctgttcaagaacaacggcctgcccctgatgatccaggccctgaccgagagccagaacgaggagctgaacaaggccgccaccttcgtgctgcacaactgcaagaagatcaccgagaagctgagcctgagcctgggcgagtaccccttcgacgagaacgagacccagcagctgaaggacatcagcgtgaaggagaacaacctggaggagcactggagaaaggccaaggagatcctgcacagaatcgagcagctggagagagagggcaacgaggaggagatccagagagagaactaccaggacaacatcagcagcatgaacatcagcatccagaacacctggaagcacctgcacgccgacagaatcggcagaggcagcaaggccgaggacgaggacaagagccacagcagacagctgcagagctacaagagccacggcgtgatgagcaaggcctgcaccaacgacgaccagatgaagacccccctgaagagcgccaaccccgtgcacgcctgctacagagagagcgagcagaacaagaccctgtacaaggccaagagcagctgcaaccagaacctgcacgaggagaccaccttcgagaagaacttcgtgagccagagcagatacagcctgatcatcgtgtgctgcatcgccgtggagaagagcctgaacagcagaaacttcagcaagctgctgcacagctgcccctaccagtgcgacagacacaaggtgatcgtggaggccgaggacagatacaagagcgagctgagaaagagcctgatctgcaacaagaagatcctgctgacccccagaagaagacagagactgagcaacgagagcaccacccccggcggcatcaagaagagaagaatcagaaagaacttcaccgaggaggaggtgaactacctgttcaacggcgtgaagaagatgggcaaccactggaacagcatcctgtggagcttccccttccagcagggcagaaaggccgtggacctggcccacaagtaccacaagctgaccaagcaccccacctgcgccgccagctag

SEQ ID NO: 20124 - DNA, 2184 bp, Artificial Sequence
  Description of Artificial Sequence: Synthetic coding sequence
atggagagcgaggacaccaagaagacccaggagatgaagaccgacctgaacctgctgctggagtgcctgaagtaccagatggacaacgccttcagccagaaggaggccctggtgaccatccacagcatctgccagcagaacagcaacgccagcgtgtacttcagagagatcggcggcctgatgttcgtgaagaacctggccaagagcagcgagcacagcatggtgaaggaggccgccctgtacaccctgggcgccatcgccgagaagaacgtgtactgccagcagaccctgtgcaccagcgagctgttcgaggacctgacctggttcctgagcaacgacagcaacatcaacctgaagagaatgagcgtgtacgtgatcctggtgctggtgagcaacaacagaaccggccagaccctggtgagagagaccggctgcatcaccgtgctgagcagactgttcagaaccgtgatcagcaagcacgagctggacctgagcgacaagaacgtgttccagagctaccagctgtggagcagcgtgtgcagcaccctgtgcgtgtgcgtgaacaacccccagaacgacgagaaccagatgttctgctgcagcctgttcccccacgccaacgagtggctgaagaactgcaccacccccgagatcatcagacccatctgcagcttcatcggcctgaccctggccaacaacacctacgtgcagaagtacttcgtgagcgtgggcggcctggacgtgctgagccaggtgctgatgcagctggagagcgacagccacgagaccctgagcagcgccaagctggccgtggtggtgaccaagaccgtggacgcctgcatcgccgacaaccccaccttcggcatcgtgctgagcaagtaccacatcgtgagcaagctgctggccctgctgctgcacgagagcctggacagcggcgagaagttcagcatcatgctgaccctgggccactgcaccgaggactgcgaggagaaccagtacgacctgttcaagaacaacggcctgcccctgatgatccaggccctgaccgagagccagaacgaggagctgaacaaggccgccaccttcgtgctgcacaactgcaagaagatcaccgagaagctgagcctgagcctgggcgagtaccccttcgacgagaacgagacccagcagctgaaggacatcagcgtgaaggagaacaacctggaggagcactggagaaaggccaaggagatcctgcacagaatcgagcagctggagagagagggcaacgaggaggagatccagagagagaactaccaggacaacatcagcagcatgaacatcagcatccagaacacctggaagcacctgcacgccgacagaatcggcagaggcagcaaggccgaggacgaggacaagagccacagcagacagctgcagagctacaagagccacggcgtgatgagcaaggcctgcaccaacgacgaccagatgaagacccccctgaagagcgccaaccccgtgcacgcctgctacagagagagcgagcagaacaagaccctgtacaaggccaagagcagctgcaaccagaacctgcacgaggagaccaccttcgagaagaacttcgtgagccagagcagcgaccacgtgttcaagcaccccgtgcacatcgccaagaacatcaagcagcagctgcccgtgaccgaccccttcaccctgtgcagcgacatcatcaacaaggaggtggtgagcttcctggccacccccagctgcagcgagatgctgacctacagatgcagcggctgcatcgccgtggagaagagcctgaacagcagaaacttcagcaagctgctgcacagctgcccctaccagtgcgacagacacaaggtgatcgtggaggccgaggacagatacaagagcgagctgagaaagagcctgatctgcaacaagaagatcctgctgacccccagaagaagacagagactgagcaacgagagcaccacccccggcggcatcaagaagagaagaatcagaaagaacttcaccgaggaggaggtgaactacctgttcaacggcgtgaagaagatgggcaaccactggaacagcatcctgtggagcttccccttccagcagggcagaaaggccgtggacctggcccacaagtaccacaagctgaccaagcaccccacctgcgccgccagctag

SEQ ID NO: 20125 - DNA, 1653 bp, Artificial Sequence
  Description of Artificial Sequence: Synthetic coding sequence
atggagagcgaggacaccaagaagacccaggagatgaagaccgacctgaacctgctgctggagtgcctgaagtaccagatggacaacgccttcagccagaaggaggccctggtgaccatccacagcatctgccagcagaacagcaacgccagcgtgtacttcagagagatcggcggcctgatgttcgtgaagaacctggccaagagcagcgagcacagcatggtgaaggaggccgccctgtacaccctgggcgccatcgccgagaagaacgtgtactgccagcagaccctgtgcaccagcgagctgttcgaggacctgacctggttcctgagcaacgacagcaacatcaacctgaagagaatgagcgtgtacgtgatcctggtgctggtgagcaacaacagaaccggccagaccctggtgagagagaccggctgcatcaccgtgctgagcagactgttcagaaccgtgatcagcaagcacgagctggacctgagcgacaagaacgtgttccagagctaccagctgtggagcagcgtgtgcagcaccctgtgcgtgtgcgtgaacaacccccagaacgacgagaaccagatgttctgctgcagcctgttcccccacgccaacgagtggctgaagaactgcaccacccccgagatcatcagacccatctgcagcttcatcggcctgaccctggccaacaacacctacgtgcagaagtacttcgtgagcgtgggcggcctggacgtgctgagccaggtgctgatgcagctggagagcgacagccacgagaccctgagcagcgccaagctggccgtggtggtgaccaagaccgtggacgcctgcatcgccgacaaccccaccttcggcatcgtgctgagcaagtaccacatcgtgagcaagctgctggccctgctgctgcacgagagcctggacagcggcgagaagttcagcatcatgctgaccctgggccactgcaccgaggactgcgaggagaaccagtacgacctgttcaagaacaacggcctgcccctgatgatccaggccctgaccgagagccagaacgaggagctgaacaaggccgccaccttcgtgctgcacaactgcaagaagatcaccgagaagctgagcctgagcctgggcgagtaccccttcgacgagaacgagacccagcagctgaaggacatcagcgtgaaggagaacaacctggaggagcactggagaaaggccaaggagatcctgcacagaatcgagcagctggagagagagggcaacgaggaggagatccagagagagaactaccaggacaacatcagcagcatgaacatcagcatccagaacacctggaagcacctgcacgccgacagaatcggcagaggcagcaaggccgaggacgaggacaagagccacagcagacagctgcagagctacaagagccacggcgtgatgagcaaggcctgcaccaacgacgaccagatgaagacccccctgaagagcgccaaccccgtgcacgcctgctacagagagagcgagcagaacaagaccctgtacaaggccaagagcagctgcaaccagaacctgcacgaggagaccaccttcgagaagaacttcgtgagccagagcagaagcatctacatcatgttcagatacaacaagtag

SEQ ID NO: 20126 - DNA, 1164 bp, Artificial Sequence
  Description of Artificial Sequence: Synthetic coding sequence
atggagaacaagctgcccatggagaccctggtggaggagtgcggcgagaacagagagagaaagtgcaagctgaaggaccagagcgacaaggaggagggcaccagagacatcagcagccccaagagactgagagacagacaggccctgttccccgccaaggtgaccaacgtgagcctgctggagaagttcgagagaagcgagagcggcggcaagatcatgacccccgagagcctgagctaccccagctgcctgaagcacgacagcgagatgaagccccagaccagccccgcctgccaggaccacaacaaggccggccagatgaagagcctggccaccagagagcagaaccagaagaacgccgcctacaacctgggcgtggccgaggccatcagaaaccacaagaacgagaagcccgagttctacaagagcttcctgttcgacaagagacccctgagccccgccctgaacgccctgaagcaggaggagtacagcagaagcctgctgaagcagatggacaacagacaggagaacgagatcaagcagagacagtacagagagctgatggacagactggagcaggtgcagctgaccgaggagctggccgcccagagagccaagttcctgaaggacaagatggaggagacccagtgctacaagagagccctggacgcccagatcaagaacaagcccagcagactgccccccttcgagcccgacagcagcgagcccatcttcggcaagaacgagggcgagctgatggtggagaagcagaagagagagcagaactacatgaagcaccagctggaggccgccgccaaccacaagagaaaggccatcctgcaccagctggtggaccagagaagagacctgcagatgctgcagagaacccagagagagcacctggccgacagaaccgccgagctggagagagtgaacagagtgaaccagtgcctgcaggaggactgggagagaagcgccgccatgaagaagcagagagacctggaggacaaggccttcgagagagccagcgacaagctgttcctgctggaccagtgcgagaagtacagaagatgcaagcagtgccagagaagaaccagcaacgtgggcgagagcaacctgtggcccctgaacaagttcctgcccggcagcagactgctggtgtag

SEQ ID NO: 20127 - DNA, 1689 bp, Artificial Sequence
  Description of Artificial Sequence: Synthetic coding sequence
atgctggacaccatcgccagagccctgcaggacctgggcagacaggtgctgcccaccctgcccagcctgagccaggaggaggtgagcatcatctggggcaacgtgagcgagttcgtgagaagacagctgaccctgcacaagggcgtgcagatccccgccttcggcaccttcaccttcatcagacagaagctggaggtgggcaacaacaagttcatcctgatccagagacccgtgttcatcatggtggagaagctggtgcagatccacggcctgaagcagaacaagagacccggcaccgtggacagcgtgctgagcagcagagaggccctgagaaagtggcccagcagcgtgctggccttccccagaatcgagctgaaggagatggagaacaagctgcccatggagaccctggtggaggagtgcggcgagaacagagagagaaagtgcaagctgaaggaccagagcgacaaggaggagggcaccagagacatcagcagccccaagagactgagagacagacaggccctgttccccgccaaggtgaccaacgtgagcctgctggagaagttcgagagaagcgagagcggcggcaagatcatgacccccgagagcctgagctaccccagctgcctgaagcacgacagcgagatgaagccccagaccagccccgcctgccaggaccacaacaaggccggccaggagatgtgctacgtgtgcctgcagagagcccagagaaacagcctgctgtactacagcgaggagagaagaagagagatcgaggacgagagactgatccagcagtaccagatgctgaaggaccaggaggccctgttcagacaccagatgaagagcctggccaccagagagcagaaccagaagaacgccgcctacaacctgggcgtggccgaggccatcagaaaccacaagaacgagaagcccgagttctacaagagcttcctgttcgacaagagacccctgagccccgccctgaacgccctgaagcaggaggagtacagcagaagcctgctgaagcagatggacaacagacaggagaacgagatcaagcagagacagtacagagagctgatggacagactggagcaggtgcagctgaccgaggagctggccgcccagagagccaagttcctgaaggacaagatggaggagacccagtgctacaagagagccctggacgcccagatcaagaacaagcccagcagactgccccccttcgagcccgacagcagcgagcccatcttcggcaagaacgagggcgagctgatggtggagaagcagaagagagagcagaactacatgaagcaccagctggaggccgccgccaaccacaagagaaaggccatcctgcaccagctggtggaccagagaagagacctgcagatgctgcagagaacccagagagagcacctggccgacagaaccgccgagctggagagagtgaacagagtgaaccagtgcctgcaggaggactgggagagaagcgccgccatgaagaagcagagagacctggaggacaaggccttcgagagagccagcgacaagctgttcctgctggaccagtgcgagaagtacagaagatgcaagcagtgccagagaagaaccagcaacgtgggcgagagcaacctgtggcccctgaacaagttcctgcccggcagcagactgctggtgtag

SEQ ID NO: 20128 - DNA, 1959 bp, Artificial Sequence
  Description of Artificial Sequence: Synthetic coding sequence
atgctggacaccatcgccagagccctgcaggacctgggcagacaggtgctgcccaccctgcccagcctgagccaggaggaggtgagcatcatctggggcaacgtgagcgagttcgtgagaagacagctgaccctgcacaagggcgtgcagatccccgccttcggcaccttcaccttcatcagacagaagctggaggtgggcaacaacaagttcatcctgatccagagacccgtgttcatcatggtggagaagctggtgcagatccacggcctgaagcagaacaaggtgtacacccccggcgagatccccatcgtgcccctgaacttcgtgatgatcagcctggagggccccttcaacagagacgtggtggagggctgcgtgaaggagaccctgctgttcctgagcagaagcatcagcatgaagcagaacgtggagttcaccttcaagggcatcggcgtgctgatgatcagagacagcaaggtgaagatgagattctacaaggacttcctgtgcaccatggacggcagcggcgccctggccaaggccctggccaacagacccggcaccgtggacagcgtgctgagcagcagagaggccctgagaaagtggcccagcagcgtgctggccttccccagaatcgagctgaaggagatggagaacaagctgcccatggagaccctggtggaggagtgcggcgagaacagagagagaaagtgcaagctgaaggaccagagcgacaaggaggagggcaccagagacatcagcagccccaagagactgagagacagacaggccctgttccccgccaaggtgaccaacgtgagcctgctggagaagttcgagagaagcgagagcggcggcaagatcatgacccccgagagcctgagctaccccagctgcctgaagcacgacagcgagatgaagccccagaccagccccgcctgccaggaccacaacaaggccggccaggagatgtgctacgtgtgcctgcagagagcccagagaaacagcctgctgtactacagcgaggagagaagaagagagatcgaggacgagagactgatccagcagtaccagatgctgaaggaccaggaggccctgttcagacaccagatgaagagcctggccaccagagagcagaaccagaagaacgccgcctacaacctgggcgtggccgaggccatcagaaaccacaagaacgagaagcccgagttctacaagagcttcctgttcgacaagagacccctgagccccgccctgaacgccctgaagcaggaggagtacagcagaagcctgctgaagcagatggacaacagacaggagaacgagatcaagcagagacagtacagagagctgatggacagactggagcaggtgcagctgaccgaggagctggccgcccagagagccaagttcctgaaggacaagatggaggagacccagtgctacaagagagccctggacgcccagatcaagaacaagcccagcagactgccccccttcgagcccgacagcagcgagcccatcttcggcaagaacgagggcgagctgatggtggagaagcagaagagagagcagaactacatgaagcaccagctggaggccgccgccaaccacaagagaaaggccatcctgcaccagctggtggaccagagaagagacctgcagatgctgcagagaacccagagagagcacctggccgacagaaccgccgagctggagagagtgaacagagtgaaccagtgcctgcaggaggactgggagagaagcgccgccatgaagaagcagagagacctggaggacaaggccttcgagagagccagcgacaagctgttcctgctggaccagtgcgagaagtacagaagatgcaagcagtgccagagaagaaccagcaacgtgggcgagagcaacctgtggcccctgaacaagttcctgcccggcagcagactgctggtgtag

SEQ ID NO: 20129 - DNA, 1635 bp, Artificial Sequence
  Description of Artificial Sequence: Synthetic coding sequence
atgatccacgtgagaagacacgagaccagaagaaacagcaagagccacgtgcccgagcagaagagcagagtggactggagaagaaccaagagaagcagcatcagccagctgctggacagcgacgaggagctggacagcgaggagttcgacagcgacgaggagctggacagcgacgagagcttcgagaacgacgaggagctggacagcaacaagggccccgactgcaacaagacccccggcagcgagagagagctgaacctgagcaagatccagagcgagggcaacgacagcaagtgcctgatcaacagcggcaacggcagcacctacgaggaggagaccaacaagatcaagcacagaaacatcgacctgcaggaccaggagaagcacctgagccaggaggacaacgacctgaacaagcagaccggccagatcatcgaggacgaccaggagaagcacctgagccaggaggacaacgacctgaacaagcagaccggccagatcatcgaggacgacctggaggaggaggacatcaagagaggcaagagaaagagactgagcagcgtgatgtgcgacagcgacgagagcgacgacagcgacatcctggtgagaaaggtgggcgtgaagagacccagaagagtggtggaggacgagggcagcagcgtggagatggagcagaagacccccgagaagaccctggccgcccagaagagagagaagctgcagaagctgaaggagctgagcaagcagagaagcagacagagaagaagcagcggcagagacttcgaggacagcgagaaggagagctgccccagcagcgacgaggtggacgaggaggaggaggaggacaactacgagagcgacgaggacggcgacgactacatcatcgacgacttcgtggtgcaggacgaggagggcgacgaggagaacaagaaccagcagggcgagaagctgaccaccagccagctgaagctggtgaagcagaacagcctgtacagcttcagcgaccactacacccacttcgagagagtggtgaaggccctgctgatcaacgccctggacgagagcttcctgggcaccctgtacgacggcaccagacagaagagctacgccaaggacatgctgaccagcctgcactacctggacaacagattcgtgcagcccagactggagagcctggtgagcagaagcagatggaaggagcagtacaaggagagagtggagaactacagcaacgtgagcatccacctgaagaaccccgagaactgcagctgccaggcctgcggcctgcacagatactgcaagtacagcgtgcacctgagcggcgagctgtacaacaccagaaccatgcagatcgacaacttcatgagccacgacaagcaggtgttcaccgtgggcagaatctgcgccagcagaaccagaatctaccacaagctgaagcacttcaagttcaagctgtaccaggagtgctgcaccatcgccatgaccgaggaggtggaggacgagcaggtgaaggagaccgtggagagaatcttcagaagaagcaaggagaacggctggatcaaggagaagtacggccagctggaggagtacctgaacttcgccgactacttccaggaggagaagttcgagctgtag

SEQ ID NO: 20130 - DNA, 1635 bp, Artificial Sequence; identical to SEQ ID NO: 20129
  Description of Artificial Sequence: Synthetic coding sequence

SEQ ID NO: 20131 - DNA, 93 bp, Artificial Sequence
  Description of Artificial Sequence: Synthetic coding sequence
atgatccacgtgagaagacacgagaccagaagaaacagcaagagccacgtgcccgagcagaagagcagagtggactggagaagaaccaagtag

SEQ ID NO: 20132 - DNA, 789 bp, Artificial Sequence
  Description of Artificial Sequence: Synthetic coding sequence
atgatccacgtgagaagacacgagaccagaagaaacagcaagagccacgtgcccgagcagaagagcagagtggactggagaagaaccaagagaagcagcatcagccagctgctggacagcgacgaggagctggacagcgaggagttcgacagcgacgaggagctggacagcgacgagagcttcgagaacgacgaggagctggacagcaacaagggccccgactgcaacaagacccccggcagcgagagagagctgaacctgagcaagatccagagcgagggcaacgacagcaagtgcctgatcaacagcggcaacggcagcacctacgaggaggagaccaacaagatcaagcacagaaacatcgacctgcaggaccaggagaagcacctgagccaggaggacaacgacctgaacaagcagaccggccagatcatcgaggacgaccaggagaagcacctgagccaggaggacaacgacctgaacaagcagaccggccagatcatcgaggacgacctggaggaggaggacatcaagagaggcaagagaaagagactgagcagcgtgatgtgcgacagcgacgagagcgacgacagcgacatcctggtgagaaaggtgggcgtgaagagacccagaagagtggtggaggacgagggcagcagcgtggagatggagcagaagacccccgagaagaccctggccgcccagaagagagagaagctgcagaagctgaaggagctgagcaagcagagaagcagacagagaagaagcagcggcagagacttcgagtag

SEQ ID NO: 20133 - DNA, 1635 bp, Artificial Sequence; identical to SEQ ID NO: 20129
  Description of Artificial Sequence: Synthetic coding sequence

SEQ ID NO: 20134 - DNA, 1335 bp, Artificial Sequence
  Description of Artificial Sequence: Synthetic coding sequence
atggagaacagcggcaaggccaacaagaaggacacccacgacggcccccccaaggagatcaagctgcccaccagcgaggccctgctggactaccagtgccagatcaaggaggacgccgtggagcagttcatgttccagatcaagaccctgagaaagaagaaccagaagtaccacgagagaaacagcagactgaaggaggagcagatctggcacatcagacacctgctgaaggagctgagcgaggagaaggccgagggcctgcccgtggtgaccagagaggacgtggaggaggccatgaaggagaagtggaagttcgagagagaccaggagaagaacctgagagacatgagaatgcagatcagcaacgccgagaagctgttcctggagaagctgagcgagaaggagtactgggaggagtacaagaacgtgggcagcgagagacacgccaagctgatcaccagcctgcagaacgacatcaacaccgtgaaggagaacgccgagaagatgagcgagcactacaagatcaccctggaggacaccagaaagaagatcatcaaggagaccctgctgcagctggaccagaagaaggagtgggccacccagaacgccgtgaagctgatcgacaagggcagctacctggagatctgggagaacgactggctgaagaaggaggtggccatccacagaaaggaggtggaggagctgaagaacgccatccacgagctggaggccgagaacctggtgctgatcgaccagctgagcaactgcagactggtggacctgaagatccccagataccccgtgctgcacagctgccccaccagcaaccccagacacctgctgctgctgcccctggagagctgcctgatcagcgccagaagatgctggagactgtacctgacccaggccgccggcctggaggtgccccccgaggagatgagcctggagctgcccgagacccacatcgaggagaagagcgagctgcagcccaccgaggtggagagcagagacctgatgagcagcagcgacgagagcaccatcctgcacctgagccacgagaacagcatcgaggacctgcagtacgtgaagatcgacaaggaggagaacagcggcaccgagttcggcgacaccgacatgaagtacctgctgtacgaggacgagaaggacttcaaggactacgtgaacctgggccccctgggcgtgaagctgatgagcgtggagagcaagaagatgcccatccacttccaggagaaggagatccccgtgaagctgtacaaggacgtgagaagccccgagagccacatcacctacaagatgatgaagagcttcctgtag

SEQ ID NO: 20135 - DNA, 1242 bp, Artificial Sequence
  Description of Artificial Sequence: Synthetic coding sequence
atggagaacagcggcaaggccaacaagaaggacacccacgacggcccccccaaggagatcaagctgcccaccagcgaggccctgctggactaccagtgccagatcaaggaggacgccgtggagcagttcatgttccagatcaagaccctgagaaagaagaaccagaagtaccacgagagaaacagcagactgaaggaggagcagatctggcacatcagacacctgctgaaggagctgagcgaggagaaggccgagggcctgcccgtggtgaccagagaggacgtggaggaggccatgaaggagaagtggaagttcgagagagaccaggagaagaacctgagagacatgagaatgcagatcagcaacgccgagaagctgttcctggagaagctgagcgagaaggagtactgggaggagtacaagaacgtgggcagcgagagacacgccaagctgatcaccagcctgcagaacgacatcaacaccgtgaaggagaacgccgagaagatgagcgagcactacaagatcaccctggaggacaccagaaagaagatcatcaaggagaccctgctgcagctggaccagaagaaggagtgggccacccagaacgccgtgaagctgatcgacaagggcagctacctggagatctgggagaacgactggctgaagaaggaggtggccatccacagaaaggaggtggaggagctgaagaacgccatccacgagctggaggccgagaacctggtgctgatcgaccagctgagcaactgcagactggtggacctgaagatccccagaagactgtacctgacccaggccgccggcctggaggtgccccccgaggagatgagcctggagctgcccgagacccacatcgaggagaagagcgagctgcagcccaccgaggtggagagcagagacctgatgagcagcagcgacgagagcaccatcctgcacctgagccacgagaacagcatcgaggacctgcagtacgtgaagatcgacaaggaggagaacagcggcaccgagttcggcgacaccgacatgaagtacctgctgtacgaggacgagaaggacttcaaggactacgtgaacctgggccccctgggcgtgaagctgatgagcgtggagagcaagaagatgcccatccacttccaggagaaggagatccccgtgaagctgtacaaggacgtgagaagccccgagagccacatcacctacaagatgatgaagagcttcctgtag

SEQ ID NO: 20136 - DNA, 942 bp, Artificial Sequence
  Description of Artificial Sequence: Synthetic coding sequence
atgttccagatcaagaccctgagaaagaagaaccagaagtaccacgagagaaacagcagactgaaggaggagcagatctggcacatcagacacctgctgaaggagctgagcgaggagaaggccgagggcctgcccgtggtgaccagagaggacgtggaggaggccatgaaggagaagtggaagttcgagagagaccaggagaagaacctgagagagcactacaagatcaccctggaggacaccagaaagaagatcatcaaggagaccctgctgcagctggaccagaagaaggagtgggccacccagaacgccgtgaagctgatcgacaagggcagctacctggagatctgggagaacgactggctgaagaaggaggtggccatccacagaaaggaggtggaggagctgaagaacgccatccacgagctggaggccgagaacctggtgctgatcgaccagctgagcaactgcagactggtggacctgaagatccccagaagactgtacctgacccaggccgccggcctggaggtgccccccgaggagatgagcctggagctgcccgagacccacatcgagaagagcgagctgcagcccaccgaggtggagagcagagacctgatgagcagcagcgacgagagcaccatcctgcacctgagccacgagaacagcatcgaggacctgcagtacgtgaagatcgacaaggaggagaacagcggcaccgagttcggcgacaccgacatgaagtacctgctgtacgaggacgagaaggacttcaaggactacgtgaacctgggccccctgggcgtgaagctgatgagcgtggagagcaagaagatgcccatccacttccaggagaaggagatccccgtgaagctgtacaaggacgtgagaagccccgagagccacatcacctacaagatgatgaagagcttcctgtag

SEQ ID NO: 20137 - DNA, 999 bp, Artificial Sequence
  Description of Artificial Sequence: Synthetic coding sequence
atggcccccgcccagagatgccccctgtgcagacagaccttcttctgcggcagaggccacgtgtacagcagaaagcaccagagacagctgaaggaggccctggagagactgctgccccaggtggaggccgccagaaaggccatcagagccgcccaggtggagagatacgtgcccgagcacgagagatgctgctggtgcctgtgctgcggctgcgaggtgagagagcacctgagccacggcaacctgaccgtgctgtacggcggcctgctggagcacctggccagccccgagcacaagaaggccaccaacaagttctggtgggagaacaaggccgaggtgcagatgaaggagaagttcctggtgaccccccaggactacgccagattcaagaagagcatggtgaagggcctggacagctacgaggagaaggaggacaaggtgatcaaggagatggccgcccagatcagagaggtggagcagagcagacaggaggtggtgagaagcgtgctggagccccaggccgtgcccgaccccgaggagggcagcagcgcccccagaagctggaagggcatgaacagccaggtggccagcagcctgcagcagcccagcaacctggacctgccccccgcccccgagctggactggatggagaccggccccagcctgaccttcatcggccaccaggacatccccggcgtgggcaacatccacagcggcgccacccccccctggatgatccaggacgaggagtacatcgccggcaaccaggagatcggccccagctacgaggagttcctgaaggagaaggagaagcagaagctgaagaagctgccccccgacagagtgggcgccaacttcgaccacagcagcagaaccagcgccggctggctgcccagcttcggcagagtgtggaacaacggcagaagatggcagagcagacaccagttcaagaccgaggccgccgccatgaagaagcagagccacaccgagaagagctag

SEQ ID NO: 20138 - DNA, 1662 bp, Artificial Sequence
  Description of Artificial Sequence: Synthetic coding sequence
atgagcaaggccgccggcggcgccgccgccgccgccgccgccgccgagagctgcagccccgcccccgccggcagcagcgccgccccccccgcccccgtggaggacctgagcaaggtgagcgacgaggagctgctgcagtggagcaaggaggagctgatcagaagcctgagaagagccgaggccgagaaggtgagcgccatgctggaccacagcaacctgatcagagaggtgaacagaagactgcagctgcacctgggcgagatcagaggcctgaaggacatcaaccagaagctgcaggaggacaaccaggagctgagagacctgtgctgcttcctggacgacgacagacagaagggcaagagagtgagcagagagtggcagagactgggcagatacaccgccggcgtgatgcacaaggaggtggccctgtacctgcagaagctgaaggacctggaggtgaagcaggaggaggtggtgaaggagaacatggagctgaaggagctgtgcgtgctgctggacgaggagaagggcgccggctgcgccggcagcagatgcagcatcgacagccaggccagcctgtgccagctgaccgccagcaccgccccctacgtgagagacgtgggcgacggcagcagcaccagcagcaccggcagcaccgacagccccgaccaccacaagcaccacgccagcagcggcagccccgagcacctgcagaagcccagaagcgagggcagccccgagcacagcaagcacagaagcgccagccccgagcacccccagaagcccagagcctgcggcacccccgacagacccaaggccctgaagggccccagccccgagcaccacaagcccctgtgcaagggcagccccgagcagcagagacacccccaccccggcagcagccccgagaccctgcccaagcacgtgctgagcggcagccccgagcacttccagaagcacagaagcggcagcagccccgagcacgccagacacagcggcggcagccccgagcacctgcagaagcacgccctgggcggcagcctggagcacctgcccagagccagaggcaccagccccgagcacctgaagcagcactacggcggcagccccgaccacaagcacggcggcggcagcggcggcagcggcggcagcggcggcggcagcagagagggcaccctgagaagacaggcccaggaggacggcagcccccaccacagaaacgtgtacagcggcatgaacgagagcaccctgagctacgtgagacagctggaggccagagtgagacagctggaggaggagaacagaatgctgccccaggccagccagaacagaagacagccccccaccagaaacagcagcaacatggagaagggctggggcagcagagccagaagagtgctgcagtggtggcagggctgcagaggcatcggcagatgcctgcccaccctgcccggcagcttcagactgagcagcggcgccgacggcagcaacagcagccccaacagcgccgccagcttcagcggccacgccacccccagccagcagcccgagcccgtggtgcacagcctgaaggtggtgtggagaaagctgggcgacgccgccggcagctgccccggcatcagacagcacctgagcggcaaccagtacaagggccccatgtag

SEQ ID NO: 20139 - DNA, 1260 bp, Artificial Sequence
  Description of Artificial Sequence: Synthetic coding sequence
atggccaagcccgccgccaccgccgccgccgccagcgaggagctgagccaggtgcccgacgaggagctgctgagatggagcaaggaggagctggccagaagactgagaagagccgagggcgagaaggtgggcctgatgctggagcacggcggcctgatgagagacgtgaacagaagactgcagcagcacctgctggagatcagaggcctgaaggacgtgaaccagagactgcaggacgacaaccaggagctgagagagctgtgctgcttcctggacgacgacagacagaagggcagaaagctggccagagagtggcagagattcggcagacacgccgccggcgccgtgtggcacgaggtggccagaagccagcagaagctgagagagctggaggccagacaggaggccctgctgagagagaacctggagctgaaggagctggtgctgctgctggacgaggagagagccgccctggccgccaccggcgccgccagcggcggcggcggcggcggcggcggcgccggcagcagaagcagcatcgacagccaggccagcctgagcggccccctgagcggcggcgcccccggcgccggcgccagagacgtgggcgacggcagcagcaccagcagcgccggcagcggcggcagccccgaccaccaccaccacgtgcccccccccctgctgccccccggcccccacaaggcccccgacggcaaggccggcgccaccagaagaagcctggacgacctgagcgcccccccccaccacagaagcatccccaacggcctgcacgaccccagcagcacctacatcagacagctggagagcaaggtgagactgctggagggcgacaagctgctggcccagcaggccggcagcggcgagttcagaaccctgagaaagggcttcagcccctaccacagcgagagccagctggccagcctgccccccagctaccaggacagcctgcagaacggccccgcctgccccgcccccgagctgcccagcccccccagcgccggctacagccccgccggccagaagcccgaggccgtggtgcacgccatgaaggtgctggaggtgcacgagaacctggacagacagctgcaggacagctgcgaggaggacctgagcgagaaggagaaggccatcgtgagagagatgtgcaacgtggtgtggagaaagctgggcgacgccgccagcagcaagcccagcatcagacagcacctgagcggcaaccagttcaagggccccctgtag

SEQ ID NO: 20140 - DNA, 2550 bp, Artificial Sequence
  Description of Artificial Sequence: Synthetic coding sequence
atgatggagccccccaagcccgagcccgagctgcagagattctaccacagactgctgagacccctgagcctgttccccaccagaaccaccagccccgagccccagaagagacccccccaggagggcagaatcctgcagagcttccccctggccaagctgaccgtggccagcctgtgcagccaggtggccaagctgctggccggcagcggcatcgccgccggcgtgccccccgaggccagactgagactgatcaaggtgatcctggacgagctgaagtgcagctggagagagccccccgccgagctgagcctgagccacaagaacaaccagaagctgagaaagagactggaggcctacgtgctgctgagcagcgagcagctgttcctgagatacctgcacctgctggtgaccatgagcacccccagaggcgtgttcaccgagagcgccaccctgaccagactggccgccagcctggccagagactgcaccctgttcctgaccagccccaacgtgtacagaggcctgctggccgacttccaggccctgctgagagccgagcaggccagcggcgacgtggacaagctgcaccccgtgtgccccgccggcaccttcaagctgtgccccatcccctggccccacagcaccggcttcgcccaggtgcagtgcagcaacctgaacctgaactacctgatccagctgagcagaccccccgagttcctgaacgagcccggcagaatggaccccgtgaaggagctgaagagcatccccagactgaagagaaagaagcccttccactggctgcccagcatcggcaagaagagagagatcgacatcagcagcagccagatggtgagcctgcccagctaccccgtggcccccaccagcagagccagccccagccccttctgccccgagctgagaagaggccagagcatgcccagcctgagagagggctggagactggccgacgagctgggcctgccccccctgcccagcagacccctgacccccctggtgctggccaccgagagcaagcccgagctgaccggcctgatcgtggccgaggacctgaagcagctgatcaagaagatgaagctggagggcaccagatacccccccctggacagcggcctgccccccctgctgggcgtggtgaccagacaccccgccgccggccacagactggaggagctggagaagatgctgagaaacctgcaggaggaggaggccagcggccagtgggacccccagccccccaagagcttccccctgcacccccagcccgtgaccatcaccctgaagctgagaaacgaggtggtggtgcaggccgccgccgtgagagtgagcgacagaaacttcctggacagcttccacatcgagggcgccggcgccctgtacaaccacctggccggcgagctggaccccaaggccatcgagaagatggacatcgacaacttcgtgggcagcaccaccagagaggtgtacaaggagctgatgagccacgtgagcagcgaccacctgcacttcgaccagggccccctggtggagcccgccgccgacaaggactggagcaccttcctgagcagcgccttcctgagacaggagaagcagccccagatcatcaaccccgagctggtgggcctgtacagccagagagccaacaccctgcagagcaacaccaagaagatgcccagcctgcccagcctgcaggccaccaagagctgggagaagtggagcaacaaggccagcctgatgaacagctggaagaccaccctgagcgtggacgactacttcaagtacctgaccaaccacgagaccgacttcctgcacgtgatcttccagatgcacgaggaggaggtgcccgtggagatcgtggcccccgccagagagagcctggagatccagcaccccccccccctgctggaggacgaggagcccgacttcgtgcccggcgagtgggactggaacaccgtgctggagcacagactgggcgccggcaagaccccccacctgggcgagccccacaagatcctgagcctgcagaagcacctggagcagctgtggagcgtgctggaggtgcccgacaaggaccaggtggacatgaccatcaagtacagcagcaaggccagactgagacagctgcccagcctggtgaacgcctgggagagagccctgaagcccatccagctgagagaggccctgctggccagactggagtggttcgagggccaggccagcaaccccaacagattcttcaagaagaccaacctgagcagcagccacttcctggaggagaaccaggtgagaagccacctgcacagaaagctgaacctgatggagagcagcctggtgagcctgctggaggagatcgagctgatcttcggcgagcccgtgatcttcaagggcagaccctacctggacaagatgaagagcgacaaggtggagatgctgtactggctgcagcagcagagaagagtgagacacctggtgagcgccctgaaggacccccaccagagcaccctgttcagaagcagcgccgccagcctgtag

SEQ ID NO: 20141 - DNA, 741 bp, Artificial Sequence
  Description of Artificial Sequence: Synthetic coding sequence
atgctgagcctgagcctgtgcagccacctgtggggccccctgatcctgagcgccctgcaggccagaagcaccgacagcctggacggccccggcgagggcagcgtgcagcccctgcccaccgccggcggccccagcgtgaagggcaagcccggcaagagactgagcgcccccagaggccccttccccagactggccgactgcgcccacttccactacgagaacgtggacttcggccacatccagctgctgctgagccccgacagagagggccccagcctgagcggcgagaacgagctggtgttcggcgtgcaggtgacctgccagggcagaagctggcccgtgctgagaagctacgacgacttcagaagcctggacgcccacctgcacagatgcatcttcgacagaagattcagctgcctgcccgagctgccccccccccccgagggcgccagagccgcccagatgctggtgcccctgctgctgcagtacctggagaccctgagcggcctggtggacagcaacctgaactgcggccccgtgctgacctggatggaggtgggcctgggcagaggcctgggcgacagcgagtgggtgagaggctgcgtgtgccaccacgcccagcacagagagatcctggacggcaacagagtggccagcgccgtggaggacgagggcgccgaggtggacggcgaggccttcagatggggcagcctgtgggtgggcgagagctgggacatgtag

SEQ ID NO: 20142 - DNA, 1542 bp, Artificial Sequence
  Description of Artificial Sequence: Synthetic coding sequence
atggccgccaccctggacctgaagagcaaggaggagaaggacgccgagctggacaagagaatcgaggccctgagaagaaagaacgaggccctgatcagaagataccaggagatcgaggaggacagaaagaaggccgagctggagggcgtggccgtgaccgcccccagaaagggcagaagcgtggagaaggagaacgtggccgtggagagcgagaagaacctgggccccagcagaagaagccccggcacccccagaccccccggcgccagcaagggcggcagaacccccccccagcagggcggcagagccggcatgggcagagccagcagaagctgggagggcagccccggcgagcagcccagaggcggcggcgccggcgacaccagcatcagcgacagaaagagcaaggagtgggaggagagaagaagacagaacatcgagaagatgaacgaggagatggagaagatcgccgagtacgagagaaaccagagagagggcgtgctggagcccaaccccgtgagaaacttcctggacgaccccagaagaagaagcggccccctggaggagagcgagagagacagaagagaggagagcagaagacacggcagaaactggggcggccccgacttcgagagagtgagatgcggcctggagcacgagagacagggcagaagagccggcctgggcagcgccggcgacatgaccctgagcatgaccggcagagagagaagcgagtacctgagatggaagcaggagagagagaagatcgaccaggagagactgcagagacacagaaagcccaccggccagtggagaagagagtgggacgccgagaagaccgacggcatgttcaaggacggccccgtgcccgcccacgagcccagccacagatacgacgaccaggcctgggccagaccccccaagccccccaccttcggcgagttcctgagccagcacaaggccgaggccagcagcagaagaagaagaaagagcagcagaccccaggccaaggccgcccccagagcctacagcgaccacgacgacagatgggagaccaaggagggcgccgccagccccgcccccgagaccccccagcccaccagccccgagaccagccccaaggagacccccatgcagccccccgagatccccgcccccgcccacagaccccccgaggacgagggcgaggagaacgagggcgaggaggacgaggagtgggaggacatcagcgaggacgaggaggaggaggagatcgaggtggaggagggcgacgaggaggagcccgcccaggaccaccaggcccccgaggccgcccccaccggcatcccctgcagcgagcaggcccacggcgtgcccttcagccccgaggagcccctgctggagccccaggcccccggcacccccagcagccccttcagcccccccagcggccaccagcccgtgagcgactggggcgaggaggtggagctgaacagccccagaaccacccacctggccggcgccctgagccccggcgaggcctggcccttcgagagcgtgtag

SEQ ID NO: 20143 - DNA, 996 bp, Artificial Sequence
  Description of Artificial Sequence: Synthetic coding sequence
atgaccagcccccacttcagcagctacgacgagggccccctggacgtgagcatggccgccaccaacctggagaaccagctgcacagcgcccagaagaacctgctgttcctgcagagagagcacgccagcaccctgaagggcctgcacagcgagatcagaagactgcagcagcactgcaccgacctgacctacgagctgaccgtgaagagcagcgagcagaccggcgacggcaccagcaagagcagcgagctgaagaagagatgcgaggagctggaggcccagctgaaggtgaaggagaacgagaacgccgagctgctgaaggagctggagcagaagaacgccatgatcaccgtgctggagaacaccatcaaggagagagagaagaagtacctggaggagctgaaggccaagagccacaagctgaccctgctgagcagcgagctggagcagagagccagcaccatcgcctacctgaccagccagctgcacgccgccaagaagaagctgatgagcagcagcggcaccagcgacgccagccccagcggcagccccgtgctggccagctacaagcccgccccccccaaggacaagctgcccgagacccccagaagaagaatgaagaagagcctgagcgcccccctgcaccccgagttcgaggaggtgtacagattcggcgccgagagcagaaagctgctgctgagagagcccgtggacgccatgcccgaccccacccccttcctgctggccagagagagcgccgaggtgcacctgatcaaggagagacccctggtgatcccccccatcgccagcgacagaagcggcgagcagcacagccccgccagagagaagccccacaaggcccacgtgggcgtggcccacagaatccaccacgccacccccccccaggcccagcccgaggtgaagaccctggccgtggaccaggtgaacggcggcaaggtggtgagaaagcacagcggcaccgacagaaccgtgtag

SEQ ID NO: 20144 - DNA, 291 bp, Artificial Sequence
  Description of Artificial Sequence: Synthetic coding sequence
atgaccagcccccacttcagcagctacgacgagggccccctggacgtgagcatggccgccaccaacctggagaaccagctgcacagcgcccagaagaacctgctgttcctgcagagagagcacgccagcaccctgaagggcctgcacagcgagatcagaagactgcagcagcactgcaccgacctgacctacgagctgaccgtgaagagcagcgagcagaccggcgacggcaccagcaagagcagcgagctgaagaagagatgcgaggagctggaggcccagctgaagtag

SEQ ID NO: 20145 - DNA, 369 bp, Artificial Sequence
  Description of Artificial Sequence: Synthetic coding sequence
atgaccagcccccacttcagcagctacgacgagggccccctggacgtgagcatggccgccaccaacctggagaaccagctgcacagcgcccagaagaacctgctgttcctgcagagagagcacgccagcaccctgaagggcctgcacagcgagatcagaagactgcagcagcactgcaccgacctgacctacgagctgaccgtgaagagcagcgagcagaccggcgacggcaccagcaagagcagcgagctgaagaagagatgcgaggagctggaggcccagctgaaggtgaaggagaacgagaacgccgagctgctgaaggagctggagcagaagaacgccatgatcaccgtgctggagaacacctag

SEQ ID NO: 20146 - DNA, 39 bp, Artificial Sequence
  Description of Artificial Sequence: Synthetic coding sequence
atgaccagcccccacttcagcagctacgacgagggctag

SEQ ID NO: 20147 - DNA, 1896 bp, Artificial Sequence
  Description of Artificial Sequence: Synthetic coding sequence
atgggcctgcccagaggccccgagggccagggcctgcccgaggtggagaccagagaggacgaggagcagaacgtgaagctgaccgagatcctggagctgctggtggccgccggctacttcagagccagaatcaagggcctgagccccttcgacaaggtggtgggcggcatgacctggtgcatcaccacctgcaacttcgacgtggacgtggacctgctgttccaggagaacagcaccatcggccagaagatcgccctgagcgagaagatcgtgagcgtgctgcccagaatgaagtgcccccaccagctggagccccaccagatccagggcatggacttcatccacatcttccccgtggtgcagtggctggtgaagagagccatcgagaccaaggaggagatgggcgactacatcagaagctacagcgtgagccagttccagaagacctacagcctgcccgaggacgacgacttcatcaagagaaaggagaaggccatcaagaccgtggtggacctgagcgaggtgtacaagcccagaagaaagtacaagagacaccagggcgccgaggagctgctggacgaggagagcagaatccacgccaccctgctggagtacggcagaagatacggcttcagcagacagagcaagatggagaaggccgaggacaagaagaccgccctgcccgccggcctgagcgccaccgagaaggccgacgcccacgaggaggacgagctgagagccgccgaggagcagagaatccagagcctgatgaccaagatgaccgccatggccaacgaggagagcagactgaccgccagcagcgtgggccagatcgtgggcctgtgcagcgccgagatcaagcagatcgtgagcgagtacgccgagaagcagagcgagctgagcgccgaggagagccccgagaagctgggcaccagccagctgcacagaagaaaggtgatcagcctgaacaagcagatcgcccagaagaccaagcacctggaggagctgagagccagccacaccagcctgcaggccagatacaacgaggccaagaagaccctgaccgagctgaagacctacagcgagaagctggacaaggagcaggccgccctggagaagatcgagagcaaggccgaccccagcatcctgcagaacctgagagccctggtggccatgaacgagaacctgaagagccaggagcaggagttcaaggcccactgcagagaggagatgaccagactgcagcaggagatcgagaacctgaaggccgagagagcccccagaggcgacgagaagaccctgagcagcggcgagccccccggcaccctgaccagcgccatgacccacgacgaggacctggacagaagatacaacatggagaaggagaagctgtacaagatcagactgctgcaggccagaagaaacagagagatcgccatcctgcacagaaagatcgacgaggtgcccagcagagccgagctgatccagtaccagaagagattcatcgagctgtacagacagatcagcgccgtgcacaaggagaccaagcagttcttcaccctgtacaacaccctggacgacaagaaggtgtacctggagaaggagatcagcctgctgaacagcatccacgagaacttcagccaggccatggccagccccgccgccagagaccagttcctgagacagatggagcagatcgtggagggcatcaagcagagcagaatgaagatggagaagaagaagcaggagaacaagatgagaagagaccagctgaacgaccagtacctggagctgctggagaagcagagactgtacttcaagaccgtgaaggagttcaaggaggagggcagaaagaacgagatgctgctgagcaaggtgaaggccaaggccagctag

SEQ ID NO: 20148 - DNA, 972 bp, Artificial Sequence
  Description of Artificial Sequence: Synthetic coding sequence
atgagcgagagaaaggtgctgaacaagtactacccccccgacttcgaccccagcaagatccccaagctgaagctgcccaaggacagacagtacgtggtgagactgatggcccccttcaacatgagatgcaagacctgcggcgagtacatctacaagggcaagaagttcaacgccagaaaggagaccgtgcagaacgaggtgtacctgggcctgcccatcttcagattctacatcaagtgcaccagatgcctggccgagatcaccttcaagaccgaccccgagaacaccgactacaccatggagcacggcgccaccagaaacttccaggccgagaagctgctggaggaggaggagaagagagtgcagaaggagagagaggacgaggagctgaacaaccccatgaaggtgctggagaacagaaccaaggacagcaagctggagatggaggtgctggagaacctgcaggagctgaaggacctgaaccagagacaggcccacgtggacttcgaggccatgctgagacagcacagactgagcgaggaggagagaagaagacagcagcaggaggaggacgagcaggagaccgccgccctgctggaggaggccagaaagagaagactgctggaggacagcgacagcgaggacgaggccgcccccagccccctgcagcccgccctgagacccaaccccaccgccatcctggacgaggcccccaagcccaagagaaaggtggaggtgtgggagcagagcgtgggcagcctgggcagcagaccccccctgagcagactggtggtggtgaagaaggccaaggccgaccccgactgcagcaacggccagccccaggccgcccccacccccggcgccccccagaacagaaaggaggccaaccccacccccctgacccccggcgccagcagcctgagccagctgggcgcctacctggacagcgacgacagcaacggcagcaactag

SEQ ID NO: 20149 - DNA, 1668 bp, Artificial Sequence
  Description of Artificial Sequence: Synthetic coding sequence
atggacgtgagcagcgagcacaccaaggaccccggcggcgagggcggcgacggcgagagcctggccgccagacccagcaagatcaaggccagcagcggcccccccaccagccccgagcccggcgagctggagagcgagcccgaggaggaggaggaggagcaggccgccagccagggcggcaccgccgccgacgagcaggccgaggcccccaagggcctgaccgccgccgaggccgccggcgaggagggccccggcgagcccggcagacccgccgagccccagcccgagcccgaggagcccgccgaggtgggcgccgaggagcccgcccagcccgagcccggcgccggccccgaggagctggaggccgaggccggcgccgaggagctggagcaggccgccgagggcaaggaggtgagattccaggccagcctgcccctgaccagaatcgacgaggaggaggccgccgccgcccccgaggccgagaccgagagagtggagggcgaggaggaggacaaggaggagacccagagagacggcgccgagagcaaggagagagacggcgagggcagacccgccaagagccaggaggagggcaagagactgtacggcagagacgagttcgaggacctggagtggagcgaggaggtgcagaagctgcaggagcagcagctgagaagcgacctgctggaccagtacagaagcctgctggtggagagaaacagaagccagagatacaacctgtacctgcagcacaagatcttcgaggccctgagaagaaagaagggcctggaggccgccgaggtggccgacagaggcgccgaggccgaggcccccgagaaggagcaggcctacctgagacacctgggcatgctggaggagctgaagaagcagcaggccgacgacctgcagtggtaccaccaggagctgggccagctgaagagacagtgccaggagaagctgaccagagtggagaaggagtggagaagattccaggccctgaagaagcaggtggtgatgcaggccatgggcagctgcagaatgagaggcggcagacaggccgccctgagagaggtggagcagatccaggccctggaggacaagaaggagaaggagatgagcgccgtgagactggagaacatccagctgaagcagagcctggtgcacttcgagaccagaatgagaacccaggaggacctgacccagggcctgctgctgatcgacttcgagcagctgaagatcgagaaccagaccttcaacgagaagatcgaggagagaaacgaggagctgctgaagctgagaagcaaggtgaccaacagcgtgcaggtgatcacccacgtgaaggagaagctgcacttcatggacatggagaacgcctgcaagaagacccagctggccgagatcgaggcccaggccgccctgggcagagacatcctgaccaagaccaagcaggccagagagggcctgagaaccgacaacatcagactgaaccagaagtgcggcctgctgggcaaggacagcctgctgagagacctggaggagaaggtggacaagaccgagctgctgcacagaagactggagagcctgaagagacaccacgccagcctgaccctgagctgcagaggcgtgagacagaagatcagagaggccaaggccttcctgcccagctag

SEQ ID NO: 20150 - DNA, 1032 bp, Artificial Sequence
  Description of Artificial Sequence: Synthetic coding sequence
atggaggccgtggccaccgccaccgccgccaaggagcccgacaagggctgcatcgagcccggccccggccactggggcgagctgagcagaacccccgtgcccagcaagccccaggacaaggtggaggccgccgaggccacccccgtggccctggacagcgacaccagcggcgccgagaacgccgccgtgagcgccatgctgcacgccgtggccgccagcagactgcccgtgtgcagccagcagcagggcgagcccgacctgaccgagcacgagaaggtggccatcctggcccagctgtaccacgagaagcccctggtgttcctggagagattcagaaccggcctgagagaggagcacctggcctgcttcggccacgtgagaggcgaccacagagccgacttctactgcgccgaggtggccagacagggcaccgccagacccagaaccctgagaaccagactgagaaacagaagatacgccgccctgagagagctgatccagggcggcgagtacttcagcgacgagcagatgagattcagagcccccctgctgtacgagcagtacatcggccagtacctgacccaggaggagctgagcgccagaacccccacccaccagccccccaagcccggcagccccggcagacccgcctgccccctgagcaacctgctgctgcagagctacgaggagagagagctgcagcagagactgctgcagcagcaggaggaggaggaggcctgcctggaggaggaggaggaggaggaggacagcgacgaggaggaccagagaagcggcaaggacagcgaggcctgggtgcccgacagcgaggagagactgatcctgagagaggagttcaccagcagaatgcaccagagattcctggacggcaaggacggcgacttcgactacagcaccgtggacgacaaccccgacttcgacaacctggacatcgtggccagagacgaggaggagagatacttcgacgaggaggagcccgaggacgcccccagccccgagctggacggcgactag

SEQ ID NO: 20151 - DNA, 462 bp, Artificial Sequence
  Description of Artificial Sequence: Synthetic coding sequence
atggagcccctgtaccaggccggcagcatcctgatgaccgtgaacaccctgcagggcaagaagatgatcgagagcggcctgcagagcggcgacttcagcctgagccagagctggcccagctgcctgcccccccccgccgacctggagatcctgcagcagaaggtggccggcgtgcagagagagctggaggacttcaagaaggaggccctgaagagcatccactacctggaggacgccttctgcgagatgaacggcgccctggtgcagcaggaggagcaggccgccagagtgagacagagactgagagaggaggaggacagaggcatcgtgagaaacaaggtgctgaccttcctgctgcccagagagaagcagctgagagagcactgcaagagactggaggacctgctgctggacagaggcagagacgccctgagagccaccaagaagagccaggccgactag

SEQ ID NO: 20152 - DNA, 333 bp, Artificial Sequence
  Description of Artificial Sequence: Synthetic coding sequence
atgcaggccgccctggaggtgaccgccagatactgcggcagagagctggagcagtacggccagtgcgtggccgccaagcccgagagctggcagagagactgccactacctgaagatgagcatcgcccagtgcaccagcagccaccccatcatcagacagatcagacaggcctgcgcccagcccttcgaggccttcgaggagtgcctgagacagaacgaggccgccgtgggcaactgcgccgagcacatgagaagattcctgcagtgcgccgagcaggtgcagccccccagaagccccgccaccgtggaggcccagcccctgcccgccagctag

SEQ ID NO: 20153 - DNA, 708 bp, Artificial Sequence
  Description of Artificial Sequence: Synthetic coding sequence
atgggcagcaccgagagcagcgagggcagaagagtgagcttcggcgtggacgaggaggagagagtgagagtgctgcagggcgtgagactgagcgagaacgtggtgaacagaatgaaggagcccagcagccccccccccgcccccaccagcagcaccttcggcctgcaggacggcaacctgagagccccccacaaggagagcaccctgcccagaagcggcagcagcggcggccagcagcccagcggcatgaaggagggcgtgaagagatacgagcaggagcacgccgccatccaggacaagctgttccaggtggccaagagagagagagaggccgccaccaagcacagcaaggccagcctgcccaccggcgagggcagcatcagccacgaggagcagaagagcgtgagactggccagagagctggagagcagagaggccgagctgagaagaagagacaccttctacaaggagcagctggagagaatcgagagaaagaacgccgagatgtacaagctgagcagcgagcagttccacgaggccgccagcaagatggagagcaccatcaagcccagaagagtggagcccgtgtgcagcggcctgcaggcccagatcctgcactgctacagagacagaccccacgaggtgctgctgtgcagcgacctggtgaaggcctaccagagatgcgtgagcgccgcccacaagggctag

SEQ ID NO: 20154 - DNA, 501 bp, Artificial Sequence
  Description of Artificial Sequence: Synthetic coding sequence
tgaaccctgcccagaagcggcagcagcggcggccagcagcccagcggcatgaaggagggcgtgaagagatacgagcaggagcacgccgccatccaggacaagctgttccaggtggccaagagagagagagaggccgccaccaagcacagcaaggccagcctgcccaccggcgagggcagcatcagccacgaggagcagaagagcgtgagactggccagagagctggagagcagagaggccgagctgagaagaagagacaccttctacaaggagcagctggagagaatcgagagaaagaacgccgagatgtacaagctgagcagcgagcagttccacgaggccgccagcaagatggagagcaccatcaaggtggagcccgtgtgcagcggcctgcaggcccagatcctgcactgctacagagacagaccccacgaggtgctgctgtgcagcgacctggtgaaggcctaccagagatgcgtgagcgccgcccacaagggctag

SEQ ID NO: 20155 - DNA, 600 bp, Artificial Sequence
  Description of Artificial Sequence: Synthetic coding sequence
atgctgctggagctgagcgaggagcacaaggagcacctggccttcctgccccaggtggacagcgccgtggtggccgagttcggcagaatcgccgtggagttcctgagaagaggcgccaaccccaagatctacgagggcgccgccagaaagctgaacgtgagcagcgacaccgtgcagcacggcgtggagggcctgacctacctgctgaccgagagcagcaagctgatgatcagcgagctggacttccaggacagcgtgttcgtgctgggcttcagcgaggagctgaacaagctgctgctgcagctgtacctggacaacagaaaggagatcagaaccatcctgagcgagctggcccccagcctgcccagctaccacaacctggagtggagactggacgtgcagctggccagcagaagcctgagacagcagatcaagcccgccgtgaccatcaagctgcacctgaaccagaacggcgaccacaacaccaaggtgctgcagaccgaccccgccaccctgctgcacctggtgcagcagctggagcaggccctggaggagatgaagaccaaccactgcagaagagtggtgagaaacatcaagtag

SEQ ID NO: 20156 - DNA, 534 bp, Artificial Sequence
  Description of Artificial Sequence: Synthetic coding sequence
atggagctgagcgagagcgtgcagaagggcttccagatgctggccgaccccagaagcttcgacagcaacgccttcaccctgctgctgagagccgccttccagagcctgctggacgcccaggccgacgaggccgtgctggaccaccccgacctgaagcacatcgaccccgtggtgctgaagcactgccacgccgccgccgccacctacatcctggaggccggcaagcacagagccgacaagagcaccctgagcacctacctggaggactgcaagttcgacagagagagaatcgagctgttctgcaccgagtaccagaacaacaagaacagcctggagatcctgctgggcagaaccctgatcccccaccccatccagagactggtgctggtggccgcctggaacaactacagaacctggtggggcaacctgaagatgctgagaaaggcctggaaggagcagctgagctgcaacctgggcaagctgaccatcagacccagcgccgaggagaaccagaagagactggccttcagctag

SEQ ID NO: 20157 - DNA, 489 bp, Artificial Sequence
  Description of Artificial Sequence: Synthetic coding sequence
atggagctgagcgagagcgtgcagaagggcttccagatgctggccgaccccagaagcttcgacagcaacgccttcaccctgctgctgagagccgccttccagagcctgctggacgcccaggccgacgaggccgtgctggaccaccccgacctgaagcacatcgaccccgtggtgctgaagcactgccacgccgccgccgccacctacatcctggaggccggcaagcacagagccgacaagagcaccctgagcatcggcagaagcctgccccacatcaccgacgtgagctggagactggagtaccagatcaagaccaaccagctgcacagaatgtacagacccgcctacctggtgaccctgagcgtgcagaacaccgacagccccagctaccccgagatcagcttcagctgcagcatggagcagctgcaggacctggtgggcaagctgaaggacgccagcaagagcctggagagagccacccagctgtag

SEQ ID NO: 20158 - DNA, 588 bp, Artificial Sequence
  Description of Artificial Sequence: Synthetic coding sequence
atggagctgagcgagagcgtgcagaagggcttccagatgctggccgaccccagaagcttcgacagcaacgccttcaccctgctgctgagagccgccttccagagcctgctggacgcccaggccgacgaggccgtgctggaccaccccgacctgaagcacatcgaccccgtggtgctgaagcactgccacgccgccgccgccacctacatcctggaggccggcaagcacagagccgacaagagcaccctgagcacctacctggaggactgcaagttcgacagagagagaatcgagctgttctgcaccgagtaccagaacaacaagaacagcctggagatcctgctgggcagcatcggcagaagcctgccccacatcaccgacgtgagctggagactggagtaccagatcaagaccaaccagctgcacagaatgtacagacccgcctacctggtgaccctgagcgtgcagaacaccgacagccccagctaccccgagatcagcttcagctgcagcatggagcagctgcaggacctggtgggcaagctgaaggacgccagcaagagcctggagagagccacccagctgtag

SEQ ID NO: 20159 - DNA, 534 bp, Artificial Sequence
  Description of Artificial Sequence: Synthetic coding sequence
tgagagctgagcgagagcgtgcagaagggcttccagatgctggccgaccccagaagcttcgacagcaacgccttcaccctgctgctgagagccgccttccagagcctgctggacgcccaggccgacgaggccgtgctggaccaccccgacctgaagcacatcgaccccgtggtgctgaagcactgccacgccgccgccgccacctacatcctggaggccggcaagcacagagccgacaagagcaccctgagcacctacctggaggactgcaagttcgacagagagagaatcgagctgttctgcaccgagtaccagaacaacaagaacagcctggagatcctgctgggcagaaccctgatcccccaccccatccagagactggtgctggtggccgcctggaacaactacagaacctggtggggcaacctgaagatgctgagaaaggcctggaaggagcagctgagctgcaacctgggcaagctgaccatcagacccagcgccgaggagaaccagaagagactggccttcagctag

SEQ ID NO: 20160 - DNA, 450 bp, Artificial Sequence
  Description of Artificial Sequence: Synthetic coding sequence
tgactgcccgacgccggcggcagccccctgctgagactgcagagactgcacgccagcccccccggcggcatccccgagagcgccggcagacccggcggcagaggcagagtgagcacctacctggaggactgcaagttcgacagagagagaatcgagctgttctgcaccgagtaccagaacaacaagaacagcctggagatcctgctgggcagcatcggcagaagcctgccccacatcaccgacgtgagctggagactggagtaccagatcaagaccaaccagctgcacagaatgtacagacccgcctacctggtgaccctgagcgtgcagaacaccgacagccccagctaccccgagatcagcttcagctgcagcatggagcagctgcaggacctggtgggcaagctgaaggacgccagcaagagcctggagagagccacccagctgtag

SEQ ID NO: 20161 - DNA, 492 bp, Artificial Sequence
  Description of Artificial Sequence: Synthetic coding sequence
tgaatggagctgagcgagagcgtgcagaagggcttccagatgctggccgaccccagaagcttcgacagcaacgccttcaccctgctgctgagagccgccttccagagcctgctggacgcccaggccgacgaggccgtgctggaccaccccgacctgaagcacatcgaccccgtggtgctgaagcactgccacgccgccgccgccacctacatcctggaggccggcaagcacagagccgacaagagcaccctgagcatcggcagaagcctgccccacatcaccgacgtgagctggagactggagtaccagatcaagaccaaccagctgcacagaatgtacagacccgcctacctggtgaccctgagcgtgcagaacaccgacagccccagctaccccgagatcagcttcagctgcagcatggagcagctgcaggacctggtgggcaagctgaaggacgccagcaagagcctggagagagccacccagctgtag

SEQ ID NO: 20162 - DNA, 603 bp, Artificial Sequence
  Description of Artificial Sequence: Synthetic coding sequence
atgggcagactgcactgcaccgaggaccccgtgcccgaggccgtgggcggcgacatgcagcagctgaaccagctgggcgcccagcagttcagcgccctgaccgaggtgctgttccacttcctgaccgagcccaaggaggtggagagattcctggcccagctgagcgagttcgccaccaccaaccagatcagcctgggcagcctgagaagcatcgtgaagagcctgctgctggtgcccaacggcgccctgaagaagagcctgaccgccaagcaggtgcaggccgacttcatcaccctgggcctgagcgaggagaaggccacctacttcagcgagaagtggaagcagaacgcccccaccctggccagatgggccatcggccagaccctgatgatcaaccagctgatcgacatggagtggaagttcggcgtgaccagcggcagcagcgagctggagaaggtgggcagcatcttcctgcagctgaagctggtggtgaagaagggcaaccagaccgagaacgtgtacatcgagctgaccctgccccagttctacagcttcctgcacgagatggagagagtgagaaccagcatggagtgcttctgctag

SEQ ID NO: 20163 - DNA, 600 bp, Artificial Sequence
  Description of Artificial Sequence: Synthetic coding sequence
atgggcagactgcactgcaccgaggaccccgtgcccgaggccgtgggcggcgacatgcagcagctgaaccagctgggcgcccagttcagcgccctgaccgaggtgctgttccacttcctgaccgagcccaaggaggtggagagattcctggcccagctgagcgagttcgccaccaccaaccagatcagcctgggcagcctgagaagcatcgtgaagagcctgctgctggtgcccaacggcgccctgaagaagagcctgaccgccaagcaggtgcaggccgacttcatcaccctgggcctgagcgaggagaaggccacctacttcagcgagaagtggaagcagaacgcccccaccctggccagatgggccatcggccagaccctgatgatcaaccagctgatcgacatggagtggaagttcggcgtgaccagcggcagcagcgagctggagaaggtgggcagcatcttcctgcagctgaagctggtggtgaagaagggcaaccagaccgagaacgtgtacatcgagctgaccctgccccagttctacagcttcctgcacgagatggagagagtgagaaccagcatggagtgcttctgctag

SEQ ID NO: 20164 - DNA, 552 bp, Artificial Sequence
  Description of Artificial Sequence: Synthetic coding sequence
atggagcccgaggagggcacccccctgtggagactgcagaagctgcccgccgagctgggcccccagctgctgcacaagatcatcgacggcatctgcggcagagcctaccccgtgtaccaggactaccacaccgtgtgggagagcgaggagtggatgcacgtgctggaggacatcgccaagttcttcaaggccatcgtgggcaagaacctgcccgacgaggagatcttccagcagctgaaccagctgaacagcctgcaccaggagaccatcatgaagtgcgtgaagagcagaaaggacgagatcaagcaggccctgagcagagagatcgtggccatcagcagcgcccagctgcaggacttcgactggcaggtgaagctggccctgagcagcgacaagatcgccgccctgagaatgcccctgctgagcctgcacctggacgtgaaggagaacggcgaggtgaagccctacagcatcgagatgagcagagaggagctgcagaacctgatccagagcctggaggccgccaacaaggtggtgctgcagctgaagtag

SEQ ID NO: 20165 - DNA, 597 bp, Artificial Sequence
  Description of Artificial Sequence: Synthetic coding sequence
atggccgccctgaccgccgagcacttcgccgccctgcagagcctgctgaaggccagcagcaaggacgtggtgagacagctgtgccaggagagcttcagcagcagcgccctgggcctgaagaagctgctggacgtgacctgcagcagcctgagcgtgacccaggaggaggccgaggagctgctgcaggccctgcacagactgaccagactggtggccttcagagacctgagcagcgccgaggccatcctggccctgttccccgagaacttccaccagaacctgaagaacctgctgaccaagatcatcctggagcacgtgagcacctggagaaccgaggcccaggccaaccagatcagcctgcccagactggtggacctggactggagagtggacatcaagaccagcagcgacagcatcagcagaatggccgtgcccacctgcctgctgcagatgaagatccaggaggaccccagcctgtgcggcgacaagcccagcatcagcgccgtgaccgtggagctgagcaaggagaccctggacaccatgctggacggcctgggcagaatcagagaccagctgagcgccgtggccagcaagtag

SEQ ID NO: 20166 - DNA, 510 bp, Artificial Sequence
  Description of Artificial Sequence: Synthetic coding sequence
atggccgccctgaccgccgagcacttcgccgccctgcagagcctgctgaaggccagcagcaaggacgtggtgagacagctgtgccaggagagcttcagcagcagcgccctgggcctgaagaagctgctggacgtgacctgcagcagcctgagcgtgacccaggaggaggccgaggagctgctgcaggccctgcacagactgaccagactggtggccttcagagacctgagcagcgccgaggccatcctggccctgttccccgagaacttccaccagaacctgaagaacctgctgaccaagatcatcctggagcacgtgagcacctggagaaccgaggcccaggccaaccagatcagcctgcccagactggtggacctggactggagagtggacatcaagaccagcagcgacagcatcagcagaatggccgtgcccacctgcctgctgcagatgaagatccaggaggaccccagcctgtgcggcgacaagcccagcatcagcgccgtgtag

SEQ ID NO: 20167 - DNA, 471 bp, Artificial Sequence
  Description of Artificial Sequence: Synthetic coding sequence
atggccgccctgaccgccgagcacttcgccgccctgcagagcctgctgaagctgctgcaggccctgcacagactgaccagactggtggccttcagagacctgagcagcgccgaggccatcctggccctgttccccgagaacttccaccagaacctgaagaacctgctgaccaagatcatcctggagcacgtgagcacctggagaaccgaggcccaggccaaccagatcagcctgcccagactggtggacctggactggagagtggacatcaagaccagcagcgacagcatcagcagaatggccgtgcccacctgcctgctgcagatgaagatccaggaggaccccagcctgtgcggcgacaagcccagcatcagcgccgtgaccgtggagctgagcaaggagaccctggacaccatgctggacggcctgggcagaatcagagaccagctgagcgccgtggccagcaagtag

SEQ ID NO: 20168 - DNA, 2067 bp, Artificial Sequence
  Description of Artificial Sequence: Synthetic coding sequence
atgtggtgcatcgtgctgttcagcctgctggcctgggtgtacgccgagcccaccatgtacggcgagatcctgagccccaactacccccaggcctaccccagcgaggtggagaagagctgggacatcgaggtgcccgagggctacggcatccacctgtacttcacccacctggacatcgagctgagcgagaactgcgcctacgacagcgtgcagatcatcagcggcgacaccgaggagggcagactgtgcggccagagaagcagcaacaacccccacagccccatcgtggaggagttccaggtgccctacaacaagctgcaggtgatcttcaagagcgacttcagcaacgaggagagattcaccggcttcgccgcctactacgtggccaccgacatcaacgagtgcaccgacttcgtggacgtgccctgcagccacttctgcaacaacttcatcggcggctacttctgcagctgcccccccgagtacttcctgcacgacgacatgaagaactgcggcgtgaactgcagcggcgacgtgttcaccgccctgatcggcgagatcgccagccccaactaccccaagccctaccccgagaacagcagatgcgagtaccagatcagactggagaagggcttccaggtggtggtgaccctgagaagagaggacttcgacgtggaggccgccgacagcgccggcaactgcctggacagcctggtgttcgtggccggcgacagacagttcggcccctactgcggccacggcttccccggccccctgaacatcgagaccaagagcaacgccctggacatcatcttccagaccgacctgaccggccagaagaagggctggaagctgagataccacggcgaccccatgccctgccccaaggaggacacccccaacagcgtgtgggagcccgccaaggccaagtacgtgttcagagacgtggtgcagatcacctgcctggacggcttcgaggtggtggagggcagagtgggcgccaccagcttctacagcacctgccagagcaacggcaagtggagcaacagcaagctgaagtgccagcccgtggactgcggcatccccgagagcatcgagaacggcaaggtggaggaccccgagagcaccctgttcggcagcgtgatcagatacacctgcgaggagccctactactacatggagaacggcggcggcggcgagtaccactgcgccggcaacggcagctgggtgaacgaggtgctgggccccgagctgcccaagtgcgtgcccgtgtgcggcgtgcccagagagcccttcgaggagaagcagagaatcatcggcggcagcgacgccgacatcaagaacttcccctggcaggtgttcttcgacaacccctgggccggcggcgccctgatcaacgagtactgggtgctgaccgccgcccacgtggtggagggcaacagagagcccaccatgtacgtgggcagcaccagcgtgcagaccagcagactggccaagagcaagatgctgacccccgagcacgtgttcatccaccccggctggaagctgctggaggtgcccgagggcagaaccaacttcgacaacgacatcgccctggtgagactgaaggaccccgtgaagatgggccccaccgtgagccccatctgcctgcccggcaccagcagcgactacaacctgatggacggcgacctgggcctgatcagcggctggggcagaaccgagaagagagacagagccgtgagactgaaggccgccagactgcccgtggcccccctgagaaagtgcaaggaggtgaaggtggagaagcccaccgccgacgccgaggcctacgtgttcacccccaacatgatctgcgccggcggcgagaagggcatggacagctgcaagggcgacagcggcggcgccttcgccgtgcaggaccccaacgacaagaccaagttctacgccgccggcctggtgagctggggcccccagtgcggcacctacggcctgtacaccagagtgaagaactacgtggactggatcatgaagaccatgcaggagaacagcacccccagagaggactag

SEQ ID NO: 20169 - DNA, 2067 bp, Artificial Sequence; identical to SEQ ID NO: 20168
  Description of Artificial Sequence: Synthetic coding sequence

SEQ ID NO: 20170 - DNA, 483 bp, Artificial Sequence
  Description of Artificial Sequence: Synthetic coding sequence
atggccttcctgatgaagagcatgatcagcaaccaggtgaagaacctgggcttcggcggcggcagcgaggagaacaaggaggagggcggcgccagcgaccccgccgccgcccagggcatgaccagagaggagtacgaggagtaccagaagcagatgatcgaggagaagatggagagagacgccgccttcacccagaagaaggccgagagagcctgcctgagagtgcacctgagagagaagtacagactgcccaagagcgagatggacgagaaccagatccagatggccggcgacgacgtggacctgcccgaggacctgagaaagatggtggacgaggaccaggaggaggaggaggacaaggacagcatcctgggccagatccagaacctgcagaacatggacctggacaccatcaaggagaaggcccaggccaccttcaccgagatcaagcagaccgccgagcagaagtgcagcgtgatgtag

SEQ ID NO: 20171 - DNA, 3924 bp, Artificial Sequence
  Description of Artificial Sequence: Synthetic coding sequence
atgggcagcgtgaccggcgccgtgctgaagaccctgctgctgagcacccagaactggaacagagtggaggccggcaacagctacgactgcgacgaccccctggtgagcgccctgccccaggccagcttcagcagcagcagcgagctgagcagcagccacggccccggcttcgccagactgaacagaagagacggcgccggcggctggagccccctggtgagcaacaagtaccagtggctgcagatcgacctgggcgagagaatggaggtgaccgccgtggccacccagggcggctacggcagcagcaactgggtgaccagctacctgctgatgttcagcgacagcggctggaactggaagcagtacagacaggaggacagcatctggggcttcagcggcaacgccaacgccgacagcgtggtgtactacagactgcagcccagcatcaaggccagattcctgagattcatccccctggagtggaaccccaagggcagaatcggcatgagaatcgaggtgttcggctgcgcctacagaagcgaggtggtggacctggacggcaagagcagcctgctgtacagattcgaccagaagagcctgagccccatcaaggacatcatcagcctgaagttcaagaccatgcagagcgacggcatcctgctgcacagagagggccccaacggcgaccacatcaccctgcagctgagaagagccagactgttcctgctgatcaacagcggcgaggccaagctgcccagcaccagcaccctggtgaacctgaccctgggcagcctgctggacgaccagcactggcacagcgtgctgatccagagactgggcaagcaggtgaacttcaccgtggacgagcacagacaccacttccacgccagaggcgagttcaacctgatgaacctggactacgagatcagcttcggcggcatccccgcccccggcaagagcgtgagcttcccccacagaaacttccacggctgcctggagaacctgtactacaacggcgtggacatcatcgacctggccaagcagcagaagccccagatcatcgccatgggcaacgtgagcttcagctgcagccagccccagagcatgcccgtgaccttcctgagcagcagaagctacctggccctgcccgacttcagcggcgaggaggaggtgagcgccaccttccagttcagaacctggaacaaggccggcctgctgctgttcagcgagctgcagctgatcagcggcggcatcctgctgttcctgagcgacggcaagctgaagagcaacctgtaccagcccggcaagctgcccagcgacatcaccgccggcgtggagctgaacgacggccagtggcacagcgtgagcctgagcgccaagaagaaccacctgagcgtggccgtggacggccagatggccagcgccgcccccctgctgggccccgagcagatctacagcggcggcacctactacttcggcggctgccccgacaagagcttcggcagcaagtgcaagagccccctgggcggcttccagggctgcatgagactgatcagcatcagcggcaaggtggtggacctgatcagcgtgcagcagggcagcctgggcaacttcagcgacctgcagatcgacagctgcggcatcagcgacagatgcctgcccaactactgcgagcacggcggcgagtgcagccagagctggagcaccttccactgcaactgcaccaacaccggctacagaggcgccacctgccacaacagcatctacgagcagagctgcgaggcctacaagcacagaggcaacaccagcggcttctactacatcgacagcgacggcagcggccccctggagcccttcctgctgtactgcaacatgaccgagaccgcctggaccatcatccagcacaacggcagcgacctgaccagagtgagaaacaccaaccccgagaacccctacgccggcttcttcgagtacgtggccagcatggagcagctgcaggccaccatcaacagagccgagcactgcgagcaggagttcacctactactgcaagaagagcagactggtgaacaagcaggacggcacccccctgagctggtgggtgggcagaaccaacgagacccagacctactggggcggcagcagccccgacctgcagaagtgcacctgcggcctggagggcaactgcatcgacagccagtactactgcaactgcgacgccgacagaaacgagtggaccaacgacaccggcctgctggcctacaaggagcacctgcccgtgaccaagatcgtgatcaccgacaccggcagactgcacagcgaggccgcctacaagctgggccccctgctgtgccagggcgacagaagcttctggaacagcgccagcttcgacaccgaggccagctacctgcacttccccaccttccacggcgagctgagcgccgacgtgagcttcttcttcaagaccaccgccagcagcggcgtgttcctggagaacctgggcatcgccgacttcatcagaatcgagctgagaagccccaccgtggtgaccttcagcttcgacgtgggcaacggccccttcgagatcagcgtgcagagccccacccacttcaacgacaaccagtggcaccacgtgagagtggagagaaacatgaaggaggccagcctgcaggtggaccagctgacccccaagacccagcccgcccccgccgacggccacgtgctgctgcagctgaacagccagctgttcgtgggcggcaccgccaccagacagagaggcttcctgggctgcatcagaagcctgcagctgaacggcatgaccctggacctggaggagagagcccaggtgacccccgaggtgcagcccggctgcagaggccactgcagcagctacggcaagctgtgcagaaacggcggcaagtgcagagagagacccatcggcttcttctgcgactgcaccttcagcgcctacaccggccccttctgcagcaacgagatcagcgcctacttcggcagcggcagcagcgtgatctacaacttccaggagaactacctgctgagcaagaacagcagcagccacgccgccagcttccacggcgacatgaagctgagcagagagatgatcaagttcagcttcagaaccaccagaacccccagcctgctgctgttcgtgagcagcttctacaaggagtacctgagcgtgatcatcgccaagaacggcgacctgcagatcagatacaagctgaacaagtaccaggagcccgacgtggtgaacttcgacttcaagaacatggccgacggccagctgcaccacatcatgatcaacagagaggagggcgtggtgttcatcgagatcgacgacaacagaagaagacaggtgcacctgagcagcggcaccgagttcagcgccgtgaagagcctggtgctgggcagaatcctggagcacagcgacgtggaccaggacaccgccctggccggcgcccagggcttcaccggctgcctgagcgccgtgcagctgagccacgtggcccccctgaaggccgccctgcaccccagccaccccgaccccgtgaccgtgaccggccacgtgaccgagagcagctgcatggcccagcccggcaccgacgccaccagcagagagagaacccacagcttcgccgaccacagcggcaccatcgacgacagagagcccctggccaacgccatcaagagcgacagcgccgtgatcggcggcctgatcgccgtggtgatcttcatcctgctgtgcatcaccgccatcgccgtgagaatctaccagcagaagagactgtacaagagaagcgaggccaagagaagcgagaacgtggacagcgccgaggccgtgctgaagagcgagctgaacatccagaacgccgtgaacgagaaccagaaggagtacttcttctag

SEQ ID NO: 20172 - DNA, 3780 bp, Artificial Sequence
  Description of Artificial Sequence: Synthetic coding sequence
atgggcagcgtgaccggcgccgtgctgaagaccctgctgctgagcacccagaactggaacagagtggaggccggcaacagctacgactgcgacgaccccctggtgagcgccctgccccaggccagcttcagcagcagcagcgagctgagcagcagccacggccccggcttcgccagactgaacagaagagacggcgccggcggctggagccccctggtgagcaacaagtaccagtggctgcagatcgacctgggcgagagaatggaggtgaccgccgtggccacccagggcggctacggcagcagcaactgggtgaccagctacctgctgatgttcagcgacagcggctggaactggaagcagtacagacaggaggacagcatctggggcttcagcggcaacgccaacgccgacagcgtggtgtactacagactgcagcccagcatcaaggccagattcctgagattcatccccctggagtggaaccccaagggcagaatcggcatgagaatcgaggtgttcggctgcgcctacagaagcgaggtggtggacctggacggcaagagcagcctgctgtacagattcgaccagaagagcctgagccccatcaaggacatcatcagcctgaagttcaagaccatgcagagcgacggcatcctgctgcacagagagggccccaacggcgaccacatcaccctgcagctgagaagagccagactgttcctgctgatcaacagcggcgaggccaagctgcccagcaccagcaccctggtgaacctgaccctgggcagcctgctggacgaccagcactggcacagcgtgctgatccagagactgggcaagcaggtgaacttcaccgtggacgagcacagacaccacttccacgccagaggcgagttcaacctgatgaacctggactacgagggcaacgtgagcttcagctgcagccagccccagagcatgcccgtgaccttcctgagcagcagaagctacctggccctgcccgacttcagcggcgaggaggaggtgagcgccaccttccagttcagaacctggaacaaggccggcctgctgctgttcagcgagctgcagctgatcagcggcggcatcctgctgttcctgagcgacggcaagctgaagagcaacctgtaccagcccggcaagctgcccagcgacatcaccgccggcgtggagctgaacgacggccagtggcacagcgtgagcctgagcgccaagaagaaccacctgagcgtggccgtggacggccagatggccagcgccgcccccctgctgggccccgagcagatctacagcggcggcacctactacttcggcggctgccccgacaagagcttcggcagcaagtgcaagagccccctgggcggcttccagggctgcatgagactgatcagcatcagcggcaaggtggtggacctgatcagcgtgcagcagggcagcctgggcaacttcagcgacctgcagatcgacagctgcggcatcagcgacagatgcctgcccaactactgcgagcacggcggcgagtgcagccagagctggagcaccttccactgcaactgcaccaacaccggctacagaggcgccacctgccacaacagcatctacgagcagagctgcgaggcctacaagcacagaggcaacaccagcggcttctactacatcgacagcgacggcagcggccccctggagcccttcctgctgtactgcaacatgaccgagaccgcctggaccatcatccagcacaacggcagcgacctgaccagagtgagaaacaccaaccccgagaacccctacgccggcttcttcgagtacgtggccagcatggagcagctgcaggccaccatcaacagagccgagcactgcgagcaggagttcacctactactgcaagaagagcagactggtgaacaagcaggacggcacccccctgagctggtgggtgggcagaaccaacgagacccagacctactggggcggcagcagccccgacctgcagaagtgcacctgcggcctggagggcaactgcatcgacagccagtactactgcaactgcgacgccgacagaaacgagtggaccaacgacaccggcctgctggcctacaaggagcacctgcccgtgaccaagatcgtgatcaccgacaccggcagactgcacagcgaggccgcctacaagctgggccccctgctgtgccagggcgacagaagcttctggaacagcgccagcttcgacaccgaggccagctacctgcacttccccaccttccacggcgagctgagcgccgacgtgagcttcttcttcaagaccaccgccagcagcggcgtgttcctggagaacctgggcatcgccgacttcatcagaatcgagctgagaagccccaccgtggtgaccttcagcttcgacgtgggcaacggccccttcgagatcagcgtgcagagccccacccacttcaacgacaaccagtggcaccacgtgagagtggagagaaacatgaaggaggccagcctgcaggtggaccagctgacccccaagacccagcccgcccccgccgacggccacgtgctgctgcagctgaacagccagctgttcgtgggcggcaccgccaccagacagagaggcttcctgggctgcatcagaagcctgcagctgaacggcatgaccctggacctggaggagagagcccaggtgacccccgaggtgcagcccggctgcagaggccactgcagcagctacggcaagctgtgcagaaacggcggcaagtgcagagagagacccatcggcttcttctgcgactgcaccttcagcgcctacaccggccccttctgcagcaacgagatcagcgcctacttcggcagcggcagcagcgtgatctacaacttccaggagaactacctgctgagcaagaacagcagcagccacgccgccagcttccacggcgacatgaagctgagcagagagatgatcaagttcagcttcagaaccaccagaacccccagcctgctgctgttcgtgagcagcttctacaaggagtacctgagcgtgatcatcgccaagaacggcgacctgcagatcagatacaagctgaacaagtaccaggagcccgacgtggtgaacttcgacttcaagaacatggccgacggccagctgcaccacatcatgatcaacagagaggagggcgtggtgttcatcgagatcgacgacaacagaagaagacaggtgcacctgagcagcggcaccgagttcagcgccgtgaagagcctggtgctgggcagaatcctggagcacagcgacgtggaccaggacaccgccctggccggcgcccagggcttcaccggctgcctgagcgccgtgcagctgagccacgtggcccccctgaaggccgccctgcaccccagccaccccgaccccgtgaccgtgaccggccacgtgaccgagagcagctgcatggcccagcccggcaccgacgccaccagcagagagagaacccacagcttcgccgaccacagcggcaccatcgacgacagagagcccctggccaacgccatcaagagcgacagcgccgtgatcggcggcctgatcgccgtggtgatcttcatcctgctgtgcatcaccgccatcgccgtgagaatctaccagcagaagagactgtacaagagaagcgaggccaagagaagcgagaacgtggacagcgccgaggccgtgctgaagagcgagctgaacatccagaacgccgtgaacgagaaccagaaggagtacttcttctag

SEQ ID NO: 20173 - DNA, 3708 bp, Artificial Sequence
  Description of Artificial Sequence: Synthetic coding sequence
atgtggaactacgactgcgacgaccccctggtgagcgccctgccccaggccagcttcagcagcagcagcgagctgagcagcagccacggccccggcttcgccagactgaacagaagagacggcgccggcggctggagccccctggtgagcaacaagtaccagtggctgcagatcgacctgggcgagagaatggaggtgaccgccgtggccacccagggcggctacggcagcagcaactgggtgaccagctacctgctgatgttcagcgacagcggctggaactggaagcagtacagacaggaggacagcatctggggcttcagcggcaacgccaacgccgacagcgtggtgtactacagactgcagcccagcatcaaggccagattcctgagattcatccccctggagtggaaccccaagggcagaatcggcatgagaatcgaggtgttcggctgcgcctacagaagcgaggtggtggacctggacggcaagagcagcctgctgtacagattcgaccagaagagcctgagccccatcaaggacatcatcagcctgaagttcaagaccatgcagagcgacggcatcctgctgcacagagagggccccaacggcgaccacatcaccctgcagctgagaagagccagactgttcctgctgatcaacagcggcgaggccaagctgcccagcaccagcaccctggtgaacctgaccctgggcagcctgctggacgaccagcactggcacagcgtgctgatccagagactgggcaagcaggtgaacttcaccgtggacgagcacagacaccacttccacgccagaggcgagttcaacctgatgaacctggactacgagggcaacgtgagcttcagctgcagccagccccagagcatgcccgtgaccttcctgagcagcagaagctacctggccctgcccgacttcagcggcgaggaggaggtgagcgccaccttccagttcagaacctggaacaaggccggcctgctgctgttcagcgagctgcagctgatcagcggcggcatcctgctgttcctgagcgacggcaagctgaagagcaacctgtaccagcccggcaagctgcccagcgacatcaccgccggcgtggagctgaacgacggccagtggcacagcgtgagcctgagcgccaagaagaaccacctgagcgtggccgtggacggccagatggccagcgccgcccccctgctgggccccgagcagatctacagcggcggcacctactacttcggcggctgccccgacaagagcttcggcagcaagtgcaagagccccctgggcggcttccagggctgcatgagactgatcagcatcagcggcaaggtggtggacctgatcagcgtgcagcagggcagcctgggcaacttcagcgacctgcagatcgacagctgcggcatcagcgacagatgcctgcccaactactgcgagcacggcggcgagtgcagccagagctggagcaccttccactgcaactgcaccaacaccggctacagaggcgccacctgccacaacagcatctacgagcagagctgcgaggcctacaagcacagaggcaacaccagcggcttctactacatcgacagcgacggcagcggccccctggagcccttcctgctgtactgcaacatgaccgagaccgcctggaccatcatccagcacaacggcagcgacctgaccagagtgagaaacaccaaccccgagaacccctacgccggcttcttcgagtacgtggccagcatggagcagctgcaggccaccatcaacagagccgagcactgcgagcaggagttcacctactactgcaagaagagcagactggtgaacaagcaggacggcacccccctgagctggtgggtgggcagaaccaacgagacccagacctactggggcggcagcagccccgacctgcagaagtgcacctgcggcctggagggcaactgcatcgacagccagtactactgcaactgcgacgccgacagaaacgagtggaccaacgacaccggcctgctggcctacaaggagcacctgcccgtgaccaagatcgtgatcaccgacaccggcagactgcacagcgaggccgcctacaagctgggccccctgctgtgccagggcgacagaagcttctggaacagcgccagcttcgacaccgaggccagctacctgcacttccccaccttccacggcgagctgagcgccgacgtgagcttcttcttcaagaccaccgccagcagcggcgtgttcctggagaacctgggcatcgccgacttcatcagaatcgagctgagaagccccaccgtggtgaccttcagcttcgacgtgggcaacggccccttcgagatcagcgtgcagagccccacccacttcaacgacaaccagtggcaccacgtgagagtggagagaaacatgaaggaggccagcctgcaggtggaccagctgacccccaagacccagcccgcccccgccgacggccacgtgctgctgcagctgaacagccagctgttcgtgggcggcaccgccaccagacagagaggcttcctgggctgcatcagaagcctgcagctgaacggcatgaccctggacctggaggagagagcccaggtgacccccgaggtgcagcccggctgcagaggccactgcagcagctacggcaagctgtgcagaaacggcggcaagtgcagagagagacccatcggcttcttctgcgactgcaccttcagcgcctacaccggccccttctgcagcaacgagatcagcgcctacttcggcagcggcagcagcgtgatctacaacttccaggagaactacctgctgagcaagaacagcagcagccacgccgccagcttccacggcgacatgaagctgagcagagagatgatcaagttcagcttcagaaccaccagaacccccagcctgctgctgttcgtgagcagcttctacaaggagtacctgagcgtgatcatcgccaagaacggcagcctgcagatcagatacaagctgaacaagtaccaggagcccgacgtggtgaacttcgacttcaagaacatggccgacggccagctgcaccacatcatgatcaacagagaggagggcgtggtgttcatcgagatcgacgacaacagaagaagacaggtgcacctgagcagcggcaccgagttcagcgccgtgaagagcctggtgctgggcagaatcctggagcacagcgacgtggaccaggacaccgccctggccggcgcccagggcttcaccggctgcctgagcgccgtgcagctgagccacgtggcccccctgaaggccgccctgcaccccagccaccccgaccccgtgaccgtgaccggccacgtgaccgagagcagctgcatggcccagcccggcaccgacgccaccagcagagagagaacccacagcttcgccgaccacagcggcaccatcgacgacagagagcccctggccaacgccatcaagagcgacagcgccgtgatcggcggcctgatcgccgtggtgatcttcatcctgctgtgcatcaccgccatcgccgtgagaatctaccagcagaagagactgtacaagagaagcgaggccaagagaagcgagaacgtggacagcgccgaggccgtgctgaagagcgagctgaacatccagaacgccgtgaacgagaaccagaaggagtacttcttctag

SEQ ID NO: 20174 - DNA, 1512 bp, Artificial Sequence
  Description of Artificial Sequence: Synthetic coding sequence
atgagcctgggcggcgccagcgagagaagcgtgcccgccaccaagatcgagatcaccgtgagctgcagaaacctgctggacctggacaccttcagcaagagcgaccccatggtggtgctgtacacccagagcagagccagccaggagtggagagagttcggcagaaccgaggtgatcgacaacaccctgaaccccgacttcgtgagaaagttcgtgctggactacttcttcgaggagaagcagaacctgagattcgacgtgtacaacgtggacagcaagaccaacatcagcaagcccaaggacttcctgggccaggccttcctggccctgggcgaggtgatcggcggccagggcagcagagtggagagaaccctgaccggcgtgcccggcaagaagtgcggcaccatcctgctgaccgccgaggagctgagcaactgcagagacatcgccaccatgcagctgtgcgccaacaagctggacaagaaggacttcttcggcaagagcgaccccttcctggtgttctacagaagcaacgaggacggcaccttcaccatctgccacaagaccgaggtggtgaagaacaccctgaaccccgtgtggcagcccttcagcatccccgtgagagccctgtgcaacggcgactacgacagaaccgtgaagatcgacgtgtacgactgggacagagacggcagccacgacttcatcggcgagttcaccaccagctacagagagctgagcaaggcccagaaccagttcaccgtgtacgaggtgctgaaccccagaaagaagtgcaagaagaagaagtacgtgaacagcggcaccgtgaccctgctgagcttcagcgtggacagcgagttcaccttcgtggactacatcaagggcggcacccagctgaacttcaccgtggccatcgacttcaccgccagcaacggcaaccccctgcagcccaccagcctgcactacatgagcccctaccagctgagcgcctacgccatggccctgaaggccgtgggcgagatcatccaggactacgacagcgacaagctgttccccgcctacggcttcggcgccaagctgccccccgagggcagaatcagccaccagttccccctgaacaacaacgacgaggaccccaactgcgccggcatcgagggcgtgctggagagctacttccagagcctgagaaccgtgcagctgtacggccccacctacttcgcccccgtgatcaaccaggtggccagagccgccgccaagatcagcgacggcagccagtactacgtgctgctgatcatcaccgacggcgtgatcagcgacatgacccagaccaaggaggccatcgtgagcgccagcagcctgcccatgagcatcatcatcgtgggcgtgggccccgccatgttcgaggccatggaggagctggacggcgacgacgtgagagtgagcagcagaggcagatacgccgagagagacatcgtgcaggagggctgctgcagcctgggcaccagcgtggtgtag

SEQ ID NO: 20175 - DNA, 1662 bp, Artificial Sequence
  Description of Artificial Sequence: Synthetic coding sequence
atgagcctgggcggcgccagcgagagaagcgtgcccgccaccaagatcgagatcaccgtgagctgcagaaacctgctggacctggacaccttcagcaagagcgaccccatggtggtgctgtacacccagagcagagccagccaggagtggagagagttcggcagaaccgaggtgatcgacaacaccctgaaccccgacttcgtgagaaagttcgtgctggactacttcttcgaggagaagcagaacctgagattcgacgtgtacaacgtggacagcaagaccaacatcagcaagcccaaggacttcctgggccaggccttcctggccctgggcgaggtgatcggcggccagggcagcagagtggagagaaccctgaccggcgtgcccggcaagaagtgcggcaccatcctgctgaccgccgaggagctgagcaactgcagagacatcgccaccatgcagctgtgcgccaacaagctggacaagaaggacttcttcggcaagagcgaccccttcctggtgttctacagaagcaacgaggacggcaccttcaccatctgccacaagaccgaggtggtgaagaacaccctgaaccccgtgtggcagcccttcagcatccccgtgagagccctgtgcaacggcgactacgacagaaccgtgaagatcgacgtgtacgactgggacagagacggcagccacgacttcatcggcgagttcaccaccagctacagagagctgagcaaggcccagaaccagttcaccgtgtacgaggtgctgaaccccagaaagaagtgcaagaagaagaagtacgtgaacagcggcaccgtgaccctgctgagcttcagcgtggacagcgagttcaccttcgtggactacatcaagggcggcacccagctgaacttcaccgtggccatcgacttcaccgccagcaacggcaaccccctgcagcccaccagcctgcactacatgagcccctaccagctgagcgcctacgccatggccctgaaggccgtgggcgagatcatccaggactacgacagcgacaagctgttccccgcctacggcttcggcgccaagctgccccccgagggcagaatcagccaccagttccccctgaacaacaacgacgaggaccccaactgcgccggcatcgagggcgtgctggagagctacttccagagcctgagaaccgtgcagctgtacggccccacctacttcgcccccgtgatcaaccaggtggccagagccgccgccaagatcagcgacggcagccagtactacgtgctgctgatcatcaccgacggcgtgatcagcgacatgacccagaccaaggaggccatcgtgagcgccagcagcctgcccatgagcatcatcatcgtgggcgtgggccccgccatgttcgaggccatggaggagctggacggcgacgacgtgagagtgagcagcagaggcagatacgccgagagagacatcgtgcagttcgtgcccttcagagactacgtggacagaagcggcaaccaggtgctgagcatggccagactggccaaggacgtgctggccgagatccccgagcagctgctgagctacatgagaaccagagacatccagcccagaccccccccccccgccaaccccagccccatccccgcccccgagcagccctag

SEQ ID NO: 20176 - DNA, 1614 bp, Artificial Sequence
  Description of Artificial Sequence: Synthetic coding sequence
atggcccactgcgtgaccctggtgcagctgagcatcagctgcgaccacctgatcgacaaggacatcggcagcaagagcgaccccctgtgcgtgctgctgcaggacgtgggcggcggcagctgggccgagctgggcagaaccgagagagtgagaaactgcagcagccccgagttcagcaagaccctgcagctggagtacagattcgagaccgtgcagaagctgagattcggcatctacgacatcgacaacaagacccccgagctgagagacgacgacttcctgggcggcgccgagtgcagcctgggccagatcgtgagcagccaggtgctgaccctgcccctgatgctgaagcccggcaagcccgccggcagaggcaccatcaccgtgagcgcccaggagctgaaggacaacagagtggtgaccatggaggtggaggccagaaacctggacaagaaggacttcctgggcaagagcgaccccttcctggagttcttcagacagggcgacggcaagtggcacctggtgtacagaagcgaggtgatcaagaacaacctgaaccccacctggaagagattcagcgtgcccgtgcagcacttctgcggcggcaaccccagcacccccatccaggtgcagtgcagcgactacgacagcgacggcagccacgacctgatcggcaccttccacaccagcctggcccagctgcaggccgtgcccgccgagttcgagtgcatccaccccgagaagcagcagaagaagaagagctacaagaacagcggcaccatcagagtgaagatctgcagagtggagaccgagtacagcttcctggactacgtgatgggcggctgccagatcaacttcaccgtgggcgtggacttcaccggcagcaacggcgaccccagcagccccgacagcctgcactacctgagccccaccggcgtgaacgagtacctgatggccctgtggagcgtgggcagcgtggtgcaggactacgacagcgacaagctgttccccgccttcggcttcggcgcccaggtgccccccgactggcaggtgagccacgagttcgccctgaacttcaaccccagcaacccctactgcgccggcatccagggcatcgtggacgcctacagacaggccctgccccaggtgagactgtacggccccaccaacttcgcccccatcatcaaccacgtggccagattcgccgcccaggccgcccaccagggcaccgccagccagtacttcatgctgctgctgctgaccgacggcgccgtgaccgacgtggaggccaccagagaggccgtggtgagagccagcaacctgcccatgagcgtgatcatcgtgggcgtgggcggcgccgacttcgaggccatggagcagctggacgccgacggcggccccctgcacaccagaagcggccaggccgccgccagagacatcgtgcagttcgtgccctacagaagattccagaacgcccccagagaggccctggcccagaccgtgctggccgaggtgcccacccagctggtgagctacttcagagcccagggctgggcccccctgaagcccctgccccccagcgccaaggaccccgcccaggccccccaggcctag

SEQ ID NO: 20177 - DNA, 1629 bp, Artificial Sequence
  Description of Artificial Sequence: Synthetic coding sequence
atgaagatgatgcacatggcccactgcgtgaccctggtgcagctgagcatcagctgcgaccacctgatcgacaaggacatcggcagcaagagcgaccccctgtgcgtgctgctgcaggacgtgggcggcggcagctgggccgagctgggcagaaccgagagagtgagaaactgcagcagccccgagttcagcaagaccctgcagctggagtacagattcgagaccgtgcagaagctgagattcggcatctacgacatcgacaacaagacccccgagctgagagacgacgacttcctgggcggcgccgagtgcagcctgggccagatcgtgagcagccaggtgctgaccctgcccctgatgctgaagcccggcaagcccgccggcagaggcaccatcaccgtgagcgcccaggagctgaaggacaacagagtggtgaccatggaggtggaggccagaaacctggacaagaaggacttcctgggcaagagcgaccccttcctggagttcttcagacagggcgacggcaagtggcacctggtgtacagaagcgaggtgatcaagaacaacctgaaccccacctggaagagattcagcgtgcccgtgcagcacttctgcggcggcaaccccagcacccccatccaggtgcagtgcagcgactacgacagcgacggcagccacgacctgatcggcaccttccacaccagcctggcccagctgcaggccgtgcccgccgagttcgagtgcatccaccccgagaagcagcagaagaagaagagctacaagaacagcggcaccatcagagtgaagatctgcagagtggagaccgagtacagcttcctggactacgtgatgggcggctgccagatcaacttcaccgtgggcgtggacttcaccggcagcaacggcgaccccagcagccccgacagcctgcactacctgagccccaccggcgtgaacgagtacctgatggccctgtggagcgtgggcagcgtggtgcaggactacgacagcgacaagctgttccccgccttcggcttcggcgcccaggtgccccccgactggcaggtgagccacgagttcgccctgaacttcaaccccagcaacccctactgcgccggcatccagggcatcgtggacgcctacagacaggccctgccccaggtgagactgtacggccccaccaacttcgcccccatcatcaaccacgtggccagattcgccgcccaggccgcccaccagggcaccgccagccagtacttcatgctgctgctgctgaccgacggcgccgtgaccgacgtggaggccaccagagaggccgtggtgagagccagcaacctgcccatgagcgtgatcatcgtgggcgtgggcggcgccgacttcgaggccatggagcagctggacgccgacggcggccccctgcacaccagaagcggccaggccgccgccagagacatcgtgcagttcgtgccctacagaagattccagaacgcccccagagaggccctggcccagaccgtgctggccgaggtgcccacccagctggtgagctacttcagagcccagggctgggcccccctgaagcccctgccccccagcgccaaggaccccgcccaggccccccaggcctag

SEQ ID NO: 20178 - DNA, 1614 bp, Artificial Sequence; identical to SEQ ID NO: 20176
  Description of Artificial Sequence: Synthetic coding sequence

SEQ ID NO: 20179 - DNA, 1614 bp, Artificial Sequence; identical to SEQ ID NO: 20176
  Description of Artificial Sequence: Synthetic coding sequence

SEQ ID NO: 20180 - DNA, 1614 bp, Artificial Sequence; identical to SEQ ID NO: 20176
  Description of Artificial Sequence: Synthetic coding sequence

SEQ ID NO: 20181 - DNA, 1614 bp, Artificial Sequence; identical to SEQ ID NO: 20176
  Description of Artificial Sequence: Synthetic coding sequence

SEQ ID NO: 20182 - DNA, 915 bp, Artificial Sequence
  Description of Artificial Sequence: Synthetic coding sequence
atggcccactgcgtgaccctggtgcagctgagcatcagctgcgaccacctgatcgacaaggacatcggcagcaagagcgaccccctgtgcgtgctgctgcaggacgtgggcggcggcagctgggccgagctgggcagaaccgagagagtgagaaactgcagcagccccgagttcagcaagaccctgcagctggagtacagattcgagaccgtgcagaagctgagattcggcatctacgacatcgacaacaagacccccgagctgagagacgacgacttcctgggcggcgccgagtgcagcctgggccagatcgtgagcagccaggtgctgaccctgcccctgatgctgaagcccggcaagcccgccggcagaggcaccatcaccgtgagcgcccaggagctgaaggacaacagagtggtgaccatggaggtggaggccagaaacctggacaagaaggacttcctgggcaagagcgaccccttcctggagttcttcagacagggcgacggcaagtggcacctggtgtacagaagcgaggtgatcaagaacaacctgaaccccacctggaagagattcagcgtgcccgtgcagcacttctgcggcggcaaccccagcacccccatccaggtgcagtgcagcgactacgacagcgacggcagccacgacctgatcggcaccttccacaccagcctggcccagctgcaggccgtgcccgccgagttcgagtgcatccaccccgagaagcagcagaagaagaagagctacaagaacagcggcaccatcagagtgaagatctgcagagtggagaccgagtacagcttcctggactacgtgatgggcggctgccagatcaacttcaccgtgggcgtggacttcaccggcagcaacggcgaccccagcagccccgacagctag

SEQ ID NO: 20183 - DNA, 411 bp, Artificial Sequence
  Description of Artificial Sequence: Synthetic coding sequence
atggcccactgcgtgaccctggtgcagctgagcatcagctgcgaccacctgatcgacaaggacatcggcagcaagagcgaccccctgtgcgtgctgctgcaggacgtgggcggcggcagctgggccgagctgggcagaaccgagagagtgagaaactgcagcagccccgagttcagcaagaccctgcagctggagtacagattcgagaccgtgcagaagctgagattcggcatctacgacatcgacaacaagacccccgagctgagagacgacgacttcctgggcggcgccgagtgcagcctgggccagatcgtgagcagccaggtgctgaccctgcccctgatgctgaagcccggcaagcccgccggcagaggcaccatcaccgtgagcgcccaggagctgaaggactag

SEQ ID NO: 20184 - DNA, 630 bp, Artificial Sequence
  Description of Artificial Sequence: Synthetic coding sequence
atggcccactgcgtgaccctggtgcagctgagcatcagctgcgaccacctgatcgacaaggacatcggcagcaagagcgaccccctgtgcgtgctgctgcaggacgtgggcggcggcagctgggccgagctgggcagaaccgagagagtgagaaactgcagcagccccgagttcagcaagaccctgcagctggagtacagattcgagaccgtgcagaagctgagattcggcatctacgacatcgacaacaagacccccgagctgagagacgacgacttcctgggcggcgccgagtgcagcctgggccagatcgtgagcagccaggtgctgaccctgcccctgatgctgaagcccggcaagcccgccggcagaggcaccatcaccgtgagcgcccaggagctgaaggacaacagagtggtgaccatggaggtggaggccagaaacctggacaagaaggacttcctgggcaagagcgaccccttcctggagttcttcagacagggcgacggcaagtggcacctggtgtacagaagcgaggtgatcaagaacaacctgaaccccacctggaagagattcagcgtgcccgtgcagcacttctgcggcggcaaccccagcacccccatccagtag

SEQ ID NO: 20185 - DNA, 609 bp, Artificial Sequence
  Description of Artificial Sequence: Synthetic coding sequence
atggcccactgcgtgaccctggtgcagctgagcatcagctgcgaccacctgatcgacaaggacatcggcagcaagagcgaccccctgtgcgtgctgctgcaggacgtgggcggcggcagctgggccgagctgggcagaaccgagagagtgagaaactgcagcagccccgagttcagcaagaccctgcagctggagtacagattcgagaccgtgcagaagctgagattcggcatctacgacatcgacaacaagacccccgagctgagagacgacgacttcctgggcggcgccgagtgcagcctgggccagatcgtgagcagccaggtgctgaccctgcccctgatgctgaagcccggcaagcccgccggcagaggcaccatcaccgtgagcgcccaggagctgaaggacaacagagtggtgaccatggaggtggaggccagaaacctggacaagaaggacttcctgggcaagagcgaccccttcctggagttcttcagacagggcgacggcaagtggcacctggtgtacagaagcgaggtgatcaagaacaacctgaaccccacctggaagagattcagcgtgcccgtgcagcacttctgcggcggctag

SEQ ID NO: 20186 - DNA, 204 bp, Artificial Sequence
  Description of Artificial Sequence: Synthetic coding sequence
atggcccactgcgtgaccctggtgcagctgagcatcagctgcgaccacctgatcgacaaggacatcggcagcaagagcgaccccctgtgcgtgctgctgcaggacgtgggcggcggcagctgggccgagctgggcagaaccgagagagtgagaaactgcagcagccccgagttcagcaagaccctgcagctggagtacagatag

SEQ ID NO: 20187 - DNA, 459 bp, Artificial Sequence
  Description of Artificial Sequence: Synthetic coding sequence
atggcccactgcgtgaccctggtgcagctgagcatcagctgcgaccacctgatcgacaaggacatcggcagcaagagcgaccccctgtgcgtgctgctgcaggacgtgggcggcggcagctgggccgagctgggcagaaccgagagagtgagaaactgcagcagccccgagttcagcaagaccctgcagctggagtacagattcgagaccgtgcagaagctgagattcggcatctacgacatcgacaacaagacccccgagctgagagacgacgacttcctgggcggcgccgagtgcagcctgggccagatcgtgagcagccaggtgctgaccctgcccctgatgctgaagcccggcaagcccgccggcagaggcaccatcaccgtgagcgcccaggagctgaaggacaacagagtggtgaccatggaggtggaggccagaaacctggacaagaagtag

SEQ ID NO: 20188 - DNA, 696 bp, Artificial Sequence
  Description of Artificial Sequence: Synthetic coding sequence
atggcccactgcgtgaccctggtgcagctgagcatcagctgcgaccacctgatcgacaaggacatcggcagcaagagcgaccccctgtgcgtgctgctgcaggacgtgggcggcggcagctgggccgagctgggcagaaccgagagagtgagaaactgcagcagccccgagttcagcaagaccctgcagctggagtacagattcgagaccgtgcagaagctgagattcggcatctacgacatcgacaacaagacccccgagctgagagacgacgacttcctgggcggcgccgagtgcagcctgggccagatcgtgagcagccaggtgctgaccctgcccctgatgctgaagcccggcaagcccgccggcagaggcaccatcaccgtgagcgcccaggagctgaaggacaacagagtggtgaccatggaggtggaggccagaaacctggacaagaaggacttcctgggcaagagcgaccccttcctggagttcttcagacagggcgacggcaagtggcacctggtgtacagaagcgaggtgatcaagaacaacctgaaccccacctggaagagattcagcgtgcccgtgcagcacttctgcggcggcaaccccagcacccccatccaggtgcagtgcagcgactacgacagcgacggcagccacgacctgatcggcaccttccacaccagcctgtag

SEQ ID NO: 20189 - DNA, 525 bp, Artificial Sequence
  Description of Artificial Sequence: Synthetic coding sequence
atggcccactgcgtgaccctggtgcagctgagcatcagctgcgaccacctgatcgacaaggacatcggcagcaagagcgaccccctgtgcgtgctgctgcaggacgtgggcggcggcagctgggccgagctgggcagaaccgagagagtgagaaactgcagcagccccgagttcagcaagaccctgcagctggagtacagattcgagaccgtgcagaagctgagattcggcatctacgacatcgacaacaagacccccgagctgagagacgacgacttcctgggcggcgccgagtgcagcctgggccagatcgtgagcagccaggtgctgaccctgcccctgatgctgaagcccggcaagcccgccggcagaggcaccatcaccgtgagcgcccaggagctgaaggacaacagagtggtgaccatggaggtggaggccagaaacctggacaagaaggacttcctgggcaagagcgaccccttcctggagttcttcagacagggcgacggcaagtggcacctgtag

SEQ ID NO: 20190 - DNA, 1647 bp, Artificial Sequence
  Description of Artificial Sequence: Synthetic coding sequence
atggcccacatccccagcggcggcgcccccgccgccggcgccgcccccatgggcccccagtactgcgtgtgcaaggtggagctgagcgtgagcggccagaacctgctggacagagacgtgaccagcaagagcgaccccttctgcgtgctgttcaccgagaacaacggcagatggatcgagtacgacagaaccgagaccgccatcaacaacctgaaccccgccttcagcaagaagttcgtgctggactaccacttcgaggaggtgcagaagctgaagttcgccctgttcgaccaggacaagagcagcatgagactggacgagcacgacttcctgggccagttcagctgcagcctgggcaccatcgtgagcagcaagaagatcaccagacccctgctgctgctgaacgacaagcccgccggcaagggcctgatcaccatcgccgcccaggagctgagcgacaacagagtgatcaccctgagcctggccggcagaagactggacaagaaggacctgttcggcaagagcgaccccttcctggagttctacaagcccggcgacgacggcaagtggatgctggtgcacagaaccgaggtgatcaagtacaccctggaccccgtgtggaagcccttcaccgtgcccctggtgagcctgtgcgacggcgacatggagaagcccatccaggtgatgtgctacgactacgacaacgacggcggccacgacttcatcggcgagttccagaccagcgtgagccagatgtgcgaggccagagacagcgtgcccctggagttcgagtgcatcaaccccaagaagcagagaaagaagaagaactacaagaacagcggcatcatcatcctgagaagctgcaagatcaacagagactacagcttcctggactacatcctgggcggctgccagctgatgttcaccgtgggcatcgacttcaccgccagcaacggcaaccccctggaccccagcagcctgcactacatcaaccccatgggcaccaacgagtacctgagcgccatctgggccgtgggccagatcatccaggactacgacagcgacaagatgttccccgccctgggcttcggcgcccagctgccccccgactggaaggtgagccacgagttcgccatcaacttcaaccccaccaaccccttctgcagcggcgtggacggcatcgcccaggcctacagcgcctgcctgccccacatcagattctacggccccaccaacttcagccccatcgtgaaccacgtggccagattcgccgcccaggccacccagcagagaaccgccacccagtacttcatcctgctgatcatcaccgacggcgtgatcagcgacatggaggagaccagacacgccgtggtgcaggccagcaagctgcccatgagcatcatcatcgtgggcgtgggcaacgccgacttcgccgccatggagttcctggacggcgacagcagaatgctgagaagccacaccggcgaggaggccgccagagacatcgtgcagttcgtgcccttcagagagttcagaaacgccgccaaggagaccctggccaaggccgtgctggccgagctgccccagcaggtggtgcagtacttcaagcacaagaacctgccccccaccaacagcgagcccgcctag

SEQ ID NO: 20191 - DNA, 1647 bp, Artificial Sequence; identical to SEQ ID NO: 20190
  Description of Artificial Sequence: Synthetic coding sequence

SEQ ID NO: 20192 - DNA, 1341 bp, Artificial Sequence
  Description of Artificial Sequence: Synthetic coding sequence
atgagactggacgagcacgacttcctgggccagttcagctgcagcctgggcaccatcgtgagcagcaagaagatcaccagacccctgctgctgctgaacgacaagcccgccggcaagggcctgatcaccatcgccgcccaggagctgagcgacaacagagtgatcaccctgagcctggccggcagaagactggacaagaaggacctgttcggcaagagcgaccccttcctggagttctacaagcccggcgacgacggcaagtggatgctggtgcacagaaccgaggtgatcaagtacaccctggaccccgtgtggaagcccttcaccgtgcccctggtgagcctgtgcgacggcgacatggagaagcccatccaggtgatgtgctacgactacgacaacgacggcggccacgacttcatcggcgagttccagaccagcgtgagccagatgtgcgaggccagagacagcgtgcccctggagttcgagtgcatcaaccccaagaagcagagaaagaagaagaactacaagaacagcggcatcatcatcctgagaagctgcaagatcaacagagactacagcttcctggactacatcctgggcggctgccagctgatgttcaccgtgggcatcgacttcaccgccagcaacggcaaccccctggaccccagcagcctgcactacatcaaccccatgggcaccaacgagtacctgagcgccatctgggccgtgggccagatcatccaggactacgacagcgacaagatgttccccgccctgggcttcggcgcccagctgccccccgactggaaggtgagccacgagttcgccatcaacttcaaccccaccaaccccttctgcagcggcgtggacggcatcgcccaggcctacagcgcctgcctgccccacatcagattctacggccccaccaacttcagccccatcgtgaaccacgtggccagattcgccgcccaggccacccagcagagaaccgccacccagtacttcatcctgctgatcatcaccgacggcgtgatcagcgacatggaggagaccagacacgccgtggtgcaggccagcaagctgcccatgagcatcatcatcgtgggcgtgggcaacgccgacttcgccgccatggagttcctggacggcgacagcagaatgctgagaagccacaccggcgaggaggccgccagagacatcgtgcagttcgtgcccttcagagagttcagaaacgccgccaaggagaccctggccaaggccgtgctggccgagctgccccagcaggtggtgcagtacttcaagcacaagaacctgccccccaccaacagcgagcccgcctag

SEQ ID NO: 20193 - DNA, 1674 bp, Artificial Sequence
  Description of Artificial Sequence: Synthetic coding sequence
atgaagaagatgagcaacatctacgagagcgccgccaacaccctgggcatcttcaacagcccctgcctgaccaaggtggagctgagagtggcctgcaagggcatcagcgacagagacgccctgagcaagcccgacccctgcgtgatcctgaagatgcagagccacggccagtggttcgaggtggacagaaccgaggtgatcagaacctgcatcaaccccgtgtacagcaagctgttcaccgtggacttctacttcgaggaggtgcagagactgagattcgaggtgcacgacatcagcagcaaccacaacggcctgaaggaggccgacttcctgggcggcatggagtgcaccctgggccagatcgtgagccagagaaagctgagcaagagcctgctgaagcacggcaacaccgccggcaagagcagcatcaccgtgatcgccgaggagctgagcggcaacgacgactacgtggagctggccttcaacgccagaaagctggacgacaaggacttcttcagcaagagcgaccccttcctggagatcttcagaatgaacgacgacgccacccagcagctggtgcacagaaccgaggtggtgatgaacaacctgagccccgcctggaagagcttcaaggtgagcgtgaacagcctgtgcagcggcgaccccgacagaagactgaagtgcatcgtgtgggactgggacagcaacggcaagcacgacttcatcggcgagttcaccagcaccttcaaggagatgagaggcgccatggagggcaagcaggtgcagtgggagtgcatcaaccccaagtacaaggccaagaagaagaactacaagaacagcggcaccgtgatcctgaacctgtgcaagatccacaagatgcacagcttcctggactacatcatgggcggctgccagatccagttcaccgtggccatcgacttcaccgccagcaacggcgaccccagaaacagctgcagcctgcactacatccacccctaccagcccaacgagtacctgaaggccctggtggccgtgggcgagatctgccaggactacgacagcgacaagatgttccccgccttcggcttcggcgccagaatcccccccgagtacaccgtgagccacgacttcgccatcaacttcaacgaggacaaccccgagtgcgccggcatccagggcgtggtggaggcctaccagagctgcctgcccaagctgcagctgtacggccccaccaacatcgcccccatcatccagaaggtggccaagagcgccagcgaggagaccaacaccaaggaggccagccagtacttcatcctgctgatcctgaccgacggcgtgatcaccgacatggccgacaccagagaggccatcgtgcacgccagccacctgcccatgagcgtgatcatcgtgggcgtgggcaacgccgacttcagcgacatgcagatgctggacggcgacgacggcatcctgagaagccccaagggcgagcccgtgctgagagacatcgtgcagttcgtgcccttcagaaacttcaagcacgccagccccgccgccctggccaagagcgtgctggccgaggtgcccaaccaggtggtggactactacaacggcaagggcatcaagcccaagtgcagcagcgagatgtacgagagcagcagaaccctggccccctag

SEQ ID NO: 20194 - DNA, 1728 bp, Artificial Sequence
  Description of Artificial Sequence: Synthetic coding sequence
atggccgtggagcccagcagcagcgagagcatcaagagaagagccggcagaagaatgaagaagatgagcaacatctacgagagcgccgccaacaccctgggcatcttcaacagcccctgcctgaccaaggtggagctgagagtggcctgcaagggcatcagcgacagagacgccctgagcaagcccgacccctgcgtgatcctgaagatgcagagccacggccagtggttcgaggtggacagaaccgaggtgatcagaacctgcatcaaccccgtgtacagcaagctgttcaccgtggacttctacttcgaggaggtgcagagactgagattcgaggtgcacgacatcagcagcaaccacaacggcctgaaggaggccgacttcctgggcggcatggagtgcaccctgggccagatcgtgagccagagaaagctgagcaagagcctgctgaagcacggcaacaccgccggcaagagcagcatcaccgtgatcgccgaggagctgagcggcaacgacgactacgtggagctggccttcaacgccagaaagctggacgacaaggacttcttcagcaagagcgaccccttcctggagatcttcagaatgaacgacgacgccacccagcagctggtgcacagaaccgaggtggtgatgaacaacctgagccccgcctggaagagcttcaaggtgagcgtgaacagcctgtgcagcggcgaccccgacagaagactgaagtgcatcgtgtgggactgggacagcaacggcaagcacgacttcatcggcgagttcaccagcaccttcaaggagatgagaggcgccatggagggcaagcaggtgcagtgggagtgcatcaaccccaagtacaaggccaagaagaagaactacaagaacagcggcaccgtgatcctgaacctgtgcaagatccacaagatgcacagcttcctggactacatcatgggcggctgccagatccagttcaccgtggccatcgacttcaccgccagcaacggcgaccccagaaacagctgcagcctgcactacatccacccctaccagcccaacgagtacctgaaggccctggtggccgtgggcgagatctgccaggactacgacagcgacaagatgttccccgccttcggcttcggcgccagaatcccccccgagtacaccgtgagccacgacttcgccatcaacttcaacgaggacaaccccgagtgcgccggcatccagggcgtggtggaggcctaccagagctgcctgcccaagctgcagctgtacggccccaccaacatcgcccccatcatccagaaggtggccaagagcgccagcgaggagaccaacaccaaggaggccagccagtacttcatcctgctgatcctgaccgacggcgtgatcaccgacatggccgacaccagagaggccatcgtgcacgccagccacctgcccatgagcgtgatcatcgtgggcgtgggcaacgccgacttcagcgacatgcagatgctggacggcgacgacggcatcctgagaagccccaagggcgagcccgtgctgagagacatcgtgcagttcgtgcccttcagaaacttcaagcacgccagccccgccgccctggccaagagcgtgctggccgaggtgcccaaccaggtggtggactactacaacggcaagggcatcaagcccaagtgcagcagcgagatgtacgagagcagcagaaccctggccccctag

SEQ ID NO: 20195 - DNA, 510 bp, Artificial Sequence
  Description of Artificial Sequence: Synthetic coding sequence
atgaagaagatgagcaacatctacgagagcgccgccaacaccctgggcatcttcaacagcccctgcctgaccaaggtggagctgagagtggcctgcaagggcatcagcgacagagacgccctgagcaagcccgacccctgcgtgatcctgaagatgcagagccacggccagtggttcgaggtggacagaaccgaggtgatcagaacctgcatcaaccccgtgtacagcaagctgttcaccgtggacttctacttcgaggaggtgcagagactgagattcgaggtgcacgacatcagcagcaaccacaacggcctgaaggaggccgacttcctgggcggcatggagtgcaccctgggccagatcgtgagccagagaaagctgagcaagagcctgctgaagcacggcaacaccgccggcaagagcagcatcaccgtgatcgccgaggagctgagcggcaacgacgactacgtggagctggccttcaacgccagaaagctggacgacaagtag

SEQ ID NO: 20196 - DNA, 1674 bp, Artificial Sequence; identical to SEQ ID NO: 20193
  Description of Artificial Sequence: Synthetic coding sequence

SEQ ID NO: 20197 - DNA, 1728 bp, Artificial Sequence; identical to SEQ ID NO: 20194
  Description of Artificial Sequence: Synthetic coding sequence

SEQ ID NO: 20198 - DNA, 1695 bp, Artificial Sequence
  Description of Artificial Sequence: Synthetic coding sequence
atggacagcagatacaacagcaccgccggcatcggcgacctgaaccagctgagcgccgccatccccgccaccagagtggaggtgagcgtgagctgcagaaacctgctggacagagacaccttcagcaagagcgaccccatctgcgtgctgtacgtgcagggcgtgggcaacaaggagtggagagagttcggcagaaccgaggtgatcgacaacaccctgaaccccgacttcgtgagaaagttcatcctggactacttcttcgaggagagagagaacctgagattcgacctgtacgacgtggacagcaagagccccaacctgagcaagcacgacttcctgggccaggtgttctgcaccctgggcgagatcgtgggcagccagggcagcagactggagaagcccatcgtgggcatccccggcaagaagtgcggcaccatcatcctgaccgccgaggagctgaactgctgcagagacgccgtgctgatgcagttctgcgccaacaagctggacaagaaggacttcttcggcaagagcgaccccttcctggtgttctacagaagcaacgaggacggcagcttcaccatctgccacaagaccgaggtggtgaagaacaccctgaaccccgtgtggcaggccttcaagatcagcgtgagagccctgtgcaacggcgactacgacagaaccatcaaggtggaggtgtacgactgggacagagacggcagccacgacttcatcggcgagttcaccaccagctacagagagctgagcagaggccagagccagttcaacgtgtacgaggtggtgaaccccaagaagaagggcaagaagaagaagtacaccaacagcggcaccgtgaccctgctgagcttcctggtggagaccgaggtgagcttcctggactacatcaagggcggcacccagatcaacttcaccgtggccatcgacttcaccgccagcaacggcaaccccgcccagcccaccagcctgcactacatgaacccctaccagctgaacgcctacggcatggccctgaaggccgtgggcgagatcgtgcaggactacgacagcgacaagatgttccccgccctgggcttcggcgccaagctgccccccgacggcagaatcagccacgagttcgccctgaacggcaacccccagaacccctactgcgacggcatcgagggcgtgatggaggcctactacagaagcctgaagagcgtgcagctgtacggccccaccaacttcgcccccgtgatcaaccacgtggccagatacgccagcagcgtgaaggacggcagccagtacttcgtgctgctgatcgtgaccgacggcgtgatcagcgacatggcccagaccaaggagagcatcgtgaacgccagcaagctgcccatgagcatcatcatcgtgggcgtgggccccgccgagttcgacgccatggtggagctggacggcgacgacgtgagagtgagcagcagaggcaagtacgccgagagagacatcgtgcagttcgtgcccttcagagactacatcgacagaagcggcaaccacatcctgagcatggccagactggccaaggacgtgctggccgagatccccgagcagttcctgagctacatgagagccagaggcatcaagcccagccccgccccccccccctacaccccccccacccacgtgctgcagacccagatctag

SEQ ID NO: 20199 - DNA, 3786 bp, Artificial Sequence
  Description of Artificial Sequence: Synthetic coding sequence
atggacgcccccagagccagcgccgccaagccccccaccggcagaaagatgaaggccagagccccccccccccccggcaaggccgccaccctgcacgtgcacagcgaccagaagcccccccacgacggcgccctgggcagccagcagaacctggtgagaatgaaggaggccctgagagccagcaccatggacgtgaccgtggtgctgcccagcggcctggagaagagaagcgtgctgaacggcagccacgccatgatggacctgctggtggagctgtgcctgcagaaccacctgaaccccagccaccacgccctggagatcagaagcagcgagacccagcagcccctgagcttcaagcccaacaccctgatcggcaccctgaacgtgcacaccgtgttcctgaaggagaaggtgcccgaggagaaggtgaagcccggcccccccaaggtgcccgagaagagcgtgagactggtggtgaactacctgagaacccagaaggccgtggtgagagtgagccccgaggtgcccctgcagaacatcctgcccgtgatctgcgccaagtgcgaggtgagccccgagcacgtggtgctgctgagagacaacatcgccggcgaggagctggagctgagcaagagcctgaacgagctgggcatcaaggagctgtacgcctgggacaacagaagagagaccttcagaaagagcagcctgggcaacgacgagaccgacaaggagaagaagaagttcctgggcttcttcaaggtgaacaagagaagcaacagcaagggctgcctgaccacccccaacagccccagcatgcacagcagaagcctgaccctgggccccagcctgagcctgggcagcatcagcggcgtgagcgtgaagagcgagatgaagaagagaagagccccccccccccccggcagcggcccccccgtgcaggacaaggccagcgagaaggtgagcctgggcagccagatcgacctgcagaagaagaagagaagagcccccgcccccccccccccccagccccccccccccagccccctgatccccaacagaaccgaggacaaggaggagaacagaaagagcaccatggtgagcctgcccctgggcagcggcagccactgcagccccgacggcgccccccaggtgctgagcgaggccgaggagaccgtgagcgtgggcagctgcttcgccagcgaggacaccaccgaggacagcggcgtgatgagcagccccagcgacatcgtgagcctggacagccagcaggacagcatgaagtacaaggacaagtgggccaccgaccaggaggactgcagcgaccaggacctggccggcacccccgacctgggcccccagaagagccccctgtgggagaagaacggcagcgagaacagccacctgagaaccgagaaggccgtgaccgccagcaacgacgaggaggacctgctgatcgccggcgagttcagaaagaccctggccgagctggacgaggacctggaggagatggaggacagctacgagaccgacaccagcagcctgaccagcagcatccacggcgccagcaaccactgcccccaggacgccatgatcccccacggcgacaccgacgccatccccgtgaccttcatcggcgaggtgagcgacgaccccgtggacagcggcctgttcagcaacagaaacaacaacgccggcagcttcgacagcgagggcgtggccagcagaagagacagcctggcccccctgcaggccgagcacagccagccccacgagaaggccagagaggaggtgcccgccctgcaccccgccagccacgacgtgggcaagggcatcagagtggccctgagcaacatcagcaaggacggcaacctgatggagaccgcccccagagtgaccagcttcgccagcaacctgcacaccgacaacctgaacgccaaggtgaaggacaaggtgtacggctgcgccgacggcgagagaacccaggccaccgagagagtgaacagccagcccgtgaacgagaaggacagcaacgacaagaacgccgccctggcccccaccagctggcaccagagaggccagaaccccggcaagagctacagactgaagcacggcctgaccacctacaagatcatcccccccaagagcgagatgagatgctacgacagagacgtgagcctgagcaccggcgccatcaagatcgacgagctgggcaacctggtgagcccccacgccaccggcatcagaatcatcagcctgagcagcagcgtgcccgaggccgagagccagcccatcggcaaggtgagagagttctggagatgcaacagcgtggagaagcacctgggcagacccagcgagagcagcgccagaggcccccccagcacccccgtgcccacccagacccagaaccccgagagcagactgcaggccgaccccaagcccatcagcccccagcagaagagcgcccaccacgagggcagaaaccccctgggcgagggcagaaaccagccccccaccatgggcatgggccacgtgagagtgcccgccgcccacaccaccgaggtgaccttcctgaagccccagagaagaaccagcagccagtacgtggccagcgccatcgccaagagaatcggcgcccccaaggtgcacgccgacgtggtgagaccccacggctacgccgagaagggctacgccggcaaggcccccgtgctggccgccccccccgtgaccgtgaaggacgacagaaccagcagcccccacagcgagacccagggctggaaggacggcgcccagtggccctgcgtgaccccccccaacaaccacggcgaggacctggccgtgggcgccccccccagaggcgaggtgatcggcccccacagaaagctgagcacccaggacagacccgccgccatccacagaagcagctgcttcagcctggtgcagagcagccagagagacagagtgagcgtgggccagagctgcggcttcagcggcaagcagagcaccagcagccaggaggccagcagcgccagcgagcccagaagagcccccgacggcaccgaccccccccccccccacaccagcgacacccaggcctgcagcagagagctggtgaacggcagcgtgagagcccccggccacggcgagcccagccacccccccggcggcagcggcaccgagagccacatcctgctggagagagaggagaagcccagcgtgttcagcaccgacggcaacgagaccgacagcatctggccccccagcatcttcggccccaagaagaagttcaagcccgtggtgcagagacccgtgcccaaggacaccagcctgcacagcgccctgatggaggccatccacagcgccggcggcaaggacagactgagaaagaccgccgagcacaccggcgagggcagacccgccaagctgagctacaccgaggccgagggcgagagaagcgccctgctggccgccatcagaggccacagcggcacctgcagcctgagaaaggtggccagcagcgccagcgaggagctgcagagcttcagagacgccgccctgagcgcccagggcagcgagagccccctgctggaggacctgggcctgctgagcccccccgccatccccccccccccccccccccccagccaggccctgagcgcccccagaaccgccagcagattcagcaccggcaccctgagcaacaccgccgacgccagacaggccctgatggacgccatcagaagcggcaccggcgccgccagactgagaaaggtgcccctgctggtgtag

SEQ ID NO: 20200 - DNA, 1410 bp, Artificial Sequence
  Description of Artificial Sequence: Synthetic coding sequence
atggacgcccccagagccagcgccgccaagccccccaccggcagaaagatgaaggccagagccccccccccccccggcaaggccgccaccctgcacgtgcacagcgaccagaagcccccccacgacggcgccctgggcagccagcagaacctggtgagaatgaaggaggccctgagagccagcaccatggacgtgaccgtggtgctgcccagcggcctggagaagagaagcgtgctgaacggcagccacgccatgatggacctgctggtggagctgtgcctgcagaaccacctgaaccccagccaccacgccctggagatcagaagcagcgagacccagcagcccctgagcttcaagcccaacaccctgatcggcaccctgaacgtgcacaccgtgttcctgaaggagaaggtgcccgaggagaaggtgaagcccggcccccccaaggtgcccgagaagagcgtgagactggtggtgaactacctgagaacccagaaggccgtggtgagagtgagccccgaggtgcccctgcagaacatcctgcccgtgatctgcgccaagtgcgaggtgagccccgagcacgtggtgctgctgagagacaacatcgccggcgaggagctggagctgagcaagagcctgaacgagctgggcatcaaggagctgtacgcctgggacaacagaagagagaccttcagaaagagcagcctgggcaacgacgagaccgacaaggagaagaagaagttcctgggcttcttcaaggtgaacaagagaagcaacagcaagggctgcctgaccacccccaacagccccagcatgcacagcagaagcctgaccctgggccccagcctgagcctgggcagcatcagcggcgtgagcgtgaagagcgagatgaagaagagaagagccccccccccccccggcagcggcccccccgtgcaggacaaggccagcgagaaggtgagcctgggcagccagatcgacctgcagaagaagaagagaagagcccccgcccccccccccccccagccccccccccccagccccctgatccccaacagaaccgaggacaaggaggagaacagaaagagcaccatggtgtacggcgccgccgaggccgtgatcagactgctgagcctgctgctgaacaccaccgcccccggcaccgccaagcccagaaccctgtggatgagcgagggcagaagcagcctgcacaaccccgagatcaagtgcagctgcttcagcagcagcagccccttcccccagagcctgctgagcctgctgctgggcctgagcagcatctgcgagtgcatgtgcaccctgagacacacccacgcccacacccacaaccccagctgcgtgctgcccaccagcgagatcctggccttcggcagacagagcctgatcagctag

SEQ ID NO: 20201 - DNA, 4032 bp, Artificial Sequence
  Description of Artificial Sequence: Synthetic coding sequence
atggacgcccccagagccagcgccgccaagccccccaccggcagaaagatgaaggccagagccccccccccccccggcaaggccgccaccctgcacgtgcacagcgaccagaagcccccccacgacggcgccctgggcagccagcagaacctggtgagaatgaaggaggccctgagagccagcaccatggacgtgaccgtggtgctgcccagcggcctggagaagagaagcgtgctgaacggcagccacgccatgatggacctgctggtggagctgtgcctgcagaaccacctgaaccccagccaccacgccctggagatcagaagcagcgagacccagcagcccctgagcttcaagcccaacaccctgatcggcaccctgaacgtgcacaccgtgttcctgaaggagaaggtgcccgaggagaaggtgaagcccggcccccccaaggtgcccgagaagagcgtgagactggtggtgaactacctgagaacccagaaggccgtggtgagagtgagccccgaggtgcccctgcagaacatcctgcccgtgatctgcgccaagtgcgaggtgagccccgagcacgtggtgctgctgagagacaacatcgccggcgaggagctggagctgagcaagagcctgaacgagctgggcatcaaggagctgtacgcctgggacaacagaagagagaccttcagaaagagcagcctgggcaacgacgagaccgacaaggagaagaagaagttcctgggcttcttcaaggtgaacaagagaagcaacagcaaggccgagcagctggtgctgagcggcgccgacagcgacgaggacaccagcagagccgcccccggcagaggcctgaacggctgcctgaccacccccaacagccccagcatgcacagcagaagcctgaccctgggccccagcctgagcctgggcagcatcagcggcgtgagcgtgaagagcgagatgaagaagagaagagccccccccccccccggcagcggcccccccgtgcaggacaaggccagcgagaaggtgagcctgggcagccagatcgacctgcagaagaagaagagaagagcccccgcccccccccccccccagccccccccccccagccccctgatccccaacagaaccgaggacaaggaggagaacagaaagagcaccatgggcggcggcagacaggtgccccagaagccccccagaggcaccgccagaggccccccccagctggtgctgccccccccccccccctaccccccccccgacaccgacgtggtggagcccctgagcttccccggcgagggcgccggcagcgaggccagcgaccccatccccaagctgagcctgcccctgggcagcggcagccactgcagccccgacggcgccccccaggtgctgagcgaggccgaggagaccgtgagcgtgggcagctgcttcgccagcgaggacaccaccgaggacagcggcgtgatgagcagccccagcgacatcgtgagcctggacagccagcaggacagcatgaagtacaaggacaagtgggccaccgaccaggaggactgcagcgaccaggacctggccggcacccccgacctgggcccccagaagagccccctgtgggagaagaacggcagcgagaacagccacctgagaaccgagaaggccgtgaccgccagcaacgacgaggaggacctgctgatcgccggcgagttcagaaagaccctggccgagctggacgaggacctggaggagatggaggacagctacgagaccgacaccagcagcctgaccagcagcatccacggcgccagcaaccactgcccccaggacgccatgatcccccacggcgacaccgacgccatccccgtgaccttcatcggcgaggtgagcgacgaccccgtggacagcggcctgttcagcaacagaaacaacaacgccggcagcttcgacagcgagggcgtggccagcagaagagacagcctggcccccctgcaggccgagcacagccagccccacgagaaggccagagaggaggtgcccgccctgcaccccgccagccacgacgtgggcaagggcatcagagtggccctgagcaacatcagcaaggacggcaacctgatggagaccgcccccagagtgaccagcttcgccagcaacctgcacaccgacaacctgaacgccaaggtgaaggacaaggtgtacggctgcgccgacggcgagagaacccaggccaccgagagagtgaacagccagcccgtgaacgagaaggacagcaacgacaagaacgccgccctggcccccaccagctggcaccagagaggccagaaccccggcaagagctacagactgaagcacggcctgaccacctacaagatcatcccccccaagagcgagatgagatgctacgacagagacgtgagcctgagcaccggcgccatcaagatcgacgagctgggcaacctggtgagcccccacgccaccggcatcagaatcatcagcctgagcagcagcgtgcccgaggccgagagccagcccatcggcaaggtgagagagttctggagatgcaacagcgtggagaagcacctgggcagacccagcgagagcagcgccagaggcccccccagcacccccgtgcccacccagacccagaaccccgagagcagactgcaggccgaccccaagcccatcagcccccagcagaagagcgcccaccacgagggcagaaaccccctgggcgagggcagaaaccagccccccaccatgggcatgggccacgtgagagtgcccgccgcccacaccaccgaggtgaccttcctgaagccccagagaagaaccagcagccagtacgtggccagcgccatcgccaagagaatcggcgcccccaaggtgcacgccgacgtggtgagaccccacggctacgccgagaagggctacgccggcaaggcccccgtgctggccgccccccccgtgaccgtgaaggacgacagaaccagcagcccccacagcgagacccagggctggaaggacggcgcccagtggccctgcgtgaccccccccaacaaccacggcgaggacctggccgtgggcgccccccccagaggcgaggtgatcggcccccacagaaagctgagcacccaggacagacccgccgccatccacagaagcagctgcttcagcctggtgcagagcagccagagagacagagtgagcgtgggccagagctgcggcttcagcggcaagcagagcaccagcagccaggaggccagcagcgccagcgagcccagaagagcccccgacggcaccgaccccccccccccccacaccagcgacacccaggcctgcagcagagagctggtgaacggcagcgtgagagcccccggccacggcgagcccagccacccccccggcggcagcggcaccgagagccacatcctgctggagagagaggagaagcccagcgtgttcagcaccgacggcaacgagaccgacagcatctggccccccagcatcttcggccccaagaagaagttcaagcccgtggtgcagagacccgtgcccaaggacaccagcctgcacagcgccctgatggaggccatccacagcgccggcggcaaggacagactgagaaagaccgccgagcacaccggcgagggcagacccgccaagctgagctacaccgaggccgagggcgagagaagcgccctgctggccgccatcagaggccacagcggcacctgcagcctgagaaaggtggccagcagcgccagcgaggagctgcagagcttcagagacgccgccctgagcgcccagggcagcgagagccccctgctggaggacctgggcctgctgagcccccccgccatccccccccccccccccccccccagccaggccctgagcgcccccagaaccgccagcagattcagcaccggcaccctgagcaacaccgccgacgccagacaggccctgatggacgccatcagaagcggcaccggcgccgccagactgagaaaggtgcccctgctggtgtag

SEQ ID NO: 20202 - DNA, 3441 bp, Artificial Sequence
  Description of Artificial Sequence: Synthetic coding sequence
ctgagagacaacatcgccggcgaggagctggagctgagcaagagcctgaacgagctgggcatcaaggagctgtacgcctgggacaacagaagagagaccttcagaaagagcagcctgggcaacgacgagaccgacaaggagaagaagaagttcctgggcttcttcaaggtgaacaagagaagcaacagcaaggccgagcagctggtgctgagcggcgccgacagcgacgaggacaccagcagagccgcccccggcagaggcctgaacggctgcctgaccacccccaacagccccagcatgcacagcagaagcctgaccctgggccccagcctgagcctgggcagcatcagcggcgtgagcgtgaagagcgagatgaagaagagaagagccccccccccccccggcagcggcccccccgtgcaggacaaggccagcgagaaggtgagcctgggcagccagatcgacctgcagaagaagaagagaagagcccccgcccccccccccccccagccccccccccccagccccctgatccccaacagaaccgaggacaaggaggagaacagaaagagcaccatgggcggcggcagacaggtgccccagaagccccccagaggcaccgccagaggccccccccagctggtgctgccccccccccccccctaccccccccccgacaccgacgtggtggagcccctgagcttccccggcgagggcgccggcagcgaggccagcgaccccatccccaagctgagcctgcccctgggcagcggcagccactgcagccccgacggcgccccccaggtgctgagcgaggccgaggagaccgtgagcgtgggcagctgcttcgccagcgaggacaccaccgaggacagcggcgtgatgagcagccccagcgacatcgtgagcctggacagccagcaggacagcatgaagtacaaggacaagtgggccaccgaccaggaggactgcagcgaccaggacctggccggcacccccgacctgggcccccagaagagccccctgtgggagaagaacggcagcgagaacagccacctgagaaccgagaaggccgtgaccgccagcaacgacgaggaggacctgctgatcgccggcgagttcagaaagaccctggccgagctggacgaggacctggaggagatggaggacagctacgagaccgacaccagcagcctgaccagcagcatccacggcgccagcaaccactgcccccaggacgccatgatcccccacggcgacaccgacgccatccccgtgaccttcatcggcgaggtgagcgacgaccccgtggacagcggcctgttcagcaacagaaacaacaacgccggcagcttcgacagcgagggcgtggccagcagaagagacagcctggcccccctgcaggccgagcacagccagccccacgagaaggccagagaggaggtgcccgccctgcaccccgccagccacgacgtgggcaagggcatcagagtggccctgagcaacatcagcaaggacggcaacctgatggagaccgcccccagagtgaccagcttcgccagcaacctgcacaccgacaacctgaacgccaaggtgaaggacaaggtgtacggctgcgccgacggcgagagaacccaggccaccgagagagtgaacagccagcccgtgaacgagaaggacagcaacgacaagaacgccgccctggcccccaccagctggcaccagagaggccagaaccccggcaagagctacagactgaagcacggcctgaccacctacaagatcatcccccccaagagcgagatgagatgctacgacagagacgtgagcctgagcaccggcgccatcaagatcgacgagctgggcaacctggtgagcccccacgccaccggcatcagaatcatcagcctgagcagcagcgtgcccgaggccgagagccagcccatcggcaaggtgagagagttctggagatgcaacagcgtggagaagcacctgggcagacccagcgagagcagcgccagaggcccccccagcacccccgtgcccacccagacccagaaccccgagagcagactgcaggccgaccccaagcccatcagcccccagcagaagagcgcccaccacgagggcagaaaccccctgggcgagggcagaaaccagccccccaccatgggcatgggccacgtgagagtgcccgccgcccacaccaccgaggtgaccttcctgaagccccagagaagaaccagcagccagtacgtggccagcgccatcgccaagagaatcggcgcccccaaggtgcacgccgacgtggtgagaccccacggctacgccgagaagggctacgccggcaaggcccccgtgctggccgccccccccgtgaccgtgaaggacgacagaaccagcagcccccacagcgagacccagggctggaaggacggcgcccagtggccctgcgtgaccccccccaacaaccacggcgaggacctggccgtgggcgccccccccagaggcgaggtgatcggcccccacagaaagctgagcacccaggacagacccgccgccatccacagaagcagctgcttcagcctggtgcagagcagccagagagacagagtgagcgtgggccagagctgcggcttcagcggcaagcagagcaccagcagccaggaggccagcagcgccagcgagcccagaagagcccccgacggcaccgaccccccccccccccacaccagcgacacccaggcctgcagcagagagctggtgaacggcagcgtgagagcccccggccacggcgagcccagccacccccccggcggcagcggcaccgagagccacatcctgctggagagagaggagaagcccagcgtgttcagcaccgacggcaacgagaccgacagcatctggccccccagcatcttcggccccaagaagaagttcaagcccgtggtgcagagacccgtgcccaaggacaccagcctgcacagcgccctgatggaggccatccacagcgccggcggcaaggacagactgagaaagaccgccgagcacaccggcgagggcagacccgccaagctgagctacaccgaggccgagggcgagagaagcgccctgctggccgccatcagaggccacagcggcacctgcagcctgagaaaggtggccagcagcgccagcgaggagctgcagagcttcagagacgccgccctgagcgcccagggcagcgagagccccctgctggaggacctgggcctgctgagcccccccgccatccccccccccccccccccccccagccaggccctgagcgcccccagaaccgccagcagattcagcaccggcaccctgagcaacaccgccgacgccagacaggccctgatggacgccatcagaagcggcaccggcgccgccagactgagaaaggtgcccctgctggtgtag

SEQ ID NO: 20203 - DNA, 1140 bp, Artificial Sequence
  Description of Artificial Sequence: Synthetic coding sequence
atggacgcccccagagccagcgccgccaagccccccaccggcagaaagatgaaggccagagccccccccccccccggcaaggccgccaccctgcacgtgcacagcgaccagaagcccccccacgacggcgccctgggcagccagcagaacctggtgagaatgaaggaggccctgagagccagcaccatggacgtgaccgtggtgctgcccagcggcctggagaagagaagcgtgctgaacggcagccacgccatgatggacctgctggtggagctgtgcctgcagaaccacctgaaccccagccaccacgccctggagatcagaagcagcgagacccagcagcccctgagcttcaagcccaacaccctgatcggcaccctgaacgtgcacaccgtgttcctgaaggagaaggtgcccgaggagaaggtgaagcccggcccccccaaggtgcccgagaagagcgtgagactggtggtgaactacctgagaacccagaaggccgtggtgagagtgagccccgaggtgcccctgcagaacatcctgcccgtgatctgcgccaagtgcgaggtgagccccgagcacgtggtgctgctgagagacaacatcgccggcgaggagctggagctgagcaagagcctgaacgagctgggcatcaaggagctgtacgcctgggacaacagaagagagaccttcagaaagagcagcctgggcaacgacgagaccgacaaggagaagaagaagttcctgggcttcttcaaggtgaacaagagaagcaacagcaagggctgcctgaccacccccaacagccccagcatgcacagcagaagcctgaccctgggccccagcctgagcctgggcagcatcagcggcgtgagcgtgaagagcgagatgaagaagagaagagccccccccccccccggcagcggcccccccgtgcaggacaaggccagcgagaaggtgagcctgggcagccagatcgacctgcagaagaagaagagaagagcccccgcccccccccccccccagccccccccccccagccccctgatccccaacagaaccgaggacaaggaggagaacagaaagagcaccatggtgtactgctgcgccagcttccccacccaggccaagagattctag

SEQ ID NO: 20204 - DNA, 825 bp, Artificial Sequence
  Description of Artificial Sequence: Synthetic coding sequence
atggaggacagctacgagaccgacaccagcagcctgaccagcagcatccacggcgccagcaaccactgcccccaggacgccatgatcccccacggcgacaccgacgccatccccgtgaccttcatcggcgaggtgagcgacgaccccgtggacagcggcctgttcagcaacagaaacaacaacgccggcagcttcgacagcgagggcgtggccagcagaagagacagcctggcccccctgcaggccgagcacagccagccccacgagaaggccagagaggaggtgcccgccctgcaccccgccagccacgacgtgggcaagggcatcagagtggccctgagcaacatcagcaaggacggcaacctgatggagaccgcccccagagtgaccagcttcgccagcaacctgcacaccgacaacctgaacgccaaggtgaaggacaaggtgtacggctgcgccgacggcgagagaacccaggccaccgagagagtgaacagccagcccgtgaacgagaaggacagcaacgacaagaacgccgccctggcccccaccagctggcaccagagaggccagaaccccggcaagagctacagactgaagcacggcctgaccacctacaagatcatcccccccaagagcgagagcagcggcggcgccaccctgtggaagaacacctgggccgacccccagagagccctgcccggcgacccccccccccccctgtgccccagaagaagaagaatccagagagccgacagcaagcagacccccagccagtacagacccagcagaagcctgcccaccatgagagccggcaccccctag

SEQ ID NO: 20205 - DNA, 2523 bp, Artificial Sequence
  Description of Artificial Sequence: Synthetic coding sequence
atgaacagattcagagtgagcaagttcagacacaccgaggccagaccccccagaagagagagctggatcagcgacatcagagccggcaccgcccccagctgcagaaaccacatcaagagcagctgcagcctgatcgccttcaacagcgacagacccggcgtgctgggcatcgtgcccctgcagggccagggcgaggacaagagaagagtggcccacctgggctgccacagcgagctggccgcccacggcgacctggtgcagagcgccgtgtggagcagagacggcgccctggtgggcaccgcctgcaaggacaagcagctgagaatcttcgaccccagaaccaagcccagagccagccagagcacccaggcccacgagaacagcagagacagcagactggcctggatgggcacctgggagcacctggtgagcaccggcttcaaccagatgagagagagagaggtgaagctgtgggacaccagattcttcagcagcgccctggccagcctgaccctggacaccagcctgggctgcctggtgcccctgctggaccccgacagcggcctgctggtgctggccggcaagggcgagagacagctgtactgctacgaggtggtgccccagcagcccgccctgagccccgtgacccagtgcgtgctggagagcgtgctgagaggcgccgccctggtgcccagacaggccctggccgtgatgagctgcgaggtgctgagagtgctgcagctgagcgacaccgccatcgtgcccatcggctaccacgtgcccagaaaggccgtggagttccacgaggacctgttccccgacaccgccggctgcgtgcccgccaccgacccccacagctggtgggccggcgacaaccagcaggtgcagaaggtgagcctgaaccccgcctgcagaccccaccccagcttcaccagctgcctggtgccccccgccgagcccctgcccgacaccgcccagcccgccgtgatggagacccccgtgggcgacgccgacgccagcgagggcttcagcagcccccccagcagcctgaccagccccagcacccccagcagcctgggccccagcctgagcagcaccagcggcatcggcaccagccccagcctgagaagcctgcagagcctgctgggccccagcagcaagttcagacacgcccagggcaccgtgctgcacagagacagccacatcaccaacctgaagggcctgaacctgaccacccccggcgagagcgacggcttctgcgccaacaagctgagagtggccgtgcccctgctgagcagcggcggccaggtggccgtgctggagctgagaaagcccggcagactgcccgacaccgccctgcccaccctgcagaacggcgccgccgtgaccgacctggcctgggaccccttcgacccccacagactggccgtggccggcgaggacgccagaatcagactgtggagagtgcccgccgagggcctggaggaggtgctgaccacccccgagaccgtgctgaccggccacaccgagaagatctgcagcctgagattccaccccctggccgccaacgtgctggccagcagcagctacgacctgaccgtgagaatctgggacctgcaggccggcgccgacagactgaagctgcagggccaccaggaccagatcttcagcctggcctggagccccgacggccagcagctggccaccgtgtgcaaggacggcagagtgagagtgtacagacccagaagcggccccgagcccctgcaggagggccccggccccaagggcggcagaggcgccagaatcgtgtgggtgtgcgacggcagatgcctgctggtgagcggcttcgacagccagagcgagagacagctgctgctgtacgaggccgaggccctggccggcggccccctggccgtgctgggcctggacgtggcccccagcaccctgctgcccagctacgaccccgacaccggcctggtgctgctgaccggcaagggcgacaccagagtgttcctgtacgagctgctgcccgagagccccttcttcctggagtgcaacagcttcaccagccccgacccccacaagggcctggtgctgctgcccaagaccgagtgcgacgtgagagaggtggagctgatgagatgcctgagactgagacagagcagcctggagcccgtggccttcagactgcccagagtgagaaaggagttcttccaggacgacgtgttccccgacaccgccgtgatctgggagcccgtgctgagcgccgaggcctggctgcagggcgccaacggccagccctggctgctgagcctgcagccccccgacatgagccccgtgagccaggcccccagagaggcccccgccagaagagcccccagcagcgcccagtacctggaggagaagagcgaccagcagaagaaggaggagctgctgaacgccatggtggccaagctgggcaacagagaggaccccctgccccaggacagcttcgagggcgtggacgaggacgagtgggactag

SEQ ID NO: 20206 - DNA, 246 bp, Artificial Sequence
  Description of Artificial Sequence: Synthetic coding sequence
atgagcagcacctactgcggcaacagcagcgccaagatgagcgtgaacgaggtgagcgccttcagcctgaccctggagcagaagaccggcttcgccttcgtgggcatcctgtgcatcttcctgggcctgctgatcatcagatgcttcaagatcctgctggacccctacagcagcatgcccagcagcacctgggaggacgaggtggaggagttcgacaagggcaccttcgagtacgccctggcctag

SEQ ID NO: 20207 - DNA, 246 bp, Artificial Sequence; identical to SEQ ID NO: 20206
  Description of Artificial Sequence: Synthetic coding sequence

SEQ ID NO: 20208 - DNA, 906 bp, Artificial Sequence
  Description of Artificial Sequence: Synthetic coding sequence
atgagctaccccaccaaggagggcagcgacaccgccggcaacgcccacaagaacagcgagaacgagccccccaacgactgcagcaccgacatcgagagccccagcgccgaccccaacatgatctaccaggtggagaccaaccccatcaacagagagcccggcaccgccaccagccaggaggacgtggtgccccaggccgccgagaacagcgagctggagaccgagatccagaaggaccagagagaggaggacctgaaggaggagctgctgctgctgcagacccccatccccagaaagctggtgagccacaagcccctgaacgacagaagcagaagccacagcggcaaggtggagatgaaggccaacaacttccccatcaaccacaagaccagattcagactgagcaccagctggagagtgcccttcatcaacagccacgagatcagaagcatgatcctgcacctgctgtgcgacagatacttcagccaggccgccggctgccagaacaccatgtgggtgaagagaaagtacatcgcctgcctgtaccaccccaacagcttcacccaccacgagagagccatcaccttcagaagacccagcagagtgcactactacagacccctgaccgagagaatgaccagcggcaagttctgcaagagcaccgacaccaagggcaagtgcagattcagagccatcgtgagaagcgtgctgttcgtgagccagatccagatcgagagcatcttcaacatcaagggcttcgtggacatcctgacctacatccacaccatgaacgtgatgatcaccaacaccaacaacggctggaagtacttctgccccatctgcggcagactgttcaacacctacagcgagctgagacagcacagctgcagcagcagcggcaactag

SEQ ID NO: 20209 - DNA, 906 bp, Artificial Sequence; identical to SEQ ID NO: 20208
  Description of Artificial Sequence: Synthetic coding sequence

SEQ ID NO: 20210 - DNA, 1935 bp, Artificial Sequence
  Description of Artificial Sequence: Synthetic coding sequence
atgctgagaaccgacgccggcgaggacctggccgacgcccccgccgaggagctgcaggagaagggcagccccgccggccccccccccagccagggccagcccgccgccagaccccccaaggaggtgcccgccagcagactggcccagcagctgagagaggagggctggaacctgcagaccagcgagagcctgaccctggccgaggtgtacctgatgatgggcaagcccagcaagctgcagctggagtacgactggctgggccccggcagacaggaccccagacccggcagcctgcccaccgccctgcacaagcagagactgctgagctgcctgctgaagctgatcagcaccgaggtgaaccccaagctggccctggaggccaacaccatcagcaccgccagcgtgagacccgcccaggaggagcagagcatgaccccccccggcaaggtggtgaccgtgagcagcagaagccccagatgccccagaaaccaggccagcctgagaagcagcaagaccttcccccccagcagcgccccctgcagcagcggcctgagaaacccccccagacccctgctggtgcccggccccagcagcaccggcagcaacgacagcgacggcggcctgttcgccgtgcccaccaccctgccccccaacagcagacacggcaagctgttcagccccagcaaggaggccgagctgaccttcagacagcacctgaacagcatcagcatgcagagcgacttcttcctgcccaagcccagaaagctgagaaacagacacctgagaaagcccctggtggtgcagagaaccctgctgcccagacccagcgagaaccagagccacaacgtgtgcagcttcagcatcctgagcaacagcagcgtgaccggcagaggcagcttcagacccatccagagcagcctgaccaaggccgccctgagcagacccatcgtgcccaaggtgctgcccccccaggccaccagccacctggccagcgccatcgacctggccgccaccagcgccggcatcctgagcggcaaccccctgcccgccctggacaccgagggcctgagcggcatcagccccctgagcagcgacgaggtgaccggcgccatcagcggccaggacagcaccggcacccaccaggacggcgacaccctgcccaccgtgggcggcagcgaccccttcgtgagcatccccagcagacccgagcaggagcccgtggccgacagcttccagggcagcagcgtgctgagcctgagcgagctgcccaaggcccccctgcagaacggcctgagcatccccctgagcagcagcgagagcagcagcaccagactgagcccccccgacgtgagcgccctgctggacatcagcctgcccggcccccccgaggacgccctgagccagggcgagcccgccacccacatcagcgacagcatcatcgagatcgccatcagcagcggcgagggcgtgcccctgagccccgccaagctgaacggcagcgacagcagcaagagcctgcccagccccagcagcagcccccagccccactggatcgccagccccacccacgacccccagtggtaccccagcgacagcaccgacagcagcctgagcagcctgttcgccagcttcatcagccccgagaagagcagaaagatgctgcccacccccatcggcaccaacagcggcaccagcctgctgggccccagcctgctggacggcaacagcagagacagcttcgtgagcagaagcctggccgacgtggccgaggtggtggacagccagctggtgtgcatgatgaacgagaacagcatcgactacatcagcagattcaacgacctggcccaggagctgagcatcgccgagcccggcagaagagaggccctgttcgacggcggcggcggcggccccgccgtgagcgacctgagccagtag

SEQ ID NO: 20211 - DNA, 3810 bp, Artificial Sequence
  Description of Artificial Sequence: Synthetic coding sequence
atgaccgtgaagctgggcgacggcggcagcggcgaggacggcctgaagaagctgggcaagagagccgccgacgaggagagcctggagggcgagggcgccggcggcgccgacgccgccgaggagagcagcggcaccaagagagacgagaagacccccagagccggcgccgacggcccccccgccccccccggcgccccccaggcccccagccccccccagggcagcccccaggaccagcaccacttcctgagaagcagcgtgagaccccagagcaagagacccagaaaggacccccccagcgccgtgggcagcggcaacgccggcggcagcggccccagaggcaagggcgccgagggcggcggcagcagcagcggcaacgtgagcggcgtggcccccgccgcccccgccggcggcagcagaagcagcagcagaaacctgggcagcagcggcggcgagaaggaggagggcaagaaggtgagaagacagtgggagagctggagcaccgaggacaagaacaccttcttcgagggcctgtacgagcacggcaaggacttcgaggccatccagaacaacatcgccctgaagtacaagaagaagggcaagcccgccagcatggtgaagaacaaggagcaggtgagacacttctactacagaacctggcacaagatcaccaagtacatcgacttcgaccacgtgttcagcagaggcctgaagaagagcagccaggagctgtacggcctgatctgctacggcgagctgagaaagaagatcggcggctgcatggacgacaagaacgccaccaagctgaacgagctgatccaggtgggcgccaccaccgtgagatacaagggcagaaacctgagaatcaaggcccccatgtgcagagccctgaagaagctgtgcgaccccgacggcctgagcgacgaggaggaccagaagcccgtgagactgcccctgaaggtgcccatcgagctgcagcccagaaacaaccacgcctgggccagagtgcagagcctggcccagaaccccagactgagaatgatcgtggagctgcacagaaaggtgagcagcctgatcgagttcctgaagcagaagtgggccctgcacgaggtgagagtgagaaagaccctggaggagagacagctgcaggacagctgcagcgcccccatgcaggagaaggtgaccctgcacctgttccccggcgagaactgcaccctgacccccctgcccggcgtggccagagtggtgcacagcaaggccttctgcaccgtgcactggcaggagggcggcagatgcaagcagagcgccaaggacgcccacgtgctgccccccgcccagatcctgggcatccagagcggccagggcaccgccagaggccaggtgaagtgccccagaagcggcgccgagggcaagggcgtgggcagacccccccccgccgccgacgccctgcagagcagcggcgagagcagccccgagagcgcccccggcgagggcgccgccctgagcctgagcagccccgacgcccccgacagacccccccccagacaccaggacaccggcccctgcctggagaagacccccgccgagggcagagacagccccaccagagagcccggcgccctgccctgcgcctgcggccagctgcccgacctggaggacgagctgagcctgctggaccccctgcccagatacctgaagagctgccaggacctgatcgtgcccgagcagtgcagatgcgccgacaccagacccggcagcgagcagccccccctgggcggcgccgccagccccgaggtgctggcccccgtgagcaaggaggccgccgacctggcccccaccggccccagccccagacccggccccggcctgctgctggacgtgtgcaccaaggacctggccgacgcccccgccgaggagctgcaggagaagggcagccccgccggccccccccccagccagggccagcccgccgccagaccccccaaggaggtgcccgccagcagactggcccagcagctgagagaggagggctggaacctgcagaccagcgagagcctgaccctggccgaggtgtacctgatgatgggcaagcccagcaagctgcagctggagtacgactggctgggccccggcagacaggaccccagacccggcagcctgcccaccgccctgcacaagcagagactgctgagctgcctgctgaagctgatcagcaccgaggtgaaccccaagctggccctggaggccaacaccatcagcaccgccagcgtgagacccgcccaggaggagcagagcatgaccccccccggcaaggtggtgaccgtgagcagcagaagccccagatgccccagaaaccaggccagcctgagaagcagcaagaccttcccccccagcagcgccccctgcagcagcggcctgagaaacccccccagacccctgctggtgcccggccccagcagcaccggcagcaacgacagcgacggcggcctgttcgccgtgcccaccaccctgccccccaacagcagacacggcaagctgttcagccccagcaaggaggccgagctgaccttcagacagcacctgaacagcatcagcatgcagagcgacttcttcctgcccaagcccagaaagctgagaaacagacacctgagaaagcccctggtggtgcagagaaccctgctgcccagacccagcgagaaccagagccacaacgtgtgcagcttcagcatcctgagcaacagcagcgtgaccggcagaggcagcttcagacccatccagagcagcctgaccaaggccgccctgagcagacccatcgtgcccaaggtgctgcccccccaggccaccagccacctggccagcgccatcgacctggccgccaccagcgccggcatcctgagcggcaaccccctgcccgccctggacaccgagggcctgagcggcatcagccccctgagcagcgacgaggtgaccggcgccatcagcggccaggacagcaccggcacccaccaggacggcgacaccctgcccaccgtgggcggcagcgaccccttcgtgagcatccccagcagacccgagcaggagcccgtggccgacagcttccagggcagcagcgtgctgagcctgagcgagctgcccaaggcccccctgcagaacggcctgagcatccccctgagcagcagcgagagcagcagcaccagactgagcccccccgacgtgagcgccctgctggacatcagcctgcccggcccccccgaggacgccctgagccagggcgagcccgccacccacatcagcgacagcatcatcgagatcgccatcagcagcggccagtacggcgagggcgtgcccctgagccccgccaagctgaacggcagcgacagcagcaagagcctgcccagccccagcagcagcccccagccccactggatcgccagccccacccacgacccccagtggtaccccagcgacagcaccgacagcagcctgagcagcctgttcgccagcttcatcagccccgagaagagcagaaagatgctgcccacccccatcggcaccaacagcggcaccagcctgctgggccccagcctgctggacggcaacagcagagacagcttcgtgagcagaagcctggccgacgtggccgaggtggtggacagccagctggtgtgcatgatgaacgagaacagcatcgactacatcagcagattcaacgacctggcccaggagctgagcatcgccgagcccggcagaagagaggccctgttcgacggcggcggcggcggccccgccgtgagcgacctgagccagtag

SEQ ID NO: 20212 - DNA, 3810 bp, Artificial Sequence; identical to SEQ ID NO: 20211
  Description of Artificial Sequence: Synthetic coding sequence

SEQ ID NO: 20213 - DNA, 3801 bp, Artificial Sequence
  Description of Artificial Sequence: Synthetic coding sequence
atgaccgtgaagctgggcgacggcggcagcggcgaggacggcctgaagaagctgggcaagagagccgccgacgaggagagcctggagggcgagggcgccggcggcgccgacgccgccgaggagagcagcggcaccaagagagacgagaagacccccagagccggcgccgacggcccccccgccccccccggcgccccccaggcccccagccccccccagggcagcccccaggaccagcaccacttcctgagaagcagcgtgagaccccagagcaagagacccagaaaggacccccccagcgccgtgggcagcggcaacgccggcggcagcggccccagaggcaaggacagacacctgcccaaggcccagctgtggctgagcatcagcagagtgcccttcggcggcagcagaagcagcagcagaaacctgggcagcagcggcggcgagaaggaggagggcaagaaggtgagaagacagtgggagagctggagcaccgaggacaagaacaccttcttcgagggcctgtacgagcacggcaaggacttcgaggccatccagaacaacatcgccctgaagtacaagaagaagggcaagcccgccagcatggtgaagaacaaggagcaggtgagacacttctactacagaacctggcacaagatcaccaagtacatcgacttcgaccacgtgttcagcagaggcctgaagaagagcagccaggagctgtacggcctgatctgctacggcgagctgagaaagaagatcggcggctgcatggacgacaagaacgccaccaagctgaacgagctgatccaggtgggcgccaccaccgtgagatacaagggcagaaacctgagaatcaaggcccccatgtgcagagccctgaagaagctgtgcgaccccgacggcctgagcgacgaggaggaccagaagcccgtgagactgcccctgaaggtgcccatcgagctgcagcccagaaacaaccacgcctgggccagagtgcagagcctggcccagaaccccagactgagaatgatcgtggagctgcacagaaaggtgagcagcctgatcgagttcctgaagcagaagtgggccctgcacgaggtgagagtgagaaagaccctggaggagagacagctgcaggacagctgcagcgcccccatgcaggagaaggtgaccctgcacctgttccccggcgagaactgcaccctgacccccctgcccggcgtggccagagtggtgcacagcaaggccttctgcaccgtgcactggcaggagggcggcagatgcaagcagagcgccaaggacgcccacgtgctgccccccgcccagatcctgggcatccagagcggccagggcaccgccagaggccaggtgaagtgccccagaagcggcgccgagggcaagggcgtgggcagacccccccccgccgccgacgccctgcagagcagcggcgagagcagccccgagagcgcccccggcgagggcgccgccctgagcctgagcagccccgacgcccccgacagacccccccccagacaccaggacaccggcccctgcctggagaagacccccgccgagggcagagacagccccaccagagagcccggcgccctgccctgcgcctgcggccagctgcccgacctggaggacgagctgagcctgctggaccccctgcccagatacctgaagagctgccaggacctgatcgtgcccgagcagtgcagatgcgccgacaccagacccggcagcgagcagccccccctgggcggcgccgccagccccgaggtgctggcccccgtgagcaaggaggccgccgacctggcccccaccggccccagccccagacccggccccggcctgctgctggacgtgtgcaccaaggacctggccgacgcccccgccgaggagctgcaggagaagggcagccccgccggccccccccccagccagggccagcccgccgccagaccccccaaggaggtgcccgccagcagactggcccagcagctgagagaggagggctggaacctgcagaccagcgagagcctgaccctggccgaggtgtacctgatgatgggcaagcccagcaagctgcagctggagtacgactggctgggccccggcagacaggaccccagacccggcagcctgcccaccgccctgcacaagcagagactgctgagctgcctgctgaagctgatcagcaccgaggtgaaccccaagctggccctggaggccaacaccatcagcaccgccagcgtgagacccgcccaggaggagcagagcatgaccccccccggcaaggtggtgaccgtgagcagcagaagccccagatgccccagaaaccaggccagcctgagaagcagcaagaccttcccccccagcagcgccccctgcagcagcggcctgagaaacccccccagacccctgctggtgcccggccccagcagcaccggcagcaacgacagcgacggcggcctgttcgccgtgcccaccaccctgccccccaacagcagacacggcaagctgttcagccccagcaaggaggccgagctgaccttcagacagcacctgaacagcatcagcatgcagagcgacttcttcctgcccaagcccagaaagctgagaaacagacacctgagaaagcccctggtggtgcagagaaccctgctgcccagacccagcgagaaccagagccacaacgtgtgcagcttcagcatcctgagcaacagcagcgtgaccggcagaggcagcttcagacccatccagagcagcctgaccaaggccgccctgagcagacccatcgtgcccaaggtgctgcccccccaggccaccagccacctggccagcgccatcgacctggccgccaccagcgccggcatcctgagcggcaaccccctgcccgccctggacaccgagggcctgagcggcatcagccccctgagcagcgacgaggtgaccggcgccatcagcggccaggacagcaccggcacccaccaggacggcgacaccctgcccaccgtgggcggcagcgaccccttcgtgagcatccccagcagacccgagcaggagcccgtggccgacagcttccagggcagcagcgtgctgagcctgagcgagctgcccaaggcccccctgcagaacggcctgagcatccccctgagcagcagcgagagcagcagcaccagactgagcccccccgacgtgagcgccctgctggacatcagcctgcccggcccccccgaggacgccctgagccagggcgagcccgccacccacatcagcgacagcatcatcgagatcgccatcagcagcggccagtacggcgagggcgtgcccctgagccccgccaagctgaacggcagcgacagcagcaagagcctgcccagccccagcagcagcccccagccccactggatcgccagccccacccacgacccccagtggtaccccagcgacagcaccgacagcagcctgagcagcctgttcgccagcttcatcagccccgagaagagcagaaagatgctgcccacccccatcggcaccaacagcggcaccagcctgctgggccccagcctgctggacggcaacagcagagacagcttcgtgagcagaagcctggccgacgtggccgaggtggtggacagccagctggtgtgcatgatgaacgagaacagcatcgactacatcagcagattcaacgacctggcccaggagctgagcatcgccgagcccggcagaagagaggccctgttcgacggcggcggcggcggccccgccgtgagcgacctgagccagtag

SEQ ID NO: 20214 - DNA, 528 bp, Artificial Sequence
  Description of Artificial Sequence: Synthetic coding sequence
atggacatcgccatccaccacccctggatcagaagacccttcttccccttccacagccccagcagactgttcgaccagttcttcggcgagcacctgctggagagcgacctgttccccaccagcaccagcctgagccccttctacctgagaccccccagcttcctgagagcccccagctggttcgacaccggcctgagcgagatgagactggagaaggacagattcagcgtgaacctggacgtgaagcacttcagccccgaggagctgaaggtgaaggtgctgggcgacgtgatcgaggtgcacggcaagcacgaggagagacaggacgagcacggcttcatcagcagagagttccacagaaagtacagaatccccgccgacgtggaccccctgaccatcaccagcagcctgagcagcgacggcgtgctgaccgtgaacggccccagaaagcaggtgagcggccccgagagaaccatccccatcaccagagaggagaagcccgccgtgaccgccgcccccaagaagtag

SEQ ID NO: 20215 - DNA, 528 bp, Artificial Sequence; identical to SEQ ID NO: 20214
  Description of Artificial Sequence: Synthetic coding sequence

SEQ ID NO: 20216 - DNA, 528 bp, Artificial Sequence; identical to SEQ ID NO: 20214
  Description of Artificial Sequence: Synthetic coding sequence

SEQ ID NO: 20217 - DNA, 549 bp, Artificial Sequence
  Description of Artificial Sequence: Synthetic coding sequence
atggcccagagaagcggcaagatcaccctgtacgagggcaagcacttcaccggccagaagctggaggtgttcggcgactgcgacaacttccaggacagaggcttcatgaacagagtgaacagcatccacgtggagagcggcgcctgggtgtgcttcaaccaccccgacttcagaggccagcagttcatcctggagcacggcgactaccccgacttcttcagatggaacagccacagcgaccacatgggcagctgcagacccgtgggcatgcacggcgagcacttcagactggagatcttcgagggctgcaacttcaccggccagtgcctggagttcctggaggacagccccttcctgcagagcagaggctgggtgaagaactgcgtgaacaccatcaaggtgtacggcgacggcgccgcctggagccccagaagcttcggcgccgaggacttccagctgagcagcagcctgcagagcgaccagggccccgaggaggccaccaccaagcccgccaccacccagccccccttcctgaccgccaacctgtag

SEQ ID NO: 20218 - DNA, 447 bp, Artificial Sequence
  Description of Artificial Sequence: Synthetic coding sequence
atgggcagagccggccccagaagcaccgccgacaccagacccagagccaccgtgatcaccaccagaagacccagaccctggcagaagcccaccagccccagaagactgcacagaagaagacccagaggccagcccgccagcgagaacgccgccgagcccagccaggtggccatcagcaagggcaagagccccgactacgccaacggcggcaaggccgccatggacagcagagccagcgacgccatcaacaagagcaaggtggacaccagcgccagcaaccccagccagagaagacccagcagactgagaggcaagagaagcctggccctgccccccagactggagtgcctgttccccagcagctgcggcagcagaagagccaccagcagacccggcttcccccccctggagggcagccacctgggctgccagctgctgcccctgtag

SEQ ID NO: 20219 - DNA, 2415 bp, Artificial Sequence
  Description of Artificial Sequence: Synthetic coding sequence
atggaggagcccggcgtgaccccccagccctacctgggcctgctgctggaggagctgagaagagtggtggccgccctgcccgagggcatgagacccgacagcaacctgtacggcttcccctgggagctggtgatctgcgccgccgtggtgggcttcttcgccgtgctgttcttcctgtggagaagcttcagaagcgtgagaagcagactgtacgtgggcagagagaagaagctggccctgatgctgagcggcctgatcgaggagaagagcaagctgctggagaagttcagcctggtgcagaaggagtacgagggctacgaggtggagagcagcctgaaggacgccagcttcgagaaggaggccaccgaggcccagagcctggaggccacctgcgagaagctgaacagaagcaacagcgagctggaggacgagatcctgtgcctggagaaggagctgaaggaggagaagagcaagcacagcgagcaggacgagctgatggccgacatcagcaagagaatccagagcctggaggacgagagcaagagcctgaagagccaggtggccgaggccaagatgaccttcaagatcttccagatgaacgaggagagactgaagatcgccatcaaggacgccctgaacgagaacagccagctgcaggagagccagaagcagctgctgcaggaggccgaggtgtggaaggagcaggtgagcgagctgaacaagcagaaggtgaccttcgaggacagcaaggtgcacgccgagcaggtgctgaacgacaaggagagccacatcaagaccctgaccgagagactgctgaagatgaaggactgggccgccatgctgggcgaggacatcaccgacgacgacaacctggagctggagatgaacagcgagagcgagaacggcgcctacctggacaacccccccaagggcgccctgaagaagctgatccacgccgccaagctgaacgccagcctgaagaccctggagggcgagagaaaccagatctacatccagctgagcgaggtggacaagaccaaggaggagctgaccgagcacatcaagaacctgcagaccgagcaggccagcctgcagagcgagaacacccacttcgagaacgagaaccagaagctgcagcagaagctgaaggtgatgaccgagctgtaccaggagaacgagatgaagctgcacagaaagctgaccgtggaggagaactacagactggagaaggaggagaagctgagcaaggtggacgagaagatcagccacgccaccgaggagctggagacctacagaaagagagccaaggacctggaggaggagctggagagaaccatccacagctaccagggccagatcatcagccacgagaagaaggcccacgacaactggctggccgccagaaacgccgagagaaacctgaacgacctgagaaaggagaacgcccacaacagacagaagctgaccgagaccgagctgaagttcgagctgctggagaaggacccctacgccctggacgtgcccaacaccgccttcggcagagagcacagcccctacggccccagccccctgggctggcccagcagcgagaccagagccttcctgagcccccccaccctgctggagggccccctgagactgagccccctgctgcccggcggcggcggcagaggcagcagaggccccggcaaccccctggaccaccagatcaccaacgagagaggcgagagcagctgcgacagactgaccgacccccacagagcccccagcgacaccggcagcctgagccccccctgggaccaggacagaagaatgatgttccccccccccggccagagctaccccgacagcgccctgcccccccagagacaggacagattctgcagcaacagcggcagactgagcggccccgccgagctgagaagcttcaacatgcccagcctggacaagatggacggcagcatgcccagcgagatggagagcagcagaaacgacaccaaggacgacctgggcaacctgaacgtgcccgacagcagcctgcccgccgagaacgaggccaccggccccggcttcgtgcccccccccctggcccccatcagaggccccctgttccccgtggacgccagaggccccttcctgagaagaggcccccccttccccccccccccccccggcgccatgttcggcgccagcagagactacttcccccccggcgacttccccggccccccccccgcccccttcgccatgagaaacgtgtacccccccagaggcttccccccctacctgccccccagacccggcttcttccccccccccccccacagcgagggcagaagcgagttccccagcggcctgatcccccccagcaacgagcccgccaccgagcaccccgagccccagcaggagacctag

SEQ ID NO: 20220 - DNA, 2316 bp, Artificial Sequence
  Description of Artificial Sequence: Synthetic coding sequence
atggaggagcccggcgtgaccccccagccctacctgggcctgctgctggaggagctgagaagagtggtggccgccctgcccgagggcatgagacccgacagcaacctgtacggcttcccctgggagctggtgatctgcgccgccgtggtgggcttcttcgccgtgctgttcttcctgtggagaagcttcagaagcgtgagaagcagactgtacgtgggcagagagaagaagctggccctgatgctgagcggcctgatcgaggagaagagcaagctgctggagaagttcagcctggtgcagaaggagtacgagggctacgaggtggagagcagcctgaaggacgccagcttcgagaaggaggccaccgaggcccagagcctggaggccacctgcgagaagctgaacagaagcaacagcgagctggaggacgagatcctgtgcctggagaaggagctgaaggaggagaagagcaagcacagcgagcaggacgagctgatggccgacatcagcaagagaatccagagcctggaggacgagagcaagagcctgaagagccaggtggccgaggccaagatgaccttcaagatcttccagatgaacgaggagagactgaagatcgccatcaaggacgccctgaacgagaacagccagctgcaggagagccagaagcagctgctgcaggaggccgaggtgtggaaggagcaggtgagcgagctgaacaagcagaaggtgaccttcgaggacagcaaggtgcacgccgagcaggtgctgaacgacaaggagagccacatcaagaccctgaccgagagactgctgaagatgaaggactgggccgccatgctgggcgaggacatcaccgacgacgacaacctggagctggagatgaacagcgagagcgagaacggcgcctacctggacaacccccccaagggcgccctgaagaagctgatccacgccgccaagctgaacgccagcctgaagaccctggagggcgagagaaaccagatctacatccagctgagcgaggtggacaagaccaaggaggagctgaccgagcacatcaagaacctgcagaccgagcaggccagcctgcagagcgagaacacccacttcgagaacgagaaccagaagctgcagcagaagctgaaggtgatgaccgagctgtaccaggagaacgagatgaagctgcacagaaagctgaccgtggaggagaactacagactggagaaggaggagaagctgagcaaggtggacgagaagatcagccacgccaccgaggagctggagacctacagaaagagagccaaggacctggaggaggagctggagagaaccatccacagctaccagggccagatcatcagccacgagaagaaggcccacgacaactggctggccgccagaaacgccgagagaaacctgaacgacctgagaaaggagaacgcccacaacagacagaagctgaccgagaccgagctgaagttcgagctgctggagaaggacccctacgccctggacgtgcccaacaccgccttcggcagagagcacagcccctacggccccagccccctgggctggcccagcagcgagaccagagccttcctgagcccccccaccctgctggagggccccctgagactgagccccctgctgcccggcggcggcggcagaggcagcagaggccccggcaaccccctggaccaccagatcaccaacgagagaggcgagagcagctgcgacagactgaccgacccccacagagcccccagcgacaccggcagcctgagccccccctgggaccaggacagaagaatgatgttccccccccccggccagagctaccccgacagcgccctgcccccccagagacaggacagattctgcagcaacagcggcagactgagcggccccgccgagctgagaagcttcaacatgcccagcctggacaagatggacggcagcatgcccagcgagatggagagcagcagaaacgacaccaaggacgacctgggcaacctgaacgtgcccgacagcagcctgcccgccgagaacgaggccaccggccccggcttcgtgcccccccccctggcccccatcagaggccccctgttccccgtggacgccagaggccccttcctgagaagaggcccccccttccccccccccccccccggcgccatgttcggcgccagcagagactacttcccccccggcgacttccccggccccccccccgcccccttcgccagcgccagaagcccccccggcgccggcgcccccgccagcggcagaggcctgggcggcccccagaagtag

SEQ ID NO: 20221 - DNA, 2379 bp, Artificial Sequence
  Description of Artificial Sequence: Synthetic coding sequence
atggagctgaagagccccgaggaggaggtggtggccgccctgcccgagggcatgagacccgacagcaacctgtacggcttcccctgggagctggtgatctgcgccgccgtggtgggcttcttcgccgtgctgttcttcctgtggagaagcttcagaagcgtgagaagcagactgtacgtgggcagagagaagaagctggccctgatgctgagcggcctgatcgaggagaagagcaagctgctggagaagttcagcctggtgcagaaggagtacgagggctacgaggtggagagcagcctgaaggacgccagcttcgagaaggaggccaccgaggcccagagcctggaggccacctgcgagaagctgaacagaagcaacagcgagctggaggacgagatcctgtgcctggagaaggagctgaaggaggagaagagcaagcacagcgagcaggacgagctgatggccgacatcagcaagagaatccagagcctggaggacgagagcaagagcctgaagagccaggtggccgaggccaagatgaccttcaagatcttccagatgaacgaggagagactgaagatcgccatcaaggacgccctgaacgagaacagccagctgcaggagagccagaagcagctgctgcaggaggccgaggtgtggaaggagcaggtgagcgagctgaacaagcagaaggtgaccttcgaggacagcaaggtgcacgccgagcaggtgctgaacgacaaggagagccacatcaagaccctgaccgagagactgctgaagatgaaggactgggccgccatgctgggcgaggacatcaccgacgacgacaacctggagctggagatgaacagcgagagcgagaacggcgcctacctggacaacccccccaagggcgccctgaagaagctgatccacgccgccaagctgaacgccagcctgaagaccctggagggcgagagaaaccagatctacatccagctgagcgaggtggacaagaccaaggaggagctgaccgagcacatcaagaacctgcagaccgagcaggccagcctgcagagcgagaacacccacttcgagaacgagaaccagaagctgcagcagaagctgaaggtgatgaccgagctgtaccaggagaacgagatgaagctgcacagaaagctgaccgtggaggagaactacagactggagaaggaggagaagctgagcaaggtggacgagaagatcagccacgccaccgaggagctggagacctacagaaagagagccaaggacctggaggaggagctggagagaaccatccacagctaccagggccagatcatcagccacgagaagaaggcccacgacaactggctggccgccagaaacgccgagagaaacctgaacgacctgagaaaggagaacgcccacaacagacagaagctgaccgagaccgagctgaagttcgagctgctggagaaggacccctacgccctggacgtgcccaacaccgccttcggcagagagcacagcccctacggccccagccccctgggctggcccagcagcgagaccagagccttcctgagcccccccaccctgctggagggccccctgagactgagccccctgctgcccggcggcggcggcagaggcagcagaggccccggcaaccccctggaccaccagatcaccaacgagagaggcgagagcagctgcgacagactgaccgacccccacagagcccccagcgacaccggcagcctgagccccccctgggaccaggacagaagaatgatgttccccccccccggccagagctaccccgacagcgccctgcccccccagagacaggacagattctgcagcaacagcggcagactgagcggccccgccgagctgagaagcttcaacatgcccagcctggacaagatggacggcagcatgcccagcgagatggagagcagcagaaacgacaccaaggacgacctgggcaacctgaacgtgcccgacagcagcctgcccgccgagaacgaggccaccggccccggcttcgtgcccccccccctggcccccatcagaggccccctgttccccgtggacgccagaggccccttcctgagaagaggcccccccttccccccccccccccccggcgccatgttcggcgccagcagagactacttcccccccggcgacttccccggccccccccccgcccccttcgccatgagaaacgtgtacccccccagaggcttccccccctacctgccccccagacccggcttcttccccccccccccccacagcgagggcagaagcgagttccccagcggcctgatcccccccagcaacgagcccgccaccgagcaccccgagccccagcaggagacctag

SEQ ID NO: 20222 - DNA, 2286 bp, Artificial Sequence
  Description of Artificial Sequence: Synthetic coding sequence
atggaggagcccggcgtgaccccccagccctacctgggcctgctgctggaggagctgagaagagtggtggccgccctgcccgagggcatgagacccgacagcaacctgtacggcttcccctgggagctggtgatctgcgccgccgtggtgggcttcttcgccgtgctgttcttcctgtggagaagcttcagaagcgtgagaagcagactgtacgtgggcagagagaagaagctggccctgatgctgagcggcctgatcgaggagaagagcaagctgctggagaagttcagcctggtgcagaaggagtacgagggctacgaggtggagagcagcctgaaggacgccagcttcgagaaggaggccaccgaggcccagagcctggaggccacctgcgagaagctgaacagaagcaacagcgagctggaggacgagatcctgtgcctggagaaggagctgaaggaggagaagagcaagcacagcgagcaggacgagctgatggccgacatcagcaagagaatccagagcctggaggacgagagcaagagcctgaagagccaggtggccgaggccaagatgaccttcaagatcttccagatgaacgaggagagactgaagatcgccatcaaggacgccctgaacgagaacagccagctgcaggagagccagaagcagctgctgcaggaggccgaggtgtggaaggagcaggtgagcgagctgaacaagcagaaggtgaccttcgaggacagcaaggtgcacgccgagcaggtgctgaacgacaaggagagccacatcaagaccctgaccgagagactgctgaagatgaaggactgggccgccatgctgggcgaggacatcaccgacgacgacaacctggagctggagatgaacagcgagagcgagaacggcgcctacctggacaacccccccaagggcgccctgaagaagctgatccacgccgccaagctgaacgccagcctgaagaccctggagggcgagagaaaccagatctacatccagctgagcgaggtggacaagaccaaggaggagctgaccgagcacatcaagaacctgcagaccgagcaggccagcctgcagagcgagaacacccacttcgagaacgagaaccagaagctgcagcagaagctgaaggtgatgaccgagctgtaccaggagaacgagatgaagctgcacagaaagctgaccgtggaggagaactacagactggagaaggaggagaagctgagcaaggtggacgagaagatcagccacgccaccgaggagctggagacctacagaaagagagccaaggacctggaggaggagctggagagaaccatccacagctaccagggccagatcatcagccacgagaagaaggcccacgacaactggctggccgccagaaacgccgagagaaacctgaacgacctgagaaaggagaacgcccacaacagacagaagctgaccgagaccgagctgaagttcgagctgctggagaaggacccctacgccctggacgtgcccaacaccgccttcggcagaggcagcagaggccccggcaaccccctggaccaccagatcaccaacgagagaggcgagagcagctgcgacagactgaccgacccccacagagcccccagcgacaccggcagcctgagccccccctgggaccaggacagaagaatgatgttccccccccccggccagagctaccccgacagcgccctgcccccccagagacaggacagattctgcagcaacagcggcagactgagcggccccgccgagctgagaagcttcaacatgcccagcctggacaagatggacggcagcatgcccagcgagatggagagcagcagaaacgacaccaaggacgacctgggcaacctgaacgtgcccgacagcagcctgcccgccgagaacgaggccaccggccccggcttcgtgcccccccccctggcccccatcagaggccccctgttccccgtggacgccagaggccccttcctgagaagaggcccccccttccccccccccccccccggcgccatgttcggcgccagcagagactacttcccccccggcgacttccccggccccccccccgcccccttcgccatgagaaacgtgtacccccccagaggcttccccccctacctgccccccagacccggcttcttccccccccccccccacagcgagggcagaagcgagttccccagcggcctgatcccccccagcaacgagcccgccaccgagcaccccgagccccagcaggagacctag

SEQ ID NO: 20223 - DNA, 2019 bp, Artificial Sequence
  Description of Artificial Sequence: Synthetic coding sequence
atggagctgaagagccccgaggaggaggtggtggccgccctgcccgagggcatgagacccgacagcaacctgtacggcttcccctgggagctggtgatctgcgccgccgtggtgggcttcttcgccgtgctgttcttcctgtggagaagcttcagaagcgtgagaagcagactgtacgtgggcagagagaagaagctggccctgatgctgagcggcctgatcgaggagaagagcaagctgctggagaagttcagcctggtgcagaaggaggccacctgcgagaagctgaacagaagcaacagcgagctggaggacgagatcctgtgcctggagaaggagctgaaggaggagaagagcaagcacagcgagcaggacgagctgatggccgacatcagcaagagaatccagagcctggaggacgagagcaagagcctgaagagccaggtggccgaggccaagatgaccttcaagatcttccagatgaacgaggagagactgaagatcgccatcaaggacgccctgaacgagaacagccagctgcaggagagccagaagcagctgctgcaggaggccgaggtgtggaaggagcaggtgagcgagctgaacaagcagaaggtgaccttcgaggacagcaaggtgcacgccgagcaggtgctgaacgacaaggagagccacatcaagaccctgaccgagagactgctgaagatgaaggactgggccgccatgctgggcgaggacatcaccgacgacgacaacctggagctggagatgaacagcgagagcgagaacggcgcctacctggacaacccccccaagggcgccctgaagaagctgatccacgccgccaagctgaacgccagcctgaagaccctggagggcgagagaaaccagatctacatccagctgagcgaggtggacaagaccaaggaggagctgaccgagcacatcaagaacctgcagaccgagcaggccagcctgcagagcgagaacacccacttcgagaacgagaaccagaagctgcagcagaagctgaaggtgatgaccgagctgtaccaggagaacgagatgaagctgcacagaaagctgaccgtggaggagaactacagactggagaaggaggagaagctgagcaaggtggacgagaagatcagccacgccaccgaggagctggagacctacagaaagagagccaaggacctggaggaggagctggagagaaccatccacagctaccagggccagatcatcagccacgagaagaaggcccacgacaactggctggccgccagaaacgccgagagaaacctgaacgacctgagaaaggagaacgcccacaacagacagaagctgaccgagaccgagctgaagttcgagctgctggagaaggacccctacgccctggacgtgcccaacaccgccttcggcagagagcacagcccctacggccccagccccctgggctggcccagcagcgagaccagagccttcctgagcccccccaccctgctggagggccccctgagactgagccccctgctgcccggcggcggcggcagaggcagcagaggccccggcaaccccctggaccaccagatcaccaacgagagaggcgagagcagctgcgacagactgaccgacccccacagagcccccagcgacaccggcagcctgagccccccctgggaccaggacagaagaatgatgttccccccccccggccagagctaccccgacagcgccctgcccccccagagacaggacagattctgcagcaacagcggcagactgagcggccccgccgagctgagaagcttcaacatgccccccggccccccccccgcccccttcgccatgagaaacgtgtacccccccagaggcttccccccctacctgccccccagacccggcttcttccccccccccccccacagcgagggcagaagcgagttccccagcggcctgatcccccccagcaacgagcccgccaccgagcaccccgagccccagcaggagacctag

SEQ ID NO: 20224 - DNA, 2430 bp, Artificial Sequence
  Description of Artificial Sequence: Synthetic coding sequence
atggaggagcccggcgtgaccccccagccctacctgggcctgctgctggaggagctgagaagagtggtggccgccctgcccgagggcatgagacccgacagcaacctgtacggcttcccctgggagctggtgatctgcgccgccgtggtgggcttcttcgccgtgctgttcttcctgtggagaagcttcagaagcgtgagaagcagactgtacgtgggcagagagaagaagctggccctgatgctgagcggcctgatcgaggagaagagcaagctgctggagaagttcagcctggtgcagaaggagtacgagggctacgaggtggagagcagcctgaaggacgccagcttcgagaaggaggccaccgaggcccagagcctggaggtggagaaccagatggccacctgcgagaagctgaacagaagcaacagcgagctggaggacgagatcctgtgcctggagaaggagctgaaggaggagaagagcaagcacagcgagcaggacgagctgatggccgacatcagcaagagaatccagagcctggaggacgagagcaagagcctgaagagccaggtggccgaggccaagatgaccttcaagatcttccagatgaacgaggagagactgaagatcgccatcaaggacgccctgaacgagaacagccagctgcaggagagccagaagcagctgctgcaggaggccgaggtgtggaaggagcaggtgagcgagctgaacaagcagaaggtgaccttcgaggacagcaaggtgcacgccgagcaggtgctgaacgacaaggagagccacatcaagaccctgaccgagagactgctgaagatgaaggactgggccgccatgctgggcgaggacatcaccgacgacgacaacctggagctggagatgaacagcgagagcgagaacggcgcctacctggacaacccccccaagggcgccctgaagaagctgatccacgccgccaagctgaacgccagcctgaagaccctggagggcgagagaaaccagatctacatccagctgagcgaggtggacaagaccaaggaggagctgaccgagcacatcaagaacctgcagaccgagcaggccagcctgcagagcgagaacacccacttcgagaacgagaaccagaagctgcagcagaagctgaaggtgatgaccgagctgtaccaggagaacgagatgaagctgcacagaaagctgaccgtggaggagaactacagactggagaaggaggagaagctgagcaaggtggacgagaagatcagccacgccaccgaggagctggagacctacagaaagagagccaaggacctggaggaggagctggagagaaccatccacagctaccagggccagatcatcagccacgagaagaaggcccacgacaactggctggccgccagaaacgccgagagaaacctgaacgacctgagaaaggagaacgcccacaacagacagaagctgaccgagaccgagctgaagttcgagctgctggagaaggacccctacgccctggacgtgcccaacaccgccttcggcagagagcacagcccctacggccccagccccctgggctggcccagcagcgagaccagagccttcctgagcccccccaccctgctggagggccccctgagactgagccccctgctgcccggcggcggcggcagaggcagcagaggccccggcaaccccctggaccaccagatcaccaacgagagaggcgagagcagctgcgacagactgaccgacccccacagagcccccagcgacaccggcagcctgagccccccctgggaccaggacagaagaatgatgttccccccccccggccagagctaccccgacagcgccctgcccccccagagacaggacagattctgcagcaacagcggcagactgagcggccccgccgagctgagaagcttcaacatgcccagcctggacaagatggacggcagcatgcccagcgagatggagagcagcagaaacgacaccaaggacgacctgggcaacctgaacgtgcccgacagcagcctgcccgccgagaacgaggccaccggccccggcttcgtgcccccccccctggcccccatcagaggccccctgttccccgtggacgccagaggccccttcctgagaagaggcccccccttccccccccccccccccggcgccatgttcggcgccagcagagactacttcccccccggcgacttccccggccccccccccgcccccttcgccatgagaaacgtgtacccccccagaggcttccccccctacctgccccccagacccggcttcttccccccccccccccacagcgagggcagaagcgagttccccagcggcctgatcccccccagcaacgagcccgccaccgagcaccccgagccccagcaggagacctag

SEQ ID NO: 20225 - DNA, 2328 bp, Artificial Sequence
  Description of Artificial Sequence: Synthetic coding sequence
atgagacccgacagcaacctgtacggcttcccctgggagctggtgatctgcgccgccgtggtgggcttcttcgccgtgctgttcttcctgtggagaagcttcagaagcgtgagaagcagactgtacgtgggcagagagaagaagctggccctgatgctgagcggcctgatcgaggagaagagcaagctgctggagaagttcagcctggtgcagaaggagtacgagggctacgaggtggagagcagcctgaaggacgccagcttcgagaaggaggccaccgaggcccagagcctggaggccacctgcgagaagctgaacagaagcaacagcgagctggaggacgagatcctgtgcctggagaaggagctgaaggaggagaagagcaagcacagcgagcaggacgagctgatggccgacatcagcaagagaatccagagcctggaggacgagagcaagagcctgaagagccaggtggccgaggccaagatgaccttcaagatcttccagatgaacgaggagagactgaagatcgccatcaaggacgccctgaacgagaacagccagctgcaggagagccagaagcagctgctgcaggaggccgaggtgtggaaggagcaggtgagcgagctgaacaagcagaaggtgaccttcgaggacagcaaggtgcacgccgagcaggtgctgaacgacaaggagagccacatcaagaccctgaccgagagactgctgaagatgaaggactgggccgccatgctgggcgaggacatcaccgacgacgacaacctggagctggagatgaacagcgagagcgagaacggcgcctacctggacaacccccccaagggcgccctgaagaagctgatccacgccgccaagctgaacgccagcctgaagaccctggagggcgagagaaaccagatctacatccagctgagcgaggtggacaagaccaaggaggagctgaccgagcacatcaagaacctgcagaccgagcaggccagcctgcagagcgagaacacccacttcgagaacgagaaccagaagctgcagcagaagctgaaggtgatgaccgagctgtaccaggagaacgagatgaagctgcacagaaagctgaccgtggaggagaactacagactggagaaggaggagaagctgagcaaggtggacgagaagatcagccacgccaccgaggagctggagacctacagaaagagagccaaggacctggaggaggagctggagagaaccatccacagctaccagggccagatcatcagccacgagaagaaggcccacgacaactggctggccgccagaaacgccgagagaaacctgaacgacctgagaaaggagaacgcccacaacagacagaagctgaccgagaccgagctgaagttcgagctgctggagaaggacccctacgccctggacgtgcccaacaccgccttcggcagagagcacagcccctacggccccagccccctgggctggcccagcagcgagaccagagccttcctgagcccccccaccctgctggagggccccctgagactgagccccctgctgcccggcggcggcggcagaggcagcagaggccccggcaaccccctggaccaccagatcaccaacgagagaggcgagagcagctgcgacagactgaccgacccccacagagcccccagcgacaccggcagcctgagccccccctgggaccaggacagaagaatgatgttccccccccccggccagagctaccccgacagcgccctgcccccccagagacaggacagattctgcagcaacagcggcagactgagcggccccgccgagctgagaagcttcaacatgcccagcctggacaagatggacggcagcatgcccagcgagatggagagcagcagaaacgacaccaaggacgacctgggcaacctgaacgtgcccgacagcagcctgcccgccgagaacgaggccaccggccccggcttcgtgcccccccccctggcccccatcagaggccccctgttccccgtggacgccagaggccccttcctgagaagaggcccccccttccccccccccccccccggcgccatgttcggcgccagcagagactacttcccccccggcgacttccccggccccccccccgcccccttcgccatgagaaacgtgtacccccccagaggcttccccccctacctgccccccagacccggcttcttccccccccccccccacagcgagggcagaagcgagttccccagcggcctgatcccccccagcaacgagcccgccaccgagcaccccgagccccagcaggagacctag

SEQ ID NO: 20226 - DNA, 1401 bp, Artificial Sequence
  Description of Artificial Sequence: Synthetic coding sequence
atgagactgagaaccagaaaggccagccagcagagcaaccagatccagacccagagaaccgccagagccaagagaaagtacagcgaggtggacgacagcctgcccagcggcggcgagaagcccagcaagaacgagaccggcctgctgagcagcatcaagaagttcatcaagggcagcacccccaaggaggagagagagaaccccagcaagagaagcagaatcgagagagacatcgacaacaacctgatcaccagcacccccagagccggcgagaagcccaacaagcagatcagcagagtgagaagaaagagccaggtgaacggcgaggccggcagctacgagatgaccaaccagcacgtgaagcagaacggcaagctggaggacaaccccagcagcggcagcccccccagaaccaccctgctgggcaccatcttcagccccgtgttcaacttcttcagccccgccaacaagaacggcaccagcggcagcgacagccccggccaggccgtggaggccgaggagatcgtgaagcagctggacatggagcaggtggacgagatcaccaccagcaccaccaccagcaccaacggcgccgcctacagcaaccaggccgtgcaggtgagacccagcctgaacaacggcctggaggaggccgaggagaccgtgaacagagacatcccccccctgaccgcccccgtgacccccgacagcggctacagcagcgcccacgccgaggccacctacgaggaggactgggaggtgttcgacccctactacttcatcaagcacgtgccccccctgaccgaggagcagctgaacagaaagcccgccctgcccctgaagaccagaagcacccccgagttcagcctggtgctggacctggacgagaccctggtgcactgcagcctgaacgagctggaggacgccgccctgaccttccccgtgctgttccaggacgtgatctaccaggtgtacgtgagactgagacccttcttcagagagttcctggagagaatgagccagatgtacgagatcatcctgttcaccgccagcaagaaggtgtacgccgacaagctgctgaacatcctggaccccaagaagcagctggtgagacacagactgttcagagagcactgcgtgtgcgtgcagggcaactacatcaaggacctgaacatcctgggcagagacctgagcaagaccatcatcatcgacaacagcccccaggccttcgcctaccagctgagcaacggcatccccatcgagagctggttcatggacaagaacgacaacgagctgctgaagctgatccccttcctggagaagctggtggagctgaacgaggacgtgagaccccacatcagagacagattcagactgcacgacctgctgccccccgactag

SEQ ID NO: 20227 - DNA, 1185 bp, Artificial Sequence
  Description of Artificial Sequence: Synthetic coding sequence
atgagactgagaaccagaaaggccagccagcagagcaaccagatccagacccagagaaccgccagagccaagagaaagtacagcgaggtggacgacagcctgcccagcggcggcgagaagcccagcaagaacgagaccggcctgctgagcagcatcaagaagttcatcaagggcagcacccccaaggaggagagagagaaccccagcaagagaagcagaatcgagagagacatcgacaacaacctgatcaccagcacccccagagccggcgagaagcccaacaagcagatcagcagagtgagaagaaagagccaggtgaacggcgaggccggcagctacgagatgaccaaccagcacgtgaagcagaacggcaagctggaggacaaccccagcagcggcagcccccccagaaccaccctgctgggcaccatcttcagccccgtgttcaacttcttcagccccgccaacaagaacgcccccgtgacccccgacagcggctacagcagcgcccacgccgaggccacctacgaggaggactgggaggtgttcgacccctactacttcatcaagcacgtgccccccctgaccgaggagcagctgaacagaaagcccgccctgcccctgaagaccagaagcacccccgagttcagcctggtgctggacctggacgagaccctggtgcactgcagcctgaacgagctggaggacgccgccctgaccttccccgtgctgttccaggacgtgatctaccaggtgtacgtgagactgagacccttcttcagagagttcctggagagaatgagccagatgtacgagatcatcctgttcaccgccagcaagaaggtgtacgccgacaagctgctgaacatcctggaccccaagaagcagctggtgagacacagactgttcagagagcactgcgtgtgcgtgcagggcaactacatcaaggacctgaacatcctgggcagagacctgagcaagaccatcatcatcgacaacagcccccaggccttcgcctaccagctgagcaacggcatccccatcgagagctggttcatggacaagaacgacaacgagctgctgaagctgatccccttcctggagaagctggtggagctgaacgaggacgtgagaccccacatcagagacagattcagactgcacgacctgctgccccccgactag

SEQ ID NO: 20228 - DNA, 1185 bp, Artificial Sequence; identical to SEQ ID NO: 20227
  Description of Artificial Sequence: Synthetic coding sequence

SEQ ID NO: 20229 - DNA, 498 bp, Artificial Sequence
  Description of Artificial Sequence: Synthetic coding sequence
atgagactgagaaccagaaaggccagccagcagagcaaccagatccagacccagagaaccgccagagccaagagaaagtacagcgaggtggacgacagcctgcccagcggcggcgagaagcccagcaagaacgagaccggcctgctgagcagcatcaagaagttcatcaagggcagcacccccaaggaggagagagagaaccccagcaagagaagcagaatcgagagagacatcgacaacaacctgatcaccagcacccccagagccggcgagaagcccaacaagcagatcagcagagtgagaagaaagagccaggtgaacggcgaggccggcagctacgagatgaccaaccagcacgtgaagcagaacggcaagctggaggacaaccccagcagcggcagcccccccagaaccaccctgctgggcaccatcttcagccccgtgttcaacttcttcagccccgccaacaagaacggcaccagcggcagcgacagctag

SEQ ID NO: 20230 - DNA, 1401 bp, Artificial Sequence; identical to SEQ ID NO: 20226
  Description of Artificial Sequence: Synthetic coding sequence

SEQ ID NO: 20231 - DNA, 279 bp, Artificial Sequence
  Description of Artificial Sequence: Synthetic coding sequence
atgagactgagaaccagaaaggccagccagcagagcaaccagatccagacccagagaaccgccagagccaagagaaagtacagcgaggtggacgacagcctgcccagcggcggcgagaagcccagcaagaacgagaccggcctgctgagcagcatcaagaagttcatcaagggcagcacccccaaggaggagagagagaaccccagcaagagaagcagaatcgagagagacatcgacaacaacctgatcaccagcacccccagagccggcgagaagtag

SEQ ID NO: 20232 - DNA, 354 bp, Artificial Sequence
  Description of Artificial Sequence: Synthetic coding sequence
atgagactgagaaccagaaaggccagccagcagagcaaccagatccagacccagagaaccgccagagccaagagaaagtacagcgaggtggacgacagcctgcccagcggcggcgagaagcccagcaagaacgagaccggcctgctgagcagcatcaagaagttcatcaagggcagcacccccaaggaggagagagagaaccccagcaagagaagcagaatcgagagagacatcgacaacaacctgatcaccagcacccccagagccggcgagaagcccaacaagcagatcagcagagtgagaagaaagagccaggtgaacggcgaggccggcagctacgagatgaccaactag

SEQ ID NO: 20233 - DNA, 522 bp, Artificial Sequence
  Description of Artificial Sequence: Synthetic coding sequence
atgggcgacctgccctgggccccccccgaggcccaggcccccagcaccgccggcgccggcgacgtggccgagcaccaggtggcccccgccagattcctgcagggcgcctggagacaggccgccggctggctgtgcagagagaccggcgccgcccccggcagcgcccaggccggcccccccgagaccgcccacgccgccgacccccagcccagaggcccccaggccccccccagactgccccccagcctgagccccgagagagtgcaccccggccagcccgccgcccccgccgagcccgcccccggcgcccccgccctgagaagcggccccagccagcccagaggcctgagactgcccgtgcccgtgcccgcctgcgccggcagcagcgcccccggcagccccgccgccctgcccgacagctacccctggcccccccccgccagaaacagacccgccaccctgccccccaccagcagagtgagccccctggccgccttcctggccagcgccccccagagatag

SEQ ID NO: 20234 - DNA, 252 bp, Artificial Sequence
  Description of Artificial Sequence: Synthetic coding sequence
atggccagcacccccatgggcaacgagggcgagaagaagagcagctggcccagccaggccgcccccagcctgagaggcggccccgccagcctgagcagaagcgaggagtacctgagccagatcagcgccgagctgatggaggaggccctgtgcaccgcctgctgccacctgaaccccgtgcccatcaagaagaagcagagccaggaccaggccacccagatcagcaagagagccttcttcaccaagacctag

SEQ ID NO: 20235 - DNA, 606 bp, Artificial Sequence
  Description of Artificial Sequence: Synthetic coding sequence
atgttcctggtggtggccgtgaacagcctgaccctgtaccagcccagcttcagacccctgctgggcgacgcctgctgcctgtgcgtggccgccgccgccggcgccctgtgcagagacctgggcccccaccacacccacaccagaggccccaacgacggcagctgcggcctgagcagatggagacacagacagcacggcgacagccccgaggacttcttcctggccagaggcgcccacctggccagcaccagaggcagaaacgagcacagccccaagggcagcctgcagaagtgcctgctgagcatcagagtgcagaccaccagactgagccacctgagagccggcgtgaccctgagatgcgtgctgctgtgcgtgagcgagagccccgtgggcctgagaagcgtggcctgcagcggcgacctgctgggcgaccccctgaccggcttcctggccttcctggtgagctgcctgacccccagcggcacccccggcaacaccagcctgaccaagctgagccccaccagcagcagccagggcctggccctgggccccctgagccccagcagctgcgacgccgccagccccagcatcagcctgggcctgtag

SEQ ID NO: 20236 - DNA, 645 bp, Artificial Sequence
  Description of Artificial Sequence: Synthetic coding sequence
atggagcccgccagagagccccccagcagagccagaccccccccccccctggccgccagacccgcccccgcccccgccgcccccagacccagaagccccgccgaggccgaggccagaggccccgagggcctgctgagaagaagcggcagcggctacgagggcagcaccagctggaaggccgccctggaggacaccaccaccagactgctgctgggcgccatcgccgtgctgctgttcgccatcctggtggtgatgagcatcctggccagcaagggctgcatcaagtgcgaggccccctgccccgaggactggctgctgtacggcagaaagtgctacttcttcagcgaggagcccagagactggaacaccggcagacagtactgccacacccacgaggccgtgctggccgtgatccagagccagaaggagctggagttcatgttcaagttcaccagaagagagccctggatcggcctgagaagagtgggcgacgagttccactgggtgaacggcgaccccttcgaccccgacaccttcaccatcgccggccccggcgagtgcgtgttcgtggagcccaccagactggtgagcaccgagtgcctgatgaccagaccctgggtgtgcagcaagatggcctacacctag

SEQ ID NO: 20237 - DNA, 1824 bp, Artificial Sequence
  Description of Artificial Sequence: Synthetic coding sequence
atggagctggtgagaagactgatgcccctgaccctgctgatcctgagctgcctggccgagctgaccatggccgaggccgagggcaacgccagctgcaccgtgagcctgggcggcgccaacatggccgagacccacaaggccatgatcctgcagctgaaccccagcgagaactgcacctggaccatcgagagacccgagaacaagagcatcagaatcatcttcagctacgtgcagctggaccccgacggcagctgcgagagcgagaacatcaaggtgttcgacggcaccagcagcaacggccccctgctgggccaggtgtgcagcaagaacgactacgtgcccgtgttcgagagcagcagcagcaccctgaccttccagatcgtgaccgacagcgccagaatccagagaaccgtgttcgtgttctactacttcttcagccccaacatcagcatccccaactgcggcggctacctggacaccctggagggcagcttcaccagccccaactaccccaagccccaccccgagctggcctactgcgtgtggcacatccaggtggagaaggactacaagatcaagctgaacttcaaggagatcttcctggagatcgacaagcagtgcaagttcgacttcctggccatctacgacggccccagcaccaacagcggcctgatcggccaggtgtgcggcagagtgacccccaccttcgagagcagcagcaacagcctgaccgtggtgctgagcaccgactacgccaacagctacagaggcttcagcgccagctacaccagcatctacgccgagaacatcaacaccaccagcctgacctgcagcagcgacagaatgagagtgatcatcagcaagagctacctggaggccttcaacagcaacggcaacaacctgcagctgaaggaccccacctgcagacccaagctgagcaacgtggtggagttcagcgtgcccctgaacggctgcggcaccatcagaaaggtggaggaccagagcatcacctacaccaacatcatcaccttcagcgccagcagcaccagcgaggtgatcaccagacagaagcagctgcagatcatcgtgaagtgcgagatgggccacaacagcaccgtggagatcatctacatcaccgaggacgacgtgatccagagccagaacgccctgggcaagtacaacaccagcatggccctgttcgagagcaacagcttcgagaagaccatcctggagagcccctactacgtggacctgaaccagaccctgttcgtgcaggtgagcctgcacaccagcgaccccaacctggtggtgttcctggacacctgcagagccagccccaccagcgacttcgccagccccacctacgacctgatcaagagcggctgcagcagagacgagacctgcaaggtgtaccccctgttcggccactacggcagattccagttcaacgccttcaagttcctgagaagcatgagcagcgtgtacctgcagtgcaaggtgctgatctgcgacagcagcgaccaccagagcagatgcaaccagggctgcgtgagcagaagcaagagagacatcagcagctacaagtggaagaccgacagcatcatcggccccatcagactgaagagagacagaagcgccagcggcaacagcggcttccagcacgagacccacgccgaggagacccccaaccagcccttcaacagcgtgcacctgttcagcttcatggtgctggccctgaacgtggtgaccgtggccaccatcaccgtgagacacttcgtgaaccagagagccgactacaagtaccagaagctgcagaactactag

SEQ ID NO: 20238 - DNA, 1824 bp, Artificial Sequence; identical to SEQ ID NO: 20237
  Description of Artificial Sequence: Synthetic coding sequence

SEQ ID NO: 20239 - DNA, 1161 bp, Artificial Sequence
  Description of Artificial Sequence: Synthetic coding sequence
atgaccagcctgttcagaagaagcagcagcggcagcggcggcggcggcaccgccggcgccagaggcggcggcggcggcaccgccgccccccaggagctgaacaacagcagacccgccagacaggtgagaagactggagttcaaccaggccatggacgacttcaagaccatgttccccaacatggactacgacatcatcgagtgcgtgctgagagccaacagcggcgccgtggacgccaccatcgaccagctgctgcagatgaacctggagggcggcggcagcagcggcggcgtgtacgaggacagcagcgacagcgaggacagcatcccccccgagatcctggagagaaccctggagcccgacagcagcgacgaggagcccccccccgtgtacagcccccccgcctaccacatgcacgtgttcgacagaccctaccccctggccccccccacccccccccccagaatcgacgccctgggcagcggcgcccccaccagccagagaagatacagaaactggaacccccccctgctgggcaacctgcccgacgacttcctgagaatcctgccccagcagctggacagcatccagggcaacgccggcggccccaagcccggcagcggcgagggctgcccccccgccatggccggccccggccccggcgaccaggagagcagatggaagcagtacctggaggacgagagaatcgccctgttcctgcagaacgaggagttcatgaaggagctgcagagaaacagagacttcctgctggccctggagagagacagactgaagtacgagagccagaagagcaagagcagcagcgtggccgtgggcaacgacttcggcttcagcagccccgtgcccggcaccggcgacgccaaccccgccgtgagcgaggacgccctgttcagagacaagctgaagcacatgggcaagagcaccagaagaaagctgttcgagctggccagagccttcagcgagaagaccaagatgagaaagagcaagagaaagcacctgctgaagcaccagagcctgggcgccgccgccagcaccgccaacctgctggacgacgtggagggccacgcctgcgacgaggacttcagaggcagaagacaggaggcccccaaggtggaggagggcctgagagagggccagtag

SEQ ID NO: 20240 - DNA, 1161 bp, Artificial Sequence; identical to SEQ ID NO: 20239
  Description of Artificial Sequence: Synthetic coding sequence

SEQ ID NO: 20241 - DNA, 471 bp, Artificial Sequence
  Description of Artificial Sequence: Synthetic coding sequence
atgcccgccctgctgcccgtggccagcagactgctgctgctgcccagagtgctgctgaccatggccagcggcagcccccccacccagcccagccccgccagcgacagcggcagcggctacgtgcccggcagcgtgagcgccgccttcgtgacctgccccaacgagaaggtggccaaggagatcgccagagccgtggtggagaagagactggccgcctgcgtgaacctgatcccccagatcaccagcatctacgagtggaagggcaagatcgaggaggacagcgaggtgctgatgatgatcaagacccagagcagcctggtgcccgccctgaccgacttcgtgagaagcgtgcacccctacgaggtggccgaggtgatcgccctgcccgtggagcagggcaacttcccctacctgcagtgggtgagacaggtgaccgagagcgtgagcgacagcatcaccgtgctgccctag

SEQ ID NO: 20242 - DNA, 597 bp, Artificial Sequence
  Description of Artificial Sequence: Synthetic coding sequence
atgatcggcagcggcctggccggcagcggcggcgccggcggccccagcagcaccgtgacctggtgcgccctgttcagcaaccacgtggccgccacccaggccagcctgctgctgagcttcgtgtggatgcccgccctgctgcccgtggccagcagactgctgctgctgcccagagtgctgctgaccatggccagcggcagcccccccacccagcccagccccgccagcgacagcggcagcggctacgtgcccggcagcgtgagcgccgccttcgtgacctgccccaacgagaaggtggccaaggagatcgccagagccgtggtggagaagagactggccgcctgcgtgaacctgatcccccagatcaccagcatctacgagtggaagggcaagatcgaggaggacagcgaggtgctgatgatgatcaagacccagagcagcctggtgcccgccctgaccgacttcgtgagaagcgtgcacccctacgaggtggccgaggtgatcgccctgcccgtggagcagggcaacttcccctacctgcagtgggtgagacaggtgaccgagagcgtgagcgacagcatcaccgtgctgccctag

SEQ ID NO: 20243 - DNA, 471 bp, Artificial Sequence; identical to SEQ ID NO: 20241
  Description of Artificial Sequence: Synthetic coding sequence

SEQ ID NO: 20244 - DNA, 540 bp, Artificial Sequence
  Description of Artificial Sequence: Synthetic coding sequence
atgagcggcggcagagcccccgccgtgctgctgggcggcgtggccagcctgctgctgagcttcgtgtggatgcccgccctgctgcccgtggccagcagactgctgctgctgcccagagtgctgctgaccatggccagcggcagcccccccacccagcccagccccgccagcgacagcggcagcggctacgtgcccggcagcgtgagcgccgccttcgtgacctgccccaacgagaaggtggccaaggagatcgccagagccgtggtggagaagagactggccgcctgcgtgaacctgatcccccagatcaccagcatctacgagtggaagggcaagatcgaggaggacagcgaggtgctgatgatgatcaagacccagagcagcctggtgcccgccctgaccgacttcgtgagaagcgtgcacccctacgaggtggccgaggtgatcgccctgcccgtggagcagggcaacttcccctacctgcagtgggtgagacaggtgaccgagagcgtgagcgacagcatcaccgtgctgccctag

SEQ ID NO: 20245 - DNA, 540 bp, Artificial Sequence; identical to SEQ ID NO: 20244
  Description of Artificial Sequence: Synthetic coding sequence

SEQ ID NO: 20246 - DNA, 129 bp, Artificial Sequence
  Description of Artificial Sequence: Synthetic coding sequence
atgagcggcggcagagcccccgccgtgctgctgggcggcgtggtgagcgacagacccagacccgcccccagcggccccagaagcctggacagatacccccaccccaagagccagagactggccccctag

SEQ ID NO: 20247 - DNA, 690 bp, Artificial Sequence
  Description of Artificial Sequence: Synthetic coding sequence
atgaccaccgccgccagacccaccttcgagcccgccagaggcggcagaggcaagggcgagggcgacctgagccagctgagcaagcagtacagcagcagagacctgcccagccacaccaagatcaagtacagacagaccacccaggacgcccccgaggaggtgagaaacagagacttcagaagagagctggaggagagagagagagccgccgccagagagaagaacagagacagacccaccagagagcacaccaccagcagcagcgtgagcaagaagcccagactggaccagatccccgccgccaacctggacgccgacgaccccctgaccgacgaggaggacgaggacttcgaggaggagagcgacgacgacgacaccgccgccctgctggccgagctggagaagatcaagaaggagagagccgaggagcaggccagaaaggagcaggagcagaaggccgaggaggagagaatcagaatggagaacatcctgagcggcaaccccctgctgaacctgaccggccccagccagccccaggccaacttcaaggtgaagagaagatgggacgacgacgtggtgttcaagaactgcgccaagggcgtggacgaccagaagaaggacaagagattcgtgaacgacaccctgagaagcgagttccacaagaagttcatggagaagtacatcaagtag

SEQ ID NO: 20248 - DNA, 618 bp, Artificial Sequence
  Description of Artificial Sequence: Synthetic coding sequence
atgagcatcatgagctacaacggcggcgccgtgatggccatgaagggcaagaactgcgtggccatcgccgccgacagaagattcggcatccaggcccagatggtgaccaccgacttccagaagatcttccccatgggcgacagactgtacatcggcctggccggcctggccaccgacgtgcagaccgtggcccagagactgaagttcagactgaacctgtacgagctgaaggagggcagacagatcaagccctacaccctgatgagcatggtggccaacctgctgtacgagaagagattcggcccctactacaccgagcccgtgatcgccggcctggaccccaagaccttcaagcccttcatctgcagcctggacctgatcggctgccccatggtgaccgacgacttcgtggtgagcggcacctgcgccgagcagatgtacggcatgtgcgagagcctgtgggagcccaacatggaccccgaccacctgttcgagaccatcagccaggccatgctgaacgccgtggacagagacgccgtgagcggcatgggcgtgatcgtgcacatcatcgagaaggacaagatcaccaccagaaccctgaaggccagaatggactag

SEQ ID NO: 20249 - DNA, 1089 bp, Artificial Sequence
  Description of Artificial Sequence: Synthetic coding sequence
atgaagaaggaggagaagctggactggatgtaccagggccccggcggcatggtgaacagagacgagtacctgctgggcagacccatcgacaagtacgtgttcgagaagatggaggagaaggaggccggctgcagcagcgagaccggcctgctgcccggcagcatcttcgcccccagcggcgccaacagcctgctggacatggccagcaagatcagagaggaccccctgttcatcatcagaaagaaggaggaggagaagaagagagaggtgctgaacaaccccgtgaagatgaagaagatcaaggagctgctgcagatgagcctggagaagaaggagaagaagaagaagaaggagaagaagaagaagcacaagaagcacaagcacagaagcagcagcagcgacagaagcagcagcgaggacgagcacagcgccggcagaagccagaagaagatggccaacagcagccccgtgctgagcaaggtgcccggctacggcctgcaggtgagaaacagcgacagaaaccagggcctgcagggccccctgaccgccgagcagaagagaggccacggcatgaagaaccacagcagaagcagaagcagcagccacagcccccccagacacgccagcaagaagagcaccagagaggccggcagcagagacagaagaagcagaagcctgggcagaagaagcagaagccccagacccagcaagctgcacaacagcaaggtgaacagaagagagaccggccagaccagaagccccagccccaagaaggaggtgtaccagagaagacacgcccccggctacaccagaaagctgagcgccgaggagctggagagaaagagacaggagatgatggagaacgccaagtggagagaggaggagagactgaacatcctgaagagacacgccaaggacgaggagagagagcagagactggagaagctggacagcagagacggcaagttcatccacagaatgaagctggagagcgccagcaccagcagcctggaggacagagtgaagagaaacatctacagcctgcagagaaccagcgtggccctggagaagaacttcatgaagagatag

SEQ ID NO: 20250 - DNA, 1617 bp, Artificial Sequence
  Description of Artificial Sequence: Synthetic coding sequence
atggcccagaagcccctgagactgctggcctgcggcgacgtggagggcaagttcgacatcctgttcaacagagtgcaggccatccagaagaagagcggcaacttcgacctgctgctgtgcgtgggcaacttcttcggcagcacccaggacgccgagtgggaggagtacaagaccggcatcaagaaggcccccatccagacctacgtgctgggcgccaacaaccaggagaccgtgaagtacttccaggacgccgacggctgcgagctggccgagaacatcacctacctgggcagaaagggcatcttcaccggcagcagcggcctgcagatcgtgtacctgagcggcaccgagagcctgaacgagcccgtgcccggctacagcttcagccccaaggacgtgagcagcctgagaatgatgctgtgcaccaccagccagttcaagggcgtggacatcctgctgaccagcccctggcccaagtgcgtgggcaacttcggcaacagcagcggcgaggtggacaccaagaagtgcggcagcgccctggtgagcagcctggccaccggcctgaagcccagataccacttcgccgccctggagaagacctactacgagagactgccctacagaaaccacatcatcctgcaggagaacgcccagcacgccaccagattcatcgccctggccaacgtgggcaaccccgagaagaagaagtacctgtacgccttcagcatcgtgcccatgaagctgatggacgccgccgagctggtgaagcagccccccgacgtgaccgagaacccctacagaaagagcggccaggaggccagcatcggcaagcagatcctggcccccgtggaggagagcgcctgccagttcttcttcgacctgaacgagaagcagggcagaaagagaagcagcaccggcagagacagcaagagcagcccccaccccaagcagcccagaaagcccccccagccccccggcccctgctggttctgcctggccagccccgaggtggagaagcacctggtggtgaacatcggcacccactgctacctggccctggccaagggcggcctgagcgacgaccacgtgctgatcctgcccatcggccactaccagagcgtggtggagctgagcgccgaggtggtggaggaggtggagaagtacaaggccaccctgagaagattcttcaagagcagaggcaagtggtgcgtggtgttcgagagaaactacaagagccaccacctgcagctgcaggtgatccccgtgcccatcagctgcagcaccaccgacgacatcaaggacgccttcatcacccaggcccaggagcagcagatcgagctgctggagatccccgagcacagcgacatcaagcagatcgcccagcccggcgccgcctacttctacgtggagctggacaccggcgagaagctgttccacagaatcaagaagaacttccccctgcagttcggcagagaggtgctggccagcgaggccatcctgaacgtgcccgacaagagcgactggagacagtgccagatcagcaaggaggacgaggagaccctggccagaagattcagaaaggacttcgagccctacgacttcaccctggacgactag

SEQ ID NO: 20251 - DNA, 762 bp, Artificial Sequence
  Description of Artificial Sequence: Synthetic coding sequence
atgaagctgatggacgccgccgagctggtgaagcagccccccgacgtgaccgagaacccctacagaaagagcggccaggaggccagcatcggcaagcagatcctggcccccgtggaggagagcgcctgccagttcttcttcgacctgaacgagaagcagggcagaaagagaagcagcaccggcagagacagcaagagcagcccccaccccaagcagcccagaaagcccccccagccccccggcccctgctggttctgcctggccagccccgaggtggagaagcacctggtggtgaacatcggcacccactgctacctggccctggccaagggcggcctgagcgacgaccacgtgctgatcctgcccatcggccactaccagagcgtggtggagctgagcgccgaggtggtggaggaggtggagaagtacaaggccaccctgagaagattcttcaagagcagaggcaagtggtgcgtggtgttcgagagaaactacaagagccaccacctgcagctgcagatcgcccagcccggcgccgcctacttctacgtggagctggacaccggcgagaagctgttccacagaatcaagaagaacttccccctgcagttcggcagagaggtgctggccagcgaggccatcctgaacgtgcccgacaagagcgactggagacagtgccagatcagcaaggaggacgaggagaccctggccagaagattcagaaaggacttcgagccctacgacttcaccctggacgactag

SEQ ID NO: 20252 - DNA, 1617 bp, Artificial Sequence; identical to SEQ ID NO: 20250
  Description of Artificial Sequence: Synthetic coding sequence

SEQ ID NO: 20253 - DNA, 2685 bp, Artificial Sequence
  Description of Artificial Sequence: Synthetic coding sequence
atggccaccagcatggccgccgccagcggcagattcgagagcgccaagagcatcgaggagagaaaggagcagaccagaaacgccagagccgaggtgctgagacaggccaaggccaacttcgagaaggaggagagaagaaaggagctgaagagactgagaggcgaggacacctggatgctgcccgacgtgaacgagagaatcgagcagttcagccaggagcacagcgtgaagaagaagaagaagaaggacaagcacagcaagaaggccaagaaggagaagaagaagaagagcaagaagcagaagtacgagaagaacaacgagagcagcgacagcagcagcagcagcgaggacgagtgggtggaggccgtgcccagccagacccccgacaaggagaaggcctggaaggtgaaggacgagaagagcggcaaggacgacacccagatcatcaagagagacgagtggatgaccgtggacttcatgagcgtgaagaccgtgagcagcagcagcctgaaggccgagaaggagaccatgagaaagatcgagcaggagaagaaccaggccctggagcagagcaagctgatggagagagagctgaacccctactggaaggacggcggcaccggcctgccccccgaggactgcagcgtgagcagcatcaccaaggtgagcgtggtggaggacggcggcctgagctggctgagaaagagctacctgagaatgaaggagcaggccgagaagcagagcagaaacttcgaggacatcgtggccgagagatacggcagcatggagatcttccagagcaagctggaggacgccgagaaggccgccagcaccaaggaggactacagaagagagagatggagaaagcccacctacagcgacaaggcccagaactgccaggagagcagagagagcgacctggtgaagtacggcaacagcagcagagacagatacgccaccaccgacaccgccaagaacagcaacaacgagaagttcatcggcgacgagaaggacaagagacccggcagcctggagacctgcagaagagagagcaaccccagacagaaccaggagttcagcttcggcaacctgagagccaagttcctgagacccagcgacgacgaggagctgagcttccacagcaagggcagaaagttcgagcccctgagcagcagcagcgccctggtggcccagggcagcctgtgcagcggcttcagaaagcccaccaagaacagcgaggagagactgaccagctggagcagaagcgacggcagaggcgacaagaagcacagcaaccagaagcccagcgagaccagcaccgacgagcaccagcacgtgcccgaggaccccagagagaagagccaggacgaggtgctgagagacgacccccccaagaaggagcacctgagagacaccaagagcaccttcgccggcagccccgagagagagagcatccacatcctgagcgtggacgagaagaacaagctgggcgccaagatcatcaaggccgagatgatgggcaacatggagctggccgagcagctgaaggtgcagctggagaaggccaacaagttcaaggagaccatcacccagatccccaagaagagcggcgtggagaacgaggaccagcaggaggtgatcctggtgagaaccgaccagagcggcagagtgtggcccgtgaacacccccggcaagagcctggagagccagggcggcagaagaaagagacagatggtgagcacccacgaggagagagagagagtgagatacttccacgacgacgacaacctgagcctgaacgacctggtgaagaacgagaagatgggcaccgccgagaaccagaacaagctgttcatgagaatggccagcaagttcatgggcaagaccgacggcgactactacaccctggacgacatgttcgtgagcaaggccgccgagagagagagactgggcgaggaggaggagaaccagagaaagaaggccatcgccgagcacagaagcctggccgcccagatggagaagtgcctgtactgcttcgacagcagccagttccccaagcacctgatcgtggccatcggcgtgaaggtgtacctgtgcctgcccaacgtgagaagcctgaccgagggccactgcctgatcgtgcccctgcagcaccacagagccgccaccctgctggacgaggacatctgggaggagatccagatgttcagaaagagcctggtgaagatgttcgaggacaagggcctggactgcatcttcctggagaccaacatgagcatgaagaagcagtaccacatggtgtacgagtgcatccccctgcccaaggaggtgggcgacatggcccccatctacttcaagaaggccatcatggagagcgacgaggagtggagcatgaacaagaagctgatcgacctgagcagcaaggacatcagaaagagcgtgcccagaggcctgccctacttcagcgtggacttcggcctgcacggcggcttcgcccacgtgatcgaggaccagcacaagttcccccactacttcggcaaggagatcatcggcggcatgctggacatcgagcccagactgtggagaaagggcatcagagagagcttcgaggaccagagaaagaaggccctgcagttcgcccagtggtggaagccctacgacttcaccaagagcaagaactactag

SEQ ID NO: 20254 - DNA, 291 bp, Artificial Sequence
  Description of Artificial Sequence: Synthetic coding sequence
atgttcgaggacaagggcctggactgcatcttcctggagaccaacatgagcatgaagaagcagtaccacatggtgtacgagtgcatccccctgcccaaggaggtgggcgacatggcccccatctacttcaagaaggccatcatggagagcgacgaggagtggagcatgaacaagaagctgatcgacctgagcagcaaggacatcagaaagagcgtgcccagaggcctgccctacttcagcgtggacttcggcctgcacggcggcttcgcccacgtgatcgaggaccagtag

SEQ ID NO: 20255 - DNA, 2229 bp, Artificial Sequence
  Description of Artificial Sequence: Synthetic coding sequence
atggccaccagcatggccgccgccagcggcagattcgagagcgccaagagcatcgaggagagaaaggagcagaccagaaacgccagagccgaggtgctgagacaggccaaggccaacttcgagaaggaggagagaagaaaggagctgaagagactgagaggcgaggacacctggatgctgcccgacgtgaacgagagaatcgagcagttcagccaggagcacagcgtgaagaagaagaagaagaaggacaagcacagcaagaaggccaagaaggagaagaagaagaagagcaagaagcagaagtacgagaagaacaacgagagcagcgacagcagcagcagcagcgaggacgagtgggtggaggccgtgcccagccagacccccgacaaggagaaggcctggaaggtgaaggacgagaagagcggcaaggacgacacccagatcatcaagagagacgagtggatgaccgtggacttcatgagcgtgaagaccgtgagcagcagcagcctgaaggccgagaaggagaccatgagaaagatcgagcaggagaagaaccaggccctggagcagagcaagctgatggagagagagctgaacccctactggaaggacggcggcaccggcctgccccccgaggactgcagcgtgagcagcatcaccaaggtgagcgtggtggaggacggcggcctgagctggctgagaaagagctacctgagaatgaaggagcaggccgagaagcagagcagaaacttcgaggacatcgtggccgagagatacggcagcatggagatcttccagagcaagctggaggacgccgagaaggccgccagcaccaaggaggactacagaagagagagatggagaaagcccacctacagcgacaaggcccagaactgccaggagagcagagagagcgacctggtgaagtacggcaacagcagcagagacagatacgccaccaccgacaccgccaagaacagcaacaacgagaagttcatcggcgacgagaaggacaagagacccggcagcctggagacctgcagaagagagagcaaccccagacagaaccaggagttcagcttcggcaacctgagagccaagttcctgagacccagcgacgacgaggagctgagcttccacagcaagggcagaaagttcgagcccctgagcagcagcagcgccctggtggcccagggcagcctgtgcagcggcttcagaaagcccaccaagaacagcgaggagagactgaccagctggagcagaagcgacggcagaggcgacaagaagcacagcaaccagaagcccagcgagaccagcaccgacgagcaccagcacgtgcccgaggaccccagagagaagagccaggacgaggtgctgagagacgacccccccaagaaggagcacctgagagacaccaagagcaccttcgccggcagccccgagagagagagcatccacatcctgagcgtggacgagaagaacaagctgggcgccaagatcatcaaggccgagatgatgggcaacatggagctggccgagcagctgaaggtgcagctggagaaggccaacaagttcaaggagaccatcacccagatccccaagaagagcggcgtggagaacgaggaccagcaggaggtgatcctggtgagaaccgaccagagcggcagagtgtggcccgtgaacacccccggcaagagcctggagagccagggcggcagaagaaagagacagatggtgagcacccacgaggagagagagagagtgagatacttccacgacgacgacaacctgagcctgaacgacctggtgaagaacgagaagatgggcaccgccgagaaccagaacaagctgttcatgagaatggccagcaagttcatgggcaagaccgacggcgactactacaccctggacgacatgttcgtgagcaaggccgccgagagagagagactgggcgaggaggaggagaaccagagaaagaaggccatcgccgagcacagaagcctggccgcccagatggagaagtgcctgtactgcttcgacagcagccagttccccaagcacctgatcgtggccatcggcgtgaaggtgtacctgtgcctgcccaacgtgagaagcctgaccgagggccactgcctgatcgtgcccctgcagcaccacagagccgccaccctgctggacgaggacatctgggaggagatccagatcaagagcagaaccgtgatccagtag

SEQ ID NO: 20256 - DNA, 207 bp, Artificial Sequence
  Description of Artificial Sequence: Synthetic coding sequence
atgccccagaaggacccctgccagaagcaggcctgcgagatccagaagtgcctgcaggccaacagctacatggagagcaagtgccaggccgtgatccaggagctgagaaagtgctgcgcccagtaccccaagggcagaagcgtggtgtgcagcggcttcgagaaggaggaggaggagaacctgaccagaaagagcgccagcaagtag

SEQ ID NO: 20257 - DNA, 1311 bp, Artificial Sequence
  Description of Artificial Sequence: Synthetic coding sequence
atgcccatgagcagcctgcccgccgccatcctgagccacatgaccgccatcaacaacgtgccccccccccccctgcacagcatccccaacctgaagaagagcaagcacatcaactacggccagctgaacgccctgtgccacatcagaggccagcacagcagaagcatgagcaacatcctgagcgcccacgacaccttcatgaagcagtaccccaaggtgttcctgcaccagaagcccagactgcccaagctgttcaagcaggaggagcagagagagctgaacgagggcaaggaggagagccagcaccagcagcccgacgacagcaacaacatcgccgtgcacgtgcagagagcccacggcggccacatcctgtacagacccaagagagccaccgagaagttcgaggagttcctggccatcctgaagaagctgcccatccacagaaccccctacgagcacaagaccgtgtggaagttcctgaagaccatccccgacctgaccttccagctgaacgacaagcacctgaagaccctgagcaagaccgtgttcagcgagacctggctgaagggcagcaccgtggtggccaacgacggcttctacgtgatcctgaagggcctggccagaccccagaccaacgtgtacaagaacctgatcgagggcagcgacagccccgacagcttcatcagccagagcttccacagcttcatctggagcgaggagttcaagaacagcaccctggccgagatgtacctgcccagctacgacagcatgctgagcaagtggagcaccttcggcaccctggaggtgatgccccagaacgagagcgagacccagatgttcagcgtggtgaccgaggacgactgcgagatcctgaagatccccgccaagggctacgccaagatcaaggaggagaagatcaagctggagaacatgcagaagctgaagctgatcagaatgtgcccctactacgaggagtggcccaccctgagcatctacgagctgatcgccctgctgaagtggaagaagttcccccccggccacgtgatcgtggagagcggcaacatcatcagcttcgtgggctacatcaacagcggctgctgcaacatctacagaagcatcatcggcttcgtgaagctgagaagcaacaaggtgaagagaagccagaagctggtgtacatgggcaagctgaaggagaaggagagcttcggcgagatcagcgtgctgctgcaggtgcccttcacctgcaccatcatcaccaagaaggaggtggagatggccatcatcgaggacaaggacctgttcgtggcctag

SEQ ID NO: 20258 - DNA, 876 bp, Artificial Sequence
  Description of Artificial Sequence: Synthetic coding sequence
atgctgctgcccctgcccccccagagcagcaagcccgtgcccaagaagagccagagcagcaagatcgtgcccagccaccacgaccccagcgagaagaccggcgagaactgccagaccaagatcagccccagcagcctgcaggagagccccagcagcctgcagggcgccctgaagaagagaagcgccttcgaggacctgaccaacgtgagcttcgagatgacccacgagaccctgtacctggccgtgaagctggtggacctgtacctgatgaaggccgtgtgcaagaaggacaagctgcagctgctgggcgccaccgccttcatgatcgccgccaagttcgaggagcacaacagccccagagtggacgacttcgtgtacatctgcgacgacaactaccagagaagcgaggtgctgagcatggagatcaacatcctgaacgtgctgaagtgcgacatcaacatccccatcgcctaccacttcctgagaagatacgccagatgcatccacaccaacatgaagaccctgaccctgagcagatacatctgcgagatgaccctgcaggagtaccactacgtgcaggagaaggccagcaagctggccgccgccagcctgctgctggccctgtacatgaagaagctgggctactgggtgcccttcctggagcactacagcggctacagcatcagcgagctgcaccccctggtgagacagctgaacaagctgctgaccttcagcagctacgacagcctgaaggccgtgtactacaagtacagccaccccgtgttcttcgaggtggccaagatccccgccctggacatgctgaagctggaggagatcctgaactgcgactgcgaggcccagggcctggtgctgtag

SEQ ID NO: 20259 - DNA, 4188 bp, Artificial Sequence
  Description of Artificial Sequence: Synthetic coding sequence
atgctgctgcccctgcccccccagagcagcaagcccgtgcccaagaagagccagagcagcaagatcgtgcccagccaccacgaccccagcgagaagaccggcgagaactgccagaccaagatcagccccagcagcctgcaggagagccccagcagcctgcagggcgccctgaagaagagaagcgccttcgaggacctgaccaacgccagccagtgccagcccgtgcagcccaagaaggaggccaacaaggagttcgtgaaggtggtgagcaagaagatcaacagaaacacccacgccctgggcctggccaagaagaacaagagaaacctgaagtggcacaagctggaggtgacccccgtggtggccagcaccaccgtggtgcccaacatcatggagaagcccctgatcctggacatcagcaccaccagcaagacccccaacaccgaggaggccagcctgttcagaaagcccctggtgctgaaggaggagcccaccatcgaggacgagaccctgatcaacaagagcctgagcctgaagaagtgcagcaaccacgaggaggtgagcctgctggagaagctgcagcccctgcaggaggagagcgacagcgacgacgccttcgtgatcgagcccatgaccttcaagaagacccacaagaccgaggaggccgccatcaccaagaagaccctgagcctgaagaagaagatgtgcgccagccagagaaagcagagctgccaggaggagagcctggccgtgcaggacgtgaacatggaggaggacagcttcttcatggagagcatgagcttcaagaagaagcccaagaccgaggagagcatccccacccacaagctgagcagcctgaagaagaagtgcaccatctacggcaagatctgccacttcagaaagccccccgtgctgcagaccaccatctgcggcgccatgagcagcatcaagaagcccaccaccgagaaggagaccctgttccaggagctgagcgtgctgcaggagaagcacaccaccgagcacgagatgagcatcctgaagaagagcctggccctgcagaagaccaacttcaaggaggacagcctggtgaaggagagcctggccttcaagaagaagcccagcaccgaggaggccatcatgatgcccgtgatcctgaaggagcagtgcatgaccgagggcaagagaagcagactgaagcccctggtgctgcaggagatcaccagcggcgagaagagcctgatcatgaagcccctgagcatcaaggagaagcccagcaccgagaaggagagcttcagccaggagcccagcgccctgcagaagaagcacaccacccaggaggaggtgagcatcctgaaggagcccagcagcctgctgaagagccccaccgaggagagccccttcgacgaggccctggccttcaccaagaagtgcaccatcgaggaggccccccccaccaagaagcccctgatcctgaagagaaagcacgccacccagggcaccatgagccacctgaagaagcccctgatcctgcagaccaccagcggcgagaagagcctgatcaaggagcccctgcccttcaaggaggagaaggtgagcctgaagaagaagtgcaccacccaggagatgatgagcatctgccccgagctgctggacttccaggacatgatcggcgaggacaagaacagcttcttcatggagcccatgagcttcagaaagaaccccaccaccgaggagaccgtgctgaccaagaccagcctgagcctgcaggagaagaagatcacccagggcaagatgagccacctgaagaagcccctggtgctgcagaagatcaccagcgaggaggagagcttctacaagaagctgctgcccttcaagatgaagagcaccaccgaggagaagttcctgagccaggagcccagcgccctgaaggagaagcacaccaccctgcaggaggtgagcctgagcaaggagagcctggccatccaggagaaggccaccaccgaggaggagttcagccaggagctgttcagcctgcacgtgaagcacaccaacaagagcggcagcctgttccaggaggccctggtgctgcaggagaagaccgacgccgaggaggacagcctgaagaacctgctggccctgcaggagaagagcaccatggaggaggagagcctgatcaacaagctgctggccctgaaggaggagctgagcgccgaggccgccaccaacatccagacccagctgagcctgaagaagaagagcaccagccacggcaaggtgttcttcctgaagaagcagctggccctgaacgagaccatcaacgaggaggagttcctgaacaagcagcccctggccctggagggctaccccagcatcgccgagggcgagaccctgttcaagaagctgctggccatgcaggaggagcccagcatcgagaaggaggccgtgctgaaggagcccaccatcgacaccgaggcccacttcaaggagcccctggccctgcaggaggagcccagcaccgagaaggaggccgtgctgaaggagcccagcgtggacaccgaggcccacttcaaggagaccctggccctgcaggagaagcccagcatcgagcaggaggccctgttcaagagacacagcgccctgtgggagaagcccagcaccgagaaggagaccatcttcaaggagagcctggacctgcaggagaagcccagcatcaagaaggagaccctgctgaagaagcccctggccctgaagatgagcaccatcaacgaggccgtgctgttcgaggacatgatcgccctgaacgagaagcccaccaccggcaaggagctgagcttcaaggagcccctggccctgcaggagagccccacctacaaggaggacaccttcctgaagaccctgctggtgccccaggtgggcaccagccccaacgtgagcagcaccgcccccgagagcatcaccagcaagagcagcatcgccaccatgaccagcgtgggcaagagcggcaccatcaacgaggccttcctgttcgaggacatgatcaccctgaacgagaagcccaccaccggcaaggagctgagcttcaaggagcccctggccctgcaggagagccccacctgcaaggaggacaccttcctggagaccttcctgatcccccagatcggcaccagcccctacgtgttcagcaccacccccgagagcatcaccgagaagagcagcatcgccaccatgaccagcgtgggcaagagcagaaccaccaccgagagcagcgcctgcgagagcgccagcgacaagcccgtgagcccccaggccaagggcacccccaaggagatcacccccagagaggacatcgacgaggacagcagcgaccccagcttcaaccccatgtacgccaaggagatcttcagctacatgaaggagagagaggagcagttcatcctgaccgactacatgaacagacagatcgagatcaccagcgacatgagagccatcctggtggactggctggtggaggtgcaggtgagcttcgagatgacccacgagaccctgtacctggccgtgaagctggtggacctgtacctgatgaaggccgtgtgcaagaaggacaagctgcagctgctgggcgccaccgccttcatgatcgccgccaagttcgaggagcacaacagccccagagtggacgacttcgtgtacatctgcgacgacaactaccagagaagcgaggtgctgagcatggagatcaacatcctgaacgtgctgaagtgcgacatcaacatccccatcgcctaccacttcctgagaagatacgccagatgcatccacaccaacatgaagaccctgaccctgagcagatacatctgcgagatgaccctgcaggagtaccactacgtgcaggagaaggccagcaagctggccgccgccagcctgctgctggccctgtacatgaagaagctgggctactgggtgcccttcctggagcactacagcggctacagcatcagcgagctgcaccccctggtgagacagctgaacaagctgctgaccttcagcagctacgacagcctgaaggccgtgtactacaagtacagccaccccgtgttcttcgaggtggccaagatccccgccctggacatgctgaagctggaggagatcctgaactgcgactgcgaggcccagggcctggtgctgtag

SEQ ID NO: 20260 - DNA, 4188 bp, Artificial Sequence; identical to SEQ ID NO: 20259
  Description of Artificial Sequence: Synthetic coding sequence

SEQ ID NO: 20261 - DNA, 4188 bp, Artificial Sequence; identical to SEQ ID NO: 20259
  Description of Artificial Sequence: Synthetic coding sequence

SEQ ID NO: 20262 - DNA, 876 bp, Artificial Sequence; identical to SEQ ID NO: 20258
  Description of Artificial Sequence: Synthetic coding sequence

SEQ ID NO: 20263 - DNA, 4188 bp, Artificial Sequence; identical to SEQ ID NO: 20259
  Description of Artificial Sequence: Synthetic coding sequence

SEQ ID NO: 20264 - DNA, 876 bp, Artificial Sequence; identical to SEQ ID NO: 20258
  Description of Artificial Sequence: Synthetic coding sequence

SEQ ID NO: 20265 - DNA, 876 bp, Artificial Sequence; identical to SEQ ID NO: 20258
  Description of Artificial Sequence: Synthetic coding sequence

SEQ ID NO: 20266 - DNA, 1215 bp, Artificial Sequence
  Description of Artificial Sequence: Synthetic coding sequence
atgagcagaagaagcagcagactgcaggccaagcagcagccccagcccagccagaccgagagcccccaggaggcccagatcatccaggccaagaagagaaagaccacccaggacgtgaagaagagaagagaggaggtgaccaagaagcaccagtacgagatcagaaactgctggccccccgtgctgagcggcggcatcagcccctgcatcatcatcgagaccccccacaaggagatcggcaccagcgacttcagcagattcaccaactacagattcaagaacctgttcatcaaccccagccccctgcccgacctgagctggggctgcagcaaggaggtgtggctgaacatgctgaagaaggagagcagatacgtgcacgacaagcacttcgaggtgctgcacagcgacctggagccccagatgagaagcatcctgctggactggctgctggaggtgtgcgaggtgtacaccctgcacagagagaccttctacctggcccaggacttcttcgacagattcatgctgacccagaaggacatcaacaagaacatgctgcagctgatcggcatcaccagcctgttcatcgccagcaagctggaggagatctacgcccccaagctgcaggagttcgcctacgtgaccgacggcgcctgcagcgaggaggacatcctgagaatggagctgatcatcctgaaggccctgaagtgggagctgtgccccgtgaccatcatcagctggctgaacctgttcctgcaggtggacgccctgaaggacgcccccaaggtgctgctgccccagtacagccaggagaccttcatccagatcgcccagctgctggacctgtgcatcctggccatcgacagcctggagttccagtacagaatcctgaccgccgccgccctgtgccacttcaccagcatcgaggtggtgaagaaggccagcggcctggagtgggacagcatcagcgagtgcgtggactggatggtgcccttcgtgaacgtggtgaagagcaccagccccgtgaagctgaagaccttcaagaagatccccatggaggacagacacaacatccagacccacaccaactacctggccatgctggaggaggtgaactacatcaacaccttcagaaagggcggccagctgagccccgtgtgcaacggcggcatcatgaccccccccaagagcaccgagaagccccccggcaagcactag

SEQ ID NO: 20267 - DNA, 1125 bp, Artificial Sequence
  Description of Artificial Sequence: Synthetic coding sequence
atgagcagaagaagcagcagactgcaggccaagcagcagccccagcccagccagaccgagagcccccaggaggcccagatcatccaggccaagaagagaaagaccacccaggacgtgaagaagagaagagaggaggtgaccaagaagcaccagtacgagatcagaaactgctggccccccgtgctgagcggcggcatcagcccctgcatcatcatcgagaccccccacaaggagatcggcaccagcgacttcagcagattcaccaactacagattcaagaacctgttcatcaaccccagccccctgcccgacctgagctggggctgcagcaaggaggtgtggctgaacatgctgaagaaggagagcagatacgtgcacgacaagcacttcgaggtgctgcacagcgacctggagccccagatgagaagcatcctgctggactggctgctggaggtgtgcgaggtgtacaccctgcacagagagaccttctacctggcccaggacttcttcgacagattcatgctgacccagaaggacatcaacaagaacatgctgcagctgatcggcatcaccagcctgttcatcgccagcaagctggaggagatctacgcccccaagctgcaggagttcgcctacgtgaccgacggcgcctgcagcgaggaggacatcctgagaatggagctgatcatcctgaaggccctgaagtgggagctgtgccccgtgaccatcatcagctggctgaacctgttcctgcaggtggacgccctgaaggacgcccccaaggtgctgctgccccagtacagccaggagaccttcatccagatcgcccagctgctggacctgtgcatcctggccatcgacagcctggagttccagtacagaatcctgaccgccgccgccctgtgccacttcaccagcatcgaggtggtgaagaaggccagcggcctggagtgggacagcatcagcgagtgcgtggactggatggtgcccttcgtgaacgtggtgaagagcaccagccccgtgaagctgaagaccttcaagaagatccccatggaggacagacacaacatccagacccacaccaactacctggccatgctgtgcatgatcagcagccacgtgtag

SEQ ID NO: 20268 - DNA, 1215 bp, Artificial Sequence; identical to SEQ ID NO: 20266
  Description of Artificial Sequence: Synthetic coding sequence

SEQ ID NO: 20269 - DNA, 891 bp, Artificial Sequence
  Description of Artificial Sequence: Synthetic coding sequence
atgagcaaggaggtgtggctgaacatgctgaagaaggagagcagatacgtgcacgacaagcacttcgaggtgctgcacagcgacctggagccccagatgagaagcatcctgctggactggctgctggaggtgtgcgaggtgtacaccctgcacagagagaccttctacctggcccaggacttcttcgacagattcatgctgacccagaaggacatcaacaagaacatgctgcagctgatcggcatcaccagcctgttcatcgccagcaagctggaggagatctacgcccccaagctgcaggagttcgcctacgtgaccgacggcgcctgcagcgaggaggacatcctgagaatggagctgatcatcctgaaggccctgaagtgggagctgtgccccgtgaccatcatcagctggctgaacctgttcctgcaggtggacgccctgaaggacgcccccaaggtgctgctgccccagtacagccaggagaccttcatccagatcgcccagctgctggacctgtgcatcctggccatcgacagcctggagttccagtacagaatcctgaccgccgccgccctgtgccacttcaccagcatcgaggtggtgaagaaggccagcggcctggagtgggacagcatcagcgagtgcgtggactggatggtgcccttcgtgaacgtggtgaagagcaccagccccgtgaagctgaagaccttcaagaagatccccatggaggacagacacaacatccagacccacaccaactacctggccatgctggaggaggtgaactacatcaacaccttcagaaagggcggccagctgagccccgtgtgcaacggcggcatcatgaccccccccaagagcaccgagaagccccccggcaagcactag

SEQ ID NO: 20270 - DNA, 1134 bp, Artificial Sequence
  Description of Artificial Sequence: Synthetic coding sequence
atgaagttccccggccccctggagaaccagagactgagcttcctgctggagaaggccatcaccagagaggcccagatgtggaaggtgaacgtgagaaagatgcccagcaaccagaacgtgagccccagccagagagacgaggtgatccagtggctggccaagctgaagtaccagttcaacctgtaccccgagaccttcgccctggccagcagcctgctggacagattcctggccaccgtgaaggcccaccccaagtacctgagctgcatcgccatcagctgcttcttcctggccgccaagaccgtggaggaggacgagagaatccccgtgctgaaggtgctggccagagacagcttctgcggctgcagcagcagcgagatcctgagaatggagagaatcatcctggacaagctgaactgggacctgcacaccgccacccccctggacttcctgcacatcttccacgccatcgccgtgagcaccagaccccagctgctgttcagcctgcccaagctgagccccagccagcacctggccgtgctgaccaagcagctgctgcactgcatggcctgcaaccagctgctgcagttcagaggcagcatgctggccctggccatggtgagcctggagatggagaagctgatccccgactggctgagcctgaccatcgagctgctgcagaaggcccagatggacagcagccagctgatccactgcagagagctggtggcccaccacctgagcaccctgcagagcagcctgcccctgaacagcgtgtacgtgtacagacccctgaagcacaccctggtgacctgcgacaagggcgtgttcagactgcaccccagcagcgtgcccggccccgacttcagcaaggacaacagcaagcccgaggtgcccgtgagaggcaccgccgccttctaccaccacctgcccgccgccagcggctgcaagcagaccagcaccaagagaaaggtggaggagatggaggtggacgacttctacgacggcatcaagagactgtacaacgaggacaacgtgagcgagaacgtgggcagcgtgtgcggcaccgacctgagcagacaggagggccacgccagcccctgcccccccctgcagcccgtgagcgtgatgtag

SEQ ID NO: 20271 - DNA, 378 bp, Artificial Sequence
  Description of Artificial Sequence: Synthetic coding sequence
atgaagttccccggccccctggagaaccagagactgagcttcctgctggagaaggccatcaccagagaggcccagatgtggaaggtgaacgtgagaaagatgcccagcaaccagaacgtgagccccagccagagagacgaggtgatccagtggctggccaagctgaagtaccagttcaacctgtaccccgagaccttcgccctggccagcagcctgctggacagattcctggccaccgtgaaggcccaccccaagtacctgagctgcatcgccatcagctgcttcttcctggccgccaagaccgtggaggaggacgagagaatccccgtgctgaaggtgctggccagagacagcttctgcggctgcagcagcagctag

SEQ ID NO: 20272 - DNA, 243 bp, Artificial Sequence
  Description of Artificial Sequence: Synthetic coding sequence
atgaagttccccggccccctggagaaccagagactgagcttcctgctggagaaggccatcaccagagaggcccagatgtggaaggtgaacgtgagaaagatgcccagcaaccagaacgtgagccccagccagagagacgaggtgatccagtggctggccaagctgaagtaccagttcaacctgtaccccgagaccttcgccctggccagcagcctgctggacagattcctggccaccgtgtag

SEQ ID NO: 20273 - DNA, 1092 bp, Artificial Sequence
  Description of Artificial Sequence: Synthetic coding sequence
atgacccccagacaccactgcgaggcctacagcagcgccggcgaggaggaggaggaggaggaggaggagaagaacgtgagccccagccagagagacgaggtgatccagtggctggccaagctgaagtaccagttcaacctgtaccccgagaccttcgccctggccagcagcctgctggacagattcctggccaccgtgaaggcccaccccaagtacctgagctgcatcgccatcagctgcttcttcctggccgccaagaccgtggaggaggacgagagaatccccgtgctgaaggtgctggccagagacagcttctgcggctgcagcagcagcgagatcctgagaatggagagaatcatcctggacaagctgaactgggacctgcacaccgccacccccctggacttcctgcacatcttccacgccatcgccgtgagcaccagaccccagctgctgttcagcctgcccaagctgagccccagccagcacctggccgtgctgaccaagcagctgctgcactgcatggcctgcaaccagctgctgcagttcagaggcagcatgctggccctggccatggtgagcctggagatggagaagctgatccccgactggctgagcctgaccatcgagctgctgcagaaggcccagatggacagcagccagctgatccactgcagagagctggtggcccaccacctgagcaccctgcagagcagcctgcccctgaacagcgtgtacgtgtacagacccctgaagcacaccctggtgacctgcgacaagggcgtgttcagactgcaccccagcagcgtgcccggccccgacttcagcaaggacaacagcaagcccgaggtgcccgtgagaggcaccgccgccttctaccaccacctgcccgccgccagcggctgcaagcagaccagcaccaagagaaaggtggaggagatggaggtggacgacttctacgacggcatcaagagactgtacaacgaggacaacgtgagcgagaacgtgggcagcgtgtgcggcaccgacctgagcagacaggagggccacgccagcccctgcccccccctgcagcccgtgagcgtgatgtag

SEQ ID NO: 20274 - DNA, 1110 bp, Artificial Sequence
  Description of Artificial Sequence: Synthetic coding sequence
atggccagcggcgcccagctgcccccccagcccagcagcagcgaggtgagcgccgtgcagagccccggcggcagacccggcgccggcctggaggagaccgccctgggcgtgcccctgccccccagccccggcgaggcccccctgcccagaagcaacagaagcagatgccccggcaccagacagcccggcgccgccagcctgcacgccgccagcgccgccgtgcccgtgagacccagaagaggcaccgcccccgccggcaagaccgccgacgccgtgcccgccgccgcccccgagcaggcccccagacccgccccccagagcagaaagcccagaaacctggagggcgacctggacgagagaagactgctgtgccacctgcagctggcccaggacagagaggccagactgtggagaggcggcaagccccaggacgagatctgcgacgccttcgaggaggtggtgctgtggctgctgagactgcagaacaccttctacttcagccagagcaccttcaacctggccctgaccatcttcggcagactgctgatcagcgtgaaggtgaaggagaagtacctgcactgcgccaccatcaccagcctgagactggccgccaaggtgaacgaggaggaggagttcatcccccaggtgaaggacttcaccaagcactacggcagcgactacagccccaacgagctgctgagaatggagctggccatcctggacagactgcactgggacctgtacatcggcacccccctggacttcctgaccatcttccacgccctggtggtgctgagctggccccacgtgctggagctgctgccccagagaaaccccagcctgcacgtggccagcctgaccagacagctgcagcactgcatggccggccaccagctgctgcagttcaagggcagcaccctggccctggtgatcatcaccctggagctggagagactgatgcccggctggtgcgcccccatcagcgacctgctgaagaaggcccaggtgggcgacatgcagtacagctgctgcaaggagctggtgatgcagcagctgagaagcctgcagagcagcagctgcaccgacaacttcgtgagccccgccaactag

SEQ ID NO: 20275 - DNA, 993 bp, Artificial Sequence
  Description of Artificial Sequence: Synthetic coding sequence
atggacggccccatgagacccagaagcgccagcctggtggacttccagttcggcgtggtggccaccgagaccatcgaggacgccctgctgcacctggcccagcagaacgagcaggccgtgagagaggccagcggcagactgggcagattcagagagccccagatcgtggagttcgtgttcctgctgagcgagcagtggtgcctggagaagagcgtgagctaccaggccgtggagatcctggagagattcatggtgaagcaggccgagaacatctgcagacaggccaccatccagcccagagacaacaagagagagagccagaactggagagccctgaagcagcagctggtgaacaagttcaccctgagactggtgagctgcgtgcagctggccagcaagctgagcttcagaaacaagatcatcagcaacatcaccgtgctgaacttcctgcaggccctgggctacctgcacaccaaggaggagctgctggagagcgagctggacgtgctgaagagcctgaacttcagaatcaacctgcccacccccctggcctacgtggagaccctgctggaggtgctgggctacaacggctgcctggtgcccgccatgagactgcacgccacctgcctgaccctgctggacctggtgtacctgctgcacgagcccatctacgagagcctgctgagagccagcatcgagaacagcacccccagccagctgcagggcgagaagttcaccagcgtgaaggaggacttcatgctgctggccgtgggcatcatcgccgccagcgccttcatccagaaccacgagtgctggagccaggtggtgggccacctgcagagcatcaccggcatcgccctggccagcatcgccgagttcagctacgccatcctgacccacggcgtgggcgccaacacccccggcagacagcagagcatccccccccacctggccgccagagccctgaagaccgtggccagcagcaacacctag

SEQ ID NO: 20276 - DNA, 993 bp, Artificial Sequence; identical to SEQ ID NO: 20275
  Description of Artificial Sequence: Synthetic coding sequence

SEQ ID NO: 20277 - DNA, 924 bp, Artificial Sequence
  Description of Artificial Sequence: Synthetic coding sequence
atgctggtgagaggcagagaccagggcagcggcagcagactgggccccatcgtgagaagatgggcccccagacccagccccctgcagagcctggccgccagcctggacgccgagcccagcagcgccgccgtgcccgacggcttccccgccggccccaccgtgagccccagaagactggccagaccccccggcctggaggaggccctgagcgccctgggcctgcagggcgagagagagtacgccggcgacatcttcgccgaggtgatggtgtgcagagtgctgcccctgagagccctgcccagagccgtgacccccgagatgagagccctggtggtggactggctggtgcaggtgcacgagtacctgggcctggccggcgacaccctgtacctggccgtgcacctgctggacagctacctgagcgccggcagagtgagactgcacagactgcagctgctgggcgtggcctgcctgttcgtggcctgcaagatggaggagtgcgtgctgcccgagcccgccttcctgtgcctgctgagcgccgacagcttcagcagagccgagctgctgagagccgagagaagaatcctgagcagactggacttcagactgcaccaccccggccccctgctgtgcctgggcctgctggccgccctggccggcagcagcccccaggtgatgctgctggccacctacttcctggagctgagcctgctggaggccgaggccgccggctgggagcccggcagaagagccgccgccgccctgagcctggcccacagactgctggacggcgccggcagcagactgcagcccgagctgtacagatgcagcctgggcggcggcagcgtgtggggccacagaagcttcagagacctgcccagctggagcttcctgagaagcagaagaatgagagacaactactag

SEQ ID NO: 20278 - DNA, 468 bp, Artificial Sequence
  Description of Artificial Sequence: Synthetic coding sequence
atgctggtgagaggcagagaccagggcagcggcagcagactgggccccatcgtgagaagatgggcccccagacccagccccctgcagagcctggccgccagcctggacgccgagcccagcagcgccgccgtgcccgacggcttccccgccggccccaccgtgagccccagaagactggccagaccccccggcctggaggaggccctgagcgccctgggcctgcagggcgagagagagtacgccggcgacatcttcgccgaggtgatggagtacctgggcctggccggcgacaccctgtacctggccgtgcacctgctggacagctacctgagcgccggcagagtgagactgcacagactgcagctgctgggcgtggcctgcctgttcgtggcctgcaagatggaggagtgcgtgctgcccgaggagaccgaggtgagaaacctgggccccttccagggcagagagtag

SEQ ID NO: 20279 - DNA, 1080 bp, Artificial Sequence
  Description of Artificial Sequence: Synthetic coding sequence
atgggcaacaccctgacctgctgcgtgagccccaacgccagccccaagctgggcagaagagccggcagcgccgagctgtactgcgccagcgacatctacgaggccgtgagcggcgacgccgtggccgtggcccccgccgtggtggagcccgccgagctggacttcggcgagggcgagggccaccacctgcagcacatcagcgacagagagatgcccgaggacctggccctggagagcaaccccagcgaccaccccagagccagcaccatcttcctgagcaagagccagaccgacgtgagagagaagagaaagagcaaccacctgaaccacgtgagccccggccagctgaccaagaagtacagcagctgcagcaccatcttcctggacgacagcaccgtgagccagcccaacctgagaaccaccgtgaagtgcgtgaccctggccatctactaccacatcaagaacagagacgccaacagaagcctggacatcttcgacgagagaagccaccccctgaccagagagaaggtgcccgaggagtacttcaagcacgaccccgagcacaagttcatctacagattcgtgagaaccctgttcagcgccgcccagctgaccgccgagtgcgccatcgtgaccctggtgtacctggagagactgctgacctacgccgagatcgacatctgccccaccaactggaagagaatcgtgctgggcgccatcctgctggccagcaaggtgtgggacgaccaggccgtgtggaacgtggactactgccagatcctgaaggacatcaccgtggaggacatgaacgagatggagagacacttcctggagctgctgcagttcaacatcaacgtgcccgccagcgtgtacgccaagtactacttcgacctgagaagcctggccgacgacaacaacctgaacttcctgttcgcccccctgagcaaggagagagcccagaacctggaggccatcagcagactgtgcgaggacaaggacctgtgcagagccgccatgagaagaagcttcagcgccgacaacttcatcggcatccagagaagcaaggccatcctgagctag

SEQ ID NO: 20280 - DNA, 927 bp, Artificial Sequence
  Description of Artificial Sequence: Synthetic coding sequence
atgggcaacaccctgacctgctgcgtgagccccaacgccagccccaagctgggcagaagagccggcagcgccgagctgtactgcgccagcgacatctacgaggccgtgagcggcgacgccgtggccgtggcccccgccgtggtggagcccgccgagctggacttcggcgagggcgagggccaccacctgcagcacatcagcgacagagagatgcccgaggacctggccctggagagcaaccccagcgaccaccccagagccagcaccatcttcctgagcaagagccagaccgacgtgagagagaagagaaagagcaaccacctgaaccactgcgacctgagcaacatcctgccccacaaggagcagagagagaaggtgcccgaggagtacttcaagcacgaccccgagcacaagttcatctacagattcgtgagaaccctgttcagcgccgcccagctgaccgccgagtgcgccatcgtgaccctggtgtacctggagagactgctgacctacgccgagatcgacatctgccccaccaactggaagagaatcgtgctgggcgccatcctgctggccagcaaggtgtgggacgaccaggccgtgtggaacgtggactactgccagatcctgaaggacatcaccgtggaggacatgaacgagatggagagacacttcctggagctgctgcagttcaacatcaacgtgcccgccagcgtgtacgccaagtactacttcgacctgagaagcctggccgacgacaacaacctgaacttcctgttcgcccccctgagcaaggagagagcccagaacctggaggccatcagcagactgtgcgaggacaaggacctgtgcagagccgccatgagaagaagcttcagcgccgacaacttcatcggcatccagagaagcaaggccatcctgagctag

SEQ ID NO: 20281 - DNA, 870 bp, Artificial Sequence
  Description of Artificial Sequence: Synthetic coding sequence
atgcccgaggacctggccctggagagcaaccccagcgaccaccccagagccagcaccatcttcctgagcaagagccagaccgacgtgagagagaagagaaagagcaaccacctgaaccacgtgagccccggccagctgaccaagaagtacagcagctgcagcaccatcttcctggacgacagcaccgtgagccagcccaacctgagaaccaccgtgaagtgcgtgaccctggccatctactaccacatcaagaacagagacgccaacagaagcctggacatcttcgacgagagaagccaccccctgaccagagagaaggtgcccgaggagtacttcaagcacgaccccgagcacaagttcatctacagattcgtgagaaccctgttcagcgccgcccagctgaccgccgagtgcgccatcgtgaccctggtgtacctggagagactgctgacctacgccgagatcgacatctgccccaccaactggaagagaatcgtgctgggcgccatcctgctggccagcaaggtgtgggacgaccaggccgtgtggaacgtggactactgccagatcctgaaggacatcaccgtggaggacatgaacgagatggagagacacttcctggagctgctgcagttcaacatcaacgtgcccgccagcgtgtacgccaagtactacttcgacctgagaagcctggccgacgacaacaacctgaacttcctgttcgcccccctgagcaaggagagagcccagaacctggaggccatcagcagactgtgcgaggacaaggacctgtgcagagccgccatgagaagaagcttcagcgccgacaacttcatcggcatccagagaagcaaggccatcctgagctag

SEQ ID NO: 20282 - DNA, 1086 bp, Artificial Sequence
  Description of Artificial Sequence: Synthetic coding sequence
atgggcaacatcctgacctgctgcgtgtgccccagagccagccccggcctgcaccagcaccagggcctggtgtgccactgcgagagcgagatctacgaggccgccgccggcgacctgatcgccggcgtgcccgtggccgccgccgtggagcccggcgaggtgaccttcgtggccggcgagggcctgcacatgcaccacatctgcgagagagagatgcccgaggacatccccctggagcccaaccccagcgaccaccccaaggccagcaccatcttcctgagaaagagccagaccgacgtgcaggagaagaagaagaagcagctgtgcaaggtgagcaccgagcacttcacccagcagtacagcagctgcagcaccatcttcctggacgacagcatcgccagccagccccacctgaccatgaccctgaagagctgcgacctgggcaccatcctgagctaccaggccaagagagacgcccacagaagcctgggcatcttcgacgagcagctgcaccccctgaccgtgagaaaggaggtgctggaggagtacttcaagtacgaccccgagcacaagctgatcttcagattcgtgagaaccctgttcaaggccatgagactgaccgccgagttcgccatcgtgagcctgatctacatcgagagactggtgagctacgccgacatcgacatctgccccaccaactggaagagaatcgtgctgggcgccatcctgctggccagcaaggtgtggagcgacatggccgtgtggaacgaggactactgcaagctgttcaagaacatcaccgtggaggagatgaacgagctggagagacagttcctgaagctgatcaactacaacaacagcatcaccaacagcgtgtacagcagattctacttcgacctgagaaccctggcccacaacaacggcctgtacagccccgtgtacctgctggacagagagagagcctggaagctggaggccttcagcagaatggagcaggacaaggtgttctacagcgccgccaagaacggcagcctgagcgccgacgacctgatccacctgcagagagccaaggccatcctgttctag

SEQ ID NO: 20283 - DNA, 864 bp, Artificial Sequence
  Description of Artificial Sequence: Synthetic coding sequence
tgaatccccctggagcccaaccccagcgaccaccccaaggccagcaccatcttcctgagaaagagccagaccgacgtgcaggagaagaagaagaagcagctgtgcaaggtgagcaccgagcacttcacccagcagtacagcagctgcagcaccatcttcctggacgacagcatcgccagccagccccacctgaccatgaccctgaagagctgcgacctgggcaccatcctgagctaccaggccaagagagacgcccacagaagcctgggcatcttcgacgagcagctgcaccccctgaccgtgagaaaggaggtgctggaggagtacttcaagtacgaccccgagcacaagctgatcttcagattcgtgagaaccctgttcaaggccatgagactgaccgccgagttcgccatcgtgagcctgatctacatcgagagactggtgagctacgccgacatcgacatctgccccaccaactggaagagaatcgtgctgggcgccatcctgctggccagcaaggtgtggagcgacatggccgtgtggaacgaggactactgcaagctgttcaagaacatcaccgtggaggagatgaacgagctggagagacagttcctgaagctgatcaactacaacaacagcatcaccaacagcgtgtacagcagattctacttcgacctgagaaccctggcccacaacaacggcctgtacagccccgtgtacctgctggacagagagagagcctggaagctggaggccttcagcagaatggagcaggacaaggtgttctacagcgccgccaagaacggcagcctgagcgccgacgacctgatccacctgcagagagccaaggccatcctgttctag

SEQ ID NO: 20284 - DNA, 1032 bp, Artificial Sequence
  Description of Artificial Sequence: Synthetic coding sequence
agctgcgtggtgatccagatccccccctggcacctggacagaaagtacggcagctgcagcaccatcctgctggacaacagcaccgccagccagcccgacctgagacacaccctggagagatacgccaacagaagcctggccatcttcgaggagcccgtgcaccccctgccccaggagaagctgcccggcaagagcttcaagcacgaccccaagagaaactgcatcttcagacacttctgcaccctgttccaggtgatcaagctgaccgccccctgcgccatcgtggccctggtgtacatcaagagactgctgaccagcgccaacatcgacctgtgccccaccaactggaagaagatcgtgctgggcaccatgctgctggccagcaaggtgtggagaaaccacggcctgtggagcgtggacgacagccagaacagcaaggacaccgccgtggagaacatgagcaagatggagaagtgcttcctggagctgctggagttcaacatccacgtgagcgccagcgtgtacgccaagtactacttcgacctgtgcgccctggccaacgaccacgacctgtacttcctgttcagcttcctgcacaaggacaaggcccagaagctggagggccacaccagccagcacagcctgagcctgggcccctgcagagtgggcatggagaactacgccacctacagccccctgagcagccagcccgtgctgggcgccctgagcctggccgaggtgctgccccaggagatcaagcaggagatccaccaggtgctgatggaccacggcgtgccctgccactacacctgcttcctgctgcaccccgaggacagcaccctggagagattcctggtgctgcacagcatccagggcctgcaggaggacagcgtgctgtgcaaggtggagatccacggcctgagcccccagccccagacctaccagagccacttcagaagccccagcctggccgagctgctgaacagaatcagcggcacctgcagaaaccacttcgccggcatgcagaagtag

SEQ ID NO: 20285 - DNA, 1155 bp, Artificial Sequence
  Description of Artificial Sequence: Synthetic coding sequence
atgaccagcttccaccccagaggcctgcaggccgccagagcccagaagttcaagagcaagagacccagaagcaacagcgactgcttccaggaggaggacctgagacagggcttccagtggagaaagagcctgcccttcggcgccgccagcagctacctgaacctggagaagctgggcgagggcagctacgccaccgtgtacaagggcatcagcagaatcaacggccagctggtggccctgaaggtgatcagcatgaacgccgaggagggcgtgcccttcaccgccatcagagaggccagcctgctgaagggcctgaagcacgccaacatcgtgctgctgcacgacatcatccacaccaaggagaccctgaccttcgtgttcgagtacatgcacaccgacctggcccagtacatgagccagcaccccggcggcctgcacccccacaacgtgagactgttcatgttccagctgctgagaggcctggcctacatccaccaccagcacgtgctgcacagagacctgaagccccagaacctgctgatcagccacctgggcgagctgaagctggccgacttcggcctggccagagccaagagcatccccagccagacctacagcagcgaggtggtgaccctgtggtacagaccccccgacgccctgctgggcgccaccgagtacagcagcgagctggacatctggggcgccggctgcatcttcatcgagatgttccagggccagcccctgttccccggcgtgagcaacatcctggagcagctggagaagatctgggaggtgctgggcgtgcccaccgaggacacctggcccggcgtgagcaagctgcccaactacaaccccgagtggttccccctgcccacccccagaagcctgcacgtggtgtggaacagactgggcagagtgcccgaggccgaggacctggccagccagatgctgaagggcttccccagagacagagtgagcgcccaggaggccctggtgcacgactacttcagcgccctgcccagccagctgtaccagctgcccgacgaggagagcctgttcaccgtgagcggcgtgagactgaagcccgagatgtgcgacctgctggccagctaccagaagggccaccaccccgcccagttcagcaagtgctggtag

SEQ ID NO: 20286 - DNA, 1308 bp, Artificial Sequence
  Description of Artificial Sequence: Synthetic coding sequence
atgggccaggagctgtgcgccaagaccgtgcagcccggctgcagctgctaccactgcagcgagggcggcgaggcccacagctgcagaagaagccagcccgagaccaccgaggccgccttcaagctgaccgacctgaaggaggccagctgcagcatgaccagcttccaccccagaggcctgcaggccgccagagcccagaagttcaagagcaagagacccagaagcaacagcgactgcttccaggaggaggacctgagacagggcttccagtggagaaagagcctgcccttcggcgccgccagcagctacctgaacctggagaagctgggcgagggcagctacgccaccgtgtacaagggcatcagcagaatcaacggccagctggtggccctgaaggtgatcagcatgaacgccgaggagggcgtgcccttcaccgccatcagagaggccagcctgctgaagggcctgaagcacgccaacatcgtgctgctgcacgacatcatccacaccaaggagaccctgaccttcgtgttcgagtacatgcacaccgacctggcccagtacatgagccagcaccccggcggcctgcacccccacaacgtgagactgttcatgttccagctgctgagaggcctggcctacatccaccaccagcacgtgctgcacagagacctgaagccccagaacctgctgatcagccacctgggcgagctgaagctggccgacttcggcctggccagagccaagagcatccccagccagacctacagcagcgaggtggtgaccctgtggtacagaccccccgacgccctgctgggcgccaccgagtacagcagcgagctggacatctggggcgccggctgcatcttcatcgagatgttccagggccagcccctgttccccggcgtgagcaacatcctggagcagctggagaagatctgggaggtgctgggcgtgcccaccgaggacacctggcccggcgtgagcaagctgcccaactacaaccccgagtggttccccctgcccacccccagaagcctgcacgtggtgtggaacagactgggcagagtgcccgaggccgaggacctggccagccagatgctgaagggcttccccagagacagagtgagcgcccaggaggccctggtgcacgactacttcagcgccctgcccagccagctgtaccagctgcccgacgaggagagcctgttcaccgtgagcggcgtgagactgaagcccgagatgtgcgacctgctggccagctaccagaagggccaccaccccgcccagttcagcaagtgctggtag

SEQ ID NO: 20287 - DNA, 1155 bp, Artificial Sequence; identical to SEQ ID NO: 20285
  Description of Artificial Sequence: Synthetic coding sequence

SEQ ID NO: 20288 - DNA, 1203 bp, Artificial Sequence
  Description of Artificial Sequence: Synthetic coding sequence
atgggccaggagctgtgcgccaagaccgtgcagcccggctgcagctgctaccactgcagcgagggcggcgaggcccacagctgcagaagaagccagcccgagaccaccgaggccgccttcaagctgaccgacctgaaggaggccagctgcagcatgaccagcttccaccccagaggcctgcaggccgccagagcccagaagttcaagagcaagagacccagaagcaacagcgactgcttccaggaggaggacctgagacagggcttccagtggagaaagagcctgcccttcggcgccgccagcagctacctgaacctggagaagctgggcgagggcagctacgccaccgtgtacaagggcatcagcagaatcaacggccagctggtggccctgaaggtgatcagcatgaacgccgaggagggcgtgcccttcaccgccatcagagaggccagcctgctgaagggcctgaagcacgccaacatcgtgctgctgcacgacatcatccacaccaaggagaccctgaccttcgtgttcgagtacatgcacaccgacctggcccagtacatgagccagcaccccggcggcctgcacccccacaacgtgagactgttcatgttccagctgctgagaggcctggcctacatccaccaccagcacgtgctgcacagagacctgaagccccagaacctgctgatcagccacctgggcgagctgaagctggccgacttcggcctggccagagccaagagcatccccagccagacctacagcagcgaggtggtgaccctgtggtacagaccccccgacgccctgctgggcgccaccgagtacagcagcgagctggacatctggggcgccggctgcatcttcatcgagatgttccagggccagcccctgttccccggcgtgagcaacatcctggagcagctggagaagatctgggaggtgctgggcgtgcccaccgaggacacctggcccggcgtgagcaagctgcccaactacaaccccgagtggttccccctgcccacccccagaagcctgcacgtggtgtggaacagactgggcagagtgcccgaggccgaggacctggccagccagatgctgaagggcttccccagagacagagtgagcgcccaggaggccctggtgcacgactacttcagcgccctgcccagccagctgtaccagctgcccgacgagtag

SEQ ID NO: 20289 - DNA, 1290 bp, Artificial Sequence
  Description of Artificial Sequence: Synthetic coding sequence
atgggccaggagctgtgcgccaagaccgtgcagcccggctgcagctgctaccactgcagcgagggcggcgaggcccacagctgcagaagaagccagcccgagaccaccgaggccgccttcaagctgaccgacctgaaggaggccagctgcagcatgaccagcttccaccccagaggcctgcaggccgccagagcccagaagttcaagagcaagagacccagaagcaacagcgactgcttccaggaggaggacctgagacagggcttccagtggagaaagagcctgcccttcggcgccgccagcagctacctgaacctggagaagctgggcgagggcagctacgccaccgtgtacaagggcatcagcagaatcaacggccagctggtggccctgaaggtgatcagcatgaacgccgaggagggcgtgcccttcaccgccatcagagaggccagcctgctgaagggcctgaagcacgccaacatcgtgctgctgcacgacatcatccacaccaaggagaccctgaccttcgtgttcgagtacatgcacaccgacctggcccagtacatgagccagcaccccggcggcctgcacccccacaacgtgagactgttcatgttccagctgctgagaggcctggcctacatccaccaccagcacgtgctgcacagagacctgaagccccagaacctgctgatcagccacctgggcgagctgaagctggccgacttcggcctggccagagccaagagcatccccagccagacctacagcagcgaggtggtgaccctgtggtacagaccccccgacgccctgctgggcgccaccgagtacagcagcgagctggacatctggggcgccggctgcatcttcatcgagatgttccagggccagcccctgttccccggcgtgagcaacatcctggagcagctggagaagatctgggaggtgctgggcgtgcccaccgaggacacctggcccggcgtgagcaagctgcccaactacaaccccgagtggttccccctgcccacccccagaagcctgcacgtggtgtggaacagactgggcagagtgcccgaggccgaggacctggccagccagatgctgaagggcttccccagagacagagtgagcgcccaggaggccctggtgcacgactacttcagcgccctgcccagccagctgtaccagctgcccgacgtgagcggcgtgagactgaagcccgagatgtgcgacctgctggccagctaccagaagggccaccaccccgcccagttcagcaagtgctggtag

SEQ ID NO: 20290 - DNA, 1713 bp, Artificial Sequence
  Description of Artificial Sequence: Synthetic coding sequence
atgcccctgtacggcagagccagagaccacgtgacccaccccagcatcctgggcaccagacccggcagacccatggccggccccatcaccgccgccgtgcccgagaagatctgcaacggcgccttctgcagctgcagcggcgccttccccctggaccccaacaaccccagcctgggccccctgcccagcatcagccacctgaacctgagaacccagatcgccatggacagaatgaagaagatcaagagacagctgagcatgaccctgagaggcggcagaggcatcgacaagaccaacggcgcccccgagcagatcggcctggacgagagcggcggcggcggcggcagcgaccccggcgaggcccccaccagagccgcccccggcgagctgagaagcgccagaggccccctgagcagcgcccccgagatcgtgcacgaggacctgaagatgggcagcgacggcgagagcgaccaggccagcgccaccagcagcgacgaggtgcagagccccgtgagagtgagaatgagaaaccacccccccagaaagatcagcaccgaggacatcaacaagagactgagcctgcccgccgacatcagactgcccgagggctacctggagaagctgaccctgaacagccccatcttcgacaagcccctgagcagaagactgagaagagtgagcctgagcgagatcggcttcggcaagctggagacctacatcaagctggacaagctgggcgagggcacctacgccaccgtgtacaagggcaagagcaagctgaccgacaacctggtggccctgaaggagatcagactggagcacgaggagggcgccccctgcaccgccatcagagaggtgagcctgctgaaggacctgaagcacgccaacatcgtgaccctgcacgacatcatccacaccgagaagagcctgaccctggtgttcgagtacctggacaaggacctgaagcagtacctggacgactgcggcaacatcatcaacatgcacaacgtgaagctgttcctgttccagctgctgagaggcctggcctactgccacagacagaaggtgctgcacagagacctgaagccccagaacctgctgatcaacgagagaggcgagctgaagctggccgacttcggcctggccagagccaagagcatccccaccaagacctacagcaacgaggtggtgaccctgtggtacagaccccccgacatcctgctgggcagcaccgactacagcacccagatcgacatgtggggcgtgggctgcatcttctacgagatggccaccggcagacccctgttccccggcagcaccgtggaggagcagctgcacttcatcttcagaatcctgggcacccccaccgaggagacctggcccggcatcctgagcaacgaggagttcaagacctacaactaccccaagtacagagccgaggccctgctgagccacgcccccagactggacagcgacggcgccgacctgctgaccaagctgctgcagttcgagggcagaaacagaatcagcgccgaggacgccatgaagcaccccttcttcctgagcctgggcgagagaatccacaagctgcccgacaccaccagcatcttcgccctgaaggagatccagctgcagaaggaggccagcctgagaagcagcagcatgcccgacagcggcagacccgccttcagagtggtggacaccgagttctag

SEQ ID NO: 20291 - DNA, 1491 bp, Artificial Sequence
  Description of Artificial Sequence: Synthetic coding sequence
atggacagaatgaagaagatcaagagacagctgagcatgaccctgagaggcggcagaggcatcgacaagaccaacggcgcccccgagcagatcggcctggacgagagcggcggcggcggcggcagcgaccccggcgaggcccccaccagagccgcccccggcgagctgagaagcgccagaggccccctgagcagcgcccccgagatcgtgcacgaggacctgaagatgggcagcgacggcgagagcgaccaggccagcgccaccagcagcgacgaggtgcagagccccgtgagagtgagaatgagaaaccacccccccagaaagatcagcaccgaggacatcaacaagagactgagcctgcccgccgacatcagactgcccgagggctacctggagaagctgaccctgaacagccccatcttcgacaagcccctgagcagaagactgagaagagtgagcctgagcgagatcggcttcggcaagctggagacctacatcaagctggacaagctgggcgagggcacctacgccaccgtgtacaagggcaagagcaagctgaccgacaacctggtggccctgaaggagatcagactggagcacgaggagggcgccccctgcaccgccatcagagaggtgagcctgctgaaggacctgaagcacgccaacatcgtgaccctgcacgacatcatccacaccgagaagagcctgaccctggtgttcgagtacctggacaaggacctgaagcagtacctggacgactgcggcaacatcatcaacatgcacaacgtgaagctgttcctgttccagctgctgagaggcctggcctactgccacagacagaaggtgctgcacagagacctgaagccccagaacctgctgatcaacgagagaggcgagctgaagctggccgacttcggcctggccagagccaagagcatccccaccaagacctacagcaacgaggtggtgaccctgtggtacagaccccccgacatcctgctgggcagcaccgactacagcacccagatcgacatgtggggcgtgggctgcatcttctacgagatggccaccggcagacccctgttccccggcagcaccgtggaggagcagctgcacttcatcttcagaatcctgggcacccccaccgaggagacctggcccggcatcctgagcaacgaggagttcaagacctacaactaccccaagtacagagccgaggccctgctgagccacgcccccagactggacagcgacggcgccgacctgctgaccaagctgctgcagttcgagggcagaaacagaatcagcgccgaggacgccatgaagcaccccttcttcctgagcctgggcgagagaatccacaagctgcccgacaccaccagcatcttcgccctgaaggagatccagctgcagaaggaggccagcctgagaagcagcagcatgcccgacagcggcagacccgccttcagagtggtggacaccgagttctag

SEQ ID NO: 20292 - DNA, 1509 bp, Artificial Sequence
  Description of Artificial Sequence: Synthetic coding sequence
atgcagagcgagatcgccatggacagaatgaagaagatcaagagacagctgagcatgaccctgagaggcggcagaggcatcgacaagaccaacggcgcccccgagcagatcggcctggacgagagcggcggcggcggcggcagcgaccccggcgaggcccccaccagagccgcccccggcgagctgagaagcgccagaggccccctgagcagcgcccccgagatcgtgcacgaggacctgaagatgggcagcgacggcgagagcgaccaggccagcgccaccagcagcgacgaggtgcagagccccgtgagagtgagaatgagaaaccacccccccagaaagatcagcaccgaggacatcaacaagagactgagcctgcccgccgacatcagactgcccgagggctacctggagaagctgaccctgaacagccccatcttcgacaagcccctgagcagaagactgagaagagtgagcctgagcgagatcggcttcggcaagctggagacctacatcaagctggacaagctgggcgagggcacctacgccaccgtgtacaagggcaagagcaagctgaccgacaacctggtggccctgaaggagatcagactggagcacgaggagggcgccccctgcaccgccatcagagaggtgagcctgctgaaggacctgaagcacgccaacatcgtgaccctgcacgacatcatccacaccgagaagagcctgaccctggtgttcgagtacctggacaaggacctgaagcagtacctggacgactgcggcaacatcatcaacatgcacaacgtgaagctgttcctgttccagctgctgagaggcctggcctactgccacagacagaaggtgctgcacagagacctgaagccccagaacctgctgatcaacgagagaggcgagctgaagctggccgacttcggcctggccagagccaagagcatccccaccaagacctacagcaacgaggtggtgaccctgtggtacagaccccccgacatcctgctgggcagcaccgactacagcacccagatcgacatgtggggcgtgggctgcatcttctacgagatggccaccggcagacccctgttccccggcagcaccgtggaggagcagctgcacttcatcttcagaatcctgggcacccccaccgaggagacctggcccggcatcctgagcaacgaggagttcaagacctacaactaccccaagtacagagccgaggccctgctgagccacgcccccagactggacagcgacggcgccgacctgctgaccaagctgctgcagttcgagggcagaaacagaatcagcgccgaggacgccatgaagcaccccttcttcctgagcctgggcgagagaatccacaagctgcccgacaccaccagcatcttcgccctgaaggagatccagctgcagaaggaggccagcctgagaagcagcagcatgcccgacagcggcagacccgccttcagagtggtggacaccgagttctag

SEQ ID NO: 20293 - DNA, 1491 bp, Artificial Sequence; identical to SEQ ID NO: 20291
  Description of Artificial Sequence: Synthetic coding sequence

SEQ ID NO: 20294 - DNA, 570 bp, Artificial Sequence
  Description of Artificial Sequence: Synthetic coding sequence
atggacagaatgaagaagatcaagagacagctgagcatgaccctgagaggcggcagaggcatcgacaagaccaacggcgcccccgagcagatcggcctggacgagagcggcggcggcggcggcagcgaccccggcgaggcccccaccagagccgcccccggcgagctgagaagcgccagaggccccctgagcagcgcccccgagatcgtgcacgaggacctgaagatgggcagcgacggcgagagcgaccaggccagcgccaccagcagcgacgaggtgcagagccccgtgagagtgagaatgagaaaccacccccccagaaagatcagcaccgaggacatcaacaagagactgagcctgcccgccgacatcagactgcccgagggctacctggagaagctgaccctgaacagccccatcttcgacaagcccctgagcagaagactgagaagagtgagcctgagcgagatcggcttcggcaagctggagacctacatcaagctggacaagctgggcgagggcacctacgccaccgtgtacaagggcaagagcaagctgaccgacaactag

SEQ ID NO: 20295 - DNA, 453 bp, Artificial Sequence
  Description of Artificial Sequence: Synthetic coding sequence
atggacagaatgaagaagatcaagagacagctgagcatgaccctgagaggcggcagaggcatcgacaagaccaacggcgcccccgagcagatcggcctggacgagagcggcggcggcggcggcagcgaccccggcgaggcccccaccagagccgcccccggcgagctgagaagcgccagaggccccctgagcagcgcccccgagatcgtgcacgaggacctgaagatgggcagcgacggcgagagcgaccaggccagcgccaccagcagcgacgaggtgcagagccccgtgagagtgagaatgagaaaccacccccccagaaagatcagcaccgaggacatcaacaagagactgagcctgcccgccgacatcagactgcccgagggctacctggagaagctgaccctgaacagccccatcttcgacaagcccctgagcagaagactgagatag

SEQ ID NO: 20296 - DNA, 462 bp, Artificial Sequence
  Description of Artificial Sequence: Synthetic coding sequence
atggacagaatgaagaagatcaagagacagctgagcatgaccctgagaggcggcagaggcatcgacaagaccaacggcgcccccgagcagatcggcctggacgagagcggcggcggcggcggcagcgaccccggcgaggcccccaccagagccgcccccggcgagctgagaagcgccagaggccccctgagcagcgcccccgagatcgtgcacgaggacctgaagatgggcagcgacggcgagagcgaccaggccagcgccaccagcagcgacgaggtgcagagccccgtgagagtgagaatgagaaaccacccccccagaaagatcagcaccgaggacatcaacaagagactgagcctgcccgccgacatcagactgcccgagggctacctggagaagctgaccctgaacagccccatcttcgacaagcccctgagcagaagactgagaagagtgagctag

SEQ ID NO: 20297 - DNA, 174 bp, Artificial Sequence
  Description of Artificial Sequence: Synthetic coding sequence
atggacagaatgaagaagatcaagagacagctgagcatgaccctgagaggcggcagaggcatcgacaagaccaacggcgcccccgagcagatcggcctggacgagagcggcggcggcggcggcagcgaccccggcgaggcccccaccagagccgcccccggcgagctgagatag

SEQ ID NO: 20298 - DNA, 1347 bp, Artificial Sequence
  Description of Artificial Sequence: Synthetic coding sequence
atggacagaatgaagaagatcaagagacagctgagcatgaccctgagaagcgcccccgagatcgtgcacgaggacctgaagatgggcagcgacggcgagagcgaccaggccagcgccaccagcagcgacgaggtgcagagccccgtgagagtgagaatgagaaaccacccccccagaaagatcagcaccgaggacatcaacaagagactgagcctgcccgccgacatcagactgcccgagggctacctggagaagctgaccctgaacagccccatcttcgacaagcccctgagcagaagactgagaagagtgagcctgagcgagatcggcttcggcaagctggagacctacatcaagctggacaagctgggcgagggcacctacgccaccgtgtacaagggcaagagcaagctgaccgacaacctggtggccctgaaggagatcagactggagcacgaggagggcgccccctgcaccgccatcagagaggtgagcctgctgaaggacctgaagcacgccaacatcgtgaccctgcacgacatcatccacaccgagaagagcctgaccctggtgttcgagtacctggacaaggacctgaagcagtacctggacgactgcggcaacatcatcaacatgcacaacgtgaagctgttcctgttccagctgctgagaggcctggcctactgccacagacagaaggtgctgcacagagacctgaagccccagaacctgctgatcaacgagagaggcgagctgaagctggccgacttcggcctggccagagccaagagcatccccaccaagacctacagcaacgaggtggtgaccctgtggtacagaccccccgacatcctgctgggcagcaccgactacagcacccagatcgacatgtggggcgtgggctgcatcttctacgagatggccaccggcagacccctgttccccggcagcaccgtggaggagcagctgcacttcatcttcagaatcctgggcacccccaccgaggagacctggcccggcatcctgagcaacgaggagttcaagacctacaactaccccaagtacagagccgaggccctgctgagccacgcccccagactggacagcgacggcgccgacctgctgaccaagctgctgcagttcgagggcagaaacagaatcagcgccgaggacgccatgaagcaccccttcttcctgagcctgggcgagagaatccacaagctgcccgacaccaccagcatcttcgccctgaaggagatccagctgcagaaggaggccagcctgagaagcagcagcatgcccgacagcggcagacccgccttcagagtggtggacaccgagttctag

SEQ ID NO: 20299 - DNA, 1806 bp, Artificial Sequence
  Description of Artificial Sequence: Synthetic coding sequence
atgagaggcgccagaagagccagaagactgggcagatggctgttcggccccggcatcagaagacacagcgccatcagacccctgtgcgccgccagcagaagagagcacagcgacagcagcagaagacagagagtgagaggccacagaccccagagacccagcagctggcccgccgagagagacgccgccagcgccagcgccaccgccgccgccgccgccagcagcagcagcgccggcggcggccccggccccgccaccatggccgaggtggccagagcccccccccccatcgccatggacagaatgaagaagatcaagagacagctgagcatgaccctgagaggcggcagaggcatcgacaagaccaacggcgcccccgagcagatcggcctggacgagagcggcggcggcggcggcagcgaccccggcgaggcccccaccagagccgcccccggcgagctgagaagcgccagaggccccctgagcagcgcccccgagatcgtgcacgaggacctgaagatgggcagcgacggcgagagcgaccaggccagcgccaccagcagcgacgaggtgcagagccccgtgagagtgagaatgagaaaccacccccccagaaagatcagcaccgaggacatcaacaagagactgagcctgcccgccgacatcagactgcccgagggctacctggagaagctgaccctgaacagccccatcttcgacaagcccctgagcagaagactgagaagagtgagcctgagcgagatcggcttcggcaagctggagacctacatcaagctggacaagctgggcgagggcacctacgccaccgtgtacaagggcaagagcaagctgaccgacaacctggtggccctgaaggagatcagactggagcacgaggagggcgccccctgcaccgccatcagagaggtgagcctgctgaaggacctgaagcacgccaacatcgtgaccctgcacgacatcatccacaccgagaagagcctgaccctggtgttcgagtacctggacaaggacctgaagcagtacctggacgactgcggcaacatcatcaacatgcacaacgtgaagctgttcctgttccagctgctgagaggcctggcctactgccacagacagaaggtgctgcacagagacctgaagccccagaacctgctgatcaacgagagaggcgagctgaagctggccgacttcggcctggccagagccaagagcatccccaccaagacctacagcaacgaggtggtgaccctgtggtacagaccccccgacatcctgctgggcagcaccgactacagcacccagatcgacatgtggggcgtgggctgcatcttctacgagatggccaccggcagacccctgttccccggcagcaccgtggaggagcagctgcacttcatcttcagaatcctgggcacccccaccgaggagacctggcccggcatcctgagcaacgaggagttcaagacctacaactaccccaagtacagagccgaggccctgctgagccacgcccccagaagcctgtgcccctgcggcagactggacagcgacggcgccgacctgctgaccaagctgctgcagttcgagggcagaaacagaatcagcgccgaggacgccatgaagcaccccttcttcctgagcctgggcgagagaatccacaagctgcccgacaccaccagcatcttcgccctgaaggagatccagctgcagaaggaggccagcctgagaagcagcagcatgcccgacagcggcagacccgccttcagagtggtggacaccgagttctag

SEQ ID NO: 20300 - DNA, 1572 bp, Artificial Sequence
  Description of Artificial Sequence: Synthetic coding sequence
atgaagaagttcaagagaagactgagcctgaccctgagaggcagccagaccatcgacgagagcctgagcgagctggccgagcagatgaccatcgaggagaacagcagcaaggacaacgagcccatcgtgaagaacggcagaccccccaccagccacagcatgcacagcttcctgcaccagtacaccggcagcttcaagaagccccccctgagaagaccccacagcgtgatcggcggcagcctgggcagcttcatggccatgcccagaaacggcagcagactggacatcgtgcacgagaacctgaagatgggcagcgacggcgagagcgaccaggccagcggcaccagcagcgacgaggtgcagagccccaccggcgtgtgcctgagaaacagaatccacagaagaatcagcatggaggacctgaacaagagactgagcctgcccgccgacatcagaatccccgacggctacctggagaagctgcagatcaacagcccccccttcgaccagcccatgagcagaagaagcagaagagccagcctgagcgagatcggcttcggcaagatggagacctacatcaagctggagaagctgggcgagggcacctacgccaccgtgtacaagggcagaagcaagctgaccgagaacctggtggccctgaaggagatcagactggagcacgaggagggcgccccctgcaccgccatcagagaggtgagcctgctgaaggacctgaagcacgccaacatcgtgaccctgcacgacatcgtgcacaccgacaagagcctgaccctggtgttcgagtacctggacaaggacctgaagcagtacatggacgactgcggcaacatcatgagcatgcacaacgtgaagctgttcctgtaccagatcctgagaggcctggcctactgccacagaagaaaggtgctgcacagagacctgaagccccagaacctgctgatcaacgagaagggcgagctgaagctggccgacttcggcctggccagagccaagagcgtgcccaccaagacctacagcaacgaggtggtgaccctgtggtacagaccccccgacgtgctgctgggcagcagcgagtacagcacccagatcgacatgtggggcgtgggctgcatcttcttcgagatggccagcggcagacccctgttccccggcagcaccgtggaggacgagctgcacctgatcttcagactgctgggcacccccagccaggagacctggcccggcatcagcagcaacgaggagttcaagaactacaacttccccaagtacaagccccagcccctgatcaaccacgcccccagactggacagcgagggcatcgagctgatcaccaagttcctgcagtacgagagcaagaagagagtgagcgccgaggaggccatgaagcacgtgtacttcagaagcctgggccccagaatccacgccctgcccgagagcgtgagcatcttcagcctgaaggagatccagctgcagaaggaccccggcttcagaaacagcagctaccccgagaccggccacggcaagaacagaagacagagcatgctgttctag

SEQ ID NO: 20301 - DNA, 1572 bp, Artificial Sequence
  Description of Artificial Sequence: Synthetic coding sequence
atgaagaagttcaagagaagactgagcctgaccctgagaggcagccagaccatcgacgagagcctgagcgagctggccgagcagatgaccatcgaggagaacagcagcaaggacaacgagcccatcgtgaagaacggcagaccccccaccagccacagcatgcacagcttcctgcaccagtacaccggcagcttcaagaagccccccctgagaagaccccacagcgtgatcggcggcagcctgggcagcttcatggccatgcccagaaacggcagcagactggacatcgtgcacgagaacctgaagatgggcagcgacggcgagagcgaccaggccagcggcaccagcagcgacgaggtgcagagccccaccggcgtgtgcctgagaaacagaatccacagaagaatcagcatggaggacctgaacaagagactgagcctgcccgccgacatcagaatccccgacggctacctggagaagctgcagatcaacagcccccccttcgaccagcccatgagcagaagaagcagaagagccagcctgagcgagatcggcttcggcaagatggagacctacatcaagctggagaagctgggcgagggcacctacgccaccgtgtacaagggcagaagcaagctgaccgagaacctggtggccctgaaggagatcagactggagcacgaggagggcgccccctgcaccgccatcagagaggtgagcctgctgaaggacctgaagcacgccaacatcgtgaccctgcacgacatcgtgcacaccgacaagagcctgaccctggtgttcgagtacctggacaaggacctgaagcagtacatggacgactgcggcaacatcatgagcatgcacaacgtgaagctgttcctgtaccagatcctgagaggcctggcctactgccacagaagaaaggtgctgcacagagacctgaagccccagaacctgctgatcaacgagaagggcgagctgaagctggccgacttcggcctggccagagccaagagcgtgcccaccaagacctacagcaacgaggtggtgaccctgtggtacagaccccccgacgtgctgctgggcagcagcgagtacagcacccagatcgacatgtggggcgtgggctgcatcttcttcgagatggccagcggcagacccctgttccccggcagcaccgtggaggacgagctgcacctgatcttcagactgctgggcacccccagccaggagacctggcccggcatcagcagcaacgaggagttcaagaactacaacttccccaagtacaagccccagcccctgatcaaccacgcccccagactggacagcgagggcatcgagctgatcaccaagttcctgcagtacgagagcaagaagagagtgagcgccgaggaggccatgaagcacgtgtacttcagaagcctgggccccagaatccacgccctgcccgagagcgtgagcatcttcagcctgaaggagatccagctgcagaaggaccccggcttcagaaacagcagctaccccgagaccggcgtgttcgtgatcaaccacttcacctgcagaagctag

SEQ ID NO: 20302 - DNA, 540 bp, Artificial Sequence
  Description of Artificial Sequence: Synthetic coding sequence
atgaagaagttcaagagaagactgagcctgaccctgagaggcagccagaccatcgacgagagcctgagcgagctggccgagcagatgaccatcgaggagaacagcagcaaggacaacgagcccatcgtgaagaacggcagaccccccaccagccacagcatgcacagcttcctgcaccagtacaccggcagcttcaagaagccccccctgagaagaccccacagcgtgatcggcggcagcctgggcagcttcatggccatgcccagaaacggcagcagactggacatcgtgcacgagaacctgaagatgggcagcgacggcgagagcgaccaggccagcggcaccagcagcgacgaggtgcagagccccaccggcgtgtgcctgagaaacagaatccacagaagaatcagcatggaggacctgaacaagagactgagcctgcccgccgacatcagaatccccgacggctacctggagaagctgcagatcaacagcccccccttcgaccagcccatgagcagaagaagcagaagagcctag

SEQ ID NO: 20303 - DNA, 267 bp, Artificial Sequence
  Description of Artificial Sequence: Synthetic coding sequence
atgaagaagttcaagagaagactgagcctgaccctgagaggcagccagaccatcgacgagagcctgagcgagctggccgagcagatgaccatcgaggagaacagcagcaaggacaacgagcccatcgtgaagaacggcagaccccccaccagccacagcatgcacagcttcctgcaccagtacaccggcagcttcaagaagccccccctgagaagaccccacagcgtgatcggcggcagcctgggcagcttcatggccatgccctag

SEQ ID NO: 20304 - DNA, 486 bp, Artificial Sequence
  Description of Artificial Sequence: Synthetic coding sequence
atgaagaagttcaagagaagactgagcctgaccctgagaggcagccagaccatcgacgagagcctgagcgagctggccgagcagatgaccatcgaggagaacagcagcaaggacaacgagcccatcgtgaagaacggcagaccccccaccagccacagcatgcacagcttcctgcaccagtacaccggcagcttcaagaagccccccctgagaagaccccacagcgtgatcggcggcagcctgggcagcttcatggccatgcccagaaacggcagcagactggacatcgtgcacgagaacctgaagatgggcagcgacggcgagagcgaccaggccagcggcaccagcagcgacgaggtgcagagccccaccggcgtgtgcctgagaaacagaatccacagaagaatcagcatggaggacctgaacaagagactgagcctgcccgccgacatcagaatccccgacggctacctggagaagctgtag

SEQ ID NO: 20305 - DNA, 1425 bp, Artificial Sequence
  Description of Artificial Sequence: Synthetic coding sequence
atgatcatgaacaagatgaagaacttcaagagaagattcagcctgagcgtgcccagaaccgagaccatcgaggagagcctggccgagttcaccgagcagttcaaccagctgcacaacagaagaaacgagaacctgcagctgggccccctgggcagagaccccccccaggagtgcagcaccttcagccccaccgacagcggcgaggagcccggccagctgagccccggcgtgcagttccagagaagacagaaccagagaagattcagcatggaggacgtgagcaagagactgagcctgcccatggacatcagactgccccaggagttcctgcagaagctgcagatggagagccccgacctgcccaagcccctgagcagaatgagcagaagagccagcctgagcgacatcggcttcggcaagctggagacctacgtgaagctggacaagctgggcgagggcacctacgccaccgtgttcaagggcagaagcaagctgaccgagaacctggtggccctgaaggagatcagactggagcacgaggagggcgccccctgcaccgccatcagagaggtgagcctgctgaagaacctgaagcacgccaacatcgtgaccctgcacgacctgatccacaccgacagaagcctgaccctggtgttcgagtacctggacagcgacctgaagcagtacctggaccactgcggcaacctgatgagcatgcacaacgtgaagatcttcatgttccagctgctgagaggcctggcctactgccaccacagaaagatcctgcacagagacctgaagccccagaacctgctgatcaacgagagaggcgagctgaagctggccgacttcggcctggccagagccaagagcgtgcccaccaagacctacagcaacgaggtggtgaccctgtggtacagaccccccgacgtgctgctgggcagcaccgagtacagcacccccatcgacatgtggggcgtgggctgcatccactacgagatggccaccggcagacccctgttccccggcagcaccgtgaaggaggagctgcacctgatcttcagactgctgggcacccccaccgaggagacctggcccggcgtgaccgccttcagcgagttcagaacctacagcttcccctgctacctgccccagcccctgatcaaccacgcccccagactggacaccgacggcatccacctgctgagcagcctgctgctgtacgagagcaagagcagaatgagcgccgaggccgccctgagccacagctacttcagaagcctgggcgagagagtgcaccagctggaggacaccgccagcatcttcagcctgaaggagatccagctgcagaaggaccccggctacagaggcctggccttccagcagcccggcagaggcaagaacagaagacagagcatcttctag

SEQ ID NO: 20306 - DNA, 855 bp, Artificial Sequence
  Description of Artificial Sequence: Synthetic coding sequence
atgatcatgaacaagatgaagaacttcaagagaagattcagcctgagcgtgcccagaaccgagaccatcgaggagagcctggccgagttcaccgagcagttcaaccagctgcacaacagaagaaacgagaacctgcagctgggccccctgggcagagaccccccccaggagtgcagcaccttcagccccaccgacagcggcgaggagcccggccagctgagccccggcgtgcagttccagagaagacagaaccagagaagattcagcatggaggtgagagccagcggcgccctgcccagacaggtggccggctgcacccacaagggcgtgcacagaagagccgccgccctgcagcccgacttcgacgtgagcaagagactgagcctgcccatggacatcagactgccccaggagttcctgcagaagctgcagatggagagccccgacctgcccaagcccctgagcagaatgagcagaagagccagcctgagcgacatcggcttcggcaagctggagacctacgtgaagctggacaagctgggcgagggcacctacgccaccgtgttcaagggcagaagcaagctgaccgagaacctggtggccctgaaggagatcagactggagcacgaggagggcgccccctgcaccgccatcagagaggtgagcctgctgaagaacctgaagcacgccaacatcgtgaccctgcacgacctgatccacaccgacagaagcctgaccctggtgttcgagtacctggacagcgacctgaagcagtacctggaccactgcggcaacctgatgagcatgcacaacgtgaagatcttcatgttccagctgctgagaggcctggcctag

SEQ ID NO: 20307 - DNA, 1425 bp, Artificial Sequence; identical to SEQ ID NO: 20305
  Description of Artificial Sequence: Synthetic coding sequence

SEQ ID NO: 20308 - DNA, 474 bp, Artificial Sequence
  Description of Artificial Sequence: Synthetic coding sequence
atgagcatgcacaacgtgaagatcttcatgttccagctgctgagaggcctggcctactgccaccacagaaagatcctgcacagagacctgaagccccagaacctgctgatcaacgagagaggcgagctgaagctggccgacttcggcctggccagagccaagagcgtgcccaccaagacctacagcaacgaggtggtgaccctgtggtacagaccccccgacgtgctgctgggcagcaccgagtacagcacccccatcgacatgtggggcgtgggctgcatccactacgagatggccaccggcagacccctgttccccggcagcaccgtgaaggaggagctgcacctgatcttcagactgctgggcacccccaccgaggagacctggcccggcgtgaccgccttcagcgagttcagaacctacagcttcccctgctacctgccccagcccctgatcaaccacgcccccagatag

SEQ ID NO: 20309 - DNA, 1515 bp, Artificial Sequence
  Description of Artificial Sequence: Synthetic coding sequence
atgatcatgaacaagatgaagaacttcaagagaagattcagcctgagcgtgcccagaaccgagaccatcgaggagagcctggccgagttcaccgagcagttcaaccagctgcacaacagaagaaacgagaacctgcagctgggccccctgggcagagaccccccccaggagtgcagcaccttcagccccaccgacagcggcgaggagcccggccagctgagccccggcgtgcagttccagagaagacagaaccagagaagattcagcatggaggtgagagccagcggcgccctgcccagacaggtggccggctgcacccacaagggcgtgcacagaagagccgccgccctgcagcccgacttcgacgtgagcaagagactgagcctgcccatggacatcagactgccccaggagttcctgcagaagctgcagatggagagccccgacctgcccaagcccctgagcagaatgagcagaagagccagcctgagcgacatcggcttcggcaagctggagacctacgtgaagctggacaagctgggcgagggcacctacgccaccgtgttcaagggcagaagcaagctgaccgagaacctggtggccctgaaggagatcagactggagcacgaggagggcgccccctgcaccgccatcagagaggtgagcctgctgaagaacctgaagcacgccaacatcgtgaccctgcacgacctgatccacaccgacagaagcctgaccctggtgttcgagtacctggacagcgacctgaagcagtacctggaccactgcggcaacctgatgagcatgcacaacgtgaagatcttcatgttccagctgctgagaggcctggcctactgccaccacagaaagatcctgcacagagacctgaagccccagaacctgctgatcaacgagagaggcgagctgaagctggccgacttcggcctggccagagccaagagcgtgcccaccaagacctacagcaacgaggtggtgaccctgtggtacagaccccccgacgtgctgctgggcagcaccgagtacagcacccccatcgacatgtggggcgtgggctgcatccactacgagatggccaccggcagacccctgttccccggcagcaccgtgaaggaggagctgcacctgatcttcagactgctgggcacccccaccgaggagacctggcccggcgtgaccgccttcagcgagttcagaacctacagcttcccctgctacctgccccagcccctgatcaaccacgcccccagactggacaccgacggcatccacctgctgagcagcctgctgctgtacgagagcaagagcagaatgagcgccgaggccgccctgagccacagctacttcagaagcctgggcgagagagtgcaccagctggaggacaccgccagcatcttcagcctgaaggagatccagctgcagaaggaccccggctacagaggcctggccttccagcagcccggcagaggcaagaacagaagacagagcatcttctag

SEQ ID NO: 20310 - DNA, 1329 bp, Artificial Sequence
  Description of Artificial Sequence: Synthetic coding sequence
atgagcgcctgcagagagatcgccctgctgagagagctgaagcaccccaacgtgatcgccctgcagaaggtgttcctgagccacagcgacagaaaggtgtggctgctgttcgactacgccgagcacgacctgtggcacatcatcaagttccacagagccagcaaggccaacaagaagcccatgcagctgcccagaagcatggtgaagagcctgctgtaccagatcctggacggcatccactacctgcacgccaactgggtgctgcacagagacctgaagcccgccaacatcctggtgatgggcgagggccccgagagaggcagagtgaagatcgccgacatgggcttcgccagactgttcaacagccccctgaagcccctggccgacctggaccccgtggtggtgaccttctggtacagagcccccgagctgctgctgggcgccagacactacaccaaggccatcgacatctgggccatcggctgcatcttcgccgagctgctgaccagcgagcccatcttccactgcagacaggaggacatcaagaccagcaaccccttccaccacgaccagctggacagaatcttcagcgtgatgggcttccccgccgacaaggactgggaggacatcagaaagatgcccgagtaccccaccctgcagaaggacttcagaagaaccacctacgccaacagcagcctgatcaagtacatggagaagcacaaggtgaagcccgacagcaaggtgttcctgctgctgcagaagctgctgaccatggaccccaccaagagaatcaccagcgagcaggccctgcaggacccctacttccaggaggaccccctgcccaccctggacgtgttcgccggctgccagatcccctaccccaagagagagttcctgaacgaggacgaccccgaggagaagggcgacaagaaccagcagcagcagcagaaccagcaccagcagcccaccgcccccccccagcaggccgccgcccccccccaggccccccccccccagcagaacagcacccagaccaacggcaccgccggcggcgccggcgccggcgtgggcggcaccggcgccggcctgcagcacagccaggacagcagcctgaaccaggtgccccccaacaagaagcccagactgggccccagcggcgccaacagcggcggccccgtgatgcccagcgactaccagcacagcagcagcagactgaactaccagagcagcgtgcagggcagcagccagagccagagcaccctgggctacagcagcagcagccagcagagcagccagtaccaccccagccaccaggcccacagatactag

SEQ ID NO: 20311 - DNA, 1509 bp, Artificial Sequence
  Description of Artificial Sequence: Synthetic coding sequence
atggactacgacttcaaggccaagctggccgccgagagagagagagtggaggacctgttcgagtacgagggctgcaaggtgggcagaggcacctacggccacgtgtacaaggccagaagaaaggacggcaaggacgagaaggagtacgccctgaagcagatcgagggcaccggcatcagcatgagcgcctgcagagagatcgccctgctgagagagctgaagcaccccaacgtgatcgccctgcagaaggtgttcctgagccacagcgacagaaaggtgtggctgctgttcgactacgccgagcacgacctgtggcacatcatcaagttccacagagccagcaaggccaacaagaagcccatgcagctgcccagaagcatggtgaagagcctgctgtaccagatcctggacggcatccactacctgcacgccaactgggtgctgcacagagacctgaagcccgccaacatcctggtgatgggcgagggccccgagagaggcagagtgaagatcgccgacatgggcttcgccagactgttcaacagccccctgaagcccctggccgacctggaccccgtggtggtgaccttctggtacagagcccccgagctgctgctgggcgccagacactacaccaaggccatcgacatctgggccatcggctgcatcttcgccgagctgctgaccagcgagcccatcttccactgcagacaggaggacatcaagaccagcaaccccttccaccacgaccagctggacagaatcttcagcgtgatgggcttccccgccgacaaggactgggaggacatcagaaagatgcccgagtaccccaccctgcagaaggacttcagaagaaccacctacgccaacagcagcctgatcaagtacatggagaagcacaaggtgaagcccgacagcaaggtgttcctgctgctgcagaagctgctgaccatggaccccaccaagagaatcaccagcgagcaggccctgcaggacccctacttccaggaggaccccctgcccaccctggacgtgttcgccggctgccagatcccctaccccaagagagagttcctgaacgaggacgaccccgaggagaagggcgacaagaaccagcagcagcagcagaaccagcaccagcagcccaccgcccccccccagcaggccgccgcccccccccaggccccccccccccagcagaacagcacccagaccaacggcaccgccggcggcgccggcgccggcgtgggcggcaccggcgccggcctgcagcacagccaggacagcagcctgaaccaggtgccccccaacaagaagcccagactgggccccagcggcgccaacagcggcggccccgtgatgcccagcgactaccagcacagcagcagcagactgaactaccagagcagcgtgcagggcagcagccagagccagagcaccctgggctacagcagcagcagccagcagagcagccagtaccaccccagccaccaggcccacagatactag

SEQ ID NO: 20312 - DNA, 1326 bp, Artificial Sequence
  Description of Artificial Sequence: Synthetic coding sequence
agcctgaccagaaacatccagctgctgagagagctgaagcaccccaacgtgatcgccctgcagaaggtgttcctgagccacagcgacagaaaggtgtggctgctgttcgactacgccgagcacgacctgtggcacatcatcaagttccacagagccagcaaggccaacaagaagcccatgcagctgcccagaagcatggtgaagagcctgctgtaccagatcctggacggcatccactacctgcacgccaactgggtgctgcacagagacctgaagcccgccaacatcctggtgatgggcgagggccccgagagaggcagagtgaagatcgccgacatgggcttcgccagactgttcaacagccccctgaagcccctggccgacctggaccccgtggtggtgaccttctggtacagagcccccgagctgctgctgggcgccagacactacaccaaggccatcgacatctgggccatcggctgcatcttcgccgagctgctgaccagcgagcccatcttccactgcagacaggaggacatcaagaccagcaaccccttccaccacgaccagctggacagaatcttcagcgtgatgggcttccccgccgacaaggactgggaggacatcagaaagatgcccgagtaccccaccctgcagaaggacttcagaagaaccacctacgccaacagcagcctgatcaagtacatggagaagcacaaggtgaagcccgacagcaaggtgttcctgctgctgcagaagctgctgaccatggaccccaccaagagaatcaccagcgagcaggccctgcaggacccctacttccaggaggaccccctgcccaccctggacgtgttcgccggctgccagatcccctaccccaagagagagttcctgaacgaggacgaccccgaggagaagggcgacaagaaccagcagcagcagcagaaccagcaccagcagcccaccgcccccccccagcaggccgccgcccccccccaggccccccccccccagcagaacagcacccagaccaacggcaccgccggcggcgccggcgccggcgtgggcggcaccggcgccggcctgcagcacagccaggacagcagcctgaaccaggtgccccccaacaagaagcccagactgggccccagcggcgccaacagcggcggccccgtgatgcccagcgactaccagcacagcagcagcagactgaactaccagagcagcgtgcagggcagcagccagagccagagcaccctgggctacagcagcagcagccagcagagcagccagtaccaccccagccaccaggcccacagatactag

SEQ ID NO: 20313 - DNA, 1137 bp, Artificial Sequence
  Description of Artificial Sequence: Synthetic coding sequence
atggacttcgtgttcaaccccctgtggaagtacctgtgcctgctggccggcaagtgcatcgtgctgctggtgagacccaagctgaagcccgccaacatcctggtgatgggcgagggccccgagagaggcagagtgaagatcgccgacatgggcttcgccagactgttcaacagccccctgaagcccctggccgacctggaccccgtggtggtgaccttctggtacagagcccccgagctgctgctgggcgccagacactacaccaaggccatcgacatctgggccatcggctgcatcttcgccgagctgctgaccagcgagcccatcttccactgcagacaggaggacatcaagaccagcaaccccttccaccacgaccagctggacagaatcttcagcgtgatgggcttccccgccgacaaggactgggaggacatcagaaagatgcccgagtaccccaccctgcagaaggacttcagaagaaccacctacgccaacagcagcctgatcaagtacatggagaagcacaaggtgaagcccgacagcaaggtgttcctgctgctgcagaagctgctgaccatggaccccaccaagagaatcaccagcgagcaggccctgcaggacccctacttccaggaggaccccctgcccaccctggacgtgttcgccggctgccagatcccctaccccaagagagagttcctgaacgaggacgaccccgaggagaagggcgacaagaaccagcagcagcagcagaaccagcaccagcagcccaccgcccccccccagcaggccgccgcccccccccaggccccccccccccagcagaacagcacccagaccaacggcaccgccggcggcgccggcgccggcgtgggcggcaccggcgccggcctgcagcacagccaggacagcagcctgaaccaggtgccccccaacaagaagcccagactgggccccagcggcgccaacagcggcggccccgtgatgcccagcgactaccagcacagcagcagcagactgaactaccagagcagcgtgcagggcagcagccagagccagagcaccctgggctacagcagcagcagccagcagagcagccagtaccaccccagccaccaggcccacagatactag

SEQ ID NO: 20314 - DNA, 756 bp, Artificial Sequence
  Description of Artificial Sequence: Synthetic coding sequence
atgagcgcctgcagagagatcgccctgctgagagagctgaagcaccccaacgtgatcgccctgcagaaggtgttcctgagccacagcgacagaaaggtgtggctgctgttcgactacgccgagcacgacctgtggcacatcatcaagttccacagagccagcaaggccaacaagaagcccatgcagctgcccagaagcatggtgaagagcctgctgtaccagatcctggacggcatccactacctgcacgccaactgggtgctgcacagagacctgaagcccgccaacatcctggtgatgggcgagggccccgagagaggcagagtgaagatcgccgacatgggcttcgccagactgttcaacagccccctgaagcccctggccgacctggaccccgtggtggtgaccttctggtacagagcccccgagctgctgctgggcgccagacactacaccaaggccatcgacatctgggccatcggctgcatcttcgccgagctgctgaccagcgagcccatcttccactgcagacaggaggacatcaagaccagcaaccccttccaccacgaccagctggacagaatcttcagcgtgatgggcttccccgccgacaaggactgggaggacatcagaaagatgcccgagtaccccaccctgcagaaggacttcagaagaaccacctacgccaacagcagcctgatcaagtacatggagaagcacaaggtgaagcccgacagcaaggtgttcctgctgtag

SEQ ID NO: 20315 - DNA, 381 bp, Artificial Sequence
  Description of Artificial Sequence: Synthetic coding sequence
atgagctacaagcccatcgcccccgcccccagcagcacccccggcagcagcacccccggccccggcacccccgtgcccaccggcagcgtgcccagccccagcggcagcgtgcccggcgccggcgcccccttcagacccctgttcaacgacttcggcccccccagcatgggctacgtgcaggccatgaagccccccggcgcccagggcagccagagcacctacaccgacctgctgagcgtgatcgaggagatgggcaaggagatcagacccacctacgccggcagcaagagcgccatggagagactgaagagaggcatcatccacgccagagccctggtgagagagtgcctggccgagaccgagagaaacgccagaacctag

SEQ ID NO: 20316 - DNA, 1077 bp, Artificial Sequence
  Description of Artificial Sequence: Synthetic coding sequence
atgatggagaagtacgagaagatcggcaagatcggcgagggcagctacggcgtggtgttcaagtgcagaaacagagacaccggccagatcgtggccatcaagaagttcctggagagcgaggacgaccccgtgatcaagaagatcgccctgagagagatcagaatgctgaagcagctgaagcaccccaacctggtgaacctgctggaggtgttcagaagaaagagaagactgcacctggtgttcgagtactgcgaccacaccgtgctgcacgagctggacagataccagagaggcgtgcccgagcacctggtgaagagcatcacctggcagaccctgcaggccgtgaacttctgccacaagcacaactgcatccacagagacgtgaagcccgagaacatcctgatcaccaagcacagcgtgatcaagctgtgcgacttcggcttcgccagactgctgaccggccccagcgactactacaccgactacgtggccaccagatggtacagaagccccgagctgctggtgggcgacacccagtacggcccccccgtggacgtgtgggccatcggctgcgtgttcgccgagctgctgagcggcgtgcccctgtggcccggcaagagcgacgtggaccagctgtacctgatcagaaagaccctgggcgacctgatccccagacaccagcaggtgttcagcaccaaccagtacttcagcggcgtgaagatccccgaccccgaggacatggagcccctggagctgaagttccccaacatcagctaccccgccctgggcctgctgaagggctgcctgcacatggaccccacccagagactgacctgcgagcagctgctgcaccacccctacttcgagaacatcagagagatcgaggacctggccaaggagcacaacaagcccaccagaaagaccctgagaaagagcagaaagcaccactgcttcaccgagaccagcaagctgcagtacctgccccagctgaccggcagcagcatcctgcccgccctggacaacaagaagtactactgcgacaccaagaagctgaactacagattccccaacatctag

SEQ ID NO: 20317 - DNA, 747 bp, Artificial Sequence
  Description of Artificial Sequence: Synthetic coding sequence
atggaggcccccgagggcggcggcggcggccccgccgccagaggccccgagggccagcccgcccccgaggccagagtgcacttcagagtggccagattcatcatggaggccggcgtgaagctgggcatgagaagcatccccatcgccaccgcctgcaccatctaccacaagttcttctgcgagaccaacctggacgcctacgacccctacctgatcgccatgagcagcatctacctggccggcaaggtggaggagcagcacctgagaaccagagacatcatcaacgtgagcaacagatacttcaaccccagcggcgagcccctggagctggacagcagattctgggagctgagagacagcatcgtgcagtgcgagctgctgatgctgagagtgctgagattccaggtgagcttccagcacccccacaagtacctgctgcactacctggtgagcctgcagaactggctgaacagacacagctggcagagaacccccgtggccgtgaccgcctgggccctgctgagagacagctaccacggcgccctgtgcctgagattccaggcccagcacatcgccgtggccgtgctgtacctggccctgcaggtgtacggcgtggaggtgcccgccgaggtggaggccgagaagccctggtggcaggtgttcaacgacgacctgaccaagcccatcatcgacaacatcgtgagcgacctgatccagatctacaccatggacaccgagatcccctag

SEQ ID NO: 20318 - DNA, 1134 bp, Artificial Sequence
  Description of Artificial Sequence: Synthetic coding sequence
atggagctgagcgtgctgctgttcctggccctgctgaccggcctgctgctgctgctggtgcagagacaccccaacagccacggcaccctgccccccggccccagacccctgcccctgctgggcaacctgctgcagatggacagaagaggcctgctgaagagcttcctgagattcagagagaagtacggcgacgtgttcaccgtgcacctgggccccagacccgtggtgatgctgtgcggcgtggaggccatcagagaggccctggtggacaacgccgaggccttcagcggcagaggcaagatcgtgatcatggaccccgtgtaccagggctacggcatgctgttcgccaacggcaacagatggaaggtgctgagaagattcagcgtgaccaccatgagagacttcggcatgggcaagagaagcgtggaggagagaatccaggacgaggcccagtgcctgatcgaggagctgagaaagagcaagggcgccctggtggaccccaccttcctgttccacagcatcaccgccaacatcatctgcagcatcatcttcggcaagagattccactaccaggaccaggagttcctgaagaccctgaacctgttctgccagagcttcctgctgatcagcagcatcagcagccagctgttcgagctgttcagcggcttcctgaagtacttccccggcgcccacagacaggtgtacaagaacctgcaggagatcaacgcctacatcggccacagcgtggagaagcacagagagaccctggaccccagcgcccccagagacctgatcgacacctacctgctgcacatggagaaggagaagagcaacccccacagcgagttcagccaccagaacctgatcatcaacaccctgagcctgttcttcgccggcaccgagaccaccagcaccaccctgagatacggcttcctgctgatgctgaagtacccccacgtggccgagagagtgtacaaggagatcgagcaggtggtgggcccccacagaccccccgccctggacgacagagccaagatgccctacaccgaggccgtgatcagagagatccagagattcgccgacctgctgcccatgggcgtgccccacatcgtgacccagcacaccagcttctag

SEQ ID NO: 20319 - DNA, 999 bp, Artificial Sequence
  Description of Artificial Sequence: Synthetic coding sequence
atggccctgctgtgctacaacagaggctgcggccagagattcgaccccgagaccaacagcgacgacgcctgcacctaccaccccggcgtgcccgtgttccacgacgccctgaagggctggagctgctgcaagagaagaaccaccgacttcagcgacttcctgagcatcgtgggctgcaccaagggcagacacaacagcgagaagccccccgagcccgtgaagcccgaggtgaagaccaccgagaagaaggagctgtgcgagctgaagcccaagttccaggagcacatcatccaggcccccaagcccgtggaggccatcaagagacccagccccgacgagcccatgaccaacctggagctgaagatcagcgccagcctgaagcaggccctggacaagctgaagctgagcagcggcaacgaggagaacaagaaggaggaggacaacgacgagatcaagatcggcaccagctgcaagaacggcggctgcagcaagacctaccagggcctggagagcctggaggaggtgtgcgtgtaccacagcggcgtgcccatcttccacgagggcatgaagtactggagctgctgcagaagaaagaccagcgacttcaacaccttcctggcccaggagggctgcaccaagggcaagcacatgtggaccaagaaggacgccggcaagaaggtggtgccctgcagacacgactggcaccagaccggcggcgaggtgaccatcagcgtgtacgccaagaacagcctgcccgagctgagcagagtggaggccaacagcaccctgctgaacgtgcacatcgtgttcgagggcgagaaggagttcgaccagaacgtgaagctgtggggcgtgatcgacgtgaagagaagctacgtgaccatgaccgccaccaagatcgagatcaccatgagaaaggccgagcccatgcagtgggccagcctggagctgcccgccgccaagaagcaggagaagcagaaggacgccaccaccgactag

SEQ ID NO: 20320 - DNA, 942 bp, Artificial Sequence
  Description of Artificial Sequence: Synthetic coding sequence
atggccctgctgtgctacaacagaggctgcggccagagattcgaccccgagaccaacagcgacgacgcctgcacctaccaccccggcgtgcccgtgttccacgacgccctgaagggctgcaccaagggcagacacaacagcgagaagccccccgagcccgtgaagcccgaggtgaagaccaccgagaagaaggagctgtgcgagctgaagcccaagttccaggagcacatcatccaggcccccaagcccgtggaggccatcaagagacccagccccgacgagcccatgaccaacctggagctgaagatcagcgccagcctgaagcaggccctggacaagctgaagctgagcagcggcaacgaggagaacaagaaggaggaggacaacgacgagatcaagatcggcaccagctgcaagaacggcggctgcagcaagacctaccagggcctggagagcctggaggaggtgtgcgtgtaccacagcggcgtgcccatcttccacgagggcatgaagtactggagctgctgcagaagaaagaccagcgacttcaacaccttcctggcccaggagggctgcaccaagggcaagcacatgtggaccaagaaggacgccggcaagaaggtggtgccctgcagacacgactggcaccagaccggcggcgaggtgaccatcagcgtgtacgccaagaacagcctgcccgagctgagcagagtggaggccaacagcaccctgctgaacgtgcacatcgtgttcgagggcgagaaggagttcgaccagaacgtgaagctgtggggcgtgatcgacgtgaagagaagctacgtgaccatgaccgccaccaagatcgagatcaccatgagaaaggccgagcccatgcagtgggccagcctggagctgcccgccgccaagaagcaggagaagcagaaggacgccaccaccgactag

SEQ ID NO: 20321 - DNA, 1563 bp, Artificial Sequence
  Description of Artificial Sequence: Synthetic coding sequence
atgagcatccccctgaagagcagcttcctgctgagctacctgtgcaccctgccccccgccctgctgagcagagagatcctgatggccgacagcgaggccctgcccagcctggccggcgaccccgtggccgtggaggccctgctgagagccgtgttcggcgtggtggtggacgaggccatccagaagggcaccagcgtgagccagaaggtgtgcgagtggaaggagcccgaggagctgaagcagctgctggacctggagctgagaagccagggcgagagccagaagcagatcctggagagatgcagagccgtgatcagatacagcgtgaagaccggccaccccagattcttcaaccagctgttcagcggcctggacccccacgccctggccggcagaatcatcaccgagagcctgaacaccagccagtacacctacgagatcgcccccgtgttcgtgctgatggaggaggaggtgctgagaaagctgagagccctggtgggctggagcagcggcgacggcatcttctgccccggcggcagcatcagcaacatgtacgccgtgaacctggccagataccagagataccccgactgcaagcagagaggcctgagaaccctgccccccctggccctgttcaccagcaaggagtgccactacagcatccagaagggcgccgccttcctgggcctgggcaccgacagcgtgagagtggtgaaggccgacgagagaggcaagatggtgcccgaggacctggagagacagatcggcatggccgaggccgagggcgccgtgcccttcctggtgagcgccaccagcggcaccaccgtgctgggcgccttcgaccccctggaggccatcgccgacgtgtgccagagacacggcctgtggctgcacgtggacgccgcctggggcggcagcgtgctgctgagccagacccacagacacctgctggacggcatccagagagccgacagcgtggcctggaacccccacaagctgctggccgccggcctgcagtgcagcgccctgctgctgcaggacaccagcaacctgctgaagagatgccacggcagccaggccagctacctgttccagcaggacaagttctacgacgtggccctggacaccggcgacaaggtggtgcagtgcggcagaagagtggactgcctgaagctgtggctgatgtggaaggcccagggcgaccagggcctggagagaagaatcgaccaggccttcgtgctggccagatacctggtggaggagatgaagaagagagagggcttcgagctggtgatggagcccgagttcgtgaacgtgtgcttctggttcgtgccccccagcctgagaggcaagcaggagagccccgactaccacgagagactgagcaaggtggcccccgtgctgaaggagagaatggtgaaggagggcagcatgatgatcggctaccagccccacggcaccagaggcaacttcttcagagtggtggtggccaacagcgccctgacctgcgccgacatggacttcctgctgaacgagctggagagactgggccaggacctgtag

SEQ ID NO: 20322 - DNA, 1749 bp, Artificial Sequence
  Description of Artificial Sequence: Synthetic coding sequence
cacggcctgagagccaccgaggccctgcccagcgtgagaaccaccctgagaagcctgggcctggcccccacctgccaggccagaccccccgccggcagcctggccgccagaagactgctgcaggcccccgcccaccccgccaaccccaccgccgccgccgcccccaccggcaccgaggccaccagccagatgtgggccacccacagcggcagacccagaagctacctgtgcaccctgccccccgccctgctgagcagagagatcctgatggccgacagcgaggccctgcccagcctggccggcgaccccgtggccgtggaggccctgctgagagccgtgttcggcgtggtggtggacgaggccatccagaagggcaccagcgtgagccagaaggtgtgcgagtggaaggagcccgaggagctgaagcagctgctggacctggagctgagaagccagggcgagagccagaagcagatcctggagagatgcagagccgtgatcagatacagcgtgaagaccggccaccccagattcttcaaccagctgttcagcggcctggacccccacgccctggccggcagaatcatcaccgagagcctgaacaccagccagtacacctacgagatcgcccccgtgttcgtgctgatggaggaggaggtgctgagaaagctgagagccctggtgggctggagcagcggcgacggcatcttctgccccggcggcagcatcagcaacatgtacgccgtgaacctggccagataccagagataccccgactgcaagcagagaggcctgagaaccctgccccccctggccctgttcaccagcaaggagtgccactacagcatccagaagggcgccgccttcctgggcctgggcaccgacagcgtgagagtggtgaaggccgacgagagaggcaagatggtgcccgaggacctggagagacagatcggcatggccgaggccgagggcgccgtgcccttcctggtgagcgccaccagcggcaccaccgtgctgggcgccttcgaccccctggaggccatcgccgacgtgtgccagagacacggcctgtggctgcacgtggacgccgcctggggcggcagcgtgctgctgagccagacccacagacacctgctggacggcatccagagagccgacagcgtggcctggaacccccacaagctgctggccgccggcctgcagtgcagcgccctgctgctgcaggacaccagcaacctgctgaagagatgccacggcagccaggccagctacctgttccagcaggacaagttctacgacgtggccctggacaccggcgacaaggtggtgcagtgcggcagaagagtggactgcctgaagctgtggctgatgtggaaggcccagggcgaccagggcctggagagaagaatcgaccaggccttcgtgctggccagatacctggtggaggagatgaagaagagagagggcttcgagctggtgatggagcccgagttcgtgaacgtgtgcttctggttcgtgccccccagcctgagaggcaagcaggagagccccgactaccacgagagactgagcaaggtggcccccgtgctgaaggagagaatggtgaaggagggcagcatgatgatcggctaccagccccacggcaccagaggcaacttcttcagagtggtggtggccaacagcgccctgacctgcgccgacatggacttcctgctgaacgagctggagagactgggccaggacctgtag

SEQ ID NO: 20323 - DNA, 1041 bp, Artificial Sequence
  Description of Artificial Sequence: Synthetic coding sequence
atggccgacagcgaggccctgcccagcctggccggcgaccccgtggccgtggaggccctgctgagagccgtgttcggcgtggtggtggacgaggccatccagaagggcaccagcgtgagccagaagtgccactacagcatccagaagggcgccgccttcctgggcctgggcaccgacagcgtgagagtggtgaaggccgacgagagaggcaagatggtgcccgaggacctggagagacagatcggcatggccgaggccgagggcgccgtgcccttcctggtgagcgccaccagcggcaccaccgtgctgggcgccttcgaccccctggaggccatcgccgacgtgtgccagagacacggcctgtggctgcacgtggacgccgcctggggcggcagcgtgctgctgagccagacccacagacacctgctggacggcatccagagagccgacagcgtggcctggaacccccacaagctgctggccgccggcctgcagtgcagcgccctgctgctgcaggacaccagcaacctgctgaagagatgccacggcagccaggccagctacctgttccagcaggacaagttctacgacgtggccctggacaccggcgacaaggtggtgcagtgcggcagaagagtggactgcctgaagctgtggctgatgtggaaggcccagggcgaccagggcctggagagaagaatcgaccaggccttcgtgctggccagatacctggtggaggagatgaagaagagagagggcttcgagctggtgatggagcccgagttcgtgaacgtgtgcttctggttcgtgccccccagcctgagaggcaagcaggagagccccgactaccacgagagactgagcaaggtggcccccgtgctgaaggagagaatggtgaaggagggcagcatgatgatcggctaccagccccacggcaccagaggcaacttcttcagagtggtggtggccaacagcgccctgacctgcgccgacatggacttcctgctgaacgagctggagagactgggccaggacctgtag

SEQ ID NO: 20324 - DNA, 1041 bp, Artificial Sequence; identical to SEQ ID NO: 20323
  Description of Artificial Sequence: Synthetic coding sequence

SEQ ID NO: 20325 - DNA, 1365 bp, Artificial Sequence
  Description of Artificial Sequence: Synthetic coding sequence
atggccgacagcgaggccctgcccagcctggccggcgaccccgtggccgtggaggccctgctgagagccgtgttcggcgtggtggtggacgaggccatccagaagggcaccagcgtgagccagaaggtgtgcgagtggaaggagcccgaggagctgaagcagctgctggacctggagctgagaagccagggcgagagccagaagcagatcctggagagatgcagagccgtgatcagatacagcgtgaagaccggccaccccagattcttcaaccagctgttcagcggcctggacccccacgccctggccggcagaatcatcaccgagagcctgaacaccagccagtacacctacgagatcgcccccgtgttcgtgctgatggaggaggaggtgctgagaaagctgagagccctggtgggctggagcagcggcgacggcatcagcgccctgtgccactacagcatccagaagggcgccgccttcctgggcctgggcaccgacagcgtgagagtggtgaaggccgacgagagaggcaagatggtgcccgaggacctggagagacagatcggcatggccgaggccgagggcgccgtgcccttcctggtgagcgccaccagcggcaccaccgtgctgggcgccttcgaccccctggaggccatcgccgacgtgtgccagagacacggcctgtggctgcacgtggacgccgcctggggcggcagcgtgctgctgagccagacccacagacacctgctggacggcatccagagagccgacagcgtggcctggaacccccacaagctgctggccgccggcctgcagtgcagcgccctgctgctgcaggacaccagcaacctgctgaagagatgccacggcagccaggccagctacctgttccagcaggacaagttctacgacgtggccctggacaccggcgacaaggtggtgcagtgcggcagaagagtggactgcctgaagctgtggctgatgtggaaggcccagggcgaccagggcctggagagaagaatcgaccaggccttcgtgctggccagatacctggtggaggagatgaagaagagagagggcttcgagctggtgatggagcccgagttcgtgaacgtgtgcttctggttcgtgccccccagcctgagaggcaagcaggagagccccgactaccacgagagactgagcaaggtggcccccgtgctgaaggagagaatggtgaaggagggcagcatgatgatcggctaccagccccacggcaccagaggcaacttcttcagagtggtggtggccaacagcgccctgacctgcgccgacatggacttcctgctgaacgagctggagagactgggccaggacctgtag

SEQ ID NO: 20326 - DNA, 1482 bp, Artificial Sequence
  Description of Artificial Sequence: Synthetic coding sequence
atggccgacagcgaggccctgcccagcctggccggcgaccccgtggccgtggaggccctgctgagagccgtgttcggcgtggtggtggacgaggccatccagaagggcaccagcgtgagccagaaggtgtgcgagtggaaggagcccgaggagctgaagcagctgctggacctggagctgagaagccagggcgagagccagaagcagatcctggagagatgcagagccgtgatcagatacagcgtgaagaccggccaccccagattcttcaaccagctgttcagcggcctggacccccacgccctggccggcagaatcatcaccgagagcctgaacaccagccagtacacctacgagatcgcccccgtgttcgtgctgatggaggaggaggtgctgagaaagctgagagccctggtgggctggagcagcggcgacggcatcttctgccccggcggcagcatcagcaacatgtacgccgtgaacctggccagataccagagataccccgactgcaagcagagaggcctgagaaccctgccccccctggccctgttcaccagcaaggagtgccactacagcatccagaagggcgccgccttcctgggcctgggcaccgacagcgtgagagtggtgaaggccgacgagagaggcaagatggtgcccgaggacctggagagacagatcggcatggccgaggccgagggcgccgtgcccttcctggtgagcgccaccagcggcaccaccgtgctgggcgccttcgaccccctggaggccatcgccgacgtgtgccagagacacggcctgtggctgcacgtggacgccgcctggggcggcagcgtgctgctgagccagacccacagacacctgctggacggcatccagagagccgacagcgtggcctggaacccccacaagctgctggccgccggcctgcagtgcagcgccctgctgctgcaggacaccagcaacctgctgaagagatgccacggcagccaggccagctacctgttccagcaggacaagttctacgacgtggccctggacaccggcgacaaggtggtgcagtgcggcagaagagtggactgcctgaagctgtggctgatgtggaaggcccagggcgaccagggcctggagagaagaatcgaccaggccttcgtgctggccagatacctggtggaggagatgaagaagagagagggcttcgagctggtgatggagcccgagttcgtgaacgtgtgcttctggttcgtgccccccagcctgagaggcaagcaggagagccccgactaccacgagagactgagcaaggtggcccccgtgctgaaggagagaatggtgaaggagggcagcatgatgatcggctaccagccccacggcaccagaggcaacttcttcagagtggtggtggccaacagcgccctgacctgcgccgacatggacttcctgctgaacgagctggagagactgggccaggacctgtag

SEQ ID NO: 20327 - DNA, 459 bp, Artificial Sequence
  Description of Artificial Sequence: Synthetic coding sequence
atggccgacagcgaggccctgcccagcctggccggcgaccccgtggccgtggaggccctgctgagagccgtgttcggcgtggtggtggacgaggccatccagaagggcaccagcgtgagccagaaggtgtgcgagtggaaggagcccgaggagctgaagcagctgctggacctggagctgagaagccagggcgagagccagaagcagatcctggagagatgcagagccgtgatcagatacagcgtgaagaccggccaccccagattcttcaaccagctgttcagcggcctggacccccacgccctggccggcagaatcatcaccgagagcctgaacaccagccagtacacctacgagatcgcccccgtgttcgtgctgatggaggaggaggtgctgagaaagctgagagccctggtgggctggagcagcggcgacggcatcttctgccccggcctgtag

SEQ ID NO: 20328 - DNA, 804 bp, Artificial Sequence
  Description of Artificial Sequence: Synthetic coding sequence
atggccgacagcgaggccctgcccagcctggccggcgaccccgtggccgtggaggccctgctgagagccgtgttcggcgtggtggtggacgaggccatccagaagggcaccagcgtgagccagaaggtgtgcgagtggaaggagcccgaggagctgaagcagctgctggacctggagctgagaagccagggcgagagccagaagcagatcctggagagatgcagagccgtgatcagatacagcgtgaagaccggccaccccagattcttcaaccagctgttcagcggcctggacccccacgccctggccggcagaatcatcaccgagagcctgaacaccagccagtacacctacgagatcgcccccgtgttcgtgctgatggaggaggaggtgctgagaaagctgagagccctggtgggctggagcagcggcgacggcatcttctgccccggcggcagcatcagcaacatgtacgccgtgaacctggccagataccagagataccccgactgcaagcagagaggcctgagaaccctgccccccctggccctgttcaccagcaaggaggtgggcaagagacacagacccaaccccggcctgctgatcctgatcagcagccacgtgaccacccccagcagaagagagctgagattctgggacctggcccccaccgtgagcgagtggagcagactgatgagagagggcaagtggagccccagaatctggagaggcagactggtgtggcccagactgagagtgctgtgcagaagctggagcgtgccccccctggcccccctgtgctag

SEQ ID NO: 20329 - DNA, 300 bp, Artificial Sequence
  Description of Artificial Sequence: Synthetic coding sequence
atgagcagccagcagagcgccgtgagcgccaagggcttcagcaagggcagcagccagggccccgccccctgccccgcccccgcccccacccccgcccccgccagcagcagcagctgctgcggcagcggcagaggctgctgcggcgacagcggctgctgcggcagcagcagcaccagctgctgctgcttccccagaagaagaagaagacagagaagcagcggctgctgctgctgcggcggcggcagccagagaagccagagaagcaacaacagaagcagcggctgctgcagcggctgctag

SEQ ID NO: 20330 - DNA, 372 bp, Artificial Sequence
  Description of Artificial Sequence: Synthetic coding sequence
atggccagccacgtggagtgcagacccctgggcgtgttcgagtgcgagctgtgcaccctgaccgccccctacagctacgtgggccagaagccccccaacacccagagcatggtgctgctggaggagagctacgtgatgaaggaccccttcaccagcgacaaggacagattcctggtgctgggcagctgctgcagcctgtgcagcagactggtgtgcgtgggccccgagtgcagcctgttctacagcaagagattctgcctgccctgcgtgagagagaacatcaacgccttcccccaggagatcagacaggacctggagaagagaaaggcccccagcaagagaacccccagccagcccggcagcagaacctag

SEQ ID NO: 20331 - DNA, 1545 bp, Artificial Sequence
  Description of Artificial Sequence: Synthetic coding sequence
atgaaggaggccggccagatgcagaacctggagagcgccagagccggcagaagcgtgagcacccagaccggcagcatgaccggccagatccccagactgagcaaggtgaacctgttcaccctgctgagcctgtggatggagctgttccccgccgaggcccagagacagaagagccagaagaacgaggagggcaagcacggccccctgggcgacaacgaggagagaaccagagtgagcaccgacaagagacaggtgaagagaaccggcctggtggtggtgaagaacatgaagatcgtgggcctgcactgcagcagcgaggacctgcacgccggccagatcgccctgatcaagcacggcagcagactgaagaactgcgacctgtacttcagcagaaagccctgcagcgcctgcctgaagatgatcgtgaacgccggcgtgaacagaatcagctactggcccgccgaccccgagatcagcctgctgaccgaggccagcagcagcgaggacgccaagctggacgccaaggccgtggagagactgaagagcaacagcagagcccacgtgtgcgtgctgctgcagcccctggtgtgctacatggtgcagttcgtggaggagaccagctacaagtgcgacttcatccagaagatcaccaagaccctgcccgacgccaacaccgacttctactacgagtgcaagcaggagagaatcaaggagtacgagatgctgttcctggtgagcaacgaggagatgcacaagcagatcctgatgaccatcggcctggagaacctgtgcgagaacccctacttcagcaacctgagacagaacatgaaggacctgatcctgctgctggccaccgtggccagcagcgtgcccaacttcaagcacttcggcttctacagaagcaaccccgagcagatcaacgagatccacaaccagagcctgccccaggagatcgccagacactgcatggtgcaggccagactgctggcctacagaaccgaggaccacaagaccggcgtgggcgccgtgatctgggccgagggcaagagcagaagctgcgacggcaccggcgccatgtacttcgtgggctgcggctacaacgccttccccgtgggcagcgagtacgccgacttcccccacatggacgacaagcagaaggacagagagatcagaaagttcagatacatcatccacgccgagcagaacgccctgaccttcagatgccaggagatcaagcccgaggagagaagcatgatcttcgtgaccaagtgcccctgcgacgagtgcgtgcccctgatcaagggcgccggcatcaagcagatctacgccggcgacgtggacgtgggcaagaagaaggccgacatcagctacatgagattcggcgagctggagggcgtgagcaagttcacctggcagctgaaccccagcggcgcctacggcctggagcagaacgagcccgagagaagagagaacggcgtgctgagacccgtgccccagaaggaggagcagcaccaggacaagaagctgagactgggcatccactag

SEQ ID NO: 20332 - DNA, 951 bp, Artificial Sequence
  Description of Artificial Sequence: Synthetic coding sequence
atggtgcagttcgtggaggagaccagctacaagtgcgacttcatccagaagatcaccaagaccctgcccgacgccaacaccgacttctactacgagtgcaagcaggagagaatcaaggagtacgagatgctgttcctggtgagcaacgaggagatgcacaagcagatcctgatgaccatcggcctggagaacctgtgcgagaacccctacttcagcaacctgagacagaacatgaaggacctgatcctgctgctggccaccgtggccagcagcgtgcccaacttcaagcacttcggcttctacagaagcaaccccgagcagatcaacgagatccacaaccagagcctgccccaggagatcgccagacactgcatggtgcaggccagactgctggcctacagaaccgaggaccacaagaccggcgtgggcgccgtgatctgggccgagggcaagagcagaagctgcgacggcaccggcgccatgtacttcgtgggctgcggctacaacgccttccccgtgggcagcgagtacgccgacttcccccacatggacgacaagcagaaggacagagagatcagaaagttcagatacatcatccacgccgagcagaacgccctgaccttcagatgccaggagatcaagcccgaggagagaagcatgatcttcgtgaccaagtgcccctgcgacgagtgcgtgcccctgatcaagggcgccggcatcaagcagatctacgccggcgacgtggacgtgggcaagaagaaggccgacatcagctacatgagattcggcgagctggagggcgtgagcaagttcacctggcagctgaaccccagcggcgcctacggcctggagcagaacgagcccgagagaagagagaacggcgtgctgagacccgtgccccagaaggaggagcagcaccaggacaagaagctgagactgggcatccactag

SEQ ID NO: 20333 - DNA, 462 bp, Artificial Sequence
  Description of Artificial Sequence: Synthetic coding sequence
atgaaggaggccggccagatgcagaacctggagagcgccagagccggcagaagcgtgagcacccagaccggcagcatgaccggccagatccccagactgagcaaggtgaacctgttcaccctgctgagcctgtggatggagctgttccccgccgaggcccagagacagaagagccagaagaacgaggagggcaagcacggccccctgggcgacaacgaggagagaaccagagtgagcaccgacaagagacaggtgaagagaaccggcctggtggtggtgaagaacatgaagatcgtgggcctgcactgcagcagcgaggacctgcacgccggccagatcgccctgatcaagcacggcagcagactgaagaactgcgacctgtacttcagcagaaagccctgcagcgcctgcctgaagatgatcgtgaacggcctgctggaggccgccaagatgcccagatag

SEQ ID NO: 20334 - DNA, 1506 bp, Artificial Sequence
  Description of Artificial Sequence: Synthetic coding sequence
atggacgagaacaacggcctgctgctgctggagctgaacccccccaacccctgggacctgcagcccagaagccccgaggagctggccttcggcgaggtgcagatcacctacctgacccacgcctgcatggacctgaagctgggcgacaagagaatggtgttcgacccctggctgatcggccccgccttcgccagaggctggtggctgctgcacgagccccccagcgactggctggagagactgtgccaggccgacctgatctacatcagccacctgcacagcgaccacctgagctaccccaccctgaagaagctggccggcagaagacccgacatccccatctacgtgggcaacaccgagagacccgtgttctggaacctgaaccagagcggcgtgcagctgaccaacatcaacgtggtgcccttcggcatctggcagcaggtggacaagaacctgagattcatgatcctgatggacggcgtgcaccccgagatggacacctgcatcatcgtggagtacaagggccacaagatcctgaacatcgtggactgcaccagacccaacggcggcagactgcccatgaaggtggccctgatgatgagcgacttcgccggcggcgccagcggcttccccatgaccttcagcggcggcaagttcaccgaggagtggaaggcccagttcatcaagaccgagagaaagaagctgctgaactacaaggccagactggtgaagaacctgcagcccagaatctactgccccttcgccggctacttcgtggagagccaccccagcgacaagtacatcaaggagaccaacaccaagaacgaccccaacgagctgaacaacctgatcaagaagaacagcgacgtgatcacctggacccccagacccggcgccaccctggacctgggcagaatgctgaaggacagaaccgacagcaagggcatcatcgagccccccgagggcaccaagatctacaaggacagctgggacttcgagccctacctggagatcctgaacgccgccctgggcgacgagatcttcctgcacagcagctggatcaaggagtacttcacctgggccggcttcaaggactacaacctggtggtgagaatgatcgagaccgacgaggacttcaaccccttccccggcggctacgactacctggtggacttcctggacctgagcttccccaaggagagaccccagagagagcacccctacgaggagatccacagcagagtggacgtgatcagacacgtggtgaagaacggcctgctgtgggacgagctgtacatcggcttccagaccagactgcagagagaccccgacatctaccaccacctgttctggaaccacttccagatcaagctgcccctgaccccccccaactggaagagcttcctgatgtgctgcgagcagaacggccccgtgatcctgcagttcagcaccgagagaaccaacgagcccaacagaaacaagttcagcgtggagaacaaggcctag

SEQ ID NO: 20335 - DNA, 1461 bp, Artificial Sequence
  Description of Artificial Sequence: Synthetic coding sequence
atggacgagaacaacggcctgctgctgctggagctgaacccccccaacccctgggacctgcagcccagaagccccgaggagctggccttcggcgaggtgcagatcacctacctgacccacgcctgcatggacctgaagctgggcgacaagagaatggtgttcgacccctggctgatcggccccgccttcgccagaggctggtggctgctgcacgagccccccagcgactggctggagagactgtgccaggccgacctgatctacatcagccacctgcacagcgaccacctgagctaccccaccctgaagaagctggccggcagaagacccgacatccccatctacgtgggcaacaccgagagacccgtgttctggaacctgaaccagagcggcgtgcagctgaccaacatcaacgtggtgcccttcggcatctggcagcaggtggacaagaacctgagattcatgatcctgatggacggcgtgcaccccgagatggacacctgcatcatcgtggagtacaagggccacaagatcctgaacatcgtggactgcaccagacccaacggcggcagactgcccatgaaggtggccctgatgatgagcgacttcgccggcggcgccagcggcttccccatgaccttcagcggcggcaagttcaccgaggagtggaaggcccagttcatcaagaccgagagaaagaagctgctgaactacaaggccagactggtgaagaacctgcagcccagaatctactgccccttcgccggctacttcgtggagagccaccccagcgacaagtacatcaaggagaccaacaccaagaacgaccccaacgagctgaacaacctgatcaagaagaacagcgacgtgatcacctggacccccagacccggcgccaccctggacctgggcagaatgctgaaggacagaaccgacagcaagggcatcatcgagccccccgagggcaccaagatctacaaggacagctgggacttcgagccctacctggagatcctgaacgccgccctgggcgacgagatcttcctgcacagcagctggatcaaggagtacttcacctgggccggcttcaaggactacaacctggtggtgagaatgatcgagaccgacgaggacttcaaccccttccccggcggctacgactacctggtggacttcctggacctgagcttccccaaggagagaccccagagagagcacccctacgaggagatccacagcagagtggacgtgatcagacacgtggtgaagaacggcctgctgtgggacgagctgtacatcggcttccagaccagactgcagagagaccccgacatctaccaccacctgttctggaaccacttccagatcaagctgcccctgaccccccccaactggaagagcttcctgatgtgctgcgagcagaacggccccgtgatcctgcaggagtgcaagaccacctag

SEQ ID NO: 20336 - DNA, 663 bp, Artificial Sequence
  Description of Artificial Sequence: Synthetic coding sequence
atggacgagaacaacggcctgctgctgctggagctgaacccccccaacccctgggacctgcagcccagaagccccgaggagctggccttcggcgaggtgcagatcacctacctgacccacgcctgcatggacctgaagctgggcgacaagagaatggtgttcgacccctggctgatcggccccgccttcgccagaggctggtggctgctgcacgagccccccagcgactggctggagagactgtgccaggccgacctgatctacatcagccacctgcacagcgaccacctgagctaccccaccctgaagaagctggccggcagaagacccgacatccccatctacgtgggcaacaccgagagacccgtgttctggaacctgaaccagagcggcgtgcagctgaccaacatcaacgtggtgcccttcggcatctggcagcaggtggacaagaacctgagattcatgatcctgatggacggcgtgcaccccgagatggacacctgcatcatcgtggagtacaagggccacaagatcctgaacatcgtggactgcaccagacccaacggcggcagactgcccatgaaggtggccctgatgatgagcgacttcgccggcggcgccagcggcttccccatgaccttcagcggcggcaagttcacctag

SEQ ID NO: 20337 - DNA, 681 bp, Artificial Sequence
  Description of Artificial Sequence: Synthetic coding sequence
atggacgagaacaacggcctgctgctgctggagctgaacccccccaacccctgggacctgcagcccagaagccccgaggagctggccttcggcgaggtgcagatcacctacctgacccacgcctgcatggacctgaagctgggcgacaagagaatggtgttcgacccctggctgatcggccccgccttcgccagaggctggtggctgctgcacgagccccccagcgactggctggagagactgtgccaggccgacctgatctacatcagccacctgcacagcgaccacctgagctaccccaccctgaagaagctggccggcagaagacccgacatccccatctacgtgggcaacaccgagagacccgtgttctggaacctgaaccagagcggcgtgcagctgaccaacatcaacgtggtgcccttcggcatctggcagcaggtggacaagaacctgagattcatgatcctgatggacggcgtgcaccccgagatggacacctgcatcatcgtggagtacaagggccacaagatcctgaacatcgtggactgcaccagacccaacggcggcagactgcccatgaaggtggccctgatgatgagcgacttcgccggcggcgccagcggcttccccatgaccttcagcggcggcaagttcaccgccgaggagaccctgatctag

SEQ ID NO: 20338 - DNA, 1506 bp, Artificial Sequence; identical to SEQ ID NO: 20334
  Description of Artificial Sequence: Synthetic coding sequence

SEQ ID NO: 20339 - DNA, 522 bp, Artificial Sequence
  Description of Artificial Sequence: Synthetic coding sequence
atggacgagaacaacggcctgctgctgctggagctgaacccccccaacccctgggacctgcagcccagaagccccgaggagctggccttcggcgaggtgcagatcacctacctgacccacgcctgcatggacctgaagctgggcgacaagagaatggtgttcgacccctggctgatcggccccgccttcgccagaggctggtggctgctgcacgagccccccagcgactggctggagagactgtgccaggccgacctgatctacatcagccacctgcacagcgaccacctgagctaccccaccctgaagaagctggccggcagaagacccgacatccccatctacgtgggcaacaccgagagacccgtgttctggaacctgaaccagagcggcgtgcagctgaccaacatcaacgtggtgcccttcggcatctggcagcaggtggacaagaacctgagattcatgatcctgatggacggcgtgcaccccgagatggacacctgcatcatcgtggagtactag

SEQ ID NO: 20340 - DNA, 687 bp, Artificial Sequence
  Description of Artificial Sequence: Synthetic coding sequence
atgcccagaagaggcctggtggccggccccgacctggagtacttccagagaagatacttcacccccgccgaggtggcccagcacaacagacccgaggacctgtgggtgagctacctgggcagagtgtacgacctgaccagcctggcccaggagtacaagggcaacctgctgctgaagcccatcgtggaggtggccggccaggacatcagccactggttcgaccccaagaccagagacatcagaaagcacatcgaccccctgaccggctgcctgagatactgcacccccagaggcagattcgtgcacgtgcccccccagctgccctgcagcgactgggccaacgacttcggcaagccctggtggcagggcagctactacgaggtgggcagactgagcgccaagaccagaagcatcagaatcatcaacaccctgaccagccaggagcacaccctggaggtgggcgtgctggagagcatctgggagatcctgcacagatacctgccctacaacagccacgccgccagctacacctggaagtacgagggcaagaacctgaacatggacttcaccctggaggagaacggcatcagagacgaggaggaggagttcgactacctgagcatggacggcaccctgcacacccccgccatcctgctgtacttcaacgacgacctgaccgagctgtag

SEQ ID NO: 20341 - DNA, 474 bp, Artificial Sequence
  Description of Artificial Sequence: Synthetic coding sequence
atgcccagaagaggcctggtggccggccccgacctggagtacttccagagaagatacttcacccccgccgaggtggcccagcacaacagacccgaggacctgtgggtgagctacctgggcagagtgtacgacctgaccagcctggcccaggagtacaagggcaacctgctgctgaagcccatcgtggaggtggccggccaggacatcagccactggttcgaccccaagaccagagacatcagaaagcacatcgaccccctgaccggctgcctgagatactgcacccccagaggcagattcgtgcacgtgcccccccagctgccctgcagcgactgggccaacgacttcggcaagccctggtggcagggcagctactacgaggtgggcagactgagcgccaagaccagaagcatcagaatcatcaacaccctgaccagccaggagcacaccctggagatccacgaggagctgtag

SEQ ID NO: 20342 - DNA, 744 bp, Artificial Sequence
  Description of Artificial Sequence: Synthetic coding sequence
atgatggccgagagagaggaggacgacgacaccgaggaggcctggatgcagctgagacccaccgagcccctgcccagccagtgctgcggcagcggctgcagcccctgcgtgttcgacctgtaccacagagacctggccagatgggaggccgcccaggccagcaaggacagaagcctgctgagaggccccgagagccagagctgccccagcaagctgaaccccgagaccttcgtggccttctgcatcatcgccatggacagactgaccaaggacacctacagagtgagattcgccctgcccggcaacagccagctgggcctgagacccggccagcacctgatcctgagaggcatcgtggacgacctggagatccagagagcctacacccccatcagccccgccaacgccgagggctacttcgaggtgctgatcaagtgctaccagatgggcctgatgagcagatacgtggagagctggagagtgggcgacaccgccttctggagaggccccttcggcgacttcttctacaagcccaaccaggagagcagcagcgagcagctgccctggagctaccaggagaagacccacttcggccacctgggccaggacctgatcaaggagctggtgagctgctgcagaagaaagcccttcgccctggtgtgcggcagcgccgagttcaccaaggacatcgccagatgcctgctgtgcgccggcctgaccgaggacagctacttcctgttctag

SEQ ID NO: 20343 - DNA, 504 bp, Artificial Sequence
  Description of Artificial Sequence: Synthetic coding sequence
atgggcctgatgagcagatacgtggagagctggagagtgggcgacaccgccttctggagaggccccttcggcgacttcttctacaagcccaaccagtacggcgagctgctgctgctggccgccggcaccggcctggcccccatggtgcccatcctgcagagcatcaccgacaacgagaacgacgagaccttcgtgaccctggtgggctgcttcaagaccttcgagagcatctacctgaagaccttcctgcaggagcaggccagattctggaacgtgagaaccttcttcgtgctgagccaggagagcagcagcgagcagctgccctggagctaccaggagaagacccacttcggccacctgggccaggacctgatcaaggagctggtgagctgctgcagaagaaagcccttcgccctggtgtgcggcagcgccgagttcaccaaggacatcgccagatgcctgctgtgcgccggcctgaccgaggacagctacttcctgttctag

SEQ ID NO: 20344 - DNA, 948 bp, Artificial Sequence
  Description of Artificial Sequence: Synthetic coding sequence
atgatggccgagagagaggaggacgacgacaccgaggaggcctggatgcagctgagacccaccgagcccctgcccagccagtgctgcggcagcggctgcagcccctgcgtgttcgacctgtaccacagagacctggccagatgggaggccgcccaggccagcaaggacagaagcctgctgagaggccccgagagccagagctgccccagcaagctgaaccccgagaccttcgtggccttctgcatcatcgccatggacagactgaccaaggacacctacagagtgagattcgccctgcccggcaacagccagctgggcctgagacccggccagcacctgatcctgagaggcatcgtggacgacctggagatccagagagcctacacccccatcagccccgccaacgccgagggctacttcgaggtgctgatcaagtgctaccagatgggcctgatgagcagatacgtggagagctggagagtgggcgacaccgccttctggagaggccccttcggcgacttcttctacaagcccaaccagtacggcgagctgctgctgctggccgccggcaccggcctggcccccatggtgcccatcctgcagagcatcaccgacaacgagaacgacgagaccttcgtgaccctggtgggctgcttcaagaccttcgagagcatctacctgaagaccttcctgcaggagcaggccagattctggaacgtgagaaccttcttcgtgctgagccaggagagcagcagcgagcagctgccctggagctaccaggagaagacccacttcggccacctgggccaggacctgatcaaggagctggtgagctgctgcagaagaaagcccttcgccctggtgtgcggcagcgccgagttcaccaaggacatcgccagatgcctgctgtgcgccggcctgaccgaggacagctacttcctgttctag

SEQ ID NO: 20345 - DNA, 417 bp, Artificial Sequence
  Description of Artificial Sequence: Synthetic coding sequence
atgatggccgagagagaggaggacgacgacaccgaggaggcctggatgcagctgagacccaccgagcccctgcccagccagtgctgcggcagcggctgcagcccctgcgtgttcgacctgtaccacagagacctggccagatgggaggccgcccaggccagcaaggacagaagcctgctgagaggccccgagagccagagctgccccagcaagctgaaccccgagaccttcgtggccttctgcatcatcgccatggacagactgaccaaggacacctacagagtgagattcgccctgcccggcaacagccagctgggcctgagacccggccagcacctgatcctgagatacacccaggtggccggcggccccaagctgcacagccccgccctgctgttcgccagctgctggccctag

SEQ ID NO: 20346 - DNA, 948 bp, Artificial Sequence; identical to SEQ ID NO: 20344
  Description of Artificial Sequence: Synthetic coding sequence

SEQ ID NO: 20347 - DNA, 744 bp, Artificial Sequence; identical to SEQ ID NO: 20342
  Description of Artificial Sequence: Synthetic coding sequence

SEQ ID NO: 20348 - DNA, 948 bp, Artificial Sequence; identical to SEQ ID NO: 20344
  Description of Artificial Sequence: Synthetic coding sequence

SEQ ID NO: 20349 - DNA, 246 bp, Artificial Sequence
  Description of Artificial Sequence: Synthetic coding sequence
atgagcagaagcagcaaggtggtgctgggcctgagcgtgctgctgaccgccgccaccgtggccggcgtgcacgtgaagcagcagtgggaccagcagagactgagagacggcgtgatcagagacatcgagagacagatcagaaagaaggagaacatcagactgctgggcgagcagatcatcctgaccgagcagctggaggccgagagagagaagatgctgctggccaagggcagccagaagagctag

SEQ ID NO: 20350 - DNA, 810 bp, Artificial Sequence
  Description of Artificial Sequence: Synthetic coding sequence
ggcctgctgctggtggccctgctggccagcctgaccgtgatggtgctgatgagcgtgtggcagcagagaaagagcagaggcaagctgcccctgggccccacccccctgctgttcatcggcaactacctgcagctgaacaccgagcacatctgcgacagcatcatgaagatcagcgagagatacggccccgtgttcaccatccacctgggccccagaagagtggtggtgctgtgcggccacgacgccgtgaaggaggccctggtggaccaggccgaggagttcagcggcagaggcgagcaggccaccttcgactggctgttcaagggctacggcgtgacctgcagaacctgggagagaaccaagcccctgagaagattcagcatcgccaccctgagagacttcggcgtgggcaagagaggcatcaaggagatccaggagaaggccggcttcctgatcaaggcccaccagagcagcgacagcagcatctaccccaccttcttcctgagcagaaccaccagcaacgtgatcagcagcatcgtgttcggcgacagattcgactacgaggacaagttcctgagcctgctgtgcatgatgctggagagcttccagttcaccgcccccagcaccggccagctgtacgagatgttcagcagcgtgatgaagcacctgcccggcccccagcagcaggccttcaaggagctgcagggcctggaggacttcatcgccaagaaggtggagcacaaccagtgcaccctggaccccaacagccccagagacttcatcgacagcttcctgatcagaatgcagtag

SEQ ID NO: 20351 - DNA, 1338 bp, Artificial Sequence
  Description of Artificial Sequence: Synthetic coding sequence
atgggcctggaggccctggtgcccctggccatgatcgtggccatcttcctgctgctggtggacctgatgcacagacaccagagatgggccgccagatacccccccggccccctgcccctgcccggcctgggcaacctgcacgtggacttccagaacaccccctactgcttcgaccagctgagaagaagattcggcgacgtgttcagcctgcagctggcctggacccccgtggtggtgctgaacggcctggccgccgtgagagaggccatggtgaccagaggcgaggacaccgccgacagaccccccgcccccatctaccaggtgctgggcttcggccccagaagccagggcagacccttcagacccaacggcctgctggacaaggccgtgagcaacgtgatcgccagcctgacctgcggcagaagattcgagtacgacgaccccagattcctgagactgctggacctggcccaggagggcctgaaggaggagagcggcttcctgagagaggtgctgaacgccgtgcccgtgctgctgcacatccccgccctggccggcaaggtgctgagattccagaaggccttcctgacccagctggacgagctgctgaccgagcacagaatgacctgggaccccgcccagccccccagagacctgaccgaggccttcctggccaagaaggagaaggccaagggcagccccgagagcagcttcaacgacgagaacctgagaatcgtggtgggcaacctgttcctggccggcatggtgaccaccctgaccaccctggcctggggcctgctgctgatgatcctgcacctggacgtgcagctgagagtgcagcaggagatcgacgacgtgatcggccaggtgagaagacccgagatgggcgaccaggcccacatgccctacaccaccgccgtgatccacgaggtgcagagattcggcgacatcatccccctgagcgtgacccacatgaccagccacgacatcgaggtgcagggcttcagaatccccaagggcaccaccctgatcaccaacctgagcagcgtgctgaaggacgaggccgtgtggaagaagcccttcagattccaccccgagcacttcctggacgcccagggccacttcgtgaagcccgaggccttcctgcccttcagcgccggcagaagagcctgcctgggcgagcccctggccagaatggagctgttcctgttcttcaccagcctgctgcagcacttcagcttcagcgtggccgccggccagcccagacccagccacagcagagtggtgagcttcctggtgacccccagcccctacgagctgtgcgccgtgcccagatag

SEQ ID NO: 20352 - DNA, 1332 bp, Artificial Sequence
  Description of Artificial Sequence: Synthetic coding sequence
caggaggccctgaccctgcccctgcagctgagaagaagattcggcgacgtgttcagcctgcagctggcctggacccccgtggtggtgctgaacggcctggccgccgtgagagaggccatggtgaccagaggcgaggacaccgccgacagaccccccgcccccatctaccaggtgctgggcttcggccccagagagcagtgggtgttcctgagcagatacggccccgcctggagagagcagagaagattcagcgtgagcaccctgagaaacctgggcctgggcaagaagagcctggagcagtgggtgaccgaggaggccgcctgcctgtgcgccgccttcgccgaccaggacgcccccttcgcccccaccgtgagctggaccaagcccaacgtgatcgccagcctgacctgcggcagaagattcgagtacgacgaccccagattcctgagactgctggacctggcccaggagggcctgaaggaggagagcggcttcctgagagaggtgctgaacgccgtgcccgtgctgctgcacatccccgccctggccggcaaggtgctgagattccagaaggccttcctgacccagctggacgagctgctgaccgagcacagaatgacctgggaccccgcccagccccccagagacctgaccgaggccttcctggccaagaaggagaaggccaagggcagccccgagagcagcttcaacgacgagaacctgagaatcgtggtgggcaacctgttcctggccggcatggtgaccaccctgaccaccctggcctggggcctgctgctgatgatcctgcacctggacgtgcagctgagagtgcagcaggagatcgacgacgtgatcggccaggtgagaagacccgagatgggcgaccaggcccacatgccctacaccaccgccgtgatccacgaggtgcagagattcggcgacatcatccccctgagcgtgacccacatgaccagccacgacatcgaggtgcagggcttcagaatccccaagggcaccaccctgatcaccaacctgagcagcgtgctgaaggacgaggccgtgtggaagaagcccttcagattccaccccgagcacttcctggacgcccagggccacttcgtgaagcccgaggccttcctgcccttcagcgccggcagaagagcctgcctgggcgagcccctggccagaatggagctgttcctgttcttcaccagcctgctgcagcacttcagcttcagcgtggccgccggccagcccagacccagccacagcagagtggtgagcttcctggtgacccccagcccctacgagctgtgcgccgtgcccagatag

SEQ ID NO: 20353 - DNA, 1491 bp, Artificial Sequence
  Description of Artificial Sequence: Synthetic coding sequence
atgggcctggaggccctggtgcccctggccatgatcgtggccatcttcctgctgctggtggacctgatgcacagacaccagagatgggccgccagatacccccccggccccctgcccctgcccggcctgggcaacctgcacgtggacttccagaacaccccctactgcttcgaccagctgagaagaagattcggcgacgtgttcagcctgcagctggcctggacccccgtggtggtgctgaacggcctggccgccgtgagagaggccatggtgaccagaggcgaggacaccgccgacagaccccccgcccccatctaccaggtgctgggcttcggccccagagagcagtgggtgttcctgagcagatacggccccgcctggagagagcagagaagattcagcgtgagcaccctgagaaacctgggcctgggcaagaagagcctggagcagtgggtgaccgaggaggccgcctgcctgtgcgccgccttcgccgaccaggccggcagacccttcagacccaacggcctgctggacaaggccgtgagcaacgtgatcgccagcctgacctgcggcagaagattcgagtacgacgaccccagattcctgagactgctggacctggcccaggagggcctgaaggaggagagcggcttcctgagagaggtgctgaacgccgtgcccgtgctgctgcacatccccgccctggccggcaaggtgctgagattccagaaggccttcctgacccagctggacgagctgctgaccgagcacagaatgacctgggaccccgcccagccccccagagacctgaccgaggccttcctggccaagaaggagaaggccaagggcagccccgagagcagcttcaacgacgagaacctgagaatcgtggtgggcaacctgttcctggccggcatggtgaccaccctgaccaccctggcctggggcctgctgctgatgatcctgcacctggacgtgcagctgagagtgcagcaggagatcgacgacgtgatcggccaggtgagaagacccgagatgggcgaccaggcccacatgccctacaccaccgccgtgatccacgaggtgcagagattcggcgacatcatccccctgagcgtgacccacatgaccagccacgacatcgaggtgcagggcttcagaatccccaagggcaccaccctgatcaccaacctgagcagcgtgctgaaggacgaggccgtgtggaagaagcccttcagattccaccccgagcacttcctggacgcccagggccacttcgtgaagcccgaggccttcctgcccttcagcgccggcagaagagcctgcctgggcgagcccctggccagaatggagctgttcctgttcttcaccagcctgctgcagcacttcagcttcagcgtggccgccggccagcccagacccagccacagcagagtggtgagcttcctggtgacccccagcccctacgagctgtgcgccgtgcccagatag

SEQ ID NO: 20354 - DNA, 1224 bp, Artificial Sequence
  Description of Artificial Sequence: Synthetic coding sequence
atggtgaccagaggcgaggacaccgccgacagaccccccgcccccatctaccaggtgctgggcttcggccccagaagccagggcgtgttcctgagcagatacggccccgcctggagagagcagagaagattcagcgtgagcaccctgagaaacctgggcctgggcaagaagagcctggagcagtgggtgaccgaggaggccgcctgcctgtgcgccgccttcgccgaccaggccggcagacccttcagacccaacggcctgctggacaaggccgtgagcaacgtgatcgccagcctgacctgcggcagaagattcgagtacgacgaccccagattcctgagactgctggacctggcccaggagggcctgaaggaggagagcggcttcctgagagaggtgctgaacgccgtgcccgtgctgctgcacatccccgccctggccggcaaggtgctgagattccagaaggccttcctgacccagctggacgagctgctgaccgagcacagaatgacctgggaccccgcccagccccccagagacctgaccgaggccttcctggccaagaaggagaaggccaagggcagccccgagagcagcttcaacgacgagaacctgagaatcgtggtgggcaacctgttcctggccggcatggtgaccaccctgaccaccctggcctggggcctgctgctgatgatcctgcacctggacgtgcagctgagagtgcagcaggagatcgacgacgtgatcggccaggtgagaagacccgagatgggcgaccaggcccacatgccctacaccaccgccgtgatccacgaggtgcagagattcggcgacatcatccccctgagcgtgacccacatgaccagccacgacatcgaggtgcagggcttcagaatccccaagggcaccaccctgatcaccaacctgagcagcgtgctgaaggacgaggccgtgtggaagaagcccttcagattccaccccgagcacttcctggacgcccagggccacttcgtgaagcccgaggccttcctgcccttcagcgccggcagaagagcctgcctgggcgagcccctggccagaatggagctgttcctgttcttcaccagcctgctgcagcacttcagcttcagcgtggccgccggccagcccagacccagccacagcagagtggtgagcttcctggtgacccccagcccctacgagctgtgcgccgtgcccagatag

SEQ ID NO: 20355 - DNA, 429 bp, Artificial Sequence
  Description of Artificial Sequence: Synthetic coding sequence
cagctgagaagaagattcggcgacgtgttcagcctgcagctggcctggacccccgtggtggtgcagtgggccggcggcagagccagaggcgacggcgaccccagaagaggccacggcagaccccccgcctgcgcccacctgcccggcgaccccctgcccgccagccccacccccagaacccccctgagcccccagagaagcctgggccagagcagagagcagagagacagactgccccacctgagagcccccctgagagtgagaagacccagcctgccccaggccgccggccccagcagcggcggcaccgagggcggcgtgggcctgcccgccagaggcgccgagtgctgccccagaccccccgcccaccccagcgccggctggcagggccccaccctgcccaagggcttccccgaccccgccggctag

SEQ ID NO: 20356 - DNA, 510 bp, Artificial Sequence
  Description of Artificial Sequence: Synthetic coding sequence
aagatccacgaggagatcaaccaggtgatcggcccccacagactgcccagagtggacgacagagtgaagatgccctacaccgacgtggtgatccacgagatccagagactggtggacatcgtgcccatgggcgtgccccacaacatcatccaggacacccagttcagaggctacctgctgcccaagggcaccgacgtgttccccctgctgggcagcgtgctgaaggaccccaagtacttcagataccccgacgccttctacccccagcacttcctggacgagcagggcagattcaagaagaacgaggccttcgtgcccttcagcagcggcaagagaatctgcctgggcgaggccatggccagaatggagctgttcctgtacttcaccagcaccctgcagaacttcagcctgtgcagcctggtgcccctggtggacatcgacatcacccccaagctgagcggcttcggcaacatcacccccacctacgagctgtgcctggtggccagatag

SEQ ID NO: 20357 - DNA, 1119 bp, Artificial Sequence
  Description of Artificial Sequence: Synthetic coding sequence
atgagaagcgtgctgagacagagaatcctgaagcccaaggacgtggccatctacagcggcgaggtgaaccaggtgatcgccgacctgatcaagagaatctacctgctgagaagccaggccgaggacggcgagaccgtgaccaacgtgaacgacctgttcttcaagtacagcatggagggcgtggccaccatcctgtacgagagcagactgggctgcctggagaacagcatcccccagctgaccgtggagtacatcgaggccctggagctgatgttcagcatgttcaagaccagcatgtacgccggcgccatccccagatggctgagacccttcatccccaagccctggagagagttctgcagaagctgggacggcctgttcaagttcagccagatccacgtggacaacaagctgagagacatccagtaccagatggacagaggcagaagagtgagcggcggcctgctgacctacctgttcctgagccaggccctgaccctgcaggagatctacgccaacgtgaccgagatgctgctggccggcgtggacaccaccagcttcaccctgagctggaccgtgtacctgctggccagacaccccgaggtgcagcagaccgtgtacagagagatcgtgaagaacctgggcgagagacacgtgcccaccgccgccgacgtgcccaaggtgcccctggtgagagccctgctgaaggagaccctgagactgttccccgtgctgcccggcaacggcagagtgacccaggaggacctggtgatcggcggctacctgatccccaagggcacccagctggccctgtgccactacgccaccagctaccaggacgagaacttccccagagccaaggagttcagacccgagagatggctgagaaagggcgacctggacagagtggacaacttcggcagcatccccttcggccacggcgtgagaagctgcatcggcagaagaatcgccgagctggagatccacctggtggtgatccagctgctgcagcacttcgagatcaagaccagcagccagaccaacgccgtgcacgccaagacccacggcctgctgacccccggcggccccatccacgtgagattcgtgaacagaaagtag

SEQ ID NO: 20358 - DNA, 1119 bp, Artificial Sequence; identical to SEQ ID NO: 20357
  Description of Artificial Sequence: Synthetic coding sequence

SEQ ID NO: 20359 - DNA, 357 bp, Artificial Sequence
  Description of Artificial Sequence: Synthetic coding sequence
atggtgacccccgccggctgcctgggcggcagaaaccagggccccagagagatccccggcaccgccttccccagaagcagcagagccggccagaccggccaggccgtgagcggcgcccaggtgagcagctggagagagagacagccctgcagcggcagcagaggccccctgcacatcctgggcaccgacggcaacgtggacaccaccggcaagctgggcctggtgcccaccccccccagaatccagaaggagaccaagcagggcgccctgtgcggcatgaagccccccttcctgcccgaggccctgctgatcgtgtggtggctgcccttcgtggccgtgagcccctgcctgttctag

SEQ ID NO: 20360 - DNA, 1194 bp, Artificial Sequence
  Description of Artificial Sequence: Synthetic coding sequence
atggaggaggacgacagctacgtgcccagcgacctgaccgccgaggagagacaggagctggagaacatcagaagaagaaagcaggagctgctggccgacatccagagactgaaggacgagatcgccgaggtggccaacgagatcgagaacctgggcagcaccgaggagagaaagaacatgcagagaaacaagcaggtggccatgggcagaaagaagttcaacatggaccccaagaagggcatccagttcctgatcgagaacgacctgctgaagaacacctgcgaggacatcgcccagttcctgtacaagggcgagggcctgaacaagaccgccatcggcgactacctgggcgagagagacgagttcaacatccaggtgctgcacgccttcgtggagctgcacgagttcaccgacctgaacctggtgcaggccctgagacagttcctgtggagcttcagactgcccggcgaggcccagaagatcgacagaatgatggaggccttcgcccagagatactgccagtgcaacaacggcgtgttccagagcaccgacacctgctacgtgctgagcttcgccatcatcatgctgaacaccagcctgcacaaccccaacgtgaaggacaagcccaccgtggagagattcatcgccatgaacagaggcatcaacgacggcggcgacctgcccgaggagctgctgagaaacctgtacgagagcatcaagaacgagcccttcaagatccccgaggacgacggcaacgacctgacccacaccttcttcaaccccgacagagagggctggctgctgaagctgggcggcagagtgaagacctggaagagaagatggttcatcctgaccgacaactgcctgtactacttcgagtacaccaccgacaaggagcccagaggcatcatccccctggagaacctgagcatcagagaggtggaggacagcaagaagcccaactgcttcgagctgtacatccccgacaacaaggaccaggtgatcaaggcctgcaagaccgaggccgacggcagagtggtggagggcaaccacaccgtgtacagaatcagcgcccccacccccgaggagaaggaggagtggatcaagtgcatcaaggccgccatcagcagagaccccttctacgagatgctggccgccagaaagaagaaggtgagcagcaccaagagacactag

SEQ ID NO: 20361 - DNA, 465 bp, Artificial Sequence
  Description of Artificial Sequence: Synthetic coding sequence
atggacctgtgccaccccgagcccgccgagctgagcagcggcgagaccgaggagctgcagagaatcaagtggcacagaaagcagctgctggaggacatccagaagctgaaggacgagatcgccgacgtgttcgcccagatcgactgcttcgagagcgccgaggagagcagaatggcccagaaggagaaggagctgtgcatcggcagaaagaagttcaacatggaccccgccaagggcatccagtacttcatcgagcacaagctgctgacccccgacgtgcaggacatcgccagattcctgtacaagggcgagggcctgaacaagaccgccatcggcacctacctgggcgagagagaccccatcaacctgcaggtgctgcaggccttcgtggactgccacgagttcgccaacctgaacctggtgcaggccctgagagtggtgaagaccaagtgggagagcgtgtag

SEQ ID NO: 20362 - DNA, 777 bp, Artificial Sequence
  Description of Artificial Sequence: Synthetic coding sequence
atggccgagtacagctacgtgaagagcaccaagctggtgctgaagggcaccaagaccaagagcaagaagaagaagagcaaggacaagaagagaaagagagaggaggacgaggagacccagctggacatcgtgggcatctggtggaccgtgaccaacttcggcgagatcagcggcaccatcgccatcgagatggacaagggcacctacatccacgccctggacaacggcctgttcaccctgggcgccccccacaaggaggtggacgagggccccagcccccccgagcagttcaccgccgtgaagctgagcgacagcagaatcgccctgaagagcggctacggcaagtacctgggcatcaacagcgacggcctggtggtgggcagaagcgacgccatcggccccagagagcagtgggagcccgtgttccagaacggcaagatggccctgctggccagcaacagctgcttcatcagatgcaacgaggccggcgacatcgaggccaagagcaagaccgccggcgaggaggagatgatcaagatcagaagctgcgccgagagagagaccaagaagaaggacgacatccccgaggaggacaagggcaacgtgaagcagtgcgagatcaactacgtgaagaagttccagagcttccaggaccacaagctgaagatcagcaaggaggacagcaagatcctgaagaaggccagaaaggacggcttcctgcacgagaccctgctggacagaagagccaagctgaaggccgacagatactgcaagtag

SEQ ID NO: 20363 - DNA, 1179 bp, Artificial Sequence
  Description of Artificial Sequence: Synthetic coding sequence
atgaaccccagaggcaacagaaagaccaccaaggagggcagcaacgacctgaagttccagaacttcagcctgcccaagaacagaagctggcccagaatcaacagcgccaccggccagtaccagagaatgaacaagcccctgctggactgggagagaaacttcgccgccgtgctggacggcgccaagggccacagcgacgacgactacgacgaccccgagctgagaatggaggagacctggcagagcatcaagatcctgcccgccagacccatcaaggagagcgagtacgccgacacccactacttcaaggtggccatggacacccccctgcccctggacaccagaaccagcatcagcatcggccagcccacctggaacacccagaccagactggagagagtggacaagcccatcagcaaggacgtgagaagccagaacatcagaccccccctgagccagagacacaccttccccgaggtgcagagaatgcccagccagatcagcctgagagacctgagcgagagcctggaggccaagaaggtgccccacaaccagagaaagcccgagagcacccacctgctggagaaccagaacacccaggagatccccctggccatcagcagcagcagcttcaccaccagcaaccacagcgtgcagaacagagaccacagaggcggcatgcagccctgcagcccccagagatgccagccccccgccagctgcagcccccacgagaacatcctgccctacaagtacaccagctggagaccccccttccccaagagaagcgacagaaaggacgtgcagcacaacgagtggtacatcggcgagtacagcagacaggccgtggaggaggccttcatgaaggagaacaaggacggcagcttcctggtgagagactgcagcaccaagagcaaggaggagccctacgtgctggccgtgttctacgagaacaaggtgtacaacgtgaagatcagattcctggagagaaaccagcagttcgccctgggcaccggcctgagaggcgacgagaagttcgacagcgtggaggacatcatcgagcactacaagaacttccccatcatcctgatcgacggcaaggacaagaccggcgtgcacagaaagcagtgccacctgacccagcccctgcccctgaccagacacctgctgcccctgtag

SEQ ID NO: 20364 - DNA, 510 bp, Artificial Sequence
  Description of Artificial Sequence: Synthetic coding sequence
atgaacaagcccctgctggactgggagagaaacttcgccgccgtgctggacggcgccaagggccacagcgacgacgactacgacgaccccgagctgagaatggaggagacctggcagagcatcaagatcctgcccgccagacccatcaaggagagcgagtacgccgacacccactacttcaaggtggccatggacacccccctgcccctggacaccagaaccagcatcagcatcggccagcccacctggaacacccagaccagactggagagagtggacaagcccatcagcaaggacgtgagaagccagaacatcaagggcgacgccagcgtgagaaagaacaagatccccctgcccccccccagacccctgatcaccctgcccaagaagtaccagcccctgccccccgagcccgagagcagcagaccccccctgagccagagacacaccttccccgaggtgcagagaatgcccagccagatcagcctgagagacctgagcgagccctag

SEQ ID NO: 20365 - DNA, 510 bp, Artificial Sequence; identical to SEQ ID NO: 20364
  Description of Artificial Sequence: Synthetic coding sequence

SEQ ID NO: 20366 - DNA, 1695 bp, Artificial Sequence
  Description of Artificial Sequence: Synthetic coding sequence
atgcccgagtgcctgtggacccagggcgtgctgcaggaggtgctgaacagctacttctgcggcagcatcatcctgagcaccctgccctgggaggtgcccggcggccacgccagcagaatctgcctgctgctgctggccaccggcgagaacaagcaggtggagtgctaccagctgagccccggcctgagcagcctgcccgacttccaggacagcgaggagaccgtgaccagcagaatgctgttccccaccagcgcccaggagagcagcagaggcctgcccgacgccaacgacctgtgcctgggcctgcagagcctgagcctgaccggctgggacagaccctggagcacccaggacagcgacagcagcgcccagagcagcacccacagcgtgctgagcatgctgcacaaccccctgggcaacgtgctgggcaagccccccctgagcttcctgcccctggaccccctgggcagcgacctggtggacaagttccccgcccccagcgtgagaggcagcagactggacaccagacccatcctggacagcagaagcagcagccccagcgacagcgacaccagcggcttcagcagcggcagcgaccacctgagcgacctgatcagcagcctgagaatcagcccccccctgcccttcctgagcctgagcggcggcggccccagagaccccctgaagatgggcgtgggcagcagaatggaccaggagcaggccgccctggccgccgtgacccccagccccaccagcgccagcaagagatggcccggcgccagcgtgtggcccagctgggacctgctggaggcccccaaggaccccttcagcatcgagagagaggccagactgcacagacaggccgccgccgtgaacgaggccacctgcacctggagcggccagctgccccccagaaactacaagaaccccatctacagctgcaaggtgttcctgggcggcgtgccctgggacatcaccgaggccggcctggtgaacaccttcagagtgttcggcagcctgagcgtggagtggcccggcaaggacggcaagcaccccagatgcccccccaagggctacgtgtacctggtgttcgagctggagaagagcgtgagaagcctgctgcaggcctgcagccacgaccccctgagccccgacggcctgagcgagtactacttcaagatgagcagcagaagaatgagatgcaaggaggtgcaggtgatcccctgggtgctggccgacagcaacttcgtgagaagccccagccagagactggaccccagcagaaccgtgttcgtgggcgccctgcacggcatgctgaacgccgaggccctggccgccatcctgaacgacctgttcggcggcgtggtgtacgccggcatcgacaccgacaagcacaagtaccccatcggcagcggcagagtgaccttcaacaaccagagaagctacctgaaggccgtgagcgccgccttcgtggagatcaagaccaccaagttcaccaagaaggtgcagatcgacccctacctggaggacagcctgtgccacatctgcagcagccagcccggccccttcttctgcagagaccaggtgtgcttcaagtacttctgcagaagctgctggcactggagacacagcatggagggcctgagacaccacagccccctgatgagaaaccagaagaacagagacagcagctag

SEQ ID NO: 20367 - DNA, 1476 bp, Artificial Sequence
  Description of Artificial Sequence: Synthetic coding sequence
atgctgttccccaccagcgcccaggagagcagcagaggcctgcccgacgccaacgacctgtgcctgggcctgcagagcctgagcctgaccggctgggacagaccctggagcacccaggacagcgacagcagcgcccagagcagcacccacagcgtgctgagcatgctgcacaaccccctgggcaacgtgctgggcaagccccccctgagcttcctgcccctggaccccctgggcagcgacctggtggacaagttccccgcccccagcgtgagaggcagcagactggacaccagacccatcctggacagcagaagcagcagccccagcgacagcgacaccagcggcttcagcagcggcagcgaccacctgagcgacctgatcagcagcctgagaatcagcccccccctgcccttcctgagcctgagcggcggcggccccagagaccccctgaagatgggcgtgggcagcagaatggaccaggagcaggccgccctggccgccgtgacccccagccccaccagcgccagcaagagatggcccggcgccagcgtgtggcccagctgggacctgctggaggcccccaaggaccccttcagcatcgagagagaggccagactgcacagacaggccgccgccgtgaacgaggccacctgcacctggagcggccagctgccccccagaaactacaagaaccccatctacagctgcaaggtgttcctgggcggcgtgccctgggacatcaccgaggccggcctggtgaacaccttcagagtgttcggcagcctgagcgtggagtggcccggcaaggacggcaagcaccccagatgcccccccaagggcaacatgcccaagggctacgtgtacctggtgttcgagctggagaagagcgtgagaagcctgctgcaggcctgcagccacgaccccctgagccccgacggcctgagcgagtactacttcaagatgagcagcagaagaatgagatgcaaggaggtgcaggtgatcccctgggtgctggccgacagcaacttcgtgagaagccccagccagagactggaccccagcagaaccgtgttcgtgggcgccctgcacggcatgctgaacgccgaggccctggccgccatcctgaacgacctgttcggcggcgtggtgtacgccggcatcgacaccgacaagcacaagtaccccatcggcagcggcagagtgaccttcaacaaccagagaagctacctgaaggccgtgagcgccgccttcgtggagatcaagaccaccaagttcaccaagaaggtgcagatcgacccctacctggaggacagcctgtgccacatctgcagcagccagcccggccccttcttctgcagagaccaggtgtgcttcaagtacttctgcagaagctgctggcactggagacacagcatggagggcctgagacaccacagccccctgatgagaaaccagaagaacagagacagcagctag

SEQ ID NO: 20368 - DNA, 1008 bp, Artificial Sequence
  Description of Artificial Sequence: Synthetic coding sequence
atgggcgtgggcagcagaatggaccaggagcaggccgccctggccgccgtgacccccagccccaccagcgccagcaagagatggcccggcgccagcgtgtggcccagctgggacctgctggaggcccccaaggaccccttcagcatcgagagagaggccagactgcacagacaggccgccgccgtgaacgaggccacctgcacctggagcggccagctgccccccagaaactacaagaaccccatctacagctgcaaggtgttcctgggcggcgtgccctgggacatcaccgaggccggcctggtgaacaccttcagagtgttcggcagcctgagcgtggagtggcccggcaaggacggcaagcaccccagatgcccccccaagggctacgtgtacctggtgttcgagctggagaagagcgtgagaagcctgctgcaggcctgcagccacgaccccctgagccccgacggcctgagcgagtactacttcaagatgagcagcagaagaatgagatgcaaggaggtgcaggtgatcccctgggtgctggccgacagcaacttcgtgagaagccccagccagagactggaccccagcagaaccgtgttcgtgggcgccctgcacggcatgctgaacgccgaggccctggccgccatcctgaacgacctgttcggcggcgtggtgtacgccggcatcgacaccgacaagcacaagtaccccatcggcagcggcagagtgaccttcaacaaccagagaagctacctgaaggccgtgagcgccgccttcgtggagatcaagaccaccaagttcaccaagaaggtgcagatcgacccctacctggaggacagcctgtgccacatctgcagcagccagcccggccccttcttctgcagagaccaggtgtgcttcaagtacttctgcagaagctgctggcactggagacacagcatggagggcctgagacaccacagccccctgatgagaaaccagaagaacagagacagcagctag

SEQ ID NO: 20369 - DNA, 1686 bp, Artificial Sequence
  Description of Artificial Sequence: Synthetic coding sequence
atgagcatgcccctggaggaggaggccggcagaatcaaggactgctgggacaaccaggaggcccccgccctgagcacctgcagcaacgccaacatcttcagaagaatcaacgccatcctggacaacagcctggacttcagcagagtgtgcaccacccccatcaacagaggcatccacgaccacctgcccgacttccaggacagcgaggagaccgtgaccagcagaatgctgttccccaccagcgcccaggagagcagcagaggcctgcccgacgccaacgacctgtgcctgggcctgcagagcctgagcctgaccggctgggacagaccctggagcacccaggacagcgacagcagcgcccagagcagcacccacagcgtgctgagcatgctgcacaaccccctgggcaacgtgctgggcaagccccccctgagcttcctgcccctggaccccctgggcagcgacctggtggacaagttccccgcccccagcgtgagaggcagcagactggacaccagacccatcctggacagcagaagcagcagccccagcgacagcgacaccagcggcttcagcagcggcagcgaccacctgagcgacctgatcagcagcctgagaatcagcccccccctgcccttcctgagcctgagcggcggcggccccagagaccccctgaagatgggcgtgggcagcagaatggaccaggagcaggccgccctggccgccgtgacccccagccccaccagcgccagcaagagatggcccggcgccagcgtgtggcccagctgggacctgctggaggcccccaaggaccccttcagcatcgagagagaggccagactgcacagacaggccgccgccgtgaacgaggccacctgcacctggagcggccagctgccccccagaaactacaagaaccccatctacagctgcaaggtgttcctgggcggcgtgccctgggacatcaccgaggccggcctggtgaacaccttcagagtgttcggcagcctgagcgtggagtggcccggcaaggacggcaagcaccccagatgcccccccaagggctacgtgtacctggtgttcgagctggagaagagcgtgagaagcctgctgcaggcctgcagccacgaccccctgagccccgacggcctgagcgagtactacttcaagatgagcagcagaagaatgagatgcaaggaggtgcaggtgatcccctgggtgctggccgacagcaacttcgtgagaagccccagccagagactggaccccagcagaaccgtgttcgtgggcgccctgcacggcatgctgaacgccgaggccctggccgccatcctgaacgacctgttcggcggcgtggtgtacgccggcatcgacaccgacaagcacaagtaccccatcggcagcggcagagtgaccttcaacaaccagagaagctacctgaaggccgtgagcgccgccttcgtggagatcaagaccaccaagttcaccaagaaggtgcagatcgacccctacctggaggacagcctgtgccacatctgcagcagccagcccggccccttcttctgcagagaccaggtgtgcttcaagtacttctgcagaagctgctggcactggagacacagcatggagggcctgagacaccacagccccctgatgagaaaccagaagaacagagacagcagctag

SEQ ID NO: 20370 - DNA, 1461 bp, Artificial Sequence
  Description of Artificial Sequence: Synthetic coding sequence
atgctgttccccaccagcgcccaggagagcagcagaggcctgcccgacgccaacgacctgtgcctgggcctgcagagcctgagcctgaccggctgggacagaccctggagcacccaggacagcgacagcagcgcccagagcagcacccacagcgtgctgagcatgctgcacaaccccctgggcaacgtgctgggcaagccccccctgagcttcctgcccctggaccccctgggcagcgacctggtggacaagttccccgcccccagcgtgagaggcagcagactggacaccagacccatcctggacagcagaagcagcagccccagcgacagcgacaccagcggcttcagcagcggcagcgaccacctgagcgacctgatcagcagcctgagaatcagcccccccctgcccttcctgagcctgagcggcggcggccccagagaccccctgaagatgggcgtgggcagcagaatggaccaggagcaggccgccctggccgccgtgacccccagccccaccagcgccagcaagagatggcccggcgccagcgtgtggcccagctgggacctgctggaggcccccaaggaccccttcagcatcgagagagaggccagactgcacagacaggccgccgccgtgaacgaggccacctgcacctggagcggccagctgccccccagaaactacaagaaccccatctacagctgcaaggtgttcctgggcggcgtgccctgggacatcaccgaggccggcctggtgaacaccttcagagtgttcggcagcctgagcgtggagtggcccggcaaggacggcaagcaccccagatgcccccccaagggctacgtgtacctggtgttcgagctggagaagagcgtgagaagcctgctgcaggcctgcagccacgaccccctgagccccgacggcctgagcgagtactacttcaagatgagcagcagaagaatgagatgcaaggaggtgcaggtgatcccctgggtgctggccgacagcaacttcgtgagaagccccagccagagactggaccccagcagaaccgtgttcgtgggcgccctgcacggcatgctgaacgccgaggccctggccgccatcctgaacgacctgttcggcggcgtggtgtacgccggcatcgacaccgacaagcacaagtaccccatcggcagcggcagagtgaccttcaacaaccagagaagctacctgaaggccgtgagcgccgccttcgtggagatcaagaccaccaagttcaccaagaaggtgcagatcgacccctacctggaggacagcctgtgccacatctgcagcagccagcccggccccttcttctgcagagaccaggtgtgcttcaagtacttctgcagaagctgctggcactggagacacagcatggagggcctgagacaccacagccccctgatgagaaaccagaagaacagagacagcagctag

SEQ ID NO: 20371 - DNA, 1686 bp, Artificial Sequence
  Description of Artificial Sequence: Synthetic coding sequence
atggccttccccctggaggaggaggccggcagaatcaaggactgctgggacaaccaggaggcccccgccctgagcacctgcagcaacgccaacatcttcagaagaatcaacgccatcctggacaacagcctggacttcagcagagtgtgcaccacccccatcaacagaggcatccacgaccacctgcccgacttccaggacagcgaggagaccgtgaccagcagaatgctgttccccaccagcgcccaggagagcagcagaggcctgcccgacgccaacgacctgtgcctgggcctgcagagcctgagcctgaccggctgggacagaccctggagcacccaggacagcgacagcagcgcccagagcagcacccacagcgtgctgagcatgctgcacaaccccctgggcaacgtgctgggcaagccccccctgagcttcctgcccctggaccccctgggcagcgacctggtggacaagttccccgcccccagcgtgagaggcagcagactggacaccagacccatcctggacagcagaagcagcagccccagcgacagcgacaccagcggcttcagcagcggcagcgaccacctgagcgacctgatcagcagcctgagaatcagcccccccctgcccttcctgagcctgagcggcggcggccccagagaccccctgaagatgggcgtgggcagcagaatggaccaggagcaggccgccctggccgccgtgacccccagccccaccagcgccagcaagagatggcccggcgccagcgtgtggcccagctgggacctgctggaggcccccaaggaccccttcagcatcgagagagaggccagactgcacagacaggccgccgccgtgaacgaggccacctgcacctggagcggccagctgccccccagaaactacaagaaccccatctacagctgcaaggtgttcctgggcggcgtgccctgggacatcaccgaggccggcctggtgaacaccttcagagtgttcggcagcctgagcgtggagtggcccggcaaggacggcaagcaccccagatgcccccccaagggctacgtgtacctggtgttcgagctggagaagagcgtgagaagcctgctgcaggcctgcagccacgaccccctgagccccgacggcctgagcgagtactacttcaagatgagcagcagaagaatgagatgcaaggaggtgcaggtgatcccctgggtgctggccgacagcaacttcgtgagaagccccagccagagactggaccccagcagaaccgtgttcgtgggcgccctgcacggcatgctgaacgccgaggccctggccgccatcctgaacgacctgttcggcggcgtggtgtacgccggcatcgacaccgacaagcacaagtaccccatcggcagcggcagagtgaccttcaacaaccagagaagctacctgaaggccgtgagcgccgccttcgtggagatcaagaccaccaagttcaccaagaaggtgcagatcgacccctacctggaggacagcctgtgccacatctgcagcagccagcccggccccttcttctgcagagaccaggtgtgcttcaagtacttctgcagaagctgctggcactggagacacagcatggagggcctgagacaccacagccccctgatgagaaaccagaagaacagagacagcagctag

SEQ ID NO: 20372 - DNA, 1686 bp, Artificial Sequence; identical to SEQ ID NO: 20371
  Description of Artificial Sequence: Synthetic coding sequence

SEQ ID NO: 20373 - DNA, 1131 bp, Artificial Sequence
  Description of Artificial Sequence: Synthetic coding sequence
atgctgaccttcctgcagcagctgagagtggactggcccgccgccagcgagagagccagcagccacaccctgagaagccacgccctggaggagctgaccagcgccaacgacggcagaaccctgagccccggcatcctgggcagactgtgcctgaaggagctggtggaggagcagggcagaaccgccggctacgaccccaacctggacaactgcctggtgaccgaggacctgctgagcgtgctggccgagctgcaggaggccctgtggcactggcccgaggacagccaccccggcctggccggcgccagcgacaccggcaccggcggctgcctggtggtgcacgtggtgagctgcgaggaggagttccagcagcagaagctggacctgctgtggcagaagctggtggacaaggcccccctgagacagaagcacctgatctgcggccccgtgaaggtggccggcgcccccggcaccctgatgaccgcccccgagtactacgagttcagacacacccaggtgtgcaaggccagcgccctgaagcacggcggcgacctggcccaggaccccgcctggaccgagatcttcggcgtgctgagcgtggccaccatcaagttcgagatgctgagcaccgccccccagagccagctgttcctggccctggccgacagcagcatcagcaccaagggcaccaagagcggcaccttcgtgatgtacaactgcgccagactggccaccctgttcgagagctacaagtgcagcatggagcagggcctgtaccccaccttcccccccgtgagcagcctggacttcagcctgctgcacgacgagggcgagtggctgctgctgttcaacagcatcctgcccttccccgacctgctgagcagaaccgccgtgctggactgcaccgcccccggcctgcacatcgccgtgagaaccgagatgatctgcaagttcctggtgcagctgagcatggacttcagcagctactacaacagagtgcacatcctgggcgagcccagaccccacctgttcggccagatgttcgtgagactgcagctgctgagagccgtgagagaggtgctgcacaccggcctggccatgctgggcctgccccccctgagccacatctag

SEQ ID NO: 20374 - DNA, 1551 bp, Artificial Sequence
  Description of Artificial Sequence: Synthetic coding sequence
atggccaccagaagactgggcgtgggcgagaccctgggcgccctgaacgccgccctgggccccggcggccccgtgtggatcaaggagaccagaaccagacacctgagaagcagagacttcctggccccccacagagccctgcaggccagattcgacgacggccaggtgcccgagcacctgctgcacgccctggcctgcctgcagggccccggcgtggcccccgtgctgagatgcgcccccacccccgccggcctgagcctgcagctgcagagaagcgccgtgttcgagagagtgctgagcgccgtggccgcctacgccacccccgccagccccgccagcctgggccagagagtgctgctgcactgccccgccctgagaagcagcccctgcgccctgagactgagccagctgagaaccgtgctggtggccgaccacctggccagagccctgagagcccacggcgtgtgcgtgagactggtgcccgccgtgagagacccccacatgctgaccttcctgcagcagctgagagtggactggcccgccgccagcgagagagccagcagccacaccctgagaagccacgccctggaggagctgaccagcgccaacgacggcagaaccctgagccccggcatcctgggcagactgtgcctgaaggagctggtggaggagcagggcagaaccgccggctacgaccccaacctggacaactgcctggtgaccgaggacctgctgagcgtgctggccgagctgcaggaggccctgtggcactggcccgaggacagccaccccggcctggccggcgccagcgacaccggcaccggcggctgcctggtggtgcacgtggtgagctgcgaggaggagttccagcagcagaagctggacctgctgtggcagaagctggtggacaaggcccccctgagacagaagcacctgatctgcggccccgtgaaggtggccggcgcccccggcaccctgatgaccgcccccgagtactacgagttcagacacacccaggtgtgcaaggccagcgccctgaagcacggcggcgacctggcccaggaccccgcctggaccgagatcttcggcgtgctgagcgtggccaccatcaagttcgagatgctgagcaccgccccccagagccagctgttcctggccctggccgacagcagcatcagcaccaagggcaccaagagcggcaccttcgtgatgtacaactgcgccagactggccaccctgttcgagagctacaagtgcagcatggagcagggcctgtaccccaccttcccccccgtgagcagcctggacttcagcctgctgcacgacgagtacccccccctgagcggcagcgccgagcccgacagcagcgccggcctgcacagccccggcgccccccactgctgcacccacagagacgacatgcaggtgcccggcaccgcccagcacggcttccagctgctgctgcagcccggcacccaccccggcggcgccagcaccacccccctgtggagcgacgtgagaccccccgccgccagcgagagctgcgcctag

SEQ ID NO: 20375 - DNA, 507 bp, Artificial Sequence
  Description of Artificial Sequence: Synthetic coding sequence
atgaacagcaagggccagtaccccacccagcccacctaccccgtgcagccccccggcaaccccgtgtacccccagaccctgcacctgccccaggcccccccctacaccgacgccccccccgcctacagcgagctgtacagacccagcttcgtgcaccccggcgccgccaccgtgcccaccatgagcgccgccttccccggcgccagcctgtacctgcccatggcccagagcgtggccgtgggccccctgggcagcaccatccccatggcctactaccccgtgggccccatctacccccccggcagcaccgtgctggtggagggcggctacgacgccggcgccagattcggcgccggcgccaccgccggcaacatccccccccccccccccggctgcccccccaacgccgcccagctggccgtgatgcagggcgccaacgtgctggtgacccagagaaagggcaacttcttcatgggcggcagcgacggcggctacaccatctggtag

SEQ ID NO: 20376 - DNA, 462 bp, Artificial Sequence
  Description of Artificial Sequence: Synthetic coding sequence
atgaacagcaagggccagtaccccacccagcccacctaccccgtgcagccccccggcaaccccgtgtacccccagaccctgcacctgccccaggcccccccctacaccgacgccccccccgcctacagcgagctgtacagacccagcttcgtgcaccccggcgccgccaccgtgcccaccatgagcgccgccttccccggcgccagcctgtacctgcccatggcccagagcgtggccgtgggccccctgggcagcaccatccccatggcctactaccccgtgggccccatctacccccccggcagcaccgtgctggtggagggcggctacgacgccggcgccagattcggcgccggcgccaccgccggcaacatccccgtgaaggaggaccaggaccacgacagagagcagggcgaggaggacaacggcgacaacaacctggagagaagaggcaagatgtag

SEQ ID NO: 20377 - DNA, 261 bp, Artificial Sequence
  Description of Artificial Sequence: Synthetic coding sequence
atgaacagcaagggccagtaccccacccagcccacctaccccgtgcagccccccggcaaccccgtgtacccccagaccctgcacctgccccaggcccccccctacaccgacgccccccccgcctacagcgagccccccccccccggctgcccccccaacgccgcccagctggccgtgatgcagggcgccaacgtgctggtgacccagagaaagggcaacttcttcatgggcggcagcgacggcggctacaccatctggtag

SEQ ID NO: 20378 - DNA, 441 bp, Artificial Sequence
  Description of Artificial Sequence: Synthetic coding sequence
atgaacagcaagggccagtaccccacccagcccacctaccccgtgcagccccccggcaaccccgtgtacccccagaccctgcacctgccccaggcccccccctacaccgacgccccccccgcctacagcgagctgtacagacccagcttcgtgcaccccggcgccgccaccgtgcccaccatgagcgccgccatccccatggcctactaccccgtgggccccatctacccccccggcagcaccgtgctggtggagggcggctacgacgccggcgccagattcggcgccggcgccaccgccggcaacatccccccccccccccccggctgcccccccaacgccgcccagctggccgtgatgcagggcgccaacgtgctggtgacccagagaaagggcaacttcttcatgggcggcagcgacggcggctacaccatctggtag

SEQ ID NO: 20379 - DNA, 624 bp, Artificial Sequence
  Description of Artificial Sequence: Synthetic coding sequence
atgaacagcaagggccagtaccccacccagcccacctaccccgtgcagccccccggcaaccccgtgtacccccagaccctgcacctgccccaggcccccccctacaccgacgccccccccgcctacagcgagctgtacagacccagcttcgtgcaccccggcgccgccaccgtgcccaccatgagcgccgccttccccggcgccagcctgtacctgcccatggcccagagcgtggccgtgggccccctgggcagcaccatccccatggcctactaccccgtgggccccatctacccccccgccagcaccagctggatgcccagccagtgctgcagcgcctgcagccacgccggcagccagagacccagaaacagcgccgagggcgagctgctgcacggctggttcagatggtggctgcaccacctggtgagaaaccagggccacctgtgcgccggcaaggacatcacctacctgcagcacttcagccagtgcaactgcttcagccacatcaacctgaagctgcagttcagacacatgctgctgggctgcctgagcggcgcccagaccttcagacacttcagcaacctgatcagaaaccacgtgatggtggccgtgcccccctag

SEQ ID NO: 20380 - DNA, 411 bp, Artificial Sequence
  Description of Artificial Sequence: Synthetic coding sequence
atgaacagcaagggccagtaccccacccagcccacctaccccgtgcagccccccggcaaccccgtgtacccccagaccctgcacctgccccaggcccccccctacaccgacgccccccccgcctacagcgagagcgtggccgtgggccccctgggcagcaccatccccatggcctactaccccgtgggccccatctacccccccggcagcaccgtgctggtggagggcggctacgacgccggcgccagattcggcgccggcgccaccgccggcaacatccccccccccccccccggctgcccccccaacgccgcccagctggccgtgatgcagggcgccaacgtgctggtgacccagagaaagggcaacttcttcatgggcggcagcgacggcggctacaccatctggtag

SEQ ID NO: 20381 - DNA, 2304 bp, Artificial Sequence
  Description of Artificial Sequence: Synthetic coding sequence
atgcagagccccgccgccaccgccgagggcctgagcggccccctgttcggcgcctacaccttccccaccttcaagttccagcccagacacgacagcatggactggagaagaatcagcaccctggacgtggacagagtggccagagagctggacgtggccaccctgcaggagaacatcgccggcatcaccttctgcaacctggacagagaggtgtgcagcagatgcggccagcccgtggaccccgccctgctgaaggtgctgagactggcccagctgatcatcgagtacctgctgcactgccaggactgcctgagcgccagcgtggcccagctggaggccagactgcagaccagcctgggccagcagcagagaggccagcaggagctgggcagacaggccgacgagctgaagggcgtgagagaggagagcagaagaagaagaaagatgatcagcaccctgcagcagctgctgatgcagaccggcacccacagctaccacacctgccacctgtgcgacaagaccttcatgaacgccaccttcctgagaggccacatccagagaagacacgccggcgtggccgagggcggcaagcagaagaagcaggagcagcccgtggaggaggtgctggaggagctgagagccaagctgaagtggacccagggcgagctggaggcccagagagaggccgagagacagagacagctgcaggaggccgagctgatccaccagagagagatcgaggccaagaaggagttcgacaagtggaaggagcaggagtggaccaagctgtacggcgagatcgacaagctgaagaagctgttctgggacgagttcaagaacgtggccaagcagaacagcaccctggaggagaagctgagagccctgcagagccacagcgtgatggagagcaagctgggcagcctgagagacgaggagagcgaggagtggctgagacaggccagagagctgcaggccctgagagagaagaccgagatccagaagaccgagtggaagagaaaggtgaaggagctgcacgaggagcacatggccgagaagaaggagctgcaggaggagaaccagagactgcaggccagcctgagccaggaccagaagaaggccgccgcccagagccagtgccagatcagcaccctgagagcccagctgcaggagcaggccagaatcatcgccagccaggaggagatgatccagagcctgagcctgagaaaggtggagggcatccacaaggtgcccaaggccgtggacaccgaggaggacagccccgaggaggagatggaggacagccaggacgagcagcacaaggtgctggccgccctgagaagaaaccccaccctgctgaagcacttcagacccatcctggaggacaccctggaggagaagctggagagcatgggcatcagaaaggacgccaagggcatcagcatccagaccctgagacacctggagagcctgctgagagtgcagagagagcagaaggccagaaagttcagcgagttcctgagcctgagaggcaagctggtgaaggaggtgaccagcagagccaaggagagacaggagaacggcgccgtggtgagccagcccgacggccagcccagcgtgaagagccagcagagcaccctggtgaccagagaggcccagcccaagaccagaaccctgcaggtggccctgcccagcacccccgccgagccccccccccccaccagacagagccacggcagccacggcagcagcctgacccaggtgagcgcccccgcccccagacccggcctgcacggccccagcagcaccccccccagcagcggccccggcatgagcaccccccccttcagcagcgaggaggacagcgagggcgacagagtgcagagagtgagcctgcagccccccaaggtgcccagcagaatggtgcccagacccaaggacgactgggactggagcgacaccgagaccagcgaggagaacgcccagccccccggccagggcagcggcaccctggtgcagagcatggtgaagaacctggagaagcagctggaggcccccgccaagaagcccgccggcggcgtgagcctgttcttcatgcccaacgccggcccccagagagccgccacccccggcagaaagccccagctgagcgaggacgagagcgacctggagatcagcagcctggaggacctgcccctggacctggaccagagagagaagcccaagcccctgagcagaagcaagctgcccgagaagttcggcaccggcccccagagcagcggccagcccagagtgcccgcctggtag

SEQ ID NO: 20382 - DNA, 204 bp, Artificial Sequence
  Description of Artificial Sequence: Synthetic coding sequence
atgcagagccccgccgccaccgccgagggcctgagcggccccctgttcggcgcctacaccttccccaccttcaagttccagcccagacacgacagcatggactggagaagaatcagcaccctggacgtggacagagtggccagagagctggacgtggccaccctgcaggagaacatcgccggcatcaccttctgcaacctgtag

SEQ ID NO: 20383 - DNA, 1620 bp, Artificial Sequence
  Description of Artificial Sequence: Synthetic coding sequence
atgcagagccccgccgccaccgccgagggcctgagcggccccctgttcggcgcctacaccttccccaccttcaagttccagcccagacacgacagcatggactggagaagaatcagcaccctggacgtggacagagtggccagagagctggacgtggccaccctgcaggagaacatcgccggcatcaccttctgcaacctggacagagaggtgtgcagcagatgcggccagcccgtggaccccgccctgctgaaggtgctgagactggcccagctgatcatcgagtacctgctgcactgccaggactgcctgagcgccagcgtggcccagctggaggccagactgcagaccagcctgggccagcagcagagaggccagcaggagctgggcagacaggccgacgagctgaagggcgtgagagaggagagcagaagaagaagaaagatgatcagcaccctgcagcagctgctgatgcagaccggcacccacagctaccacacctgccacctgtgcgacaagaccttcatgaacgccaccttcctgagaggccacatccagagaagacacgccggcgtggccgagggcggcaagcagaagaagcaggagcagcccgtggaggaggtgctggaggagctgagagccaagctgaagtggacccagggcgagctggaggcccagagagaggccgagagacagagacagctgcaggaggccgagctgatccaccagagagagatcgaggccaagaaggagttcgacaagtggaaggagcaggagtggaccaagctgtacggcgagatcgacaagctgaagaagctgttctgggacgagttcaagaacgtggccaagcagaacagcaccctggaggagaagctgagagccctgcagagccacagcgtgatggagagcaagctgggcagcctgagagacgaggagagcgaggagtggctgagacaggccagagagctgcaggccctgagagagaagaccgagatccagaagaccgagtggaagagaaaggtgaaggagctgcacgaggagcacatggccgagaagaaggagctgcaggaggagaaccagagactgcaggccagcctgagccaggaccagaagaaggccgccgcccagagccagtgccagatcagcaccctgagagcccagctgcaggagcaggccagaatcatcgccagccaggaggagatgatccagagcctgagcctgagaaaggtggagggcatccacaaggtgcccaaggccgtggacaccgaggaggacagccccgaggaggagatggaggacagccaggacgagcagcacaaggtgctggccgccctgagaagaaaccccaccctgctgaagcacttcagacccatcctggaggacaccctggaggagaagctggagagcatgggcatcagaaaggacgccaagggcatcagcatccagaccctgagacacctggagagcctgctgagagtgcagagagagcagaaggccagaaagttcagcgagttcctgagcctgagaggcaagctggtgaaggaggtgaccagcagagccaaggagagacaggagaacggcgccgtggtgagccagcccgacggccagcccagcggctag

SEQ ID NO: 20384 - DNA, 120 bp, Artificial Sequence
  Description of Artificial Sequence: Synthetic coding sequence
atgcagagccccgccgccaccgccgagggcctgagcggccccctgttcggcgcctacaccttccccaccttcaagttccagcccagacacgacagcatggactggagaagaatcagctag

SEQ ID NO: 20385 - DNA, 1620 bp, Artificial Sequence; identical to SEQ ID NO: 20383
  Description of Artificial Sequence: Synthetic coding sequence

SEQ ID NO: 20386 - DNA, 561 bp, Artificial Sequence
  Description of Artificial Sequence: Synthetic coding sequence
atgcacaagctgaagagcagccagaaggacaaggtgagacagttcatggcctgcacccaggccggcgagagaaccgccatctactgcctgacccagaacgagtggagactggacgaggccaccgacagcttcttccagaaccccgacagcctgcacagagagagcatgagaaacgccgtggacaagaagaagctggagagactgtacggcagatacaaggacccccaggacgagaacaagatcggcgtggacggcatccagcagttctgcgacgacctgagcctggaccccgccagcatcagcgtgctggtgatcgcctggaagttcagagccgccacccagtgcgagttcagcagaaaggagttcctggacggcatgaccgagctgggctgcgacagcatggagaagctgaaggccctgctgcccagactggagcaggagctgaaggacaccgccaagttcaaggacttctaccagttcaccttcaccttcgccaagaaccccggccagaagggcctgggcagcccccccttcctgaacgtgaaggccctgcaccactag

SEQ ID NO: 20387 - DNA, 780 bp, Artificial Sequence
  Description of Artificial Sequence: Synthetic coding sequence
atgcacaagctgaagagcagccagaaggacaaggtgagacagttcatggcctgcacccaggccggcgagagaaccgccatctactgcctgacccagaacgagtggagactggacgaggccaccgacagcttcttccagaaccccgacagcctgcacagagagagcatgagaaacgccgtggacaagaagaagctggagagactgtacggcagatacaaggacccccaggacgagaacaagatcggcgtggacggcatccagcagttctgcgacgacctgagcctggaccccgccagcatcagcgtgctggtgatcgcctggaagttcagagccgccacccagtgcgagttcagcagaaaggagttcctggacggcatgaccgagctgggctgcgacagcatggagaagctgaaggccctgctgcccagactggagcaggagctgaaggacaccgccaagttcaaggacttctaccagttcaccttcaccttcgccaagaaccccggccagaagggcctggacctggagatggccgtggcctactggaagctggtgctgagcggcagattcaagttcctggacctgtggaacaccttcctgatggagcaccacaagagaagcatccccagagacacctggaacctgctgctggacttcggcaacatgatcgccgacgacatgagcaactacgacgaggagggcgcctggcccgtgctgatcgacgacttcgtggagtacgccagacccgtggtgaccggcggcaagagaagcctgttctag

SEQ ID NO: 20388 - DNA, 714 bp, Artificial Sequence
  Description of Artificial Sequence: Synthetic coding sequence
atgcccgtgaagaagaagagaaagagccccggcgtggccgccgccgtggccgaggacggcggcctgaagaagtgcaagatcagcagctactgcagaagccagccccccgccagactgatcagcggcgaggagcacttcagcagcaagaagtgcctggcctggttctacgagtacgccggccccgacgaggtggtgggccccgagggcatggagaagttctgcgaggacatcggcgtggagcccgagaacatcatcatgctggtgctggcctggaagctggaggccgagagcatgggcttcttcaccaaggaggagtggctgaagggcatgaccagcctgcagtgcgactgcaccgagaagctgcagaacaagttcgacttcctgagaagccagctgaacgacatcagcagcttcaagaacatctacagatacgccttcgacttcgccagagacaaggaccagagaagcctggacatcgacaccgccaagagcatgctggccctgctgctgggcagaacctggcccctgttcagcgtgttctaccagtacctggagcagagcaagtacagagtgatgaacaaggaccagtggtacaacgtgctggagttcagcagaaccgtgcacgccgacctgagcaactacgacgaggacggcgcctggcccgtgctgctggacgagttcgtggagtggcagaaggtgagacagaccagctag

SEQ ID NO: 20389 - DNA, 1749 bp, Artificial Sequence
  Description of Artificial Sequence: Synthetic coding sequence
atggaggccctgagcagagccggccaggagatgagcctggccgccctgaagcagcacgacccctacatcaccagcatcgccgacctgaccggccaggtggccctgtacaccttctgccccaaggccaaccagtgggagaagaccgacatcgagggcaccctgttcgtgtacagaagaagcgccagcccctaccacggcttcaccatcgtgaacagactgaacatgcacaacctggtggagcccgtgaacaaggacctggagttccagctgcacgagcccttcctgctgtacagaaacgccagcctgagcatctacagcatctggttctacgacaagaacgactgccacagaatcgccaagctgatggccgacgtggtggaggaggagaccagaagaagccagcaggccgccagagacaagcagagccccagccaggccaacggctgcagcgaccacagacccatcgacatcctggagatgctgagcagagccaaggacgagtacgagagaaaccagatgggcgacagcaacatcagcagccccggcctgcagcccagcacccagctgagcaacctgggcagcaccgagaccctggaggagatgcccagcggcagccaggacaagagcgcccccagcggccacaagcacctgaccgtggaggagctgttcggcaccagcctgcccaaggagcagcccgccgtggtgggcctggacagcgaggagatggagagactgcccggcgacgccagccagaaggagcccaacagcttcctgcccttccccttcgagcagctgggcggcgccccccagagcgagaccctgggcgtgcccagcgccgcccaccacagcgtgcagcccgagatcaccacccccgtgctgatcacccccgccagcatcacccagagcaacgagaagcacgcccccacctacaccatccccctgagccccgtgctgagccccaccctgcccgccgaggcccccaccgcccaggtgccccccagcctgcccagaaacagcaccatgatgcaggccgtgaagaccacccccagacagagaagccccctgctgaaccagcccgtgcccgagctgagccacgccagcctgatcgccaaccagagccccttcagagcccccctgaacgtgaccaacaccgccggcaccagcctgcccagcgtggacctgctgcagaagctgagactgaccccccagcacgaccagatccagacccagcccctgggcaagggcgccatggtggccagcttcagccccgccgccggccagctggccacccccgagagcttcatcgagccccccagcaagaccgccgccgccagagtggccgccagcgccagcctgagcaacatggtgctggcccccctgcagagcatgcagcagaaccaggaccccgaggtgttcgtgcagcccaaggtgctgagcagcgccaagagagtggccggcgcccccctggtgaccgccaccaccaccgccgtgagcagcgtgctgctggcccccagcgtgttccagcagaccgtgaccagaagcagcgacctggagagaaaggccagcagccccagccccctgaccatcggcacccccgagagccagagaaagcccagcatcatcctgagcaagagccagctgcaggacaccctgatccacctgatcaagaacgacagcagcttcctgagcaccctgcacgaggtgtacctgcaggtgctgaccaagaacaaggacaaccacaacctgtag

SEQ ID NO: 20390 - DNA, 1569 bp, Artificial Sequence
  Description of Artificial Sequence: Synthetic coding sequence
atgttccccttcggcccccacagccccggcggcgacggcagcgccggcgccggcgccgaggagcccaccccccacgagggccaggccgccgccaccggcccccccagccccctgcaccccggcgccgacgccacccacccccccccccccgccagaagccccagaagacccggcgcccccagcctgagccccgcccccagaagcggcgagctgggcctgcccggcgcccccgagagcagcaccgccagcgcccccggcgagcccagcccccccagccccccctgcagaagacccggccccgactgcagagccaagagcagaggcagacacggcctgggcgccggcctgggcggccccggcgccagactgttcggctggctgaaggagagaagcctgggcagaggcctgttcgtggaccccgccagagacaacttcagaaccatgaccagcctgtacggcagcatccaccccgccgacagcgtgtacctgagcaccagaacccacggcgccgtgttcaacctggagtacagccccgacggcagcgtgctgaccgtggcctgcgagcagaccgaggtgctgctgttcgaccccatcagcagcaagcacatcaagaccctgagcgaggcccacgaggactgcgtgaacaacatcagattcctggacaacagactgttcgccacctgcagcgacgacaccaccatcgccctgtgggacctgagaaagctgaacaccaaggtgtgcaccctgcacggccacaccagctgggtgaagaacatcgagtacgacaccaacaccagactgctggtgaccagcggcttcgacggcaacgtgatcatctgggacaccaacagatacaccgaggacggctgcccccacaagaagttcttccacaccagattcctgatgagaatgagactgacccccgactgcagcaagatgctgatcagcaccagcagcggctacctgctgatcctgcacgacctggacctgaccaagagcctggaggtgggcagctaccccatcctgagagccagaagaaccaccagcagcagcggcgtgagccccagaaacagcctggaggtggtgacccccgaggtgctgggcgagagcgaccacggcaactgcatcaccagcctgcagctgcaccccaagggctgggccaccctgctgagatgcagcagcaacagcgacgacgaggagtgcacctgcgtgtacgagttccaggagggcgcccccgtgagacccgtgagccccagatgcagcctgagactgacccactacatcgaggaggccaacgtgggcagaggctacatcaaggagctgtgcttcagccccgacggcagaatgatcagcagcccccacggctacggcatcagactgctgggcttcgacaagcagtgcagcgagctggtggactgcctgcccaaggaggccagccccctgagagtgatcagaagcctgtacagccacaacgacgtggtgctgaccaccaagttcagccccacccactgccagatcgccagcggctgcctgagcggcagagtgagcctgtaccagcccaagttctag

SEQ ID NO: 20391 - DNA, 1680 bp, Artificial Sequence
  Description of Artificial Sequence: Synthetic coding sequence
atgttccccttcggcccccacagccccggcggcgacggcagcgccggcgccggcgccgaggagcccaccccccacgagggccaggccgccgccaccggcccccccagccccctgcaccccggcgccgacgccacccacccccccccccccgccagaagccccagaagacccggcgcccccagcctgagccccgcccccagaagcggcgagctgggcctgcccggcgcccccgagagcagcaccgccagcgcccccggcgagcccagcccccccagccccccctgcagaagacccggccccgactgcagagccaagagcagaggcagacacggcctgggcgccggcctgggcggccccggcgccagactgttcggctggctgaaggagagaagcctgggcagaggcctgttcgtggaccccgccagagacaacttcagaaccatgaccagcctgtacggcagcatccaccccgccgacagcgtgtacctgagcaccagaacccacggcgccgtgttcaacctggagtacagccccgacggcagcgtgctgaccgtggcctgcgagcagaccgaggtgctgctgttcgaccccatcagcagcaagcacatcaagaccctgagcgaggcccacgaggactgcgtgaacaacatcagattcctggacaacagactgttcgccacctgcagcgacgacaccaccatcgccctgtgggacctgagaaagctgaacaccaaggtgtgcaccctgcacggccacaccagctgggtgaagaacatcgagtacgacaccaacaccagactgctggtgaccagcggcttcgacggcaacgtgatcatctgggacaccaacagatacaccgaggacggctgcccccacaagaagttcttccacaccagattcctgatgagaatgagactgacccccgactgcagcaagatgctgatcagcaccagcagcggctacctgctgatcctgcacgacctggacctgaccaagagcctggaggtgggcagctaccccatcctgagagccagaagaaccaccagcagcagcgacctgaccaccagcagcagcagcagcggccccagagtgagcggcagcccctgccaccacagcgacagcaacagcagcgagaagcacatgagcagagccagccagagagagggcgtgagccccagaaacagcctggaggtggtgacccccgaggtgctgggcgagagcgaccacggcaactgcatcaccagcctgcagctgcaccccaagggctgggccaccctgctgagatgcagcagcaacagcgacgacgaggagtgcacctgcgtgtacgagttccaggagggcgcccccgtgagacccgtgagccccagatgcagcctgagactgacccactacatcgaggaggccaacgtgggcagaggctacatcaaggagctgtgcttcagccccgacggcagaatgatcagcagcccccacggctacggcatcagactgctgggcttcgacaagcagtgcagcgagctggtggactgcctgcccaaggaggccagccccctgagagtgatcagaagcctgtacagccacaacgacgtggtgctgaccaccaagttcagccccacccactgccagatcgccagcggctgcctgagcggcagagtgagcctgtaccagcccaagttctag

SEQ ID NO: 20392 - DNA, 1392 bp, Artificial Sequence
  Description of Artificial Sequence: Synthetic coding sequence
atggcccagcagcagaccggcagcagaaagagaaaggcccccgccgtggaggccgacgccgagagcagccccagccagggcctggccgccgccgacggcgagggccccctgctgctgaagagacagagaagacccgccacctacagaagcatggcccactacctgaaggtgagagaggtgggcggctggggccccgccagactgcagggcttcgacggcgagctgagaggctacgccgtgcagagactgcccgagctgctgaccgagagacagctggagctgggcaccgtgaacaaggtgttcgccagccagtggctgaacagcagacaggtggtgtgcggcaccaagtgcaacaccctgttcgtggtggacgtggagagcggccacatcgccagaatccccctgctgagagacagcgaggccagactggcccaggaccagcagggctgcggcatccacgccatcgagctgaaccccagcaagaccctgctggccaccggcggcgagaaccccaacagcctggccatctaccagctgcccagcctggaccccctgtgcctgggcgacagacacggccacaaggactggatcttcgccgtggcctggctgagcgacaccgtggccgtgagcggcagcagagacggcaccgtggccctgtggagaatggaccccgacaagttcgacgacaccgtggcctggcacagcgaggtgggcctgcccgtgtacgcccacatcagacccagagacgtggaggccatccccagagccatcatcaaccccagcaacagaaaggtgagagccctggcctgcggcggcaagaaccaggagctgggcgccgtgagcctggacggctacttccacctgtggaaggccggcagcgccctgagcagactgctgagcatcagactgccctacttcagagacaacgtgtgcctgacctactgcgacgacatgagcgtgtacgccgtgggcagccacagccacgtgagcttcctggacctgagacaggaccagcagaacatcagacccctgtgcagcagagagggcggcaccggcgtgagaagcctgagcttctacagacacatcatcaccgtgggcaccggccagggcagcctgctgttctacgacgtgagagcccagaagttcctggaggagagagccagcgccaccctggagagcagcagcggccccgccagaagaaagctgagactggcctgcggcagaggctggctgaaccacaacgacttctgggtgaactacttcggcggcatggaggtgttccccaacgccctgtacacccactgctacaactggcccgagatgaagctgttcgtggccggcggccccctgcccgccggcctgcacggcaactacgccggcctgtggagctag

SEQ ID NO: 20393 - DNA, 1392 bp, Artificial Sequence
  Description of Artificial Sequence: Synthetic coding sequence
atggcccagcagcagaccggcagcagaaagagaaaggcccccgccgtggaggccggcgccggcagcagcagcagccagggcctggccgccgccgacggcgagggccccctgctgcccaagaagcagaagagacccgccaccagaagaagactggtgcactacctgaagggcagagaggtgggcgccagaggccccgccggcctgcagggcttcgagggcgagctgagaggctacgccgtgcagagactgcccgagctgctgaccgagagacagctggacctgggcaccctgaacaaggtgttcgccagccagtggctgaacgccagacaggtggtgtgcggcaccaagtgcaacaccctgttcgtggtggacgtgcagagcggccacatcaccagaatccccctgatgagagacaaggaggccggcctggcccaggcccaccagggctgcggcatccacgccatcgagctgaaccccagcaagaccctgctggccaccggcggcgagaaccccaacagcctggccatctaccagctgcccaccctggaccccctgtgcctgggcgacagacacggccacaaggactggatcttcgccgtggcctggctgagcgacaccgtggccgtgagcggcagcagagacggcaccgtggccctgtggagaatggaccccgacatgttcaacggcagcatcgcctggcacagcgaggtgggcctgcccgtgtacgcccacatcagacccagagacgtggaggccatccccagagccagcaccaaccccagcaacagaaaggtgagagccctggccttcagcggcaagaaccaggagctgggcgccgtgagcctggacggctacttccacctgtggaaggccagaagcaccctgagcagactgctgagcatcagactgccctactgcagagagaacgtgtgcctgacctactgcgacgagctgagcctgtacgccgtgggcagccagagccacgtgagcttcctggaccccagacagagacagcagaacatcagacccctgtgcagcagagagggcggcaccggcgtgagaagcctgagcttctaccagcacatcatcaccgtgggcaccggccacggcagcctgctgttctacgacatcagagcccagaagttcctggaggagagagccagcagcagcctggacagcatgcccggccccgccggcagaaagctgaagctggcctgcggcagaggctggctgaaccaggacgacgtgtgggtgaactacttcggcggcatgggcgagttccccaacgccctgtacacccactgctacaactggcccgagatgaagctgttcgtggccggcggccccctgcccagcggcctgcacggcaactacgccggcctgtggagctag

SEQ ID NO: 20394 - DNA, 1392 bp, Artificial Sequence; identical to SEQ ID NO: 20393
  Description of Artificial Sequence: Synthetic coding sequence

SEQ ID NO: 20395 - DNA, 1803 bp, Artificial Sequence
  Description of Artificial Sequence: Synthetic coding sequence
atggcccccagcagcaagagcgagagaaacagcggcgccggcagcggcggcggcggccccggcggcgccggcggcaagagagccgccggcagaagaagagagcacgtgctgaagcagctggagagagtgaagatcagcggccagctgagccccagactgttcagaaagctgccccccagagtgtgcgtgagcctgaagaacatcgtggacgaggacttcctgtacgccggccacatcttcctgggcttcagcaagtgcggcagatacgtgctgagctacaccagcagcagcggcgacgacgacttcagcttctacatctaccacctgtactggtgggagttcaacgtgcacagcaagctgaagctggtgagacaggtgagactgttccaggacgaggagatctacagcgacctgtacctgaccgtgtgcgagtggcccagcgacgccagcaaggtgatcgtgttcggcttcaacaccagaagcgccaacggcatgctgatgaacatgatgatgatgagcgacgagaaccacagagacatctacgtgagcaccgtggccgtgcccccccccggcagatgcgccgcctgccaggacgccagcagagcccaccccggcgaccccaacgcccagtgcctgagacacggcttcatgctgcacaccaagtaccaggtggtgtaccccttccccaccttccagcccgccttccagctgaagaaggaccaggtggtgctgctgaacaccagctacagcctggtggcctgcgccgtgagcgtgcacagcgccggcgacagaagcttctgccagatcctgtacgaccacagcacctgccccctggcccccgccagcccccccgagccccagagccccgagctgccccccgccctgcccagcttctgccccgaggccgcccccgccagaagcagcggcagccccgagcccagccccgccatcgccaaggccaaggagttcgtggccgacatcttcagaagagccaaggaggccaagggcggcgtgcccgaggaggccagacccgccctgtgccccggccccagcggcagcagatgcagagcccacagcgagcccctggccctgtgcggcgagaccgcccccagagacagcccccccgccagcgaggcccccgccagcgagcccggctacgtgaactacaccaagctgtactacgtgctggagagcggcgagggcaccgagcccgaggacgagctggaggacgacaagatcagcctgcccttcgtggtgaccgacctgagaggcagaaacctgagacccatgagagagagaaccgccgtgcagggccagtacctgaccgtggagcagctgaccctggacttcgagtacgtgatcaacgaggtgatcagacacgacgccacctggggccaccagttctgcagcttcagcgactacgacatcgtgatcctggaggtgtgccccgagaccaaccaggtgctgatcaacatcggcctgctgctgctggccttccccagccccaccgaggagggccagctgagacccaagacctaccacaccagcctgaaggtggcctgggacctgaacaccggcatcttcgagaccgtgagcgtgggcgacctgaccgaggtgaagggccagaccagcggcagcgtgtggagcagctacagaaagagctgcgtggacatggtgatgaagtggctggtgcccgagagcagcggcagatacgtgaacagaatgaccaacgaggccctgcacaagggctgcagcctgaaggtgctggccgacagcgagagatacacctggatcgtgctgtag

SEQ ID NO: 20396 - DNA, 651 bp, Artificial Sequence
  Description of Artificial Sequence: Synthetic coding sequence
atgggccccagaaaccccagccccgaccacctgagcgagagcgagagcgaggaggaggagaacatcagctacctgaacgagagcagcggcgaggagtgggacagcagcgaggaggaggacagcatggtgcccaacctgagccccctggagagcctggcctggcaggtgaagtgcctgctgaagtacagcaccacctggaagcccctgaaccccaacagctggctgtaccacgccaagctgctggaccccagcacccccgtgcacatcctgagagagatcggcctgagactgagccactgcagccactgcgtgcccaagctggagcccatccccgagtggccccccctggccagctgcggcgtgccccccttccagaagcccctgaccagccccagcagactgagcagagaccacgccaccctgaacggcgccctgcagttcgccaccaagcagctgagcagaaccctgagcagagccacccccatccccgagtacctgaagcagatccccaacagctgcgtgagcggctgctgctgcggctggctgaccaagaccgtgaaggagaccaccagaaccgagcccatcaacaccacctacagctacaccgacttccagaaggccgtgaacaagctgctgaccgccagcctgtag

SEQ ID NO: 20397 - DNA, 651 bp, Artificial Sequence; identical to SEQ ID NO: 20396
  Description of Artificial Sequence: Synthetic coding sequence

SEQ ID NO: 20398 - DNA, 1488 bp, Artificial Sequence
  Description of Artificial Sequence: Synthetic coding sequence
atgaacaagagcagatggcagagcagaagaagacacggcagaagaagccaccagcagaacccctggttcagactgagagacagcgaggacagaagcgacagcagagccgcccagcccgcccacgacagcggccacggcgacgacgagagccccagcaccagcagcggcaccgccggcaccagcagcgtgcccgagctgcccggcttctacttcgaccccgagaagaagagatacttcagactgctgcccggccacaacaactgcaaccccctgaccaaggagagcatcagacagaaggagatggagagcaagagactgagactgctgcaggaggaggacagaagaaagaagatcgccagaatgggcttcaacgccagcagcatgctgagaaagagccagctgggcttcctgaacgtgaccaactactgccacctggcccacgagctgagactgagctgcatggagagaaagaaggtgcagatcagaagcatggaccccagcgccctggccagcgacagattcaacctgatcctggccgacaccaacagcgacagactgttcaccgtgaacgacgtgaaggtgggcggcagcaagtacggcatcatcaacctgcagagcctgaagacccccaccctgaaggtgttcatgcacgagaacctgtacttcaccaacagaaaggtgaacagcgtgtgctgggccagcctgaaccacctggacagccacatcctgctgtgcctgatgggcctggccgagacccccggctgcgccaccctgctgcccgccagcctgttcgtgaacagccaccccggcatcgacagacccggcatgctgtgcagcttcagaatccccggcgcctggagctgcgcctggagcctgaacatccaggccaacaactgcttcagcaccggcctgagcagaagagtgctgctgaccaacgtggtgaccggccacagacagagcttcggcaccaacagcgacgtgctggcccagcagttcgccctgatggcccccctgctgttcaacggctgcagaagcggcgagatcttcgccatcgacctgagatgcggcaaccagggcaagggctggaaggccaccagactgttccacgacagcgccgtgaccagcgtgagaatcctgcaggacgagcagtacctgatggccagcgacatggccggcaagatcaagctgtgggacctgagaaccaccaagtgcgtgagacagtacgagggccacgtgaacgagtacgcctacctgcccctgcacgtgcacgaggaggagggcatcctggtggccgtgggccaggactgctacaccagaatctggagcctgcacgacgccagactgctgagaaccatccccagcccctaccccgccagcaaggccgacatccccagcgtggccttcagcagcagactgggcggcagcagaggcgcccccggcctgctgatggccgtgggccaggacctgtactgctacagctacagctag

SEQ ID NO: 20399 - DNA, 1188 bp, Artificial Sequence
  Description of Artificial Sequence: Synthetic coding sequence
atggagagcaagagactgagactgctgcaggaggaggacagaagaaagaagatcgccagaatgggcttcaacgccagcagcatgctgagaaagagccagctgggcttcctgaacgtgaccaactactgccacctggcccacgagctgagactgagctgcatggagagaaagaaggtgcagatcagaagcatggaccccagcgccctggccagcgacagattcaacctgatcctggccgacaccaacagcgacagactgttcaccgtgaacgacgtgaaggtgggcggcagcaagtacggcatcatcaacctgcagagcctgaagacccccaccctgaaggtgttcatgcacgagaacctgtacttcaccaacagaaaggtgaacagcgtgtgctgggccagcctgaaccacctggacagccacatcctgctgtgcctgatgggcctggccgagacccccggctgcgccaccctgctgcccgccagcctgttcgtgaacagccaccccggcatcgacagacccggcatgctgtgcagcttcagaatccccggcgcctggagctgcgcctggagcctgaacatccaggccaacaactgcttcagcaccggcctgagcagaagagtgctgctgaccaacgtggtgaccggccacagacagagcttcggcaccaacagcgacgtgctggcccagcagttcgccctgatggcccccctgctgttcaacggctgcagaagcggcgagatcttcgccatcgacctgagatgcggcaaccagggcaagggctggaaggccaccagactgttccacgacagcgccgtgaccagcgtgagaatcctgcaggacgagcagtacctgatggccagcgacatggccggcaagatcaagctgtgggacctgagaaccaccaagtgcgtgagacagtacgagggccacgtgaacgagtacgcctacctgcccctgcacgtgcacgaggaggagggcatcctggtggccgtgggccaggactgctacaccagaatctggagcctgcacgacgccagactgctgagaaccatccccagcccctaccccgccagcaaggccgacatccccagcgtggccttcagcagcagactgggcggcagcagaggcgcccccggcctgctgatggccgtgggccaggacctgtactgctacagctacagctag

SEQ ID NO: 20400 - DNA, 1308 bp, Artificial Sequence
  Description of Artificial Sequence: Synthetic coding sequence
atgaacaagagcagatggcagagcagaagaagacacggcagaagaagccaccagcagaacccctggttcagactgagagacagcgaggacagaagcgacagcagagccgcccagcccgcccacgacagcggccacggcgacgacgagagccccagcaccagcagcggcaccgccggcaccagcagcgtgcccgagctgcccggcttctacttcgaccccgagaagaagagatacttcagactgctgcccggccacaacaactgcaaccccctgaccaaggagagcatcagacagaaggagatggagagcaagagactgagactgctgcaggaggaggacagaagaaagaaggccgacaccaacagcgacagactgttcaccgtgaacgacgtgaaggtgggcggcagcaagtacggcatcatcaacctgcagagcctgaagacccccaccctgaaggtgttcatgcacgagaacctgtacttcaccaacagaaaggtgaacagcgtgtgctgggccagcctgaaccacctggacagccacatcctgctgtgcctgatgggcctggccgagacccccggctgcgccaccctgctgcccgccagcctgttcgtgaacagccaccccgccggcatcgacagacccggcatgctgtgcagcttcagaatccccggcgcctggagctgcgcctggagcctgaacatccaggccaacaactgcttcagcaccggcctgagcagaagagtgctgctgaccaacgtggtgaccggccacagacagagcttcggcaccaacagcgacgtgctggcccagcagttcgccctgatggcccccctgctgttcaacggctgcagaagcggcgagatcttcgccatcgacctgagatgcggcaaccagggcaagggctggaaggccaccagactgttccacgacagcgccgtgaccagcgtgagaatcctgcaggacgagcagtacctgatggccagcgacatggccggcaagatcaagctgtgggacctgagaaccaccaagtgcgtgagacagtacgagggccacgtgaacgagtacgcctacctgcccctgcacgtgcacgaggaggagggcatcctggtggccgtgggccaggactgctacaccagaatctggagcctgcacgacgccagactgctgagaaccatccccagcccctaccccgccagcaaggccgacatccccagcgtggccttcagcagcagactgggcggcagcagaggcgcccccggcctgctgatggccgtgggccaggacctgtactgctacagctacagctag

SEQ ID NO: 20401 - DNA, 1470 bp, Artificial Sequence
  Description of Artificial Sequence: Synthetic coding sequence
atgaacaagagcagatggcagagcagaagaagacacggcagaagaagccaccagcagaacccctggttcagactgagagacagcgaggacagaagcgacagcagagccgcccagcccgcccacgacagcggccacggcgacgacgagagccccagcaccagcagcggcaccgccggcaccagcagcgtgcccgagctgcccggcttctacttcgaccccgagaagaagagatacttcagactgctgcccggccacaacaactgcaaccccctgaccaaggagagcatcagacagaaggagatggagagcaagagactgagactgctgcaggaggaggacagaagaaagaagatcgccagaatgggcttcaacgccagcagcatgctgagaaagagccagctgggcttcctgaacgtgaccaactactgccacctggcccacgagctgagactgagctgcatggagagaaagaaggtgcagatcagaagcatggaccccagcgccctggccagcgacagattcaacctgatcctggccgacaccaacagcgacagactgttcaccgtgaacgacgtgaaggtgggcggcagcaagtacggcatcatcaacctgcagagcctgaagacccccaccctgaaggtgttcatgcacgagaacctgtacttcaccaacagaaaggtgaacagcgtgtgctgggccagcctgaaccacctggacagccacatcctgctgtgcctgatgggcctggccgagacccccggctgcgccaccctgctgcccgccagcctgttcgtgaacagccaccccgccggcatcgacagacccggcatgctgtgcagcttcagaatccccggcgcctggagctgcgcctggagcctgaacatccaggccaacaactgcttcagcaccggcctgagcagaagagtgctgctgaccaacgtggtgaccggccacagacagagcttcggcaccaacagcgacgtgctggcccccctgctgttcaacggctgcagaagcggcgagatcttcgccatcgacctgagatgcggcaaccagggcaagggctggaaggccaccagactgttccacgacagcgccgtgaccagcgtgagaatcctgcaggacgagcagtacctgatggccagcgacatggccggcaagatcaagctgtgggacctgagaaccaccaagtgcgtgagacagtacgagggccacgtgaacgagtacgcctacctgcccctgcacgtgcacgaggaggagggcatcctggtggccgtgggccaggactgctacaccagaatctggagcctgcacgacgccagactgctgagaaccatccccagcccctaccccgccagcaaggccgacatccccagcgtggccttcagcagcagactgggcggcagcagaggcgcccccggcctgctgatggccgtgggccaggacctgtactgctacagctacagctag

SEQ ID NO: 20402 - DNA, 1191 bp, Artificial Sequence
  Description of Artificial Sequence: Synthetic coding sequence
atggaggccgagagactgagactgctggaggaggaggccaagctgaagaaggtggccagaatgggcttcaacgccagcagcatgctgagaaagagccagctgggcttcctgaacgtgaccagctacagcagactggccaacgagctgagagtgagctgcatggagagaaagaaggtgcagatcagaagcctggaccccagcagcctggccagcgacagattcaacttcatcctggccagcaccaacagcgaccagctgttcgtggtgaaccaggtggaggtggagggcagcaagtacggcatcatcagcctgagaaccctgaagatccccagcttccacgtgtacgtgctgagaaacctgtacgtgcccaacagaaaggtgaagagcctgtgctgggccagcctgaaccagctggacagccacgtgctgctgtgcttcgagggcatcaccgacgcccccagctgcgccgtgctgctgcccgccagcagattcctgagcgtgcacaccagagtgaaccagcccggcatgctgtgcagcttccagatccccgaggcctggagctgcgcctggagcctgaacaccagagcctaccactgcttcagcgccggcctgagccagcaggtgctgctgaccagcgtggccaccggccaccagcagagcttcgacaccagcagcgacgtgctggcccagcagttcgccagcaccgcccccctgctgttcaacggctgcagaagcggcgagatcttcgccatcgacctgagatgcagaaacagaggcaagggctggagagccaccagactgttccacgacagcgccgtgaccagcgtgcagatcctgcaggaggagcagtgcctgatggccagcgacatgaccggcaagatcaagctgtgggacctgagagccaccaagtgcgtgagacagtacgagggccacgtgaacgagagcgcctacctgcccctgcacgtgcacgaggaggagggcatcgtggtggccgtgggccaggactgctacaccagaatctggagcctgcacgacgcccacctgctgagaaccatccccagcccctacagcgccagcgaggacgacatccccagcgtggccttcgccagcagactgggcggcatcagaggcgccgcccccggcctgctgatggccgtgagacaggacctgtactgcttccccttcagctag

SEQ ID NO: 20403 - DNA, 1188 bp, Artificial Sequence
  Description of Artificial Sequence: Synthetic coding sequence
atggagagcaagagacccagactgctggaggaggccgacaagcagaagaagaccgtgagagtgggcctgaacgcccccagcatgctgagaaagaaccagctgggcttcctgagattcgccaactactgcagaatcgccagagagctgagagtgagctgcatgcagagaaagaaggtgcagatccacagctgggaccccagcagcctggccagcgacagattcaacagaatcctggccaacaccaacaccgaccagctgttcaccgtgaaccaggtggaggccggcggcagcaagtacggcatcatcaccatgagaggcctgaccacccccgagctgagagtgtacccccacaagaccctgtacgtgcccaacagaaaggtgaacagcatgtgctgggccagcctgaaccacctggacagccacctgctgctgtgcttcgtgggcctggccgacacccccagctgcgccgtgctgctgcccgccagcctgttcatcggcagcttccccggcatgagaagacccggcatgctgtgcagcttccagatccccgacgcctggagctgcgcctggagcctgagcatccacgcctaccacagcttcagcaccggcctgagccagcaggtgctgctgaccaacgtggtgaccggccaccagcagagcttcggcaccagcagcgacgtgctggcccagcagttcgccatcatgacccccctgctgttcaacggctgcagaagcggcgagatcttcggcatcgacctgagatgcggcaaccagggcagcggctggaaggccatctgcctgagccacgacagcgccgtgaccagcctgcagatcctgcaggacggccagttcctggtgagcagcgacatgaccggcaccatcaagctgtgggacctgagagccaccaagtgcgtgacccagtacgagggccacgtgaacaacagcgcctacctgcccgtgcacgtgaacgaggaggagggcgtggtggccgccgtgggccaggactgctacaccagaatctggagcctgagacacggccacctgctgaccaccatccccagcccctaccccgccagcgagaacgacatccccagcgtggccttcagcagcagactgggcggcttcagaggcgcccccggcctgctgatggccgtgagagaggacctgtactgcttcagctacggctag

SEQ ID NO: 20404 - DNA, 1803 bp, Artificial Sequence
  Description of Artificial Sequence: Synthetic coding sequence
atgagccaccaggagggcagcaccggcggcctgcccgacctggtgaccgagagcctgttcagcagccccgaggagcagagcggcgtggccgccgtgaccgccgccagcagcgacatcgagatggccgccaccgagcccagcaccggcgacggcggcgacaccagagacggcggcttcctgaacgacgccagcaccgagaaccagaacaccgacagcgagagcagcagcgaggacgtggagctggagagcatgggcgagggcctgttcggctaccccctggtgggcgaggagaccgagagagaggaggaggaggaggagatggaggaggagggcgaggaggaggagcagcccagaatgtgccccagatgcggcggcaccaaccacgaccagtgcctgctggacgaggaccaggccctggaggagtggatcagcagcgagaccagcgccctgcccagaagcagatggcaggtgctgaccgccctgagacagagacagctgggcagcagcgccagattcgtgtacgaggcctgcggcgccagaaccttcgtgcagagattcagactgcagtacctgctgggcagccacgccggcagcgtgagcaccatccacttcaaccagagaggcaccagactggccagcagcggcgacgacctgagagtgatcgtgtgggactgggtgagacagaagcccgtgctgaacttcgagagcggccacgacatcaacgtgatccaggccaagttcttccccaactgcggcgacagcaccctggccatgtgcggccacgacggccaggtgagagtggccgagctgatcaacgccagctactgcgagaacaccaagagagtggccaagcacagaggccccgcccacgagctggccctggagcccgacagcccctacaagttcctgaccagcggcgaggacgccgtggtgttcaccatcgacctgagacaggacagacccgccagcaaggtggtggtgaccagagagaacgacaagaaggtgggcctgtacaccatcagcatgaaccccgccaacatctaccagttcgccgtgggcggccacgaccagttcgtgagaatctacgaccagagaagaatcgacaagaaggagaacaacggcgtgctgaagaagttcaccccccaccacctggtgtactgcgacttccccaccaacatcacctgcgtggtgtacagccacgacggcaccgagctgctggccagctacaacgacgaggacatctacctgttcaacagcagcctgagcgacggcgcccagtacgtgaagagatacaagggccacagaaacaacgacaccatcaagtgcgtgaacttctacggccccagaagcgagttcgtggtgagcggcagcgactgcggccacgtgttcttctgggagaagagcagcagccagatcatccagttcatggagggcgacagaggcgacatcgtgaactgcctggagccccacccctacctgcccgtgctggccaccagcggcctggaccagcacgtgagaatctggacccccaccgccaagaccgccaccgagctgaccggcctgaaggacgtgatcaagaagaacaagcaggagagagacgaggacaacctgaactacaccgacagcttcgacaacagaatgctgagattcttcgtgagacacctgctgcagagagcccaccagcccggctggagagaccacggcgccgagttccccgacgaggaggagctggacgagagcagcagcaccagcgacaccagcgaggaggagggccaggacagagtgcagtgcatccccagctag

SEQ ID NO: 20405 - DNA, 1896 bp, Artificial Sequence
  Description of Artificial Sequence: Synthetic coding sequence
atgagccaccaggagggcagcaccgacggcctgcccgacctgggcaccgagagcctgttcagcagccccgaggagcagagcggcgccgtggccgccaccgaggccagcagcgacatcgacatcgccaccagcgagctgagcgtgaccgtgaccggcgacggcagcgacagcagagacggcggcttccccaacgacgccagcaccgagaacagaagcagcgaccaggagagcgccagcgaggacatcgagctggagagcctggaggacttcgagcacttcctgatgagcggcgagagcctgttccactaccccctggtgggcgaggaggagaccgagagagaggaggaggacgaggagatccaggaggagggcggcgaggaggaggaggaggaggaggaggaggaggaggaggaggaggaggaggaggaggaggaggaggagcagcccagagccggcccccagggcagcggcggcaaccacgagcagtacagcctggaggaggaccaggccctggaggagtgggtgagcagcgagaccagcgccctgcccagacccagatggcaggtggtgaccgccctgcaccagagacagctgggcagcagacccagattcgtgtacgaggcctgcggcgccagagccttcgtgcagagattcagactgcagtacagactggccgaccacgtgggctgcgtgaacaccgtgcacttcaaccagagaggcaccagactggccagcagcggcgacgacctgaaggtgatcgtgtgggactgggtgagacagagacccgtgctgaacttcgagagcggccacaccaacaacgtgttccaggccaagttcctgcccaactgcggcgacagcaccctggccatgtgcgccagagacggccaggtgagagtggccgagctgatcaacgccagctacttcaacaacaccaagtgcgtggcccagcacagaggccccgcccacaagctggccctggagcccgacagcccctacaagttcctgaccagcggcgaggacgccgtggtgttcaccatcgacctgagacaggacagacccgccagcaaggtggtggtgaccagagagaacgacaagaaggtgggcctgtacaccatcaccgtgaaccccgccaacacctaccagttcgccgtgggcggccaggaccagttcgtgagaatctacgaccagagaaagatcgacaagaaggagaacaacggcgtgctgaagaagttcaccccccaccacctggtgaactgcgacttccccaccaacatcacctgcgtggtgtacagccacgacggcaccgagctgctggccagctacaacgacgacgacatctacctgttcaacagcagccacagcgacggcgcccagtacagcaagagattcaagggccacagaaacaacaccaccgtgaagggcgtgaacttctacggccccagaagcgagttcgtggtgagcggcagcgactgcggccacatcttcttctgggagaagagcagctgccagatcatccagttcctgaagggcagcagagagggcaccatcaactgcctggagccccacccctacctgcccgtgctggcctgcagcggcctggaccacgacgtgaagatctggacccccaccgccaaggccgccaccgagctgaccggcctgaagaaggtgatcaagaagaacaagtgggagagagacgaggacagcctgcaccacggcagcctgttcgaccagtacatgctgtggttcctgctgagacacgtgacccagagaggcagacaccaggactggagaagcggcgaggccgagttccccgacgaggagagcgacgagagcagcagcaccagcgagaccagcgaggaggaggtgcaggacagagtgcagtgcatgcccagctag

SEQ ID NO: 20406 - DNA, 1452 bp, Artificial Sequence
  Description of Artificial Sequence: Synthetic coding sequence
atgagcaccgccagaaccgagaaccccgtgatcatgggcctgagcagccagaacggccagctgagaggccccgtgaagcccaccggcggccccggcggcggcggcacccagacccagcagcagatgaaccagctgaagaacaccaacaccatcaacaacggcacccagcagcaggcccagagcatgaccaccaccatcaagcccggcgacgactggaagaagaccctgaagctgccccccaaggacctgagaatcaagaccagcgacgtgaccagcaccaagggcaacgagttcgaggactactgcctgaagagagagctgctgatgggcatcttcgagatgggctgggagaagcccagccccatccaggaggagagcatccccatcgccctgagcggcagagacatcctggccagagccaagaacggcaccggcaagagcggcgcctacctgatccccctgctggagagactggacctgaagaaggacaacatccaggccatggtgatcgtgcccaccagagagctggccctgcaggtgagccagatctgcatccaggtgagcaagcacatgggcggcgccaaggtgatggccaccaccggcggcaccaacctgagagacgacatcatgagactggacgacaccgtgcacgtggtgatcgccacccccggcagaatcctggacctgatcaagaagggcgtggccaaggtggaccacgtgcagatgatcgtgctggacgaggccgacaagctgctgagccaggacttcgtgcagatcatggaggacatcatcctgaccctgcccaagaacagacagatcctgctgtacagcgccaccttccccctgagcgtgcagaagttcatgaacagccacctgcagaagccctacgagatcaacctgatggaggagctgaccctgaagggcgtgacccagtactacgcctacgtgaccgagagacagaaggtgcactgcctgaacaccctgttcagcagactgcagatcaaccagagcatcatcttctgcaacagcagccagagagtggagctgctggccaagaagatcagccagctgggctacagctgcttctacatccacgccaagatgagacaggagcacagaaacagagtgttccacgacttcagaaacggcctgtgcagaaacctggtgtgcaccgacctgttcaccagaggcatcgacatccaggccgtgaacgtggtgatcaacttcgacttccccaagctggccgagacctacctgcacagaatcggcagaagcggcagattcggccacctgggcctggccatcaacctgatcacctacgacgacagattcaacctgaagagcatcgaggagcagctgggcaccgagatcaagcccatccccagcaacatcgacaagagcctgtacgtggccgagtaccacagcgagcccgtggaggacgagaagccctag

SEQ ID NO: 20407 - DNA, 1452 bp, Artificial Sequence
  Description of Artificial Sequence: Synthetic coding sequence
atggccggcttcgccgagctgggcctgagcagctggctggtggagcagtgcagacagctgggcctgaagcagcccacccccgtgcagctgggctgcatccccgccatcctggagggcagagactgcctgggctgcgccaagaccggcagcggcaagaccgccgccttcgtgctgcccatcctgcagaagctgagcgaggacccctacggcatcttctgcctggtgctgacccccaccagagagctggcctaccagatcgccgagcagttcagagtgctgggcaagcccctgggcctgaaggactgcatcatcgtgggcggcatggacatggtggcccaggccctggagctgagcagaaagccccacgtggtgatcgccacccccggcagactggccgaccacctgagaagcagcaacaccttcagcatcaagaagatcagattcctggtgatggacgaggccgacagactgctggagcagggctgcaccgacttcaccgtggacctggaggccatcctggccgccgtgcccgccagaagacagaccctgctgttcagcgccaccctgaccgacaccctgagagagctgcagggcctggccaccaaccagcccttcttctgggaggcccaggcccccgtgagcaccgtggagcagctggaccagagatacctgctggtgcccgagaaggtgaaggacgcctacctggtgcacctgatccagagattccaggacgagcacgaggactggagcatcatcatcttcaccaacacctgcaagacctgccagatcctgtgcatgatgctgagaaagttcagcttccccaccgtggccctgcacagcatgatgaagcagaaggagagattcgccgccctggccaagttcaagagcagcatctacagaatcctgatcgccaccgacgtggccagcagaggcctggacatccccaccgtgcaggtggtgatcaaccacaacacccccggcctgcccaagatctacatccacagagtgggcagaaccgccagagccggcagacagggccaggccatcaccctggtgacccagtacgacatccacctggtgcacgccatcgaggagcagatcaagaagaagctggaggagttcagcgtggaggaggccgaggtgctgcagatcctgacccaggtgaacgtggtgagaagagagtgcgagatcaagctggaggccgcccacttcgacgagaagaaggagatcaacaagagaaagcagctgatcctggagggcaaggaccccgacctggaggccaagagaaaggccgagctggccaagatcaagcagaagaacagaagattcaaggagaaggtggaggagaccctgaagagacagaaggccggcagagccggccacaagggcagaccccccagaacccccagcggcagccacagcggccccgtgcccagccagggcctggtgtag

SEQ ID NO: 20408 - DNA, 765 bp, Artificial Sequence
  Description of Artificial Sequence: Synthetic coding sequence
atggacatggtggcccaggccctggagctgagcagaaagccccacgtggtgatcgccacccccggcagactggccgaccacctgagaagcagcaacaccttcagcatcaagaagatcagattcctggtgatggacgaggccgacagactgctggagcagggctgcaccgacttcaccgtggacctggaggccatcctggccgccgtgcccgccagaagacagaccctgctgttcagcgccaccctgaccgacaccctgagagagctgcagggcctggccaccaaccagcccttcttctgggaggcccaggcccccgtgagcaccgtggagcagctggaccagagatacctgctggtgcccgagaaggtgaaggacgcctacctggtgcacctgatccagagattccaggacgagcacgaggactggagcatcatcatcttcaccaacacctgcaagacctgccagatcctgtgcatgatgctgagaaagttcagcttccccaccgtggccctgcacagcatgatgaagcagaaggagagattcgccgccctggccaagttcaagagcagcatctacagaatcctgatcgccaccgacgtggccagcagaggcgccgaccagccccccctgccccccggcgcctggaccagcctgagatacagatggagcagcaccaccaccccccccggcagccccagaagcaccagcaccgagagcgccggcagacccgtgcagggcggcagagtgagacccagcagatggtag

SEQ ID NO: 20409 - DNA, 1803 bp, Artificial Sequence
  Description of Artificial Sequence: Synthetic coding sequence
atggagcacgtgaccgagggcagctgggagagcctgcccgtgcccctgcacccccaggtgctgggcgccctgagagagctgggcttcccctacatgacccccgtgcagagcgccaccatccccctgttcatgagaaacaaggacgtggccgccgaggccgtgaccggcagcggcaagaccctggccttcgtgatccccatcctggagatcctgctgagaagagaggagaagctgaagaagagccaggtgggcgccatcatcatcacccccaccagagagctggccatccagatcgacgaggtgctgagccacttcaccaagcacttccccgagttcagccagatcctgtggatcggcggcagaaaccccggcgaggacgtggagagattcaagcagcagggcggcaacatcatcgtggccacccccggcagactggaggacatgttcagaagaaaggccgagggcctggacctggccagctgcgtgagaagcctggacgtgctggtgctggacgaggccgacagactgctggacatgggcttcgaggccagcatcaacaccatcctggagttcctgcccaagcagagaagaaccggcctgttcagcgccacccagacccaggaggtggagaacctggtgagagccggcctgagaaaccccgtgagagtgagcgtgaaggagaagggcgtggccgccagcagcgcccagaagacccccagcagactggagaactactacatggtgtgcaaggccgacgagaagttcaaccagctggtgcacttcctgagaaaccacaagcaggagaagcacctggtgttcttcagcacctgcgcctgcgtggagtactacggcaaggccctggaggtgctggtgaagggcgtgaagatcatgtgcatccacggcaagatgaagtacaagagaaacaagatcttcatggagttcagaaagctgcagagcggcatcctggtgtgcaccgacgtgatggccagaggcatcgacatccccgaggtgaactgggtgctgcagtacgacccccccagcaacgccagcgccttcgtgcacagatgcggcagaaccgccagaatcggccacggcggcagcgccctggtgttcctgctgcccatggaggagagctacatcaacttcctggccatcaaccagaagtgccccctgcaggagatgaagccccagagaaacaccgccgacctgctgcccaagctgaagagcatggccctggccgacagagccgtgttcgagaagggcatgaaggccttcgtgagctacgtgcaggcctacgccaagcacgagtgcaacctgatcttcagactgaaggacctggacttcgccagcctggccagaggcttcgccctgctgagaatgcccaagatgcccgagctgagaggcaagcagttccccgacttcgtgcccgtggacgtgaacaccgacaccatccccttcaaggacaagatcagagagaagcagagacagaagctgctggagcagcagagaagagagaagaccgagaacgagggcagaagaaagttcatcaagaacaaggcctggagcaagcagaaggccaagaaggagaagaagaagaagatgaacgagaagagaaagagagaggagggcagcgacatcgaggacgaggacatggaggagctgctgaacgacaccagactgctgaagaagctgaagaagggcaagatcaccgaggaggagttcgagaagggcctgctgaccaccggcaagagaaccatcaagaccgtggacctgggcatcagcgacctggaggacgactgctag

SEQ ID NO: 20410 - DNA, 1062 bp, Artificial Sequence
  Description of Artificial Sequence: Synthetic coding sequence
atggagcacgtgaccgagggcagctgggagagcctgcccgtgcccctgcacccccaggtgctgggcgccctgagagagctgggcttcccctacatgacccccgtgcagagcgccaccatccccctgttcatgagaaacaaggacgtggccgccgaggccgtgaccggcagcggcaagaccctggccttcgtgatccccatcctggagatcctgctgagaagagaggagaagctgaagaagagccaggtgggcgccatcatcatcacccccaccagagagctggccatccagatcgacgaggtgctgagccacttcaccaagcacttccccgagttcagccagatcctgtggatcggcggcagaaaccccggcgaggacgtggagagattcaagcagcagggcggcaacatcatcgtggccacccccggcagactggaggacatgttcagaagaaaggccgagggcctggacctggccagctgcgtgagaagcctggacgtgctggtgctggacgaggccgacagactgctggacatgggcttcgaggccagcatcaacaccatcctggagttcctgcccaagcagagaagaaccggcctgttcagcgccacccagacccaggaggtggagaacctggtgagagccggcctgagaaaccccgtgagagtgagcgtgaaggagaagggcgtggccgccagcagcgcccagaagacccccagcagactggagaactactacatggtgtgcaaggccgacgagaagttcaaccagctggtgcacttcctgagaaaccacaagcaggagaagcacctggtgttcttcagcacctgcgcctgcgtggagtactacggcaaggccctggaggtgctggtgaagggcgtgaagatcatgtgcatccacggcaagatgaagtacaagagaaacaagatcttcatggagttcagaaagctgcagagcggcatcctggtgtgcaccgacgtgatggccagaggcatcgacatccccgaggtgaactgggtgctgcagtacgacccccccagcaacgccgtgctgccctgctag

SEQ ID NO: 20411 - DNA, 1860 bp, Artificial Sequence
  Description of Artificial Sequence: Synthetic coding sequence
atgttcgtgcccagaagcctgaagatcaagagaaacgccaacgacgacggcaagagctgcgtggccaagatcatcaagcccgaccccgaggacctgcagctggacaagagcagagacgtgcccgtggacgccgtggccaccgaggccgccaccatcgacagacacatcagcgagagctgccccttccccagccccggcggccagctggccgaggtgcacagcgtgagccccgagcagggcgccaaggacagccaccccagcgaggagcccgtgaagagcttcagcaagacccagagatgggccgagcccggcgagcccatctgcgtggtgtgcggcagatacggcgagtacatctgcgacaagaccgacgaggacgtgtgcagcctggagtgcaaggccaagcacctgctgcaggtgaaggagaaggaggagaagagcaagctgagcaacccccagaaggccgacagcgagcccgagagccccctgaacgccagctacgtgtacaaggagcaccccttcatcctgaacctgcaggaggaccagatcgagaacctgaagcagcagctgggcatcctggtgcagggccaggaggtgaccagacccatcatcgacttcgagcactgcagcctgcccgaggtgctgaaccacaacctgaagaagagcggctacgaggtgcccacccccatccagatgcagatgatccccgtgggcctgctgggcagagacatcctggccagcgccgacaccggcagcggcaagaccgccgccttcctgctgcccgtgatcatgagagccctgttcgagagcaagacccccagcgccctgatcctgacccccaccagagagctggccatccagatcgagagacaggccaaggagctgatgagcggcctgcccagaatgaagaccgtgctgctggtgggcggcctgcccctgcccccccagctgtacagactgcagcagcacgtgaaggtgatcatcgccacccccggcagactgctggacatcatcaagcagagcagcgtggagctgtgcggcgtgaagatcgtggtggtggacgaggccgacaccatgctgaagatgggcttccagcagcaggtgctggacatcctggagaacatccccaacgactgccagaccatcctggtgagcgccaccatccccaccagcatcgagcagctggccagccagctgctgcacaaccccgtgagaatcatcaccggcgagaagaacctgccctgcgccaacgtgagacagatcatcctgtgggtggaggaccccgccaagaagaagaagctgttcgagatcctgaacgacaagaagctgttcaagccccccgtgctggtgttcgtggactgcaagctgggcgccgacctgctgagcgaggccgtgcagaagatcaccggcctgaagagcatcagcatccacagcgagaagagccagatcgagagaaagaacatcctgaagggcctgctggagggcgactacgaggtggtggtgagcaccggcgtgctgggcagaggcctggacctgatcagcgtgagactggtggtgaacttcgacatgcccagcagcatggacgagtacgtgcaccagatcggcagagtgggcagactgggccagaacggcaccgccatcaccttcatcaacaacaacagcaagagactgttctgggacatcgccaagagagtgaagcccaccggcagcatcctgcccccccagctgctgaacagcccctacctgcacgaccagaagagaaaggagcagcagaaggacaagcagacccagaacgacctggtgaccggcgccaacctgatggacatcatcagaaagcacgacaagagcaacagccagaagtag

SEQ ID NO: 20412 - DNA, 618 bp, Artificial Sequence
  Description of Artificial Sequence: Synthetic coding sequence
atgaagaccgtgctgctggtgggcggcctgcccctgcccccccagctgtacagactgcagcagcacgtgaaggacaagaagctgttcaagccccccgtgctggtgttcgtggactgcaagctgggcgccgacctgctgagcgaggccgtgcagaagatcaccggcctgaagagcatcagcatccacagcgagaagagccagatcgagagaaagaacatcctgaagggcctgctggagggcgactacgaggtggtggtgagcaccggcgtgctgggcagaggcctggacctgatcagcgtgagactggtggtgaacttcgacatgcccagcagcatggacgagtacgtgcaccagatcggcagagtgggcagactgggccagaacggcaccgccatcaccttcatcaacaacaacagcaagagactgttctgggacatcgccaagagagtgaagcccaccggcagcatcctgcccccccagctgctgaacagcccctacctgcacgaccagaagagaaaggagcagcagaaggacaagcagacccagaacgacctggtgaccggcgccaacctgatggacatcatcagaaagcacgacaagagcaacagccagaagtag

SEQ ID NO: 20413 - DNA, 1704 bp, Artificial Sequence
  Description of Artificial Sequence: Synthetic coding sequence
atgttcgtgcccagaagcctgaagatcaagagaaacgccaacgacgacggcaagagctgcgtggccaagatcatcaagcccgaccccgaggacctgcagctggacaagagcagagacgtgcccgtggacgccgtggccaccgaggccgccaccatcgacagacacatcagcgagagctgccccttccccagccccggcggccagctggccgaggtgcacagcgtgagccccgagcagggcgccaaggacagccaccccagcgaggagcccgtgaagagcttcagcaagacccagagatgggccgagcccggcgagcccatctgcgtggtgtgcggcagatacggcgagtacatctgcgacaagaccgacgaggacgtgtgcagcctggagtgcaaggccaagcacctgctgcaggtgaaggagaaggaggagaagagcaagctgagcaacccccagaaggccgacagcgagcccgagagccccctgaacgccagctacgtgtacaaggagcaccccttcatcctgaacctgcaggaggaccagatcgagaacctgaagcagcagctgggcatcctggtgcagggccaggaggtgaccagacccatcatcgacttcgagcactgcagcctgcccgaggtgctgaaccacaacctgaagaagagcggctacgaggtgcccacccccatccagatgcagatgatccccgtgggcctgctgggcagagacatcctggccagcgccgacaccggcagcggcaagaccgccgccttcctgctgcccgtgatcatgagagccctgttcgagagcaagacccccagcgccctgatcctgacccccaccagagagctggccatccagatcgagagacaggccaaggagctgatgagcggcctgcccagaatgaagaccgtgctgctggtgggcggcctgcccctgcccccccagctgtacagactgcagcagcacgtgaaggtgatcatcgccacccccggcagactgctggacatcatcaagcagagcagcgtggagctgtgcggcgtgaagatcgtggtggtggacgaggccgacaccatgctgaagatgggcttccagcagcaggtgctggacatcctggagaacatccccaacgactgccagaccatcctggtgagcgccaccatccccaccagcatcgagcagctggccagccagctgctgcacaaccccgtgagaatcatcaccggcgagaagaacctgccctgcgccaacgtgagacagatcatcctgtgggtggaggaccccgccaagaagaagaagctgttcgagatcctgaacgacaagaagctgttcaagccccccgtgctggtgttcgtggactgcaagctgggcgccgacctgctgagcgaggccgtgcagaagatcaccggcctgaagagcatcagcatccacagcgagaagagccagatcgagagaaagaacatcctgaagggcctgctggagggcgactacgaggtggtggtgagcaccggcgtgctgggcagaggcctggacctgatcagcgtgagactggtggtgaacttcgacatgcccagcagcatggacgagtacgtgcaccagctgaacatcatctgggtggtgcccttcagcggcatcaacatcaacgccagcctgatcgccctgctgtacagcctgctgaccaccatcaacatgaagttcaccccctag

SEQ ID NO: 20414 - DNA, 486 bp, Artificial Sequence
  Description of Artificial Sequence: Synthetic coding sequence
atgttcgtgcccagaagcctgaagatcaagagaaacgccaacgacgacggcaagagctgcgtggccaagatcatcaagcccgaccccgaggacctgcagctggacaagagcagagacgtgcccgtggacgccgtggccaccgaggccgccaccatcgacagacacatcagcgagagctgccccttccccagccccggcggccagctggccgaggtgcacagcgtgagccccgagcagggcgccaaggacagccaccccagcgaggagcccgtgaagagcttcagcaagacccagagatgggccgagcccggcgagcccatctgcgtggtgtgcggcagatacggcgagtacatctgcgacaagaccgacgaggacgtgtgcagcctggagtgcaaggccaagcacctgctgcaggtgaaggagaaggaggagaagagcaagctgagcaacccccagaaggccgacagcgagcccgagagcccctag

SEQ ID NO: 20415 - DNA, 1743 bp, Artificial Sequence
  Description of Artificial Sequence: Synthetic coding sequence
atgttcgtgcccagaagcctgaagatcaagagaaacgccaacgacgacggcaagagctgcgtggccaagatcatcaagcccgaccccgaggacctgcagctggacaagagcagagacgtgcccgtggacgccgtggccaccgaggccgccaccatcgacagacacatcagcgagagctgccccttccccagccccggcggccagctggccgaggtgcacagcgtgagccccgagcagggcgccaaggacagccaccccagcgaggagcccgtgaagagcttcagcaagacccagagatgggccgagcccggcgagcccatctgcgtggtgtgcggcagatacggcgagtacatctgcgacaagaccgacgaggacgtgtgcagcctggagtgcaaggccaagcacctgctgcaggtgaaggagaaggaggagaagagcaagctgagcaacccccagaaggccgacagcgagcccgagagccccctgaacgccagctacgtgtacaaggagcaccccttcatcctgaacctgcaggaggaccagatcgagaacctgaagcagcagctgggcatcctggtgcagggccaggaggtgaccagacccatcatcgacttcgagcactgcagcctgcccgaggtgctgaaccacaacctgaagaagagcggctacgaggtgcccacccccatccagatgcagatgatccccgtgggcctgctgggcagagacatcctggccagcgccgacaccggcagcggcaagaccgccgccttcctgctgcccgtgatcatgagagccctgttcgagagcaagacccccagcgccctgatcctgacccccaccagagagctggccatccagatcgagagacaggccaaggagctgatgagcggcctgcccagaatgaagaccgtgctgctggtgggcggcctgcccctgcccccccagctgtacagactgcagcagcacgtgaaggtgatcatcgccacccccggcagactgctggacatcatcaagcagagcagcgtggagctgtgcggcgtgaagatcgtggtggtggacgaggccgacaccatgctgaagatgggcttccagcagcaggtgctggacatcctggagaacatccccaacgactgccagaccatcctggtgagcgccaccatccccaccagcatcgagcagctggccagccagctgctgcacaaccccgtgagaatcatcaccggcgagaagaacctgccctgcgccaacgtgagacagatcatcctgtgggtggaggaccccgccaagaagaagaagctgttcgagatcctgaacgacaagaagctgttcaagccccccgtgctggtgttcgtggactgcaagctgggcgccgacctgctgagcgaggccgtgcagaagatcaccggcctgaagagcatcagcatccacagcgagaagagccagatcgagagaaagaacatcctgaagggcctgctggagggcgactacgaggtggtggtgagcaccggcgtgctgggcagaggcctggacctgatcagcgtgagactggtggtgaacttcgacatgcccagcagcatggacgagtacgtgcaccaggagaacacctacaagagcacctggagaaacccccagcacttccagcaggacgtgagaatgaccctgggctacgtgggcaaggcccagtgggaggaggacaaccagctgaaggtgaagctgggcctgaagaagaactgcagcagctag

SEQ ID NO: 20416 - DNA, 5121 bp, Artificial Sequence
  Description of Artificial Sequence: Synthetic coding sequence
atgggcagcaaggaccacgccgtgttcttcagagagatgacccagctgatcctgaacgagatgcccaaggccggctacagcagcatcctgaacgacttcgtggagagcaacttcttcgtgatcgacggcgacagcctgctggtgacctgcctgggcgtgaagagcttcaagtggggccagaacctgcacttcttctacctggtggagtgctacctggtggacctgctgagcaacggcggccagttcaccatcgtgttcttcaaggacgccgagtacgcctacttcgacttccccgagctgctgagcctgagaaccgccctgatcctgcacctgcagcacaacaccaacatcgacgtgcagaccgagttcagcggctgcctgagccaggactggaagctgttcctggagcagcactacccctacttcctgatcgtgagcgaggagggcctgagcgacctgcagacctacctgttcaacttcctgatcatccacagctggggcatgaaggtgaacgtggtgctgagcagcggccacgagagcgacaccctgagattctacgcctacaccatggagagcaccgacagaaaccagaccttcagcaaggagaacgagaccgtgatccagagcgcctacaagagcctgatccagcacctggaggagatcagagtgctggtgctggccacccacttcgagcacctgaagtggaacgacatgatggaggaggcctaccagaccctgttcctgctgcagcacctgtggagcgagggcagcgacatccagagagtgctgtgcgtgaccagctgcagcctgagcctgagaatgtaccacagagtgctggtgcacagcaactgcctgagcctgcaggaggtggaggacttctgcagactgagatgcctgtgcgtggccttccagctgcacctgcccctgagccagagagcctgcagcagagtgatcacctgcagctggatcagaaacagcgacagcttcctgaagatgaacaagtggtgcgagtacttcatcctgagcaacctgaacgtgttcggctgctggaacctgaacctgaaccacgtgagcgacctgtacgacgagcagctgctgaagaacatcgccttctactacgagttcgagagcacccaggagccccacctgaacctgggcgacagcatcagaagagactacgaggacctgtggaacgtggtgagccacctggtgaaggagttcaacgtgggcaagagcttccccctgagaaccaccagaagacacttcctgagacaggagaagagcgtgatccaggagatcagcctggagaagatgcccagcgtgggcttcatccccatgaccagcgccgtgatcgacgagttcgtgggcgacatgatgaaggacctgcccatcctgaagagcgacgaccccgtggtgcccagcctgttcaagcagaagaccagcgacgagctgctgcactggcacgcccagagactgctgagcgacgactacgacagaatcaagtgccacgtggacgagcagagcagagacccccacgtgctggacttcctgaagaagatccaggactaccagcagttctacggcaagagcctggagagcatcagcaccaaggtgatcgtgacccagaccaccagacccaaggaggacagcagcggcgccagcggcgagatcctgcagaacaccaagccccaccagatcaccaagaagagcaagaagaagagcttcctgaaggaggaccagaacaaggcccagcagaacgacgacctgctgttcagcatcgaggaggagatgaagaacaacctgcacagcggcatcagaaagctggaggactacctgaccagctgcgccagcaacagcgtgaagttcggcgtggagatgctgggcctgatcgcctgcttcaaggcctggaagaagcactgcagaggcgagggcaagatcagcaaggacctgagcatcgccgtgcagatgatgaagagaatccacagcctgctggagagataccccgagatcctggaggccgagcaccaccagtacatcgccaagtgcctgaagtacctgggcttcaacgacctggccaacagcctggaccccaccctgatcggcgacgacaagaacaagaagaagtacagcatcgacatcggccccgccagattccagctgcagtacatgggccactacctgatcagagacgagagaaaggacagagaccccagagtgcaggacttcatccccaacgcctggcagcaggagctgctggacgtggtggacaagaacgagagcgccgtgatcgtggcccccaccagcagcggcaagacctacgccagctactactgcatggagaaggtgctgagagagagcgacgtgggcgtggtggtgtacgtggcccccgccaagagcctggtgggccaggtggccgccaccgtggagaacagattcaccaagaccctgcccgccggcagaaccctgtgcggcgccttcaccagagactactgccacaacgtgctgaactgccaggtgctgatcaccgtgcccgagtgcttcgagatcctgctgctggccccccacagacagaagtgggtggagagaatcagatacgtgatcttcgacgaggtgcactacctgggcagagaggtgggcgccaagttctgggagctgctgctggtgatcatcagatgccccttcctggtgctgagcgccaccatcaacaaccccaacctgctgaccaagtggctgcagagcgtgaagcagtactggaagcaggccgacaagatcatggaggagaagtgcatcagcgagaagcaggccgacaagtgcctgaacttcctgcaggaccacagctacaagaaccagagctacgaggtgagactggtgctgtacggcgagagatacaacgacctggagaagcacatctgcagcgtgaagcacgacgacgtgtacttcgaccacttccacccctgcgccgccctgaccaccgacatcatcgagaagtacggcttcccccccgacctgaccctgaccccccaggagagcatccagctgtacgacaccatggcccaggtgtgggagacctggcccagagcccaggagctgtgccccgaggagttcatcctgttcaagaacaagatcgtgatcaagaagctggacgccagaaagtacgaggagaacctgaaggccgagctgaccaactggatcaagaacggccaggtgaagaaggtgaagagagtgctgaagaacctgagccccgacagcctgagcagcagcaaggacatggtgaagatgttccccctgctggtggagaagctgagacagatggacaagctgcccgccatcttcttcctgttcaagaacgacgacgtgggcaagagagccggcagcgtgtgcaccttcctggagaagaccgagaccaagagccacccccacaccgagtgccacagctacgtgttcgccatcgacgaggtgctggagaaggtgagaaagacccagaagagaatcaccaagaagaaccccaagaaggccgagaagctggagagaaagaaggtgtacagagccgagtacatcaacttcctggagaacctgaagatcctggagatcagcgaggactgcacctacgccgacgtgaaggccctgcacaccgagatcaccagaaacaaggacagcaccctggagagagtgctgcccagagtgagattcaccagacacggcaaggagctgaaggccctggcccagagaggcatcggctaccaccacagcagcatgtacttcaaggagaaggagttcgtggagatcctgttcgtgaagggcctgatcagagtggtgaccgccaccgagaccctggccctgggcatccacatgccctgcaagagcgtggtgttcgcccaggacagcgtgtacctggacgccctgaactacagacagatgagcggcagagccggcagaagaggccaggacctgctgggcaacgtgtacttcttcgacatccccctgcccaagatcaagagactgctggccagcagcgtgcccgagctgagaggccagttccccctgagcatcaccctggtgctgagactgatgctgctggccagcaagggcgacgaccccgaggacgccaaggccaaggtgctgagcgtgctgaagcacagcctgctgagcttcaagagaagaagagccatggagaccctgaagctgtacttcctgttcagcctgcagctgctgatcaaggaggactacctgaacaagaagggcaaccccaagaagttcgccggcctggccagctacctgcacggccacgagcccagcaacctggtgttcgtgaacttcctgaagagaggcctgttccacaacctgtgcaagcccgcctggaagggcagccagcagttcagccaggacgtgatggagaagctggtgctggtgctggccaacctgttcggcagaaagtacatccccgccaagttccagaacgccaacctgagcttcagccagagcaaggtgatcctggccgagctgcccgaggacttcaaggccgccctgtacgagtacaacctggccgtgatgaaggacttcgccagcttcctgctgatcgccagcaagagcgtgaacatgaagaaggagcaccagctgcccctgagcagaatcaagttcaccggcaaggagtgcgaggacagccagctggtgagccacctgatgagctgcaagaagggcagagtggccatcagccccttcgtgtgcctgagcggcaacaccgacaacgacctgctgagacccgagaccatcaaccaggtgatcctgagaaccgtgggcgtgagcggcacccaggcccccctgctgtggccctggaagctggacaacagaggcagaagaatgcccctgaacgcctacgtgctgaacttctacaagcacaactgcctgaccagactggaccagaagaacggcatgagaatgggccagctgctgaagtgcctgaaggacttcgccttcaacatccaggccatcagcgacagcctgagcgagctgtgcgagaacaagagagacaacgtggtgctggccttcaagcagctgagccagaccttctacgagaagctgcaggagatgcagatccagatgagccagaaccacctggagtag

SEQ ID NO: 20417 - DNA, 378 bp, Artificial Sequence
  Description of Artificial Sequence: Synthetic coding sequence
atgggcagcaaggaccacgccgtgttcttcagagagatgacccagctgatcctgaacgagatgcccaaggccggctacagcagcatcctgaacgacttcgtggagagcaacttcttcgtgatcgacggcgacagcctgctggtgacctgcctgggcgtgaagagcttcaagtggggccagaacctgcacttcttctacctggtggagtgctacctggtggacctgctgagcaacggcggccagttcaccatcgtgttcttcaaggacgccgagtacgcctacttcgacttccccgagctgctgagcctgagaaccgccctgatcctgcacctgcagcacaacaccaacatcgacgtgcagaccgagttcagcggctag

SEQ ID NO: 20418 - DNA, 3927 bp, Artificial Sequence
  Description of Artificial Sequence: Synthetic coding sequence
atgggcagcaaggaccacgccgtgttcttcagagagatgacccagctgatcctgaacgagatgcccaaggccggctacagcagcatcctgaacgacttcgtggagagcaacttcttcgtgatcgacggcgacagcctgctggtgacctgcctgggcgtgaagagcttcaagtggggccagaacctgcacttcttctacctggtggagtgctacctggtggacctgctgagcaacggcggccagttcaccatcgtgttcttcaaggacgccgagtacgcctacttcgacttccccgagctgctgagcctgagaaccgccctgatcctgcacctgcagcacaacaccaacatcgacgtgcagaccgagttcagcggctgcctgagccaggactggaagctgttcctggagcagcactacccctacttcctgatcgtgagcgaggagggcctgagcgacctgcagacctacctgttcaacttcctgatcatccacagctggggcatgaaggtgaacgtggtgctgagcagcggccacgagagcgacaccctgagattctacgcctacaccatggagagcaccgacagaaaccagaccttcagcaaggagaacgagaccgtgatccagagcgcctacaagagcctgatccagcacctggaggagatcagagtgctggtgctggccacccacttcgagcacctgaagtggaacgacatgatggaggaggcctaccagaccctgttcctgctgcagcacctgtggagcgagggcagcgacatccagagagtgctgtgcgtgaccagctgcagcctgagcctgagaatgtaccacagagtgctggtgcacagcaactgcctgagcctgcaggaggtggaggacttctgcagactgagatgcctgtgcgtggccttccagctgcacctgcccctgagccagagagcctgcagcagagtgatcacctgcagctggatcagaaacagcgacagcttcctgaagatgaacaagtggtgcgagtacttcatcctgagcaacctgaacgtgttcggctgctggaacctgaacctgaaccacgtgagcgacctgtacgacgagcagctgctgaagaacatcgccttctactacgagttcgagagcacccaggagccccacctgaacctgggcgacagcatcagaagagactacgaggacctgtggaacgtggtgagccacctggtgaaggagttcaacgtgggcaagagcttccccctgagaaccaccagaagacacttcctgagacaggagaagagcgtgatccaggagatcagcctggagaagatgcccagcgtgggcttcatccccatgaccagcgccgtgatcgacgagttcgtgggcgacatgatgaaggacctgcccatcctgaagagcgacgaccccgtggtgcccagcctgttcaagcagaagaccagcgacgagctgctgcactggcacgcccagagactgctgagcgacgactacgacagaatcaagtgccacgtggacgagcagagcagagacccccacgtgctggacttcctgaagaagatccaggactaccagcagttctacggcaagagcctggagagcatcagcaccaaggtgatcgtgacccagaccaccagacccaaggaggacagcagcggcgccagcggcgagatcctgcagaacaccaagccccaccagatcaccaagaagagcaagaagaagagcttcctgaaggaggaccagaacaaggcccagcagaacgacgacctgctgttcagcatcgaggaggagatgaagaacaacctgcacagcggcatcagaaagctggaggactacctgaccagctgcgccagcaacagcgtgaagttcggcgtggagatgctgggcctgatcgcctgcttcaaggcctggaagaagcactgcagaggcgagggcaagatcagcaaggacctgagcatcgccgtgcagatgatgaagagaatccacagcctgctggagagataccccgagatcctggaggccgagcaccaccagtacatcgccaagtgcctgaagtacctgggcttcaacgacctggccaacagcctggaccccaccctgatcggcgacgacaagaacaagaagaagtacagcatcgacatcggccccgccagattccagctgcagtacatgggccactacctgatcagagacgagagaaaggacagagaccccagagtgcaggacttcatccccaacgcctggcagcaggagctgctggacgtggtggacaagaacgagagcgccgtgatcgtggcccccaccagcagcggcaagacctacgccagctactactgcatggagaaggtgctgagagagagcgacgtgggcgtggtggtgtacgtggcccccgccaagagcctggtgggccaggtggccgccaccgtggagaacagattcaccaagaccctgcccgccggcagaaccctgtgcggcgccttcaccagagactactgccacaacgtgctgaactgccaggtgctgatcaccgtgcccgagtgcttcgagatcctgctgctggccccccacagacagaagtgggtggagagaatcagatacgtgatcttcgacgaggtgcactacctgggcagagaggtgggcgccaagttctgggagctgctgctggtgatcatcagatgccccttcctggtgctgagcgccaccatcaacaaccccaacctgctgaccaagtggctgcagagcgtgaagcagtactggaagcaggccgacaagatcatggaggagaagtgcatcagcgagaagcaggccgacaagtgcctgaacttcctgcaggaccacagctacaagaaccagagctacgaggtgagactggtgctgtacggcgagagatacaacgacctggagaagcacatctgcagcgtgaagcacgacgacgtgtacttcgaccacttccacccctgcgccgccctgaccaccgacatcatcgagaagtacggcttcccccccgacctgaccctgaccccccaggagagcatccagctgtacgacaccatggcccaggtgtgggagacctggcccagagcccaggagctgtgccccgaggagttcatcctgttcaagaacaagatcgtgatcaagaagctggacgccagaaagtacgaggagaacctgaaggccgagctgaccaactggatcaagaacggccaggtgaagaaggtgaagagagtgctgaagaacctgagccccgacagcctgagcagcagcaaggacatggtgaagatgttccccctgctggtggagaagctgagacagatggacaagctgcccgccatcttcttcctgttcaagaacgacgacgtgggcaagagagccggcagcgtgtgcaccttcctggagaagaccgagaccaagagccacccccacaccgagtgccacagctacgtgttcgccatcgacgaggtgctggagaaggtgagaaagacccagaagagaatcagcaccaagaagaaccccaagaaggccgagaagctggagagaaagaaggtgtacagagccgagtacatcaacttcctggagaacctgaagatcctggagatcagcgaggactgcacctacgccgacgtgaaggccctgcacaccgagatcaccagaaacaaggacagcaccctggagagagtgctgcccagagtgagattcaccagacacggcaaggagctgaaggccctggcccagagaggcatcggctaccaccacagcagcatgtacttcaaggagaaggagttcgtggagatcctgttcgtgaagggcctgatcagagtggtgaccgccaccgagaccctggccctgggcatccacatgccctgcaagagcgtggtgttcgcccaggacagcgtgtacctggacgccctgaactacagacagatcatgtag

SEQ ID NO: 20419 - DNA, 5121 bp, Artificial Sequence; identical to SEQ ID NO: 20416
  Description of Artificial Sequence: Synthetic coding sequence

SEQ ID NO: 20420 - DNA, 234 bp, Artificial Sequence
  Description of Artificial Sequence: Synthetic coding sequence
atgggcagcaaggaccacgccgtgttcttcagagagatgacccagctgatcctgaacgagatgcccaaggccggctacagcagcatcctgaacgacttcgtggagagcaacttcttcgtgatcgacggcgacagcctgctggtgacctgcctgggcgtgaagagcttcaagtggggccagaacctgcacttcttctacctggtggagtgctacctggtggacctgctgagctag

SEQ ID NO: 20421 - DNA, 297 bp, Artificial Sequence
  Description of Artificial Sequence: Synthetic coding sequence
atgggcagcaaggaccacgccgtgttcttcagagagatgacccagctgatcctgaacgagatgcccaaggccggctacagcagcatcctgaacgacttcgtggagagcaacttcttcgtgatcgacggcgacagcctgctggtgacctgcctgggcgtgaagagcttcaagtggggccagaacctgcacttcttctacctggtggagtgctacctggtggacctgctgagcaacggcggccagttcaccatcgtgttcttcaaggacgccgagtacgcctacttcgacttcccctag

SEQ ID NO: 20422 - DNA, 2586 bp, Artificial Sequence
  Description of Artificial Sequence: Synthetic coding sequence
atgcccatcctgctgttcctgatcgacaccagcgccagcatgaaccagagaaccgacctgggcaccagctacctggacatcgccaagggcgccgtggagctgttcctgaagctgagagccagagaccccgccagcagaggcgacagatacatgctggtgacctacgacgagcccccctactgcatcaaggccggctggaaggagaaccacgccaccttcatgagcgagctgaagaacctgcaggccagcggcctgaccaccctgggccaggccctgagaagcagcttcgacctgctgaacctgaacagactgatcagcggcatcgacaactacggccagggcagaaaccccttcttcctggagcccagcatcctgatcaccatcaccgacggcaacaagctgaccagcaccgccggcgtgcaggaggagctgcacctgcccctgaacagccccctgcccggcagcgagctgaccaaggagcccttcagatgggaccagagactgttcgccctggtgctgagactgcccggcgtggccagcaccgagcccgagcagctgggcagcgtgcccaccgacgagagcgccatcacccagatgtgcgaggtgaccggcggcagaagctactgcgtgagaacccagagaatgctgaaccagtgcctggagagcctggtgcagaaggtgcagagcggcgtggtgatcaacttcgagaagaccggccccgaccccctgcccatcggcgaggacggcctgatggacagcagcagacccagcaacagcttcgccgcccagccctggcacagctgccacaagctgatctacgtgagacccaacagcaagaccggcgtgcccgtgggccactggcccatccccgagagcttctggcccgaccagaacctgcccagcctgccccccagaaccagccaccccgtggtgagattcagctgcgtggactgcgagcccatggtgatcgacaagctgcccttcgacaagtacgagctggagcccagccccctgacccagtacatcctggagagaaagagcccccacacctgctggcaggtgttcgtgaccagcagcggcaagtacaacgagctgggctaccccttcggctacctgaaggccagcaccaccctgacctgcgtgaacctgttcgtgatgccctacaactaccccgtgctgctgcccctgctggacgacctgttcaaggtgcacaagctgaagcccaacctgaagtggagacaggccttcgacagctacctgaagaccctgcccccctactacctgctgaccaagctggagagcgagagaatcctggccagcgtgggcaagaagcccccccaggagatcggcatcaaggtgaagaaccacagcggcggcggcatgagcctgacccacaacaagaacttcagaaagctgctgaaggagatcaccggcgagaccgccctgagactgaccgagctgaacaccaaggagttcgccggcttccagatcggcctgctgaacaaggacctgaagccccagacctacagaaacgcctacgacatccccagaagaggcctgctggaccagctgaccagaatgagaagcaacctgctgaagacccacaagttcatcgtgggccaggacgaggacagcctgcacagcgtgcccgtggcccagatgggcaactaccaggagtacctgaagaccctggccagccccctgagagagatcgaccccgaccagcccaagagactgcacaccttcggcaaccccttcaagcaggacaagaagggcatgatgatcgacgaggccgacgagttcgtggccggcccccagaacaaggtgaagagacccggcgagcccaacagccccatgagcagcaagagaagaagaagcatgagcctgctgctgagaaagccccagaccccccccaccgtgaccaaccacgtgggcggcaagggcccccccagcgccagctggttccccagctaccccaacctgatcaagcccaccctggtgcacaccgacgccaccatcatccacgacggccacgaggagaagatggagaacggccagatcacccccgacggcttcctgagcaagagcgcccccagcgagctgatcaacatgaccggcgacctgatgccccccaaccaggtggacagcctgagcgacgacttcaccagcctgagcaaggacggcctgatccagaagcccggcagcaacgccttcgtgggcggcgccaagaactgcagcctgagcgtggacgaccagaaggaccccgtggccagcaccctgggcgccatgcccaacaccctgcagatcacccccgccatggcccagggcatcaacgccgacatcaagcaccagctgatgaaggaggtgagaaagttcggcagaaagtacgagagaatcttcatcctgctggaggaggtgcagggccccctggagatgaagaagcagttcgtggagttcaccatcaaggaggccgccagattcaagagaagagtgctgatccagtacctggagaaggtgctggagaagatcaacagccaccacctgcacaacaacatcagccacatcaacagcagaagcagctgctag

SEQ ID NO: 20423 - DNA, 4161 bp, Artificial Sequence
  Description of Artificial Sequence: Synthetic coding sequence
atgagcagcagcgtgagaagaaagggcaagcccggcaagggcggcggcaagggcagcagcagaggcggcagaggcggcagaagccacgccagcaagagccacggcagcggcggcggcggcggcggcggcggcggcggcggcggcggcaacagaaaggccagcagcagaatctgggacgacggcgacgacttctgcatcttcagcgagagcagaagacccagcagacccagcaacagcaacatcagcaagggcgagagcagacccaagtggaagcccaaggccaaggtgcccctgcagaccctgcacatgaccagcgagaaccaggagaaggtgaaggccctgctgagagacctgcaggagcaggacgccgacgccggcagcgagagaggcctgagcggcgaggaggaggacgacgagcccgactgctgcaacgacgagagatactggcccgccggccaggagcccagcctggtgcccgacctggaccccctggagtacgccggcctggccagcgtggagccctacgtgcccgagttcaccgtgagccccttcgccgtgcagaagctgagcagatacggcttcaacaccgagagatgccaggccgtgctgagaatgtgcgacggcgacgtgggcgccagcctggagcacctgctgacccagtgcttcagcgagaccttcggcgagagaatgaagatcagcgaggccgtgaaccagatcagcctggacgagtgcatggagcagagacaggaggaggccttcgccctgaagagcatctgcggcgagaagttcatcgagagaatccagaacagagtgtggaccatcggcctggagctggagtacctgaccagcagattcagaaagagcaagcccaaggagagcaccaagaacgtgcaggagaacagcctggagatctgcaagttctacctgaagggcaactgcaagttcggcagcaagtgcagattcaagcacgaggtgccccccaaccagatcgtgggcagaatcgagagaagcgtggacgacagccacctgaacgccatcgaggacgccagcttcctgtacgagctggagatcagattcagcaaggaccacaagtacccctaccaggcccccctggtggccttctacagcaccaacgagaacctgcccctggcctgcagactgcacatcagcgagttcctgtacgacaaggccctgaccttcgccgagaccagcgagcccgtggtgtacagcctgatcaccctgctggaggaggagagcgagatcgtgaagctgctgaccaacacccaccacaagtacagcgacccccccgtgaacttcctgcccgtgcccagcagaaccagaatcaacaaccccgcctgccacaagaccgtgatccccaacaacagcttcgtgagcaaccagatccccgaggtggagaaggccagcgagagcgaggagagcgacgaggacgacggccccgcccccgtgatcgtggagaacgagagctacgtgaacctgaagaagaagatcagcaagagatacgactggcaggccaagagcgtgcacgccgagaacggcaagatctgcaagcagttcagaatgaagcaggccagcagacagttccagagcatcctgcaggagagacagagcctgcccgcctgggaggagagagagaccatcctgaacctgctgagaaagcaccaggtggtggtgatcagcggcatgaccggctgcggcaagaccacccagatcccccagttcatcctggacgacagcctgaacggcccccccgagaaggtggccaacatcatctgcacccagcccagaagaatcagcgccatcagcgtggccgagagagtggccaaggagagagccgagagagtgggcctgaccgtgggctaccagatcagactggagagcgtgaagagcagcgccaccagactgctgtactgcaccaccggcgtgctgctgagaagactggagggcgacaccgccctgcagggcgtgagccacatcatcgtggacgaggtgcacgagagaaccgaggagagcgacttcctgctgctggtgctgaaggacatcgtgagccagagacccggcctgcaggtgatcctgatgagcgccaccctgaacgccgagctgttcagcgactacttcaacagctgccccgtgatcaccatccccggcagaaccttccccgtggaccagttcttcctggaggacgccatcgccgtgaccagatacgtgctgcaggacggcagcccctacatgagaagcatgaagcagatcagcaaggagaagctgaaggccagaagaaacagaaccgccttcgaggaggtggaggaggacctgagactgagcctgcacctgcaggaccaggacagcgtgaaggacgccgtgcccgaccagcagctggacttcaagcagctgctggccagatacaagggcgtgagcaagagcgtgatcaagaccatgagcatcatggacttcgagaaggtgaacctggagctgatcgaggccctgctggagtggatcgtggacggcaagcacagctacccccccggcgccatcctggtgttcctgcccggcctggccgagatcaagatgctgtacgagcagctgcagagcaacagcctgttcaacaacagaagaagcaacagatgcgtgatccaccccctgcacagcagcctgagcagcgaggagcagcaggccgtgttcgtgaagccccccgccggcgtgaccaagatcatcatcagcaccaacatcgccgagaccagcatcaccatcgacgacgtggtgtacgtgatcgacagcggcaagatgaaggagaagagatacgacgccagcaagggcatggagagcctggaggacaccttcgtgagccaggccaacgccctgcagagaaagggcagagccggcagagtggccagcggcgtgtgcttccacctgttcaccagccaccactacaaccaccagctgctgaagcagcagctgcccgagatccagagagtgcccctggagcagctgtgcctgagaatcaagatcctggagatgttcagcgcccacaacctgcagagcgtgttcagcagactgatcgagcccccccacaccgacagcctgagagccagcaagatcagactgagagacctgggcgccctgacccccgacgagagactgacccccctgggctaccacctggccagcctgcccgtggacgtgagaatcggcaagctgatgctgttcggcagcatcttcagatgcctggaccccgccctgaccatcgccgccagcctggccttcaagagccccttcgtgagcccctgggacaagaaggaggaggccaaccagaagaagctggagttcgccttcgccaacagcgactacctggccctgctgcaggcctacaagggctggcagctgagcaccaaggagggcgtgagagccagctacaactactgcagacagaacttcctgagcggcagagtgctgcaggagatggccagcctgaagagacagttcaccgagctgctgagcgacatcggcttcgccagagagggcctgagagccagagagatcgagaagagagcccagggcggcgacggcgtgctggacgccaccggcgaggaggccaacagcaacgccgagaaccccaagctgatcagcgccatgctgtgcgccgccctgtaccccaacgtggtgcaggtgaagagccccgagggcaagttccagaagaccagcaccggcgccgtgagaatgcagcccaagagcgccgagctgaagttcgtgaccaagaacgacggctacgtgcacatccaccccagcagcgtgaactaccaggtgagacacttcgacagcccctacctgctgtaccacgagaagatcaagaccagcagagtgttcatcagagactgcagcatggtgagcgtgtaccccctggtgctgttcggcggcggccaggtgaacgtgcagctgcagagaggcgagttcgtggtgagcctggacgacggctggatcagattcgtggccgccagccaccaggtggccgagctggtgaaggagctgagatgcgagctggaccagctgctgcaggacaagatcaagaaccccagcatcgacctgtgcacctgccccagaggcagcagaatcatcagcaccatcgtgaagctggtgaccacccagtag

SEQ ID NO: 20424 - DNA, 1302 bp, Artificial Sequence
  Description of Artificial Sequence: Synthetic coding sequence
atgaccagcgagaaccaggagaaggtgaaggccctgctgagagacctgcaggagcaggacgccgacgccggcagcgagagaggcctgagcggcgaggaggaggacgacgagcccgactgctgcaacgacgagagatactggcccgccggccaggagcccagcctggtgcccgacctggaccccctggagtacgccggcctggccagcgtggagccctacgtgcccgagttcaccgtgagccccttcgccgtgcagaagctgagcagatacggcttcaacaccgagagatgccaggccgtgctgagaatgtgcgacggcgacgtgggcgccagcctggagcacctgctgacccagtgcttcagcgagaccttcggcgagagaatgaagatcagcgaggccgtgaaccagatcagcctggacgagtgcatggagcagagacaggaggaggccttcgccctgaagagcatctgcggcgagaagttcatcgagagaatccagaacagagtgtggaccatcggcctggagctggagtacctgaccagcagattcagaaagagcaagcccaaggagagcaccaagaacgtgcaggagaacagcctggagatctgcaagttctacctgaagggcaactgcaagttcggcagcaagtgcagattcaagcacgaggtgccccccaaccagatcgtgggcagaatcgagagaagcgtggacgacagccacctgaacgccatcgaggacgccagcttcctgtacgagctggagatcagattcagcaaggaccacaagtacccctaccaggcccccctggtggccttctacagcaccaacgagaacctgcccctggcctgcagactgcacatcagcgagttcctgtacgacaaggccctgaccttcgccgagaccagcgagcccgtggtgtacagcctgatcaccctgctggaggaggagagcgagatcgtgaagctgctgaccaacacccaccacaagtacagcgacccccccgtgaacttcctgcccgtgcccagcagaaccagaatcaacaaccccgcctgccacaagaccgtgatccccaacaacagcttcgtgagcaaccagatccccgaggtggagaaggccagcgagagcgaggagagcgacgaggacgacggccccgcccccgtgatcgtggagaacgagagctacgtgaacctgaagaagaagatcagcaagagatacgactggcaggccaagagcgtgcacgccgagaacggcaagatctgcaagcagttcagaatgaagcagatcctgcagagccacctgtag

SEQ ID NO: 20425 - DNA, 1731 bp, Artificial Sequence
  Description of Artificial Sequence: Synthetic coding sequence
atgcccccccccagaaccagagagggcagagacagaagagaccaccacagagcccccagcgaggaggaggccctggagaagtgggactggaactgccccgagaccagaagactgctggaggacgccttcttcagagaggaggactacatcagacagggcagcgaggagtgccagaagttctggaccttcttcgagagactgcagagattccagaacctgaagaccagcagaaaggaggagaaggaccccggccagcccaagcacagcatccccgccctggccgacctgcccagaacctacgaccccagatacagaatcaacctgagcgtgctgggccccgccaccagaggcagccagggcctgggcagacacctgcccgccgagagagtggccgagttcagaagagccctgctgcactacctggacttcggccagaagcaggccttcggcagactggccaagctgcagagagagagagccgccctgcccatcgcccagtacggcaacagaatcctgcagaccctgaaggagcaccaggtggtggtggtggccggcgacaccggctgcggcaagagcacccaggtgccccagtacctgctggccgccggcttcagccacgtggcctgcacccagcccagaagaatcgcctgcatcagcctggccaagagagtgggcttcgagagcctgagccagtacggcagccaggtgggctaccagatcagattcgagagcaccagaagcgccgccaccaagatcgtgttcctgaccgtgggcctgctgctgagacagatccagagagagcccagcctgccccagtacgaggtgctgatcgtggacgaggtgcacgagagacacctgcacaacgacttcctgctgggcgtgctgcagagactgctgcccaccagacccgacctgaaggtgatcctgatgagcgccaccatcaacatcagcctgttcagcagctacttcagcaacgcccccgtggtgcaggtgcccggcagactgttccccatcaccgtgttcgacgtggccccccccggcgtgagaaagtgcatcctgagcaccaacatcgccgagaccagcgtgaccatcgacggcatcagattcgtggtggacagcggcaaggtgaaggagatgagctacgacccccaggccaagctgcagagactgcaggagttctggatcagccaggccagcgccgagcagagaaagggcagagccggcagaaccggccccggcgtgtgcttcagactgtacgccgagagcgactacgacgccttcgccccctaccccgtgcccgagatcagaagagtggccctggacagcctggtgctgcagatgaagagcatgagcgtgggcgaccccagaaccttccccttcatcgagccccccccccccgccagcctggagaccgccatcctgtacctgagagaccagggcgccctggacagcagcgaggccctgacccccatcggcagcctgctggcccagctgcccgtggacgtggtgatcggcaagatgctgatcctgggcagcatgttcagcctggtggagcccgtgctgaccatcgccgccgccctgagcgtgcagagccccttcaccagaagcgcccagagcagccccgagtgctgcaccccccccgccagcagcctggccgcccccagatgctgcacccacagaagctggagacccgccaccgccaccgaggccgagaccaccagaaccagatag

SEQ ID NO: 20426 - DNA, 3432 bp, Artificial Sequence
  Description of Artificial Sequence: Synthetic coding sequence
atgcccccccccagaaccagagagggcagagacagaagagaccaccacagagcccccagcgaggaggaggccctggagaagtgggactggaactgccccgagaccagaagactgctggaggacgccttcttcagagaggaggactacatcagacagggcagcgaggagtgccagaagttctggaccttcttcgagagactgcagagattccagaacctgaagaccagcagaaaggaggagaaggaccccggccagcccaagcacagcatccccgccctggccgacctgcccagaacctacgaccccagatacagaatcaacctgagcgtgctgggccccgccaccagaggcagccagggcctgggcagacacctgcccgccgagagagtggccgagttcagaagagccctgctgcactacctggacttcggccagaagcaggccttcggcagactggccaagctgcagagagagagagccgccctgcccatcgcccagtacggcaacagaatcctgcagaccctgaaggagcaccaggtggtggtggtggccggcgacaccggctgcggcaagagcacccaggtgccccagtacctgctggccgccggcttcagccacgtggcctgcacccagcccagaagaatcgcctgcatcagcctggccaagagagtgggcttcgagagcctgagccagtacggcagccaggtgggctaccagatcagattcgagagcaccagaagcgccgccaccaagatcgtgttcctgaccgtgggcctgctgctgagacagatccagagagagcccagcctgccccagtacgaggtgctgatcgtggacgaggtgcacgagagacacctgcacaacgacttcctgctgggcgtgctgcagagactgctgcccaccagacccgacctgaaggtgatcctgatgagcgccaccatcaacatcagcctgttcagcagctacttcagcaacgcccccgtggtgcaggtgcccggcagactgttccccatcaccgtggtgtaccagccccaggaggccgagcccaccaccagcaagagcgagaagctggaccccagacccttcctgagagtgctggagagcatcgaccacaagtacccccccgaggagagaggcgacctgctggtgttcctgagcggcatggccgagatcagcgccgtgctggaggccgcccagacctacgccagccacacccagagatgggtggtgctgcccctgcacagcgccctgagcgtggccgaccaggacaaggtgttcgacgtggccccccccggcgtgagaaagtgcatcctgagcaccaacatcgccgagaccagcgtgaccatcgacggcatcagattcgtggtggacagcggcaaggtgaaggagatgagctacgacccccaggccaagctgcagagactgcaggagttctggatcagccaggccagcgccgagcagagaaagggcagagccggcagaaccggccccggcgtgtgcttcagactgtacgccgagagcgactacgacgccttcgccccctaccccgtgcccgagatcagaagagtggccctggacagcctggtgctgcagatgaagagcatgagcgtgggcgaccccagaaccttccccttcatcgagccccccccccccgccagcctggagaccgccatcctgtacctgagagaccagggcgccctggacagcagcgaggccctgacccccatcggcagcctgctggcccagctgcccgtggacgtggtgatcggcaagatgctgatcctgggcagcatgttcagcctggtggagcccgtgctgaccatcgccgccgccctgagcgtgcagagccccttcaccagaagcgcccagagcagccccgagtgcgccgccgccagaagacccctggagagcgaccagggcgaccccttcaccctgttcaacgtgttcaacgcctgggtgcaggtgaagagcgagagaagcagaaacagcagaaagtggtgcagaagaagaggcatcgaggagcacagactgtacgagatggccaacctgagaagacagttcaaggagctgctggaggaccacggcctgctggccggcgcccaggccgcccaggtgggcgacagctacagcagactgcagcagagaagagagagaagagccctgcaccagctgaagagacagcacgaggagggcgccggcagaagaagaaaggtgctgagactgcaggaggagcaggacggcggcagcagcgacgaggacagagccggccccgccccccccggcgccagcgacggcgtggacatccaggacgtgaagttcaagctgagacacgacctggcccagctgcaggccgccgccagcagcgcccaggacctgagcagagagcagctggccctgctgaagctggtgctgggcagaggcctgtacccccagctggccgtgcccgacgccttcaacagcagcagaaaggacagcgaccagatcttccacacccaggccaagcagggcgccgtgctgcaccccacctgcgtgttcgccggcagccccgaggtgctgcacgcccaggagctggaggccagcaactgcgacggcagcagagacgacaaggacaagatgagcagcaagcaccagctgctgagcttcgtgagcctgctggagaccaacaagccctacctggtgaactgcgtgagaatccccgccctgcagagcctgctgctgttcagcagaagcctggacaccaacggcgactgcagcagactggtggccgacggctggctggagctgcagctggccgacagcgagagcgccatcagactgctggccgccagcctgagactgagagccagatgggagagcgccctggacagacagctggcccaccaggcccagcagcagctggaggaggaggaggaggacacccccgtgagccccaaggaggtggccaccctgagcaaggagctgctgcagttcaccgccagcaagatcccctacagcctgagaagactgaccggcctggaggtgcagaacatgtacgtgggcccccagaccatccccgccaccccccacctgcccggcctgttcggcagcagcaccctgagcccccaccccaccaagggcggctacgccgtgaccgacttcctgacctacaactgcctgaccaacgacaccgacctgtacagcgactgcctgagaaccttctggacctgcccccactgcggcctgcacgcccccctgacccccctggagagaatcgcccacgagaacacctgcccccaggccccccaggacggcccccccggcgccgaggaggccgccctggagaccctgcagaagaccagcgtgctgcagagaccctaccactgcgaggcctgcggcaaggacttcctgttcacccccaccgaggtgctgagacacagaaagcagcacgtgtag

SEQ ID NO: 20427 - DNA, 3474 bp, Artificial Sequence
  Description of Artificial Sequence: Synthetic coding sequence
atgggcaagctgagaagaagatacaacatcaagggcagacagcaggccggccccggccccagcaagggcccccccgagcccccccccgtgcagctggagctggaggacaaggacaccctgaagggcgtggacgccagcaacgccctggtgctgcccggcaagaagaagaagaagaccaaggccccccccctgagcaagaaggagaagaagcccctgaccaagaaggagaagaaggtgctgcagaagatcctggagcagaaggagaagaagagccagagagccgagatgctgcagaagctgagcgaggtgcaggccagcgaggccgagatgagactgttctacaccaccagcaagctgggcaccggcaacagaatgtaccacaccaaggagaaggccgacgaggtggtggcccccggccaggagaagatcagcagcctgagcggcgcccacagaaagagaagaagatggcccagcgccgaggaggaggaggaggaggaggaggagagcgagagcgagctggaggaggagagcgagctggacgaggaccccgccgccgagcccgccgaggccggcgtgggcaccaccgtggcccccctgccccccgcccccgcccccagcagccagcccgtgcccgccggcatgaccgtgccccccccccccgccgccgccccccccctgcccagagccctggccaagcccgccgtgttcatccccgtgaacagaagccccgagatgcaggaggagagactgaagctgcccatcctgagcgaggagcaggtgatcatggaggccgtggccgagcaccccatcgtgatcgtgtgcggcgagaccggcagcggcaagaccacccaggtgccccagttcctgtacgaggccggcttcagcagcgaggacagcatcatcggcgtgaccgagcccagaagagtggccgccgtggccatgagccagagagtggccaaggagatgaacctgagccagagagtggtgagctaccagatcagatacgagggcaacgtgaccgaggagaccagaatcaagttcatgaccgacggcgtgctgctgaaggagatccagaaggacttcctgctgctgagatacaaggtggtgatcatcgacgaggcccacgagagaagcgtgtacaccgacatcctgatcggcctgctgagcagaatcgtgaccctgagagccaagagaaacctgcccctgaagctgctgatcatgagcgccaccctgagagtggaggacttcacccagaaccccagactgttcgccaagcccccccccgtgatcaaggtggagagcagacagttccccgtgaccgtgcacttcaacaagagaacccccctggaggactacagcggcgagtgcttcagaaaggtgtgcaagatccacagaatgctgcccgccggcggcatcctggtgttcctgaccggccaggccgaggtgcacgccctgtgcagaagactgagaaaggccttcccccccagcagagccagaccccaggagaaggacgacgaccagaaggacagcgtggaggagatgagaaagttcaagaagagcagagccagagccaagaaggccagagccgaggtgctgccccagatcaacctggaccactacagcgtgctgcccgccggcgagggcgacgaggacagagaggccgaggtggacgaggaggagggcgccctggacagcgacctggacctggacctgggcgacggcggccaggacggcggcgagcagcccgacgccagcctgcccctgcacgtgctgcccctgtacagcctgctggcccccgagaagcaggcccaggtgttcaagcccccccccgagggcaccagactgtgcgtggtggccaccaacgtggccgagaccagcctgaccatccccggcatcaagtacgtggtggactgcggcaaggtgaagaagagatactacgacagagtgaccggcgtgagcagcttcagagtgacctgggtgagccaggccagcgccgaccagagagccggcagagccggcagaaccgagcccggccactgctacagactgtacagcagcgccgtgttcggcgacttcgagcagttccccccccccgagatcaccagaagacccgtggaggacctgatcctgcagatgaaggccctgaacgtggagaaggtgatcaacttccccttccccaccccccccagcgtggaggccctgctggccgccgaggagctgctgatcgccctgggcgccctgcagcccccccagaaggccgagagagtgaagcagctgcaggagaacagactgagctgccccatcaccgccctgggcagaaccatggccaccttccccgtggcccccagatacgccaagatgctggccctgagcagacagcacggctgcctgccctacgccatcaccatcgtggccagcatgaccgtgagagagctgttcgaggagctggacagacccgccgccagcgacgaggagctgaccagactgaagagcaagagagccagagtggcccagatgaagagaacctgggccggccagggcgccagcctgaagctgggcgacctgatggtgctgctgggcgccgtgggcgcctgcgagtacgccagctgcaccccccagttctgcgaggccaacggcctgagatacaaggccatgatggagatcagaagactgagaggccagctgaccaccgccgtgaacgccgtgtgccccgaggccgagctgttcgtggaccccaagatgcagccccccaccgagagccaggtgacctacctgagacagatcgtgaccgccggcctgggcgaccacctggccagaagagtgcagagcgaggagatgctggaggacaagtggagaaacgcctacaagacccccctgctggacgaccccgtgttcatccaccccagcagcgtgctgttcaaggagctgcccgagttcgtggtgtaccaggagatcgtggagaccaccaagatgtacatgaagggcgtgagcagcgtggaggtgcagtggatccccgccctgctgcccagctactgccagttcgacaagcccctggaggagcccgcccccacctactgccccgagagaggcagagtgctgtgccacagagccagcgtgttctacagagtgggctggcccctgcccgccatcgaggtggacttccccgagggcatcgacagatacaagcacttcgccagattcctgctggagggccaggtgttcagaaagctggccagctacagaagctgcctgctgagcagccccggcaccatgctgaagacctgggccagactgcagcccagaaccgagagcctgctgagagccctggtggccgagaaggccgactgccacgaggccctgctggccgcctggaagaagaaccccaagtacctgctggccgagtactgcgagtggctgccccaggccatgcaccccgacatcgagaaggcctggccccccaccaccgtgcactag

SEQ ID NO: 20428 - DNA, 1851 bp, Artificial Sequence
  Description of Artificial Sequence: Synthetic coding sequence
atgtgcctggagaagagatacctggacgtgctgagcgacgtgaccggcccccaggtgagctgctacatcaccgcccccagctacgtgctgcagcagctggagtgcagaatcatcaaccacatgagcagcctgatcgtgggcgacaacgaggagctggtgagcaacgtgatcaccatcgagtgcagcgacaaggagaagagagtgcccttccccatcggcatcgccatccccttcaccgccagatacagaggcaactacagagacatcatggtgaaggtgtgcgacatcaacctgcagagcagctacctgaaccccaacagcctggagggcatgaagggcggctacaagggcacctgcgccagcgtgaaggtgtacaagctgggcatcttcagcgtggtgagctgcctgaagaaggagagcttcaccgtgaccaagaagggcctggccctgaagagcagcatggacagcagaatcagcctgaactacccccccggcgtgttcaccagccccgtgctggtgcagctgaagatccagcccgtggaccccgccctggtggcccacctgaaggcccagcaggacaccttctacagcgtgcagagcaccagccccctgatccacatccagcaccccagcacctaccccttccagaagcccgtgaccctgttcctgccctgcagcccctacctggacaagaacaacctgggcagcgagatcgaccacaagagaagagccagcgccaccatcaacagaatcacccccagctacttcaacagaaccaagatcgccagcatcagaaagcccagaaagaacgccagcgagtgcctgaagctgctgggcttcagaagccaggacagcggctggtgcggcctggacgacgtggtgaagaccatccagagcggcctggtgagcgtggagctgtacgagcacctggagagattcatcgtgctgcacctgagcagcaccatggacaacagccacctggtgaccttcgtgaagagcctggaggaggccatgctgagcaccaccgcctgcatcgtgctgagccaccagaaggacaacccccacagaatcgccgtgctggtggtgcccagcaaggacctgagccaggtgctgaaggacctgcacctggagggcttcggcggcccccccgagcccagcagacacttccaggtgagagagggcgagcagctgctgctgagattcaccggcaacatcttcgccagcagcaacggcaaggactacggcaaggactacaccctgatcttccacctgcagagaaagcccagactggagctgcagatcaaggaggtggacgagttcggcaactacagctgcccccactacaagggcaccatcgtggtgtacaaggtgcccaagggcaagatcgtgcccaacctgaaccagagcctggtgatcaacgagaaccacagccagctgcccatctgcaagctgcccctgaagctgcccaagcacaagaagctgatcaacagaccccagagcaccaagagagtgagcaaggaccccgtggaggccctgtgggacaacctgctgcactggctggccgaggagctgagcgaggagaacgccgagagcctgagcagcaccctgcccctgagaagaagcaccatccagctgatcaagctgaagaaccccgacgacctgaccgagcagatccacgagttcctgtgcttctggaagaagagcctgcccaccttcaccgacaagctgagactgctggccagacacctgagaaagatcggcagaagcgacctggccgaggagctgaagttcaagtgggagaacaaggtgttcaccgagccccagcagtgcttcgacgtggcccccgagtag

SEQ ID NO: 20429 - DNA, 2346 bp, Artificial Sequence
  Description of Artificial Sequence: Synthetic coding sequence
atgcacgacgagtgcaccccccagcagaccatgagcagcatccaggacaccaaggccgccgacatcgccgccagaggcgagctgaacgtgatcgagaccgccaccgtgagccccaccaacggcgaggagagccactacaccaaccaggtgcagctggagaagaacaagacccacatgagcagcgccctggtggagaaggagaacaacaccagcctgaacggcagagtgctgggccaggaggagagccagaacaagatgttccccgacaacgccgagaacgaggacgacaagcagatcgagcacatgaccgtggagaacatcaacggcaacagagaggagacccacggcatcatccagaccaccgagaccgagatccaggagaccagcgagagccccagagaggagatgaccaccagcagcatcatctgcgacatcagcaagaagtacatcaacagcaccctgcccaacgacagcgagaacatcaagcacaagaacaacatcatggagaaggagtacctggacgtgctgagcgacgtgaccggcccccaggtgagctgctacatcaccgcccccagctacgtgctgcagcagctggagtgcagaatcatcaaccacatgagcagcctgatcgtgggcgacaacgaggagctggtgagcaacgtgatcaccatcgagtgcagcgacaaggagaagagagtgcccttccccatcggcatcgccatccccttcaccgccagatacagaggcaactacagagacatcatggtgaaggtgtgcgacatcaacctgcagagcagctacctgaaccccaacagcctggagggcatgaagggcggctacaagggcacctgcgccagcgtgaaggtgtacaagctgggcatcttcagcgtggtgagctgcctgaagaaggagagcttcaccgtgaccaagaagggcctggccctgaagagcagcatggacagcagaatcagcctgaactacccccccggcgtgttcaccagccccgtgctggtgcagctgaagatccagcccgtggaccccgccctggtggcccacctgaaggcccagcaggacaccttctacagcgtgcagagcaccagccccctgatccacatccagcaccccagcacctaccccttccagaagcccgtgaccctgttcctgccctgcagcccctacctggacaagaacaacctgggcagcgagatcgaccacaagagaagagccagcgccaccatcaacagaatcacccccagctacttcaacagaaccaagatcgccagcatcagaaagcccagaaagaacgccagcgagtgcctgaagctgctgggcttcagaagccaggacagcggctggtgcggcctggacgacgtggtgaagaccatccagagcggcctggtgagcgtggagctgtacgagcacctggagagattcatcgtgctgcacctgagcagcaccatggacaacagccacctggtgaccttcgtgaagagcctggaggaggccatgctgagcaccaccgcctgcatcgtgctgagccaccagaaggacaacccccacagaatcgccgtgctggtggtgcccagcaaggacctgagccaggtgctgaaggacctgcacctggagggcttcggcggcccccccgagcccagcagacacttccaggtgagagagggcgagcagctgctgctgagattcaccggcaacatcttcgccagcagcaacggcaaggactacggcaaggactacaccctgatcttccacctgcagagaaagcccagactggagctgcagatcaaggaggtggacgagttcggcaactacagctgcccccactacaagggcaccatcgtggtgtacaaggtgcccaagggcaagatcgtgcccaacctgaaccagagcctggtgatcaacgagaaccacagccagctgcccatctgcaagctgcccctgaagctgcccaagcacaagaagctgatcaacagaccccagagcaccaagagagtgagcaaggaccccgtggaggccctgtgggacaacctgctgcactggctggccgaggagctgagcgaggagaacgccgagagcctgagcagcaccctgcccctgagaagaagcaccatccagctgatcaagctgaagaaccccgacgacctgaccgagcagatccacgagttcctgtgcttctggaagaagagcctgcccaccttcaccgacaagctgagactgctggccagacacctgagaaagatcggcagaagcgacctggccgaggagctgaagttcaagtgggagaacaaggtgttcaccgagccccagcagtgcttcgacgtggcccccgagtag

SEQ ID NO: 20430 - DNA, 6390 bp, Artificial Sequence
  Description of Artificial Sequence: Synthetic coding sequence
atggccgagagaagagccttcgcccagaagatcagcagaaccgtggccgccgaggtgagaaagcagatcagcggccagtacagcggcagcccccagctgctgaagaacctgaacatcgtgggcaacatcagccaccacaccaccgtgcccctgaccgaggccgtggaccccgtggacctggaggactacctgatcacccaccccctggccgtggacagcggccccctgagagacctgatcgagttcccccccgacgacatcgaggtggtgtacagccccagagactgcagaaccctggtgagcgccgtgcccgaggagagcgagatggacccccacgtgagagactgcatcagaagctacaccgaggactgggccatcgtgatcagaaagtaccacaagctgggcaccggcttcaaccccaacaccctggacaagcagaaggagagacagaagggcctgcccaagcaggtgttcgagagcgacgaggcccccgacggcaacagctaccaggacgaccaggacgacctgaagagaagaagcatgagcatcgacgacacccccagaggcagctgggcctgcagcatcttcgacctgaagaacagcctgcccgacgccctgctgcccaacctgctggacagaacccccaacgaggagatcgacagacagaacgacgaccagagaaagagcaacagacacaaggagctgttcgccctgcaccccagccccgacgaggaggagcccatcgagagactgagcgtgcccgacatccccaaggagcacttcggccagagactgctggtgaagtgcctgagcctgaagttcgagatcgagatcgagcccatcttcgccagcctggccctgtacgacgtgaaggagaagaagaagatcagcgagaacttctacttcgacctgaacagcgagcagatgaagggcctgctgagaccccacgtgccccccgccgccatcaccaccctggccagaagcgccatcttcagcatcacctaccccagccaggacgtgttcctggtgatcaagctggagaaggtgctgcagcagggcgacatcggcgagtgcgccgagccctacatgatcttcaaggaggccgacgccaccaagaacaaggagaagctggagaagctgaagagccaggccgaccagttctgccagagactgggcaagtacagaatgcccttcgcctggaccgccatccacctgatgaacatcgtgagcagcgccggcagcctggagagagacagcaccgaggtggagatcagcaccggcgagagaaagggcagctggagcgagagaagaaacagcagcatcgtgggcagaagaagcctggagagaaccaccagcggcgacgacgcctgcaacctgaccagcttcagacccgccaccctgaccgtgaccaacttcttcaagcaggagggcgacagactgagcgacgaggacctgtacaagttcctggccgacatgagaagacccagcagcgtgctgagaagactgagacccatcaccgcccagctgaagatcgacatcagccccgcccccgagaacccccactactgcctgacccccgagctgctgcaggtgaagctgtaccccgacagcagagtgagacccaccagagagatcctggagttccccgccagagacgtgtacgtgcccaacaccacctacagaaacctgctgtacatctacccccagagcctgaacttcgccaacagacagggcagcgccagaaacatcaccgtgaaggtgcagttcatgtacggcgaggaccccagcaacgccatgcccgtgatcttcggcaagagcagctgcagcgagttcagcaaggaggcctacaccgccgtggtgtaccacaacagaagccccgacttccacgaggagatcaaggtgaagctgcccgccaccctgaccgaccaccaccacctgctgttcaccttctaccacgtgagctgccagcagaagcagaacacccccctggagacccccgtgggctacacctggatccccatgctgcagaacggcagactgaagaccggccagttctgcctgcccgtgagcctggagaagcccccccaggcctacagcgtgctgagccccgaggtgcccctgcccggcatgaagtgggtggacaaccacaagggcgtgttcaacgtggaggtggtggccgtgagcagcatccacacccaggacccctacctggacaagttcttcgccctggtgaacgccctggacgagcacctgttccccgtgagaatcggcgacatgagaatcatggagaacaacctggagaacgagctgaagagcagcatcagcgccctgaacagcagccagctggagcccgtggtgagattcctgcacctgctgctggacaagctgatcctgctggtgatcagaccccccgtgatcgccggccagatcgtgaacctgggccaggccagcttcgaggccatggccagcatcatcaacagactgcacaagaacctggagggcaaccacgaccagcacggcagaaacagcctgctggccagctacatccactacgtgttcagactgcccaacacctaccccaacagcagcagccccggccccggcggcctgggcggcagcgtgcactacgccaccatggccagaagcgccgtgagacccgccagcctgaacctgaacagaagcagaagcctgagcaacagcaaccccgacatcagcggcacccccaccagccccgacgacgaggtgagaagcatcatcggcagcaagggcctggacagaagcaacagctgggtgaacaccggcggccccaaggccgccccctggggcagcaaccccagccccagcgccgagagcacccaggccatggacagaagctgcaacagaatgagcagccacaccgagaccagcagcttcctgcagaccctgaccggcagactgcccaccaagaagctgttccacgaggagctggccctgcagtgggtggtgtgcagcggcagcgtgagagagagcgccctgcagcaggcctggttcttcttcgagctgatggtgaagagcatggtgcaccacctgtacttcaacgacaagctggaggcccccagaaagagcagattccccgagagattcatggacgacatcgccgccctggtgagcaccatcgccagcgacatcgtgagcagattccagaaggacaccgagatggtggagagactgaacaccagcctggccttcttcctgaacgacctgctgagcgtgatggacagaggcttcgtgttcagcctgatcaagagctgctacaagcaggtgagcagcaagctgtacagcctgcccaaccccagcgtgctggtgagcctgagactggacttcctgagaatcatctgcagccacgagcactacgtgaccctgaacctgccctgcagcctgctgaccccccccgccagccccagccccagcgtgagcagcgccaccagccagagcagcggcttcagcaccaacgtgcaggaccagaagatcgccaacatgttcgagctgagcgtgcccttcagacagcagcactacctggccggcctggtgctgaccgagctggccgtgatcctggaccccgacgccgagggcctgttcggcctgcacaagaaggtgatcaacatggtgcacaacctgctgagcagccacgacagcgaccccagatacagcgacccccagatcaaggccagagtggccatgctgtacctgcccctgatcggcatcatcatggagaccgtgccccagctgtacgacttcaccgagacccacaaccagagaggcagacccatctgcatcgccaccgacgactacgagagcgagagcggcagcatgatcagccagaccgtggccatggccatcgccggcaccagcgtgccccagctgaccagacccggcagcttcctgctgaccagcaccagcggcagacagcacaccaccttcagcgccgagagcagcagaagcctgctgatctgcctgctgtgggtgctgaagaacgccgacgagaccgtgctgcagaagtggttcaccgacctgagcgtgctgcagctgaacagactgctggacctgctgtacctgtgcgtgagctgcttcgagtacaagggcaagaaggtgttcgagagaatgaacagcctgaccttcaagaagagcaaggacatgagagccaagctggaggaggccatcctgggcagcatcggcgccagacaggagatggtgagaagaagcagaggccagctggagagaagccccagcggcagcgccttcggcagccaggagaacctgagatggagaaaggacatgacccactggagacagaacaccgagaagctggacaagagcagagccgagatcgagcacgaggccctgatcgacggcaacctggccaccgaggccaacctgatcatcctggacaccctggagatcgtggtgcagaccgtgagcgtgaccgagagcaaggagagcatcctgggcggcgtgctgaaggtgctgctgcacagcatggcctgcaaccagagcgccgtgtacctgcagcactgcttcgccacccagagagccctggtgagcaagttccccgagctgctgttcgaggaggagaccgagcagtgcgccgacctgtgcctgagactgctgagacactgcagcagcagcatcggcaccatcagaagccacgccagcgccagcctgtacctgctgatgagacagaacttcgagatcggcaacaacttcgccagagtgaagatgcaggtgaccatgagcctgagcagcctggtgggcaccagccagaacttcaacgaggagttcctgagaagaagcctgaagaccatcctgacctacgccgaggaggacctggagctgagagagaccaccttccccgaccaggtgcaggacctggtgttcaacctgcacatgatcctgagcgacaccgtgaagatgaaggagcaccaggaggaccccgagatgctgatcgacctgatgtacagaatcgccaagggctaccagaccagccccgacctgagactgacctggctgcagaacatggccggcaagcacagcgagagaagcaaccacgccgaggccgcccagtgcctggtgcacagcgccgccctggtggccgagtacctgagcatgctggaggacagaaagtacctgcccgtgggctgcgtgaccttccagaacatcagcagcaacgtgctggaggagagcgccgtgagcgacgacgtggtgagccccgacgaggagggcatctgcagcggcaagtacttcaccgagagcggcctggtgggcctgctggagcaggccgccgccagcttcagcatggccggcatgtacgaggccgtgaacgaggtgtacaaggtgctgatccccatccacgaggccaacagagacgccaagaagctgagcaccatccacggcaagctgcaggaggccttcagcaagatcgtgcaccaggacggcaagagaatgttcggcacctacttcagagtgggcttctacggcaccaagttcggcgacctggacgagcaggagttcgtgtacaaggagcccgccatcaccaagctggccgagatcagccacagactggagggcttctacggcgagagattcggcgaggacgtggtggaggtgatcaaggacagcaaccccgtggacaagtgcaagctggaccccaacaaggcctacatccagatcacctacgtggagccctacttcgacacctacgagatgaaggacagaatcacctacttcgacaagaactacaacctgagaagattcatgtactgcacccccttcaccctggacggcagagcccacggcgagctgcacgagcagttcaagagaaagaccatcctgaccaccagccacgccttcccctacatcaagaccagagtgaacgtgacccacaaggaggagatcatcctgacccccatcgaggtggccatcgaggacatgcagaagaagacccaggagctggccttcgccacccaccaggaccccgccgaccccaagatgctgcagatggtgctgcagggcagcgtgggcaccaccgtgaaccagggccccctggaggtggcccaggtgttcctgagcgagatccccagcgaccccaagctgttcagacaccacaacaagctgagactgtgcttcaaggacttcaccaagagatgcgaggacgccctgagaaagaacaagagcctgatcggccccgaccagaaggagtaccagagagagctggagagaaactaccacagactgaaggaggccctgcagcccctgatcaacagaaagatcccccagctgtacaaggccgtgctgcccgtgacctgccacagagacagcttcagcagaatgagcctgagaaagatggacctgtag

SEQ ID NO: 20431 - DNA, 6330 bp, Artificial Sequence
  Description of Artificial Sequence: Synthetic coding sequence
atggccgagagaagagccttcgcccagaagatcagcagaaccgtggccgccgaggtgagaaagcagatcagcggccagtacagcggcagcccccagctgctgaagaacctgaacatcgtgggcaacatcagccaccacaccaccgtgcccctgaccgaggccgtggaccccgtggacctggaggactacctgatcacccaccccctggccgtggacagcggccccctgagagacctgatcgagttcccccccgacgacatcgaggtggtgtacagccccagagactgcagaaccctggtgagcgccgtgcccgaggagagcgagatggacccccacgtgagagactgcatcagaagctacaccgaggactgggccatcgtgatcagaaagtaccacaagctgggcaccggcttcaaccccaacaccctggacaagcagaaggagagacagaagggcctgcccaagcaggtgttcgagagcgacgaggcccccgacggcaacagctaccaggacgaccaggacgacctgaagagaagaagcatgagcatcgacgacacccccagaggcagctgggcctgcagcatcttcgacctgaagaacagcctgcccgacgccctgctgcccaacctgctggacagaacccccaacgaggagatcgacagacagaacgacgaccagagaaagagcaacagacacaaggagctgttcgccctgcaccccagccccgacgaggaggagcccatcgagagactgagcgtgcccgacatccccaaggagcacttcggccagagactgctggtgaagtgcctgagcctgaagttcgagatcgagatcgagcccatcttcgccagcctggccctgtacgacgtgaaggagaagaagaagatcagcgagaacttctacttcgacctgaacagcgagcagatgaagggcctgctgagaccccacgtgccccccgccgccatcaccaccctggccagaagcgccatcttcagcatcacctaccccagccaggacgtgttcctggtgatcaagctggagaaggtgctgcagcagggcgacatcggcgagtgcgccgagccctacatgatcttcaaggaggccgacgccaccaagaacaaggagaagctggagaagctgaagagccaggccgaccagttctgccagagactgggcaagtacagaatgcccttcgcctggaccgccatccacctgatgaacatcgtgagcagcgccggcagcctggagagagacagcaccgaggtggagatcagcaccggcgagagaaagggcagctggagcgagagaagaaacagcagcatcgtgggcagaagaagcctggagagaaccaccagcggcgacgacgcctgcaacctgaccagcttcagacccgccaccctgaccgtgaccaacttcttcaagcaggagggcgacagactgagcgacgaggacctgtacaagttcctggccgacatgagaagacccagcagcgtgctgagaagactgagacccatcaccgcccagctgaagatcgacatcagccccgcccccgagaacccccactactgcctgacccccgagctgctgcaggtgaagctgtaccccgacagcagagtgagacccaccagagagatcctggagttccccgccagagacgtgtacgtgcccaacaccacctacagaaacctgctgtacatctacccccagagcctgaacttcgccaacagacagggcagcgccagaaacatcaccgtgaaggtgcagttcatgtacggcgaggaccccagcaacgccatgcccgtgatcttcggcaagagcagctgcagcgagttcagcaaggaggcctacaccgccgtggtgtaccacaacagaagccccgacttccacgaggagatcaaggtgaagctgcccgccaccctgaccgaccaccaccacctgctgttcaccttctaccacgtgagctgccagcagaagcagaacacccccctggagacccccgtgggctacacctggatccccatgctgcagaacggcagactgaagaccggccagttctgcctgcccgtgagcctggagaagcccccccaggcctacagcgtgctgagccccgaggtgcccctgcccggcatgaagtgggtggacaaccacaagggcgtgttcaacgtggaggtggtggccgtgagcagcatccacacccaggacccctacctggacaagttcttcgccctggtgaacgccctggacgagcacctgttccccgtgagaatcggcgacatgagaatcatggagaacaacctggagaacgagctgaagagcagcatcagcgccctgaacagcagccagctggagcccgtggtgagattcctgcacctgctgctggacaagctgatcctgctggtgatcagaccccccgtgatcgccggccagatcgtgaacctgggccaggccagcttcgaggccatggccagcatcatcaacagactgcacaagaacctggagggcaaccacgaccagcacggcagaaacagcctgctggccagctacatccactacgtgttcagactgcccaacacctaccccaacagcagcagccccggccccggcggcctgggcggcagcgtgcactacgccaccatggccagaagcgccgtgagacccgccagcctgaacctgaacagaagcagaagcctgagcaacagcaaccccgacatcagcggcacccccaccagccccgacgacgaggtgagaagcatcatcggcagcaaggccatggacagaagctgcaacagaatgagcagccacaccgagaccagcagcttcctgcagaccctgaccggcagactgcccaccaagaagctgttccacgaggagctggccctgcagtgggtggtgtgcagcggcagcgtgagagagagcgccctgcagcaggcctggttcttcttcgagctgatggtgaagagcatggtgcaccacctgtacttcaacgacaagctggaggcccccagaaagagcagattccccgagagattcatggacgacatcgccgccctggtgagcaccatcgccagcgacatcgtgagcagattccagaaggacaccgagatggtggagagactgaacaccagcctggccttcttcctgaacgacctgctgagcgtgatggacagaggcttcgtgttcagcctgatcaagagctgctacaagcaggtgagcagcaagctgtacagcctgcccaaccccagcgtgctggtgagcctgagactggacttcctgagaatcatctgcagccacgagcactacgtgaccctgaacctgccctgcagcctgctgaccccccccgccagccccagccccagcgtgagcagcgccaccagccagagcagcggcttcagcaccaacgtgcaggaccagaagatcgccaacatgttcgagctgagcgtgcccttcagacagcagcactacctggccggcctggtgctgaccgagctggccgtgatcctggaccccgacgccgagggcctgttcggcctgcacaagaaggtgatcaacatggtgcacaacctgctgagcagccacgacagcgaccccagatacagcgacccccagatcaaggccagagtggccatgctgtacctgcccctgatcggcatcatcatggagaccgtgccccagctgtacgacttcaccgagacccacaaccagagaggcagacccatctgcatcgccaccgacgactacgagagcgagagcggcagcatgatcagccagaccgtggccatggccatcgccggcaccagcgtgccccagctgaccagacccggcagcttcctgctgaccagcaccagcggcagacagcacaccaccttcagcgccgagagcagcagaagcctgctgatctgcctgctgtgggtgctgaagaacgccgacgagaccgtgctgcagaagtggttcaccgacctgagcgtgctgcagctgaacagactgctggacctgctgtacctgtgcgtgagctgcttcgagtacaagggcaagaaggtgttcgagagaatgaacagcctgaccttcaagaagagcaaggacatgagagccaagctggaggaggccatcctgggcagcatcggcgccagacaggagatggtgagaagaagcagaggccagctgggcacctacaccatcgccagcccccccgagagaagccccagcggcagcgccttcggcagccaggagaacctgagatggagaaaggacatgacccactggagacagaacaccgagaagctggacaagagcagagccgagatcgagcacgaggccctgatcgacggcaacctggccaccgaggccaacctgatcatcctggacaccctggagatcgtggtgcagaccgtgagcgtgaccgagagcaaggagagcatcctgggcggcgtgctgaaggtgctgctgcacagcatggcctgcaaccagagcgccgtgtacctgcagcactgcttcgccacccagagagccctggtgagcaagttccccgagctgctgttcgaggaggagaccgagcagtgcgccgacctgtgcctgagactgctgagacactgcagcagcagcatcggcaccatcagaagccacgccagcgccagcctgtacctgctgatgagacagaacttcgagatcggcaacaacttcgccagagtgaagatgcaggtgaccatgagcctgagcagcctggtgggcaccagccagaacttcaacgaggagttcctgagaagaagcctgaagaccatcctgacctacgccgaggaggacctggagctgagagagaccaccttccccgaccaggtgcaggacctggtgttcaacctgcacatgatcctgagcgacaccgtgaagatgaaggagcaccaggaggaccccgagatgctgatcgacctgatgtacagaatcgccaagggctaccagaccagccccgacctgagactgacctggctgcagaacatggccggcaagcacagcgagagaagcaaccacgccgaggccgcccagtgcctggtgcacagcgccgccctggtggccgagtacctgagcatgctggaggacagaaagtacctgcccgtgggctgcgtgaccttccagaacatcagcagcaacgtgctggaggagagcgccgtgagcgacgacgtggtgagccccgacgaggagggcatctgcagcggcaagtacttcaccgagagcggcctggtgggcctgctggagcaggccgccgccagcttcagcatggccggcatgtacgaggccgtgaacgaggtgtacaaggtgctgatccccatccacgaggccaacagagacgccaagaagctgagcaccatccacggcaagctgcaggaggccttcagcaagatcgtgcaccagagcaccggctgggagagaatgttcggcacctacttcagagtgggcttctacggcaccaagttcggcgacctggacgagcaggagttcgtgtacaaggagcccgccatcaccaagctggccgagatcagccacagactggagggcttctacggcgagagattcggcgaggacgtggtggaggtgatcaaggacagcaaccccgtggacaagtgcaagctggaccccaacaaggcctacatccagatcacctacgtggagccctacttcgacacctacgagatgaaggacagaatcacctacttcgacaagaactacaacctgagaagattcatgtactgcacccccttcaccctggacggcagagcccacggcgagctgcacgagcagttcaagagaaagaccatcctgaccaccagccacgccttcccctacatcaagaccagagtgaacgtgacccacaaggaggagatcatcctgacccccatcgaggtggccatcgaggacatgcagaagaagacccaggagctggccttcgccacccaccaggaccccgccgaccccaagatgctgcagatggtgctgcagggcagcgtgggcaccaccgtgaaccagggccccctggaggtggcccaggtgttcctgagcgagatccccagcgaccccaagctgttcagacaccacaacaagctgagactgtgcttcaaggacttcaccaagagatgcgaggacgccctgagaaagaacaagagcctgatcggccccgaccagaaggagtaccagagagagctggagagaaactaccacagactgaaggaggccctgcagcccctgatcaacagaaagatcccccagctgtacaaggccgtgctgcccgtgacctgccacagagacagcttcagcagaatgagcctgagaaagatggacctgtag

SEQ ID NO: 20432 - DNA, 6423 bp, Artificial Sequence
  Description of Artificial Sequence: Synthetic coding sequence
atggccgagagaagagccttcgcccagaagatcagcagaaccgtggccgccgaggtgagaaagcagatcagcggccagtacagcggcagcccccagctgctgaagaacctgaacatcgtgggcaacatcagccaccacaccaccgtgcccctgaccgaggccgtggaccccgtggacctggaggactacctgatcacccaccccctggccgtggacagcggccccctgagagacctgatcgagttcccccccgacgacatcgaggtggtgtacagccccagagactgcagaaccctggtgagcgccgtgcccgaggagagcgagatggacccccacgtgagagactgcatcagaagctacaccgaggactgggccatcgtgatcagaaagtaccacaagctgggcaccggcttcaaccccaacaccctggacaagcagaaggagagacagaagggcctgcccaagcaggtgttcgagagcgacgaggcccccgacggcaacagctaccaggacgaccaggacgacctgaagagaagaagcatgagcatcgacgacacccccagaggcagctgggcctgcagcatcttcgacctgaagaacagcctgcccgacgccctgctgcccaacctgctggacagaacccccaacgaggagatcgacagacagaacgacgaccagagaaagagcaacagacacaaggagctgttcgccctgcaccccagccccgacgaggaggagcccatcgagagactgagcgtgcccgacatccccaaggagcacttcggccagagactgctggtgaagtgcctgagcctgaagttcgagatcgagatcgagcccatcttcgccagcctggccctgtacgacgtgaaggagaagaagaagatcagcgagaacttctacttcgacctgaacagcgagcagatgaagggcctgctgagaccccacgtgccccccgccgccatcaccaccctggccagaagcgccatcttcagcatcacctaccccagccaggacgtgttcctggtgatcaagctggagaaggtgctgcagcagggcgacatcggcgagtgcgccgagccctacatgatcttcaaggaggccgacgccaccaagaacaaggagaagctggagaagctgaagagccaggccgaccagttctgccagagactgggcaagtacagaatgcccttcgcctggaccgccatccacctgatgaacatcgtgagcagcgccggcagcctggagagagacagcaccgaggtggagatcagcaccggcgagagaaagggcagctggagcgagagaagaaacagcagcatcgtgggcagaagaagcctggagagaaccaccagcggcgacgacgcctgcaacctgaccagcttcagacccgccaccctgaccgtgaccaacttcttcaagcaggagggcgacagactgagcgacgaggacctgtacaagttcctggccgacatgagaagacccagcagcgtgctgagaagactgagacccatcaccgcccagctgaagatcgacatcagccccgcccccgagaacccccactactgcctgacccccgagctgctgcaggtgaagctgtaccccgacagcagagtgagacccaccagagagatcctggagttccccgccagagacgtgtacgtgcccaacaccacctacagaaacctgctgtacatctacccccagagcctgaacttcgccaacagacagggcagcgccagaaacatcaccgtgaaggtgcagttcatgtacggcgaggaccccagcaacgccatgcccgtgatcttcggcaagagcagctgcagcgagttcagcaaggaggcctacaccgccgtggtgtaccacaacagaagccccgacttccacgaggagatcaaggtgaagctgcccgccaccctgaccgaccaccaccacctgctgttcaccttctaccacgtgagctgccagcagaagcagaacacccccctggagacccccgtgggctacacctggatccccatgctgcagaacggcagactgaagaccggccagttctgcctgcccgtgagcctggagaagcccccccaggcctacagcgtgctgagccccgaggtgcccctgcccggcatgaagtgggtggacaaccacaagggcgtgttcaacgtggaggtggtggccgtgagcagcatccacacccaggacccctacctggacaagttcttcgccctggtgaacgccctggacgagcacctgttccccgtgagaatcggcgacatgagaatcatggagaacaacctggagaacgagctgaagagcagcatcagcgccctgaacagcagccagctggagcccgtggtgagattcctgcacctgctgctggacaagctgatcctgctggtgatcagaccccccgtgatcgccggccagatcgtgaacctgggccaggccagcttcgaggccatggccagcatcatcaacagactgcacaagaacctggagggcaaccacgaccagcacggcagaaacagcctgctggccagctacatccactacgtgttcagactgcccaacacctaccccaacagcagcagccccggccccggcggcctgggcggcagcgtgcactacgccaccatggccagaagcgccgtgagacccgccagcctgaacctgaacagaagcagaagcctgagcaacagcaaccccgacatcagcggcacccccaccagccccgacgacgaggtgagaagcatcatcggcagcaagggcctggacagaagcaacagctgggtgaacaccggcggccccaaggccgccccctggggcagcaaccccagccccagcgccgagagcacccaggccatggacagaagctgcaacagaatgagcagccacaccgagaccagcagcttcctgcagaccctgaccggcagactgcccaccaagaagctgttccacgaggagctggccctgcagtgggtggtgtgcagcggcagcgtgagagagagcgccctgcagcaggcctggttcttcttcgagctgatggtgaagagcatggtgcaccacctgtacttcaacgacaagctggaggcccccagaaagagcagattccccgagagattcatggacgacatcgccgccctggtgagcaccatcgccagcgacatcgtgagcagattccagaaggacaccgagatggtggagagactgaacaccagcctggccttcttcctgaacgacctgctgagcgtgatggacagaggcttcgtgttcagcctgatcaagagctgctacaagcaggtgagcagcaagctgtacagcctgcccaaccccagcgtgctggtgagcctgagactggacttcctgagaatcatctgcagccacgagcactacgtgaccctgaacctgccctgcagcctgctgaccccccccgccagccccagccccagcgtgagcagcgccaccagccagagcagcggcttcagcaccaacgtgcaggaccagaagatcgccaacatgttcgagctgagcgtgcccttcagacagcagcactacctggccggcctggtgctgaccgagctggccgtgatcctggaccccgacgccgagggcctgttcggcctgcacaagaaggtgatcaacatggtgcacaacctgctgagcagccacgacagcgaccccagatacagcgacccccagatcaaggccagagtggccatgctgtacctgcccctgatcggcatcatcatggagaccgtgccccagctgtacgacttcaccgagacccacaaccagagaggcagacccatctgcatcgccaccgacgactacgagagcgagagcggcagcatgatcagccagaccgtggccatggccatcgccggcaccagcgtgccccagctgaccagacccggcagcttcctgctgaccagcaccagcggcagacagcacaccaccttcagcgccgagagcagcagaagcctgctgatctgcctgctgtgggtgctgaagaacgccgacgagaccgtgctgcagaagtggttcaccgacctgagcgtgctgcagctgaacagactgctggacctgctgtacctgtgcgtgagctgcttcgagtacaagggcaagaaggtgttcgagagaatgaacagcctgaccttcaagaagagcaaggacatgagagccaagctggaggaggccatcctgggcagcatcggcgccagacaggagatggtgagaagaagcagaggccagctgggcacctacaccatcgccagcccccccgagagaagccccagcggcagcgccttcggcagccaggagaacctgagatggagaaaggacatgacccactggagacagaacaccgagaagctggacaagagcagagccgagatcgagcacgaggccctgatcgacggcaacctggccaccgaggccaacctgatcatcctggacaccctggagatcgtggtgcagaccgtgagcgtgaccgagagcaaggagagcatcctgggcggcgtgctgaaggtgctgctgcacagcatggcctgcaaccagagcgccgtgtacctgcagcactgcttcgccacccagagagccctggtgagcaagttccccgagctgctgttcgaggaggagaccgagcagtgcgccgacctgtgcctgagactgctgagacactgcagcagcagcatcggcaccatcagaagccacgccagcgccagcctgtacctgctgatgagacagaacttcgagatcggcaacaacttcgccagagtgaagatgcaggtgaccatgagcctgagcagcctggtgggcaccagccagaacttcaacgaggagttcctgagaagaagcctgaagaccatcctgacctacgccgaggaggacctggagctgagagagaccaccttccccgaccaggtgcaggacctggtgttcaacctgcacatgatcctgagcgacaccgtgaagatgaaggagcaccaggaggaccccgagatgctgatcgacctgatgtacagaatcgccaagggctaccagaccagccccgacctgagactgacctggctgcagaacatggccggcaagcacagcgagagaagcaaccacgccgaggccgcccagtgcctggtgcacagcgccgccctggtggccgagtacctgagcatgctggaggacagaaagtacctgcccgtgggctgcgtgaccttccagaacatcagcagcaacgtgctggaggagagcgccgtgagcgacgacgtggtgagccccgacgaggagggcatctgcagcggcaagtacttcaccgagagcggcctggtgggcctgctggagcaggccgccgccagcttcagcatggccggcatgtacgaggccgtgaacgaggtgtacaaggtgctgatccccatccacgaggccaacagagacgccaagaagctgagcaccatccacggcaagctgcaggaggccttcagcaagatcgtgcaccagaccaccatctggaagagaatgttcggcacctacttcagagtgggcttctacggcaccaagttcggcgacctggacgagcaggagttcgtgtacaaggagcccgccatcaccaagctggccgagatcagccacagactggagggcttctacggcgagagattcggcgaggacgtggtggaggtgatcaaggacagcaaccccgtggacaagtgcaagctggaccccaacaaggcctacatccagatcacctacgtggagccctacttcgacacctacgagatgaaggacagaatcacctacttcgacaagaactacaacctgagaagattcatgtactgcacccccttcaccctggacggcagagcccacggcgagctgcacgagcagttcaagagaaagaccatcctgaccaccagccacgccttcccctacatcaagaccagagtgaacgtgacccacaaggaggagatcatcctgacccccatcgaggtggccatcgaggacatgcagaagaagacccaggagctggccttcgccacccaccaggaccccgccgaccccaagatgctgcagatggtgctgcagggcagcgtgggcaccaccgtgaaccagggccccctggaggtggcccaggtgttcctgagcgagatccccagcgaccccaagctgttcagacaccacaacaagctgagactgtgcttcaaggacttcaccaagagatgcgaggacgccctgagaaagaacaagagcctgatcggccccgaccagaaggagtaccagagagagctggagagaaactaccacagactgaaggaggccctgcagcccctgatcaacagaaagatcccccagctgtacaaggccgtgctgcccgtgacctgccacagagacagcttcagcagaatgagcctgagaaagatggacctgtag

SEQ ID NO: 20433 - DNA, 2799 bp, Artificial Sequence
  Description of Artificial Sequence: Synthetic coding sequence
atgttcgagctgagcgtgcccttcagacagcagcactacctggccggcctggtgctgaccgagctggccgtgatcctggaccccgacgccgagggcctgttcggcctgcacaagaaggtgatcaacatggtgcacaacctgctgagcagccacgacagcgaccccagatacagcgacccccagatcaaggccagagtggccatgctgtacctgcccctgatcggcatcatcatggagaccgtgccccagctgtacgacttcaccgacctgagcgtgctgcagctgaacagactgctggacctgctgtacctgtgcgtgagctgcttcgagtacaagggcaagaaggtgttcgagagaatgaacagcctgaccttcaagaagagcaaggacatgagagccaagctggaggaggccatcctgggcagcatcggcgccagacaggagatggtgagaagaagcagaggccagctggagagaagccccagcggcagcgccttcggcagccaggagaacctgagatggagaaaggacatgacccactggagacagaacaccgagaagctggacaagagcagagccgagatcgagcacgaggccctgatcgacggcaacctggccaccgaggccaacctgatcatcctggacaccctggagatcgtggtgcagaccgtgagcgtgaccgagagcaaggagagcatcctgggcggcgtgctgaaggtgctgctgcacagcatggcctgcaaccagagcgccgtgtacctgcagcactgcttcgccacccagagagccctggtgagcaagttccccgagctgctgttcgaggaggagaccgagcagtgcgccgacctgtgcctgagactgctgagacactgcagcagcagcatcggcaccatcagaagccacgccagcgccagcctgtacctgctgatgagacagaacttcgagatcggcaacaacttcgccagagtgaagatgcaggtgaccatgagcctgagcagcctggtgggcaccagccagaacttcaacgaggagttcctgagaagaagcctgaagaccatcctgacctacgccgaggaggacctggagctgagagagaccaccttccccgaccaggtgcaggacctggtgttcaacctgcacatgatcctgagcgacaccgtgaagatgaaggagcaccaggaggaccccgagatgctgatcgacctgatgtacagaatcgccaagggctaccagaccagccccgacctgagactgacctggctgcagaacatggccggcaagcacagcgagagaagcaaccacgccgaggccgcccagtgcctggtgcacagcgccgccctggtggccgagtacctgagcatgctggaggacagaaagtacctgcccgtgggctgcgtgaccttccagaacatcagcagcaacgtgctggaggagagcgccgtgagcgacgacgtggtgagccccgacgaggagggcatctgcagcggcaagtacttcaccgagagcggcctggtgggcctgctggagcaggccgccgccagcttcagcatggccggcatgtacgaggccgtgaacgaggtgtacaaggtgctgatccccatccacgaggccaacagagacgccaagaagctgagcaccatccacggcaagctgcaggaggccttcagcaagatcgtgcaccagagcaccggctgggagagaatgttcggcacctacttcagagtgggcttctacggcaccaagttcggcgacctggacgagcaggagttcgtgtacaaggagcccgccatcaccaagctggccgagatcagccacagactggagggcttctacggcgagagattcggcgaggacgtggtggaggtgatcaaggacagcaaccccgtggacaagtgcaagctggaccccaacaaggcctacatccagatcacctacgtggagccctacttcgacacctacgagatgaaggacagaatcacctacttcgacaagaactacaacctgagaagattcatgtactgcacccccttcaccctggacggcagagcccacggcgagctgcacgagcagttcaagagaaagaccatcctgaccaccagccacgccttcccctacatcaagaccagagtgaacgtgacccacaaggaggagatcatcctgacccccatcgaggtggccatcgaggacatgcagaagaagacccaggagctggccttcgccacccaccaggaccccgccgaccccaagatgctgcagatggtgctgcagggcagcgtgggcaccaccgtgaaccagggccccctggaggtggcccaggtgttcctgagcgagatccccagcgaccccaagctgttcagacaccacaacaagctgagactgtgcttcaaggacttcaccaagagatgcgaggacgccctgagaaagaacaagagcctgatcggccccgaccagaaggagtaccagagagagctggagagaaactaccacagactgaaggaggccctgcagcccctgatcaacagaaagatcccccagctgtacaaggccaccaactacgtgctgagcttcttcagccagagattcctgcagagcaacgagcccagccagaacggcagcctggagtgcacctgcttcatccacctgcagagagccatgtacagcaccagcagcgtgaagagaagcatcggcaagcagcacggcatggagttctggaagctgctgttcatcgaggagtgcagcggccaggagaacatcaagtgcagactgctgaccctggagaaccacggctacggcttctag

SEQ ID NO: 20434 - DNA, 1899 bp, Artificial Sequence
  Description of Artificial Sequence: Synthetic coding sequence
atggccgagagaagagccttcgcccagaagatcagcagaaccgtggccgccgaggtgagaaagcagatcagcggccagtacagcggcagcccccagctgctgaagaacctgaacatcgtgggcaacatcagccaccacaccaccgtgcccctgaccgaggccgtggaccccgtggacctggaggactacctgatcacccaccccctggccgtggacagcggccccctgagagacctgatcgagttcccccccgacgacatcgaggtggtgtacagccccagagactgcagaaccctggtgagcgccgtgcccgaggagagcgagatggacccccacgtgagagactgcatcagaagctacaccgaggactgggccatcgtgatcagaaagtaccacaagctgggcaccggcttcaaccccaacaccctggacaagcagaaggagagacagaagggcctgcccaagcaggtgttcgagagcgacgaggcccccgacggcaacagctaccaggacgaccaggacgacctgaagagaagaagcatgagcatcgacgacacccccagaggcagctgggcctgcagcatcttcgacctgaagaacagcctgcccgacgccctgctgcccaacctgctggacagaacccccaacgaggagatcgacagacagaacgacgaccagagaaagagcaacagacacaaggagctgttcgccctgcaccccagccccgacgaggaggagcccatcgagagactgagcgtgcccgacatccccaaggagcacttcggccagagactgctggtgaagtgcctgagcctgaagttcgagatcgagatcgagcccatcttcgccagcctggccctgtacgacgtgaaggagaagaagaagatcagcgagaacttctacttcgacctgaacagcgagcagatgaagggcctgctgagaccccacgtgccccccgccgccatcaccaccctggccagaagcgccatcttcagcatcacctaccccagccaggacgtgttcctggtgatcaagctggagaaggtgctgcagcagggcgacatcggcgagtgcgccgagccctacatgatcttcaaggaggccgacgccaccaagaacaaggagaagctggagaagctgaagagccaggccgaccagttctgccagagactgggcaagtacagaatgcccttcgcctggaccgccatccacctgatgaacatcgtgagcagcgccggcagcctggagagagacagcaccgaggtggagatcagcaccggcgagagaaagggcagctggagcgagagaagaaacagcagcatcgtgggcagaagaagcctggagagaaccaccagcggcgacgacgcctgcaacctgaccagcttcagacccgccaccctgaccgtgaccaacttcttcaagcaggagggcgacagactgagcgacgaggacctgtacaagttcctggccgacatgagaagacccagcagcgtgctgagaagactgagacccatcaccgcccagctgaagatcgacatcagccccgcccccgagaacccccactactgcctgacccccgagctgctgcaggtgaagctgtaccccgacagcagagtgagacccaccagagagatcctggagttccccgccagagacgtgtacgtgcccaacaccacctacagaaacctgctgtacatctacccccagagcctgaacttcgccaacagacagggcagcgccagaaacatcaccgtgaaggtgcagttcatgtacggcgaggaccccagcaacgccatgcccagccccagctgcacccaccccatccccaccgtgagacccctgcccctgtggtgctaccacagcatcttcagcctgctgagctgggacttcatcacctag

SEQ ID NO: 20435 - DNA, 3912 bp, Artificial Sequence
  Description of Artificial Sequence: Synthetic coding sequence
tgaaagaacctggagggcaaccacgaccagcacggcagaaacagcctgctggccagctacatccactacgtgttcagactgcccaacacctaccccaacagcagcagccccggccccggcggcctgggcggcagcgtgcactacgccaccatggccagaagcgccgtgagacccgccagcctgaacctgaacagaagcagaagcctgagcaacagcaaccccgacatcagcggcacccccaccagccccgacgacgaggtgagaagcatcatcggcagcaagggcctggacagaagcaacagctgggtgaacaccggcggccccaaggccgccccctggggcagcaaccccagccccagcgccgagagcacccaggccatggacagaagctgcaacagaatgagcagccacaccgagaccagcagcttcctgcagaccctgaccggcagactgcccaccaagaagctgttccacgaggagctggccctgcagtgggtggtgtgcagcggcagcgtgagagagagcgccctgcagcaggcctggttcttcttcgagctgatggtgaagagcatggtgcaccacctgtacttcaacgacaagctggaggcccccagaaagagcagattccccgagagattcatggacgacatcgccgccctggtgagcaccatcgccagcgacatcgtgagcagattccagaaggacaccgagatggtggagagactgaacaccagcctggccttcttcctgaacgacctgctgagcgtgatggacagaggcttcgtgttcagcctgatcaagagctgctacaagcaggtgagcagcaagctgtacagcctgcccaaccccagcgtgctggtgagcctgagactggacttcctgagaatcatctgcagccacgagcactacgtgaccctgaacctgccctgcagcctgctgaccccccccgccagccccagccccagcgtgagcagcgccaccagccagagcagcggcttcagcaccaacgtgcaggaccagaagatcgccaacatgttcgagctgagcgtgcccttcagacagcagcactacctggccggcctggtgctgaccgagctggccgtgatcctggaccccgacgccgagggcctgttcggcctgcacaagaaggtgatcaacatggtgcacaacctgctgagcagccacgacagcgaccccagatacagcgacccccagatcaaggccagagtggccatgctgtacctgcccctgatcggcatcatcatggagaccgtgccccagctgtacgacttcaccgagacccacaaccagagaggcagacccatctgcatcgccaccgacgactacgagagcgagagcggcagcatgatcagccagaccgtggccatggccatcgccggcaccagcgtgccccagctgaccagacccggcagcttcctgctgaccagcaccagcggcagacagcacaccaccttcagcgccgagagcagcagaagcctgctgatctgcctgctgtgggtgctgaagaacgccgacgagaccgtgctgcagaagtggttcaccgacctgagcgtgctgcagctgaacagactgctggacctgctgtacctgtgcgtgagctgcttcgagtacaagggcaagaaggtgttcgagagaatgaacagcctgaccttcaagaagagcaaggacatgagagccaagctggaggaggccatcctgggcagcatcggcgccagacaggagatggtgagaagaagcagaggccagctggagagaagccccagcggcagcgccttcggcagccaggagaacctgagatggagaaaggacatgacccactggagacagaacaccgagaagctggacaagagcagagccgagatcgagcacgaggccctgatcgacggcaacctggccaccgaggccaacctgatcatcctggacaccctggagatcgtggtgcagaccgtgagcgtgaccgagagcaaggagagcatcctgggcggcgtgctgaaggtgctgctgcacagcatggcctgcaaccagagcgccgtgtacctgcagcactgcttcgccacccagagagccctggtgagcaagttccccgagctgctgttcgaggaggagaccgagcagtgcgccgacctgtgcctgagactgctgagacactgcagcagcagcatcggcaccatcagaagccacgccagcgccagcctgtacctgctgatgagacagaacttcgagatcggcaacaacttcgccagagtgaagatgcaggtgaccatgagcctgagcagcctggtgggcaccagccagaacttcaacgaggagttcctgagaagaagcctgaagaccatcctgacctacgccgaggaggacctggagctgagagagaccaccttccccgaccaggtgcaggacctggtgttcaacctgcacatgatcctgagcgacaccgtgaagatgaaggagcaccaggaggaccccgagatgctgatcgacctgatgtacagaatcgccaagggctaccagaccagccccgacctgagactgacctggctgcagaacatggccggcaagcacagcgagagaagcaaccacgccgaggccgcccagtgcctggtgcacagcgccgccctggtggccgagtacctgagcatgctggaggacagaaagtacctgcccgtgggctgcgtgaccttccagaacatcagcagcaacgtgctggaggagagcgccgtgagcgacgacgtggtgagccccgacgaggagggcatctgcagcggcaagtacttcaccgagagcggcctggtgggcctgctggagcaggccgccgccagcttcagcatggccggcatgtacgaggccgtgaacgaggtgtacaaggtgctgatccccatccacgaggccaacagagacgccaagaagctgagcaccatccacggcaagctgcaggaggccttcagcaagatcgtgcaccagagcaccggctgggagagaatgttcggcacctacttcagagtgggcttctacggcaccaagttcggcgacctggacgagcaggagttcgtgtacaaggagcccgccatcaccaagctggccgagatcagccacagactggagggcttctacggcgagagattcggcgaggacgtggtggaggtgatcaaggacagcaaccccgtggacaagtgcaagctggaccccaacaaggcctacatccagatcacctacgtggagccctacttcgacacctacgagatgaaggacagaatcacctacttcgacaagaactacaacctgagaagattcatgtactgcacccccttcaccctggacggcagagcccacggcgagctgcacgagcagttcaagagaaagaccatcctgaccaccagccacgccttcccctacatcaagaccagagtgaacgtgacccacaaggaggagatcatcctgacccccatcgaggtggccatcgaggacatgcagaagaagacccaggagctggccttcgccacccaccaggaccccgccgaccccaagatgctgcagatggtgctgcagggcagcgtgggcaccaccgtgaaccagggccccctggaggtggcccaggtgttcctgagcgagatccccagcgaccccaagctgttcagacaccacaacaagctgagactgtgcttcaaggacttcaccaagagatgcgaggacgccctgagaaagaacaagagcctgatcggccccgaccagaaggagtaccagagagagctggagagaaactaccacagactgaaggaggccctgcagcccctgatcaacagaaagatcccccagctgtacaaggccgtgctgcccgtgacctgccacagagacagcttcagcagaatgagcctgagaaagatggacctgtag

SEQ ID NO: 20436 - DNA, 6282 bp, Artificial Sequence
  Description of Artificial Sequence: Synthetic coding sequence
atgagccagccccccctgctgcccgccagcgccgagaccagaaagttcaccagagccctgagcaagcccggcaccgccgccgagctgagacagagcgtgagcgaggtggtgagaggcagcgtgctgctggccaagcccaagctgatcgagcccctggactacgagaacgtgatcgtgcagaagaagacccagatcctgaacgactgcctgagagagatgctgctgttcccctacgacgacttccagaccgccatcctgagaagacagggcagatacatctgcagcaccgtgcccgccaaggccgaggaggaggcccagagcctgttcgtgaccgagtgcatcaagacctacaacagcgactggcacctggtgaactacaagtacgaggactacagcggcgagttcagacagctgcccaacaaggtggtgaagctggacaagctgcccgtgcacgtgtacgaggtggacgaggaggtggacaaggacgaggacgccgccagcctgggcagccagaagggcggcatcaccaagcacggctggctgtacaagggcaacatgaacagcgccatcagcgtgaccatgagaagcttcaagagaagattcttccacctgatccagctgggcgacggcagctacaacctgaacttctacaaggacgagaagatcagcaaggagcccaagggcagcatcttcctggacagctgcatgggcgtggtgcagaacaacaaggtgagaagattcgccttcgagctgaagatgcaggacaagagcagctacctgctggccgccgacagcgaggtggagatggaggagtggatcaccatcctgaacaagatcctgcagctgaacttcgaggccgccatgcaggagaagagaaacggcgacagccacgaggacgacgagcagagcaagctggagggcagcggcagcggcctggacagctacctgcccgagctggccaagagcgccagagaggccgagatcaagctgaagagcgagagcagagtgaagctgttctacctggaccccgacgcccagaagctggacttcagcagcgccgagcccgaggtgaagagcttcgaggagaagttcggcaagagaatcctggtgaagtgcaacgacctgagcttcaacctgcagtgctgcgtggccgagaacgaggagggccccaccaccaacgtggagcccttcttcgtgaccctgagcctgttcgacatcaagtacaacagaaagatcagcgccgacttccacgtggacctgaaccacttcagcgtgagacagatgctggccaccaccagccccgccctgatgaacggcagcggccagagccccagcgtgctgaagggcatcctgcacgaggccgccatgcagtaccccaagcagggcatcttcagcgtgacctgcccccaccccgacatcttcctggtggccagaatcgagaaggtgctgcagggcagcatcacccactgcgccgagccctacatgaagagcagcgacagcagcaaggtggcccagaaggtgctgaagaacgccaagcaggcctgccagagactgggccagtacagaatgcccttcgcctgggccgccagaaccctgttcaaggacgccagcggcaacctggacaagaacgccagattcagcgccatctacagacaggacagcaacaagctgagcaacgacgacatgctgaagctgctggccgacttcagaaagcccgagaagatggccaagctgcccgtgatcctgggcaacctggacatcaccatcgacaacgtgagcagcgacttccccaactacgtgaacagcagctacatccccaccaagcagttcgagacctgcagcaagacccccatcaccttcgaggtggaggagttcgtgccctgcatccccaagcacacccagccctacaccatctacaccaaccacctgtacgtgtaccccaagtacctgaagtacgacagccagaagagcttcgccaaggccagaaacatcgccatctgcatcgagttcaaggacagcgacgaggaggacagccagcccctgaagtgcatctacggcagacccggcggccccgtgttcaccagaagcgccttcgccgccgtgctgcaccaccaccagaaccccgagttctacgacgagatcaagatcgagctgcccacccagctgcacgagaagcaccacctgctgctgaccttcttccacgtgagctgcgacaacagcagcaagggcagcaccaagaagagagacgtggtggagacccaggtgggctacagctggctgcccctgctgaaggacggcagagtggtgaccagcgagcagcacatccccgtgagcgccaacctgcccagcggctacctgggctaccaggagctgggcatgggcagacactacggccccgagatcaagtgggtggacggcggcaagcccctgctgaagatcagcacccacctggtgagcaccgtgtacacccaggaccagcacctgcacaacttcttccagtactgccagaagaccgagagcggcgcccaggccctgggcaacgagctggtgaagtacctgaagagcctgcacgccatggagggccacgtgatgatcgccttcctgcccaccatcctgaaccagctgttcagagtgctgaccagagccacccaggaggaggtggccgtgaacgtgaccagagtgatcatccacgtggtggcccagtgccacgaggagggcctggagagccacctgagaagctacgtgaagtacgcctacaaggccgagccctacgtggccagcgagtacaagaccgtgcacgaggagctgaccaagagcatgaccaccatcctgaagcccagcgccgacttcctgaccagcaacaagctgctgaagtacagctggttcttcttcgacgtgctgatcaagagcatggcccagcacctgatcgagaacagcaaggtgaagctgctgagaaaccagagattccccgccagctaccaccacgccgtggagaccgtggtgaacatgctgatgccccacatcacccagaagttcagagacaaccccgaggccagcaagaacgccaaccacagcctggccgtgttcatcaagagatgcttcaccttcatggacagaggcttcgtgttcaagcagatcaacaactacatcagctgcttcgcccccggcgaccccaagaccctgttcgagtacaagttcgagttcctgagagtggtgtgcaaccacgagcactacatccccctgaacctgcccatgcccttcggcaagggcagaatccagagataccaggacctgcagctggactacagcctgaccgacgagttctgcagaaaccacttcctggtgggcctgctgctgagagaggtgggcaccgccctgcaggagttcagagaggtgagactgatcgccatcagcgtgctgaagaacctgctgatcaagcacagcttcgacgacagatacgccagcagaagccaccaggccagaatcgccaccctgtacctgcccctgttcggcctgctgatcgagaacgtgcagagaatcaacgtgagagacgtgagccccttccccgtgaacgccggcatgaccgtgaaggacgagagcctggccctgcccgccgtgaaccccctggtgaccccccagaagggcagcaccctggacaacagcctgcacaaggacctgctgggcgccatcagcggcatcgccagcccctacaccaccagcacccccaacatcaacagcgtgagaaacgccgacagcagaggcagcctgatcagcaccgacagcggcaacagcctgcccgagagaaacagcgagaagagcaacagcctggacaagcaccagcagagcagcaccctgggcaacagcgtggtgagatgcgacaagctggaccagagcgagatcaagagcctgctgatgtgcttcctgtacatcctgaagagcatgagcgacgacgccctgttcacctactggaacaaggccagcaccagcgagctgatggacttcttcaccatcagcgaggtgtgcctgcaccagttccagtacatgggcaagagatacatcgccagaaccggcatgatgcacgccagactgcagcagctgggcagcctggacaacagcctgaccttcaaccacagctacggccacagcgacgccgacgtgctgcaccagagcctgctggaggccaacatcgccaccgaggtgtgcctgaccgccctggacaccctgagcctgttcaccctggccttcaagaaccagctgctggccgaccacggccacaaccccctgatgaagaaggtgttcgacgtgtacctgtgcttcctgcagaagcaccagagcgagaccgccctgaagaacgtgttcaccgccctgagaagcctgatctacaagttccccagcaccttctacgagggcagagccgacatgtgcgccgccctgtgctacgagatcctgaagtgctgcaacagcaagctgagcagcatcagaaccgaggccagccagctgctgtacttcctgatgagaaacaacttcgactacaccggcaagaagagcttcgtgagaacccacctgcaggtgatcatcagcgtgagccagctgatcgccgacgtggtgggcatcggcggcaccagattccagcagagcctgagcatcatcaacaactgcgccaacagcgacagactgatcaagcacaccagcttcagcagcgacgtgaaggacctgaccaagagaatcagaaccgtgctgatggccaccgcccagatgaaggagcacgagaacgaccccgagatgctggtggacctgcagtacagcctggccaagagctacgccagcacccccgagctgagaaagacctggctggacagcatggccagaatccacgtgaagaacggcgacctgagcgaggccgccatgtgctacgtgcacgtgaccgccctggtggccgagtacctgaccagaaaggaggccgtgcagtgggagccccccctgctgccccacagccacagcgcctgcctgagaagaagcagaggcggcgtgttcagacagggctgcaccgccttcagagtgatcacccccaacatcgacgaggaggccagcatgatggaggacgtgggcatgcaggacgtgcacttcaacgaggacgtgctgatggagctgctggagcagtgcgccgacggcctgtggaaggccgagagatacgagctgatcgccgacatctacaagctgatcatccccatctacgagaagagaagagacttcgagagactggcccacctgtacgacaccctgcacagagcctacagcaaggtgaccgaggtgatgcacagcggcagaagactgctgggcacctacttcagagtggccttcttcggccagggcttcttcgaggacgaggacggcaaggagtacatctacaaggagcccaagctgacccccctgagcgagatcagccagagactgctgaagctgtacagcgacaagttcggcagcgagaacgtgaagatgatccaggacagcggcaaggtgaaccccaaggacctggacagcaagtacgcctacatccaggtgacccacgtgatccccttcttcgacgagaaggagctgcaggagagaaagaccgagttcgagagaagccacaacatcagaagattcatgttcgagatgcccttcacccagaccggcaagagacagggcggcgtggaggagcagtgcaagagaagaaccatcctgaccgccatccactgcttcccctacgtgaagaagagaatccccgtgatgtaccagcaccacaccgacctgaaccccatcgaggtggccatcgacgagatgagcaagaaggtggccgagctgagacagctgtgcagcagcgccgaggtggacatgatcaagctgcagctgaagctgcagggcagcgtgagcgtgcaggtgaacgccggccccctggcctacgccagagccttcctggacgacaccaacaccaagagataccccgacaacaaggtgaagctgctgaaggaggtgttcagacagttcgtggaggcctgcggccaggccctggccgtgaacgagagactgatcaaggaggaccagctggagtaccaggaggagatgaaggccaactacagagagatggccaaggagctgagcgagatcatgcacgagcagatctgccccctggaggagaagaccagcgtgctgcccaacagcctgcacatcttcaacgccatcagcggcacccccaccagcaccatggtgcacggcatgaccagcagcagcagcgtggtgtag

SEQ ID NO: 20437 - DNA, 1275 bp, Artificial Sequence
  Description of Artificial Sequence: Synthetic coding sequence
atgatgcacgccagactgcagcagctgggcagcctggacaacagcctgaccttcaaccacagctacggccacagcgacgccgacgtgctgcaccagagcctgctggaggccaacatcgccaccgaggtgtgcctgaccgccctggacaccctgagcctgttcaccctggccttcaagaaccagctgctggccgaccacggccacaaccccctgatgaagaaggtgttcgacgtgtacctgtgcttcctgcagaagcaccagagcgagaccgccctgaagaacgtgttcaccgccctgagaagcctgatctacaagttccccagcaccttctacgagggcagagccgacatgtgcgccgccctgtgctacgagatcctgaagtgctgcaacagcaagctgagcagcatcagaaccgaggccagccagctgctgtacttcctgatgagaaacaacttcgactacaccggcaagaagagcttcgtgagaacccacctgcaggtgatcatcagcgtgagccagctgatcgccgacgtggtgggcatcggcggcaccagattccagcagagcctgagcatcatcaacaactgcgccaacagcgacagactgatcaagcacaccagcttcagcagcgacgtgaaggacctgaccaagagaatcagaaccgtgctgatggccaccgcccagatgaaggagcacgagaacgaccccgagatgctggtggacctgcagtacagcctggccaagagctacgccagcacccccgagctgagaaagacctggctggacagcatggccagaatccacgtgaagaacggcgacctgagcgaggccgccatgtgctacgtgcacgtgaccgccctggtggccgagtacctgaccagaaagggcgtgttcagacagggctgcaccgccttcagagtgatcacccccaacatcgacgaggaggccagcatgatggaggacgtgggcatgcaggacgtgcacttcaacgaggacgtgctgatggagctgctggagcagtgcgccgacggcctgtggaaggccgagagatacgagctgatcgccgacatctacaagctgatcatccccatctacgagaagagaagagacttcgagagactggcccacctgtacgacaccctgcacagagcctacagcaaggtgaccgaggtgatgcacagcggcagaagactgctgggcacctacttcagagtggccttcttcggccaggtgagcctgctgagcatcctgcagaccgtgctgagccccctgtag

SEQ ID NO: 20438 - DNA, 6309 bp, Artificial Sequence
  Description of Artificial Sequence: Synthetic coding sequence
atgagccagccccccctgctgcccgccagcgccgagaccagaaagttcaccagagccctgagcaagcccggcaccgccgccgagctgagacagagcgtgagcgaggtggtgagaggcagcgtgctgctggccaagcccaagctgatcgagcccctggactacgagaacgtgatcgtgcagaagaagacccagatcctgaacgactgcctgagagagatgctgctgttcccctacgacgacttccagaccgccatcctgagaagacagggcagatacatctgcagcaccgtgcccgccaaggccgaggaggaggcccagagcctgttcgtgaccgagtgcatcaagacctacaacagcgactggcacctggtgaactacaagtacgaggactacagcggcgagttcagacagctgcccaacaaggtggtgaagctggacaagctgcccgtgcacgtgtacgaggtggacgaggaggtggacaaggacgaggacgccgccagcctgggcagccagaagggcggcatcaccaagcacggctggctgtacaagggcaacatgaacagcgccatcagcgtgaccatgagaagcttcaagagaagattcttccacctgatccagctgggcgacggcagctacaacctgaacttctacaaggacgagaagatcagcaaggagcccaagggcagcatcttcctggacagctgcatgggcgtggtgcagaacaacaaggtgagaagattcgccttcgagctgaagatgcaggacaagagcagctacctgctggccgccgacagcgaggtggagatggaggagtggatcaccatcctgaacaagatcctgcagctgaacttcgaggccgccatgcaggagaagagaaacggcgacagccacgaggacgacgagcagagcaagctggagggcagcggcagcggcctggacagctacctgcccgagctggccaagagcgccagagaggccgagatcaagctgaagagcgagagcagagtgaagctgttctacctggaccccgacgcccagaagctggacttcagcagcgccgagcccgaggtgaagagcttcgaggagaagttcggcaagagaatcctggtgaagtgcaacgacctgagcttcaacctgcagtgctgcgtggccgagaacgaggagggccccaccaccaacgtggagcccttcttcgtgaccctgagcctgttcgacatcaagtacaacagaaagatcagcgccgacttccacgtggacctgaaccacttcagcgtgagacagatgctggccaccaccagccccgccctgatgaacggcagcggccagagccccagcgtgctgaagggcatcctgcacgaggccgccatgcagtaccccaagcagggcatcttcagcgtgacctgcccccaccccgacatcttcctggtggccagaatcgagaaggtgctgcagggcagcatcacccactgcgccgagccctacatgaagagcagcgacagcagcaaggtggcccagaaggtgctgaagaacgccaagcaggcctgccagagactgggccagtacagaatgcccttcgcctgggccgccagaaccctgttcaaggacgccagcggcaacctggacaagaacgccagattcagcgccatctacagacaggacagcaacaagctgagcaacgacgacatgctgaagctgctggccgacttcagaaagcccgagaagatggccaagctgcccgtgatcctgggcaacctggacatcaccatcgacaacgtgagcagcgacttccccaactacgtgaacagcagctacatccccaccaagcagttcgagacctgcagcaagacccccatcaccttcgaggtggaggagttcgtgccctgcatccccaagcacacccagccctacaccatctacaccaaccacctgtacgtgtaccccaagtacctgaagtacgacagccagaagagcttcgccaaggccagaaacatcgccatctgcatcgagttcaaggacagcgacgaggaggacagccagcccctgaagtgcatctacggcagacccggcggccccgtgttcaccagaagcgccttcgccgccgtgctgcaccaccaccagaaccccgagttctacgacgagatcaagatcgagctgcccacccagctgcacgagaagcaccacctgctgctgaccttcttccacgtgagctgcgacaacagcagcaagggcagcaccaagaagagagacgtggtggagacccaggtgggctacagctggctgcccctgctgaaggacggcagagtggtgaccagcgagcagcacatccccgtgagcgccaacctgcccagcggctacctgggctaccaggagctgggcatgggcagacactacggccccgagatcaagtgggtggacggcggcaagcccctgctgaagatcagcacccacctggtgagcaccgtgtacacccaggaccagcacctgcacaacttcttccagtactgccagaagaccgagagcggcgcccaggccctgggcaacgagctggtgaagtacctgaagagcctgcacgccatggagggccacgtgatgatcgccttcctgcccaccatcctgaaccagctgttcagagtgctgaccagagccacccaggaggaggtggccgtgaacgtgaccagagtgatcatccacgtggtggcccagtgccacgaggagggcctggagagccacctgagaagctacgtgaagtacgcctacaaggccgagccctacgtggccagcgagtacaagaccgtgcacgaggagctgaccaagagcatgaccaccatcctgaagcccagcgccgacttcctgaccagcaacaagctgctgaagtacagctggttcttcttcgacgtgctgatcaagagcatggcccagcacctgatcgagaacagcaaggtgaagctgctgagaaaccagagattccccgccagctaccaccacgccgtggagaccgtggtgaacatgctgatgccccacatcacccagaagttcagagacaaccccgaggccagcaagaacgccaaccacagcctggccgtgttcatcaagagatgcttcaccttcatggacagaggcttcgtgttcaagcagatcaacaactacatcagctgcttcgcccccggcgaccccaagaccctgttcgagtacaagttcgagttcctgagagtggtgtgcaaccacgagcactacatccccctgaacctgcccatgcccttcggcaagggcagaatccagagataccaggacctgcagctggactacagcctgaccgacgagttctgcagaaaccacttcctggtgggcctgctgctgagagaggtgggcaccgccctgcaggagttcagagaggtgagactgatcgccatcagcgtgctgaagaacctgctgatcaagcacagcttcgacgacagatacgccagcagaagccaccaggccagaatcgccaccctgtacctgcccctgttcggcctgctgatcgagaacgtgcagagaatcaacgtgagagacgtgagccccttccccgtgaacgccggcatgaccgtgaaggacgagagcctggccctgcccgccgtgaaccccctggtgaccccccagaagggcagcaccctggacaacagcctgcacaaggacctgctgggcgccatcagcggcatcgccagcccctacaccaccagcacccccaacatcaacagcgtgagaaacgccgacagcagaggcagcctgatcagcaccgacagcggcaacagcctgcccgagagaaacagcgagaagagcaacagcctggacaagcaccagcagagcagcaccctgggcaacagcgtggtgagatgcgacaagctggaccagagcgagatcaagagcctgctgatgtgcttcctgtacatcctgaagagcatgagcgacgacgccctgttcacctactggaacaaggccagcaccagcgagctgatggacttcttcaccatcagcgaggtgtgcctgcaccagttccagtacatgggcaagagatacatcgccagaaccggcatgatgcacgccagactgcagcagctgggcagcctggacaacagcctgaccttcaaccacagctacggccacagcgacgccgacgtgctgcaccagagcctgctggaggccaacatcgccaccgaggtgtgcctgaccgccctggacaccctgagcctgttcaccctggccttcaagaaccagctgctggccgaccacggccacaaccccctgatgaagaaggtgttcgacgtgtacctgtgcttcctgcagaagcaccagagcgagaccgccctgaagaacgtgttcaccgccctgagaagcctgatctacaagttccccagcaccttctacgagggcagagccgacatgtgcgccgccctgtgctacgagatcctgaagtgctgcaacagcaagctgagcagcatcagaaccgaggccagccagctgctgtacttcctgatgagaaacaacttcgactacaccggcaagaagagcttcgtgagaacccacctgcaggtgatcatcagcgtgagccagctgatcgccgacgtggtgggcatcggcggcaccagattccagcagagcctgagcatcatcaacaactgcgccaacagcgacagactgatcaagcacaccagcttcagcagcgacgtgaaggacctgaccaagagaatcagaaccgtgctgatggccaccgcccagatgaaggagcacgagaacgaccccgagatgctggtggacctgcagtacagcctggccaagagctacgccagcacccccgagctgagaaagacctggctggacagcatggccagaatccacgtgaagaacggcgacctgagcgaggccgccatgtgctacgtgcacgtgaccgccctggtggccgagtacctgaccagaaaggaggccgtgcagtgggagccccccctgctgccccacagccacagcgcctgcctgagaagaagcagaggcggcgtgttcagacagggctgcaccgccttcagagtgatcacccccaacatcgacgaggaggccagcatgatggaggacgtgggcatgcaggacgtgcacttcaacgaggacgtgctgatggagctgctggagcagtgcgccgacggcctgtggaaggccgagagatacgagctgatcgccgacatctacaagctgatcatccccatctacgagaagagaagagacttcgagagactggcccacctgtacgacaccctgcacagagcctacagcaaggtgaccgaggtgatgcacagcggcagaagactgctgggcacctacttcagagtggccttcttcggccaggccgcccagtaccagttcaccgacagcgagaccgacgtggagggcttcttcgaggacgaggacggcaaggagtacatctacaaggagcccaagctgacccccctgagcgagatcagccagagactgctgaagctgtacagcgacaagttcggcagcgagaacgtgaagatgatccaggacagcggcaaggtgaaccccaaggacctggacagcaagtacgcctacatccaggtgacccacgtgatccccttcttcgacgagaaggagctgcaggagagaaagaccgagttcgagagaagccacaacatcagaagattcatgttcgagatgcccttcacccagaccggcaagagacagggcggcgtggaggagcagtgcaagagaagaaccatcctgaccgccatccactgcttcccctacgtgaagaagagaatccccgtgatgtaccagcaccacaccgacctgaaccccatcgaggtggccatcgacgagatgagcaagaaggtggccgagctgagacagctgtgcagcagcgccgaggtggacatgatcaagctgcagctgaagctgcagggcagcgtgagcgtgcaggtgaacgccggccccctggcctacgccagagccttcctggacgacaccaacaccaagagataccccgacaacaaggtgaagctgctgaaggaggtgttcagacagttcgtggaggcctgcggccaggccctggccgtgaacgagagactgatcaaggaggaccagctggagtaccaggaggagatgaaggccaactacagagagatggccaaggagctgagcgagatcatgcacgagcaggtgagaagaagcgccccctggagaagaagaagagccagctacagaatccccttcaccagcagcacccccagcgtgggcctgcagcaggcccagtggttcaccggctag

SEQ ID NO: 20439 - DNA, 2175 bp, Artificial Sequence
  Description of Artificial Sequence: Synthetic coding sequence
atgcacgccagactgcagcagctgggcagcctggacaacagcctgaccttcaaccacagctacggccacagcgacgccgacgtgctgcaccagagcctgctggaggccaacatcgccaccgaggtgtgcctgaccgccctggacaccctgagcctgttcaccctggccttcaagaaccagctgctggccgaccacggccacaaccccctgatgaagaaggtgttcgacgtgtacctgtgcttcctgcagaagcaccagagcgagaccgccctgaagaacgtgttcaccgccctgagaagcctgatctacaagttccccagcaccttctacgagggcagagccgacatgtgcgccgccctgtgctacgagatcctgaagtgctgcaacagcaagctgagcagcatcagaaccgaggccagccagctgctgtacttcctgatgagaaacaacttcgactacaccggcaagaagagcttcgtgagaacccacctgcaggtgatcatcagcgtgagccagctgatcgccgacgtggtgggcatcggcggcaccagattccagcagagcctgagcatcatcaacaactgcgccaacagcgacagactgatcaagcacaccagcttcagcagcgacgtgaaggacctgaccaagagaatcagaaccgtgctgatggccaccgcccagatgaaggagcacgagaacgaccccgagatgctggtggacctgcagtacagcctggccaagagctacgccagcacccccgagctgagaaagacctggctggacagcatggccagaatccacgtgaagaacggcgacctgagcgaggccgccatgtgctacgtgcacgtgaccgccctggtggccgagtacctgaccagaaagggcgtgttcagacagggctgcaccgccttcagagtgatcacccccaacatcgacgaggaggccagcatgatggaggacgtgggcatgcaggacgtgcacttcaacgaggacgtgctgatggagctgctggagcagtgcgccgacggcctgtggaaggccgagagatacgagctgatcgccgacatctacaagctgatcatccccatctacgagaagagaagagacttcgagagactggcccacctgtacgacaccctgcacagagcctacagcaaggtgaccgaggtgatgcacagcggcagaagactgctgggcacctacttcagagtggccttcttcggccagcagtaccagttcaccgacagcgagaccgacgtggagggcttcttcgaggacgaggacggcaaggagtacatctacaaggagcccaagctgacccccctgagcgagatcagccagagactgctgaagctgtacagcgacaagttcggcagcgagaacgtgaagatgatccaggacagcggcaaggtgaaccccaaggacctggacagcaagtacgcctacatccaggtgacccacgtgatccccttcttcgacgagaaggagctgcaggagagaaagaccgagttcgagagaagccacaacatcagaagattcatgttcgagatgcccttcacccagaccggcaagagacagggcggcgtggaggagcagtgcaagagaagaaccatcctgaccgccatccactgcttcccctacgtgaagaagagaatccccgtgatgtaccagcaccacaccgacctgaaccccatcgaggtggccatcgacgagatgagcaagaaggtggccgagctgagacagctgtgcagcagcgccgaggtggacatgatcaagctgcagctgaagctgcagggcagcgtgagcgtgcaggtgaacgccggccccctggcctacgccagagccttcctggacgacaccaacaccaagagataccccgacaacaaggtgaagctgctgaaggaggtgttcagacagttcgtggaggcctgcggccaggccctggccgtgaacgagagactgatcaaggaggaccagctggagtaccaggaggagatgaaggccaactacagagagatggccaaggagctgagcgagatcatgcacgagcagatctgccccctggaggagaagaccagcgtgctgcccaacagcctgcacatcttcaacgccatcagcggcacccccaccagcaccatggtgcacggcatgaccagcagcagcagcgtggtgtag

SEQ ID NO: 20440 - DNA, 6285 bp, Artificial Sequence
  Description of Artificial Sequence: Synthetic coding sequence
atgagccagccccccctgctgcccgccagcgccgagaccagaaagttcaccagagccctgagcaagcccggcaccgccgccgagctgagacagagcgtgagcgaggtggtgagaggcagcgtgctgctggccaagcccaagctgatcgagcccctggactacgagaacgtgatcgtgcagaagaagacccagatcctgaacgactgcctgagagagatgctgctgttcccctacgacgacttccagaccgccatcctgagaagacagggcagatacatctgcagcaccgtgcccgccaaggccgaggaggaggcccagagcctgttcgtgaccgagtgcatcaagacctacaacagcgactggcacctggtgaactacaagtacgaggactacagcggcgagttcagacagctgcccaacaaggtggtgaagctggacaagctgcccgtgcacgtgtacgaggtggacgaggaggtggacaaggacgaggacgccgccagcctgggcagccagaagggcggcatcaccaagcacggctggctgtacaagggcaacatgaacagcgccatcagcgtgaccatgagaagcttcaagagaagattcttccacctgatccagctgggcgacggcagctacaacctgaacttctacaaggacgagaagatcagcaaggagcccaagggcagcatcttcctggacagctgcatgggcgtggtgcagaacaacaaggtgagaagattcgccttcgagctgaagatgcaggacaagagcagctacctgctggccgccgacagcgaggtggagatggaggagtggatcaccatcctgaacaagatcctgcagctgaacttcgaggccgccatgcaggagaagagaaacggcgacagccacgaggacgacgagcagagcaagctggagggcagcggcagcggcctggacagctacctgcccgagctggccaagagcgccagagaggccgagatcaagctgaagagcgagagcagagtgaagctgttctacctggaccccgacgcccagaagctggacttcagcagcgccgagcccgaggtgaagagcttcgaggagaagttcggcaagagaatcctggtgaagtgcaacgacctgagcttcaacctgcagtgctgcgtggccgagaacgaggagggccccaccaccaacgtggagcccttcttcgtgaccctgagcctgttcgacatcaagtacaacagaaagatcagcgccgacttccacgtggacctgaaccacttcagcgtgagacagatgctggccaccaccagccccgccctgatgaacggcagcggccagagccccagcgtgctgaagggcatcctgcacgaggccgccatgcagtaccccaagcagggcatcttcagcgtgacctgcccccaccccgacatcttcctggtggccagaatcgagaaggtgctgcagggcagcatcacccactgcgccgagccctacatgaagagcagcgacagcagcaaggtggcccagaaggtgctgaagaacgccaagcaggcctgccagagactgggccagtacagaatgcccttcgcctgggccgccagaaccctgttcaaggacgccagcggcaacctggacaagaacgccagattcagcgccatctacagacaggacagcaacaagctgagcaacgacgacatgctgaagctgctggccgacttcagaaagcccgagaagatggccaagctgcccgtgatcctgggcaacctggacatcaccatcgacaacgtgagcagcgacttccccaactacgtgaacagcagctacatccccaccaagcagttcgagacctgcagcaagacccccatcaccttcgaggtggaggagttcgtgccctgcatccccaagcacacccagccctacaccatctacaccaaccacctgtacgtgtaccccaagtacctgaagtacgacagccagaagagcttcgccaaggccagaaacatcgccatctgcatcgagttcaaggacagcgacgaggaggacagccagcccctgaagtgcatctacggcagacccggcggccccgtgttcaccagaagcgccttcgccgccgtgctgcaccaccaccagaaccccgagttctacgacgagatcaagatcgagctgcccacccagctgcacgagaagcaccacctgctgctgaccttcttccacgtgagctgcgacaacagcagcaagggcagcaccaagaagagagacgtggtggagacccaggtgggctacagctggctgcccctgctgaaggacggcagagtggtgaccagcgagcagcacatccccgtgagcgccaacctgcccagcggctacctgggctaccaggagctgggcatgggcagacactacggccccgagatcaagtgggtggacggcggcaagcccctgctgaagatcagcacccacctggtgagcaccgtgtacacccaggaccagcacctgcacaacttcttccagtactgccagaagaccgagagcggcgcccaggccctgggcaacgagctggtgaagtacctgaagagcctgcacgccatggagggccacgtgatgatcgccttcctgcccaccatcctgaaccagctgttcagagtgctgaccagagccacccaggaggaggtggccgtgaacgtgaccagagtgatcatccacgtggtggcccagtgccacgaggagggcctggagagccacctgagaagctacgtgaagtacgcctacaaggccgagccctacgtggccagcgagtacaagaccgtgcacgaggagctgaccaagagcatgaccaccatcctgaagcccagcgccgacttcctgaccagcaacaagctgctgaagtacagctggttcttcttcgacgtgctgatcaagagcatggcccagcacctgatcgagaacagcaaggtgaagctgctgagaaaccagagattccccgccagctaccaccacgccgtggagaccgtggtgaacatgctgatgccccacatcacccagaagttcagagacaaccccgaggccagcaagaacgccaaccacagcctggccgtgttcatcaagagatgcttcaccttcatggacagaggcttcgtgttcaagcagatcaacaactacatcagctgcttcgcccccggcgaccccaagaccctgttcgagtacaagttcgagttcctgagagtggtgtgcaaccacgagcactacatccccctgaacctgcccatgcccttcggcaagggcagaatccagagataccaggacctgcagctggactacagcctgaccgacgagttctgcagaaaccacttcctggtgggcctgctgctgagagaggtgggcaccgccctgcaggagttcagagaggtgagactgatcgccatcagcgtgctgaagaacctgctgatcaagcacagcttcgacgacagatacgccagcagaagccaccaggccagaatcgccaccctgtacctgcccctgttcggcctgctgatcgagaacgtgcagagaatcaacgtgagagacgtgagccccttccccgtgaacgccggcatgaccgtgaaggacgagagcctggccctgcccgccgtgaaccccctggtgaccccccagaagggcagcaccctggacaacagcctgcacaaggacctgctgggcgccatcagcggcatcgccagcccctacaccaccagcacccccaacatcaacagcgtgagaaacgccgacagcagaggcagcctgatcagcaccgacagcggcaacagcctgcccgagagaaacagcgagaagagcaacagcctggacaagcaccagcagagcagcaccctgggcaacagcgtggtgagatgcgacaagctggaccagagcgagatcaagagcctgctgatgtgcttcctgtacatcctgaagagcatgagcgacgacgccctgttcacctactggaacaaggccagcaccagcgagctgatggacttcttcaccatcagcgaggtgtgcctgcaccagttccagtacatgggcaagagatacatcgccagcgtgagaaagatcagcagcgtgctgggcatcagcgtggacaacggctacggccacagcgacgccgacgtgctgcaccagagcctgctggaggccaacatcgccaccgaggtgtgcctgaccgccctggacaccctgagcctgttcaccctggccttcaagaaccagctgctggccgaccacggccacaaccccctgatgaagaaggtgttcgacgtgtacctgtgcttcctgcagaagcaccagagcgagaccgccctgaagaacgtgttcaccgccctgagaagcctgatctacaagttccccagcaccttctacgagggcagagccgacatgtgcgccgccctgtgctacgagatcctgaagtgctgcaacagcaagctgagcagcatcagaaccgaggccagccagctgctgtacttcctgatgagaaacaacttcgactacaccggcaagaagagcttcgtgagaacccacctgcaggtgatcatcagcgtgagccagctgatcgccgacgtggtgggcatcggcggcaccagattccagcagagcctgagcatcatcaacaactgcgccaacagcgacagactgatcaagcacaccagcttcagcagcgacgtgaaggacctgaccaagagaatcagaaccgtgctgatggccaccgcccagatgaaggagcacgagaacgaccccgagatgctggtggacctgcagtacagcctggccaagagctacgccagcacccccgagctgagaaagacctggctggacagcatggccagaatccacgtgaagaacggcgacctgagcgaggccgccatgtgctacgtgcacgtgaccgccctggtggccgagtacctgaccagaaaggaggccgtgcagtgggagccccccctgctgccccacagccacagcgcctgcctgagaagaagcagaggcggcgtgttcagacagggctgcaccgccttcagagtgatcacccccaacatcgacgaggaggccagcatgatggaggacgtgggcatgcaggacgtgcacttcaacgaggacgtgctgatggagctgctggagcagtgcgccgacggcctgtggaaggccgagagatacgagctgatcgccgacatctacaagctgatcatccccatctacgagaagagaagagacttcgagagactggcccacctgtacgacaccctgcacagagcctacagcaaggtgaccgaggtgatgcacagcggcagaagactgctgggcacctacttcagagtggccttcttcggccaggccgcccagtaccagttcaccgacagcgagaccgacgtggagggcttcttcgaggacgaggacggcaaggagtacatctacaaggagcccaagctgacccccctgagcgagatcagccagagactgctgaagctgtacagcgacaagttcggcagcgagaacgtgaagatgatccaggacagcggcaaggtgaaccccaaggacctggacagcaagtacgcctacatccaggtgacccacgtgatccccttcttcgacgagaaggagctgcaggagagaaagaccgagttcgagagaagccacaacatcagaagattcatgttcgagatgcccttcacccagaccggcaagagacagggcggcgtggaggagcagtgcaagagaagaaccatcctgaccgccatccactgcttcccctacgtgaagaagagaatccccgtgatgtaccagcaccacaccgacctgaaccccatcgaggtggccatcgacgagatgagcaagaaggtggccgagctgagacagctgtgcagcagcgccgaggtggacatgatcaagctgcagctgaagctgcagggcagcgtgagcgtgcaggtgaacgccggccccctggcctacgccagagccttcctggacgacaccaacaccaagagataccccgacaacaaggtgaagctgctgaaggaggtgttcagacagttcgtggaggcctgcggccaggccctggccgtgaacgagagactgatcaaggaggaccagctggagtaccaggaggagatgaaggccaactacagagagatggccaaggagctgagcgagatcatgcacgagcaggtgagaagaagcgccccctggagaagaagaagagccagctacagaatccccttcaccagcagcacccccagcgtgggcctgcagcaggcccagtggttcaccggctag

SEQ ID NO: 20441 - DNA, 6207 bp, Artificial Sequence
  Description of Artificial Sequence: Synthetic coding sequence
atgcaggccgacaagtgcagaaccagcagcagaagcgtgaagaaggagctggtgatcgagagccccctgcagtacaaggacgccgcccagggcgaggtggaggccgagagccccggccccgtgcccgccaagcccaagctgatcgagcccctggactacgagaacgtgatcgtgcagaagaagacccagatcctgaacgactgcctgagagagatgctgctgttcccctacgacgacttccagaccgccatcctgagaagacagggcagatacatctgcagcaccgtgcccgccaaggccgaggaggaggcccagagcctgttcgtgaccgagtgcatcaagacctacaacagcgactggcacctggtgaactacaagtacgaggactacagcggcgagttcagacagctgcccaacaaggtggtgaagctggacaagctgcccgtgcacgtgtacgaggtggacgaggaggtggacaaggacgaggacgccgccagcctgggcagccagaagggcggcatcaccaagcacggctggctgtacaagggcaacatgaacagcgccatcagcgtgaccatgagaagcttcaagagaagattcttccacctgatccagctgggcgacggcagctacaacctgaacttctacaaggacgagaagatcagcaaggagcccaagggcagcatcttcctggacagctgcatgggcgtggtgcagaacaacaaggtgagaagattcgccttcgagctgaagatgcaggacaagagcagctacctgctggccgccgacagcgaggtggagatggaggagtggatcaccatcctgaacaagatcctgcagctgaacttcgaggccgccatgcaggagaagagaaacggcgacagccacgaggacgacgagcagagcaagctggagggcagcggcagcggcctggacagctacctgcccgagctggccaagagcgccagagaggccgagatcaagctgaagagcgagagcagagtgaagctgttctacctggaccccgacgcccagaagctggacttcagcagcgccgagcccgaggtgaagagcttcgaggagaagttcggcaagagaatcctggtgaagtgcaacgacctgagcttcaacctgcagtgctgcgtggccgagaacgaggagggccccaccaccaacgtggagcccttcttcgtgaccctgagcctgttcgacatcaagtacaacagaaagatcagcgccgacttccacgtggacctgaaccacttcagcgtgagacagatgctggccaccaccagccccgccctgatgaacggcagcggccagagccccagcgtgctgaagggcatcctgcacgaggccgccatgcagtaccccaagcagggcatcttcagcgtgacctgcccccaccccgacatcttcctggtggccagaatcgagaaggtgctgcagggcagcatcacccactgcgccgagccctacatgaagagcagcgacagcagcaaggtggcccagaaggtgctgaagaacgccaagcaggcctgccagagactgggccagtacagaatgcccttcgcctgggccgccagaaccctgttcaaggacgccagcggcaacctggacaagaacgccagattcagcgccatctacagacaggacagcaacaagctgagcaacgacgacatgctgaagctgctggccgacttcagaaagcccgagaagatggccaagctgcccgtgatcctgggcaacctggacatcaccatcgacaacgtgagcagcgacttccccaactacgtgaacagcagctacatccccaccaagcagttcgagacctgcagcaagacccccatcaccttcgaggtggaggagttcgtgccctgcatccccaagcacacccagccctacaccatctacaccaaccacctgtacgtgtaccccaagtacctgaagtacgacagccagaagagcttcgccaaggccagaaacatcgccatctgcatcgagttcaaggacagcgacgaggaggacagccagcccctgaagtgcatctacggcagacccggcggccccgtgttcaccagaagcgccttcgccgccgtgctgcaccaccaccagaaccccgagttctacgacgagatcaagatcgagctgcccacccagctgcacgagaagcaccacctgctgctgaccttcttccacgtgagctgcgacaacagcagcaagggcagcaccaagaagagagacgtggtggagacccaggtgggctacagctggctgcccctgctgaaggacggcagagtggtgaccagcgagcagcacatccccgtgagcgccaacctgcccagcggctacctgggctaccaggagctgggcatgggcagacactacggccccgagatcaagtgggtggacggcggcaagcccctgctgaagatcagcacccacctggtgagcaccgtgtacacccaggaccagcacctgcacaacttcttccagtactgccagaagaccgagagcggcgcccaggccctgggcaacgagctggtgaagtacctgaagagcctgcacgccatggagggccacgtgatgatcgccttcctgcccaccatcctgaaccagctgttcagagtgctgaccagagccacccaggaggaggtggccgtgaacgtgaccagagtgatcatccacgtggtggcccagtgccacgaggagggcctggagagccacctgagaagctacgtgaagtacgcctacaaggccgagccctacgtggccagcgagtacaagaccgtgcacgaggagctgaccaagagcatgaccaccatcctgaagcccagcgccgacttcctgaccagcaacaagctgctgaagtacagctggttcttcttcgacgtgctgatcaagagcatggcccagcacctgatcgagaacagcaaggtgaagctgctgagaaaccagagattccccgccagctaccaccacgccgtggagaccgtggtgaacatgctgatgccccacatcacccagaagttcagagacaaccccgaggccagcaagaacgccaaccacagcctggccgtgttcatcaagagatgcttcaccttcatggacagaggcttcgtgttcaagcagatcaacaactacatcagctgcttcgcccccggcgaccccaagaccctgttcgagtacaagttcgagttcctgagagtggtgtgcaaccacgagcactacatccccctgaacctgcccatgcccttcggcaagggcagaatccagagataccaggacctgcagctggactacagcctgaccgacgagttctgcagaaaccacttcctggtgggcctgctgctgagagaggtgggcaccgccctgcaggagttcagagaggtgagactgatcgccatcagcgtgctgaagaacctgctgatcaagcacagcttcgacgacagatacgccagcagaagccaccaggccagaatcgccaccctgtacctgcccctgttcggcctgctgatcgagaacgtgcagagaatcaacgtgagagacgtgagccccttccccgtgaacgccggcatgaccgtgaaggacgagagcctggccctgcccgccgtgaaccccctggtgaccccccagaagggcagcaccctggacaacagcctgcacaaggacctgctgggcgccatcagcggcatcgccagcccctacaccaccagcacccccaacatcaacagcgtgagaaacgccgacagcagaggcagcctgatcagcaccgacagcggcaacagcctgcccgagagaaacagcgagaagagcaacagcctggacaagcaccagcagagcagcaccctgggcaacagcgtggtgagatgcgacaagctggaccagagcgagatcaagagcctgctgatgtgcttcctgtacatcctgaagagcatgagcgacgacgccctgttcacctactggaacaaggccagcaccagcgagctgatggacttcttcaccatcagcgaggtgtgcctgcaccagttccagtacatgggcaagagatacatcgccagaaccggcatgatgcacgccagactgcagcagctgggcagcctggacaacagcctgaccttcaaccacagctacggccacagcgacgccgacgtgctgcaccagagcctgctggaggccaacatcgccaccgaggtgtgcctgaccgccctggacaccctgagcctgttcaccctggccttcaagaaccagctgctggccgaccacggccacaaccccctgatgaagaaggtgttcgacgtgtacctgtgcttcctgcagaagcaccagagcgagaccgccctgaagaacgtgttcaccgccctgagaagcctgatctacaagttccccagcaccttctacgagggcagagccgacatgtgcgccgccctgtgctacgagatcctgaagtgctgcaacagcaagctgagcagcatcagaaccgaggccagccagctgctgtacttcctgatgagaaacaacttcgactacaccggcaagaagagcttcgtgagaacccacctgcaggtgatcatcagcgtgagccagctgatcgccgacgtggtgggcatcggcggcaccagattccagcagagcctgagcatcatcaacaactgcgccaacagcgacagactgatcaagcacaccagcttcagcagcgacgtgaaggacctgaccaagagaatcagaaccgtgctgatggccaccgcccagatgaaggagcacgagaacgaccccgagatgctggtggacctgcagtacagcctggccaagagctacgccagcacccccgagctgagaaagacctggctggacagcatggccagaatccacgtgaagaacggcgacctgagcgaggccgccatgtgctacgtgcacgtgaccgccctggtggccgagtacctgaccagaaaggaggccgtgcagtgggagccccccctgctgccccacagccacagcgcctgcctgagaagaagcagaggcggcgtgttcagacagggctgcaccgccttcagagtgatcacccccaacatcgacgaggaggccagcatgatggaggacgtgggcatgcaggacgtgcacttcaacgaggacgtgctgatggagctgctggagcagtgcgccgacggcctgtggaaggccgagagatacgagctgatcgccgacatctacaagctgatcatccccatctacgagaagagaagagacttcgagagactggcccacctgtacgacaccctgcacagagcctacagcaaggtgaccgaggtgatgcacagcggcagaagactgctgggcacctacttcagagtggccttcttcggccaggccgcccagtaccagttcaccgacagcgagaccgacgtggagggcttcttcgaggacgaggacggcaaggagtacatctacaaggagcccaagctgacccccctgagcgagatcagccagagactgctgaagctgtacagcgacaagttcggcagcgagaacgtgaagatgatccaggacagcggcaaggtgaaccccaaggacctggacagcaagtacgcctacatccaggtgacccacgtgatccccttcttcgacgagaaggagctgcaggagagaaagaccgagttcgagagaagccacaacatcagaagattcatgttcgagatgcccttcacccagaccggcaagagacagggcggcgtggaggagcagtgcaagagaagaaccatcctgaccgccatccactgcttcccctacgtgaagaagagaatccccgtgatgtaccagcaccacaccgacctgaaccccatcgaggtggccatcgacgagatgagcaagaaggtggccgagctgagacagctgtgcagcagcgccgaggtggacatgatcaagctgcagctgaagctgcagggcagcgtgagcgtgcaggtgaacgccggccccctggcctacgccagagccttcctggacgacaccaacaccaagagataccccgacaacaaggtgaagctgctgaaggaggtgttcagacagttcgtggaggcctgcggccaggccctggccgtgaacgagagactgatcaaggaggaccagctggagtaccaggaggagatgaaggccaactacagagagatggccaaggagctgagcgagatcatgcacgagcagctgggctag

SEQ ID NO: 20442 - DNA, 3030 bp, Artificial Sequence
  Description of Artificial Sequence: Synthetic coding sequence
atgcccttcggcaagggcagaatccagagataccaggccttcctgagccccaccgtggagagcaacgacacccccgtggacctgcagctggactacagcctgaccgacgagttctgcagaaaccacttcctggtgggcctgctgctgagagaggtgggcaccgccctgcaggagttcagagaggtgagactgatcgccatcagcgtgctgaagaacctgctgatcaagcacagcttcgacgacagatacgccagcagaagccaccaggccagaatcgccaccctgtacctgcccctgttcggcctgctgatcgagaacgtgcagagaatcaacgtgagagacgtgagccccttccccgtgaacgccggcatgaccgtgaaggacgagagcctggccctgcccgccgtgaaccccctggtgaccccccagaagggcagcaccctggacaacagcctgcacaaggacctgctgggcgccatcagcggcatcgccagcccctacaccaccagcacccccaacatcaacagcgtgagaaacgccgacagcagaggcagcctgatcagcaccgacagcggcaacagcctgcccgagagaaacagcgagaagagcaacagcctggacaagcaccagcagagcagcaccctgggcaacagcgtggtgagatgcgacaagctggaccagagcgagatcaagagcctgctgatgtgcttcctgtacatcctgaagagcatgagcgacgacgccctgttcacctactggaacaaggccagcaccagcgagctgatggacttcttcaccatcagcgaggtgtgcctgcaccagttccagtacatgggcaagagatacatcgccagaaccggcatgatgcacgccagactgcagcagctgggcagcctggacaacagcctgaccttcaaccacagctacggccacagcgacgccgacgtgctgcaccagagcctgctggaggccaacatcgccaccgaggtgtgcctgaccgccctggacaccctgagcctgttcaccctggccttcaagaaccagctgctggccgaccacggccacaaccccctgatgaagaaggtgttcgacgtgtacctgtgcttcctgcagaagcaccagagcgagaccgccctgaagaacgtgttcaccgccctgagaagcctgatctacaagttccccagcaccttctacgagggcagagccgacatgtgcgccgccctgtgctacgagatcctgaagtgctgcaacagcaagctgagcagcatcagaaccgaggccagccagctgctgtacttcctgatgagaaacaacttcgactacaccggcaagaagagcttcgtgagaacccacctgcaggtgatcatcagcgtgagccagctgatcgccgacgtggtgggcatcggcggcaccagattccagcagagcctgagcatcatcaacaactgcgccaacagcgacagactgatcaagcacaccagcttcagcagcgacgtgaaggacctgaccaagagaatcagaaccgtgctgatggccaccgcccagatgaaggagcacgagaacgaccccgagatgctggtggacctgcagtacagcctggccaagagctacgccagcacccccgagctgagaaagacctggctggacagcatggccagaatccacgtgaagaacggcgacctgagcgaggccgccatgtgctacgtgcacgtgaccgccctggtggccgagtacctgaccagaaagggcgtgttcagacagggctgcaccgccttcagagtgatcacccccaacatcgacgaggaggccagcatgatggaggacgtgggcatgcaggacgtgcacttcaacgaggacgtgctgatggagctgctggagcagtgcgccgacggcctgtggaaggccgagagatacgagctgatcgccgacatctacaagctgatcatccccatctacgagaagagaagagacttcgagagactggcccacctgtacgacaccctgcacagagcctacagcaaggtgaccgaggtgatgcacagcggcagaagactgctgggcacctacttcagagtggccttcttcggccaggccgcccagtaccagttcaccgacagcgagaccgacgtggagggcttcttcgaggacgaggacggcaaggagtacatctacaaggagcccaagctgacccccctgagcgagatcagccagagactgctgaagctgtacagcgacaagttcggcagcgagaacgtgaagatgatccaggacagcggcaaggtgaaccccaaggacctggacagcaagtacgcctacatccaggtgacccacgtgatccccttcttcgacgagaaggagctgcaggagagaaagaccgagttcgagagaagccacaacatcagaagattcatgttcgagatgcccttcacccagaccggcaagagacagggcggcgtggaggagcagtgcaagagaagaaccatcctgaccgccatccactgcttcccctacgtgaagaagagaatccccgtgatgtaccagcaccacaccgacctgaaccccatcgaggtggccatcgacgagatgagcaagaaggtggccgagctgagacagctgtgcagcagcgccgaggtggacatgatcaagctgcagctgaagctgcagggcagcgtgagcgtgcaggtgaacgccggccccctggcctacgccagagccttcctggacgacaccaacaccaagagataccccgacaacaaggtgaagctgctgaaggaggtgttcagacagttcgtggaggcctgcggccaggccctggccgtgaacgagagactgatcaaggaggaccagctggagtaccaggaggagatgaaggccaactacagagagatggccaaggagctgagcgagatcatgcacgagcaggtgagaagaagcgccccctggagaagaagaagagccagctacagaatccccttcaccagcagcacccccagcgtgggcctgcagcaggcccagtggttcaccggctag

SEQ ID NO: 20443 - DNA, 2010 bp, Artificial Sequence
  Description of Artificial Sequence: Synthetic coding sequence
tgattcaagaaccagctgctggccgaccacggccacaaccccctgatgaagaaggtgttcgacgtgtacctgtgcttcctgcagaagcaccagagcgagaccgccctgaagaacgtgttcaccgccctgagaagcctgatctacaagttccccagcaccttctacgagggcagagccgacatgtgcgccgccctgtgctacgagatcctgaagtgctgcaacagcaagctgagcagcatcagaaccgaggccagccagctgctgtacttcctgatgagaaacaacttcgactacaccggcaagaagagcttcgtgagaacccacctgcaggtgatcatcagcgtgagccagctgatcgccgacgtggtgggcatcggcggcaccagattccagcagagcctgagcatcatcaacaactgcgccaacagcgacagactgatcaagcacaccagcttcagcagcgacgtgaaggacctgaccaagagaatcagaaccgtgctgatggccaccgcccagatgaaggagcacgagaacgaccccgagatgctggtggacctgcagtacagcctggccaagagctacgccagcacccccgagctgagaaagacctggctggacagcatggccagaatccacgtgaagaacggcgacctgagcgaggccgccatgtgctacgtgcacgtgaccgccctggtggccgagtacctgaccagaaagggcgtgttcagacagggctgcaccgccttcagagtgatcacccccaacatcgacgaggaggccagcatgatggaggacgtgggcatgcaggacgtgcacttcaacgaggacgtgctgatggagctgctggagcagtgcgccgacggcctgtggaaggccgagagatacgagctgatcgccgacatctacaagctgatcatccccatctacgagaagagaagagacttcgagagactggcccacctgtacgacaccctgcacagagcctacagcaaggtgaccgaggtgatgcacagcggcagaagactgctgggcacctacttcagagtggccttcttcggccagcagtaccagttcaccgacagcgagaccgacgtggagggcttcttcgaggacgaggacggcaaggagtacatctacaaggagcccaagctgacccccctgagcgagatcagccagagactgctgaagctgtacagcgacaagttcggcagcgagaacgtgaagatgatccaggacagcggcaaggtgaaccccaaggacctggacagcaagtacgcctacatccaggtgacccacgtgatccccttcttcgacgagaaggagctgcaggagagaaagaccgagttcgagagaagccacaacatcagaagattcatgttcgagatgcccttcacccagaccggcaagagacagggcggcgtggaggagcagtgcaagagaagaaccatcctgaccgccatccactgcttcccctacgtgaagaagagaatccccgtgatgtaccagcaccacaccgacctgaaccccatcgaggtggccatcgacgagatgagcaagaaggtggccgagctgagacagctgtgcagcagcgccgaggtggacatgatcaagctgcagctgaagctgcagggcagcgtgagcgtgcaggtgaacgccggccccctggcctacgccagagccttcctggacgacaccaacaccaagagataccccgacaacaaggtgaagctgctgaaggaggtgttcagacagttcgtggaggcctgcggccaggccctggccgtgaacgagagactgatcaaggaggaccagctggagtaccaggaggagatgaaggccaactacagagagatggccaaggagctgagcgagatcatgcacgagcagatctgccccctggaggagaagaccagcgtgctgcccaacagcctgcacatcttcaacgccatcagcggcacccccaccagcaccatggtgcacggcatgaccagcagcagcagcgtggtgtag

SEQ ID NO: 20444 - DNA, 6240 bp, Artificial Sequence
  Description of Artificial Sequence: Synthetic coding sequence
atgagccagccccccctgctgcccgccagcgccgagaccagaaagttcaccagagccctgagcaagcccggcaccgccgccgagctgagacagagcgtgagcgaggtggtgagaggcagcgtgctgctggccaagcccaagctgatcgagcccctggactacgagaacgtgatcgtgcagaagaagacccagatcctgaacgactgcctgagagagatgctgctgttcccctacgacgacttccagaccgccatcctgagaagacagggcagatacatctgcagcaccgtgcccgccaaggccgaggaggaggcccagagcctgttcgtgaccgagtgcatcaagacctacaacagcgactggcacctggtgaactacaagtacgaggactacagcggcgagttcagacagctgcccaacaaggtggtgaagctggacaagctgcccgtgcacgtgtacgaggtggacgaggaggtggacaaggacgaggacgccgccagcctgggcagccagaagggcggcatcaccaagcacggctggctgtacaagggcaacatgaacagcgccatcagcgtgaccatgagaagcttcaagagaagattcttccacctgatccagctgggcgacggcagctacaacctgaacttctacaaggacgagaagatcagcaaggagcccaagggcagcatcttcctggacagctgcatgggcgtggtgcagaacaacaaggtgagaagattcgccttcgagctgaagatgcaggacaagagcagctacctgctggccgccgacagcgaggtggagatggaggagtggatcaccatcctgaacaagatcctgcagctgaacttcgaggccgccatgcaggagaagagaaacggcgacagccacgaggacgacgagcagagcaagctggagggcagcggcagcggcctggacagctacctgcccgagctggccaagagcgccagagaggccgagatcaagctgaagagcgagagcagagtgaagctgttctacctggaccccgacgcccagaagctggacttcagcagcgccgagcccgaggtgaagagcttcgaggagaagttcggcaagagaatcctggtgaagtgcaacgacctgagcttcaacctgcagtgctgcgtggccgagaacgaggagggccccaccaccaacgtggagcccttcttcgtgaccctgagcctgttcgacatcaagtacaacagaaagatcagcgccgacttccacgtggacctgaaccacttcagcgtgagacagatgctggccaccaccagccccgccctgatgaacggcagcggccagagccccagcgtgctgaagggcatcctgcacgaggccgccatgcagtaccccaagcagggcatcttcagcgtgacctgcccccaccccgacatcttcctggtggccagaatcgagaaggtgctgcagggcagcatcacccactgcgccgagccctacatgaagagcagcgacagcagcaaggtggcccagaaggtgctgaagaacgccaagcaggcctgccagagactgggccagtacagaatgcccttcgcctgggccgccagaaccctgttcaaggacgccagcggcaacctggacaagaacgccagattcagcgccatctacagacaggacagcaacaagctgagcaacgacgacatgctgaagctgctggccgacttcagaaagcccgagaagatggccaagctgcccgtgatcctgggcaacctggacatcaccatcgacaacgtgagcagcgacttccccaactacgtgaacagcagctacatccccaccaagcagttcgagacctgcagcaagacccccatcaccttcgaggtggaggagttcgtgccctgcatccccaagcacacccagccctacaccatctacaccaaccacctgtacgtgtaccccaagtacctgaagtacgacagccagaagagcttcgccaaggccagaaacatcgccatctgcatcgagttcaaggacagcgacgaggaggacagccagcccctgaagtgcatctacggcagacccggcggccccgtgttcaccagaagcgccttcgccgccgtgctgcaccaccaccagaaccccgagttctacgacgagatcaagatcgagctgcccacccagctgcacgagaagcaccacctgctgctgaccttcttccacgtgagctgcgacaacagcagcaagggcagcaccaagaagagagacgtggtggagacccaggtgggctacagctggctgcccctgctgaaggacggcagagtggtgaccagcgagcagcacatccccgtgagcgccaacctgcccagcggctacctgggctaccaggagctgggcatgggcagacactacggccccgagatcaagtgggtggacggcggcaagcccctgctgaagatcagcacccacctggtgagcaccgtgtacacccaggaccagcacctgcacaacttcttccagtactgccagaagaccgagagcggcgcccaggccctgggcaacgagctggtgaagtacctgaagagcctgcacgccatggagggccacgtgatgatcgccttcctgcccaccatcctgaaccagctgttcagagtgctgaccagagccacccaggaggaggtggccgtgaacgtgaccagagtgatcatccacgtggtggcccagtgccacgaggagggcctggagagccacctgagaagctacgtgaagtacgcctacaaggccgagccctacgtggccagcgagtacaagaccgtgcacgaggagctgaccaagagcatgaccaccatcctgaagcccagcgccgacttcctgaccagcaacaagctgctgaagtacagctggttcttcttcgacgtgctgatcaagagcatggcccagcacctgatcgagaacagcaaggtgaagctgctgagaaaccagagattccccgccagctaccaccacgccgtggagaccgtggtgaacatgctgatgccccacatcacccagaagttcagagacaaccccgaggccagcaagaacgccaaccacagcctggccgtgttcatcaagagatgcttcaccttcatggacagaggcttcgtgttcaagcagatcaacaactacatcagctgcttcgcccccggcgaccccaagaccctgttcgagtacaagttcgagttcctgagagtggtgtgcaaccacgagcactacatccccctgaacctgcccatgcccttcggcaagggcagaatccagagataccaggacctgcagctggactacagcctgaccgacgagttctgcagaaaccacttcctggtgggcctgctgctgagagaggtgggcaccgccctgcaggagttcagagaggtgagactgatcgccatcagcgtgctgaagaacctgctgatcaagcacagcttcgacgacagatacgccagcagaagccaccaggccagaatcgccaccctgtacctgcccctgttcggcctgctgatcgagaacgtgcagagaatcaacgtgagagacgtgagccccttccccgtgaacgccggcatgaccgtgaaggacgagagcctggccctgcccgccgtgaaccccctggtgaccccccagaagggcagcaccctggacaacagcctgcacaaggacctgctgggcgccatcagcggcatcgccagcccctacaccaccagcacccccaacatcaacagcgtgagaaacgccgacagcagaggcagcctgatcagcaccgacagcggcaacagcctgcccgagagaaacagcgagaagagcaacagcctggacaagcaccagcagagcagcaccctgggcaacagcgtggtgagatgcgacaagctggaccagagcgagatcaagagcctgctgatgtgcttcctgtacatcctgaagagcatgagcgacgacgccctgttcacctactggaacaaggccagcaccagcgagctgatggacttcttcaccatcagcgaggtgtgcctgcaccagttccagtacatgggcaagagatacatcgccagaaccggcatgatgcacgccagactgcagcagctgggcagcctggacaacagcctgaccttcaaccacagctacggccacagcgacgccgacgtgctgcaccagagcctgctggaggccaacatcgccaccgaggtgtgcctgaccgccctggacaccctgagcctgttcaccctggccttcaagaaccagctgctggccgaccacggccacaaccccctgatgaagaaggtgttcgacgtgtacctgtgcttcctgcagaagcaccagagcgagaccgccctgaagaacgtgttcaccgccctgagaagcctgatctacaagttccccagcaccttctacgagggcagagccgacatgtgcgccgccctgtgctacgagatcctgaagtgctgcaacagcaagctgagcagcatcagaaccgaggccagccagctgctgtacttcctgatgagaaacaacttcgactacaccggcaagaagagcttcgtgagaacccacctgcaggtgatcatcagcgtgagccagctgatcgccgacgtggtgggcatcggcggcaccagattccagcagagcctgagcatcatcaacaactgcgccaacagcgacagactgatcaagcacaccagcttcagcagcgacgtgaaggacctgaccaagagaatcagaaccgtgctgatggccaccgcccagatgaaggagcacgagaacgaccccgagatgctggtggacctgcagtacagcctggccaagagctacgccagcacccccgagctgagaaagacctggctggacagcatggccagaatccacgtgaagaacggcgacctgagcgaggccgccatgtgctacgtgcacgtgaccgccctggtggccgagtacctgaccagaaagggcgtgttcagacagggctgcaccgccttcagagtgatcacccccaacatcgacgaggaggccagcatgatggaggacgtgggcatgcaggacgtgcacttcaacgaggacgtgctgatggagctgctggagcagtgcgccgacggcctgtggaaggccgagagatacgagctgatcgccgacatctacaagctgatcatccccatctacgagaagagaagagacttcgagagactggcccacctgtacgacaccctgcacagagcctacagcaaggtgaccgaggtgatgcacagcggcagaagactgctgggcacctacttcagagtggccttcttcggccaggccgcccagtaccagttcaccgacagcgagaccgacgtggagggcttcttcgaggacgaggacggcaaggagtacatctacaaggagcccaagctgacccccctgagcgagatcagccagagactgctgaagctgtacagcgacaagttcggcagcgagaacgtgaagatgatccaggacagcggcaaggtgaaccccaaggacctggacagcaagtacgcctacatccaggtgacccacgtgatccccttcttcgacgagaaggagctgcaggagagaaagaccgagttcgagagaagccacaacatcagaagattcatgttcgagatgcccttcacccagaccggcaagagacagggcggcgtggaggagcagtgcaagagaagaaccatcctgaccgccatccactgcttcccctacgtgaagaagagaatccccgtgatgtaccagcaccacaccgacctgaaccccatcgaggtggccatcgacgagatgagcaagaaggtggccgagctgagacagctgtgcagcagcgccgaggtggacatgatcaagctgcagctgaagctgcagggcagcgtgagcgtgcaggtgaacgccggccccctggcctacgccagagccttcctggacgacaccaacaccaagagataccccgacaacaaggtgaagctgctgaaggaggtgttcagacagttcgtggaggcctgcggccaggccctggccgtgaacgagagactgatcaaggaggaccagctggagtaccaggaggagatgaaggccaactacagagagatggccaaggagctgagcgagatcatgcacgagcaggtgagaagaagcgccccctggagaagaagaagagccagctacagaatccccttcaccagcagcacccccagcgtgggcctgcagcaggcccagtggttcaccggctag

SEQ ID NO: 20445 - DNA, 1173 bp, Artificial Sequence
  Description of Artificial Sequence: Synthetic coding sequence
tgacagatgaaggagcacgagaacgaccccgagatgctggtggacctgcagtacagcctggccaagagctacgccagcacccccgagctgagaaagacctggctggacagcatggccagaatccacgtgaagaacggcgacctgagcgaggccgccatgtgctacgtgcacgtgaccgccctggtggccgagtacctgaccagaaaggaggccgtgcagtgggagccccccctgctgccccacagccacagcgcctgcctgagaagaagcagaggcggcgtgttcagacagggctgcaccgccttcagagtgatcacccccaacatcgacgaggaggccagcatgatggaggacgtgggcatgcaggacgtgcacttcaacgaggacgtgctgatggagctgctggagcagtgcgccgacggcctgtggaaggccgagagatacgagctgatcgccgacatctacaagctgatcatccccatctacgagaagagaagagacttcgagagactggcccacctgtacgacaccctgcacagagcctacagcaaggtgaccgaggtgatgcacagcggcagaagactgctgggcacctacttcagagtggccttcttcggccagggcttcttcgaggacgaggacggcaaggagtacatctacaaggagcccaagctgacccccctgagcgagatcagccagagactgctgaagctgtacagcgacaagttcggcagcgagaacgtgaagatgatccaggacagcggcaaggtgaaccccaaggacctggacagcaagtacgcctacatccaggtgacccacgtgatccccttcttcgacgagaaggagctgcaggagagaaagaccgagttcgagagaagccacaacatcagaagattcatgttcgagatgcccttcacccagaccggcaagagacagggcggcgtggaggagcagtgcaagagaagaaccatcctgaccgccatccactgcttcccctacgtgaagaagagaatccccgtgatgtaccagcaccacaccgacctgaaccccatcgaggtggccatcgacgagatgagcaagaaggtggccgagctgagacagctgtgcagcagcgccgaggtggacatgatcaagctgcagctgaagctgcagggcagcgtgagcgtgcagtag

SEQ ID NO: 20446 - DNA, 588 bp, Artificial Sequence
  Description of Artificial Sequence: Synthetic coding sequence
atgagccagccccccctgctgcccgccagcgccgagaccagaaagttcaccagagccctgagcaagcccggcaccgccgccgagctgagacagagcgtgagcgaggtggtgagaggcagcgtgctgctggccaagcccaagctgatcgagcccctggactacgagaacgtgatcgtgcagaagaagacccagatcctgaacgactgcctgagagagatgctgctgttcccctacgacgacttccagaccgccatcctgagaagacagggcagatacatctgcagcaccgtgcccgccaaggccgaggaggaggcccagagcctgttcgtgaccgagtgcatcaagacctacaacagcgactggcacctggtgaactacaagtacgaggactacagcggcgagttcagacagctgcccaacaaggtggtgaagctggacaagctgcccgtgcacgtgtacgaggtggacgaggaggtggacaaggacgaggacgccgccagcctgggcagccagaagggcggcatcaccaagcacggctggctgtacaagggcaacatgaacagcgccatcagcgtgaccatgagatag

SEQ ID NO: 20447 - DNA, 6306 bp, Artificial Sequence
  Description of Artificial Sequence: Synthetic coding sequence
atgcaggccgacaagtgcagaaccagcagcagaagcgtgaagaaggagctggtgatcgagagccccctgcagtacaaggacgccgcccagggcgaggtggaggccgagagccccggccccgtgcccgccaagcccaagctgatcgagcccctggactacgagaacgtgatcgtgcagaagaagacccagatcctgaacgactgcctgagagagatgctgctgttcccctacgacgacttccagaccgccatcctgagaagacagggcagatacatctgcagcaccgtgcccgccaaggccgaggaggaggcccagagcctgttcgtgaccgagtgcatcaagacctacaacagcgactggcacctggtgaactacaagtacgaggactacagcggcgagttcagacagctgcccaacaaggtggtgaagctggacaagctgcccgtgcacgtgtacgaggtggacgaggaggtggacaaggacgaggacgccgccagcctgggcagccagaagggcggcatcaccaagcacggctggctgtacaagggcaacatgaacagcgccatcagcgtgaccatgagaagcttcaagagaagattcttccacctgatccagctgggcgacggcagctacaacctgaacttctacaaggacgagaagatcagcaaggagcccaagggcagcatcttcctggacagctgcatgggcgtggtgcagaacaacaaggtgagaagattcgccttcgagctgaagatgcaggacaagagcagctacctgctggccgccgacagcgaggtggagatggaggagtggatcaccatcctgaacaagatcctgcagctgaacttcgaggccgccatgcaggagaagagaaacggcgacagccacgaggacgacgagcagagcaagctggagggcagcggcagcggcctggacagctacctgcccgagctggccaagagcgccagagaggccgagatcaagctgaagagcgagagcagagtgaagctgttctacctggaccccgacgcccagaagctggacttcagcagcgccgagcccgaggtgaagagcttcgaggagaagttcggcaagagaatcctggtgaagtgcaacgacctgagcttcaacctgcagtgctgcgtggccgagaacgaggagggccccaccaccaacgtggagcccttcttcgtgaccctgagcctgttcgacatcaagtacaacagaaagatcagcgccgacttccacgtggacctgaaccacttcagcgtgagacagatgctggccaccaccagccccgccctgatgaacggcagcggccagagccccagcgtgctgaagggcatcctgcacgaggccgccatgcagtaccccaagcagggcatcttcagcgtgacctgcccccaccccgacatcttcctggtggccagaatcgagaaggtgctgcagggcagcatcacccactgcgccgagccctacatgaagagcagcgacagcagcaaggtggcccagaaggtgctgaagaacgccaagcaggcctgccagagactgggccagtacagaatgcccttcgcctgggccgccagaaccctgttcaaggacgccagcggcaacctggacaagaacgccagattcagcgccatctacagacaggacagcaacaagctgagcaacgacgacatgctgaagctgctggccgacttcagaaagcccgagaagatggccaagctgcccgtgatcctgggcaacctggacatcaccatcgacaacgtgagcagcgacttccccaactacgtgaacagcagctacatccccaccaagcagttcgagacctgcagcaagacccccatcaccttcgaggtggaggagttcgtgccctgcatccccaagcacacccagccctacaccatctacaccaaccacctgtacgtgtaccccaagtacctgaagtacgacagccagaagagcttcgccaaggccagaaacatcgccatctgcatcgagttcaaggacagcgacgaggaggacagccagcccctgaagtgcatctacggcagacccggcggccccgtgttcaccagaagcgccttcgccgccgtgctgcaccaccaccagaaccccgagttctacgacgagatcaagatcgagctgcccacccagctgcacgagaagcaccacctgctgctgaccttcttccacgtgagctgcgacaacagcagcaagggcagcaccaagaagagagacgtggtggagacccaggtgggctacagctggctgcccctgctgaaggacggcagagtggtgaccagcgagcagcacatccccgtgagcgccaacctgcccagcggctacctgggctaccaggagctgggcatgggcagacactacggccccgagatcaagtgggtggacggcggcaagcccctgctgaagatcagcacccacctggtgagcaccgtgtacacccaggaccagcacctgcacaacttcttccagtactgccagaagaccgagagcggcgcccaggccctgggcaacgagctggtgaagtacctgaagagcctgcacgccatggagggccacgtgatgatcgccttcctgcccaccatcctgaaccagctgttcagagtgctgaccagagccacccaggaggaggtggccgtgaacgtgaccagagtgatcatccacgtggtggcccagtgccacgaggagggcctggagagccacctgagaagctacgtgaagtacgcctacaaggccgagccctacgtggccagcgagtacaagaccgtgcacgaggagctgaccaagagcatgaccaccatcctgaagcccagcgccgacttcctgaccagcaacaagctgctgaagtacagctggttcttcttcgacgtgctgatcaagagcatggcccagcacctgatcgagaacagcaaggtgaagctgctgagaaaccagagattccccgccagctaccaccacgccgtggagaccgtggtgaacatgctgatgccccacatcacccagaagttcagagacaaccccgaggccagcaagaacgccaaccacagcctggccgtgttcatcaagagatgcttcaccttcatggacagaggcttcgtgttcaagcagatcaacaactacatcagctgcttcgcccccggcgaccccaagaccctgttcgagtacaagttcgagttcctgagagtggtgtgcaaccacgagcactacatccccctgaacctgcccatgcccttcggcaagggcagaatccagagataccaggacctgcagctggactacagcctgaccgacgagttctgcagaaaccacttcctggtgggcctgctgctgagagaggtgggcaccgccctgcaggagttcagagaggtgagactgatcgccatcagcgtgctgaagaacctgctgatcaagcacagcttcgacgacagatacgccagcagaagccaccaggccagaatcgccaccctgtacctgcccctgttcggcctgctgatcgagaacgtgcagagaatcaacgtgagagacgtgagccccttccccgtgaacgccggcatgaccgtgaaggacgagagcctggccctgcccgccgtgaaccccctggtgaccccccagaagggcagcaccctggacaacagcctgcacaaggacctgctgggcgccatcagcggcatcgccagcccctacaccaccagcacccccaacatcaacagcgtgagaaacgccgacagcagaggcagcctgatcagcaccgacagcggcaacagcctgcccgagagaaacagcgagaagagcaacagcctggacaagcaccagcagagcagcaccctgggcaacagcgtggtgagatgcgacaagctggaccagagcgagatcaagagcctgctgatgtgcttcctgtacatcctgaagagcatgagcgacgacgccctgttcacctactggaacaaggccagcaccagcgagctgatggacttcttcaccatcagcgaggtgtgcctgcaccagttccagtacatgggcaagagatacatcgccagaaccggcatgatgcacgccagactgcagcagctgggcagcctggacaacagcctgaccttcaaccacagctacggccacagcgacgccgacgtgctgcaccagagcctgctggaggccaacatcgccaccgaggtgtgcctgaccgccctggacaccctgagcctgttcaccctggccttcaagaaccagctgctggccgaccacggccacaaccccctgatgaagaaggtgttcgacgtgtacctgtgcttcctgcagaagcaccagagcgagaccgccctgaagaacgtgttcaccgccctgagaagcctgatctacaagttccccagcaccttctacgagggcagagccgacatgtgcgccgccctgtgctacgagatcctgaagtgctgcaacagcaagctgagcagcatcagaaccgaggccagccagctgctgtacttcctgatgagaaacaacttcgactacaccggcaagaagagcttcgtgagaacccacctgcaggtgatcatcagcgtgagccagctgatcgccgacgtggtgggcatcggcggcaccagattccagcagagcctgagcatcatcaacaactgcgccaacagcgacagactgatcaagcacaccagcttcagcagcgacgtgaaggacctgaccaagagaatcagaaccgtgctgatggccaccgcccagatgaaggagcacgagaacgaccccgagatgctggtggacctgcagtacagcctggccaagagctacgccagcacccccgagctgagaaagacctggctggacagcatggccagaatccacgtgaagaacggcgacctgagcgaggccgccatgtgctacgtgcacgtgaccgccctggtggccgagtacctgaccagaaaggaggccgtgcagtgggagccccccctgctgccccacagccacagcgcctgcctgagaagaagcagaggcggcgtgttcagacagggctgcaccgccttcagagtgatcacccccaacatcgacgaggaggccagcatgatggaggacgtgggcatgcaggacgtgcacttcaacgaggacgtgctgatggagctgctggagcagtgcgccgacggcctgtggaaggccgagagatacgagctgatcgccgacatctacaagctgatcatccccatctacgagaagagaagagacttcgagagactggcccacctgtacgacaccctgcacagagcctacagcaaggtgaccgaggtgatgcacagcggcagaagactgctgggcacctacttcagagtggccttcttcggccaggccgcccagtaccagttcaccgacagcgagaccgacgtggagggcttcttcgaggacgaggacggcaaggagtacatctacaaggagcccaagctgacccccctgagcgagatcagccagagactgctgaagctgtacagcgacaagttcggcagcgagaacgtgaagatgatccaggacagcggcaaggtgaaccccaaggacctggacagcaagtacgcctacatccaggtgacccacgtgatccccttcttcgacgagaaggagctgcaggagagaaagaccgagttcgagagaagccacaacatcagaagattcatgttcgagatgcccttcacccagaccggcaagagacagggcggcgtggaggagcagtgcaagagaagaaccatcctgaccgccatccactgcttcccctacgtgaagaagagaatccccgtgatgtaccagcaccacaccgacctgaaccccatcgaggtggccatcgacgagatgagcaagaaggtggccgagctgagacagctgtgcagcagcgccgaggtggacatgatcaagctgcagctgaagctgcagggcagcgtgagcgtgcaggtgaacgccggccccctggcctacgccagagccttcctggacgacaccaacaccaagagataccccgacaacaaggtgaagctgctgaaggaggtgttcagacagttcgtggaggcctgcggccaggccctggccgtgaacgagagactgatcaaggaggaccagctggagtaccaggaggagatgaaggccaactacagagagatggccaaggagctgagcgagatcatgcacgagcaggtgagaagaagcgccccctggagaagaagaagagccagctacagaatccccttcaccagcagcacccccagcgtgggcctgcagcaggcccagtggttcaccggctag

SEQ ID NO: 20448 - DNA, 3762 bp, Artificial Sequence
  Description of Artificial Sequence: Synthetic coding sequence
atgcaggccgacaagtgcagaaccagcagcagaagcgtgaagaaggagctggtgatcgagagccccctgcagtacaaggacgccgcccagggcgaggtggaggccgagagccccggccccgtgcccgccaagcccaagctgatcgagcccctggactacgagaacgtgatcgtgcagaagaagacccagatcctgaacgactgcctgagagagatgctgctgttcccctacgacgacttccagaccgccatcctgagaagacagggcagatacatctgcagcaccgtgcccgccaaggccgaggaggaggcccagagcctgttcgtgaccgagtgcatcaagacctacaacagcgactggcacctggtgaactacaagtacgaggactacagcggcgagttcagacagctgcccaacaaggtggtgaagctggacaagctgcccgtgcacgtgtacgaggtggacgaggaggtggacaaggacgaggacgccgccagcctgggcagccagaagggcggcatcaccaagcacggctggctgtacaagggcaacatgaacagcgccatcagcgtgaccatgagaagcttcaagagaagattcttccacctgatccagctgggcgacggcagctacaacctgaacttctacaaggacgagaagatcagcaaggagcccaagggcagcatcttcctggacagctgcatgggcgtggtgcagaacaacaaggtgagaagattcgccttcgagctgaagatgcaggacaagagcagctacctgctggccgccgacagcgaggtggagatggaggagtggatcaccatcctgaacaagatcctgcagctgaacttcgaggccgccatgcaggagaagagaaacggcgacagccacgaggacgacgagcagagcaagctggagggcagcggcagcggcctggacagctacctgcccgagctggccaagagcgccagagaggccgagatcaagctgaagagcgagagcagagtgaagctgttctacctggaccccgacgcccagaagctggacttcagcagcgccgagcccgaggtgaagagcttcgaggagaagttcggcaagagaatcctggtgaagtgcaacgacctgagcttcaacctgcagtgctgcgtggccgagaacgaggagggccccaccaccaacgtggagcccttcttcgtgaccctgagcctgttcgacatcaagtacaacagaaagatcagcgccgacttccacgtggacctgaaccacttcagcgtgagacagatgctggccaccaccagccccgccctgatgaacggcagcggccagagccccagcgtgctgaagggcatcctgcacgaggccgccatgcagtaccccaagcagggcatcttcagcgtgacctgcccccaccccgacatcttcctggtggccagaatcgagaaggtgctgcagggcagcatcacccactgcgccgagccctacatgaagagcagcgacagcagcaaggtggcccagaaggtgctgaagaacgccaagcaggcctgccagagactgggccagtacagaatgcccttcgcctgggccgccagaaccctgttcaaggacgccagcggcaacctggacaagaacgccagattcagcgccatctacagacaggacagcaacaagctgagcaacgacgacatgctgaagctgctggccgacttcagaaagcccgagaagatggccaagctgcccgtgatcctgggcaacctggacatcaccatcgacaacgtgagcagcgacttccccaactacgtgaacagcagctacatccccaccaagcagttcgagacctgcagcaagacccccatcaccttcgaggtggaggagttcgtgccctgcatccccaagcacacccagccctacaccatctacaccaaccacctgtacgtgtaccccaagtacctgaagtacgacagccagaagagcttcgccaaggccagaaacatcgccatctgcatcgagttcaaggacagcgacgaggaggacagccagcccctgaagtgcatctacggcagacccggcggccccgtgttcaccagaagcgccttcgccgccgtgctgcaccaccaccagaaccccgagttctacgacgagatcaagatcgagctgcccacccagctgcacgagaagcaccacctgctgctgaccttcttccacgtgagctgcgacaacagcagcaagggcagcaccaagaagagagacgtggtggagacccaggtgggctacagctggctgcccctgctgaaggacggcagagtggtgaccagcgagcagcacatccccgtgagcgccaacctgcccagcggctacctgggctaccaggagctgggcatgggcagacactacggccccgagatcaagtgggtggacggcggcaagcccctgctgaagatcagcacccacctggtgagcaccgtgtacacccaggaccagcacctgcacaacttcttccagtactgccagaagaccgagagcggcgcccaggccctgggcaacgagctggtgaagtacctgaagagcctgcacgccatggagggccacgtgatgatcgccttcctgcccaccatcctgaaccagctgttcagagtgctgaccagagccacccaggaggaggtggccgtgaacgtgaccagagtgatcatccacgtggtggcccagtgccacgaggagggcctggagagccacctgagaagctacgtgaagtacgcctacaaggccgagccctacgtggccagcgagtacaagaccgtgcacgaggagctgaccaagagcatgaccaccatcctgaagcccagcgccgacttcctgaccagcaacaagctgctgaagtacagctggttcttcttcgacgtgctgatcaagagcatggcccagcacctgatcgagaacagcaaggtgaagctgctgagaaaccagagattccccgccagctaccaccacgccgtggagaccgtggtgaacatgctgatgccccacatcacccagaagttcagagacaaccccgaggccagcaagaacgccaaccacagcctggccgtgttcatcaagagatgcttcaccttcatggacagaggcttcgtgttcaagcagatcaacaactacatcagctgcttcgcccccggcgaccccaagaccctgttcgagtacaagttcgagttcctgagagtggtgtgcaaccacgagcactacatccccctgaacctgcccatgcccttcggcaagggcagaatccagagataccaggacctgcagctggactacagcctgaccgacgagttctgcagaaaccacttcctggtgggcctgctgctgagagaggtgggcaccgccctgcaggagttcagagaggtgagactgatcgccatcagcgtgctgaagaacctgctgatcaagcacagcttcgacgacagatacgccagcagaagccaccaggccagaatcgccaccctgtacctgcccctgttcggcctgctgatcgagaacgtgcagagaatcaacgtgagagacgtgagccccttccccgtgaacgccggcatgaccgtgaaggacgagagcctggccctgcccgccgtgaaccccctggtgaccccccagaagggcagcaccctggacaacagcctgcacaaggacctgctgggcgccatcagcggcatcggcaacgccccctgcagctgcggcctgctgagcaccatcaccctgaaggtgagctggagccagtag

SEQ ID NO: 20449 - DNA, 4182 bp, Artificial Sequence
  Description of Artificial Sequence: Synthetic coding sequence
atgggctgcaccaccagcgtgatcctgttcaagggcatcagaaccgtgttcgagagaaactgcgcctacatgtgcaagcagcagggcgagaacaacgccctggagtacaccgcctacaactggaccaaggaggacagcgagctgctgatcagcagctggctggccaagcccaagctgatcgagcccctggactacgagaacgtgatcgtgcagaagaagacccagatcctgaacgactgcctgagagagatgctgctgttcccctacgacgacttccagaccgccatcctgagaagacagggcagatacatctgcagcaccgtgcccgccaaggccgaggaggaggcccagagcctgttcgtgaccgagtgcatcaagacctacaacagcgactggcacctggtgaactacaagtacgaggactacagcggcgagttcagacagctgcccaacaaggtggtgaagctggacaagctgcccgtgcacgtgtacgaggtggacgaggaggtggacaaggacgaggacgccgccagcctgggcagccagaagggcggcatcaccaagcacggctggctgtacaagggcaacatgaacagcgccatcagcgtgaccatgagaagcttcaagagaagattcttccacctgatccagctgggcgacggcagctacaacctgaacttctacaaggacgagaagatcagcaaggagcccaagggcagcatcttcctggacagctgcatgggcgtggtgcagaacaacaaggtgagaagattcgccttcgagctgaagatgcaggacaagagcagctacctgctggccgccgacagcgaggtggagatggaggagtggatcaccatcctgaacaagatcctgcagctgaacttcgaggccgccatgcaggagaagagaaacggcgacagccacgaggacgacgagcagagcaagctggagggcagcggcagcggcctggacagctacctgcccgagctggccaagagcgccagagaggccgagatcaagctgaagagcgagagcagagtgaagctgttctacctggaccccgacgcccagaagctggacttcagcagcgccgagcccgaggtgaagagcttcgaggagaagttcggcaagagaatcctggtgaagtgcaacgacctgagcttcaacctgcagtgctgcgtggccgagaacgaggagggccccaccaccaacgtggagcccttcttcgtgaccctgagcctgttcgacatcaagtacaacagaaagatcagcgccgacttccacgtggacctgaaccacttcagcgtgagacagatgctggccaccaccagccccgccctgatgaacggcagcggccagagccccagcgtgctgaagggcatcctgcacgaggccgccatgcagtaccccaagcagggcatcttcagcgtgacctgcccccaccccgacatcttcctggtggccagaatcgagaaggtgctgcagggcagcatcacccactgcgccgagccctacatgaagagcagcgacagcagcaaggtggcccagaaggtgctgaagaacgccaagcaggcctgccagagactgggccagtacagaatgcccttcgcctgggccgccagaaccctgttcaaggacgccagcggcaacctggacaagaacgccagattcagcgccatctacagacaggacagcaacaagctgagcaacgacgacatgctgaagctgctggccgacttcagaaagcccgagaagatggccaagctgcccgtgatcctgggcaacctggacatcaccatcgacaacgtgagcagcgacttccccaactacgtgaacagcagctacatccccaccaagcagttcgagacctgcagcaagacccccatcaccttcgaggtggaggagttcgtgccctgcatccccaagcacacccagccctacaccatctacaccaaccacctgtacgtgtaccccaagtacctgaagtacgacagccagaagagcttcgccaaggccagaaacatcgccatctgcatcgagttcaaggacagcgacgaggaggacagccagcccctgaagtgcatctacggcagacccggcggccccgtgttcaccagaagcgccttcgccgccgtgctgcaccaccaccagaaccccgagttctacgacgagatcaagatcgagctgcccacccagctgcacgagaagcaccacctgctgctgaccttcttccacgtgagctgcgacaacagcagcaagggcagcaccaagaagagagacgtggtggagacccaggtgggctacagctggctgcccctgctgaaggacggcagagtggtgaccagcgagcagcacatccccgtgagcgccaacctgcccagcggctacctgggctaccaggagctgggcatgggcagacactacggccccgagatcaagtgggtggacggcggcaagcccctgctgaagatcagcacccacctggtgagcaccgtgtacacccaggaccagcacctgcacaacttcttccagtactgccagaagaccgagagcggcgcccaggccctgggcaacgagctggtgaagtacctgaagagcctgcacgccatggagggccacgtgatgatcgccttcctgcccaccatcctgaaccagctgttcagagtgctgaccagagccacccaggaggaggtggccgtgaacgtgaccagagtgatcatccacgtggtggcccagtgccacgaggagggcctggagagccacctgagaagctacgtgaagtacgcctacaaggccgagccctacgtggccagcgagtacaagaccgtgcacgaggagctgaccaagagcatgaccaccatcctgaagcccagcgccgacttcctgaccagcaacaagctgctgaagtacagctggttcttcttcgacgtgctgatcaagagcatggcccagcacctgatcgagaacagcaaggtgaagctgctgagaaaccagagattccccgccagctaccaccacgccgtggagaccgtggtgaacatgctgatgccccacatcacccagaagttcagagacaaccccgaggccagcaagaacgccaaccacagcctggccgtgttcatcaagagatgcttcaccttcatggacagaggcttcgtgttcaagcagatcaacaactacatcagctgcttcgcccccggcgaccccaagaccctgttcgagtacaagttcgagttcctgagagtggtgtgcaaccacgagcactacatccccctgaacctgcccatgcccttcggcaagggcagaatccagagataccaggacctgcagctggactacagcctgaccgacgagttctgcagaaaccacttcctggtgggcctgctgctgagagaggtgggcaccgccctgcaggagttcagagaggtgagactgatcgccatcagcgtgctgaagaacctgctgatcaagcacagcttcgacgacagatacgccagcagaagccaccaggccagaatcgccaccctgtacctgcccctgttcggcctgctgatcgagaacgtgcagagaatcaacgtgagagacgtgagccccttccccgtgaacgccggcatgaccgtgaaggacgagagcctggccctgcccgccgtgaaccccctggtgaccccccagaagggcagcaccctggacaacagcctgcacaaggacctgctgggcgccatcagcggcatcgccagcccctacaccaccagcacccccaacatcaacagcgtgagaaacgccgacagcagaggcagcctgatcagcaccgacagcggcaacagcctgcccgagagaaacagcgagaagagcaacagcctggacaagcaccagcagagcagcaccctgggcaacagcgtggtgagatgcgacaagctggaccagagcgagatcaagagcctgctgatgtgcttcctgtacatcctgaagagcatgagcgacgacgccctgttcacctactggaacaaggccagcaccagcgagctgatggacttcttcaccatcagcgaggtgtgcctgcaccagttccagtacatgggcaagagatacatcgccagcctgaccaagtgcgtggccctgctgctgcccgcctggaacagaaacgacgcctgccagatcgccgccgccggccagcccggctag

SEQ ID NO: 20450 - DNA, 753 bp, Artificial Sequence
  Description of Artificial Sequence: Synthetic coding sequence
gccgacagcagaggcagcctgatcagcaccgacagcggcaacagcctgcccgagagaaacagcgagaagagcaacagcctggacaagcaccagcagagcagcaccctgggcaacagcgtggtgagatgcgacaagctggaccagagcgagatcaagagcctgctgatgtgcttcctgtacatcctgaagagcatgagcgacgacgccctgttcacctactggaacaaggccagcaccagcgagctgatggacttcttcaccatcagcgaggtgtgcctgcaccagttccagtacatgggcaagagatacatcgccagcgtgagaaagatcagcagcgtgctgggcatcagcgtggacaacggctacggccacagcgacgccgacgtgctgcaccagagcctgctggaggccaacatcgccaccgaggtgtgcctgaccgccctggacaccctgagcctgttcaccctggccttcaagaaccagctgctggccgaccacggccacaaccccctgatgaagaaggtgttcgacgtgtacctgtgcttcctgcagaagcaccagagcgagaccgccctgaagaacgtgttcaccgccctgagaagcctgatctacaagttccccagcaccttctacgagggcagagccgacatgtgcgccgccctgtgctacgagatcctgaagtgctgcaacagcaagctgagcagcatcagaaccgaggccagccagctgctgtacttcctgatgagaaactag

SEQ ID NO: 20451 - DNA, 351 bp, Artificial Sequence
  Description of Artificial Sequence: Synthetic coding sequence
tgaagcgagctgatggacttcttcaccatcagcgaggtgtgcctgcaccagttccagtacatgggcaagagatacatcgccagaaaccaggagggcctgggccccatcgtgcacgacagaaagagccagaccctgcccgtgagcagaaacagaaccggcatgatgcacgccagactgcagcagctgggcagcctggacaacagcctgaccttcaaccacagctacggccacagcgacgccgacgtgctgcaccagagcctgctggaggccaacatcgccaccgaggtgtgcctgaccgccctggacaccctgagcctgttcaccctggccttcaagaaccagctgctgtag

SEQ ID NO: 20452 - DNA, 612 bp, Artificial Sequence
  Description of Artificial Sequence: Synthetic coding sequence
agaaagacctggctggacagcatggccagaatccacgtgaagaacggcgacctgagcgaggccgccatgtgctacgtgcacgtgaccgccctggtggccgagtacctgaccagaaagggcgtgttcagacagggctgcaccgccttcagagtgatcacccccaacatcgacgaggaggccagcatgatggaggacgtgggcatgcaggacgtgcacttcaacgaggacgtgctgatggagctgctggagcagtgcgccgacggcctgtggaaggccgagagatacgagctgatcgccgacatctacaagctgatcatccccatctacgagaagagaagagacttcgagagactggcccacctgtacgacaccctgcacagagcctacagcaaggtgaccgaggtgatgcacagcggcagaagactgctgggcacctacttcagagtggccttcttcggccagggcttcttcgaggacgaggacggcaaggagtacatctacaaggagcccaagctgacccccctgagcgagatcagccagagactgctgaagctgtacagcgacaagttcggcagcgagaacgtgaagatgatccaggacagcggcaagtag

SEQ ID NO: 20453 - DNA, 1122 bp, Artificial Sequence
  Description of Artificial Sequence: Synthetic coding sequence
atggccgagaccagagaggaggagaccgtgagcgccgaggccagcggcttcagcgacctgagcgacagcgagttcctggagttcctggacctggaggacgcccaggagagcaaggccctggtgaacatgcccggccccagcagcgagagcctgggcaaggacgacaagcccatcagcctgcagaactggaagagaggcctggacatcctgagccccatggagagattccacctgaagtacctgtacgtgaccgacctggccacccagaactggtgcgagctgcagaccgcctacggcaaggagctgcccggcttcctggcccccgagaaggccgccgtgctggacaccggcgccagcatccacctggccagagagctggagctgcacgacctggtgaccgtgcccgtgaccaccaaggaggacgcctgggccatcaagttcctgaacatcctgctgctgatccccaccctgcagagcgagggccacatcagagagttccccgtgttcggcgagggcgagggcgtgctgctggtgggcgtgatcgacgagctgcactacaccgccaagggcgagctggagctggccgagctgaagaccagaagaagacccatgctgcccctggaggcccagaagaagaaggactgcttccaggtgagcctgtacaagtacatcttcgacgccatggtgcagggcaaggtgacccccgccagcctgatccaccacaccaagctgtgcctggagaagcccctgggccccagcgtgctgagacacgcccagcagggcggcttcagcgtgaagagcctgggcgacctgatggagctggtgttcctgagcctgaccctgagcgacctgcccgtgatcgacatcctgaagatcgagtacatccaccaggagaccgccaccgtgctgggcaccgagatcgtggccttcaaggagaaggaggtgagagccaaggtgcagcactacatggcctactggatgggccacagagagccccagggcgtggacgtggaggaggcctggaagtgcagaacctgcacctacgccgacatctgcgagtggagaaagggcagcggcgtgctgagcagcaccctggccccccaggtgaagaaggccaagtag

SEQ ID NO: 20454 - DNA, 1122 bp, Artificial Sequence; identical to SEQ ID NO: 20453
  Description of Artificial Sequence: Synthetic coding sequence

SEQ ID NO: 20455 - DNA, 1122 bp, Artificial Sequence; identical to SEQ ID NO: 20453
  Description of Artificial Sequence: Synthetic coding sequence

SEQ ID NO: 20456 - DNA, 486 bp, Artificial Sequence
  Description of Artificial Sequence: Synthetic coding sequence
atggccgagaccagagaggaggagaccgtgagcgccgaggccagcggcttcagcgacctgagcgacagcgagttcctggagttcctggacctggaggacgcccaggagagcaaggccctggtgaacatgcccggccccagcagcgagagcctgggcaaggacgacaagcccatcagcctgcagaactggaagagaggcctggacatcctgagccccatggagagattccacctgaagtacctgtacgtgaccgacctggccacccagaactggtgcgagctgcagaccgcctacggcaaggagctgcccggcttcctggcccccgagaaggccgccgtgctggacaccggcgccagcatccacctggccagagagctggagctgcacgacctggtgaccgtgcccgtgaccaccaaggaggacgcctgggccatcaagttcctgaacatcctgctgctgatccccaccctgcagagcgagggctag

SEQ ID NO: 20457 - DNA, 675 bp, Artificial Sequence
  Description of Artificial Sequence: Synthetic coding sequence
atggccgagaccagagaggaggagaccgtgagcgccgaggccagcggcttcagcgacctgagcgacagcgagttcctggagttcctggacctggaggacgcccaggagagcaaggccctggtgaacatgcccggccccagcagcgagagcctgggcaaggacgacaagcccatcagcctgcagaactggaagagaggcctggacatcctgagccccatggagagattccacctgaagtacctgtacgtgaccgacctggccacccagaactggtgcgagctgcagaccgcctacggcaaggagctgcccggcttcctggcccccgagaaggccgccgtgctggacaccggcgccagcatccacctggccagagagctggagctgcacgacctggtgaccgtgcccgtgaccaccaaggaggacgcctgggccatcaagttcctgaacatcctgctgctgatccccaccctgcagagcgagggccacatcagagagttccccgtgttcggcgagggcgagggcgtgctgctggtgggcgtgatcgacgagctgcactacaccgccaagggcgagctggagctggccgagctgaagaccagaagaagacccatgctgcccctggaggcccagaagaagaaggactgcttccaggtgagcctgtacaagtacatctag

SEQ ID NO: 20458 - DNA, 744 bp, Artificial Sequence
  Description of Artificial Sequence: Synthetic coding sequence
atggccgagaccagagaggaggagaccgtgagcgccgaggccagcggcttcagcgacctgagcgacagcgagttcctggagttcctggacctggaggacgcccaggagagcaaggccctggtgaacatgcccggccccagcagcgagagcctgggcaaggacgacaagcccatcagcctgcagaactggaagagaggcctggacatcctgagccccatggagagattccacctgaagtacctgtacgtgaccgacctggccacccagaactggtgcgagctgcagaccgcctacggcaaggagctgcccggcttcctggcccccgagaaggccgccgtgctggacaccggcgccagcatccacctggccagagagctggagctgcacgacctggtgaccgtgcccgtgaccaccaaggaggacgcctgggccatcaagttcctgaacatcctgctgctgatccccaccctgcagagcgagggccacatcagagagttccccgtgttcggcgagggcgagggcgtgctgctggtgggcgtgatcgacgagctgcactacaccgccaagggcgagctggagctggccgagctgaagaccagaagaagacccatgctgcccctggaggcccagaagaagaaggactgcttccaggtgagcctgtacaagtacatcttcgacgccatggtgcagggcaaggtgacccccgccagcctgatccaccacaccaagctgtgcctggagtag

SEQ ID NO: 20459 - DNA, 681 bp, Artificial Sequence
  Description of Artificial Sequence: Synthetic coding sequence
atggccgagaccagagaggaggagaccgtgagcgccgaggccagcggcttcagcgacctgagcgacagcgagttcctggagttcctggacctggaggacgcccaggagagcaaggccctggtgaacatgcccggccccagcagcgagagcctgggcaaggacgacaagcccatcagcctgcagaactggaagagaggcctggacatcctgagccccatggagagattccacctgaagtacctgtacgtgaccgacctggccacccagaactggtgcgagctgcagaccgcctacggcaaggagctgcccggcttcctggcccccgagaaggccgccgtgctggacaccggcgccagcatccacctggccagagagctggagctgcacgacctggtgaccgtgcccgtgaccaccaaggaggacgcctgggccatcaagttcctgaacatcctgctgctgatccccaccctgcagagcgagggccacatcagagagttccccgtgttcggcgagggcgagggcgtgctgctggtgggcgtgatcgacgagctgcactacaccgccaagggcgagctggagctggccgagctgaagaccagaagaagacccatgctgcccctggaggcccagaagaagaaggactgcttccaggtgagcctgtacaagtacatcttcgactag

SEQ ID NO: 20460 - DNA, 303 bp, Artificial Sequence
  Description of Artificial Sequence: Synthetic coding sequence
atggccgagaccagagaggaggagaccgtgagcgccgaggccagcggcttcagcgacctgagcgacagcgagttcctggagttcctggacctggaggacgcccaggagagcaaggccctggtgaacatgcccggccccagcagcgagagcctgggcaaggacgacaagcccatcagcctgcagaactggaagagaggcctggacatcctgagccccatggagagattccacctgaagtacctgtacgtgaccgacctggccacccagaactggtgcgagctgcagaccgcctacggcaagtag

SEQ ID NO: 20461 - DNA, 744 bp, Artificial Sequence; identical to SEQ ID NO: 20458
  Description of Artificial Sequence: Synthetic coding sequence

SEQ ID NO: 20462 - DNA, 129 bp, Artificial Sequence
  Description of Artificial Sequence: Synthetic coding sequence
tgcagaagccagaagagctgctggatcatcaagggccactgcagaaagaactgcaagcccggcgagcaggtgaagaagccctgcaagaacggcgactactgctgcatccccagcaacaccgacagctag

SEQ ID NO: 20463 - DNA, 876 bp, Artificial Sequence
  Description of Artificial Sequence: Synthetic coding sequence
atggtgagagagcagtacaccaccgccaccgagggcatctgcatcgagagacccgagaaccagtacgtgtacaagatcggcatctacggctggagaaagagatgcctgtacctgttcgtgctgctgctgctgatcatcctggtggtgaacctggccctgaccatctggatcctgaaggtgatgtggttcagccccgccggcatgggccacctgtgcgtgaccaaggacggcctgagactggagggcgagagcgagttcctgttccccctgtacgccaaggagatccacagcagagtggacagcagcctgctgctgcagagcacccagaacgtgaccgtgaacgccagaaacagcgagggcgaggtgaccggcagactgaaggtgggccccaagatggtggaggtgcagaaccagcagttccagatcaacagcaacgacggcaagcccctgttcaccgtggacgagaaggaggtggtggtgggcaccgacaagctgagagtgaccggccccgagggcgccctgttcgagcacagcgtggagacccccctggtgagagccgaccccttccaggacctgagactggagagccccaccagaagcctgagcatggacgcccccagaggcgtgcacatccaggcccacgccggcaagatcgaggccctgagccagatggacatcctgttccacagcagcgacggcatgctggtgctggacgccgagaccgtgtgcctgcccaagctggtgcagggcacctggggccccagcggcagcagccagagcctgtacgagatctgcgtgtgccccgacggcaagctgtacctgagcgtggccggcgtgagcaccacctgccaggagcacaaccacatctgcctgtag

SEQ ID NO: 20464 - DNA, 816 bp, Artificial Sequence
  Description of Artificial Sequence: Synthetic coding sequence
atgaacctgcacgtgaagaccctgagcctgatgacctggagaagcagattcctggaggagagcttctggagcctggaggagaccgccgccctggccaagcagctgcccctgaagagccccagcgagaacatcttcctgcacatcgtggacctgagcgaccccaagcagatctggaagttcgtggagaacttcaagcaggagcacaagctgcacgtgctgatcaacaacgccggctgcatggtgaacaagagagagctgaccgaggacggcctggagaagaacttcgccgccaacaccctgggcgtgtacatcctgaccaccggcctgatccccgtgctggagaaggagcacgaccccagagtgatcaccgtgagcagcggcggcatgctggtgcagaagctgaacaccaacgacctgcagagcgagagaacccccttcgacggcaccatggtgtacgcccagaacaagagacagcaggtggtgctgaccgagagatgggcccagggccaccccgccatccacttcagcagcatgcaccccggctgggccgacacccccgacagaaacgagcaggagctgagaaaggtggtgggcgaggcccagaccgccagccccctgcccagattcctggagatcatgatgcacgagggcaagtgccagccccagggccacagcagcaacgacctggaggcctgctggagcagcggcggcggcgagcagaacagcctgcccgactggccccaccagctgcacgacctgagacagctgacctgggccctgtgcagcagcttcctgctgtacaagcagggcaactag

SEQ ID NO: 20465 - DNA, 954 bp, Artificial Sequence
  Description of Artificial Sequence: Synthetic coding sequence
atgagcctgtacagaagcgtggtgtggttcgccaagggcctgagagagtacaccaagagcggctacgagagcgcctgcaaggacttcgtgccccacgacctggaggtgcagatccccggcagagtgttcctggtgaccggcggcaacagcggcatcggcaaggccaccgccctggagatcgccaagagaggcggcaccgtgcacctggtgtgcagagaccaggcccccgccgaggacgccagaggcgagatcatcagagagagcggcaaccagaacatcttcctgcacatcgtggacctgagcgaccccaagcagatctggaagttcgtggagaacttcaagcaggagcacaagctgcacgtgctgatcaacaacgccggctgcatggtgaacaagagagagctgaccgaggacggcctggagaagaacttcgccgccaacaccctgggcgtgtacatcctgaccaccggcctgatccccgtgctggagaaggagcacgaccccagagtgatcaccgtgagcagcggcggcatgctggtgcagaagctgaacaccaacgacctgcagagcgagagaacccccttcgacggcaccatggtgtacgcccagaacaagagacagcaggtggtgctgaccgagagatgggcccagggccaccccgccatccacttcagcagcatgcaccccggctgggccgacacccccggcgtgagacaggccatgcccggcttccacgccagattcggcgacagactgagaagcgaggcccagggcgccgacaccatgctgtggctggccctgagcagcgccgccgccgcccagcccagcggcagattcttccaggacagaaagcccgtgagcacccacctgcccctggccaccgccagcagcagccccgccgaggaggagaagctgatcgagatcctggagcagctggcccagaccttcaagtag

SEQ ID NO: 20466 - DNA, 699 bp, Artificial Sequence
  Description of Artificial Sequence: Synthetic coding sequence
atgcagatggccagactgctgggcctgtgcgcctgggccagaaagagcgtgagaatggccagcagcagaatgaccagaagagaccccctgaccaacaaggtggccctggtgaccgccagcaccgacggcatcggcttcgccatcgccagaagactggcccaggacagagcccacgtggtggtgagcagcagaaagcagcagaacgtggaccaggccgtggccaccctgcagggcgagggcctgagcgtgaccggcaccgtgtgccacgtgggcaaggccgaggacagagagagactggtggccatggccgtgaagctgcacggcggcatcgacatcctggtgagcaacgccgccgtgaaccccttcttcggcagcctgatggacgtgaccgaggaggtgtgggacaagaccctggacatcaacgtgaaggcccccgccctgatgaccaaggccgtggtgcccgagatggagaagagaggcggcggcagcgtggtgatcgtgagcagcatcgccgccttcagccccagccccggcttcagcccctacaacgtgagcaagaccgccctgctgggcctgaacaacaccctggccatcgagctggcccccagaaacatcagagtgaactgcctgcacctggacctgagcagactggccagcgccggctgcagcggctggaccagaaagaagagaaaggcctag

SEQ ID NO: 20467 - DNA, 648 bp, Artificial Sequence
  Description of Artificial Sequence: Synthetic coding sequence
atgcccttcccctgcctgagcctgcccagcagctgggactacagaatcggcttcgccatcgccagaagactggcccaggacagagcccacgtggtggtgagcagcagaaagcagcagaacgtggaccaggccgtggccaccctgcagggcgagggcctgagcgtgaccggcaccgtgtgccacgtgggcaaggccgaggacagagagagactggtggccatgaccctggacatcaacgtgaaggcccccgccctgatgaccaaggccgtggtgcccgagatggagaagagaggcggcggcagcgtggtgatcgtgagcagcatcgccgccttcagccccagccccggcttcagcccctacaacgtgagcaagaccgccctgctgggcctgaacaacaccctggccatcgagctggcccccagaaacatcagagtgaactgcctgcccggcctgatcaagaccagcttcagcagaatgctgtggatggacaaggagaaggaggagagcatgaaggagaccctgagaatcagaagactgggcgagcccgaggactgcgccggcatcgtgagcttcctgtgcagcgaggacgccagctacatcaccggcgagaccgtggtggtgggcggcggcacccccagcagactgtag

SEQ ID NO: 20468 - DNA, 774 bp, Artificial Sequence
  Description of Artificial Sequence: Synthetic coding sequence
atggccagactgctgggcctgtgcgcctgggccagaaagagcgtgagaatggccagcagcagaatgaccagaagagaccccctgaccaacaaggtggccctggtgaccgccagcaccgacggcatcggcttcgccatcgccagaagactggcccaggacagagcccacgtggtggtgagcagcagaaagcagcagaacgtggaccaggccgtggccaccctgcagggcgagggcctgagcgtgaccggcaccgtgtgccacgtgggcaaggccgaggacagagagagactggtggccatggccgtgaagctgcacggcggcatcgacatcctggtgagcaacgccgccgtgaaccccttcttcggcagcctgatggacgtgaccgaggaggtgtgggacaagaccctggacatcaacgtgaaggcccccgccctgatgaccaaggccgtggtgcccgagatggagaagagaggcggcggcagcgtggtgatcgtgagcagcatcgccgccttcagccccagccccggcttcagcccctacaacgtgagcaagaccgccctgctgggcctgaacaacaccctggccatcgagctggcccccagaaacatcagagtgaactgcctgcacctggacctgagcagactggccagcgccggctggctgggcgagcccgaggactgcgccggcatcgtgagcttcctgtgcagcgaggacgccagctacatcaccggcgagaccgtggtggtgggcggcggcacccccagcagactgtag

SEQ ID NO: 20469 - DNA, 276 bp, Artificial Sequence
  Description of Artificial Sequence: Synthetic coding sequence
atggccgtgaagctgcacggcggcatcgacatcctggtgagcaacgccgccgtgaaccccttcttcggcagcctgatggacgtgaccgaggaggtgtgggacaagctgtggatggacaaggagaaggaggagagcatgaaggagaccctgagaatcagaagactgggcgagcccgaggactgcgccggcatcgtgagcttcctgtgcagcgaggacgccagctacatcaccggcgagaccgtggtggtgggcggcggcacccccagcagactgtag

SEQ ID NO: 20470 - DNA, 174 bp, Artificial Sequence
  Description of Artificial Sequence: Synthetic coding sequence
atgctgtggatggacaaggagaaggaggagagcatgaaggagaccctgagaatcagaagactgggcgagcccgaggactgcgccggcatcgtgagcttcctgtgcagcgaggacgccagctacatcaccggcgagaccgtggtggtgggcggcggcacccccagcagactgtag

SEQ ID NO: 20471 - DNA, 468 bp, Artificial Sequence
  Description of Artificial Sequence: Synthetic coding sequence
atgcagatggccagactgctgggcctgtgcgcctgggccagaaagagcgtgagaatggccagcagcagaatgaccagaagagaccccctgaccaacaaggtggccctggtgaccgccagcaccgacggcatcggcttcgccatcgccagaagactggcccaggacagagcccacgtggtggtgagcagcagaaagcagcagaacgtggaccaggccgtggccaccctgcagggcgagggcctgagcgtgaccggcaccgtgtgccacgtgggcaaggccgaggacagagagagactggtggccatggccgtgaagctgcacggcggcatcgacatcctggtgagcaacgccgccgtgaaccccttcttcggcagcctgatggacgtgaccgaggaggtgtgggacaagctgtggatggacaaggagaaggaggagagcatgaaggagaccctgagaatcagaagatag

SEQ ID NO: 20472 - DNA, 993 bp, Artificial Sequence
  Description of Artificial Sequence: Synthetic coding sequence
atgagccccctgagcgccgccagagccgccctgagagtgtacgccgtgggcgccgccgtgatcctggcccagctgctgagaagatgcagaggcggcttcctggagcccgtgttcccccccagacccgacagagtggccatcgtgaccggcggcaccgacggcatcggctacagcaccgccaagcacctggccagactgggcatgcacgtgatcatcgccggcaacaacgacagcaaggccaagcaggtggtgagcaagatcaaggaggagaccctgaacgacaaggtggagttcctgtactgcgacctggccagcatgaccagcatcagacagttcgtgcagaagttcaagatgaagaagatccccctgcacgtgctgatcaacaacgccggcgtgatgatggtgccccagagaaagaccagagacggcttcgaggagcacttcggcctgaactacctgggccacttcctgctgaccaacctgctgctggacaccctgaaggagagcggcagccccggccacagcgccagagtggtgaccgtgagcagcgccacccactacgtggccgagctgaacatggacgacctgcagagcagcgcctgctacagcccccacgccgcctacgcccagagcaagctggccctggtgctgttcacctaccacctgcagagactgctggccgccgagggcagccacgtgaccgccaacgtggtggaccccggcgtggtgaacaccgacgtgtacaagcacgtgttctgggccaccagactggccaagaagctgctgggctggctgctgttcaagacccccgacgagggcgcctggaccagcatctacgccgccgtgacccccgagctggagggcgtgggcggccactacctgtacaacgagaaggagaccaagagcctgcacgtgacctacaaccagaagctgcagcagcagctgtggagcaagagctgcgagatgaccggcgtgctggacgtgaccctgtag

SEQ ID NO: 20473 - DNA, 168 bp, Artificial Sequence
  Description of Artificial Sequence: Synthetic coding sequence
atgaagatgagcttcgagagatgcaccgccagaaacaagatgttcgtgaacagcgccttcaccaaggtggacaactactgcaccttcctgatggagaaggtgctgttcaaggtgctgttcctggtggagtactaccagaagggcaagaagaacgacctgaacttctag

SEQ ID NO: 20474 - DNA, 168 bp, Artificial Sequence; identical to SEQ ID NO: 20473
  Description of Artificial Sequence: Synthetic coding sequence

SEQ ID NO: 20475 - DNA, 483 bp, Artificial Sequence
  Description of Artificial Sequence: Synthetic coding sequence
atggccagccccgcccccctggtggccagcatcagccaccagatggtggccctgcagaccctgcagctgctgcagcaggagtggggctggggcgacggccccgtggcccccggcaaccccagagaccccgaccacgtgagcaccgcccccgccagaagaagcggcccccccagagccagacccggccccggcagagaggagagaggcggcggcgtgggcaccagaagcagaagaaccgccgccagagccaacagccccgaggaggaggtggtgagaggcgccgagggcggcgccgagctgctgcccttccccagagacagaggcccctgcaccctggcccagatggccatgagaagcgccctggccagagtggtggacagcaccagcgagctggtgagcgtggagcagaccctgctgggccccctgcagcaggagagaagcttccccatccacctgaagctgcagctgctggccaacgagtag

SEQ ID NO: 20476 - DNA, 525 bp, Artificial Sequence
  Description of Artificial Sequence: Synthetic coding sequence
atggccagccccgcccccctggtggccagcatcagccaccagatggtggccctgcagaccctgcagctgctgcagcaggagtggggctggggcgacgccgccagagccaacagccccgaggaggaggtggtgagaggcgccgagggcggcgccgagctgctgcccttccccagagacagaggcccctgcaccctggcccagatggccatgagaagcgccctggccagagtggtggacagcaccagcgagctggtgagcgtggagcagaccctgctgggccccctgcagcaggagagaagcttccccatccacctgaaggacagcgtggagttcagaaacatctgcagccacctggccctgcagatcgagggccagcagttcgacagagacctgaacgccgcccaccagtgcctgaagaccatcgtgaagaagctgatccagagcctggccaacttccccagcgacgcccacatggtggcctgcgccagcctgagacagatcctgcagaacctgcccgacatctag

SEQ ID NO: 20477 - DNA, 666 bp, Artificial Sequence
  Description of Artificial Sequence: Synthetic coding sequence
atggccagccccgcccccctggtggccagcatcagccaccagatggtggccctgcagaccctgcagctgctgcagcaggagtggggctggggcgacggccccgtggcccccggcaaccccagagaccccgaccacgtgagcaccgcccccgccagaagaagcggcccccccagagccagacccggccccggcagagaggagagaggcggcggcgtgggcaccagaagcagaagaaccgccgccagagccaacagccccgaggaggaggtggtgagaggcgccgagggcggcgccgagctgctgcccttccccagagacagaggcccctgcaccctggcccagatggccatgagaagcgccctggccagagtggtggacagcaccagcgagctggtgagcgtggagcagaccctgctgggccccctgcagcaggagagaagcttccccatccacctgaaggacagcgtggagttcagaaacatctgcagccacctggccctgcagatcgagggccagcagttcgacagagacctgaacgccgcccaccagtgcctgaagaccatcgtgaagaagctgatccagagcctggccaacttccccagcgacgcccacatggtggcctgcgccagcctgagacagatcctgcagaacctgcccgacatctag

SEQ ID NO: 20478 - DNA, 513 bp, Artificial Sequence
  Description of Artificial Sequence: Synthetic coding sequence
atggccgtgaccggctggctggagagcctgagaaccgcccagaagaccgccctgctgcaggacggcagaagaaaggtgcactacctgttccccgacggcaaggagatggccgaggagtacgacgagaagaccagcgagctgctggtgagaaagtggagagtgaagagcgccctgggcgccatgggccagtggcagctggaggtgggcgaccccgcccccctgggcgccggcaacctgggccccgagctgatcaaggagagcaacgccaaccccatcttcatgagaaaggacaccaagatgagcttccagtggagaatcagaaacctgccctaccccaaggacgtgtacagcgtgagcgtggaccagaaggagagatgcatcatcgtgagaaccaccaacaagaagagaaccggctggagactgctgtggacccccctggccatgagatgcgccggcgtgcacggcacccccagcgagatcgacaccagctacctgtggatgaccccctgctag

SEQ ID NO: 20479 - DNA, 513 bp, Artificial Sequence; identical to SEQ ID NO: 20478
  Description of Artificial Sequence: Synthetic coding sequence

SEQ ID NO: 20480 - DNA, 354 bp, Artificial Sequence
  Description of Artificial Sequence: Synthetic coding sequence
atggccgaggagtacgacgagaagaccagcgagctgctggtgagaaagtggagagtgaagagcgccctgggcgccatgggccagtggcagctggaggtgggcgaccccgcccccctgggcgccggcaacctgggccccgagctgatcaaggagagcaacgccaaccccatcttcatgagaaaggacaccaagatgagcttccagtggagaatcagaaacctgccctaccccaaggacgtgtacagcgtgagcgtggaccagaaggagagatgcatcatcgtgagaaccaccaacaagaacaccagaagccagagaagactgtggtggcccagcctgagctacagaagaaactag

SEQ ID NO: 20481 - DNA, 612 bp, Artificial Sequence
  Description of Artificial Sequence: Synthetic coding sequence
atggccgtgaccggctggctggagagcctgagaaccgcccagaagaccgccctgctgcaggacggcagaagaaaggtgcactacctgttccccgacggcaaggagatggccgaggagtacgacgagaagaccagcgagctgctggtgagaaagtggagagtgaagagcgccctgggcgccatgggccagtggcagctggaggtgggcgaccccgcccccctgggcgccggcaacctgggccccgagctgatcaaggagagcaacgccaaccccatcttcatgagaaaggacaccaagatgagcttccagtggagaatcagaaacctgccctaccccaaggacgtgtacagcgtgagcgtggaccagaaggagagatgcatcatcgtgagaaccaccaacaagaagtactacaagaagttcagcatccccgacctggacagacaccagctgcccctggacgacgccctgctgagcttcgcccacgccaactgcaccctgatcatcagctaccagaagcccaaggaggtggtggtggccgagagcgagctgcagaaggagctgaagaaggtgaagaccgcccacagcaacgacggcgactgcaagacccagtag

SEQ ID NO: 20482 - DNA, 741 bp, Artificial Sequence
  Description of Artificial Sequence: Synthetic coding sequence
atggagaccagaagaggcagaagaagaaccttcggcggcgagtgggagagacccgcccccgtgctggtgagcgccagcagacacggcggcgcccagagaagaagctgcggcgagatgggccacggcagaagcagatgcggcgagcccagcggcaacggcggcgtgagccagctgagagtgaagagcagagccggcgccgtgtacagcccctgcacccagctggcccaggccagagagagccagctgggcgccagaagaaagctggagtgccccacccccgcccccagagtgagccccacccccagagtgggccccagagtgggcagcaccaccggccaggccagccaccccggcgtgggcagaaacagacccctgaccagcagagccaacgagagcggcagaagaggcgagggcggccagatggccagaatcgccagcgagagcgccggcagcgaccccctggagagactgccctggcagagactgggcgtgctgctgagcagaggcaagatggccgtgaccggctggctggagagcctgagaaccgcccagaagaccgccctgctgcaggacggcaacagcagagtgcccaccggcagcttcgtgttcttcccccagggccccgccctgagagagggcccccagggcctgggcagacagagctggaagggcctgggcggccagcccggccaggtgctgcacctgcagatgagaagactgagattcaccgagatgacctag

SEQ ID NO: 20483 - DNA, 351 bp, Artificial Sequence
  Description of Artificial Sequence: Synthetic coding sequence
gccgaggagtacgacgagaagaccagcgagctgctggtgagaaagtggagagtgaagagcgccctgggcgccatgggccagtggcagctggaggtgggcgaccccgcccccctgggcgccggcaacctgggccccgagctgatcaaggagagcaacgccaaccccatcttcatgagaaaggacaccaagatgagcttccagtggagaatcagaaacctgccctaccccaaggacgtgtacagcgtgagcgtggaccagaaggagagatgcatcatcgtgagaaccaccaacaagaacaccagaagccagagaagactgtggtggcccagcctgagctacagaagaaactag

SEQ ID NO: 20484 - DNA, 3030 bp, Artificial Sequence
  Description of Artificial Sequence: Synthetic coding sequence
atggacatgttcagcctggacatgatcatcagcgaccccgccgccgaggccagcagagccggcaagaagcagctgagaggcgtgcagaacccctgccccagcgccagagccagacccagacacaagagcctgaacatcaaggacaagatcagcgagtgggagggcaagaaggaggtgcccacccccgcccccagcagaagagccgacggccaggaggactacctgcccagcagcaccgtggagagaagaagcagcgacggcgtgagaacccaggtgaccgaggccaagaacggcatgagacccggcaccgagagcaccgagaaggagagaaacaagggcgccgtgaacgtgggcggccaggaccccgagcccggccaggacctgagccagcccgagagagaggtggaccccagctggggcagaggcagagagcccagactgggcaagctgagattccagaacgaccccctgagcgtgctgaagcaggtgaagaagctggagcaggccctgaaggacggcagcgccggcctggacccccagctgcccggcacctgctacagcccccactgcccccccgacaaggccgaggccggcagcaccctgcccgagaacctgggcggcggcagcggcagcgaggtgagccagagagtgcaccccagcgacctggagggcagagagcccacccccgagctggtggaggacagaaagggcagctgcagaagaccctgggacagaagcctggagaacgtgtacagaggcagcgagggcagccccaccaagcccttcatcaaccccctgcccaagcccagaagaaccttcaagcacgccggcgagggcgacaaggacggcaagcccggcatcggcttcagaaaggagaagagaaacctgccccccctgcccagcctgccccccccccccctgcccagcagccccccccccagcagcgtgaacagaagactgtggaccggcagacagaagagcagcgccgaccacagaaagagctacgagttcgaggacctgctgcagagcagcagcgagagcagcagagtggactggtacgcccagaccaagctgggcctgaccagaaccctgagcgaggagaacgtgtacgaggacatcctggacccccccatgaaggagaacccctacgaggacatcgagctgcacggcagatgcctgggcaagaagtgcgtgctgaacttccccgccagccccaccagcagcatccccgacaccctgaccaagcagagcctgagcaagcccgccttcttcagacagaacagcgagagaagaaacttcaagctgctggacaccagaaagctgagcagagacggcaccggcagccccagcaagatcagcccccccagcacccccagcagccccgacgacatcttcttcaacctgggcgacccccagaacggcagaaagaagagaaagatccccaagctggtgctgagaatcaacgccatctacgaggtgagaagaggcaagaagagagtgaagagactgagccagagcatggagagcaacagcggcaaggtgaccgacgagaacagcgagagcgacagcgacaccgaggagaagctgaaggcccacagccagagactggtgaacgtgaagagcagactgaagcaggcccccagataccccagcctggccagagagctgatcgagtaccaggagagacagctgttcgagtacttcgtggtggtgagcctgcacaagaagcaggccggcgccgcctacgtgcccgagctgacccagcagttccccctgaagctggagagaagcttcaagttcatgagagaggccgaggaccagctgaaggccatcccccagttctgcttccccgacgccaaggactgggtgcccgtgcagcagttcaccagcgagaccttcagcttcgtgctgaccggcgaggacggcagcagaagattcggctactgcagaagactgctgcccggcggcaagggcaagagactgcccgaggtgtactgcatcgtgagcagactgggctgcttcagcctgttcagcagaatcctggacgaggtggagaagagaagaggcatcagccccgccctggtgcagcccctgatgagaagcgtgatggaggcccccttccccgccctgggcaagaccatcctggtgaagaacttcctgcccggcagcggcaccgaggtgatcgagctgtgcagacccctggacagcagactggagcacgtggacttcgagagcctgttcagcagcctgagcgtgagacacctggtgtgcgtgttcgccagcctgctgctggagagaagagtgatcttcatcgccgacaagctgagcatcctgagcaagtgctgccacgccatggtggccctgatctaccccttcgcctggcagcacacctacatccccgtgctgccccccgccatggtggacatcgtgtgcagccccacccccttcctgatcggcctgctgagcagcagcctgcccctgctgagagagctgcccctggaggaggtgctggtggtggacctggtgaacagcagattcctgagacagatggacgacgaggacagcatcctgcccagaaagctgcaggtggccctggagcacatcctggagcagagaaacgagctggcctgcgagcaggacgagggccccctggacggcagacacggccccgagagcagccccctgaacgaggtggtgagcgaggccttcgtgagattcttcgtggagatcgtgggccactacagcctgttcctgaccagcggcgagagagaggagagaaccctgcagagagaggccttcagaaaggccgtgagcagcaagagcctgagacacttcctggaggtgttcatggagacccagatgttcagaggcttcatccaggagagagagctgagaagacaggacgccaagggcctgttcgaggtgagagcccaggagtacctggagaccctgcccagcggcgagcacagcggcgtgaacaagttcctgaagggcctgggcaacaagatgaagttcctgcacaagaagtag

SEQ ID NO: 20485 - DNA, 240 bp, Artificial Sequence
  Description of Artificial Sequence: Synthetic coding sequence
atggacatgttcagcctggacatgatcatcagcgaccccgccgccgaggccagcagagccggcaagaagcagctgagaggcgtgcagaacccctgccccagcgccagagccagacccagacacaagagcctgaacatcaaggacaagatcagcgagtgggagggcaagaaggaggtgcccacccccgcccccagcagaagagccgacggccaggaggactacctgcccagcagcacctag

SEQ ID NO: 20486 - DNA, 273 bp, Artificial Sequence
  Description of Artificial Sequence: Synthetic coding sequence
atggacatgttcagcctggacatgatcatcagcgaccccgccgccgaggccagcagagccggcaagaagcagctgagaggcgtgcagaacccctgccccagcgccagagccagacccagacacaagagcctgaacatcaaggacaagatcagcgagtgggagggcaagaaggaggtgcccacccccgcccccagcagaagagccgacggccaggaggactacctgcccagcagcaccgtggagagaagaagcagcgacggcgtgagaacctag

SEQ ID NO: 20487 - DNA, 477 bp, Artificial Sequence
  Description of Artificial Sequence: Synthetic coding sequence
atggacatgttcagcctggacatgatcatcagcgaccccgccgccgaggccagcagagccggcaagaagcagctgagaggcgtgcagaacccctgccccagcgccagagccagacccagacacaagagcctgaacatcaaggacaagatcagcgagtgggagggcaagaaggaggtgcccacccccgcccccagcagaagagccgacggccaggaggactacctgcccagcagcaccgtggagagaagaagcagcgacggcgtgagaacccaggtgaccgaggccaagaacggcatgagacccggcaccgagagcaccgagaaggagagaaacaagggcgccgtgaacgtgggcggccaggaccccgagcccggccaggacctgagccagcccgagagagaggtggaccccagctggggcagaggcagagagcccagactgggcaagctgagattccagaacgaccccctgagctag

SEQ ID NO: 20488 - DNA, 2388 bp, Artificial Sequence
  Description of Artificial Sequence: Synthetic coding sequence
atggacatgttcagcctggacatgatcatcagcgaccccgccgccgaggccagcagagccggcaagaagcagctgagaggcgtgcagaacccctgccccagcgccagagccagacccagacacaagagcctgaacatcaaggacaagatcagcgagtgggagggcaagaaggaggtgcccacccccgcccccagcagaagagccgacggccaggaggactacctgcccagcagcaccgtggagagaagaagcagcgacggcgtgagaacccaggtgaccgaggccaagaacggcatgagacccggcaccgagagcaccgagaaggagagaaacaagggcgccgtgaacgtgggcggccaggaccccgagcccggccaggacctgagccagcccgagagagaggtggaccccagctggggcagaggcagagagcccagactgggcaagctgagattccagaacgaccccctgagcgtgctgaagcaggtgaagaagctggagcaggccctgaaggacggcagcgccggcctggacccccagctgcccggcacctgctacagcccccactgcccccccgacaaggccgaggccggcagcaccctgcccgagaacctgggcggcggcagcggcagcgaggtgagccagagagtgcaccccagcgacctggagggcagagagcccacccccgagctggtggaggacagaaagggcagctgcagaagaccctgggacagaagcctggagaacgtgtacagaggcagcgagggcagccccaccaagcccttcatcaaccccctgcccaagcccagaagaaccttcaagcacgccggcgagggcgacaaggacggcaagcccggcatcggcttcagaaaggagaagagaaacctgccccccctgcccagcctgccccccccccccctgcccagcagccccccccccagcagcgtgaacagaagactgtggaccggcagacagaagagcagcgccgaccacagaaagagctacgagttcgaggacctgctgcagagcagcagcgagagcagcagagtggactggtacgcccagaccaagctgggcctgaccagaaccctgagcgaggagaacgtgtacgaggacatcctggacccccccatgaaggagaacccctacgaggacatcgagctgcacggcagatgcctgggcaagaagtgcgtgctgaacttccccgccagccccaccagcagcatccccgacaccctgaccaagcagagcctgagcaagcccgccttcttcagacagaacagcgagagaagaaacttcaagctgctggacaccagaaagctgagcagagacggcaccggcagccccagcaagatcagcccccccagcacccccagcagccccgacgacatcttcttcaacctgggcgacccccagaacggcagaaagaagagaaagatccccaagctggtgctgagaatcaacgccatctacgaggtgagaagaggcaagaagagagtgaagagactgagccagagcatggagagcaacagcggcaaggtgaccgacgagaacagcgagagcgacagcgacaccgaggagaagctgaaggcccacagccagagactggtgaacgtgaagagcagactgaagcaggcccccagataccccagcctggccagagagctgatcgagtaccaggagagacagctgttcgagtacttcgtggtggtgagcctgcacaagaagcaggccggcgccgcctacgtgcccgagctgacccagcagttccccctgaagctggagagaagcttcaagttcatgagagaggccgaggaccagctgaaggccatcccccagttctgcttccccgacgccaaggactgggtgcccgtgcagcagttcaccagcgagaccttcagcttcgtgctgaccggcgaggacggcagcagaagattcggctactgcagaagactgctgcccggcggcaagggcaagagactgcccgaggtgtactgcatcgtgagcagactgggctgcttcagcctgttcagcagaatcctggacgaggtggagaagagaagaggcatcagccccgccctggtgcagcccctgatgagaagcgtgatggaggcccccttccccgccctgggcaagaccatcctggtgaagaacttcctgcccggcagcggcaccgaggtgatcgagctgtgcagacccctggacagcagactggagcacgtggacttcgagagcctgttcagcagcctgagcgtgagacacctggtgtgcgtgttcgccagcctgctgctggagagaagagtgatcttcatcgccgacaagctgagataccccccctggctgctgctgctgaagagactgaacgacagcagaagctggaccctgtag

SEQ ID NO: 20489 - DNA, 3030 bp, Artificial Sequence; identical to SEQ ID NO: 20484
  Description of Artificial Sequence: Synthetic coding sequence

SEQ ID NO: 20490 - DNA, 3030 bp, Artificial Sequence; identical to SEQ ID NO: 20484
  Description of Artificial Sequence: Synthetic coding sequence

SEQ ID NO: 20491 - DNA, 2787 bp, Artificial Sequence
  Description of Artificial Sequence: Synthetic coding sequence
atggacgtgggcttcagcagaaccaccgtgcagaccctgagcagaagccactgcaagaacatcaagcagaagatcagccagtgggagggcagagccaacggcatcagcaaccccgagaagtggtgccccaaggacttcggcgtgagatacaactgccaccaggagatcagactgaagaagaaccccatcgccgagagaaagagcaagaacctggacgtgaccagcagagagaacgtgggcctggacatcaacgagaacaccaagagccacgaccagagcgagaacgagaacaagaagcacgagtacgacgacacccacttcttcaagaacgagagcgagagcaactgggtgtgcagcagagtgaaggagatcgagagctgcaaggaggacgtgctggaccccgagaccagcctgccccccggcaacttctacaccagccagatcctgtggaagaagatcgaggccctgccccccgacaagctgctgaacctggccctggagcactgcgacagcagcgagaaggagctgaacttcagagtgctggacagcagctacggcatcaccaagagcctggagaacatctacagcgagcccgagggccaggagtgcggccccagcatcaaccccctgcccaagcccagaagaaccttcagatacctgagcgagagcggcgtgaccccctacaaggagagaaactgcgacaagaagtactgcgagaacaacagctgcgcccagagcagcctggccagcagccaggagcccgagcccaagaagtacggcggcaagatcagaggcagaagcaagagaaagagcttcgagttcgaggacatccagcacttcagaaacagaaacagccagaccatcagagaggagctgggcagaaacagcggcagcgccctgtactacacccagagcgaggacaacatctacgaggacatcatctaccccaccaaggagaacccctacgaggacatccccgtgcagcccctgcccatgtggagaagccccagcgcctggaagctgccccccgccaagagcgccttcaaggcccccaagctgccccccaagccccagttcctgcacagaaagaccatggaggtgaagaacagccaggcctacctgagaagcaagctgaccaaggacaccaccctgcccgtgaccctgaccgagtggaagctgttcagagccggcgaggtggccaacaccaagagaaagaacctgcccagactggtgctgaagatcgacgacatcttcgagagcaagagaggcaagaagaaggtgaagctgcacagctacaccggcaaggagctgccccccaccaagggcgagaccagcggcaacgagagcgacgccgagtacctgcccaagaacagacacaagagactggcccagctgcagcccagcagcaagagaaacccccactaccagaccctggagagagacctgatcgagctgcaggagcagcagctgttcgagctgttcgtggtggtgagcctgcagaagaagcccagcggcatcagctacatcccccaggtgatccagcagttccccggcaaggacgaccacggctacaagcagagcaaggacatggaggagagactgaaggtgatccccaagttctgcttccccgacagcaaggactggatgcccaccagcgagctgaagagcgagaccttcagcttcgtgctgaccggcgaggacggcagcagatggttcggctactgcaagaagctgctgcccgtgggcaagggcaagagactgcccgaggtgtactgcatggtgagcagactgggctgcttcaacctgttcagcaagatcctggacgaggtggagaagagaagagagatgagccccgccctggtgtaccccttcatgagaagcgtgatggaggcccccttccccgcccccggcagaaccatcaccgtgaagagctacctgcccggcgccggcgacgagagcatcgagctgtgcagacccctggacagcagactggagcacgtggacttcaagtgcctgttcaagtgcctgagcgtgtgccacctgatcagagtgtgcgccagcctgctgctggagagaagagtgatcttcgtggccaacagcctgagcaccctgagcaagtgcggccacgccgtggtggccaccctgtaccccttcacctggcagcacacctacatccccgtgctgcccgccagcatgatcgacatcgtgtgcagccccacccccttcctgatcggcatcctgagctgcagcctgccccagctgcaggacctgcccatcgaggaggtgctgatcgtggacctgtgcgccgacaagttcctgcaggaggtgagcgacgaggacgagatcctgccccccaagctgcaggccgccctgatgcagatcctggaggagagaaacgagatcctgacccaggagcagaacttcagccaggacgtgaccctgaacagcctggtgagcgaggccttcgtgagattcttcgtggagctggtgggccactacagcctgaacatgaccgtgaccgagagaggcgagagagtgttccagagagagcccttcagaaagagccacaccagcagaagcgtgagacacttcctggacctgttcatggagacccagatgttcgccggcttcatccaggacagagagctgagaaagagcggcgtgaagggcctgttcgagatcagagccatccagtacctggagaccatccccgagagcgagcccagcggcatgaacagaatcctgagaagcctgggcagcaagatgaagttcctgcagaagaagtag

SEQ ID NO: 20492 - DNA, 2787 bp, Artificial Sequence; identical to SEQ ID NO: 20491
  Description of Artificial Sequence: Synthetic coding sequence

SEQ ID NO: 20493 - DNA, 2616 bp, Artificial Sequence
  Description of Artificial Sequence: Synthetic coding sequence
atggacgtgggcttcagcagaaccaccgtgcagaccctgagcagaagccactgcaagaacatcaagcagaagatcagccagtgggagggcagagccaacggcatcagcaaccccgagaagtggtgccccaaggacttcggcgtgagatacaactgccaccaggagatcagactgaagaagaaccccatcgccgagagaaagagcaagaacctggacgtgaccagcagagagaacgtgggcctggacatcaacgagaacaccaagagccacgaccagagcgagaacgagaacaagaagcacgagtacgacgacacccacttcttcaagaacgagagcgagagcaactgggtgtgcagcagagtgaaggagatcgagagctgcaaggaggacgtgctggaccccgagaccagcctgccccccggcaacttctacaccagccagatcctgtggaagaagatcgaggccctgccccccgacaagctgctgaacctggccctggagcactgcgacagcagcgagaaggagctgaacttcagagtgctggacagcagctacggcatcaccaagagcctggagaacatctacagcgagcccgagggccaggagtgcggccccagcatcaaccccctgcccaagcccagaagaaccttcagatacctgagcgagagcggcgtgaccccctacaaggagagaaactgcgacaagaagtactgcgagaacaacagctgcgcccagagcagcctggccagcagccaggagcccgagcccaagaagtacggcggcaagatcagaggcagaagcaagagaaagagcttcgagttcgaggacatccagcacttcagaaacagaaacagccagaccatcagagaggagctgggcagaaacagcggcagcgccctgtactacacccagagcgaggacaacatctacgaggacatcatctaccccaccaaggagaacccctacgaggacatccccgtgcagcccctgcccatgtggagaagccccagcgcctggaagctgccccccgccaagagcgccttcaaggcccccaagctggtgctgaagatcgacgacatcttcgagagcaagagaggcaagaagaaggtgaagctgcacagctacaccggcaaggagctgccccccaccaagggcgagaccagcggcaacgagagcgacgccgagtacctgcccaagaacagacacaagagactggcccagctgcagcccagcagcaagagaaacccccactaccagaccctggagagagacctgatcgagctgcaggagcagcagctgttcgagctgttcgtggtggtgagcctgcagaagaagcccagcggcatcagctacatcccccaggtgatccagcagttccccggcaaggacgaccacggctacaagcagagcaaggacatggaggagagactgaaggtgatccccaagttctgcttccccgacagcaaggactggatgcccaccagcgagctgaagagcgagaccttcagcttcgtgctgaccggcgaggacggcagcagatggttcggctactgcaagaagctgctgcccgtgggcaagggcaagagactgcccgaggtgtactgcatggtgagcagactgggctgcttcaacctgttcagcaagatcctggacgaggtggagaagagaagagagatgagccccgccctggtgtaccccttcatgagaagcgtgatggaggcccccttccccgcccccggcagaaccatcaccgtgaagagctacctgcccggcgccggcgacgagagcatcgagctgtgcagacccctggacagcagactggagcacgtggacttcaagtgcctgttcaagtgcctgagcgtgtgccacctgatcagagtgtgcgccagcctgctgctggagagaagagtgatcttcgtggccaacagcctgagcaccctgagcaagtgcggccacgccgtggtggccaccctgtaccccttcacctggcagcacacctacatccccgtgctgcccgccagcatgatcgacatcgtgtgcagccccacccccttcctgatcggcatcctgagctgcagcctgccccagctgcaggacctgcccatcgaggaggtgctgatcgtggacctgtgcgccgacaagttcctgcaggaggtgagcgacgaggacgagatcctgccccccaagctgcaggccgccctgatgcagatcctggaggagagaaacgagatcctgacccaggagcagaacttcagccaggacgtgaccctgaacagcctggtgagcgaggccttcgtgagattcttcgtggagctggtgggccactacagcctgaacatgaccgtgaccgagagaggcgagagagtgttccagagagagcccttcagaaagagccacaccagcagaagcgtgagacacttcctggacctgttcatggagacccagatgttcgccggcttcatccaggacagagagctgagaaagagcggcgtgaagggcctgttcgagatcagagccatccagtacctggagaccatccccgagagcgagcccagcggcatgaacagaatcctgagaagcctgggcagcaagatgaagttcctgcagaagaagtag

SEQ ID NO: 20494 - DNA, 2451 bp, Artificial Sequence
  Description of Artificial Sequence: Synthetic coding sequence
atggacgtgggcttcagcagaaccaccgtgcagaccctgagcagaagccactgcaagaacatcaagcagaagatcagccagtgggagggcagagccaacggcatcagcaaccccgagaagtggtgccccaaggacttcggcgtgagatacaactgccaccaggagatcagactgaagaagaaccccatcgccgagagaaagagcaagaacctggacgtgaccagcagagagaacgtgggcctggacatcaacgagaacaccaagagccacgaccagagcgagaacgagaacaagaagcacgagtacgacgacacccacttcttcaagaacgagagcgagagcaactgggtgtgcagcagagtgaaggagatcgagagctgcaaggaggacgtgctggaccccgagaccagcctgccccccggcaacttctacaccagccagatcctgtggaagaagatcgaggccctgccccccgacaagctgctgaacctggccctggagcactgcgacagcagcgagaaggagctgaacttcagagtgctggacagcagctacggcatcaccaagagcctggagaacatctacagcgagcccgagggccaggagtgcggccccagcatcaaccccctgcccaagcccagaagaaccttcagatacctgagcgagagcggcgtgaccccctacaaggagagaaactgcgacaagaagtactgcgagaacaacagctgcgcccagagcagcctggccagcagccaggagcccgagcccaagaagtacggcggcaagatcagaggcagaagcaagagaaagagcttcgagttcgaggacatccagcacttcagaaacagaaacagccagaccatcagagaggagctgggcagaaacagcggcagcgccctgtactacacccagagcgaggacaacatctacgaggacatcatctaccccaccaaggagaacccctacgaggacatccccgtgcagcccctgcccatgtggagaagccccagcgcctggaagctgccccccgccaagagcgccttcaaggcccccaagctgccccccaagccccagttcctgcacagaaagaccatggaggtgaagaacagccaggcctacctgagaagcaagctgaccaaggacaccaccctgcccgtgaccctgaccgagtggaagctgttcagagccggcgaggtggccaacaccaagagaaagaacctgcccagactggtgctgaagatcgacgacatcttcgagagcaagagaggcaagaagaaggtgaagctgcacagctacaccggcaaggagctgccccccaccaagggcgagaccagcggcaacgagagcgacgccgagtacctgcccaagaacagacacaagagactggcccagctgcagcccagcagcaagagaaacccccactaccagaccctggagagagacctgatcgagctgcaggagcagcagctgttcgagctgttcgtggtggtgagcctgcagaagaagcccagcggcatcagctacatcccccaggtgatccagcagttccccggcaaggacgaccacggctacaagcagagcaaggacatggaggagagactgaaggtgatccccaagttctgcttccccgacagcaaggactggatgcccaccagcgagctgaagagcgagaccttcagcttcgtgctgaccggcgaggacggcagcagatggttcggctactgcaagaagctgctgcccgtgggcaagggcaagagactgcccgaggtgtactgcatggtgagcagactgggctgcttcaacctgttcagcaagatcctggacgaggtggagaagagaagagagatgagccccgccctggtgtaccccttcatgagaagcgtgatggaggcccccttccccgcccccggcagaaccatcaccctgcaggacctgcccatcgaggaggtgctgatcgtggacctgtgcgccgacaagttcctgcaggaggtgagcgacgaggacgagatcctgccccccaagctgcaggccgccctgatgcagatcctggaggagagaaacgagatcctgacccaggagcagaacttcagccaggacgtgaccctgaacagcctggtgagcgaggccttcgtgagattcttcgtggagctggtgggccactacagcctgaacatgaccgtgaccgagagaggcgagagagtgttccagagagagcccttcagaaagagccacaccagcagaagcgtgagacacttcctggacctgttcatggagacccagatgttcgccggcttcatccaggacagagagctgagaaagagcggcgtgaagggcctgttcgagatcagagccatccagtacctggagaccatccccgagagcgagcccagcggcatgaacagaatcctgagaagcctgggctacaagatgaagttcctgcagaagaagtag

SEQ ID NO: 20495 - DNA, 1416 bp, Artificial Sequence
  Description of Artificial Sequence: Synthetic coding sequence
atggagggccaggtggtgggcagagtgttcagactgttccagagaagactgctgcagctgagagccggccccccccaggacaacagcggcgaggccctgaaggagcccgagagagcccaggagcacagcctgcccaacttcgccggcggccagcacttcttcgagtacctgctggtggtgagcctgaagaagaagagaagcgaggacgactacgagcccatcatcacctaccagttccccaagagagagaacctgctgagaggccagcaggaggaggaggagagactgctgaaggccatccccctgttctgcttccccgacggcaacgagtgggccagcctgaccgagtaccccagagagaccttcagcttcgtgctgaccaacgtggacggcagcagaaagatcggctactgcagaagactgctgcccgccggccccggccccagactgcccaaggtgtactgcatcatcagctgcatcggctgcttcggcctgttcagcaagatcctggacgaggtggagaagagacaccagatcagcatggccgtgatctaccccttcatgcagggcctgagagaggccgccttccccgcccccggcaagaccgtgaccctgaagagcttcatccccgacagcggcaccgagttcatcagcctgaccagacccctggacagccacctggagcacgtggacttcagcagcctgctgcactgcctgagcttcgagcagatcctgcagatcttcgccagcgccgtgctggagagaaagatcatcttcctggccgagggcctgagcaccctgagccagtgcatccacgccgccgccgccctgctgtaccccttcagctgggcccacacctacatccccgtggtgcccgagagcctgctggccaccgtgtgctgccccacccccttcatggtgggcgtgcagatgagattccagcaggaggtgatggacagccccatggaggaggtgctgctggtgaacctgtgcgagggcaccttcctgatgagcgtgggcgacgagaaggacatcctgccccccaagctgcaggacgacatcctggacagcctgggccagggcatcaacgagctgaagaccgccgagcagatcaacgagcacgtgagcggccccttcgtgcagttcttcgtgaagatcgtgggccactacgccagctacatcaagagagaggccaacggccagggccacttccaggagagaagcttctgcaaggccctgaccagcaagaccaacagaagattcgtgaagaagttcgtgaagacccagctgttcagcctgttcatccaggaggccgagaagagcaagaacccccccgccggctacttccagcagaagatcctggagtacgaggagcagaagaagcagaagaagcccagagagaagaccgtgaagtag

SEQ ID NO: 20496 - DNA, 1407 bp, Artificial Sequence
  Description of Artificial Sequence: Synthetic coding sequence
atggacggcctgggcagaagactgagagccagcctgagactgaagagaggccacggcggccccccccaggacaacagcggcgaggccctgaaggagcccgagagagcccaggagcacagcctgcccaacttcgccggcggccagcacttcttcgagtacctgctggtggtgagcctgaagaagaagagaagcgaggacgactacgagcccatcatcacctaccagttccccaagagagagaacctgctgagaggccagcaggaggaggaggagagactgctgaaggccatccccctgttctgcttccccgacggcaacgagtgggccagcctgaccgagtaccccagagagaccttcagcttcgtgctgaccaacgtggacggcagcagaaagatcggctactgcagaagactgctgcccgccggccccggccccagactgcccaaggtgtactgcatcatcagctgcatcggctgcttcggcctgttcagcaagatcctggacgaggtggagaagagacaccagatcagcatggccgtgatctaccccttcatgcagggcctgagagaggccgccttccccgcccccggcaagaccgtgaccctgaagagcttcatccccgacagcggcaccgagttcatcagcctgaccagacccctggacagccacctggagcacgtggacttcagcagcctgctgcactgcctgagcttcgagcagatcctgcagatcttcgccagcgccgtgctggagagaaagatcatcttcctggccgagggcctgagcaccctgagccagtgcatccacgccgccgccgccctgctgtaccccttcagctgggcccacacctacatccccgtggtgcccgagagcctgctggccaccgtgtgctgccccacccccttcatggtgggcgtgcagatgagattccagcaggaggtgatggacagccccatggaggaggtgctgctggtgaacctgtgcgagggcaccttcctgatgagcgtgggcgacgagaaggacatcctgccccccaagctgcaggacgacatcctggacagcctgggccagggcatcaacgagctgaagaccgccgagcagatcaacgagcacgtgagcggccccttcgtgcagttcttcgtgaagatcgtgggccactacgccagctacatcaagagagaggccaacggccagggccacttccaggagagaagcttctgcaaggccctgaccagcaagaccaacagaagattcgtgaagaagttcgtgaagacccagctgttcagcctgttcatccaggaggccgagaagagcaagaacccccccgccggctacttccagcagaagatcctggagtacgaggagcagaagaagcagaagaagcccagagagaagaccgtgaagtag

SEQ ID NO: 20497 - DNA, 3597 bp, Artificial Sequence
  Description of Artificial Sequence: Synthetic coding sequence
atgagaagcctgagaaagaagagagagaagcccagacccgagcagtggaagggcctgcccggcccccccagagcccccgagcccgaggacgtggccgtgcccggcggcgtggacctgctgaccctgccccagctgtgcttccccggcggcgtgtgcgtggccaccgagcccaaggaggactgcgtgcacttcctggtgctgaccgacgtgtgcggcaacagaacctacggcgtggtggcccagtactacagacccctgcacgacgagtactgcttctacaacggcaagacccacagagagtgccccggctgcttcgtgcccttcgccgtgtgcgtggtgagcagattcccctactacaacagcctgaaggactgcctgagctgcctgctggccctgctgaagccctgcaaggacttcgaggtggacagccacatcaaggacttcgccgccaagctgagcctgatccccagccccccccccggccccctgcacctggtgttcaacatgaagagcctgcagatcgtgctgcccgccagagccgaccccgagagccccatcctggacctggacctgcacctgcccctgctgtgcttcagacccgagaaggtgctgcagatcctgacctgcatcctgaccgagcagagaatcgtgttcttcagcagcgactgggccctgctgaccctggtgaccgagtgcttcatggcctacctgtaccccctgcagtggcagcaccccttcgtgcccatcctgagcgaccagatgctggacttcgtgatggcccccaccagcttcctgatgggctgccacctggaccacttcgaggaggtgagcaaggaggccgacggcctggtgctgatcaacatcgaccacggcagcatcacctacagcaagagcaccgacgacaacgtggacatccccgacgtgcccctgctggccgcccagaccttcatccagagagtgcagagcctgcagctgcaccacgagctgcacgccgcccacctgctgagcagcaccgacctgaaggagggcagagcccacagaagaagctggcagcagaagctgaactgccagatccagcagaccaccctgcagctgctggtgagcatcttcagagacgtgaagaaccacctgaactacgagcacagagtgttcaacagcgaggagttcctgaagaccagagcccccggcgaccaccagttctacaagcaggtgctggacacctacatgttccacagcttcctgaaggccagactgaacagaagaatggacgccttcgcccagatggacctggacacccagagcgaggaggacagaatcaacggcatgctgctgagccccagaagacccaccgtggagaagagagccagcagaaagagcagccacctgcacgtgacccacagaagaatggtggtgagcatgcccaacctgcaggacatcgccatgcccgagctggcccccagaaacagcagcctgagactgaccgacaccgccggctgcagaggcagcagcgccgtgctgaacgtgacccccaagagcccctacaccttcaagatccccgagatccacttccccctggagagcaagtgcgtgcaggcctaccacgcccacttcgtgagcatgctgagcgaggccatgtgcttcctggcccccgacaacagcctgctgctggccagatacctgtacctgagaggcctggtgtacctgatgcagggccagctgctgaacgccctgctggacttccagaacctgtacaagaccgacatcagaatcttccccaccgacctggtgaagagaaccgtggagagcatgagcgcccccgagtgggagggcgccgagcaggcccccgagctgatgagactgatcagcgagatcctggacaagccccacgaggccagcaagctggacgaccacgtgaagaagttcaagctgcccaagaagcacatgcagctgggcgacttcatgaagagagtgcaggagagcggcatcgtgaaggacgccagcatcatccacagactgttcgaggccctgaccgtgggccaggagaagcagatcgaccccgagaccttcaaggacttctacaactgctggaaggagaccgaggccgaggcccaggaggtgagcctgccctggctggtgatggagcacctggacaagaacgagtgcgtgtgcaagctgagcagcagcgtgaagaccaacctgggcgtgggcaagatcgccatgacccagaagagactgttcctgctgaccgagggcagacccggctacctggagatcagcaccttcagaaacatcgaggaggtgagaagaaccaccaccaccttcctgctgagaagaatccccaccctgaagatcagagtggccagcaagaaggaggtgttcgaggccaacctgaagaccgagtgcgacctgtggcacctgatggtgaaggagatgtgggccggcaagaagctggccgacgaccacaaggacccccactacgtgcagcaggccctgaccaacgtgctgctgatggacgccgtggtgggcaccctgcagagccccggcgccatctacgccgccagcaagctgagctacttcgacaagatgagcaacgagatgcccatgaccctgcccgagaccaccctggagaccctgaagcacaagatcaaccccagcgccggcgaggccttcccccaggccgtggacgtgctgctgtacacccccggccacctggaccccgccgagaaggtggaggacgcccaccccaagctgtggtgcgccctgagcgagggcaaggtgaccgtgttcaacgccagcagctggaccatccaccagcacagcttcaaggtgggcaccgccaaggtgaactgcatggtgatggccgaccagaaccaggtgtgggtgggcagcgaggacagcgtgatctacatcatcaacgtgcacagcatgagctgcaacaagcagctgaccgcccactgcagcagcgtgaccgacctgatcgtgcaggacggccaggaggcccccagcaacgtgtacagctgcagcatggacggcatggtgctggtgtggaacgtgagcaccctgcaggtgaccagcagattccagctgcccagaggcggcctgaccagcatcagactgcacggcggcagactgtggtgctgcaccggcaacagcatcatggtgatgaagatgaacggcagcctgcaccaggagctgaagatcgaggagaacttcaaggacaccagcaccagcttcctggccttccagctgctgcccgaggaggagcagctgtgggccgcctgcgccggcagaagcgaggtgtacatctggagcctgaaggacctggcccagcccccccagagagtgcccctggaggactgcagcgagatcaactgcatgatcagagtgaagaagcaggtgtgggtgggcagcagaggcctgggccagggcacccccaagggcaagatctacgtgatcgacgccgagagaaagaccgtggagaaggagctggtggcccacatggacaccgtgagaaccctgtgcagcgccgaggacagatacgtgctgagcggcagcggcagagaggagggcaaggtggccatctggaagggcgagtag

SEQ ID NO: 20498 - DNA, 3441 bp, Artificial Sequence
  Description of Artificial Sequence: Synthetic coding sequence
atgagaagcctgagaaagaagagagagaagcccagacccgagcagtggaagggcctgcccggcccccccagagcccccgagcccgaggacgtggccgtgcccggcggcgtggacctgctgaccctgccccagctgtgcttccccggcggcgtgtgcgtggccaccgagcccaaggaggactgcgtgcacttcctggtgctgaccgacgtgtgcggcaacagaacctacggcgtggtggcccagtactacagacccctgcacgacgagtactgcttctacaacggcaagacccacagagagtgccccggctgcttcgtgcccttcgccgtgtgcgtggtgagcagattcccctactacaacagcctgaaggactgcctgagctgcctgctggccctgctgaagccctgcaaggacttcgaggtggacagccacatcaaggacttcgccgccaagctgagcctgatccccagccccccccccggccccctgcacctggtgttcaacatgaagagcctgcagatcgtgctgcccgccagagccgaccccgagagccccatcctggacctggacctgcacctgcccctgctgtgcttcagacccgagaaggtgctgcagatcctgacctgcatcctgaccgagcagagaatcgtgttcttcagcagcgactgggccctgctgaccctggtgaccgagtgcttcatggcctacctgtaccccctgcagtggcagcaccccttcgtgcccatcctgagcgaccagatgctggacttcgtgatggcccccaccagcttcctgatgggctgccacctggaccacttcgaggaggtgagcaaggaggccgacggcctggtgctgatcaacatcgaccacggcagcatcacctacagcaagagcaccgacgacaacgtggacatccccgacgtgcccctgctggccgcccagaccttcatccagagagacgtgaagaaccacctgaactacgagcacagagtgttcaacagcgaggagttcctgaagaccagagcccccggcgaccaccagttctacaagcaggtgctggacacctacatgttccacagcttcctgaaggccagactgaacagaagaatggacgccttcgcccagatggacctggacacccagagcgaggaggacagaatcaacggcatgctgctgagccccagaagacccaccgtggagaagagagccagcagaaagagcagccacctgcacgtgacccacagaagaatggtggtgagcatgcccaacctgcaggacatcgccatgcccgagctggcccccagaaacagcagcctgagactgaccgacaccgccggctgcagaggcagcagcgccgtgctgaacgtgacccccaagagcccctacaccttcaagatccccgagatccacttccccctggagagcaagtgcgtgcaggcctaccacgcccacttcgtgagcatgctgagcgaggccatgtgcttcctggcccccgacaacagcctgctgctggccagatacctgtacctgagaggcctggtgtacctgatgcagggccagctgctgaacgccctgctggacttccagaacctgtacaagaccgacatcagaatcttccccaccgacctggtgaagagaaccgtggagagcatgagcgcccccgagtgggagggcgccgagcaggcccccgagctgatgagactgatcagcgagatcctggacaagccccacgaggccagcaagctggacgaccacgtgaagaagttcaagctgcccaagaagcacatgcagctgggcgacttcatgaagagagtgcaggagagcggcatcgtgaaggacgccagcatcatccacagactgttcgaggccctgaccgtgggccaggagaagcagatcgaccccgagaccttcaaggacttctacaactgctggaaggagaccgaggccgaggcccaggaggtgagcctgccctggctggtgatggagcacctggacaagaacgagtgcgtgtgcaagctgagcagcagcgtgaagaccaacctgggcgtgggcaagatcgccatgacccagaagagactgttcctgctgaccgagggcagacccggctacctggagatcagcaccttcagaaacatcgaggaggtgagaagaaccaccaccaccttcctgctgagaagaatccccaccctgaagatcagagtggccagcaagaaggaggtgttcgaggccaacctgaagaccgagtgcgacctgtggcacctgatggtgaaggagatgtgggccggcaagaagctggccgacgaccacaaggacccccactacgtgcagcaggccctgaccaacgtgctgctgatggacgccgtggtgggcaccctgcagagccccggcgccatctacgccgccagcaagctgagctacttcgacaagatgagcaacgagatgcccatgaccctgcccgagaccaccctggagaccctgaagcacaagatcaaccccagcgccggcgaggccttcccccaggccgtggacgtgctgctgtacacccccggccacctggaccccgccgagaaggtggaggacgcccaccccaagctgtggtgcgccctgagcgagggcaaggtgaccgtgttcaacgccagcagctggaccatccaccagcacagcttcaaggtgggcaccgccaaggtgaactgcatggtgatggccgaccagaaccaggtgtgggtgggcagcgaggacagcgtgatctacatcatcaacgtgcacagcatgagctgcaacaagcagctgaccgcccactgcagcagcgtgaccgacctgatcgtgcaggacggccaggaggcccccagcaacgtgtacagctgcagcatggacggcatggtgctggtgtggaacgtgagcaccctgcaggtgaccagcagattccagctgcccagaggcggcctgaccagcatcagactgcacggcggcagactgtggtgctgcaccggcaacagcatcatggtgatgaagatgaacggcagcctgcaccaggagctgaagatcgaggagaacttcaaggacaccagcaccagcttcctggccttccagctgctgcccgaggaggagcagctgtgggccgcctgcgccggcagaagcgaggtgtacatctggagcctgaaggacctggcccagcccccccagagagtgcccctggaggactgcagcgagatcaactgcatgatcagagtgaagaagcaggtgtgggtgggcagcagaggcctgggccagggcacccccaagggcaagatctacgtgatcgacgccgagagaaagaccgtggagaaggagctggtggcccacatggacaccgtgagaaccctgtgcagcgccgaggacagatacgtgctgagcggcagcggcagagaggagggcaaggtggccatctggaagggcgagtag

SEQ ID NO: 20499 - DNA, 4491 bp, Artificial Sequence
  Description of Artificial Sequence: Synthetic coding sequence
atggccgaggagagaccccccagactggtggactacttcgtggtggccggcctggccggcaacggcgcccccatccccgaggagacctgggtgcccgagcccagcggccccctgagaccccccagacccgccgagcccatcaccgacgtggccgtgatcgccagagccctgggcgaggaggtgccccagggctacacctgcatccaggccagcgccggcggccaccccctggagctgagcgccggcctgctgggcggcacccagcccgtgatctgctacagaagaggcagagacaagccccccctggtggagctgggcgtgctgtacgagggcaaggagagacccaagcccggcttccaggtgctggacaccaccccctacagccacagcgccaacctggccccccccggccccggccaccccagaacctacctgacctacagaagagccgccgagggcgccggcctgcacgccctgggcatcaccgacctgtgcctggtgctgcccagcaagggcgagggcaccccccacacctactgcagactgcccagaaacctgaaccccggcatgtggggccccgccgtgtacctgtgctacaaggtgggcctggccaaggccaacaccctggtgtacgaggccgagctgctgggcagataccccgaggaggacaacgaggccttccccctgcccgagagcgtgcccgtgttctgcctgcccatgggcgccaccatcgagtgctggcccgcccagaccaagtaccccgtgcccgtgttcagcaccttcgtgctgaccggcgccgccggcgacaaggtgtacggcgccgccctgcagttctacgaggccttccccagagccagactgagcgagagacaggccagagccctgggcctgctgagcgccgtggagagaggcagagccctgggcggcagagccgtgagaagcagaagagccatcgccgtgctgagcagatggcccgccttccccgccttcagagccttcctgaccttcctgtacagatacagcgtgagcggcccccacagactgcccctggaggcccacatcagccacttcatccacaacgtgcccttccccagcccccagagacccagaatcctggtgcagatgagcccctacgacaacctgctgctgtgccagcccgtgagcagccccctgcccctgagcggcgccagcttcctgcagctgctgcagagcctgggccccgagctggccatcaccctgctgctggccgtgctgaccgagcacaagctgctggtgcacagcctgagacccgacctgctgaccagcgtgtgcgaggccctggtgagcatgatcttccccctgcactggcagtgcccctacatccccctgtgccccctggtgctggccgacgtgctgagcgcccccgtgcccttcatcgtgggcatccacagcagctacttcgacctgcacgacccccccgccgacgtgatctgcgtggacctggacaccaacaccctgttccagaccgaggagaagaagctgctgagccccagaaccctgcccagaagaccctacaaggtgctgctggccaccctgaccaacctgtaccagcagctggaccagacctacaccggccccgaggaggaggccagcctggagttcctgctgaccgactacgaggccgtgtgcggcagaagagccagactggagagagaggtgcagggcgccttcctgagattcatggcctgcctgctgaagggctacagagtgttcctgagacccctgacccaggcccccagcgagggcgccagagacgtggacaacctgttcttcctgcagggcttcctgaagagcagagagagaagcagccacaagctgtacagccagctgctgcacacccagatgttcagccagttcatcgaggagtgcagcttcggcagcgccagacacgccgccctggagttcttcgacagctgcgtggagaaggtgcaccccgagcaggagaagcccgagcccacccccctggtggagctggaggagctgagcggcagcgagctgaccgtgttcatcaccccccccgaggagcccgccctgcccgagggcagcgagagcaccccccagtactgctacgacggcttccccgagctgagagccgagctgttcgagagcctgcaggagcagcccggcgccctgcccgtgcccggccccagcagaagcgcccccagcagccccgcccccagaagaaccaagcaggagatgaaggtggcccagagaatggcccagaagagcgccgccgtgcccgagctgtgggccagatgcctgctgggccactgctacggcctgtggttcctgtgcctgcccgcctacgtgagaagcgcccccagcagagtgcaggccctgcacaccgcctaccacgtgctgagacagatggagagcggcaaggtggtgctgcccgacgaggtgtgctacagagtgctgatgcagctgtgcagccactacggccagcccgtgctgagcgtgagagtgatgctggagatgagacaggccggcatcgtgcccaacaccatcacctacggctactacaacaaggccgtgctggagagcaagtggcccagcggcacccccggcggcagactgagatgggccaagctgagaaacgtggtgctgggcgccgcccagttcagacagcccctgagagagagacagcagcagcagcagcagcagcagcagcagcagcagcagcagcagcaggagcaggtgagcgcccaccaggaggccggcagcagccaggccgagccctacctggagagacccagccccaccagacccctgcagagacagaccacctgggccggcagaagcctgagagaccccgccagcccccccggcagactggtgaagagcggcagcctgggcagcgccagaggcgcccagcccaccgtggaggccggcgtggcccacatgatcgaggccctgggcgtgctggagcccagaggcagccccgtgccctggcacgacggcagcctgagcgacctgagcctgaccggcgaggagcccctgcccggcggcagccccggcggcagcggcagcgccctgagcgcccagagcaccgaggccctggagggcctgagcggcagaggccccaaggccggcggcagacaggacgaggccggcacccccagaagaggcctgggcgccagactgcagcagctgctgacccccagcagacacagccccgccagcagaatccccccccccgagctgccccccgacctgcccccccccgccagaagaagccccatggacagcctgctgcaccccagagagagacccggcagcaccgccagcgagagcagcgccagcctgggcagcgagtgggacctgagcgagagcagcctgagcaacctgagcctgagaagaagcagcgagagactgagcgacacccccggcagcttccagagccccagcctggagatcctgctgagcagctgcagcctgtgcagagcctgcgacagcctggtgtacgacgaggagatcatggccggctgggcccccgacgacagcaacctgaacaccacctgccccttctgcgcctgccccttcgtgcccctgctgagcgtgcagaccctggacagcagacccagcgtgcccagccccaagagcgccggcgccagcggcagcaaggacgcccccgtgcccggcggccccggccccgtgctgagcgacagaagactgtgcctggccctggacgagccccagctgtgcaacggccacatgggcggcgccagcagaagagtggagagcggcgcctgggcctacctgagccccctggtgctgagaaaggagctggagagcctggtggagaacgagggcagcgaggtgctggccctgcccgagctgcccagcgcccaccccatcatcttctggaacctgctgtggtacttccagagactgagactgcccagcatcctgcccggcctggtgctggccagctgcgacggccccagccacagccaggcccccagcccctggctgacccccgaccccgccagcgtgcaggtgagactgctgtgggacgtgctgacccccgaccccaacagctgcccccccctgtacgtgctgtggagagtgcacagccagatcccccagagagtggtgtggcccggccccgtgcccgccagcctgagcctggccctgctggagagcgtgctgagacacgtgggcctgaacgaggtgcacaaggccgtgggcctgctgctggagaccctgggccccccccccaccggcctgcacctgcagagaggcatctacagagagatcctgttcctgaccatggccgccctgggcaaggaccacgtggacatcgtggccttcgacaagaagtacaagagcgccttcaacaagctggccagcagcatgggcaaggaggagctgagacacagaagagcccagatgcccacccccaaggccatcgactgcagaaagtgcttcggcgccccccccgagtgctag

SEQ ID NO: 20500 - DNA, 1002 bp, Artificial Sequence
  Description of Artificial Sequence: Synthetic coding sequence
atggtgcccggcgaggagcccgccagagagctgatggccgtgctgctgacccccagattcagaagactggtgagccagaacgagctgcccggccccggcctgaacggccccagcagcagaaacagaagagacggcttctgcagaaagagaagaaccggcgtgcacctgtgccaggtgctgatgaaccacaaggtgttcgagcccgtgggcatgaagaagctgttcaagaaggagaaggagctggagttcgaggacagcaacatcagcctgtacagattcctgggcaacaagagcagctacgactgctgcaagagacagaaggacgccgagaacgagttcaacgagaccctgagacccggctacgagatgatcagcaaccccctggcccaggagatcggcgaggagagaatcgaggagctgatccacaccatcaacggcaaccccgccctgtgccccaacatcaccgtgcagaagcccttcctgagactgagcaaggagggcgtgagcttctacaccgccatcaccagcgacaagaccgacgtgtggaaggagcagaccctgctgtgcctgctgcagctgatccacctgcccttcctggacaacatcctggagccccccgtgaagacccagaacctgcagctgaacaaggaggaggacctggtgatcaccaacacctgcctggacagagagctgatccccagcctgtgcctgcccgagatcgacaactggctgaacgccgccatcgagtgcctggagtacttccccgaccagctgatcgtgaccgtgagccagcagctgatgcagaacagaaacgaggagaccagactgaacagccagaagaagatcctgttcgacgtgatcgccaagtactacgcccaggagagagactgcctgctgaccgacgagtacttcgacatccacagcggcatcatcgagctgctggagaacgagaagagagccgaggccctggaggccacccagctgtacctgagactgctgtag

SEQ ID NO: 20501 - DNA, 885 bp, Artificial Sequence
  Description of Artificial Sequence: Synthetic coding sequence
atggtgcccggcgaggagcccgccagagagctgatggccgtgctgctgacccccagattcagaagactggtgagccagaacgagctgcccggccccggcctgaacggccccagcagcagaaacagaagagacggcttctgcagaaagagaagaaccggctgcagcggccccttccaggccacccagctgtgggacggcatcatccacagcctgcaggcccaggtggagatcaagagaagaagacaccacctgcagacctacaaggactgcttcaccggcagcgacgccgtggacgtggtgctgagccacctgatgcagaacacctgcctgagcagcaacgacatcagctgcctgaagggcgtgcacctgtgccaggtgctgatgaaccacaaggtgttcgagcccgtgggcatgaagaagctgttcaagaaggagaaggagctggagttcgaggacagcaacatcagcctgtacagattcctgggcaacaagagcagctacgactgctgcaagagacagaaggacgccgagaacgagttcaacgagaccctgagacccggctacgagatgatcagcaaccccctggcccaggagatcggcgaggagagaatcgaggagctgatccacaccatcaacggcaaccccgccctgtgccccaacatcaccgtgcagaagcccttcctgagactgagcaaggaggacgtgtggaaggagcagaccctgctgtgcctgctgcagctgatccacctgcccttcctggacaacatcctggagccccccgtgaagacccagaacctgcagctgaacaaggaggaggacctggtgatcaccaacacctgcctggacagagagctgatccccagcctgtgcctgcccgagaagtag

SEQ ID NO: 20502 - DNA, 1164 bp, Artificial Sequence
  Description of Artificial Sequence: Synthetic coding sequence
atggtgcccggcgaggagcccgccagagagctgatggccgtgctgctgacccccagattcagaagactggtgagccagaacgagctgcccggccccggcctgaacggccccagcagcagaaacagaagagacggcttctgcagaaagagaagaaccggctgcagcggccccttccaggccacccagctgtgggacggcatcatccacagcctgcaggcccaggtggagatcaagagaagaagacaccacctgcagacctacaaggactgcttcaccggcagcgacgccgtggacgtggtgctgagccacctgatgcagaacacctgcctgagcagcaacgacatcagctgcctgaagggcgtgcacctgtgccaggtgctgatgaaccacaaggtgttcgagcccgtgggcatgaagaagctgttcaagaaggagaaggagctggagttcgaggacagcaacatcagcctgtacagattcctgggcaacaagagcagctacgactgctgcaagagacagaaggacgccgagaacgagttcaacgagaccctgagacccggctacgagatgatcagcaaccccctggcccaggagatcggcgaggagagaatcgaggagctgatccacaccatcaacggcaaccccgccctgtgccccaacatcaccgtgcagaagcccttcctgagactgagcaaggaggacgtgtggaaggagcagaccctgctgtgcctgctgcagctgatccacctgcccttcctggacaacatcctggagccccccgtgaagacccagaacctgcagctgaacaaggaggaggacctggtgatcaccaacacctgcctggacagagagctgatccccagcctgtgcctgcccgagatcgacaactggctgaacgccgccatcgagtgcctggagtacttccccgaccagctgatcgtgaccgtgagccagcagctgatgcagaacagaaacgaggagaccagactgaacagccagaagaagatcctgttcgacgtgatcgccaagtactacgcccaggagagagactgcctgctgaccgacgagtacttcgacatccacagcggcatcatcgagctgctggagaacgagaagagagccgaggccctggaggccacccagctgtacctgagactgctgtag

SEQ ID NO: 20503 - DNA, 309 bp, Artificial Sequence
  Description of Artificial Sequence: Synthetic coding sequence
atggccgacttcctgaagggcctgcccgtgtacaacaagagcaacttcagcagattccacgccgacagcgtgtgcaaggccagcaacagaagacccagcgtgtacctgcccaccagagagtaccccagcgagcagatcatcgtgaccgagaagaccaacatcctgctgagatacctgcaccagcagtgggacaagaagaacgccgccaagaagagagaccaggagcaggtggagctggagggcgagagcagcgccccccccagaaaggtggccagaaccgacagccccgacatgcacgaggacacctag

SEQ ID NO: 20504 - DNA, 528 bp, Artificial Sequence; identical to SEQ ID NO: 20214
  Description of Artificial Sequence: Synthetic coding sequence

SEQ ID NO: 20505 - DNA, 1032 bp, Artificial Sequence
  Description of Artificial Sequence: Synthetic coding sequence
atgatgttccccggcctgctggccccccccgccggctaccccagcctgctgagacccacccccaccctgaccctgccccagagcctgcagagcgccttcagcggccacagcagcttcctggtggaggacctgatcagaatcagcagaccccccgcctacctgcccagaagcgtgcccaccgccagcatgagcccccccagacagggcgcccccaccgccctgaccgacaccggcgccagcgacctgggcagccccggccccggcagcagaagaggcggcagcccccccaccgccttcagccccgccagcgagaccaccttcctgaagttcggcgtgaacgccatcctgagcagcggccccagaaccgagaccagccccgccctgctgcagagcgtgccccccaagaccttcgccttcccctacttcgagggcagcttccagcccttcatcagaagcagctacttccccgccagcagcagcgtggtgcccatccccggcaccttcagctggcccctggccgccagaggcaagcccagaagaggcatgctgagaagagccgtgttcagcgacgtgcagagaaaggccctggagaagatgttccagaagcagaagtacatcagcaagcccgacagaaagaagctggccgccaagctgggcctgaaggacagccaggtgaagatctggttccagaacagaagaatgaagtggagaaacagcaaggagagagagctgctgagcagcggcggctgcagagagcagaccctgcccaccaagctgaacccccaccccgacctgagcgacgtgggccagaagggccccggcaacgaggaggaggaggagggccccggcagccccagccacagactggcctaccacgccagcagcgacccccagcacctgagagaccccagactgcccggccccctgccccccagccccgcccacagcagcagccccggcaagcccagcgacttcagcgacagcgaggaggaggaggagggcgaggagcaggaggagatcaccgtgagctag

SEQ ID NO: 20506 - DNA, 288 bp, Artificial Sequence
  Description of Artificial Sequence: Synthetic coding sequence
atgctgggcgccagagtggccgcccacctggacgccctgggccccctggtgccctacgtgcccccccccctgctgcccagcatgttctacgtgggcctgttcttcgtgaacgtgctgatcctgtactacgccttcctgatggagtacatcgtgctgaacgtgggcctggtgttcctgcccgaggacatggaccaggccctggtggacctgggcgtgctgagcgaccccggcagcggcctgtacgacgccgacagcgagctggacgtgttcgacgcctacctggagtag

SEQ ID NO: 20507 - DNA, 3816 bp, Artificial Sequence
  Description of Artificial Sequence: Synthetic coding sequence
atggacagaggcgccgccgccgcccagggcaccgcccccccccaggacggcgagcagcccgccgagagccccgagcccccccccccctggcccccccccccccccccccccgcccccccccccgccccccccctgctgagcgaggccagccccgagcccatccccgagccctgccccgagctggcccccggcccctgccccgaggccaccagcgagagcgccaccgagctgtacaccgagcccacccccgagcccgccaccgagcccgccagcgagcccgcccccgagcccgccaccgagcccgcccccgagcccgccaccgagcccgcccccgagcccgcccccgagcccgccaccgagagcgcccccgagcccacccccgagcccgccctggagagcgtgcccgagcccgcccccgagctgacccccgaggtggcccccgagctggcccccgagcccacccccgagcccgtgaccgagctggcccccgagttctgccccgaggccgcccccgagttcagacccagccccgccccctgcctgctgcagtgccccgtggacaccagagagagaggcctgaagaccagccccagccccagccccagccccagccccagaacccccatgagctggagcagaatcaagaagatcctgaaggagggccccatgctgaagaactgcaacagcttcaagagatggaagctgagatacttcctggtgcagggccagaagctgtacttcgcccaccaccccgccttcgcccacttcgagaccatcgacctgagccaggccaccgtggccgagagcagctgcagaaacctgtgccacagcttctgcgtgatcaccccccagagaaagatcaccctggccgcccccaacagaaaggacatggaggagtggatcaacatcatcaagaccatccagcagggcgagatctacaagatccccgccgccgagaacaaccccttcctggtgggcatgcactgctggtacagcagctacagccacagaacccagcactgcaacgtgtgcagagagagcatccccgccctgagcagagacgccatcatctgcgaggtgtgcaaggtgaagagccacagactgtgcgccctgagagccagcaaggactgcaagtggaacaccctgagcatcaccgacgacctgctgctgcccgccgacgaggtgaacatgccccaccagtgggtggagggcaacatgcccgtgagcagccagtgcgccgtgtgccacgagagctgcggcagctaccagagactgcaggacttcagatgcctgtggtgcaacagcaccgtgcacgacgactgcagaagaagattcagcaaggagtgctgcttcagaagccacagaagcagcgtgatcccccccaccgccctgagcgaccccaagggcgacggccagctggtggtgagcagcgacttctggaacctggactggagcagcgcctgcagctgccccctgctgatcttcatcaacagcaagagcggcgaccaccagggcatcgtgttcctgagaaagttcaagcagtacctgaaccccagccaggtgttcgacctgctgaagggcggccccgaggccggcctgagcatgttcaagaacttcgccagattcagaatcctggtgtgcggcggcgacggcagcgtgagctgggtgctgagcctgatcgacgccttcggcctgcacgagaagtgccagctggccgtgatccccctgggcaccggcaacgacctggccagagtgctgggctggggcgccttctggaacaagagcaagagccccctggacatcctgaacagagtggagcaggccagcgtgagaatcctggacagatggagcgtgatgatcagagagacccccagacagacccccctgctgaagggccaggtggagatggacgtgcccagattcgaggccgccgccatccagcacctggagagcgccgccaccgagctgaacaagatcctgaaggccaagtaccccaccgagatgatcatcgccaccagattcctgtgcagcgccgtggaggacttcgtggtggacatcgtgaaggcctggggccagatcaagcagaacaacaccgccatcgtgagcgtgatcctgaagagcgacctgatgtacgacagactgagcgtgctgatcgacgtgctggccgaggaggccgccgccaccagcgccgagaagagcgccaccgagtacgccgacagcagcaaggccgacagaaagcccttcatcccccagatcgaccacatcgccaagtgcaagctggagctggccaccaaggcccagagcctgcagaagagcctgaagctgatcatcttccaggtggagcaggccctggacgaggagagcagacagaccatcagcgtgaagaacttcagcagcaccttcttcctggaggacgaccccgaggacatcaaccagaccagccccagaagaagaagcagaagaggcaccctgagcagcatcagcagcctgaagagcgaggacctggacaacctgaacctggaccacctgcacttcacccccgagagcatcagattcaaggagaagtgcgtgatgaacaactacttcggcatcggcctggacgccaagatcagcctggacttcaacaccagaagagacgagcaccccggccagtacaacagcagactgaagaacaagatgtggtacggcctgctgggcaccaaggagctgctgcagagaagctacagaaagctggaggagagagtgcacctggagtgcgacggcgagaccatcagcctgcccaacctgcagggcatcgtggtgctgaacatcaccagctacgccggcggcatcaacttctggggcagcaacaccgccaccaccgagtacgaggcccccgccatcgacgacggcaagctggaggtggtggccatcttcggcagcgtgcagatggccatgagcagaatcatcaacctgcaccaccacagaatcgcccagtgccacgaggtgatgatcaccatcgacggcgaggagggcatccccgtgcaggtggacggcgaggcctggatccagagacccggcctgatcaagatcagatacaagaacgccgcccagatgctgaccagagacagagacttcgagaacagcatgaagatgtgggagtacaagcacaccgagatccaggccgccccccagccccagctggacttccaggacagccaggagagcctgagcgacgaggagtacgcccagatgcagcacctggccagactggccgagaacctgatcagcaagctgaacgacctgagcaagatccaccagcacgtgagcgtgctgatgggcagcgtgaacgccagcgccaacatcctgaacgacatcttctacggccaggacagcggcaacgagatgggcgccgccagctgcatccccatcgagaccctgagcagaaacgacgccgtggacgtgaccttcagcctgaagggcctgtacgacgacaccaccgccttcctggacgagaagctgctgagaagcgccgaggacgagaccgccctgcagagcgccctggacgccatgaacaaggagttcaagaagctgagcgagatcgactggatgaaccccatcttcgtgcccgaggagaagagcagcgacaccgacagcagaagcctgagactgaagatcaagttccccaagctgggcaagaagaaggtggaggaggagagaaagcccaagagcggccagagcgtgcagagcttcatcggcaacctgtggcacagaagacacagagaggacgaggccgagggcgacgaccccctgacccccagcagaagccagctgtag

SEQ ID NO: 20508 - DNA, 2550 bp, Artificial Sequence
  Description of Artificial Sequence: Synthetic coding sequence
atgagcgaggagagaagcctgagcctgctggccaaggccgtggaccccagacaccccaacatgatgaccgacgtggtgaagctgctgagcgccgtgtgcatcgtgggcgaggagagcatcctggaggaggtgctggaggccctgaccagcgccggcgaggagaagaagatcgacagattcttctgcatcgtggagggcctgagacacaacagcgtgcagctgcaggtggcctgcatgcagctgatcaacgccctggtgaccagccccgacgacctggacttcagactgcacatcagaaacgagttcatgagatgcggcctgaaggagatcctgcccaacctgaagtgcatcaagaacgacggcctggacatccagctgaaggtgttcgacgagcacaaggaggaggacctgttcgagctgagccacagactggaggacatcagagccgagctggacgaggcctacgacgtgtacaacatggtgtggagcaccgtgaaggagaccagagccgagggctacttcatcagcatcctgcagcacctgctgctgatcagaaacgactacttcatcagacagcagtacttcaagctgatcgacgagtgcgtgagccagatcgtgctgcacagagacggcatggaccccgacttcacctacagaaagagactggacctggacctgacccagttcgtggacatctgcatcgaccaggccaagctggaggagttcgaggagaaggccagcgagctgtacaagaagttcgagaaggagttcaccgaccaccaggagacccaggccgagctgcagaagaaggaggccaagatcaacgagctgcaggccgagctgcaggccttcaagagccagttcggcgccctgcccgccgactgcaacatccccctgccccccagcaaggagggcggcaccggccacagcgccctgcccccccccccccccctgcccagcggcggcggcgtgcccccccccccccccccccccccccccccccccctgcccggcatgagaatgcccttcagcggccccgtgcccccccccccccccctgggcttcctgggcggccagaacagcccccccctgcccatcctgcccttcggcctgaagcccaagaaggagttcaagcccgagatcagcatgagaagactgaactggctgaagatcagaccccacgagatgaccgagaactgcttctggatcaaggtgaacgagaacaagtacgagaacgtggacctgctgtgcaagctggagaacaccttctgctgccagcagaaggagagaagagaggaggaggacatcgaggagaagaagagcatcaagaagaagatcaaggagctgaagttcctggacagcaagatcgcccagaacctgagcatcttcctgagcagcttcagagtgccctacgaggagatcagaatgatgatcctggaggtggacgagaccagactggccgagagcatgatccagaacctgatcaagcacctgcccgaccaggagcagctgaacagcctgagccagttcaagagcgagtacagcaacctgtgcgagcccgagcagttcgtggtggtgatgagcaacgtgaagagactgagacccagactgagcgccatcctgttcaagctgcagttcgaggagcaggtgaacaacatcaagcccgacatcatggccgtgagcaccgcctgcgaggagatcaagaagagcaagagcttcagcaagctgctggagctggtgctgctgatgggcaactacatgaacgccggcagcagaaacgcccagaccttcggcttcaacctgagcagcctgtgcaagctgaaggacaccaagagcgccgaccagaagaccaccctgctgcacttcctggtggagatctgcgaggagaagtaccccgacatcctgaacttcgtggacgacctggagcccctggacaaggccagcaaggtgagcgtggagaccctggagaagaacctgagacagatgggcagacagctgcagcagctggagaaggagctggagaccttccccccccccgaggacctgcacgacaagttcgtgaccaagatgagcatcttcgtgatcagcgccaaggagcagtacgagaccctgagcaagctgcacgagaacatggagaagctgtaccagagcatcatcggctactacgccatcgacgtgaagaaggtgagcgtggaggacttcctgaccgacctgaacaacttcagaaccaccttcatgcaggccatcaaggagaacatcaagaagagagaggccgaggagaaggagaagagagtgagaatcgccaaggagctggccgagagagagagactggagagacagcagaagaagaagagactgctggagatgaagaccgagggcgacgagaccggcgtgatggacaacctgctggaggccctgcagagcggcgccgccttcagagacagaagaaagagaacccccatgcccaaggacgtgagacagagcctgagccccatgagccagagacccgtgctgaaggtgtgcaaccacggcaacaagccctacctgtag

SEQ ID NO: 20509 - DNA, 3582 bp, Artificial Sequence
  Description of Artificial Sequence: Synthetic coding sequence
atggagagacaccagcccagactgcaccaccccgcccagggcagcgccgccggcaccccctaccccagcagcgccagcctgagaggctgcagagagagcaagatgcccagaagaaagggcccccagcacccccccccccccagcggccccgaggagcccggcgagaagagacccaagttccacctgaacatcagaaccctgaccgacgacatgctggacaagttcgccagcatcagaatccccggcagcaagaaggagagaccccccctgcccaacctgaagaccgccttcgccagcagcgactgcagcgccgcccccctggagatgatggagaacttccccaagcccctgagcgagaacgagctgctggagctgttcgagaagatgatggaggacatgaacctgaacgaggacaagaaggcccccctgagagagaaggacttcagcatcaagaaggagatggtgatgcagtacatcaacaccgccagcaagaccggcagcctgaagagaagcagacagatcagcccccaggagttcatccacgagctgaagatgggcagcgccgacgagagactggtgacctgcctggagagcctgagagtgagcctgaccagcaaccccgtgagctgggtggagagcttcggccacgagggcctgggcctgctgctggacatcctggagaagctgatcagcggcaagatccaggagaaggtggtgaagaagaaccagcacaaggtgatccagtgcctgaaggccctgatgaacacccagtacggcctggagagaatcatgagcgaggagagaagcctgagcctgctggccaaggccgtggaccccagacaccccaacatgatgaccgacgtggtgaagctgctgagcgccgtgtgcatcgtgggcgaggagagcatcctggaggaggtgctggaggccctgaccagcgccggcgaggagaagaagatcgacagattcttctgcatcgtggagggcctgagacacaacagcgtgcagctgcaggtggcctgcatgcagctgatcaacgccctggtgaccagccccgacgacctggacttcagactgcacatcagaaacgagttcatgagatgcggcctgaaggagatcctgcccaacctgaagtgcatcaagaacgacggcctggacatccagctgaaggtgttcgacgagcacaaggaggaggacctgttcgagctgagccacagactggaggacatcagagccgagctggacgaggcctacgacgtgtacaacatggtgtggagcaccgtgaaggagaccagagccgagggctacttcatcagcatcctgcagcacctgctgctgatcagaaacgactacttcatcagacagcagtacttcaagctgatcgacgagtgcgtgagccagatcgtgctgcacagagacggcatggaccccgacttcacctacagaaagagactggacctggacctgacccagttcgtggacatctgcatcgaccaggccaagctggaggagttcgaggagaaggccagcgagctgtacaagaagttcgagaaggagttcaccgaccaccaggagacccaggccgagctgcagaagaaggaggccaagatcaacgagctgcaggccgagctgcaggccttcaagagccagttcggcgccctgcccgccgactgcaacatccccctgccccccagcaaggagggcggcaccggccacagcgccctgcccccccccccccccctgcccagcggcggcggcgtgcccccccccccccccccccccccccccccccccctgcccggcatgagaatgcccttcagcggccccgtgcccccccccccccccctgggcttcctgggcggccagaacagcccccccctgcccatcctgcccttcggcctgaagcccaagaaggagttcaagcccgagatcagcatgagaagactgaactggctgaagatcagaccccacgagatgaccgagaactgcttctggatcaaggtgaacgagaacaagtacgagaacgtggacctgctgtgcaagctggagaacaccttctgctgccagcagaaggagagaagagaggaggaggacatcgaggagaagaagagcatcaagaagaagatcaaggagctgaagttcctggacagcaagatcgcccagaacctgagcatcttcctgagcagcttcagagtgccctacgaggagatcagaatgatgatcctggaggtggacgagaccagactggccgagagcatgatccagaacctgatcaagcacctgcccgaccaggagcagctgaacagcctgagccagttcaagagcgagtacagcaacctgtgcgagcccgagcagttcgtggtggtgatgagcaacgtgaagagactgagacccagactgagcgccatcctgttcaagctgcagttcgaggagcaggtgaacaacatcaagcccgacatcatggccgtgagcaccgcctgcgaggagatcaagaagagcaagagcttcagcaagctgctggagctggtgctgctgatgggcaactacatgaacgccggcagcagaaacgcccagaccttcggcttcaacctgagcagcctgtgcaagctgaaggacaccaagagcgccgaccagaagaccaccctgctgcacttcctggtggagatctgcgaggagaagtaccccgacatcctgaacttcgtggacgacctggagcccctggacaaggccagcaaggtgagcgtggagaccctggagaagaacctgagacagatgggcagacagctgcagcagctggagaaggagctggagaccttccccccccccgaggacctgcacgacaagttcgtgaccaagatgagcagattcgtgatcagcgccaaggagcagtacgagaccctgagcaagctgcacgagaacatggagaagctgtaccagagcatcatcggctactacgccatcgacgtgaagaaggtgagcgtggaggacttcctgaccgacctgaacaacttcagaaccaccttcatgcaggccatcaaggagaacatcaagaagagagaggccgaggagaaggagaagagagtgagaatcgccaaggagctggccgagagagagagactggagagacagcagaagaagaagagactgctggagatgaagaccgagggcgacgagaccggcgtgatggacaacctgctggaggccctgcagagcggcgccgccttcagagacagaagaaagagaacccccatgcccaaggacgtgagacagagcctgagccccatgagccagagacccgtgctgaaggtgtgcaaccacgagaaccagaaggtgcagctgaccgagggcagcagaagccactacaacatcaactgcaacagcaccagaacccccgtggccaaggagctgaactacaacctggacacccacaccagcaccggcagaatcaaggccgccgagaagaaggaggcctgcaacgtggagagcaacagaaagaaggagaccgagctgctgggcagcttcagcaagaacgagagcgtgcccgaggtggaggccctgctggccagactgagagccctgtag

SEQ ID NO: 20510 - DNA, 3549 bp, Artificial Sequence
  Description of Artificial Sequence: Synthetic coding sequence
atggagagacaccagcccagactgcaccaccccgcccagggcagcgccgccggcaccccctaccccagcagcgccagcctgagaggctgcagagagagcaagatgcccagaagaaagggcccccagcacccccccccccccagcggccccgaggagcccggcgagaagagacccaagttcctggacaagttcgccagcatcagaatccccggcagcaagaaggagagaccccccctgcccaacctgaagaccgccttcgccagcagcgactgcagcgccgcccccctggagatgatggagaacttccccaagcccctgagcgagaacgagctgctggagctgttcgagaagatgatggaggacatgaacctgaacgaggacaagaaggcccccctgagagagaaggacttcagcatcaagaaggagatggtgatgcagtacatcaacaccgccagcaagaccggcagcctgaagagaagcagacagatcagcccccaggagttcatccacgagctgaagatgggcagcgccgacgagagactggtgacctgcctggagagcctgagagtgagcctgaccagcaaccccgtgagctgggtggagagcttcggccacgagggcctgggcctgctgctggacatcctggagaagctgatcagcggcaagatccaggagaaggtggtgaagaagaaccagcacaaggtgatccagtgcctgaaggccctgatgaacacccagtacggcctggagagaatcatgagcgaggagagaagcctgagcctgctggccaaggccgtggaccccagacaccccaacatgatgaccgacgtggtgaagctgctgagcgccgtgtgcatcgtgggcgaggagagcatcctggaggaggtgctggaggccctgaccagcgccggcgaggagaagaagatcgacagattcttctgcatcgtggagggcctgagacacaacagcgtgcagctgcaggtggcctgcatgcagctgatcaacgccctggtgaccagccccgacgacctggacttcagactgcacatcagaaacgagttcatgagatgcggcctgaaggagatcctgcccaacctgaagtgcatcaagaacgacggcctggacatccagctgaaggtgttcgacgagcacaaggaggaggacctgttcgagctgagccacagactggaggacatcagagccgagctggacgaggcctacgacgtgtacaacatggtgtggagcaccgtgaaggagaccagagccgagggctacttcatcagcatcctgcagcacctgctgctgatcagaaacgactacttcatcagacagcagtacttcaagctgatcgacgagtgcgtgagccagatcgtgctgcacagagacggcatggaccccgacttcacctacagaaagagactggacctggacctgacccagttcgtggacatctgcatcgaccaggccaagctggaggagttcgaggagaaggccagcgagctgtacaagaagttcgagaaggagttcaccgaccaccaggagacccaggccgagctgcagaagaaggaggccaagatcaacgagctgcaggccgagctgcaggccttcaagagccagttcggcgccctgcccgccgactgcaacatccccctgccccccagcaaggagggcggcaccggccacagcgccctgcccccccccccccccctgcccagcggcggcggcgtgcccccccccccccccccccccccccccccccccctgcccggcatgagaatgcccttcagcggccccgtgcccccccccccccccctgggcttcctgggcggccagaacagcccccccctgcccatcctgcccttcggcctgaagcccaagaaggagttcaagcccgagatcagcatgagaagactgaactggctgaagatcagaccccacgagatgaccgagaactgcttctggatcaaggtgaacgagaacaagtacgagaacgtggacctgctgtgcaagctggagaacaccttctgctgccagcagaaggagagaagagaggaggaggacatcgaggagaagaagagcatcaagaagaagatcaaggagctgaagttcctggacagcaagatcgcccagaacctgagcatcttcctgagcagcttcagagtgccctacgaggagatcagaatgatgatcctggaggtggacgagaccagactggccgagagcatgatccagaacctgatcaagcacctgcccgaccaggagcagctgaacagcctgagccagttcaagagcgagtacagcaacctgtgcgagcccgagcagttcgtggtggtgatgagcaacgtgaagagactgagacccagactgagcgccatcctgttcaagctgcagttcgaggagcaggtgaacaacatcaagcccgacatcatggccgtgagcaccgcctgcgaggagatcaagaagagcaagagcttcagcaagctgctggagctggtgctgctgatgggcaactacatgaacgccggcagcagaaacgcccagaccttcggcttcaacctgagcagcctgtgcaagctgaaggacaccaagagcgccgaccagaagaccaccctgctgcacttcctggtggagatctgcgaggagaagtaccccgacatcctgaacttcgtggacgacctggagcccctggacaaggccagcaaggtgagcgtggagaccctggagaagaacctgagacagatgggcagacagctgcagcagctggagaaggagctggagaccttccccccccccgaggacctgcacgacaagttcgtgaccaagatgagcatcttcgtgatcagcgccaaggagcagtacgagaccctgagcaagctgcacgagaacatggagaagctgtaccagagcatcatcggctactacgccatcgacgtgaagaaggtgagcgtggaggacttcctgaccgacctgaacaacttcagaaccaccttcatgcaggccatcaaggagaacatcaagaagagagaggccgaggagaaggagaagagagtgagaatcgccaaggagctggccgagagagagagactggagagacagcagaagaagaagagactgctggagatgaagaccgagggcgacgagaccggcgtgatggacaacctgctggaggccctgcagagcggcgccgccttcagagacagaagaaagagaacccccatgcccaaggacgtgagacagagcctgagccccatgagccagagacccgtgctgaaggtgtgcaaccacgagaaccagaaggtgcagctgaccgagggcagcagaagccactacaacatcaactgcaacagcaccagaacccccgtggccaaggagctgaactacaacctggacacccacaccagcaccggcagaatcaaggccgccgagaagaaggaggcctgcaacgtggagagcaacagaaagaaggagaccgagctgctgggcagcttcagcaagaacgagagcgtgcccgaggtggaggccctgctggccagactgagagccctgtag

SEQ ID NO: 20511 - DNA, 3372 bp, Artificial Sequence
  Description of Artificial Sequence: Synthetic coding sequence
atggagagacaccagcccagactgcaccaccccgcccagggcagcgccgccggcaccccctaccccagcagcgccagcctgagaggctgcagagagagcaagatgcccagaagaaagggcccccagcacccccccccccccagcggccccgaggagcccggcgagaagagacccaagttcgaggacatgaacctgaacgaggacaagaaggcccccctgagagagaaggacttcagcatcaagaaggagatggtgatgcagtacatcaacaccgccagcaagaccggcagcctgaagagaagcagacagatcagcccccaggagttcatccacgagctgaagatgggcagcgccgacgagagactggtgacctgcctggagagcctgagagtgagcctgaccagcaaccccgtgagctgggtggagagcttcggccacgagggcctgggcctgctgctggacatcctggagaagctgatcagcggcaagatccaggagaaggtggtgaagaagaaccagcacaaggtgatccagtgcctgaaggccctgatgaacacccagtacggcctggagagaatcatgagcgaggagagaagcctgagcctgctggccaaggccgtggaccccagacaccccaacatgatgaccgacgtggtgaagctgctgagcgccgtgtgcatcgtgggcgaggagagcatcctggaggaggtgctggaggccctgaccagcgccggcgaggagaagaagatcgacagattcttctgcatcgtggagggcctgagacacaacagcgtgcagctgcaggtggcctgcatgcagctgatcaacgccctggtgaccagccccgacgacctggacttcagactgcacatcagaaacgagttcatgagatgcggcctgaaggagatcctgcccaacctgaagtgcatcaagaacgacggcctggacatccagctgaaggtgttcgacgagcacaaggaggaggacctgttcgagctgagccacagactggaggacatcagagccgagctggacgaggcctacgacgtgtacaacatggtgtggagcaccgtgaaggagaccagagccgagggctacttcatcagcatcctgcagcacctgctgctgatcagaaacgactacttcatcagacagcagtacttcaagctgatcgacgagtgcgtgagccagatcgtgctgcacagagacggcatggaccccgacttcacctacagaaagagactggacctggacctgacccagttcgtggacatctgcatcgaccaggccaagctggaggagttcgaggagaaggccagcgagctgtacaagaagttcgagaaggagttcaccgaccaccaggagacccaggccgagctgcagaagaaggaggccaagatcaacgagctgcaggccgagctgcaggccttcaagagccagttcggcgccctgcccgccgactgcaacatccccctgccccccagcaaggagggcggcaccggccacagcgccctgcccccccccccccccctgcccagcggcggcggcgtgcccccccccccccccccccccccccccccccccctgcccggcatgagaatgcccttcagcggccccgtgcccccccccccccccctgggcttcctgggcggccagaacagcccccccctgcccatcctgcccttcggcctgaagcccaagaaggagttcaagcccgagatcagcatgagaagactgaactggctgaagatcagaccccacgagatgaccgagaactgcttctggatcaaggtgaacgagaacaagtacgagaacgtggacctgctgtgcaagctggagaacaccttctgctgccagcagaaggagagaagagaggaggaggacatcgaggagaagaagagcatcaagaagaagatcaaggagctgaagttcctggacagcaagatcgcccagaacctgagcatcttcctgagcagcttcagagtgccctacgaggagatcagaatgatgatcctggaggtggacgagaccagactggccgagagcatgatccagaacctgatcaagcacctgcccgaccaggagcagctgaacagcctgagccagttcaagagcgagtacagcaacctgtgcgagcccgagcagttcgtggtggtgatgagcaacgtgaagagactgagacccagactgagcgccatcctgttcaagctgcagttcgaggagcaggtgaacaacatcaagcccgacatcatggccgtgagcaccgcctgcgaggagatcaagaagagcaagagcttcagcaagctgctggagctggtgctgctgatgggcaactacatgaacgccggcagcagaaacgcccagaccttcggcttcaacctgagcagcctgtgcaagctgaaggacaccaagagcgccgaccagaagaccaccctgctgcacttcctggtggagatctgcgaggagaagtaccccgacatcctgaacttcgtggacgacctggagcccctggacaaggccagcaaggtgagcgtggagaccctggagaagaacctgagacagatgggcagacagctgcagcagctggagaaggagctggagaccttccccccccccgaggacctgcacgacaagttcgtgaccaagatgagcatcttcgtgatcagcgccaaggagcagtacgagaccctgagcaagctgcacgagaacatggagaagctgtaccagagcatcatcggctactacgccatcgacgtgaagaaggtgagcgtggaggacttcctgaccgacctgaacaacttcagaaccaccttcatgcaggccatcaaggagaacatcaagaagagagaggccgaggagaaggagaagagagtgagaatcgccaaggagctggccgagagagagagactggagagacagcagaagaagaagagactgctggagatgaagaccgagggcgacgagaccggcgtgatggacaacctgctggaggccctgcagagcggcgccgccttcagagacagaagaaagagaacccccatgcccaaggacgtgagacagagcctgagccccatgagccagagacccgtgctgaaggtgtgcaaccacgagaaccagaaggtgcagctgaccgagggcagcagaagccactacaacatcaactgcaacagcaccagaacccccgtggccaaggagctgaactacaacctggacacccacaccagcaccggcagaatcaaggccgccgagaagaaggaggcctgcaacgtggagagcaacagaaagaaggagaccgagctgctgggcagcttcagcaagaacgagagcgtgcccgaggtggaggccctgctggccagactgagagccctgtag

SEQ ID NO: 20512 - DNA, 3582 bp, Artificial Sequence
  Description of Artificial Sequence: Synthetic coding sequence
atggagagacaccagcccagactgcaccaccccgcccagggcagcgccgccggcaccccctaccccagcagcgccagcctgagaggctgcagagagagcaagatgcccagaagaaagggcccccagcacccccccccccccagcggccccgaggagcccggcgagaagagacccaagttccacctgaacatcagaaccctgaccgacgacatgctggacaagttcgccagcatcagaatccccggcagcaagaaggagagaccccccctgcccaacctgaagaccgccttcgccagcagcgactgcagcgccgcccccctggagatgatggagaacttccccaagcccctgagcgagaacgagctgctggagctgttcgagaagatgatggaggacatgaacctgaacgaggacaagaaggcccccctgagagagaaggacttcagcatcaagaaggagatggtgatgcagtacatcaacaccgccagcaagaccggcagcctgaagagaagcagacagatcagcccccaggagttcatccacgagctgaagatgggcagcgccgacgagagactggtgacctgcctggagagcctgagagtgagcctgaccagcaaccccgtgagctgggtggagagcttcggccacgagggcctgggcctgctgctggacatcctggagaagctgatcagcggcaagatccaggagaaggtggtgaagaagaaccagcacaaggtgatccagtgcctgaaggccctgatgaacacccagtacggcctggagagaatcatgagcgaggagagaagcctgagcctgctggccaaggccgtggaccccagacaccccaacatgatgaccgacgtggtgaagctgctgagcgccgtgtgcatcgtgggcgaggagagcatcctggaggaggtgctggaggccctgaccagcgccggcgaggagaagaagatcgacagattcttctgcatcgtggagggcctgagacacaacagcgtgcagctgcaggtggcctgcatgcagctgatcaacgccctggtgaccagccccgacgacctggacttcagactgcacatcagaaacgagttcatgagatgcggcctgaaggagatcctgcccaacctgaagtgcatcaagaacgacggcctggacatccagctgaaggtgttcgacgagcacaaggaggaggacctgttcgagctgagccacagactggaggacatcagagccgagctggacgaggcctacgacgtgtacaacatggtgtggagcaccgtgaaggagaccagagccgagggctacttcatcagcatcctgcagcacctgctgctgatcagaaacgactacttcatcagacagcagtacttcaagctgatcgacgagtgcgtgagccagatcgtgctgcacagagacggcatggaccccgacttcacctacagaaagagactggacctggacctgacccagttcgtggacatctgcatcgaccaggccaagctggaggagttcgaggagaaggccagcgagctgtacaagaagttcgagaaggagttcaccgaccaccaggagacccaggccgagctgcagaagaaggaggccaagatcaacgagctgcaggccgagctgcaggccttcaagagccagttcggcgccctgcccgccgactgcaacatccccctgccccccagcaaggagggcggcaccggccacagcgccctgcccccccccccccccctgcccagcggcggcggcgtgcccccccccccccccccccccccccccccccccctgcccggcatgagaatgcccttcagcggccccgtgcccccccccccccccctgggcttcctgggcggccagaacagcccccccctgcccatcctgcccttcggcctgaagcccaagaaggagttcaagcccgagatcagcatgagaagactgaactggctgaagatcagaccccacgagatgaccgagaactgcttctggatcaaggtgaacgagaacaagtacgagaacgtggacctgctgtgcaagctggagaacaccttctgctgccagcagaaggagagaagagaggaggaggacatcgaggagaagaagagcatcaagaagaagatcaaggagctgaagttcctggacagcaagatcgcccagaacctgagcatcttcctgagcagcttcagagtgccctacgaggagatcagaatgatgatcctggaggtggacgagaccagactggccgagagcatgatccagaacctgatcaagcacctgcccgaccaggagcagctgaacagcctgagccagttcaagagcgagtacagcaacctgtgcgagcccgagcagttcgtggtggtgatgagcaacgtgaagagactgagacccagactgagcgccatcctgttcaagctgcagttcgaggagcaggtgaacaacatcaagcccgacatcatggccgtgagcaccgcctgcgaggagatcaagaagagcaagagcttcagcaagctgctggagctggtgctgctgatgggcaactacatgaacgccggcagcagaaacgcccagaccttcggcttcaacctgagcagcctgtgcaagctgaaggacaccaagagcgccgaccagaagaccaccctgctgcacttcctggtggagatctgcgaggagaagtaccccgacatcctgaacttcgtggacgacctggagcccctggacaaggccagcaaggtgagcgtggagaccctggagaagaacctgagacagatgggcagacagctgcagcagctggagaaggagctggagaccttccccccccccgaggacctgcacgacaagttcgtgaccaagatgagcatcttcgtgatcagcgccaaggagcagtacgagaccctgagcaagctgcacgagaacatggagaagctgtaccagagcatcatcggctactacgccatcgacgtgaagaaggtgagcgtggaggacttcctgaccgacctgaacaacttcagaaccaccttcatgcaggccatcaaggagaacatcaagaagagagaggccgaggagaaggagaagagagtgagaatcgccaaggagctggccgagagagagagactggagagacagcagaagaagaagagactgctggagatgaagaccgagggcgacgagaccggcgtgatggacaacctgctggaggccctgcagagcggcgccgccttcagagacagaagaaagagaacccccatgcccaaggacgtgagacagagcctgagccccatgagccagagacccgtgctgaaggtgtgcaaccacgagaaccagaaggtgcagctgaccgagggcagcagaagccactacaacatcaactgcaacagcaccagaacccccgtggccaaggagctgaactacaacctggacacccacaccagcaccggcagaatcaaggccgccgagaagaaggaggcctgcaacgtggagagcaacagaaagaaggagaccgagctgctgggcagcttcagcaagaacgagagcgtgcccgaggtggaggccctgctggccagactgagagccctgtag

SEQ ID NO: 20513 - DNA, 3444 bp, Artificial Sequence
  Description of Artificial Sequence: Synthetic coding sequence
atggagagacaccagcccagactgcaccaccccgcccagggcagcgccgccggcaccccctaccccagcagcgccagcctgagaggctgcagagagagcaagatgcccagaagaaagggcccccagcacccccccccccccagcggccccgaggagcccggcgagaagagacccaagttcctggacaagttcgccagcatcagaatccccggcagcaagaaggagagaccccccctgcccaacctgaagaccgccttcgccagcagcgactgcagcgccgcccccctggagatgatggagaacttccccaagcccctgagcgagaacgagctgctggagctgttcgagaagatgatgggcagcctgaagagaagcagacagatcagcccccaggagttcatccacgagctgaagatgggcagcgccgacgagagactggtgacctgcctggagagcctgagagtgagcctgaccagcaaccccgtgagctgggtggagagcttcggccacgagggcctgggcctgctgctggacatcctggagaagctgatcagcggcaagatccaggagaaggtggtgaagaagaaccagcacaaggtgatccagtgcctgaaggccctgatgaacacccagtacggcctggagagaatcatgagcgaggagagaagcctgagcctgctggccaaggccgtggaccccagacaccccaacatgatgaccgacgtggtgaagctgctgagcgccgtgtgcatcgtgggcgaggagagcatcctggaggaggtgctggaggccctgaccagcgccggcgaggagaagaagatcgacagattcttctgcatcgtggagggcctgagacacaacagcgtgcagctgcaggtggcctgcatgcagctgatcaacgccctggtgaccagccccgacgacctggacttcagactgcacatcagaaacgagttcatgagatgcggcctgaaggagatcctgcccaacctgaagtgcatcaagaacgacggcctggacatccagctgaaggtgttcgacgagcacaaggaggaggacctgttcgagctgagccacagactggaggacatcagagccgagctggacgaggcctacgacgtgtacaacatggtgtggagcaccgtgaaggagaccagagccgagggctacttcatcagcatcctgcagcacctgctgctgatcagaaacgactacttcatcagacagcagtacttcaagctgatcgacgagtgcgtgagccagatcgtgctgcacagagacggcatggaccccgacttcacctacagaaagagactggacctggacctgacccagttcgtggacatctgcatcgaccaggccaagctggaggagttcgaggagaaggccagcgagctgtacaagaagttcgagaaggagttcaccgaccaccaggagacccaggccgagctgcagaagaaggaggccaagatcaacgagctgcaggccgagctgcaggccttcaagagccagttcggcgccctgcccgccgactgcaacatccccctgccccccagcaaggagggcggcaccggccacagcgccctgcccccccccccccccctgcccagcggcggcggcgtgcccccccccccccccccccccccccccccccccctgcccggcatgagaatgcccttcagcggccccgtgcccccccccccccccctgggcttcctgggcggccagaacagcccccccctgcccatcctgcccttcggcctgaagcccaagaaggagttcaagcccgagatcagcatgagaagactgaactggctgaagatcagaccccacgagatgaccgagaactgcttctggatcaaggtgaacgagaacaagtacgagaacgtggacctgctgtgcaagctggagaacaccttctgctgccagcagaaggagagaagagaggaggaggacatcgaggagaagaagagcatcaagaagaagatcaaggagctgaagttcctggacagcaagatcgcccagaacctgagcatcttcctgagcagcttcagagtgccctacgaggagatcagaatgatgatcctggaggtggacgagaccagactggccgagagcatgatccagaacctgatcaagcacctgcccgaccaggagcagctgaacagcctgagccagttcaagagcgagtacagcaacctgtgcgagcccgagcagttcgtggtggtgatgagcaacgtgaagagactgagacccagactgagcgccatcctgttcaagctgcagttcgaggagcaggtgaacaacatcaagcccgacatcatggccgtgagcaccgcctgcgaggagatcaagaagagcaagagcttcagcaagctgctggagctggtgctgctgatgggcaactacatgaacgccggcagcagaaacgcccagaccttcggcttcaacctgagcagcctgtgcaagctgaaggacaccaagagcgccgaccagaagaccaccctgctgcacttcctggtggagatctgcgaggagaagtaccccgacatcctgaacttcgtggacgacctggagcccctggacaaggccagcaaggtgagcgtggagaccctggagaagaacctgagacagatgggcagacagctgcagcagctggagaaggagctggagaccttccccccccccgaggacctgcacgacaagttcgtgaccaagatgagcatcttcgtgatcagcgccaaggagcagtacgagaccctgagcaagctgcacgagaacatggagaagctgtaccagagcatcatcggctactacgccatcgacgtgaagaaggtgagcgtggaggacttcctgaccgacctgaacaacttcagaaccaccttcatgcaggccatcaaggagaacatcaagaagagagaggccgaggagaaggagaagagagtgagaatcgccaaggagctggccgagagagagagactggagagacagcagaagaagaagagactgctggagatgaagaccgagggcgacgagaccggcgtgatggacaacctgctggaggccctgcagagcggcgccgccttcagagacagaagaaagagaacccccatgcccaaggacgtgagacagagcctgagccccatgagccagagacccgtgctgaaggtgtgcaaccacgagaaccagaaggtgcagctgaccgagggcagcagaagccactacaacatcaactgcaacagcaccagaacccccgtggccaaggagctgaactacaacctggacacccacaccagcaccggcagaatcaaggccgccgagaagaaggaggcctgcaacgtggagagcaacagaaagaaggagaccgagctgctgggcagcttcagcaagaacgagagcgtgcccgaggtggaggccctgctggccagactgagagccctgtag

SEQ ID NO: 20514 - DNA, 3051 bp, Artificial Sequence
  Description of Artificial Sequence: Synthetic coding sequence
atggagagacaccagcccagactgcaccaccccgcccagggcagcgccgccggcaccccctaccccagcagcgccagcctgagaggctgcagagagagcaagatgcccagaagaaagggcccccagcacccccccccccccagcggccccgaggagcccggcgagaagagacccaagttccacctgaacatcagaaccctgaccgacgacatgctggacaagttcgccagcatcagaatccccggcagcaagaaggagagaccccccctgcccaacctgaagaccgccttcgccagcagcgactgcagcgccgcccccctggagatgatggagaacttccccaagcccctgagcgagaacgagctgctggagctgttcgagaagatgatggaggacatgaacctgaacgaggacaagaaggcccccctgagagagaaggacttcagcatcaagaaggagatggtgatgcagtacatcaacaccgccagcaagaccggcagcctgaagagaagcagacagatcagcccccaggagttcatccacgagctgaagatgggcagcgccgacgagagactggtgacctgcctggagagcctgagagtgagcctgaccagcaaccccgtgagctgggtggagagcttcggccacgagggcctgggcctgctgctggacatcctggagaagctgatcagcggcaagatccaggagaaggtggtgaagaagaaccagcacaaggtgatccagtgcctgaaggccctgatgaacacccagtacggcctggagagaatcatgagcgaggagagaagcctgagcctgctggccaaggccgtggaccccagacaccccaacatgatgaccgacgtggtgaagctgctgagcgccgtgtgcatcgtgggcgaggagagcatcctggaggaggtgctggaggccctgaccagcgccggcgaggagaagaagatcgacagattcttctgcatcgtggagggcctgagacacaacagcgtgcagctgcaggtggcctgcatgcagctgatcaacgccctggtgaccagccccgacgacctggacttcagactgcacatcagaaacgagttcatgagatgcggcctgaaggagatcctgcccaacctgaagtgcatcaagaacgacggcctggacatccagctgaaggtgttcgacgagcacaaggaggaggacctgttcgagctgagccacagactggaggacatcagagccgagctggacgaggcctacgacgtgtacaacatggtgtggagcaccgtgaaggagaccagagccgagggctacttcatcagcatcctgcagcacctgctgctgatcagaaacgactacttcatcagacagcagtacttcaagctgatcgacgagtgcgtgagccagatcgtgctgcacagagacggcatggaccccgacttcacctacagaaagagactggacctggacctgacccagttcgtggacatctgcatcgaccaggccaagctggaggagttcgaggagaaggccagcgagctgtacaagaagttcgagaaggagttcaccgaccaccaggagacccaggccgagctgcagaagaaggaggccaagatcaacgagctgcaggccgagctgcaggccttcaagagccagttcggcgccctgcccgccgactgcaacatccccctgccccccagcaaggagggcggcaccggccacagcgccctgcccccccccccccccctgcccagcggcggcggcgtgcccccccccccccccccccccccccccccccccctgcccggcatgagaatgcccttcagcggccccgtgcccccccccccccccctgggcttcctgggcggccagaacagcccccccctgcccatcctgcccttcggcctgaagcccaagaaggagttcaagcccgagatcagcatgagaagactgaactggctgaagatcagaccccacgagatgaccgagaactgcttctggatcaaggtgaacgagaacaagtacgagaacgtggacctgctgtgcaagctggagaacaccttctgctgccagcagaaggagagaagagaggaggaggacatcgaggagaagaagagcatcaagaagaagatcaaggagctgaagttcctggacagcaagatcgcccagaacctgagcatcttcctgagcagcttcagagtgccctacgaggagatcagaatgatgatcctggaggtggacgagaccagactggccgagagcatgatccagaacctgatcaagcacctgcccgaccaggagcagctgaacagcctgagccagttcaagagcgagtacagcaacctgtgcgagcccgagcagttcgtggtggtgatgagcaacgtgaagagactgagacccagactgagcgccatcctgttcaagctgcagttcgaggagcaggtgaacaacatcaagcccgacatcatggccgtgagcaccgcctgcgaggagatcaagaagagcaagagcttcagcaagctgctggagctggtgctgctgatgggcaactacatgaacgccggcagcagaaacgcccagaccttcggcttcaacctgagcagcctgtgcaagctgaaggacaccaagagcgccgaccagaagaccaccctgctgcacttcctggtggagatctgcgaggagaagtaccccgacatcctgaacttcgtggacgacctggagcccctggacaaggccagcaaggtgagcgtggagaccctggagaagaacctgagacagatgggcagacagctgcagcagctggagaaggagctggagaccttccccccccccgaggacctgcacgacaagttcgtgaccaagatgagcatcttcgtgatcagcgccaaggagcagtacgagaccctgagcaagctgcacgagaacatggagaagctgtaccagagcatcatcggctactacgccatcgacgtgaagaaggtgagcgtggaggacttcctgaccgacctgaacaacttcagaaccaccttcatgaaggccatcaagttccagatctag

SEQ ID NO: 20515 - DNA, 3339 bp, Artificial Sequence
  Description of Artificial Sequence: Synthetic coding sequence
atggagagacaccagcccagactgcaccaccccgcccagggcagcgccgccggcaccccctaccccagcagcgccagcctgagaggctgcagagagagcaagatgcccagaagaaagggcccccagcacccccccccccccagcggccccgaggagcccggcgagaagagacccaagttccacctgaacatcagaaccctgaccgacgacatgctggacaagttcgccagcatcagaatccccggcagcaagaaggagagaccccccctgcccaacctgaagaccgccttcgccagcagcgactgcagcgccgcccccctggagatgatggagaacttccccaagcccctgagcgagaacgagctgctggagctgttcgagaagatgatggaggacatgaacctgaacgaggacaagaaggcccccctgagagagaaggacttcagcatcaagaaggagatggtgatgcagtacatcaacaccgccagcaagaccggcagcctgaagagaagcagacagatcagcccccaggagttcatccacgagctgaagatgggcagcgccgacgagagactggtgacctgcctggagagcctgagagtgagcctgaccagcaaccccgtgagctgggtggagagcttcggccacgagggcctgggcctgctgctggacatcctggagaagctgatcagcggcaagatccaggagaaggtggtgaagaagaaccagcacaaggtgatccagtgcctgaaggccctgatgaacacccagtacggcctggagagaatcatgagcgaggagagaagcctgagcctgctggccaaggccgtggaccccagacaccccaacatgatgaccgacgtggtgaagctgctgagcgccgtgtgcatcgtgggcgaggagagcatcctggaggaggtgctggaggccctgaccagcgccggcgaggagaagaagatcgacagattcttctgcatcgtggagggcctgagacacaacagcgtgcagctgcaggtggcctgcatgcagctgatcaacgccctggtgaccagccccgacgacctggacttcagactgcacatcagaaacgagttcatgagatgcggcctgaaggagatcctgcccaacctgaagtgcatcaagaacgacggcctggacatccagctgaaggtgttcgacgagcacaaggaggaggacctgttcgagctgagccacagactggaggacatcagagccgagctggacgaggcctacgacgtgtacaacatggtgtggagcaccgtgaaggagaccagagccgagggctacttcatcagcatcctgcagcacctgctgctgatcagaaacgactacttcatcagacagcagtacttcaagctgatcgacgagtgcgtgagccagatcgtgctgcacagagacggcatggaccccgacttcacctacagaaagagactggacctggacctgacccagttcgtggacatctgcatcgaccaggccaagctggaggagttcgaggagaaggccagcgagctgtacaagaagttcgagaaggagttcaccgaccaccaggagacccaggccgagctgcagaagaaggaggccaagatcaacgagctgcaggccgagctgcaggccttcaagagccagttcggcgccctgcccgccgactgcaacatccccctgccccccagcaaggagggcggcaccggccacagcgccctgcccccccccccccccctgcccagcggcggcggcgtgcccccccccccccccccccccccccccccccccctgcccggcatgagaatgcccttcagcggccccgtgcccccccccccccccctgggcttcctgggcggccagaacagcccccccctgcccatcctgcccttcggcctgaagcccaagaaggagttcaagcccgagatcagcatgagaagactgaactggctgaagatcagaccccacgagatgaccgagaactgcttctggatcaaggtgaacgagaacaagtacgagaacgtggacctgctgtgcaagctggagaacaccttctgctgccagcagaaggagagaagagaggaggaggacatcgaggagaagaagagcatcaagaagaagatcaaggagctgaagttcctggacagcaagatcgcccagaacctgagcatcttcctgagcagcttcagagtgccctacgaggagatcagaatgatgatcctggaggtggacgagaccagactggccgagagcatgatccagaacctgatcaagcacctgcccgaccaggagcagctgaacagcctgagccagttcaagagcgagtacagcaacctgtgcgagcccgagcagttcgtggtggtgatgagcaacgtgaagagactgagacccagactgagcgccatcctgttcaagctgcagttcgaggagcaggtgaacaacatcaagcccgacatcatggccgtgagcaccgcctgcgaggagatcaagaagagcaagagcttcagcaagctgctggagctggtgctgctgatgggcaactacatgaacgccggcagcagaaacgcccagaccttcggcttcaacctgagcagcctgtgcaagctgaaggacaccaagagcgccgaccagaagaccaccctgctgcacttcctggtggagatctgcgaggagaagtaccccgacatcctgaacttcgtggacgacctggagcccctggacaaggccagcaaggtgagcgtggagaccctggagaagaacctgagacagatgggcagacagctgcagcagctggagaaggagctggagaccttccccccccccgaggacctgcacgacaagttcgtgaccaagatgagcagattcgtgatcagcgccaaggagcagtacgagaccctgagcaagctgcacgagaacatggagaagctgtaccagagcatcatcggctactacgccatcgacgtgaagaaggtgagcgtggaggacttcctgaccgacctgaacaacttcagaaccaccttcatgcaggccatcaaggagaacatcaagaagagagaggccgaggagaaggagaagagagtgagaatcgccaaggagctggccgagagagagagactggagagacagcagaagaagaagagactgctggagatgaagaccgagggcgacgagaccggcgtgatggacaacctgctggaggccctgcagagcggcgccgccttcagagacagaagaaagagaacccccatgcccaaggacgtgagacagagcctgagccccatgagccagagacccgtgctgaaggtgtgcaaccacggcaacaagccctacctgtag

SEQ ID NO: 20516 - DNA, 1866 bp, Artificial Sequence
  Description of Artificial Sequence: Synthetic coding sequence
atgtgcagcggctggagcagcagcgtgatctggagacacacccagttcgccgtggagagatgcggcttctgcggcagcagcggccccggcgcccccctggagcccagcaccctgggcagcaagcacctgccctgggaggccgtgagcgccggcttcgccgacagaaacagaaacatggacggcgccatgtggctgagcctgtgccccgacaacgaggacctgctgtggagaaagaagcacaagctgctgcaggccagaggcaagggcgacctggccctgcagagaagagccgacgccaagctgtggaagaactaccagctgcagagactggccgaggagctgagaagaggctaccaggaggcccagcacctgcacgtgggcggcctggacagactgcagagcgccagactgctgggctggggcggcggcagagccagagagaacgagcccgacagccagggccccatccagagaagaagcgccagaccccccagagccaaggagaagcacagagccgccctgagcgaggagagaagctgcagagaggagctgggccagcagcaccccagacacagcagacccagaaagaccgccgccagccccgagaagccccagaccaccaaggccaccggcagaatgaacagccacctggccccccccgagaagagaaagggcagacccgagcccagcaccaagagcggcggcggcagatgcgccatccaccccagaagaagcaagggcgccgacctggagagaagcaaccccctggtggccgccgtgggcgagatcggcctggtggaggagaaggagaagggcaccgccagagccggcagaagacagctgggcaagggcgccgtgtgcttcgtgcccgccctgaccagcagaagccagggccagagcctggagggcaagctgagagacctgggccagctgtggcccgccgacagcagctgcagaagagaggccgtgagccccgccagccagtgcaccctgagagagaagaacaagtggcagaaggagctggagctggccttcgaggagctgttcaacatcaacagaaagctgaagaagcacctgtgcctgtacctggccctgaagcccagaatggaccagagacccggcgagggccacgccttcagcgagatgcaggagtgcggcgccggcacccccagaggcaagaagatggccgaccccgagatgctgcccgccggcgagcccagaagccccgccgaggaggaggcccagcaggccgccagcaagaccgacctgaagaccttcatgggcaaggcccagaaccagaagtaccagggcaccgtgaagcccaccttcagaaacggcagccagaccctgagccccgaggccggcatcttcatcaacaaggaggacagcctgctgtacagcaccgagagcggccaggagacccccaagctgggcaccctggccgagggcagcctgcagctgcacctgcaggaccaggccgacagagtgggcagcaccgccagcagacagagacagaaggccgagatggagcagagaagacagaagcagctggagagcctggagcagatggagcaccccgacatgagcctggagatccactacaaggccgagctggagaaggagagaagagagcagagaagagccagactggcccacctgaagagcagcagcaccagagcccaggagagagagagaggcagcgagctgagcaccaccagccccagcggcaccagcctggccgacgacgacagacacagccagatgatcagagaccagcagcagcagatcctgcagcagaacagactgcacaagcagttcctggaggaggccagaaagtgcctgagagagttccagaacatctgctag

SEQ ID NO: 20517 - DNA, 1539 bp, Artificial Sequence
  Description of Artificial Sequence: Synthetic coding sequence
atggccatcctgagcctgagagcccccggcccctggcaggccatgcaggtgtgggccgacagaaccctgctgaccccccacaccggcgtgaccagccaggtgctgggcgtggccgccgccgtgatgacccccctgcccggcggccacgccgccggcagaaccagagaggccagatgggacgccatggagtacgacgagaagctggccagattcagacaggcccacctgaaccccttcaacaagcagagcggccccagacagcacgagcagggccccggcgaggaggtgcccgacgtgacccccgaggaggccctgcccgagctgccccccggcgagcccgagttcagatgccccgagagagtgatggacctgggcctgagcgaggaccacttcagcagacccgtgggcctgttcctggccagcgacgtgcagcagctgagacaggccatcgaggagtgcaagcaggtgatcctggagctgcccgagcagagcgagaagcagaaggacgccgtggtgagactgatccacctgagactgaagctgcaggagctgaaggaccccaacgaggacgagcccaacatcagagtgctgctggagcacagattctacaaggagaagagcaagagcgtgaagcagacctgcgacaagtgcaacaccatcatctggggcctgatccagacctggtacacctgcaccggctgctactacagatgccacagcaagtgcctgaacctgatcagcaagccctgcgtgagcagcaaggtgagccaccaggccgagtacgagctgaacatctgccccgagaccggcctggacagccaggactacagatgcgccgagtgcagagcccccatcagcctgagaggcgtgcccagcgaggccagacagtgcgactacaccggccagtactactgcagccactgccactggaacgacctggccgtgatccccgccagagtggtgcacaactgggacttcgagcccagaaaggtgagcagatgcagcatgagatacctggccctgatggtgagcagacccgtgctgagactgagagagatcaaccccctgctgttcagctacgtggaggagctggtggagatcagaaagctgagacaggacatcctgctgatgaagccctacttcatcacctgcagagaggccatggaggccagactgctgctgcagctgcaggacagacagcacttcgtggagaacgacgagatgtacagcgtgcaggacctgctggacgtgcacgccggcagactgggctgcagcctgaccgagatccacaccctgttcgccaagcacatcaagctggactgcgagagatgccaggccaagggcttcgtgtgcgagctgtgcagagagggcgacgtgctgttccccttcgacagccacaccagcgtgtgcgccgactgcagcgccgtgttccacagagactgctactacgacaacagcaccacctgccccaagtgcgccagactgagcctgagaaagcagagcctgttccaggagcccggccccgacgtggaggcctag

SEQ ID NO: 20518 - DNA, 594 bp, Artificial Sequence
  Description of Artificial Sequence: Synthetic coding sequence
atggagtacgacgagaagctggccagattcagacaggcccacctgaaccccttcaacaagcagagcggccccagacagcacgagcagggccccggcgaggaggtgcccgacgtgacccccgaggaggccctgcccgagctgccccccggcgagcccgagttcagatgccccgagagagtgatggacctgggcctgagcgaggaccacttcagcagacccgtgggcctgttcctggccagcgacgtgcagcagctgagacaggccatcgaggagtgcaagcaggtgatcctggagctgcccgagcagagcgagaagcagaaggacgccgtggtgagactgatccacctgagactgaagctgcaggagctgaaggaccccaacgaggacgagcccaacatcagagtgctgctggagcacagattctacaaggagaagagcaagagcgtgaagcagacctgcgacaagtgcaacaccatcatctggggcctgatccagacctggtacacctgcaccggcggccccagacccagaagaggcgtgagaaacgagagagaccagagcagctgcctgagatgggcccacatccagatgtag

SEQ ID NO: 20519 - DNA, 1356 bp, Artificial Sequence
  Description of Artificial Sequence: Synthetic coding sequence
atggagtacgacgagaagctggccagattcagacaggcccacctgaaccccttcaacaagcagagcggccccagacagcacgagcagggccccggcgaggaggtgcccgacgtgacccccgaggaggccctgcccgagctgccccccggcgagcccgagttcagatgccccgagagagtgatggacctgggcctgagcgaggaccacttcagcagacccgtgggcctgttcctggccagcgacgtgcagcagctgagacaggccatcgaggagtgcaagcaggtgatcctggagctgcccgagcagagcgagaagcagaaggacgccgtggtgagactgatccacctgagactgaagctgcaggagctgaaggaccccaacgaggacgagcccaacatcagagtgctgctggagcacagattctacaaggagaagagcaagagcgtgaagcagacctgcgacaagtgcaacaccatcatctggggcctgatccagacctggtacacctgcaccggctgctactacagatgccacagcaagtgcctgaacctgatcagcaagccctgcgtgagcagcaaggtgagccaccaggccgagtacgagctgaacatctgccccgagaccggcctggacagccaggactacagatgcgccgagtgcagagcccccatcagcctgagaggcgtgcccagcgaggccagacagtgcgactacaccggccagtactactgcagccactgccactggaacgacctggccgtgatccccgccagagtggtgcacaactgggacttcgagcccagaaaggtgagcagatgcagcatgagatacctggccctgatggtgagcagacccgtgctgagactgagagagatcaaccccctgctgttcagctacgtggaggagctggtggagatcagaaagctgagacaggacatcctgctgatgaagccctacttcatcacctgcagagaggccatggaggccagactgctgctgcagctgcaggacagacagcacttcgtggagaacgacgagatgtacagcgtgcaggacctgctggacgtgcacgccggcagactgggctgcagcctgaccgagatccacaccctgttcgccaagcacatcaagctggactgcgagagatgccaggccaagggcttcgtgtgcgagctgtgcagagagggcgacgtgctgttccccttcgacagccacaccagcgtgtgcgccgactgcagcgccgtgttccacagagactgctactacgacaacagcaccacctgccccaagtgcgccagactgagcctgagaaagcagagcctgttccaggagcccggccccgacgtggaggcctag

SEQ ID NO: 20520 - DNA, 1326 bp, Artificial Sequence
  Description of Artificial Sequence: Synthetic coding sequence
atggagtacgacgagaagctggccagattcagacaggcccacctgaaccccttcaacaagcagagcggccccagacagcacgagcagggccccggcgaggaggtgcccgacgtgacccccgaggaggccctgcccgagctgccccccggcgagcccgagttcagatgccccgagagagtgatggacctgggcctgagcgaggaccacttcagcagacccgtgctgagacaggccatcgaggagtgcaagcaggtgatcctggagctgcccgagcagagcgagaagcagaaggacgccgtggtgagactgatccacctgagactgaagctgcaggagctgaaggaccccaacgaggacgagcccaacatcagagtgctgctggagcacagattctacaaggagaagagcaagagcgtgaagcagacctgcgacaagtgcaacaccatcatctggggcctgatccagacctggtacacctgcaccggctgctactacagatgccacagcaagtgcctgaacctgatcagcaagccctgcgtgagcagcaaggtgagccaccaggccgagtacgagctgaacatctgccccgagaccggcctggacagccaggactacagatgcgccgagtgcagagcccccatcagcctgagaggcgtgcccagcgaggccagacagtgcgactacaccggccagtactactgcagccactgccactggaacgacctggccgtgatccccgccagagtggtgcacaactgggacttcgagcccagaaaggtgagcagatgcagcatgagatacctggccctgatggtgagcagacccgtgctgagactgagagagatcaaccccctgctgttcagctacgtggaggagctggtggagatcagaaagctgagacaggacatcctgctgatgaagccctacttcatcacctgcagagaggccatggaggccagactgctgctgcagctgcaggacagacagcacttcgtggagaacgacgagatgtacagcgtgcaggacctgctggacgtgcacgccggcagactgggctgcagcctgaccgagatccacaccctgttcgccaagcacatcaagctggactgcgagagatgccaggccaagggcttcgtgtgcgagctgtgcagagagggcgacgtgctgttccccttcgacagccacaccagcgtgtgcgccgactgcagcgccgtgttccacagagactgctactacgacaacagcaccacctgccccaagtgcgccagactgagcctgagaaagcagagcctgttccaggagcccggccccgacgtggaggcctag

SEQ ID NO: 20521 - DNA, 1563 bp, Artificial Sequence
  Description of Artificial Sequence: Synthetic coding sequence
atgagccaggacaacgacaccctgatgagagacatcctgggccacgagctggccgccatgagactgcagaagctggagcagcagagaagactgttcgagaagaagcagagacagaagagacaggagctgctgatggtgcaggccaaccccgacgccagcccctggctgtggagaagctgcctgagagaggagagactgctgggcgacagaggcctgggcaaccccttcctgagaaagaaggtgagcgaggcccacctgcccagcggcatccacagcgccctgggcaccgtgagctgcggcggcgacggcagaggcgagagaggcctgcccacccccagaaccgaggccgtgttcagaaacctgggcctgcagagccccttcctgagctggctgcccgacaacagcgacgccgagctggaggaggtgagcgtggagaacggcagcgtgagccccccccccttcaagcagagccccagaatcagaagaaagggctggcaggcccaccagagacccggcaccagagccgagggcgagagcgacagccaggacatgggcgacgcccacaagagccccaacatgggccccaaccccggcatggacggcgactgcgtgtacgagaacctggccttccagaaggaggaggacctggagaagaagagagaggccagcgagagcaccggcaccaacagcagcgccgcccacaacgaggagctgagcaaggccctgaagggcgagggcggcaccgacagcgaccacatgagacacgaggccagcctggccatcagaagcccctgccccggcctggaggaggacatggaggcctacgtgctgagacccgccctgcccggcaccatgatgcagtgctacctgaccagagacaagcacggcgtggacaagggcctgttccccctgtactacctgtacctggagaccagcgacagcctgcagagattcctgctggccggcagaaagagaagaagaagcaagaccagcaactacctgatcagcctggaccccacccacctgagcagagacggcgacaacttcgtgggcaaggtgagaagcaacgtgttcagcaccaagttcaccatcttcgacaacggcgtgaaccccgacagagagcacctgaccagaaacaccgccagaatcagacaggagctgggcgccgtgtgctacgagcccaacgtgctgggctacctgggccccagaaagatgaccgtgatcctgcccggcaccaacagccagaaccagagaatcaacgtgcagcccctgaacgagcaggagagcctgctgagcagataccagagaggcgacaagcagggcctgctgctgctgcacaacaagacccccagctgggacaaggagaacggcgtgtacaccctgaacttccacggcagagtgaccagagccagcgtgaagaacttccagatcgtggaccccaagcaccaggagcacctggtgctgcagttcggcagagtgggccccgacaccttcaccatggacttctgcttccccttcagccccctgcaggccttcagcatctgcctgagcagcttcaactag

SEQ ID NO: 20522 - DNA, 1422 bp, Artificial Sequence
  Description of Artificial Sequence: Synthetic coding sequence
atgcccaagctgcagggcttcgagttctggagcagaaccctgagaggcgccagacacgtggtggcccccatggtggaccagagcgagctggcctggagactgctgagcagaagacacggcgcccagctgtgctacacccccatgctgcacgcccaggtgttcgtgagagacgccaactacagaaaggagaacctgtactgcgaggtgtgccccgaggacagacccctgatcgtgcagttctgcgccaacgaccccgaggtgttcgtgcaggccgccctgctggcccaggactactgcgacgccatcgacctgaacctgggctgcccccagatgatcgccaagagaggccactacggcgccttcctgcaggacgagtgggacctgctgcagagaatgatcctgctggcccacgagaagctgagcgtgcccgtgacctgcaagatcagagtgttccccgagatcgacaagaccgtgagatacgcccagatgctggagaaggccggctgccagctgctgaccgtgcacggcagaaccaaggagcagaagggccccctgagcggcgccgccagctgggagcacatcaaggccgtgagaaaggccgtggccatccccgtgttcgccaacggcaacatccagtgcctgcaggacgtggagagatgcctgagagacaccggcgtgcagggcgtgatgagcgccgagggcaacctgcacaaccccgccctgttcgagggcagaagccccgccgtgtgggagctggccgaggagtacctggacatcgtgagagagcacccctgccccctgagctacgtgagagcccacctgttcaagctgtggcaccacaccctgcaggtgcaccaggagctgagagaggagctggccaaggtgaagaccctggagggcatcgccgccgtgagccaggagctgaagctgagatgccaggaggagatcagcagacaggagggcgccaagcccaccggcgacctgcccttccactggatctgccagccctacatcagacccggccccagagagggcagcaaggagaaggccggcgccagaagcaagagagccctggaggaggaggagggcggcaccgaggtgctgagcaagaacaagcagaagaagcagctgagaaacccccacaagaccttcgaccccagcctgaagcccaagtacgccaagtgcgaccagtgcggcaaccccaagggcaacagatgcgtgttcagcctgtgcagaggctgctgcaagaagagagccagcaaggagaccgccgactgccccggccacggcctgctgttcaagaccaagctggagaagagcctggcctggaaggaggcccagcccgagctgcaggagccccagcccgccgcccccggcacccccggcggcttcagcgaggtgatgggcagcgccctggcctag

SEQ ID NO: 20523 - DNA, 1422 bp, Artificial Sequence; identical to SEQ ID NO: 20522
  Description of Artificial Sequence: Synthetic coding sequence

SEQ ID NO: 20524 - DNA, 894 bp, Artificial Sequence
  Description of Artificial Sequence: Synthetic coding sequence
cccagcttcgccggccccagagagaccctgcccgtgacctgcaagatcagagtgttccccgagatcgacaagaccgtgagatacgcccagatgctggagaaggccggctgccagctgctgaccgtgcacggcagaaccaaggagcagaagggccccctgagcggcgccgccagctgggagcacatcaaggccgtgagaaaggccgtggccatccccgtgttcgccaacggcaacatccagtgcctgcaggacgtggagagatgcctgagagacaccggcgtgcagggcgtgatgagcgccgagggcaacctgcacaaccccgccctgttcgagggcagaagccccgccgtgtgggagctggccgaggagtacctggacatcgtgagagagcacccctgccccctgagctacgtgagagcccacctgttcaagctgtggcaccacaccctgcaggtgcaccaggagctgagagaggagctggccaaggtgaagaccctggagggcatcgccgccgtgagccaggagctgaagctgagatgccaggagatcagcagacaggagggcgccaagcccaccggcgacctgcccttccactggatctgccagccctacatcagacccggccccagagagggcagcaaggagaaggccggcgccagaagcaagagagccctggaggaggaggagggcggcaccgaggtgctgagcaagaacaagcagaagaagcagctgagaaacccccacaagaccttcgaccccagcctgaagcccaagtacgccaagtgcgaccagtgcggcaaccccaagatgtgcgtgcagcccgtgcccagactgctgcaggaggccagcctgcagagagactgcagactgcccagaagcagaatcgccttctag

SEQ ID NO: 20525 - DNA, 1011 bp, Artificial Sequence
  Description of Artificial Sequence: Synthetic coding sequence
atgatcgccaagagagtgctgctggcccacgagaagctgagcgtgcccgtgacctgcaagatcagagtgttccccgagatcgacaagaccgtgagatacgcccagatgctggagaaggccggctgccagctgctgaccgtgcacggcagaaccaaggagcagaagggccccctgagcggcgccgccagctgggagcacatcaaggccgtgagaaaggccgtggccatccccgtgttcgccaacggcaacatccagtgcctgcaggacgtggagagatgcctgagagacaccggcgtgcagggcgtgatgagcgccgagggcaacctgcacaaccccgccctgttcgagggcagaagccccgccgtgtgggagctggccgaggagtacctggacatcgtgagagcccacctgttcaagctgtggcaccacaccctgcaggtgcaccaggagctgagagaggagctggccaaggtgaagaccctggagggcatcgccgccgtgagccaggagctgaagctgagatgccaggaggagatcagcagacaggagggcgccaagcccaccggcgacctgcccttccactggatctgccagccctacatcagacccggccccagagagggcagcaaggagaaggccggcgccagaagcaagagagccctggaggaggaggagggcggcaccgaggtgctgagcaagaacaagcagaagaagcagctgagaaacccccacaagaccttcgaccccagcctgaagcccaagtacgccaagtgcgaccagtgcggcaaccccaagggcaacagatgcgtgttcagcctgtgcagaggctgctgcaagaagagagccagcaaggagaccgccgactgccccggccacggcctgctgttcaagaccaagctggagaagagcctggcctggaaggaggcccagcccgagctgcaggagccccagcccgccgcccccggcacccccggcggcttcagcgaggtgatgggcagcgccctggcctag

SEQ ID NO: 20526 - DNA, 1953 bp, Artificial Sequence
  Description of Artificial Sequence: Synthetic coding sequence
atggccgagggcaccgccgaggcccccctggagaacggcggcggcggcgacagcggcgccggcgccctggagagaggcgtggcccccatcaagagacagtacctgaccaccaaggagcagttccaccagttcctggaggccaagggccaggagaagacctgcagagagaccgaggtgggcgaccccgccggcaacgagctggccgagcccgaggccaagagaatcagactggaggacggccagaccgccgacggccagaccgaggaggccgccgagcccggcgagcagctgcagacccagaagagagccagaggccagaacaagggcagaccccacgtgaagcccaccaactacgacaagaacagactgtgccccagcctgatccaggagagcgccgccaagtgcttcttcggcgacagatgcagattcctgcacgacgtgggcagatacctggagaccaagcccgccgacctgggccccagatgcgtgctgttcgagaccttcggcagatgcccctacggcgtgacctgcagattcgccggcgcccacctgagacccgagggccagaacctggtgcaggaggagctggccgccagaggcacccagccccccagcatcagaaacggcctggacaaggccctgcagcagcagctgagaaagagagaggtgagattcgagagagccgagcaggccctgagaagattcagccagggccccacccccgccgccgccgtgcccgagggcaccgccgccgagggcgcccccagacaggagaactgcggcgcccagcaggtgcccgccggccccggcaccagcaccccccccagcagccccgtgagaacctgcggccccctgaccgacgaggacgtggtgagactgagaccctgcgagaagaagagactggacatcagaggcaagctgtacctggcccccctgaccacctgcggcaacctgcccttcagaagaatctgcaagagattcggcgccgacgtgacctgcggcgagatggccgtgtgcaccaacctgctgcagggccagatgagcgagtgggccctgctgaagagacaccagtgcgaggacatcttcggcgtgcagctggagggcgccttccccgacaccatgaccaagtgcgccgagctgctgagcagaaccgtggaggtggacttcgtggacatcaacgtgggctgccccatcgacctggtgtacaagaagggcggcggctgcgccctgatgaacagaagcaccaagttccagcagatcgtgagaggcatgaaccaggtgctggacgtgcccctgaccgtgaagatcagaaccggcgtgcaggagagagtgaacctggcccacagactgctgcccgagctgagagactggggcgtggccctggtgaccctgcacggcagaagcagagagcagagatacaccaagctggccgactggcagtacatcgaggagtgcgtgcaggccgccagccccatgcccctgttcggcaacggcgacatcctgagcttcgaggacgccaacagagccatgcagaccggcgtgaccggcatcatgatcgccagaggcgccctgctgaagccctggctgttcaccgagatcaaggagcagagacactgggacatcagcagcagcgagagactggacatcctgagagacttcaccaactacggcctggagcactggggcagcgacacccagggcgtggagaagaccagaagattcctgctggagtggctgagcttcctgtgcagatacgtgcccgtgggcctgctggagagactgccccagagaatcaacgagagacccccctactacctgggcagagactacctggagaccctgatggccagccagaaggccgccgactggatcagaatcagcgagatgctgctgggccccgtgccccccagcttcgccttcctgcccaagcacaaggccaacgcctacaagtag

SEQ ID NO: 20527 - DNA, 1227 bp, Artificial Sequence
  Description of Artificial Sequence: Synthetic coding sequence
atggccgagggcaccgccgaggcccccctggagaacggcggcggcggcgacagcggcgccggcgccctggagagaggcgtggcccccatcaagagacagtacctgaccaccaaggagcagttccaccagttcctggaggccaagggccaggagaagacctgcagagagaccgagctggacatcagaggcaagctgtacctggcccccctgaccacctgcggcaacctgcccttcagaagaatctgcaagagattcggcgccgacgtgacctgcggcgagatggccgtgtgcaccaacctgctgcagggccagatgagcgagtgggccctgctgaagagacaccagtgcgaggacatcttcggcgtgcagctggagggcgccttccccgacaccatgaccaagtgcgccgagctgctgagcagaaccgtggaggtggacttcgtggacatcaacgtgggctgccccatcgacctggtgtacaagaagggcggcggctgcgccctgatgaacagaagcaccaagttccagcagatcgtgagaggcatgaaccaggtgctggacgtgcccctgaccgtgaagatcagaaccggcgtgcaggagagagtgaacctggcccacagactgctgcccgagctgagagactggggcgtggccctggtgaccctgcacggcagaagcagagagcagagatacaccaagctggccgactggcagtacatcgaggagtgcgtgcaggccgccagccccatgcccctgttcggcaacggcgacatcctgagcttcgaggacgccaacagagccatgcagaccggcgtgaccggcatcatgatcgccagaggcgccctgctgaagccctggctgttcaccgagatcaaggagcagagacactgggacatcagcagcagcgagagactggacatcctgagagacttcaccaactacggcctggagcactggggcagcgacacccagggcgtggagaagaccagaagattcctgctggagtggctgagcttcctgtgcagatacgtgcccgtgggcctgctggagagactgccccagagaatcaacgagagacccccctactacctgggcagagactacctggagaccctgatggccagccagaaggccgccgactggatcagaatcagcgagatgctgctgggccccgtgccccccagcttcgccttcctgcccaagcacaaggccaacgcctacaagtag

SEQ ID NO: 20528 - DNA, 954 bp, Artificial Sequence
  Description of Artificial Sequence: Synthetic coding sequence
atgaagagcgactgcatgcagaccaccatctgccaggagagaaagaaggaccccatcgagatgttccacagcggccagctggtgaaggtgtgcgcccccatggtgagatacagcaagctggccttcagaaccctggtgagaaagtacagctgcgacctgtgctacacccccatgatcgtggccgccgacttcgtgaagagcatcaaggccagagacagcgagttcaccaccaaccagggcgactgccccctgatcgtgcagttcgccgccaacgacgccagactgctgagcgacgccgccagaatcgtgtgcccctacgccaacggcatcgacatcaactgcggctgcccccagagatgggccatggccgagggctacggcgcctgcctgatcaacaagcccgagctggtgcaggacatggtgaagcaggtgagaaaccaggtggagacccccggcttcagcgtgagcatcaagatcagaatccacgacgacctgaagagaaccgtggacctgtgccagaaggccgaggccaccggcgtgagctggatcaccgtgcacggcagaaccgccgaggagagacaccagcccgtgcactacgacagcatcaagatcatcaaggagaacatgagcatccccgtgatcgccaacggcgacatcagaagcctgaaggaggccgagaacgtgtggagaatcaccggcaccgacggcgtgatggtggccagaggcctgctggccaaccccgccatgttcgccggctacgaggagacccccctgaagtgcatctgggactgggtggacatcgccctggagctgggcaccccctacatgtgcttccaccagcacctgatgtacatgatggagaagatcaccagcagacaggagaagagagtgttcaacgccctgagcagcaccagcgccatcatcgactacctgaccgaccactacggcatctag

SEQ ID NO: 20529 - DNA, 591 bp, Artificial Sequence
  Description of Artificial Sequence: Synthetic coding sequence
atggccgagggctacggcgcctgcctgatcaacaagcccgagctggtgcaggacatggtgaagcaggtgagaaaccaggtggagacccccggcttcagcgtgagcatcaagatcagaatccacgacgacctgaagagaaccgtggacctgtgccagaaggccgaggccaccggcgtgagctggatcaccgtgcacggcagaaccgccgaggagagacaccagcccgtgcactacgacagcatcaagatcatcaaggagaacatgagcatccccgtgatcgccaacggcgacatcagaagcctgaaggaggccgagaacgtgtggagaatcaccggcaccgacggcgtgatggtggccagaggcctgctggccaaccccgccatgttcgccggctacgaggagacccccctgaagtgcatctgggactgggtggacatcgccctggagctgggcaccccctacatgtgcttccaccagcacctgatgtacatgatggagaagatcaccagcagacaggagaagagagtgttcaacgccctgagcagcaccagcgccatcatcgactacctgaccgaccactacggcatctag

SEQ ID NO: 20530 - DNA, 3669 bp, Artificial Sequence
  Description of Artificial Sequence: Synthetic coding sequence
atgagcgaggcccccagattcttcgtgggccccgaggacaccgagatcaaccccggcaactacagacacttcttccaccacgccgacgaggacgacgaggaggaggacgacagcccccccgagagacagatcgtggtgggcatctgcagcatggccaagaagagcaagagcaagcccatgaaggagatcctggagagaatcagcctgttcaagtacatcaccgtggtggtgttcgaggaggaggtgatcctgaacgagcccgtggagaactggcccctgtgcgactgcctgatcagcttccacagcaagggcttccccctggacaaggccgtggcctacgccaagctgagaaaccccttcgtgatcaacgacctgaacatgcagtacctgatccaggacagaagagaggtgtacagcatcctgcaggccgagggcatcctgctgcccagatacgccatcctgaacagagaccccaacaaccccaaggagtgcaacctgatcgagggcgaggaccacgtggaggtgaacggcgaggtgttccagaagcccttcgtggagaagcccgtgagcgccgaggaccacaacgtgtacatctactaccccaccagcgccggcggcggcagccagagactgttcagaaagatcggcagcagaagcagcgtgtacagccccgagagcaacgtgagaaagaccggcagctacatctacgaggagttcatgcccaccgacggcaccgacgtgaaggtgtacaccgtgggccccgactacgcccacgccgaggccagaaagagccccgccctggacggcaaggtggagagagacagcgagggcaaggaggtgagataccccgtgatcctgaacgccagagagaagctgatcgcctggaaggtgtgcctggccttcaagcagaccgtgtgcggcttcgacctgctgagagccaacggccagagctacgtgtgcgacgtgaacggcttcagcttcgtgaagaacagcatgaagtactacgacgactgcgccaagatcctgggcaacatcgtgatgagagagctggccccccagttccacatcccctggagcatccccctggaggccgaggacatccccatcgtgcccaccaccagcggcaccatgatggagctgagatgcgtgatcgccgtgatcagacacggcgacagaacccccaagcagaagatgaagatggaggtgagacaccagaagttcttcgacctgttcgagaagtgcgacggctacaagagcggcaagctgaagctgaagaagcccaagcagctgcaggaggtgctggacatcgccagacagctgctgatggagctgggccagaacaacgacagcgagatcgaggagaacaagcccaagctggagcagctgaagaccgtgctggagatgtacggccacttcagcggcatcaacagaaaggtgcagctgacctacctgccccacggctgccccaagaccagcagcgaggaggaggacagcagaagagaggagcccagcctgctgctggtgctgaagtggggcggcgagctgacccccgccggcagagtgcaggccgaggagctgggcagagccttcagatgcatgtaccccggcggccagggcgactacgccggcttccccggctgcggcctgctgagactgcacagcacctacagacacgacctgaagatctacgccagcgacgagggcagagtgcagatgaccgccgccgccttcgccaagggcctgctggccctggagggcgagctgacccccatcctggtgcagatggtgaagagcgccaacatgaacggcctgctggacagcgacagcgacagcctgagcagctgccagcagagagtgaaggccagactgcacgagatcctgcagaaggacagagacttcaccgccgaggactacgagaagctgacccccagcggcagcatcagcctgatcaagagcatgcacctgatcaagaaccccgtgaagacctgcgacaaggtgtacagcctgatccagagcctgaccagccagatcagacacagaatggaggaccccaagagcagcgacatccagctgtaccacagcgagaccctggagctgatgctgagaagatggagcaagctggagaaggacttcaagaccaagaacggcagatacgacatcagcaagatccccgacatctacgactgcatcaagtacgacgtgcagcacaacggcagcctgaagctggagaacaccatggagctgtacagactgagcaaggccctggccgacatcgtgatcccccaggagtacggcatcaccaaggccgagaagctggagatcgccaagggctactgcacccccctggtgagaaagatcagaagcgacctgcagagaacccaggacgacgacaccgtgaacaagctgcaccccgtgtacagcagaggcgtgctgagccccgagagacacgtgagaaccagactgtacttcaccagcgagagccacgtgcacagcctgctgagcatcctgagatacggcgccctgtgcaacgagagcaaggacgagcagtggaagagagccatggactacctgaacgtggtgaacgagctgaactacatgacccagatcgtgatcatgctgtacgaggaccccaacaaggacctgagcagcgaggagagattccacgtggagctgcacttcagccccggcgccaagggctgcgaggaggacaagaacctgcccagcggctacggctacagacccgccagcagagagaacgagggcagaagacccttcaagatcgacaacgacgacgagccccacaccagcaagagagacgaggtggacagagccgtgatcctgttcaagcccatggtgagcgagcccatccacatccacagaaagagccccctgcccagaagcagaaagaccgccaccaacgacgaggagagccccctgagcgtgagcagccccgagggcaccggcacctggctgcactacaccagcggcgtgggcaccggcagaagaagaagaagaagcggcgagcagatcaccagcagccccgtgagccccaagagcctggccttcaccagcagcatcttcggcagctggcagcaggtggtgagcgagaacgccaactacctgagaacccccagaaccctggtggagcagaagcagaaccccaccgtgggcagccactgcgccggcctgttcagcaccagcgtgctgggcggcagcagcagcgcccccaacctgcaggactacgccagaacccacagaaagaagctgaccagcagcggctgcatcgacggcttcgagctgtacagcatggtgcccagcatctgccccctggagaccctgcacaacgccctgagcctgaagcaggtggacgagttcctggccagcatcgccagccccagcagcgacgtgcccagaaagaccgccgagatcagcagcaccgccctgagaagcagccccatcatgagaaagaaggtgagcctgaacacctacacccccgccaagatcctgcccaccccccccgccaccctgaagagcaccaaggccagcagcaagcccgccaccagcggccccagcagcgccgtggtgcccaacaccagcagcagaaagaagaacatcaccagcaagaccgagacccacgagcacaagaagaacaccggcaagaagaagtag

SEQ ID NO: 20531 - DNA, 2970 bp, Artificial Sequence
  Description of Artificial Sequence: Synthetic coding sequence
atgaagggcctgggcgacagcagacccagacacctgagcgacagcctggaccccccccacgagcccctgttcgccggcaccgacagaaacccctacctgctgagccccaccgaggccttcgccagagaggccagattccccggccagaacaccctgcccggcgacggcctgttccccctgaacaaccagctgcccccccccagcagcaccttccccagaatccactacaacagccacttcgaggtgcccgaggagagccccttccccagccacgcccaggccaccaagatcaacagactgcccgccaacctgctggaccagttcgagaagcagctgcccatccacagagacggcttcagcaccctgcagttccccagaggcgaggccaaggccagaggcgagagccccggcagaatcagacacctggtgcacagcgtgcagagactgttcttcaccaaggcccccagcctggagggcaccgccggcaaggtgggcggcaacggcagcaagaagggcggcatggaggacggcaagggcagaagagccaagagcaaggagagagccaaggccggcgagcccaagagaagaagcagaagcaacatcagcggctggtggagcagcgacgacaacctggacggcgaggccggcgccttcagaagcagcggccccgccagcggcctgatgaccctgggcagacaggccgagagaagccagcccagatacttcatgcacgcctacaacaccatcagcggccacatgctgaagaccaccaagaacaacaccaccgagctgaccgcccccccccccccccccgccccccccgccacctgccccagcctgggcgtgggcaccgacaccaactacgtgaagagaggcagctggagcaccctgaccctgagccacgcccacgaggtgtgccagaagaccagcgccaccctggacaagagcctgctgaagagcaagagctgccaccagggcctggcctaccactacctgcaggtgcccggcggcggcggcgagtggagcaccaccctgctgagccccagagagaccgacgccgccgccgagggccccatcccctgcagaagaatgagaagcggcagctacatcaaggccatgggcgacgaggacagcgacgagagcggcggcagccccaagcccagccccaagaccgccgccagaagacagagctacctgagagccacccagcagagcctgggcgagcagagcaaccccagaagaagcctggacagactggacagcgtggacatgctgctgcccagcaagtgccccagctgggaggaggactacacccccgtgagcgacagcctgaacgacagcagctgcatcagccagatcttcggccaggccagcctgatcccccagctgttcggccacgagcagcaggtgagagaggccgagctgagcgaccagtacgaggccgcctgcgagagcgcctgcagcgaggccgagagcaccgccgccgagaccctggacctgcccctgcccagctacttcagaagcagaagccacagctacctgagagccatccaggccggctgcagccaggaggaggacagcgtgagcctgcagagcctgagccccccccccagcaccggcagcctgagcaacagcagaaccctgcccagcagcagctgcctggtggcctacaagaagacccccccccccgtgccccccagaaccaccagcaagcccttcatcagcgtgaccgtgcagagcagcaccgagagcgcccaggacacctacctggacagccaggaccacaagagcgaggtgaccagccagagcggcctgagcaacagcagcgacagcctggacagcagcaccagaccccccagcgtgaccagaggcggcgtggcccccgcccccgaggcccccgagcccccccccaagcacgccgccctgaagagcgagcagggcaccctgaccagcagcgagagccaccccgaggccgcccccaagagaaagctgagcagcatcggcatccaggagagaaccagaagaaacggcagccacctgagcgaggacaacggccccaaggccatcgacgtgatggcccccagcagcgagagcagcgtgcccagccacagcatgagcagcagaagagacaccgacagcgacacccaggacgccaacgacagcagctgcaagagcagcgagagaagcctgcccgactgcaccccccaccccaacagcatcagcatcgacgccggccccagacaggcccccaagatcgcccagatcaagagaaacctgagctacggcgacaacagcgaccccgccctggaggccagcagcctgcccccccccgacccctggctggagaccagcagcagcagccccgccgagcccgcccagcccggcgcctgcagaagagacggctactggttcctgaagctgctgcaggccgagaccgagagactggagggctggtgctgccagatggacaaggagaccaaggagaacaacctgagcgaggaggtgctgggcaaggtgctgagcgccgtgggcagcgcccagctgctgatgagccagaagttccagcagttcagaggcctgtgcgagcagaacctgaaccccgacgccaaccccagacccaccgcccaggacctggccggcttctgggacctgctgcagctgagcatcgaggacatcagcatgaagttcgacgagctgtaccacctgaaggccaacagctggcagctggtggagacccccgagaagagaaaggaggagaagaagccccccccccccgtgcccaagaagcccgccaagagcaagcccgccgtgagcagagacaaggccagcgacgccagcgacaagcagagacaggaggccagaaagagactgctggccgccaagagagccgccagcgtgagacagaacagcgccaccgagagcgccgacagcatcgagatctacgtgcccgaggcccagaccagactgtag

SEQ ID NO: 20532 - DNA, 2979 bp, Artificial Sequence
  Description of Artificial Sequence: Synthetic coding sequence
atgaagggcctgggcgacagcagacccagacacctgagcgacagcctggaccccccccacgagcccctgttcgccggcaccgacagaaacccctacctgctgagccccaccgaggccttcgccagagaggccagattccccggccagaacaccctgcccggcgacggcctgttccccctgaacaaccagctgcccccccccagcagcaccttccccagaatccactacaacagccacttcgaggtgcccgaggagagccccttccccagccacgcccaggccaccaagatcaacagactgcccgccaacctgctggaccagttcgagaagcagctgcccatccacagagacggcttcagcaccctgcagttccccagaggcgaggccaaggccagaggcgagagccccggcagaatcagacacctggtgcacagcgtgcagagactgttcttcaccaaggcccccagcctggagggcaccgccggcaaggtgggcggcaacggcagcaagaagggcggcatggaggacggcaagggcagaagagccaagagcaaggagagagccaaggccggcgagcccaagagaagaagcagaagcaacatcagcggctggtggagcagcgacgacaacctggacggcgaggccggcgccttcagaagcagcggccccgccagcggcctgatgaccctgggcagacaggccgagagaagccagcccagatacttcatgcacgcctacaacaccatcagcggccacatgctgaagaccaccaagaacaacaccaccgagctgaccgcccccccccccccccccgccccccccgccacctgccccagcctgggcgtgggcaccgacaccaactacgtgaagagaggcagctggagcaccctgaccctgagccacgcccacgaggtgtgccagaagaccagcgccaccctggacaagagcctgctgaagagcaagagctgccaccagggcctggcctaccactacctgcaggtgcccggcggcggcggcgagtggagcaccaccctgctgagccccagagagaccgacgccgccgccgagggccccatcccctgcagaagaatgagaagcggcagctacatcaaggccatgggcgacgaggacagcgacgagagcggcggcagccccaagcccagccccaagaccgccgccagaagacagagctacctgagagccacccagcagagcctgggcgagcagagcaaccccagaagaagcctggacagactggacagcgtggacatgctgctgcccagcaagtgccccagctgggaggaggactacacccccgtgagcgacagcctgaacgacagcagctgcatcagccagatcttcggccaggccagcctgatcccccagctgttcggccacgagcagcaggtgagagaggccgagctgagcgaccagtacgaggccgcctgcgagagcgcctgcagcgaggccgagagcaccgccgccgagaccctggacctgcccctgcccagctacttcagaagcagaagccacagctacctgagagccatccaggccggctgcagccaggaggaggacagcgtgagcctgcagagcctgagccccccccccagcaccggcagcctgagcaacagcagaaccctgcccagcagcagctgcctggtggcctacaagaagacccccccccccgtgccccccagaaccaccagcaagcccttcatcagcgtgaccgtgcagagcagcaccgagagcgcccaggacacctacctggacagccaggaccacaagagcgaggtgaccagccagagcggcctgagcaacagcagcgacagcctggacagcagcaccagaccccccagcgtgaccagaggcggcgtggcccccgcccccgaggcccccgagcccccccccaagcacgccgccctgaagagcgagcagggcaccctgaccagcagcgagagccaccccgaggccgcccccaagagaaagctgagcagcatcggcatccaggtggactgcatccagcccgtgcccaaggaggagcccagccccgccaccaagttccagagcatcggcgtgcaggtggaggacgactggagaagcagcgtgcccagccacagcatgagcagcagaagagacaccgacagcgacacccaggacgccaacgacagcagctgcaagagcagcgagagaagcctgcccgactgcaccccccaccccaacagcatcagcatcgacgccggccccagacaggcccccaagatcgcccagatcaagagaaacctgagctacggcgacaacagcgaccccgccctggaggccagcagcctgcccccccccgacccctggctggagaccagcagcagcagccccgccgagcccgcccagcccggcgcctgcagaagagacggctactggttcctgaagctgctgcaggccgagaccgagagactggagggctggtgctgccagatggacaaggagaccaaggagaacaacctgagcgaggaggtgctgggcaaggtgctgagcgccgtgggcagcgcccagctgctgatgagccagaagttccagcagttcagaggcctgtgcgagcagaacctgaaccccgacgccaaccccagacccaccgcccaggacctggccggcttctgggacctgctgcagctgagcatcgaggacatcagcatgaagttcgacgagctgtaccacctgaaggccaacagctggcagctggtggagacccccgagaagagaaaggaggagaagaagccccccccccccgtgcccaagaagcccgccaagagcaagcccgccgtgagcagagacaaggccagcgacgccagcgacaagcagagacaggaggccagaaagagactgctggccgccaagagagccgccagcgtgagacagaacagcgccaccgagagcgccgacagcatcgagatctacgtgcccgaggcccagaccagactgtag

SEQ ID NO: 20533 - DNA, 2979 bp, Artificial Sequence; identical to SEQ ID NO: 20532
  Description of Artificial Sequence: Synthetic coding sequence

SEQ ID NO: 20534 - DNA, 1362 bp, Artificial Sequence
  Description of Artificial Sequence: Synthetic coding sequence
atggccctgtgcctggagctgctgaagcagtgcagcagctgcctggtggcctacaagaagacccccccccccgtgccccccagaaccaccagcaagcccttcatcagcgtgaccgtgcagagcagcaccgagagcgcccaggacacctacctggacagccaggaccacaagagcgaggtgaccagccagagcggcctgagcaacagcagcgacagcctggacagcagcaccagaccccccagcgtgaccagaggcggcgtggcccccgcccccgaggcccccgagcccccccccaagcacgccgccctgaagagcgagcagggcaccctgaccagcagcgagagccaccccgaggccgcccccaagagaaagctgagcagcatcggcatccaggtggactgcatccagcccgtgcccaaggaggagcccagccccgccaccaagttccagagcatcggcgtgcaggtggaggacgactggagaagcagcgtgcccagccacagcatgagcagcagaagagacaccgacagcgacacccaggacgccaacgacagcagctgcaagagcagcgagagaagcctgcccgactgcaccccccaccccaacagcatcagcatcgacgccggccccagacaggcccccaagatcgcccagatcaagagaaacctgagctacggcgacaacagcgaccccgccctggaggccagcagcctgcccccccccgacccctggctggagaccagcagcagcagccccgccgagcccgcccagcccggcgcctgcagaagagacggctactggttcctgaagctgctgcaggccgagaccgagagactggagggctggtgctgccagatggacaaggagaccaaggagaacaacctgagcgaggaggtgctgggcaaggtgctgagcgccgtgggcagcgcccagctgctgatgagccagaagttccagcagttcagaggcctgtgcgagcagaacctgaaccccgacgccaaccccagacccaccgcccaggacctggccggcttctgggacctgctgcagctgagcatcgaggacatcagcatgaagttcgacgagctgtaccacctgaaggccaacagctggcagctggtggagacccccgagaagagaaaggaggagaagaagccccccccccccgtgcccaagaagcccgccaagagcaagcccgccgtgagcagagacaaggccagcgacgccagcgacaagcagagacaggaggccagaaagagactgctggccgccaagagagccgccagcgtgagacagaacagcgccaccgagagcgccgacagcatcgagatctacgtgcccgaggcccagaccagactgtag

SEQ ID NO: 20535 - DNA, 2979 bp, Artificial Sequence; identical to SEQ ID NO: 20532
  Description of Artificial Sequence: Synthetic coding sequence

SEQ ID NO: 20536 - DNA, 2970 bp, Artificial Sequence; identical to SEQ ID NO: 20531
  Description of Artificial Sequence: Synthetic coding sequence

SEQ ID NO: 20537 - DNA, 2970 bp, Artificial Sequence; identical to SEQ ID NO: 20531
  Description of Artificial Sequence: Synthetic coding sequence

SEQ ID NO: 20538 - DNA, 576 bp, Artificial Sequence
  Description of Artificial Sequence: Synthetic coding sequence
atgcccggcagcgaggacctgagaaagggcaaggaccagatgcacagccacagaaagagaaccatgttcaccaagaagcagctggaggacctgaacatcctgttcaacgagaacccctaccccaaccccagcctgcagaaggagatggccagcaagatcgacatccaccccaccgtgctgcaggtgtggttcaagaaccacagagccaagctgaagaaggccaagtgcaagcacatccaccagaagcaggagaccccccagccccccatccccgagggcggcgtgagcaccagcgtgggcctgagaaacgccgacaccctgcccagactgcccaacgccgcccaccccatcggcctggtgtacaccggccacagagtgcccagcttccagctgatcctgtaccccaacctgaaggtgcccgccaacgacttcatcggccacagaatcgtgcacttcggctgctgcagagaccccaacatctactgcctgtaccccatcctggagagccaggtgtgcgcccccagcttccacagcggcagccccgcctgcagcagcaaccagagcagagagagatag

SEQ ID NO: 20539 - DNA, 2052 bp, Artificial Sequence
  Description of Artificial Sequence: Synthetic coding sequence
atgctggcctgcctgaccagaggcaacctgctggacgtgctgcaggagggcttcaacgagcagcagctgcaggcctacgtggcctgggtgaacgcccagctgaagaagagacccgccgtgaagcccgtgcaggacctgagacaggacctgagagacggcgtgatcctggcctacctgatcgagatcgtggccggcgagaagctgagcggcgtgcagctgagccccggcaaccagcaggagatgaagaacaacgtggagaaggtgctgcagttcgtggccagcaagaagatcagaatgcaccagaccagcgccaaggacatcgtggacggcaacctgaagagcatcatgagactggtgctggccctggccgcccacttcaagcccggcagcagcagaaccgtgaaccagggcagagacagcagagcccccctgcagagccacagaccccactgcgccaccgccgtggcccagggcgccgccgccgccctggccgacgtgtgccacgacatgagcagaagcggcagagacgtgttcagatacagacagagaaacagcagcatggacgaggagatcgagaacccctactggagcgtgagagccctggtgcagcagtacgagggccagcagagaagccccagcgagagcagctgcagcagcctgaccagccccagccccatccacagcgccaagagcgagagcatcatcacccagagcgaggagaaggccgacttcgtgatcatccccgccgagggcatcgagaacagaaccgagggcaccgacagccccctgagcagagactggagacccggcagccccggcacctacctggagaccagctgggaggagcagctgctggagcagcaggagtacctggagaaggagatggaggaggccaagaagatgatcagcggcctgcaggccctgctgctgaacggcagcctgcccgaggacgagcaggagagacccctggccctgtgcgagcccggcgtgaaccccgaggagcagctgatcatcatccagagcagactggaccagagcatggaggagaaccaggacctgaagaaggagctgctgaagtgcaagcaggaggccagaaacctgcagggcatcaaggacgccctgcagcagagactgacccagcaggacaccagcgtgctgcagctgaagcaggagctgctgagagccaacatggacaaggacgagctgcacaaccagaacgtggacctgcagagaaagctggacgagagaaacagactgctgggcgagtacaagaaggagctgggccagaaggacagactgctgcagcagcaccaggccaagctggaggaggccctgagaaagctgagcgacgtgagctaccaccaggtggacctggagagagagctggagcacaaggacgtgctgctggcccactgcatgaagagagaggccgacgaggccaccaactacaacagccacaacagccagagcaacggcttcctgctgcccaccgccggcaagggcgccaccagcgtgagcaacagaggcaccagcgacctgcagctggtgagagacgccctgagaagcctgagaaacagcttcagcggccacgacccccagcaccacaccatcgacagcctggagcagggcatcagcagcctgatggagagactgcacgtgatggagacccagaagaagcaggagagaaaggtgagagtgaagagccccagaacccaggtgggcagcgagtacagagagagctggccccccaacagcaagctgccccacagccagagcagccccaccgtgagcagcacctgcaccaaggtgctgtacttcaccgacagaagcctgacccccttcatggtgaacatccccaagagactggaggaggtgaccctgaaggacttcaaggccgccatcgacagagagggcaaccacagataccacttcaaggccctggaccccgagttcggcaccgtgaaggaggagatcttccacgacgacgacgccatccccggctgggagggcaagatcgtggcctgggtggaggaggaccacggcgagaactag

SEQ ID NO: 20540 - DNA, 384 bp, Artificial Sequence
  Description of Artificial Sequence: Synthetic coding sequence
atggccgccccccccaaggcccccatcagagtgagaaacctgaccatcagagccggcgccctgaccggcaaggagaacaacatgctgcagcccgagacccacatcttcaccgcccccgaggaggtgcccaaggtgagcgaccaggccctggtgagcgcccacagcgagtggcagagaaagctggaggccgccgaggccctgctgaccctgagaaacagcgcccaggccccccccgacagcatcagcctgcaccagccctgcaacccccccgcccccgccggcgacaagggcttccagccccccagccccagcctgagacccagacccgccagcagcatcagcctgcccatcggccacctgggctgcatcagcctgctgagctag

SEQ ID NO: 20541 - DNA, 579 bp, Artificial Sequence
  Description of Artificial Sequence: Synthetic coding sequence
atggccgccccccccaaggcccccatcagagtgagaaacctgaccatcagagccggcgccctgaccggcaaggagaacaacatgctgcagcccgagacccacatcttcaccgcccccgaggagggcagcagccagggcgccctgctgctgggccaggcccccgagcccctgagcctgccctgcacccccgtgaccctggagcagcagctggtgagccccagcggcgacccccacagagcccccgccctgcccagcatctgcagcaccctgatcctgcagccctgcgccaccctggaccccctgctgctgcagccccaggtgcccaaggtgagcgaccaggccctggtgagcgcccacagcgagtggcagagaaagctggaggccgccgaggccctgctgaccctgagaaacagcgcccaggccccccccgacagcatcagcctgcaccagccctgcaacccccccgcccccgccggcgacaagggcttccagccccccagccccagcctgagacccagacccgccagcagcatcagcctgcccatcggccacctgggctgcatcagcctgctgagctag

SEQ ID NO: 20542 - DNA, 384 bp, Artificial Sequence; identical to SEQ ID NO: 20540
  Description of Artificial Sequence: Synthetic coding sequence

SEQ ID NO: 20543 - DNA, 579 bp, Artificial Sequence; identical to SEQ ID NO: 20541
  Description of Artificial Sequence: Synthetic coding sequence

SEQ ID NO: 20544 - DNA, 579 bp, Artificial Sequence; identical to SEQ ID NO: 20541
  Description of Artificial Sequence: Synthetic coding sequence

SEQ ID NO: 20545 - DNA, 384 bp, Artificial Sequence; identical to SEQ ID NO: 20540
  Description of Artificial Sequence: Synthetic coding sequence

SEQ ID NO: 20546 - DNA, 195 bp, Artificial Sequence
  Description of Artificial Sequence: Synthetic coding sequence
atggccgccccccccaaggcccccatcagagtgagaaacctgaccatcagagccggcgccctgaccggcaaggagaacaacatgctgcagcccgagacccacatcttcaccgcccccgaggagggcagcagccagggcgccctgctgctgggccaggcccccgagcccctgagcctgccctgcacccccgtgtag

SEQ ID NO: 20547 - DNA, 306 bp, Artificial Sequence
  Description of Artificial Sequence: Synthetic coding sequence
atggccgccccccccaaggcccccatcagagtgagaaacctgaccatcagagccggcgccctgaccggcaaggagaacaacatgctgcagcccgagacccacatcttcaccgcccccgaggagggcagcagccagggcgccctgctgctgggccaggcccccgagcccctgagcctgccctgcacccccgtgaccctggagcagcagctggtgagccccagcggcgacccccacagagcccccgccctgcccagcatctgcagcaccctgatcctgcagccctgcgccaccctggaccccctgtag

SEQ ID NO: 20548 - DNA, 579 bp, Artificial Sequence; identical to SEQ ID NO: 20541
  Description of Artificial Sequence: Synthetic coding sequence

SEQ ID NO: 20549 - DNA, 1191 bp, Artificial Sequence
  Description of Artificial Sequence: Synthetic coding sequence
atgctgatcaccgtgtactgcgtgagaagagacctgagcgaggtgaccttcagcctgcaggtgagccccgacttcgagctgagaaacttcaaggtgctgtgcgaggccgagagcagagtgcccgtggaggagatccagatcatccacatggagagactgctgatcgaggaccactgcagcctgggcagctacggcctgaaggacggcgacatcgtggtgctgctgcagaaggacaacgtgggccccagagcccccggcagagcccccaaccagcccagagtggacttcagcggcatcgccgtgcccggcaccagcagcagcagaccccagcaccccggccagcagcagcagagaacccccgccgcccagagaagccagggcctggccagcggcgagaaggtggccggcctgcagggcctgggcagccccgccctgatcagaagcatgctgctgagcaacccccacgacctgagcctgctgaaggagagaaacccccccctggccgaggccctgctgagcggcagcctggagaccttcagccaggtgctgatggagcagcagagagagaaggccctgagagagcaggagagactgagactgtacaccgccgaccccctggacagagaggcccaggccaagatcgaggaggagatcagacagcagaacatcgaggagaacatgaacatcgccatcgaggaggcccccgagagcttcggccaggtgaccatgctgtacatcaactgcaaggtgaacggccaccccctgaaggccttcgtggacagcggcgcccagatgaccatcatgagccaggcctgcgccgagagatgcaacatcatgagactggtggacagaagatgggccggcgtggccaagggcgtgggcacccagagaatcatcggcagagtgcacctggcccagatccagatcgagggcgacttcctgcagtgcagcttcagcatcctggaggaccagcccatggacatgctgctgggcctggacatgctgagaagacaccagtgcagcatcgacctgaagaagaacgtgctggtgatcggcaccaccggcacccagacctacttcctgcccgagggcgagctgcccctgtgcagcagaatggtgagcggccaggacgagagcagcgacaaggagatcacccacagcgtgatggacagcggcagaaaggagcactag

SEQ ID NO: 20550 - DNA, 1200 bp, Artificial Sequence
  Description of Artificial Sequence: Synthetic coding sequence
atgctgctgaccgtgtactgcgtgagaagagacctgagcgaggtgaccttcagcctgcaggtggacgccgacttcgagctgcacaacttcagagccctgtgcgagctggagagcggcatccccgccgccgagagccagatcgtgtacgccgagagacccctgaccgacaaccacagaagcctggccagctacggcctgaaggacggcgacgtggtgatcctgagacagaaggagaacgccgaccccagaccccccgtgcagttccccaacctgcccagaatcgacttcagcagcatcgccgtgcccggcaccagcagccccagacagagacagccccccggcacccagcagagccacagcagccccggcgagatcaccagcagcccccagggcctggacaaccccgccctgctgagagacatgctgctggccaacccccacgagctgagcctgctgaaggagagaaacccccccctggccgaggccctgctgagcggcgacctggagaagttcagcagagtgctggtggagcagcagcaggacagagccagaagagagcaggagagaatcagactgttcagcgccgaccccttcgacctggaggcccaggccaagatcgaggaggacatcagacagcagaacatcgaggagaacatgaccatcgccatggaggaggcccccgagagcttcggccaggtggtgatgctgtacatcaactgcaaggtgaacggccaccccgtgaaggccttcgtggacagcggcgcccagatgaccatcatgagccaggcctgcgccgagagatgcaacatcatgagactggtggacagaagatgggccggcatcgccaagggcgtgggcacccagaagatcatcggcagagtgcacctggcccaggtgcagatcgagggcgacttcctgccctgcagcttcagcatcctggaggagcagcccatggacatgctgctgggcctggacatgctgaagagacaccagtgcagcatcgacctgaagaagaacgtgctggtgatcggcaccaccggcagccagaccaccttcctgcccgagggcgagctgcccgagtgcgccagactggcctacggcgccggcagagaggacgtgagacccgaggagatcgccgaccaggagctggccgaggccctgcagaagagcgccgaggacgccgagagacagaagccctag

SEQ ID NO: 20551 - DNA, 1167 bp, Artificial Sequence
  Description of Artificial Sequence: Synthetic coding sequence
atgaacaccatgtacgtgatgatggcccagatcctgagaagccacctgatcaaggccaccgtgatccccaacagagtgaagatgctgccctacttcggcatcatcagaaacagaatgatgagcacccacaagagcaagaagaagatcagagagtactacagactgctgaacgtggaggagggctgcagcgccgacgaggtgagagagagcttccacaagctggccaagcagtaccaccccgacagcggcagcaacaccgccgacagcgccaccttcatcagaatcgagaaggcctacagaaaggtgctgagccacgtgatcgagcagaccaacgccagccagagcaagggcgaggaggaggaggacgtggagaagttcaagtacaagaccccccagcacagacactacctgagcttcgagggcatcggcttcggcacccccacccagagagagaagcactacagacagttcagagccgacagagccgccgagcaggtgatggagtaccagaagcagaagctgcagagccagtacttccccgacagcgtgatcgtgaagaacatcagacagagcaagcagcagaagatcacccaggccatcgagagactggtggaggacctgatccaggagagcatggccaagggcgacttcgacaacctgagcggcaagggcaagcccctgaagaagttcagcgactgcagctacatcgaccccatgacccacaacctgaacagaatcctgatcgacaacggctaccagcccgagtggatcctgaagcagaaggagatcagcgacaccatcgagcagctgagagaggccatcctggtgagcagaaagaagctgggcaaccccatgacccccaccgagaagaagcagtggaaccacgtgtgcgagcagttccaggagaacatcagaaagctgaacaagagaatcaacgacttcaacctgatcgtgcccatcctgaccagacagaaggtgcacttcgacgcccagaaggagatcgtgagagcccagaagatctacgagaccctgatcaagaccaaggaggtgaccgacagaaaccccaacaacctggaccagggcgagggcgagaagacccccgagatcaagaagggcttcctgaactggatgaacctgtggaagttcatcaagatcagaagcttctag

SEQ ID NO: 20552 - DNA, 1167 bp, Artificial Sequence; identical to SEQ ID NO: 20551
  Description of Artificial Sequence: Synthetic coding sequence

SEQ ID NO: 20553 - DNA, 1194 bp, Artificial Sequence
  Description of Artificial Sequence: Synthetic coding sequence
atggtgaaggagaccacctactacgacgtgctgggcgtgaagcccaacgccacccaggaggagctgaagaaggcctacagaaagctggccctgaagtaccaccccgacaagaaccccaacgagggcgagaagttcaagcagatcagccaggcctacgaggtgctgagcgacgccaagaagagagagctgtacgacaagggcggcgagcaggccatcaaggagggcggcgccggcggcggcttcggcagccccatggacatcttcgacatgttcttcggcggcggcggcagaatgcagagagagagaagaggcaagaacgtggtgcaccagctgagcgtgaccctggaggacctgtacaacggcgccaccagaaagctggccctgcagaagaacgtgatctgcgacaagtgcgagggcagaggcggcaagaagggcgccgtggagtgctgccccaactgcagaggcaccggcatgcagatcagaatccaccagatcggccccggcatggtgcagcagatccagagcgtgtgcatggagtgccagggccacggcgagagaatcagccccaaggacagatgcaagagctgcaacggcagaaagatcgtgagagagaagaagatcctggaggtgcacatcgacaagggcatgaaggacggccagaagatcaccttccacggcgagggcgaccaggagcccggcctggagcccggcgacatcatcatcgtgctggaccagaaggaccacgccgtgttcaccagaagaggcgaggacctgttcatgtgcatggacatccagctggtggaggccctgtgcggcttccagaagcccatcagcaccctggacaacagaaccatcgtgatcaccagccaccccggccagatcgtgaagcacggcgacatcaagtgcgtgctgaacgagggcatgcccatctacagaagaccctacgagaagggcagactgatcatcgagttcaaggtgaacttccccgagaacggcttcctgagccccgacaagctgagcctgctggagaagctgctgcccgagagaaaggaggtggaggagaccgacgagatggaccaggtggagctggtggacttcgaccccaaccaggagagaagaagacactacaacggcgaggcctacgaggacgacgagcaccaccccagaggcggcgtgcagtgccagaccagctag

SEQ ID NO: 20554 - DNA, 774 bp, Artificial Sequence
  Description of Artificial Sequence: Synthetic coding sequence
atgcagatcagaatccaccagatcggccccggcatggtgcagcagatccagagcgtgtgcatggagtgccagggccacggcgagagaatcagccccaaggacagatgcaagagctgcaacggcagaaagatcgtgagagagaagaagatcctggaggtgcacatcgacaagggcatgaaggacggccagaagatcaccttccacggcgagggcgaccaggagcccggcctggagcccggcgacatcatcatcgtgctggaccagaaggaccacgccgtgttcaccagaagaggcgaggacctgttcatgtgcatggacatccagctggtggaggccctgtgcggcttccagaagcccatcagcaccctggacaacagaaccatcgtgatcaccagccaccccggccagatcgtgaagcacggcgacatcaagtgcgtgctgaacgagggcatgcccatctacagaagaccctacgagaagggcagactgatcatcgagttcaaggtgaacttccccgagaacggcttcctgagccccgacaagctgagcctgctggagaagctgctgcccgagagaaaggaggtggaggagaccgacgagatggaccaggtggagctggtggacttcgaccccaaccaggagagaagaagacactacaacggcgaggcctacgaggacgacgagcaccaccccagaggcggcgtgcagtgccagaccagcaacggccccgtgaacaacacccactgctggcacctgatgtgcagcagcgagtag

SEQ ID NO: 20555 - DNA, 723 bp, Artificial Sequence
  Description of Artificial Sequence: Synthetic coding sequence
atgcagatcagaatccaccagatcggccccggcatggtgcagcagatccagagcgtgtgcatggagtgccagggccacggcgagagaatcagccccaaggacagatgcaagagctgcaacggcagaaagatcgtgagagagaagaagatcctggaggtgcacatcgacaagggcatgaaggacggccagaagatcaccttccacggcgagggcgaccaggagcccggcctggagcccggcgacatcatcatcgtgctggaccagaaggaccacgccgtgttcaccagaagaggcgaggacctgttcatgtgcatggacatccagctggtggaggccctgtgcggcttccagaagcccatcagcaccctggacaacagaaccatcgtgatcaccagccaccccggccagatcgtgaagcacggcgacatcaagtgcgtgctgaacgagggcatgcccatctacagaagaccctacgagaagggcagactgatcatcgagttcaaggtgaacttccccgagaacggcttcctgagccccgacaagctgagcctgctggagaagctgctgcccgagagaaaggaggtggaggagaccgacgagatggaccaggtggagctggtggacttcgaccccaaccaggagagaagaagacactacaacggcgaggcctacgaggacgacgagcaccaccccagaggcggcgtgcagtgccagaccagctag

SEQ ID NO: 20556 - DNA, 1194 bp, Artificial Sequence
  Description of Artificial Sequence: Synthetic coding sequence
atggtgaaggagacccagtactacgacatcctgggcgtgaagcccagcgccagccccgaggagatcaagaaggcctacagaaagctggccctgaagtaccaccccgacaagaaccccgacgagggcgagaagttcaagctgatcagccaggcctacgaggtgctgagcgaccccaagaagagagacgtgtacgaccagggcggcgagcaggccatcaaggagggcggcagcggcagccccagcttcagcagccccatggacatcttcgacatgttcttcggcggcggcggcagaatggccagagagagaagaggcaagaacgtggtgcaccagctgagcgtgaccctggaggacctgtacaacggcgtgaccaagaagctggccctgcagaagaacgtgatctgcgagaagtgcgagggcgtgggcggcaagaagggcagcgtggagaagtgccccctgtgcaagggcagaggcatgcagatccacatccagcagatcggccccggcatggtgcagcagatccagaccgtgtgcatcgagtgcaagggccagggcgagagaatcaaccccaaggacagatgcgagagctgcagcggcgccaaggtgatcagagagaagaagatcatcgaggtgcacgtggagaagggcatgaaggacggccagaagatcctgttccacggcgagggcgaccaggagcccgagctggagcccggcgacgtgatcatcgtgctggaccagaaggaccacagcgtgttccagagaagaggccacgacctgatcatgaagatgaagatccagctgagcgaggccctgtgcggcttcaagaagaccatcaagaccctggacaacagaatcctggtgatcaccagcaaggccggcgaggtgatcaagcacggcgacctgagatgcgtgagagacgagggcatgcccatctacaaggcccccctggagaagggcatcctgatcatccagttcctggtgatcttccccgagaagcactggctgagcctggagaagctgccccagctggaggccctgctgccccccagacagaaggtgagaatcaccgacgacatggaccaggtggagctgaaggagttctgccccaacgagcagaactggagacagcacagagaggcctacgaggaggacgaggacggcccccaggccggcgtgcagtgccagaccgcctag

SEQ ID NO: 20557 - DNA, 1194 bp, Artificial Sequence; identical to SEQ ID NO: 20556
  Description of Artificial Sequence: Synthetic coding sequence

SEQ ID NO: 20558 - DNA, 1281 bp, Artificial Sequence
  Description of Artificial Sequence: Synthetic coding sequence
atggccagaggcggcagccagagctggagcagcggcgagagcgacggccagcccaaggagcagacccccgagaagcccagacacaagatggtgaaggagacccagtactacgacatcctgggcgtgaagcccagcgccagccccgaggagatcaagaaggcctacagaaagctggccctgaagtaccaccccgacaagaaccccgacgagggcgagaagttcaagctgatcagccaggcctacgaggtgctgagcgaccccaagaagagagacgtgtacgaccagggcggcgagcaggccatcaaggagggcggcagcggcagccccagcttcagcagccccatggacatcttcgacatgttcttcggcggcggcggcagaatggccagagagagaagaggcaagaacgtggtgcaccagctgagcgtgaccctggaggacctgtacaacggcgtgaccaagaagctggccctgcagaagaacgtgatctgcgagaagtgcgagggcgtgggcggcaagaagggcagcgtggagaagtgccccctgtgcaagggcagaggcatgcagatccacatccagcagatcggccccggcatggtgcagcagatccagaccgtgtgcatcgagtgcaagggccagggcgagagaatcaaccccaaggacagatgcgagagctgcagcggcgccaaggtgatcagagagaagaagatcatcgaggtgcacgtggagaagggcatgaaggacggccagaagatcctgttccacggcgagggcgaccaggagcccgagctggagcccggcgacgtgatcatcgtgctggaccagaaggaccacagcgtgttccagagaagaggccacgacctgatcatgaagatgaagatccagctgagcgaggccctgtgcggcttcaagaagaccatcaagaccctggacaacagaatcctggtgatcaccagcaaggccggcgaggtgatcaagcacggcgacctgagatgcgtgagagacgagggcatgcccatctacaaggcccccctggagaagggcatcctgatcatccagttcctggtgatcttccccgagaagcactggctgagcctggagaagctgccccagctggaggccctgctgccccccagacagaaggtgagaatcaccgacgacatggaccaggtggagctgaaggagttctgccccaacgagcagaactggagacagcacagagaggcctacgaggaggacgaggacggcccccaggccggcgtgcagtgccagaccgcctag

SEQ ID NO: 20559 - DNA, 1113 bp, Artificial Sequence
  Description of Artificial Sequence: Synthetic coding sequence
atgtgggagagcctgaccctggacagcggccagatcagcgccctgaccagattcaagctgatcagccaggcctacgaggtgctgagcgaccccaagaagagagacgtgtacgaccagggcggcgagcaggccatcaaggagggcggcagcggcagccccagcttcagcagccccatggacatcttcgacatgttcttcggcggcggcggcagaatggccagagagagaagaggcaagaacgtggtgcaccagctgagcgtgaccctggaggacctgtacaacggcgtgaccaagaagctggccctgcagaagaacgtgatctgcgagaagtgcgagggcgtgggcggcaagaagggcagcgtggagaagtgccccctgtgcaagggcagaggcatgcagatccacatccagcagatcggccccggcatggtgcagcagatccagaccgtgtgcatcgagtgcaagggccagggcgagagaatcaaccccaaggacagatgcgagagctgcagcggcgccaaggtgatcagagagaagaagatcatcgaggtgcacgtggagaagggcatgaaggacggccagaagatcctgttccacggcgagggcgaccaggagcccgagctggagcccggcgacgtgatcatcgtgctggaccagaaggaccacagcgtgttccagagaagaggccacgacctgatcatgaagatgaagatccagctgagcgaggccctgtgcggcttcaagaagaccatcaagaccctggacaacagaatcctggtgatcaccagcaaggccggcgaggtgatcaagcacggcgacctgagatgcgtgagagacgagggcatgcccatctacaaggcccccctggagaagggcatcctgatcatccagttcctggtgatcttccccgagaagcactggctgagcctggagaagctgccccagctggaggccctgctgccccccagacagaaggtgagaatcaccgacgacatggaccaggtggagctgaaggagttctgccccaacgagcagaactggagacagcacagagaggcctacgaggaggacgaggacggcccccaggccggcgtgcagtgccagaccgcctag

SEQ ID NO: 20560 - DNA, 951 bp, Artificial Sequence
  Description of Artificial Sequence: Synthetic coding sequence
atgggccaggactactacagcgtgctgggcatcaccagaaacagcgaggacgcccagatcaagcaggcctacagaagactggccctgaagcaccaccccctgaagagcaacgagcccagcagcgccgagatcttcagacagatcgccgaggcctacgacgtgctgagcgaccccatgaagagaggcatctacgacaagttcggcgaggagggcctgaagggcggcatccccctggagttcggcagccagaccccctggaccaccggctacgtgttccacggcaagcccgagaaggtgttccacgagttcttcggcggcaacaaccccttcagcgagttcttcgacgccgagggcagcgaggtggacctgaacttcggcggcctgcagggcagaggcgtgaagaagcaggacccccaggtggagagagacctgtacctgagcctggaggacctgttcttcggctgcaccaagaagatcaagatcagcagaagagtgctgaacgaggacggctacagcagcaccatcaaggacaagatcctgaccatcgacgtgaagcccggctggagacagggcaccagaatcaccttcgagaaggagggcgaccagggccccaacatcatccccgccgacatcatcttcatcgtgaaggagaagctgcaccccagattcagaagagagaacgacaacctgttcttcgtgaaccccatccccctgggcaaggccctgacctgctgcaccgtggaggtgagaaccctggacgacagactgctgaacatccccatcaacgacatcatccaccccaagtacttcaagaaggtgcccggcgagggcatgcccctgcccgaggaccccaccaagaagggcgacctgttcatcttcttcgacatccagttccccaccagactgaccccccagaagaagcagatgctgagacaggccctgctgacctag

SEQ ID NO: 20561 - DNA, 426 bp, Artificial Sequence
  Description of Artificial Sequence: Synthetic coding sequence
atggagaccagcagaggcagaaacctggccaaggtgaccagacccaccagcccctgccacctgctggccagccccgcccagggccccaacatcatccccgccgacatcatcttcatcgtgaaggagaagctgcaccccagattcagaagagagaacgacaacctgttcttcgtgaaccccatccccctgggcaaggccctgacctgctgcaccgtggaggtgagaaccctggacgacagactgctgaacatccccatcaacgacatcatccaccccaagtacttcaagaaggtgcccggcgagggcatgcccctgcccgaggaccccaccaagaagggcgacctgttcatcttcttcgacatccagttccccaccagactgaccccccagaagaagcagatgctgagacaggccctgctgacctag

SEQ ID NO: 20562 - DNA, 426 bp, Artificial Sequence; identical to SEQ ID NO: 20561
  Description of Artificial Sequence: Synthetic coding sequence

SEQ ID NO: 20563 - DNA, 930 bp, Artificial Sequence
  Description of Artificial Sequence: Synthetic coding sequence
atggtggactactacgaggtgctgggcctgcagagatacgccagccccgaggacatcaagaaggcctaccacaaggtggccctgaagtggcaccccgacaagaaccccgagaacaaggaggaggccgagagaaagttcaaggaggtggccgaggcctacgaggtgctgagcaacgacgagaagagagacatctacgacaagtacggcaccgagggcctgaacggcggcggcagccacttcgacgacgagtgcgagtacggcttcaccttccacaagcccgacgacgtgttcaaggagatcttccacgagagagaccccttcagcttccacttcttcgaggacagcctggaggacctgctgaacagacccggcagcagctacggcaacagaaacagagacgccggctacttcttcagcaccgccagcgagtaccccatcttcgagaagttcagcagctacgacaccggctacaccagccagggcagcctgggccacgagggcctgaccagcttcagcagcctggccttcgacaacagcggcatggacaactacatcagcgtgaccaccagcgacaagatcgtgaacggcagaaacatcaacaccaagaagatcatcgagagcgaccaggagagagaggccgaggacaacggcgagctgaccttcttcctggtgaacagcgtggccaacgaggagggcttcgccaaggagtgcagctggagaacccagagcttcaacaactacagccccaacagccacagcagcaagcacgtgagccagtacaccttcgtggacaacgacgagggcggcatcagctgggtgaccagcaacagagacccccccatcttcagcgccggcgtgaaggagggcggcaagagaaagaagaagaagagaaaggaggtgcagaagaagagcaccaagagaaactgctag

SEQ ID NO: 20564 - DNA, 699 bp, Artificial Sequence
  Description of Artificial Sequence: Synthetic coding sequence
atggccaactactacgaggtgctgggcgtgcaggccagcgccagccccgaggacatcaagaaggcctacagaaagctggccctgagatggcaccccgacaagaaccccgacaacaaggaggaggccgagaagaagttcaagctggtgagcgaggcctacgaggtgctgagcgacagcaagaagagaagcctgtacgacagagccggctgcgacagctggagagccggcggcggcgccagcaccccctaccacagccccttcgacaccggctacaccttcagaaaccccgaggacatcttcagagagttcttcggcggcctggaccccttcagcttcgagttctgggacagccccttcaacagcgacagaggcggcagaggccacggcctgagaggcgccttcagcgccggcttcggcgagttccccgccttcatggaggccttcagcagcttcaacatgctgggctgcagcggcggcagccacaccaccttcagcagcaccagcttcggcggcagcagcagcggcagcagcggcttcaagagcgtgatgagcagcaccgagatgatcaacggccacaaggtgaccaccaagagaatcgtggagaacggccaggagagagtggaggtggaggaggacggccagctgaagagcgtgaccgtgaacggcaaggagcagctgaagtggatggacagcaagtag

SEQ ID NO: 20565 - DNA, 699 bp, Artificial Sequence; identical to SEQ ID NO: 20564
  Description of Artificial Sequence: Synthetic coding sequence

SEQ ID NO: 20566 - DNA, 1107 bp, Artificial Sequence
  Description of Artificial Sequence: Synthetic coding sequence
atgcagcccggcagcagcagatgcgaggaggagacccccagcctgctgtggggcctggaccccgtgttcctggccttcgccaagctgtacatcagagacatcctggacatgaaggagagcagacaggtgcccggcgtgttcctgtacaacggccaccccatcaagcaggtggacgtgctgggcaccgtgatcggcgtgagagagagagacgccttctacagctacggcgtggacgacagcaccggcgtgatcaactgcatctgctggaagaagctgaacaccgagagcgtgagcgccgcccccagcgccgccagagagctgagcctgaccagccagctgaagaagctgcaggagaccatcgagcagaagaccaagatcgagatcggcgacaccatcagagtgagaggcagcatcagaacctacagagaggagagagagatccacgccaccacctactacaaggtggacgaccccgtgtggaacatccagatcgccagaatgctggagctgcccaccatctacagaaaggtgtacgaccagcccttccacagcagcgccctggagaaggaggaggccctgagcaaccccggcgccctggacctgcccagcctgaccagcctgctgagcgagaaggccaaggagttcctgatggagaacagagtgcagagcttctaccagcaggagctggagatggtggagagcctgctgagcctggccaaccagcccgtgatccacagcgccagcagcgaccaggtgaacttcaagaaggacaccaccagcaaggccatccacagcatcttcaagaacgccatccagctgctgcaggagaagggcctggtgttccagaaggacgacggcttcgacaacctgtactacgtgaccagagaggacaaggacctgcacagaaagatccacagaatcatccagcaggactgccagaagcccaaccacatggagaagggctgccacttcctgcacatcctggcctgcgccagactgagcatcagacccggcctgagcgaggccgtgctgcagcaggtgctggagctgctggaggaccagagcgacatcgtgagcaccatggagcactactacaccgccttctag

SEQ ID NO: 20567 - DNA, 324 bp, Artificial Sequence
  Description of Artificial Sequence: Synthetic coding sequence
atggacgccatcctgaactacagaagcgaggacaccgaggactactacaccctgctgggctgcgacgagctgagcagcgtggagcagatcctggccgagttcaaggtgagagccctggagtgccaccccgacaagcaccccgagaaccccaaggccgtggagaccttccagaagctgcagaaggccaaggagatcctgaccaacgaggagagcagagccagatacgaccactggagaagaagccagatgagcatgcccttccagcagtgggaggccctgaacgacagcgtgaagaccgtgggcttcagcctgggcgccacctag

SEQ ID NO: 20568 - DNA, 1407 bp, Artificial Sequence
  Description of Artificial Sequence: Synthetic coding sequence
atgggcttcctgggcaccggcacctggatcctggtgctggtgctgcccatccaggccttccccaagcccggcggcagccaggacaagagcctgcacaacagagagctgagcgccgagagacccctgaacgagcagatcgccgaggccgaggaggacaagatcaagaagacctacccccccgagaacaagcccggccagagcaactacagcttcgtggacaacctgaacctgctgaaggccatcaccgagaaggagaagatcgagaaggagagacagagcatcagaagcagccccctggacaacaagctgaacgtggaggacgtggacagcaccaagaacagaaagctgatcgacgactacgacagcaccaagagcggcctggaccacaagttccaggacgaccccgacggcctgcaccagctggacggcacccccctgaccgccgaggacatcgtgcacaagatcgccgccagaatctacgaggagaacgacagagccgtgttcgacaagatcgtgagcaagctgctgaacctgggcctgatcaccgagagccaggcccacaccctggaggacgaggtggccgaggtgctgcagaagctgatcagcaaggaggccaacaactacgaggaggaccccaacaagcccaccagctggaccgagaaccaggccggcaagatccccgagaaggtgacccccatggccgccatccaggacggcctggccaagggcgagaacgacgagaccgtgagcaacaccctgaccctgaccaacggcctggagagaagaaccaagacctacagcgaggacaacttcgaggagctgcagtacttccccaacttctacgccctgctgaagagcatcgacagcgagaaggaggccaaggagaaggagaccctgatcaccatcatgaagaccctgatcgacttcgtgaagatgatggtgaagtacggcaccatcagccccgaggagggcgtgagctacctggagaacctggacgagatgatcgccctgcagaccaagaacaagctggagaagaacgccaccgacaacatcagcaagctgttccccgcccccagcgagaagagccacgaggagaccgacagcaccaaggaggaggccgccaagatggagaaggagtacggcagcctgaaggacagcaccaaggacgacaacagcaaccccggcggcaagaccgacgagcccaagggcaagaccgaggcctacctggaggccatcagaaagaacatcgagtggctgaagaagcacgacaagaagggcaacaaggaggactacgacctgagcaagatgagagacttcatcaacaagcaggccgacgcctacgtggagaagggcatcctggacaaggaggaggccgaggccatcaagagaatctacagcagcctgtag

SEQ ID NO: 20569 - DNA, 450 bp, Artificial Sequence
  Description of Artificial Sequence: Synthetic coding sequence
atgatggccgtggagcagatgcccaagaaggactggtacagcatcctgggcgccgaccccagcgccaacatcagcgacctgaagcagaagtaccagaagctgatcctgatgtaccaccccgacaagcagagcaccgacgtgcccgccggcaccgtggaggagtgcgtgcagaagttcatcgagatcgaccaggcctggaagatcctgggcaacgaggagaccaagagagagtacgacctgcagagatgcgaggacgacctgagaaacgtgggccccgtggacgcccaggtgtacctggaggagatgagctggaacgagggcgaccacagcttctacctgagctgcagatgcggcggcaagtacagcgtgagcaaggacgaggccgaggaggtgagcctgatcagctgcgacacctgcagcctgatcatcgagctgctgcactacaactag

SEQ ID NO: 20570 - DNA, 255 bp, Artificial Sequence
  Description of Artificial Sequence: Synthetic coding sequence
atggccgtggagcagatgcccaagaaggactggtacagcatcctgggcgccgaccccagcgccaacatcagcgacctgaagcagaagtaccagaagctgatcctgatgtaccaccccgacaagcagagcaccgacgtgcccgccggcaccgtggaggagtgcgtgcagaagttcatcgagatcgaccaggcctggaagatcctgggcaacgaggagaccaagagagagtacgacctgcagagatgcggcagctag

SEQ ID NO: 20571 - DNA, 1167 bp, Artificial Sequence; identical to SEQ ID NO: 20551
  Description of Artificial Sequence: Synthetic coding sequence

SEQ ID NO: 20572 - DNA, 1167 bp, Artificial Sequence; identical to SEQ ID NO: 20551
  Description of Artificial Sequence: Synthetic coding sequence

SEQ ID NO: 20573 - DNA, 1167 bp, Artificial Sequence; identical to SEQ ID NO: 20551
  Description of Artificial Sequence: Synthetic coding sequence

SEQ ID NO: 20574 - DNA, 462 bp, Artificial Sequence
  Description of Artificial Sequence: Synthetic coding sequence
atgggcgcccccctgctgagccccggctggggcgccggcgccgccggcagaagatggtggatgctgctggcccccctgctgcccgccctgctgctggtgagacccgccggcgccctggtggagggcctgtactgcggcaccagagactgctacgaggtgctgggcgtgagcagaagcgccggcaaggccgagatcgccagagcctacagacagctggccagaagataccaccccgacagatacagaccccagcccggcgacgagggccccggcagaaccccccagagcgccgaggaggccttcctgctggtggccaccgcctacgagaccctgaaggtgagccaggccgccgccgagctgcagcagtactgcatgcagaacgcctgcaaggacgccctgctggtgggcgtgcccgccggcagcaaccccttcagagagcccagaagctgcgccctgctgtag

SEQ ID NO: 20575 - DNA, 996 bp, Artificial Sequence
  Description of Artificial Sequence: Synthetic coding sequence
atggccagcaacttcaacgacatcgtgaagcagggctacgtgaagatcagaagcagaaagctgggcatcttcagaagatgctggctggtgttcaagaaggccagcagcaagggccccagaagactggagaagttccccgacgagaaggccgcctacttcagaaacttccacaaggtgaccgagctgcacaacatcaagaacatcaccagactgcccagagagaccaagaagcacgccgtggccatcatcttccacgacgagaccagcaagaccttcgcctgcgagagcgagctggaggccgaggagtggtgcaagcacctgtgcatggagtgcctgggcaccagactgaacgacatcagcctgggcgagcccgacctgctggccgccggcgtgcagagagagcagaacgagagattcaacgtgtacctgatgcccacccccaacctggacatctacggcgagtgcaccatgcagatcacccacgagaacatctacctgtgggacatccacaacgccaaggtgaagctggtgatgtggcccctgagcagcctgagaagatacggcagagacagcacctggttcaccttcgagagcggcagaatgtgcgacaccggcgagggcctgttcaccttccagaccagagagggcgagatgatctaccagaaggtgcacagcgccaccctggccatcgccgagcagcacgagagactgatgctggagatggagcagaaggccagactgcagaccagcctgaccgagcccatgaccctgagcaagagcatcagcctgcccagaagcgcctactggcaccacatcaccagacagaacagcgtgggcgagatctacagcctgcagggccacggcttcggcagcagcaagatgagcagagcccagaccttccccagctacgcccccgagcagagcgaggaggcccagcagcccctgagcagaagcagcagctacggcttcagctacagcagcagcctgatccagtag

SEQ ID NO: 20576 - DNA, 615 bp, Artificial Sequence
  Description of Artificial Sequence: Synthetic coding sequence
atggccgaggacacctacagccacaagatggtgaagaccaaccacagaagatgcagaaccaagttcaccgaggagcagctgaagatcctgatcaacaccttcaaccagaagccctaccccggctacgccaccaagcagaagctggccctggagatcaacaccgaggagagcagaatccagatctggttccagaacagaagagccagacacggcttccagaagagacccgaggccgagaccctggagagcagccagagccagggccaggaccagcccggcgtggagttccagagcagagaggccagaagatgcagaaccacctacagcgccagccagctgcacaccctgatcaaggccttcatgaagaacccctaccccggcatcgacagcagagaggagctggccaaggagatcggcgtgcccgagagcagagtgcagatctggttccagaacagaagaagcagactgctgctgcagagaaagagagagcccgtggccagcctggagcaggaggagcagggcaagatccccgagggcctgcagggcgccgaggacacccagaacggcaccaacttcaccagcgacagccacttcagcggcgccagaacctggtag

SEQ ID NO: 20577 - DNA, 2259 bp, Artificial Sequence
  Description of Artificial Sequence: Synthetic coding sequence
atgaccgccggcagcgtgtgcgtgccccagatcatccccctgagagtgccccagcccggcaaggccaaccacgagatcgacaacaacaccctgctggagatgaagagcgacacccccgacgtgaacatctactacaccctggacggcagcaagcccgagttcctgaagagaatcggctacggcgagaacaacaccttcaagtacatcaagcccatcaccctgcccgacggcaagatccaggtgaaggccatcgccgtgagcaaggactgcagacagagcggcatcgtgaccaaggtgttccacgtggactacgagccccccaacatcgtgagccccgaggacaacgtggagaacgtgctgaaggacagcagcagacaggagttcaagaacggcttcgtgggcagcaagctgaagaagaagtacaagaacagcgagaaccagagaagctggaacgtgaacctgagaaagttccccgagagccccctggagatccccgcctacggcggcggcagcggcagcagaccccccaccagacagagccagagccccggcttcgcccacgtgagcggccagaagtgcctgaccagcaccgagatcatgagaatccagagagagaccgacttcctgaagtgcgcccactgcctggcccccagacccagcgaccccttcgccagattctgccaggagtgcggcagccccgtgccccccatcttcggctgcagactgcccccccccgagggcgcccagatgggcctgtgcgccgagtgcagaagcctggtgcccatgaacacccccatctgcgtggtgtgcgaggcccccctggccctgcagctgcagccccaggccagcctgcacctgaaggagaaggtgatctgcagagcctgcggcaccggcaaccccgcccacctgagatactgcgtgacctgcgagggcgccctgcccagcagccaggagagcatgtgcagcggcgacaaggccccccccccccccacccagaagggcggcaccatcagctgctacagatgcggcagatggaacctgtgggaggccagcttctgcggctggtgcggcgccatgctgggcatccccgccggctgcagcgtgtgccccaagtgcggcgccagcaaccacctgagcgccagattctgcggcagctgcggcatctgcgtgaagagcctggtgaagctgagcctggacagaagcctggccctggccgccgaggagcccagacccttcagcgagagcctgaacatccccctgcccagaagcgacgtgggcaccaagagagacatcggcacccagaccgtgggcctgttctaccccagcggcaagctgctggccaagaaggagcaggagctggccagccagaagcagagacaggagaagatgagcgaccacaagcccctgctgaccgccatcagccccggcagaggctactggagaagacagctggaccacatcagcgcccacctgagatgctacgcccagaacaaccccgagttcagagccctgatcgccgagcccagaatgggcaagctgatcagcgccaccgtgcacgaggacggctgcgaggtgagcatcagactgaactacagccaggtgagcaacaagaacctgtacctgaacaaggccgtgaacttcagcgaccacctgctgagcagcgccgccgagggcgacggcggcctgtgcggcagcagaagcagctgggtgagcgactacagccagagcaccagcgacaccatcgagaagatcaagagaatcaagaacttcaagaccaagaccttccaggagaagaaggagcagctgatccccgagaacagactgctgctgaaggaggtgggccccaccggcgagggcagagtgagcgtgatcgagcagctgctggacgagggcgccgaccccaactgctgcgacgaggacaacagacccgtgatcaccgtggccgtgatgaacaagcaccacgaggccatccccgtgctggtgcagagaggcgccgacatcgaccagcagtggggccccctgagaaacaccgccctgcacgaggccaccctgctgggcctggccggcagagagagcaccgccaccctgctgggctgcaacgccagcatccagaagaagaacgccggcggccagaccgcctacgacctggccctgaacaccggcgacgacctggtgaccagcctgttcgccgccaagttcggccagggcctggaggaccagctggcccagaccagaagcctgagcctggacgactgctag

SEQ ID NO: 20578 - DNA, 2193 bp, Artificial Sequence
  Description of Artificial Sequence: Synthetic coding sequence
atgaccgccggcagcgtgtgcgtgccccagatcatccccctgagagtgccccagcccggcaaggccaaccacgagatcgacaacaacaccctgctggagatgaagagcgacacccccgacgtgaacatctactacaccctggacggcagcaagcccgagttcctgaagagaatcggctacggcgagaacaacaccttcaagtacatcaagcccatcaccctgcccgacggcaagatccaggtgaaggccatcgccgtgagcaaggactgcagacagagcggcatcgtgaccaaggtgttccacgtggactacgagccccccaacatcgtgagccccgaggacaacgtggagaacgtgctgaaggacagcagcagacaggccagagagttcaagaacggcttcgtgggcagcaagctgaagaagaagtacaagaacagcgagaaccagagaagctggaacgtgaacctgagaaagttccccgagagccccctggagatccccgcctacggcggcggcagcggcagcagaccccccaccagacagagccagagccccggcttcgcccacgtgagcggccagaagtgcctgaccagcaccgagatcatgagaatccagagagagaccgacttcctgaagtgcgcccactgcctggcccccagacccagcgaccccttcgccagattctgccaggagtgcggcagccccgtgccccccatcttcggctgcagactgcccccccccgagggcgcccagatgggcctgtgcgccgagtgcagaagcctggtgcccatgaacacccccatctgcgtggtgtgcgaggcccccctggccctgcagctgcagccccaggccagcctgcacctgaaggagaaggtgatctgcagagcctgcggcaccggcaaccccgcccacctgagatactgcgtgacctgcgagggcgccctgcccagcagccaggagagcatgtgcagcggcgacaaggccccccccccccccacccagaagggcggcaccatcagctgctacagatgcggcagatggaacctgtgggaggccagcttctgcggctggtgcggcgccatgctgggcatccccgccggctgcagcgtgtgccccaagtgcggcgccagcaaccacctgagcgccagattctgcggcagctgcggcatctgcgtgaagagcctggtgaagctgagcctggacagaagcctggccctggccgccgaggagcccagacccttcagcgagagcctgaacatccccctgcccagaagcgacgtgggcaccaagagagacatcggcacccagaccgtgggcctgttctaccccagcggcaagctgctggccaagaaggagcaggagctggccagccagaagcagagacaggagaagatgagcgaccacaagcccctgctgaccgccatcagccccggcagaggctactggagaagacagctggaccacatcagcgcccacctgagatgctacgcccagaacaaccccgagttcagagccctgatcgccgagcccagaatgggcaagctgatcagcgccaccgtgcacgaggacggctgcgaggtgagcatcagactgaactacagccaggtgagcaacaaggtgagaaagctgagactgagagaggtgaagcagcccgccagcagcaagggcaccaagctggccggcagacccctgatcaagaacttcaagaccaagaccttccaggagaagaaggagcagctgatccccgagaacagactgctgctgaaggaggtgggccccaccggcgagggcagagtgagcgtgatcgagcagctgctggacgagggcgccgaccccaactgctgcgacgaggacaacagacccgtgatcaccgtggccgtgatgaacaagcaccacgaggccatccccgtgctggtgcagagaggcgccgacatcgaccagcagtggggccccctgagaaacaccgccctgcacgaggccaccctgctgggcctggccggcagagagagcaccgccaccctgctgggctgcaacgccagcatccagaagaagaacgccggcggccagaccgcctacgacctggccctgaacaccggcgacgacctggtgaccagcctgttcgccgccaagttcggccagggcctggaggaccagctggcccagaccagaagcctgagcctggacgactgctag

SEQ ID NO: 20579 - DNA, 1917 bp, Artificial Sequence
  Description of Artificial Sequence: Synthetic coding sequence
atgctgaccctggagagcttccagagagtgcactggaagagccagctgatggtggaggaccaggtgctggaccacccccccgccagccccagacaggacaccgtgcccttcaccttcaagagcttcctgttcggccacagcatggagatcagaccctggaagagaaagggcagaaccctgttcagaagactgctgttccagagccccggcttcgcccacgtgagcggccagaagtgcctgaccagcaccgagatcatgagaatccagagagagaccgacttcctgaagtgcgcccactgcctggcccccagacccagcgaccccttcgccagattctgccaggagtgcggcagccccgtgccccccatcttcggctgcagactgcccccccccgagggcgcccagatgggcctgtgcgccgagtgcagaagcctggtgcccatgaacacccccatctgcgtggtgtgcgaggcccccctggccctgcagctgcagccccaggccagcctgcacctgaaggagaaggtgatctgcagagcctgcggcaccggcaaccccgcccacctgagatactgcgtgacctgcgagggcgccctgcccagcagccaggagagcatgtgcagcggcgacaaggccccccccccccccacccagaagggcggcaccatcagctgctacagatgcggcagatggaacctgtgggaggccagcttctgcggctggtgcggcgccatgctgggcatccccgccggctgcagcgtgtgccccaagtgcggcgccagcaaccacctgagcgccagattctgcggcagctgcggcatctgcgtgaagagcctggtgaagctgagcctggacagaagcctggccctggccgccgaggagcccagacccttcagcgagagcctgaacatccccctgcccagaagcgacgtgggcaccaagagagacatcggcacccagaccgtgggcctgttctaccccagcggcaagctgctggccaagaaggagcaggagctggccagccagaagcagagacaggagaagatgagcgaccacaagcccctgctgaccgccatcagccccggcagaggctactggagaagacagctggaccacatcagcgcccacctgagatgctacgcccagaacaaccccgagttcagagccctgatcgccgagcccagaatgggcaagctgatcagcgccaccgtgcacgaggacggctgcgaggtgagcatcagactgaactacagccaggtgagcaacaagaacctgtacctgaacaaggccgtgaacttcagcgaccacctgctgagcagcgccgccgagggcgacggcggcctgtgcggcagcagaagcagctgggtgagcgactacagccagagcaccagcgacaccatcgagaagatcaagagaatcaagaacttcaagaccaagaccttccaggagaagaaggagcagctgatccccgagaacagactgctgctgaaggaggtgggccccaccggcgagggcagagtgagcgtgatcgagcagctgctggacgagggcgccgaccccaactgctgcgacgaggacaacagacccgtgatcaccgtggccgtgatgaacaagcaccacgaggccatccccgtgctggtgcagagaggcgccgacatcgaccagcagtggggccccctgagaaacaccgccctgcacgaggccaccctgctgggcctggccggcagagagagcaccgccaccctgctgggctgcaacgccagcatccagaagaagaacgccggcggccagaccgcctacgacctggccctgaacaccggcgacgacctggtgaccagcctgttcgccgccaagttcggccagggcctggaggaccagctggcccagaccagaagcctgagcctggacgactgctag

SEQ ID NO: 20580 - DNA, 1656 bp, Artificial Sequence
  Description of Artificial Sequence: Synthetic coding sequence
tgacagagagagaccgacttcctgaagtgcgcccactgcctggcccccagacccagcgaccccttcgccagattctgccaggagtgcggcagccccgtgccccccatcttcggctgcagactgcccccccccgagggcgcccagatgggcctgtgcgccgagtgcagaagcctggtgcccatgaacacccccatctgcgtggtgtgcgaggcccccctggccctgcagctgcagccccaggccagcctgcacctgaaggagaaggtgatctgcagagcctgcggcaccggcaaccccgcccacctgagatactgcgtgacctgcgagggcgccctgcccagcagccaggagagcatgtgcagcggcgacaaggccccccccccccccacccagaagggcggcaccatcagctgctacagatgcggcagatggaacctgtgggaggccagcttctgcggctggtgcggcgccatgctgggcatccccgccggctgcagcgtgtgccccaagtgcggcgccagcaaccacctgagcgccagattctgcggcagctgcggcatctgcgtgaagagcctggtgaagctgagcctggacagaagcctggccctggccgccgaggagcccagacccttcagcgagagcctgaacatccccctgcccagaagcgacgtgggcaccaagagagacatcggcacccagaccgtgggcctgttctaccccagcggcaagctgctggccaagaaggagcaggagctggccagccagaagcagagacaggagaagatgagcgaccacaagcccctgctgaccgccatcagccccggcagaggctactggagaagacagctggaccacatcagcgcccacctgagatgctacgcccagaacaaccccgagttcagagccctgatcgccgagcccagaatgggcaagctgatcagcgccaccgtgcacgaggacggctgcgaggtgagcatcagactgaactacagccaggtgagcaacaagaacctgtacctgaacaaggccgtgaacttcagcgaccacctgctgagcagcgccgccgagggcgacggcggcctgtgcggcagcagaagcagctgggtgagcgactacagccagagcaccagcgacaccatcgagaagatcaagagaatcaagaacttcaagaccaagaccttccaggagaagaaggagcagctgatccccgagaacagactgctgctgaaggaggtgggccccaccggcgagggcagagtgagcgtgatcgagcagctgctggacgagggcgccgaccccaactgctgcgacgaggacaacagacccgtgatcaccgtggccgtgatgaacaagcaccacgaggccatccccgtgctggtgcagagaggcgccgacatcgaccagcagtggggccccctgagaaacaccgccctgcacgaggccaccctgctgggcctggccggcagagagagcaccgccaccctgctgggctgcaacgccagcatccagaagaagaacgccggcggccagaccgcctacgacctggccctgaacaccggcgacgacctggtgaccagcctgttcgccgccaagttcggccagggcctggaggaccagctggcccagaccagaagcctgagcctggacgactgctag

SEQ ID NO: 20581 - DNA, 1758 bp, Artificial Sequence
  Description of Artificial Sequence: Synthetic coding sequence
atgctgaccctggagagcttccagagccccggcttcgcccacgtgagcggccagaagtgcctgaccagcaccgagatcatgagaatccagagagagaccgacttcctgaagtgcgcccactgcctggcccccagacccagcgaccccttcgccagattctgccaggagtgcggcagccccgtgccccccatcttcggctgcagactgcccccccccgagggcgcccagatgggcctgtgcgccgagtgcagaagcctggtgcccatgaacacccccatctgcgtggtgtgcgaggcccccctggccctgcagctgcagccccaggccagcctgcacctgaaggagaaggtgatctgcagagcctgcggcaccggcaaccccgcccacctgagatactgcgtgacctgcgagggcgccctgcccagcagccaggagagcatgtgcagcggcgacaaggccccccccccccccacccagaagggcggcaccatcagctgctacagatgcggcagatggaacctgtgggaggccagcttctgcggctggtgcggcgccatgctgggcatccccgccggctgcagcgtgtgccccaagtgcggcgccagcaaccacctgagcgccagattctgcggcagctgcggcatctgcgtgaagagcctggtgaagctgagcctggacagaagcctggccctggccgccgaggagcccagacccttcagcgagcccagatgcgcctggcagagcctgaacatccccctgcccagaagcgacgtgggcaccaagagagacatcggcacccagaccgtgggcctgttctaccccagcggcaagctgctggccaagaaggagcaggagctggccagccagaagcagagacaggagaagatgagcgaccacaagcccctgctgaccgccatcagccccggcagaggctactggagaagacagctggaccacatcagcgcccacctgagatgctacgcccagaacaaccccgagttcagagccctgatcgccgagcccagaatgggcaagctgatcagcgccaccgtgcacgaggacggctgcgaggtgagcatcagactgaactacagccaggtgagcaacaagaacctgtacctgaacaaggccgtgaacttcagcgaccacctgctgagcagcgccgccgagggcgacggcggcctgtgcggcagcagaagcagctgggtgagcgactacagccagagcaccagcgacaccatcgagaagatcaagagaatcaagaacttcaagaccaagaccttccaggagaagaaggagcagctgatccccgagaacagactgctgctgaaggaggtgggccccaccggcgagggcagagtgagcgtgatcgagcagctgctggacgagggcgccgaccccaactgctgcgacgaggacaacagacccgtgatcaccgtggccgtgatgaacaagcaccacgaggccatccccgtgctggtgcagagaggcgccgacatcgaccagcagtggggccccctgagaaacaccgccctgcacgaggccaccctgctgggcctggccggcagagagagcaccgccaccctgctgggctgcaacgccagcatccagaagaagaacgccggcggccagaccgcctacgacctggccctgaacaccggcgacgacctggtgaccagcctgttcgccgccaagttcggccagggcctggaggaccagctggcccagaccagaagcctgagcctggacgactgctag

SEQ ID NO: 20582 - DNA, 1614 bp, Artificial Sequence
  Description of Artificial Sequence: Synthetic coding sequence
atgaccatcaacagcttcaagagccccggcttcgcccacgtgagcggccagaagtgcctgaccagcaccgagatcatgagaatccagagagagaccgacttcctgaagtgcgcccactgcctggcccccagacccagcgaccccttcgccagattctgccaggagtgcggcagccccgtgccccccatcttcggctgcagactgcccccccccgagggcgcccagatgggcctgtgcgccgagtgcagaagcctggtgcccatgaacacccccatctgcgtggtgtgcgaggcccccctggccctgcagctgcagccccaggccagcctgcacctgaaggagaaggtgatctgcagagcctgcggcaccggcaaccccgcccacctgagatactgcgtgacctgcgagggcgccctgcccagcagccaggagctgggcatccccgccggctgcagcgtgtgccccaagtgcggcgccagcaaccacctgagcgccagattctgcggcagctgcggcatctgcgtgaagagcctggtgaagctgagcctggacagaagcctggccctggccgccgaggagcccagacccttcagcgagagcctgaacatccccctgcccagaagcgacgtgggcaccaagagagacatcggcacccagaccgtgggcctgttctaccccagcggcaagctgctggccaagaaggagcaggagctggccagccagaagcagagacaggagaagatgagcgaccacaagcccctgctgaccgccatcagccccggcagaggctactggagaagacagctggaccacatcagcgcccacctgagatgctacgcccagaacaaccccgagttcagagccctgatcgccgagcccagaatgggcaagctgatcagcgccaccgtgcacgaggacggctgcgaggtgagcatcagactgaactacagccaggtgagcaacaagaacctgtacctgaacaaggccgtgaacttcagcgaccacctgctgagcagcgccgccgagggcgacggcggcctgtgcggcagcagaagcagctgggtgagcgactacagccagagcaccagcgacaccatcgagaagatcaagagaatcaagaacttcaagaccaagaccttccaggagaagaaggagcagctgatccccgagaacagactgctgctgaaggaggtgggccccaccggcgagggcagagtgagcgtgatcgagcagctgctggacgagggcgccgaccccaactgctgcgacgaggacaacagacccgtgatcaccgtggccgtgatgaacaagcaccacgaggccatccccgtgctggtgcagagaggcgccgacatcgaccagcagtggggccccctgagaaacaccgccctgcacgaggccaccctgctgggcctggccggcagagagagcaccgccaccctgctgggctgcaacgccagcatccagaagaagaacgccggcggccagaccgcctacgacctggccctgaacaccggcgacgacctggtgaccagcctgttcgccgccaagttcggccagggcctggaggaccagctggcccagaccagaagcctgagcctggacgactgctag

SEQ ID NO: 20583 - DNA, 1755 bp, Artificial Sequence
  Description of Artificial Sequence: Synthetic coding sequence
atgaccatcaacagcttcaagagccccggcttcgcccacgtgagcggccagaagtgcctgaccagcaccgagatcatgagaatccagagagagaccgacttcctgaagtgcgcccactgcctggcccccagacccagcgaccccttcgccagattctgccaggagtgcggcagccccgtgccccccatcttcggctgcagactgcccccccccgagggcgcccagatgggcctgtgcgccgagtgcagaagcctggtgcccatgaacacccccatctgcgtggtgtgcgaggcccccctggccctgcagctgcagccccaggccagcctgcacctgaaggagaaggtgatctgcagagcctgcggcaccggcaaccccgcccacctgagatactgcgtgacctgcgagggcgccctgcccagcagccaggagagcatgtgcagcggcgacaaggccccccccccccccacccagaagggcggcaccatcagctgctacagatgcggcagatggaacctgtgggaggccagcttctgcggctggtgcggcgccatgctgggcatccccgccggctgcagcgtgtgccccaagtgcggcgccagcaaccacctgagcgccagattctgcggcagctgcggcatctgcgtgaagagcctggtgaagctgagcctggacagaagcctggccctggccgccgaggagcccagacccttcagcgagcccagatgcgcctggcagagcctgaacatccccctgcccagaagcgacgtgggcaccaagagagacatcggcacccagaccgtgggcctgttctaccccagcggcaagctgctggccaagaaggagcaggagctggccagccagaagcagagacaggagaagatgagcgaccacaagcccctgctgaccgccatcagccccggcagaggctactggagaagacagctggaccacatcagcgcccacctgagatgctacgcccagaacaaccccgagttcagagccctgatcgccgagcccagaatgggcaagctgatcagcgccaccgtgcacgaggacggctgcgaggtgagcatcagactgaactacagccaggtgagcaacaagaacctgtacctgaacaaggccgtgaacttcagcgaccacctgctgagcagcgccgccgagggcgacggcggcctgtgcggcagcagaagcagctgggtgagcgactacagccagagcaccagcgacaccatcgagaagatcaagagaatcaagaacttcaagaccaagaccttccaggagaagaaggagcagctgatccccgagaacagactgctgctgaaggaggtgggccccaccggcgagggcagagtgagcgtgatcgagcagctgctggacgagggcgccgaccccaactgctgcgacgaggacaacagacccgtgatcaccgtggccgtgatgaacaagcaccacgaggccatccccgtgctggtgcagagaggcgccgacatcgaccagcagtggggccccctgagaaacaccgccctgcacgaggccaccctgctgggcctggccggcagagagagcaccgccaccctgctgggctgcaacgccagcatccagaagaagaacgccggcggccagaccgcctacgacctggccctgaacaccggcgacgacctggtgaccagcctgttcgccgccaagttcggccagggcctggaggaccagctggcccagaccagaagcctgagcctggacgactgctag

SEQ ID NO: 20584 - DNA, 1050 bp, Artificial Sequence
  Description of Artificial Sequence: Synthetic coding sequence
atggccggcggcagccccgccgccaagagagtggtggtgtacagaaacggcgaccccttcttccccggcagccagctggtggtgacccagagaagattccccaccatggaggccttcctgtgcgaggtgaccagcgccgtgcaggcccccctggccgtgagagccctgtacaccccctgccacggccaccccgtgaccaacctggccgacctgaagaacagaggccagtacgtggccgccggcttcgagagattccacaagctgcactacctgccccacagaggcaaggaccccggcggcaagagctgcagactgcagggcccccccgtgaccagacacctgtgcgacggcgccatcggcagacagctgcccgccggcgcccccagctacatccacgtgttcagaaacggcgacctggtgagcccccccttcagcctgaagctgagccaggccgccagccaggactgggagaccgtgctgaagctgctgaccgagaaggtgaagctgcagagcggcgccgtgtgcaagctgtgcaccctggagggcctgcccctgagcgccggcaaggagctggtgaccggccactactacgtggccgtgggcgaggacgagttcaaggacctgccctacctggagctgctggtgcccagccccagcctgcccagaggctgctggcagccccccggcagcaagagcagaccccacagacagggcgcccagggccacagagcccaggtgacccagcccagccccaaggagcccgacagaatcaagcccagcgccttctacgccagaccccagcagaccatccagcccagaagcaagctgcccaccctgagcttccccagcggcgtgatcggcgtgtacggcgccccccacagaagaaaggagaccgccggcgccctggaggtggccgacgacgaggacacccagaccgaggagcccctggaccagagagccgcccagatcgtggaggaggccctgagcctggagaaccagcccggcgccggcgccgccatcagcgccagcgcccccgccctgcccagctag

SEQ ID NO: 20585 - DNA, 453 bp, Artificial Sequence
  Description of Artificial Sequence: Synthetic coding sequence
ctgatcctggaggagcagttccccagcggcctgatcggccccctgttcaccatgaacggccacctgctgggcgacagcaaggacctgcaggacaaccacttctacgtggccgtgggcctggagaccttcaagtacttcccctactggaagagccccagagtgcccagcgaggtgcagcagagatacgccaacgtggagaagaacagccagagaaagaagaaggtggacagcaagggcaaggagccctgcaagtacgacggcatcccccccaagacccaggacagcgtgtactacgccaaggaggagaagaagaagaccctggccgagcccctggtgcagagaggcgccgagggcgacgtgtacaaggcccccacccccagcaaggagacccagggcgccctggacgtgaaggaggagcacaacgtgcagctggaggtgcccgtggaccagtag

SEQ ID NO: 20586 - DNA, 579 bp, Artificial Sequence; identical to SEQ ID NO: 20541
  Description of Artificial Sequence: Synthetic coding sequence

SEQ ID NO: 20587 - DNA, 534 bp, Artificial Sequence
  Description of Artificial Sequence: Synthetic coding sequence
atggagagcatctacctgcagaagcacctgggcgcctgcctgacccagggcctggccgaggtggccagagtgagacccgtggaccccatcgagtacctggccctgtggatctacaagtacaaggagaacgtgaccatggagcagctgagacagaaggagatggccaagctggagagagagagagagctggccctgatggagcaggagatgatggagagactgaaggccgaggagctgctgctgcagcagcagcagctggccctgcagctggagctggagatgcaggagaaggagagacagagaatccaggagctgcagagagcccaggagcagctgggcaaggagatgagaatgaacatggagaacctggtgagaaacgaggacatcctgcacagcgaggaggccaccctggacagcggcaagaccctggccgagatcagcgacagatacggcgcccccaacctgagcagagtggaggagctggacgagcccatgttcagcgacatcgccctgaacatcgaccaggacctgtag

SEQ ID NO: 20588 - DNA, 534 bp, Artificial Sequence; identical to SEQ ID NO: 20587
  Description of Artificial Sequence: Synthetic coding sequence

SEQ ID NO: 20589 - DNA, 555 bp, Artificial Sequence
  Description of Artificial Sequence: Synthetic coding sequence
atggagagcatctacctgcagaagcacctgggcgcctgcctgacccagggcctggccgaggtggccagagtgagacccgtggaccccatcgagtacctggccctgtggatctacaagtacaaggagaacgtgaccatggagcagctgagacagaaggagatggccaagctggagagagagagagagctggccctgatggagcaggagatgatggagagactgaaggccgaggagctgctgctgcagcagcagcagctggccctgcagctggagctggagatgcaggagaaggagagacagagaatccaggagctgcagagagcccaggagcagctgggcaaggagatgagaatgaacatggagaacctggtgagaaacgaggacatcctgcacagcgaggaggccaccctggacagcggcaagaccctggccgagatcagcgacagatacggcgcccccaacctgagcagagtggaggagctggacgagcccatgttcagcgacgtgagcatcagcgtgttctgcgagaagaccagattctgcttctgcttctag

SEQ ID NO: 20590 - DNA, 243 bp, Artificial Sequence
  Description of Artificial Sequence: Synthetic coding sequence
atggagagcatctacctgcagaagcacctgggcgcctgcctgacccagggcctggccgaggtggccagagtgagacccgtggaccccatcgagtacctggccctgtggatctacaagtacaaggagaacgtgaccatggagcagctgagacagaaggagatggccaagctggagagagagagagagctggccctgatggagcaggagatgatggagagactgaaggccgaggagctgctgtag

SEQ ID NO: 20591 - DNA, 462 bp, Artificial Sequence
  Description of Artificial Sequence: Synthetic coding sequence
atggagagcatctacctgcagaagcacctgggcgcctgcctgacccagggcctggccgaggtggccagagtgagacccgtggaccccatcgagtacctggccctgtggatctacaagtacaaggagaacgtgaccatggagcagctgagacagaaggagatggccaagctggagagagagagagagctggccctgatggagcaggagatgatggagagactgaaggccgaggagctgctgctgcagcagcagcagctggccctgcagctggagctggagatgcaggagaaggagagacagagaatccaggagctgcagagagcccaggagcagctgggcaaggagatgagaatgaacatggagaacctggtgagaaacgaggacatcctgcacagcgaggaggccaccctggacagcggcaagaccctggccgagatcagcgacagatacggcgccccctag

SEQ ID NO: 20592 - DNA, 534 bp, Artificial Sequence
  Description of Artificial Sequence: Synthetic coding sequence
atggagaccaactacctgaagagatgcttcggcaactgcctggcccaggccctggccgaggtggccaaggtgagacccagcgaccccatcgagtacctggcccactggctgtaccactacagaaagaccgccaaggccaaggaggagaacagagagaagaagatccacctgcaggaggagtacgacagcagcctgaaggagatggagatgaccgagatgctgaagcaggaggagtaccagatccagcagaactgcgagaagtgccacaaggagctgaccagcgagaccgtgagcaccaagaagaccatcttcatgcaggaggacaccaaccccctggagaaggaggccctgaagcaggagttcctgcccggcaccagcagcctgatccccggcatgccccagcaggtgccccccagcgagagcgccggccagatcgaccagaacttcaagatgccccaggagatcaactacaaggaggccttccagcacgaggtggcccacgagatgccccccggcagcaagagccccttctag

SEQ ID NO: 20593 - DNA, 534 bp, Artificial Sequence; identical to SEQ ID NO: 20592
  Description of Artificial Sequence: Synthetic coding sequence

SEQ ID NO: 20594 - DNA, 576 bp, Artificial Sequence
  Description of Artificial Sequence: Synthetic coding sequence
atgatcctgagacccccccagcagtgcggcaccgccgccagaatggagaccaactacctgaagagatgcttcggcaactgcctggcccaggccctggccgaggtggccaaggtgagacccagcgaccccatcgagtacctggcccactggctgtaccactacagaaagaccgccaaggccaaggaggagaacagagagaagaagatccacctgcaggaggagtacgacagcagcctgaaggagatggagatgaccgagatgctgaagcaggaggagtaccagatccagcagaactgcgagaagtgccacaaggagctgaccagcgagaccgtgagcaccaagaagaccatcttcatgcaggaggacaccaaccccctggagaaggaggccctgaagcaggagttcctgcccggcaccagcagcctgatccccggcatgccccagcaggtgccccccagcgagagcgccggccagatcgaccagaacttcaagatgccccaggagatcaactacaaggaggccttccagcacgaggtggcccacgagatgccccccggcagcaagagccccttctag

SEQ ID NO: 20595 - DNA, 534 bp, Artificial Sequence; identical to SEQ ID NO: 20592
  Description of Artificial Sequence: Synthetic coding sequence

SEQ ID NO: 20596 - DNA, 381 bp, Artificial Sequence
  Description of Artificial Sequence: Synthetic coding sequence
atggagaccaactacctgaagagatgcttcggcaactgcctggcccaggccctggccgaggtggccaaggtgagacccagcgaccccatcgagtacctggcccactggctgtaccactacagaaagaccgccaaggccaaggaggagaacagagagaagaagatccacctgcaggaggagtacgacagcagcctgaaggagatggagatgaccgagatgctgaagcaggaggagtaccagatccagcagaactgcgagaagtgccacaaggagctgaccagcgagaccgtgagcaccaagaagaccatcttcatgcaggaggacaccaaccccctggagaaggaggccctgaagcaggagttcctgcccggcaccagctag

SEQ ID NO: 20597 - DNA, 534 bp, Artificial Sequence; identical to SEQ ID NO: 20592
  Description of Artificial Sequence: Synthetic coding sequence

SEQ ID NO: 20598 - DNA, 915 bp, Artificial Sequence
  Description of Artificial Sequence: Synthetic coding sequence
atgagcctgaacccccccatcttcctgaagagaagcgaggagaacagcagcaagttcgtggagaccaagcagagccagaccaccagcatcgccagcgaggaccccctgcagaacctgtgcctggccagccaggaggtgctgcagaaggcccagcagagcggcagaagcaagtgcctgaagtgcggcggcagcagaatgttctactgctacacctgctacgtgcccgtggagaacgtgcccatcgagcagatccccctggtgaagctgcccctgaagatcgacatcatcaagcaccccaacgagaccgacggcaagagcaccgccatccacgccaagctgctggcccccgagttcgtgaacatctacacctacccctgcatccccgagtacgaggagaaggaccacgaggtggccctgatcttccccggcccccagagcatcagcatcaaggacatcagcttccacctgcagaagagaatccagaacaacgtgagaggcaagaacgacgaccccgacaagcccagcttcaagagaaagagaaccgaggagcaggagttctgcgacctgaacgacagcaagtgcaagggcaccaccctgaagaagatcatcttcatcgacagcacctggaaccagaccaacaagatcttcaccgacgagagactgcagggcctgctgcaggtggagctgaagaccagaaagacctgcttctggagacaccagaagggcaagcccgacaccttcctgagcaccatcgaggccatctactacttcctggtggactaccacaccgacatcctgaaggagaagtacagaggccagtacgacaacctgctgttcttctacagcttcatgtaccagctgatcaagaacgccaagtgcagcggcgacaaggagaccggcaagctgacccactag

SEQ ID NO: 20599 - DNA, 330 bp, Artificial Sequence
  Description of Artificial Sequence: Synthetic coding sequence
atgagcctgaacccccccatcttcctgaagagaagcgaggagaacagcagcaagttcgtggagaccaagcagagccagaccaccagcatcgccagcgaggaccccctgcagaacctgtgcctggccagccaggaggtgctgcagaaggcccagcagagcggcagaagcaagtgcctgaagtgcggcggcagcagaatgttctactgctacacctgctacgtgcccgtggagaacgtgcccatcgagcagatccccctggtgaagttcagcctgtaccacctgggccagagcatggtgagcagcgccagcaagatcacctgcatcggctag

SEQ ID NO: 20600 - DNA, 915 bp, Artificial Sequence; identical to SEQ ID NO: 20598
  Description of Artificial Sequence: Synthetic coding sequence

SEQ ID NO: 20601 - DNA, 654 bp, Artificial Sequence
  Description of Artificial Sequence: Synthetic coding sequence
atgctgcccctgaagatcgacatcatcaagcaccccaacgagaccgacggcaagagcaccgccatccacgccaagctgctggcccccgagttcgtgaacatctacacctacccctgcatccccgagtacgaggagaaggaccacgaggtggccctgatcttccccggcccccagagcatcagcatcaaggacatcagcttccacctgcagaagagaatccagaacaacgtgagaggcaagaacgacgaccccgacaagcccagcttcaagagaaagagaaccgaggagcaggagttctgcgacctgaacgacagcaagtgcaagggcaccaccctgaagaagatcatcttcatcgacagcacctggaaccagaccaacaagatcttcaccgacgagagactgcagggcctgctgcaggtggagctgaagaccagaaagacctgcttctggagacaccagaagggcaagcccgacaccttcctgagcaccatcgaggccatctactacttcctggtggactaccacaccgacatcctgaaggagaagtacagaggccagtacgacaacctgctgttcttctacagcttcatgtaccagctgatcaagaacgccaagtgcagcggcgacaaggagaccggcaagctgacccactag

SEQ ID NO: 20602 - DNA, 915 bp, Artificial Sequence; identical to SEQ ID NO: 20598
  Description of Artificial Sequence: Synthetic coding sequence

SEQ ID NO: 20603 - DNA, 285 bp, Artificial Sequence
  Description of Artificial Sequence: Synthetic coding sequence
atgagcctgaacccccccatcttcctgaagagaagcgaggagaacagcagcaagttcgtggagaccaagcagagccagaccaccagcatcgccagcgaggaccccctgcagaacctgtgcctggccagccaggaggtgctgcagaaggcccagcagagcggcagaagcaagtgcctgaagtgcggcggcagcagaatgttctactgctacacctgctacgtgcccgtggagaacgtgcccatcgagcagatccccctggtgaagctgcccctgaagatcgactag

SEQ ID NO: 20604 - DNA, 897 bp, Artificial Sequence
  Description of Artificial Sequence: Synthetic coding sequence
atggagagccagaaggaggccagaaccctgcaggagcccgtggccagacccagcggcgccagcagcagccagacccccaacgacaaggagagaagagagggcggcgccgtgcccgccgccgccgccctgggcgccgaggccgacgacgacagcgccgacggcctgtgggagctgcccgtggagcccgccgagagaagacccgagtgcaccagatgcagcagaccccagaaggtgtgcctgtgccccttcctgcccgcccaccccctgcacatcagcacccacctgtacatcatccagcaccccgccgaggagaacaaggtgctgagaaccgtgcccctgctggccgcctgcctgccccaggacaagtgcaaggtgaagatcggcagaagattcagcgaggagagagaccccgagctgagcaccgtgtgcagaaagagcggcaccctgatcctgtaccccggcgccgaggccgccaacctggaggagttcatcctggacagccccgtgtaccccagcaccatcatcatcatcgacggcacctggagccaggccaaggacatcttctacaagaacagcctgttcagacaccccaagcaggtgcagctgaagaccagcatcagcagccagtacgtgatcagaatgcagcccaccaacagatgcctgagcaccctggagtgcgccgccgtggccctgagcatcctggagaagaacaactacatccaggagaccctgctgagacccctgcaggccctgtgcagcttccagctgcagcacggcgcccagatcagactgagcaaggagcacctgctgaagaacggcctgtaccccaagcccatgcccaagaacaagagaaagctgagaaagatggagctgctgatgaacagcgtgaagatctag

SEQ ID NO: 20605 - DNA, 3477 bp, Artificial Sequence
  Description of Artificial Sequence: Synthetic coding sequence
atggccaccagaaaggacaccgaggaggagcaggtggtgcccagcgaggaggacgaggccaacgtgagagccgtgcaggcccactacctgagaagccccagccccagccagtacagcatggtgagcgacgccgagaccgagagcatcttcatggagcccatccacctgagcagcgccatcgccgccaagcagatcatcaacgaggagctgaagccccccggcgtgagagccgacgccgagtgccccggcatgctggagagcgccgagcagctgctggtggaggacctgtacaacagagtgagagagaagatggacgacaccagcctgtacaacaccccctgcgtgctggacctgcagagagccctggtgcaggacagacaggaggccccctggaacgaggtggacgaggtgtggcccaacgtgttcatcgccgagaagagcgtggccgtgaacaagggcagactgaagagactgggcatcacccacatcctgaacgccgcccacggcaccggcgtgtacaccggccccgagttctacaccggcctggagatccagtacctgggcgtggaggtggacgacttccccgaggtggacatcagccagcacttcagaaaggccagcgagttcctggacgaggccctgctgacctacagaggcaaggtgctggtgagcagcgagatgggcatcagcagaagcgccgtgctggtggtggcctacctgatgatcttccacaacatggccatcctggaggccctgatgaccgtgagaaagaagagagccatctaccccaacgagggcttcctgaagcagctgagagagctgaacgagaagctgatggaggagagagaggaggactacggcagagagggcggcagcgccgaggccgaggagggcgagggcaccggcagcatgctgggcgccagagtgcacgccctgaccgtggaggaggaggacgacagcgccagccacctgagcggcagcagcctgggcaaggccacccaggccagcaagcccctgaccctgatcgacgaggaggaggaggagaagctgtacgagcagtggaagaagggccagggcctgctgagcgacaaggtgccccaggacggcggcggctggagaagcgccagcagcggccagggcggcgaggagctggaggacgaggacgtggagagaatcatccaggagtggcagagcagaaacgagagataccaggccgagggctacagaagatggggcagagaggaggagaaggaggaggagagcgacgccggcagcagcgtgggcagaagaagaagaaccctgagcgagagcagcgcctgggagagcgtgagcagccacgacatctgggtgctgaagcagcagctggagctgaacagacccgaccacggcagaagaagaagagccgacagcatgagcagcgagagcacctgggacgcctggaacgagagactgctggagatcgagaaggaggccagcagaagataccacgccaagagcaagagagaggaggccgccgacagaagcagcgaggccggcagcagagtgagagaggacgacgaggacagcgtgggcagcgaggccagcagcttctacaacttctgcagcagaaacaaggacaagctgaccgccctggagagatggaagatcaagagaatccagttcggcttccacaagaaggacctgggcgccggcgacagcagcggcgagcccggcgccgaggaggccgtgggcgagaagaaccccagcgacgtgagcctgaccgcctaccaggcctggaagctgaagcaccagaagaaggtgggcagcgagaacaaggaggaggtggtggagctgagcaagggcgaggacagcgccctggccaagaagagacagagaagactggagctgctggagagaagcagacagaccctggaggagagccagagcatggccagctgggaggccgacagcagcaccgccagcggcagcatccccctgagcgccttctggagcgccgaccccagcgtgagcgccgacggcgacaccaccagcgtgctgagcacccagagccacagaagccacctgagccaggccgccagcaacatcgccggctgcagcaccagcaaccccaccacccccctgcccaacctgcccgtgggccccggcgacaccatcagcatcgccagcatccagaactggatcgccaacgtggtgagcgagaccctggcccagaagcagaacgagatgctgctgctgagcagaagccccagcgtggccagcatgaaggccgtgcccgccgccagctgcctgggcgacgaccaggtgagcatgctgagcggccacagcagcagcagcctgggcggctgcctgctgccccagagccaggccagacccagcagcgacatgcagagcgtgctgagctgcaacaccaccctgagcagccccgccgagagctgcagaagcaaggtgagaggcaccagcaagcccatcttcagcctgttcgccgacaacgtggacctgaaggagctgggcagaaaggagaaggagatgcagatggagctgagagagaagatgagcgagtacaagatggagaagctggccagcgacaacaagagaagcagcctgttcaagaagaagaaggtgaaggaggacgaggacgacggcgtgggcgacggcgacgaggacaccgacagcgccatcggcagcttcagatacagcagcagaagcaacagccagaagcccgagaccgacacctgcagcagcctggccgtgtgcgaccactacgccagcggcagcagagtgggcaaggagatggacagcagcatcaacaagtggctgagcggcctgagaaccgaggagaagccccccttccagagcgactggagcggcagcagcagaggcaagtacaccagaagcagcctgctgagagagaccgagagcaagagcagcagctacaagttcagcaagagccagagcgaggagcaggacaccagcagctaccacgaggccaacggcaacagcgtgagaagcaccagcagattcagcagcagcagcaccagagagggcagagagatgcacaagttcagcagaagcacctacaacgagaccagcagcagcagagaggagagccccgagccctacttcttcagaagaacccccgagagcagcgagagagaggagagccccgagccccagagacccaactgggccagaagcagagactgggaggacgtggaggagagcagcaagagcgacttcagcgagttcggcgccaagagaaagttcacccagagcttcatgagaagcgaggaggagggcgagaaggagagaaccgagaacagagaggagggcagattcgccagcggcagaagaagccagtacagaagaagcaccgacagagaggaggaggaggagatggacgacgaggccatcatcgccgcctggagaagaagacaggaggagaccagaaccaagctgcagaagagaagagaggactag

SEQ ID NO: 20606 - DNA, 3477 bp, Artificial Sequence; identical to SEQ ID NO: 20605
  Description of Artificial Sequence: Synthetic coding sequence

SEQ ID NO: 20607 - DNA, 3477 bp, Artificial Sequence; identical to SEQ ID NO: 20605
  Description of Artificial Sequence: Synthetic coding sequence

SEQ ID NO: 20608 - DNA, 531 bp, Artificial Sequence
  Description of Artificial Sequence: Synthetic coding sequence
atgggccccgccgaggccggcagaagaggcgccgccagccccgtgcccccccccctggtgagagtggcccccagcctgttcctgggcagcgccagagccgccggcgccgaggagcagctggccagagccggcgtgaccctgtgcgtgaacgtgagcagacagcagcccggccccagagcccccggcgtggccgagctgagagtgcccgtgttcgacgaccccgccgaggacctgctggcccacctggagcccacctgcgccgccatggaggccgccgtgagagccggcggcgcctgcctggtgtactgcaagaacggcagaagcagaagcgccgccgtgtgcaccgcctacctgatgagacacagaggcctgagcctggccaaggccttccagatggtgaagagcgccagacccgtggccgagcccaaccccggcttctggagccagctgcagaagtacgaggaggccctgcaggcccagagctgcctgcagggcgagccccccgccctgggcctgggccccgaggcctag

SEQ ID NO: 20609 - DNA, 531 bp, Artificial Sequence; identical to SEQ ID NO: 20608
  Description of Artificial Sequence: Synthetic coding sequence

SEQ ID NO: 20610 - DNA, 1155 bp, Artificial Sequence
  Description of Artificial Sequence: Synthetic coding sequence
atggagggcctgggcagaagctgcctgtggctgagaagagagctgagcccccccagacccagactgctgctgctggactgcagaagcagagagctgtacgagagcgccagaatcggcggcgccctgagcgtggccctgcccgccctgctgctgagaagactgagaagaggcagcctgagcgtgagagccctgctgcccggcccccccctgcagccccccccccccgcccccgtgctgctgtacgaccagggcggcggcagaagaagaagaggcgaggccgaggccgaggccgaggagtgggaggccgagagcgtgctgggcaccctgctgcagaagctgagagaggagggctacctggcctactacctgcagggcggcttcagcagattccaggccgagtgcccccacctgtgcgagaccagcctggccggcagagccggcagcagcatggcccccgtgcccggccccgtgcccgtggtgggcctgggcagcctgtgcctgggcagcgactgcagcgacgccgagagcgaggccgacagagacagcatgagctgcggcctggacagcgagggcgccacccccccccccgtgggcctgagagccagcttccccgtgcagatcctgcccaacctgtacctgggcagcgccagagacagcgccaacctggagagcctggccaagctgggcatcagatacatcctgaacgtgacccccaacctgcccaacttcttcgagaagaacggcgacttccactacaagcagatccccatcagcgaccactggagccagaacctgagcagattcttccccgaggccatcgagttcatcgacgaggccctgagccagaactgcggcgtgctggtgcactgcctggccggcgtgagcagaagcgtgaccgtgaccgtggcctacctgatgcagaagctgcacctgagcctgaacgacgcctacgacctggtgaagagaaagaagagcaacatcagccccaacttcaacttcatgggccagctgctggacttcgagagaagcctgagactggaggagagacacagccaggagcagggcagcggcggccaggccagcgccgccagcaacccccccagcttcttcaccacccccaccagcgacggcgccttcgagctggcccccacctag

SEQ ID NO: 20611 - DNA, 1707 bp, Artificial Sequence
  Description of Artificial Sequence: Synthetic coding sequence
atgaagtggaaggagaagctgggcgacggcgtgtacgacaccttcatgatgatcgacgagaccaagtgccccccctgcagcaacgtgctgtgcaaccccagcgagccccccccccccagaagactgaacatgaccaccgagcagttcaccggcgaccacacccagcacttcctggacggcggcgagatgaaggtggagcagctgttccaggagttcggcaacagaaagagcaacaccatccagagcgacggcatcagcgacagcgagaagtgcagccccaccgtgagccagggcaagagcagcgactgcctgaacaccgtgaagagcaacagcagcagcaaggcccccaaggtggtgcccctgacccccgagcaggccctgaagcagtacaagcaccacctgaccgcctacgagaagctggagatcatcaactaccccgagatctacttcgtgggccccaacgccaagaagagacacggcgtgatcggcggccccaacaacggcggctacgacgacgccgacggcgcctacatccacgtgcccagagaccacctggcctacagatacgaggtgctgaagatcatcggcaagggcagcttcggccaggtggccagagtgtacgaccacaagctgagacagtacgtggccctgaagatggtgagaaacgagaagagattccacagacaggccgccgaggagatcagaatcctggagcacctgaagaagcaggacaagaccggcagcatgaacgtgatccacatgctggagagcttcaccttcagaaaccacgtgtgcatggccttcgagctgctgagcatcgacctgtacgagctgatcaagaagaacaagttccagggcttcagcgtgcagctggtgagaaagttcgcccagagcatcctgcagagcctggacgccctgcacaagaacaagatcatccactgcgacctgaagcccgagaacatcctgctgaagcaccacggcagaagcagcaccaaggtgatcgacttcggcagcagctgcttcgagtaccagaagctgtacacctacatccagagcagattctacagagcccccgagatcatcctgggcagcagatacagcacccccatcgacatctggagcttcggctgcatcctggccgagctgctgaccggccagcccctgttccccggcgaggacgagggcgaccagctggcctgcatgatggagctgctgggcatgcccccccccaagctgctggagcagagcaagagagccaagtacttcatcaacagcaagggcatccccagatactgcagcgtgaccacccaggccgacggcagagtggtgctggtgggcggcagaagcagaagaggcaagaagagaggcccccccggcagcaaggactggggcaccgccctgaagggctgcgacgactacctgttcatcgagttcctgaagagatgcctgcactgggaccccagcgccagactgacccccgcccaggccctgagacacccctggatcagcaagagcgtgcccagacccctgaccaccatcgacaaggtgagcggcaagagagtggtgaaccccgccagcgccttccagggcctgggcagcaagctgccccccgtggtgggcatcgccaacaagctgaaggccaacctgatgagcgagaccaacggcagcatccccctgtgcagcgtgctgcccaagctgatcagctag

SEQ ID NO: 20612 - DNA, 1767 bp, Artificial Sequence; identical to SEQ ID NO: 19043
  Description of Artificial Sequence: Synthetic coding sequence

SEQ ID NO: 20613 - DNA, 1827 bp, Artificial Sequence; identical to SEQ ID NO: 19042
  Description of Artificial Sequence: Synthetic coding sequence

SEQ ID NO: 20614 - DNA, 288 bp, Artificial Sequence
  Description of Artificial Sequence: Synthetic coding sequence
atgaccacccccgccggcagcggcagcggcttcggcagcgtgagctggtggggcctgagccccgccctggacctgcaggccgagagcccccccgtggaccccgacagccaggccgacaccgtgcacagcaaccccgagctggacgtgctgctgctgggcagcgtggacggcagacacctgctgagaaccctgagcagagccaagttctggcccagaagaagattcaacgtgagctgggacgaggacgagagccccgacagcagagtgctggagggcggcagagactag

SEQ ID NO: 20615 - DNA, 9279 bp, Artificial Sequence
  Description of Artificial Sequence: Synthetic coding sequence
atgagcgacgccaacaaggccgccatcgccgccgagaaggaggccctgaacctgaagctgccccccatcgtgcacctgcccgagaacatcggcgtggacacccccacccagagcaagctgctgaagtacagaagaagcaaggagcagcagcagaagatcaaccagctggtgatcgacggcgccaagagaaacctggacagaaccctgggcaagagaacccccctgctgcccccccccgactacccccagaccatgaccagcgagatgaagaagaagggcttcaactacatctacatgaagcagtgcgtggagagcagccccctggtgcccatccagcaggagtggctggaccacatgctgagactgatccccgagagcctgaaggagggcaaggagagagaggagctgctggagagcctgatcaacgaggtgagcagcgacttcgagaacagcatgaagagatacctggtgcagagcgtgctggtgaagccccccgtgaagagcctggaggacgagggcggccccctgcccgagagccccgtgggcctggactacagcaacccctggcacagcagctacgtgcaggccagaaaccagatcttcagcaacctgcacatcatccaccccaccatgaagatgctgctggacctgggctacaccaccttcgccgacaccgtgctgctggacttcaccggcatcagagccaagggccccatcgactgcgagagcctgaagaccgacctgagcatccagaccagaaacgccgaggagaagatcatgaacacctggtaccccaaggtgatcaacctgttcaccaagaaggaggccctggagggcgtgaagcccgagaagctggacgccttctacagctgcgtgagcaccctgatgagcaaccagctgaaggacctgctgagaagaaccgtggagggcttcgtgaagctgttcgaccccaaggaccagcagagactgcccatcttcaagatcgagctgaccttcgacgacgacaagatggagttctaccccaccttccaggacctggaggacaacgtgctgagcctggtggagagaatcgccgaggccctgcagaacgtgcagaccatccccagctggctgagcggcaccagcacccccgtgaacctggacaccgagctgcccgagcacgtgctgcactgggccgtggacaccctgaaggccgccgtgcacagaaacctggagggcgccagaaagcactacgagacctacgtggagaagtacaactggctgctggacggcaccgccgtggagaacatcgagaccttccagaccgaggaccacaccttcgacgagtacaccgagttcatcgagaagttcctgagcctggccagcgagatcatgctgctgccccagtggatccactacaccatggtgagactggactgcgaggacctgaagaccggcctgaccaacaaggccaaggccttcgccaacatcctgctgaacgacatcgccagcaagtacagaaaggagaacgagtgcatctgcagcgagttcgaggccatcaaggagcacgccctgaaggtgcccgagaccaccgaggagatgatggacctgatcagctacgtggagaaggccagaaccgtgggcatcgaggagctgatcctgagaatccaggagagcaagagacagatgagctacttcctggacgtgttcctgttcccccaggaggacctggccctgaacgccaccgtgctgatgtggcccagaaagatcaaccccatcttcgacgagaacgacgagctgatcgagaacgccaagcacaagaaggagaacgagctgatggccaagagagagaagctgatcctggagatcgagaaggagagcagaagaatggaggagttcaccgagttcgccgagctggagagaatgcagcagtacgtgaccgacgtgagacagctgcagaagagaatccaggagagcgaggaggccgtgcagttcatcaacaaggaggaggagctgttcaagtgggagctgaccaagtaccccgagctggacaagctgaaggtgaacatcgagccctaccagaagttcttcaacttcgtgctgaagtggcagagaagcgagaagagatggatggacggcggcttcctggacctgaacggcgagagcatggaggccgacgtggaggagttcagcagagagatcttcaagaccctgaagttcttccagaccaagctgaagaaggagctgcaggagaagagaaaggccgccagaaagagaagcctggaggaggagaagatcgaggaggagcccaaggacaacgccaccatcaccatgtgcagaatgagagccagacactggaagcagatcagcgagatcgtgggctacgacctgacccccgacagcggcaccaccctgagaaaggtgctgaagctgaacctgaccccctacctggagcagttcgaggtgatcagcgccggcgccagcaaggagttcagcctggagaaggccatgaacaccatgatcggcacctgggaggacatcgccttccacatcagcctgtacagagacaccggcgtgtgcatcctgagcagcgtggacgagatccaggccatcctggacgaccagatcatcaagacccagaccatgagaggcagccccttcatcaagcccttcgagcacgagatcaaggcctgggaggacagactgatcagaatccaggagaccatcgacgagtggctgaaggtgcaggcccagtggctgtacctggagcccatcttctgcagcgaggacatcatgcagcagatgcccgaggagggcagacagttccagaccgtggacagacactggagagacatcatgaagttctgcgccaaggaccccaaggtgctggccgccaccagcctgaccggcctgctggagaagctgcagaactgcaacgagctgctggagaagatcatgaagggcctgaacgcctacctggagaagaagagactgttcttccccagattcttcttcctgagcaacgacgagatgctggagatcctgagcgagaccaaggaccccctgagagtgcagccccacctgaagaagtgcttcgagggcatcgccaagctggagttcctgcccaacctggacatcaaggccatgtacagcagcgagggcgagagagtggagctgatcgccctgatcagcaccagcgccgccagaggcgccgtggagaagtggctgatccaggtggaggacctgatgctgagaagcgtgcacgacgtgatcgccgccgccagactggcctaccccgagagcgccagaagagactgggtgagagagtggcccggccaggtggtgctgtgcatcagccagatgttctggaccagcgagacccaggaggtgatcagcggcggcaccgagggcctgaagaagtactacaaggagctgcagaaccagctgaacgagatcgtggagctggtgagaggcaagctgagcaagcagaccagaaccaccctgggcgccctggtgaccatcgacgtgcacgccagagacgtggtgatggacatgatcaagatgggcgtgagccacgacaccgacttcctgtggctggcccagctgagatactactgggagaacgagaacgccagagtgagaatcatcaactgcaacgtgaagtacgcctacgagtacctgggcaacagccccagactggtgatcacccccctgaccgacagatgctacagaaccctgatcggcgccttctacctgaacctgggcggcgcccccgagggccccgccggcaccggcaagaccgagaccaccaaggacctggccaaggccctggccgtgcagtgcgtggtgttcaactgcagcgacggcctggactacctggccatgggcaagttcttcaagggcctggccagcagcggcgcctgggcctgcttcgacgagttcaacagaatcgagctggaggtgctgagcgtggtggcccagcagatcctgtgcatccagagagccatccagcagaagctggtggtgttcgtgttcgagggcaccgagctgaagctgaaccccaactgcttcgtggccatcaccatgaaccccggctacgccggcagaagcgagctgcccgacaacctgaaggtgctgttcagaaccgtggccatgatggtgcccaactacgccctgatcgccgagatcagcctgtacagctacggcttcctgaacgccagacccctgagcgtgaagatcgtgatgacctacagactgtgcagcgagcagctgagcagccagttccactacgactacggcatgagagccgtgaaggccgtgctggtggccgccggcaacctgaagctgaagtaccccaacgagaacgaggacatcctgctgctgagaagcatcaaggacgtgaacgagcccaagttcctgagccacgacatccccctgttcaacggcatcaccagcgacctgttccccggcatcaagctgcccgaggccgactaccacgagttcctggagtgcgcccacgaggcctgcaacgtgcacaacctgcagcccgtgaagttcttcctggagaagatcatccagacctacgagatgatgatcgtgagacacggcttcatgctggtgggcgagcccttcgccgccaagaccaaggtgctgcacgtgctggccgacaccctgaccctgatgaacgagcacggctacggcgaggaggagaaggtgatctacagaaccgtgaaccccaagagcatcaccatgggccagctgttcggccagttcgaccccgtgagccacgagtggaccgacggcatcgtggccaacaccttcagagagttcgccctgagcgagacccccgacagaaagtgggtggtgttcgacggccccatcgacaccctgtggatcgagagcatgaacaccgtgctggacgacaacaagaagctgtgcctgatgagcggcgagatcatccagatgagcccccagatgagcctgatcttcgagaccatggacctgagccaggccagccccgccaccgtgagcagatgcggcatgatctacctggagcccagccagctgggctgggagcccctggtgagcagctggctgaacagcctgaagggccccctgtgcgagcccgagtaccaggccctgctgagaggcctgttcgcctggctgatcccccccagcctgaaccagagagtggagctgttccagctgaactacctgtacaccaccatcgtgagcaagatcctgaagatcctgatcaccttcagaatcagcaactacttcaagtacgtgcccctgaagacccagtgcaccttcatcaagttcttcctgcaccagcaggcctgcttcatcttcagcctgatctggagcatcggcggcagctgcgacaccgacggcagaagagtgttcgacaccttcatcagactgatcatcctgggcaaggacgacgagaaccccgtgcccgacagcgtgggcaagtgggagtgccccttcgacgagaagggcctggtgtacgactacatgtacgagctgaagaacaagggcagatgggtgcactggaacgagctgatcaagaacaccaacctgggcgacaagcagatcaagatccaggacatcatcgtgcccaccatggacaccatcagatacaccttcctgatggacctgagcatcacctacgccaagcccctgctgttcgtgggccccaccggcaccggcaagagcgtgtacgtgaaggacaagctgatgaaccacctggagaaggaccagtacttccccttctacatcaacctgagcgccagaaccagcgccaaccaggtgcagaacatcatcatggccagactggacaagagaagaaagggcgtgttcggcccccccatgggcaagaagtgcatcatcttcatcgacgacatgaacatgcccgccctggagaagtacggcgcccagccccccatcgagctgctgagacagttcttcgactgcggccactggtacgacctgaaggacaccagcaagatcaccctggtggacatcgagctgatcgccgccatgggcccccccggcggcggcagaaaccccgtgacccccagatgcatcagacacttcaacatctgcagcatcaacagcttcagcgacgagaccatggtgagaatcttcagcagcatcgtggccttctacctgagaacccacgagttcccccccgagtacttcgtgatcggcaaccagatcgtgaacggcaccatggagatctacaagcagagcgtggagaacctgctgcccacccccaccaagagccactacaccttcaacctgagagacttcagcagagtgatcagaggctgcctgctgatcgagagagacgccgtggccaacaagcacaccatgatcagactgttcgtgcacgaggtgctgagagtgttctacgacagactgatcaacgacgacgacagaagatggctgttccagctgaccaagaccgtgatcaaggaccacttcaaggagagcttccacagcatcttcagccacctgagaaagcagaacgcccccgtgaccgaggaggacctgagaaacctgatgttcggcgactacatgaaccccgacctggagggcgacgacagagtgtacatcgagatccccaacatccaccacttcagcgacgtggtggaccagtgcctggacgagtacaaccagacccacaagaccagaatgaacctggtgatcttcagatacgtgctggagcacctgagcagaatctgcagagtgctgaagcagagcggcggcaacgccctgctggtgggcctgggcggcagcggcagacagagcctgaccagactggccaccagcatggccaagatgcacatcttccagcccgagatcagcaagagctacggcatgaacgagtggagagaggacatgaagagcttcatcgccgtgcccgtgaccaacagaatcgtggacaacaagagcaagatcctggagaagagactgagatacctgaacgaccacttcacctacaacctgtactgcaacatctgcagaagcctgttcgagaaggacaagctgctgttcagcttcctgctgtgcgccaacctgctgctggccagaaaggagatcgagtaccaggagctgatgttcctgctgaccggcggcgtgagcctgaagagcgccgagaagaaccccgaccccacctggctgcaggacaagagctgggaggagatctgcagagccagcgagttccccgccttcagaggcctgagacagcacttctgcgagcacatctacgagtggagagagatctacgacagcaaggagccccacaacgccaagttccccgcccccatggacaagaacctgaacgagctgcagaagatcatcatcctgagatgcctgagacccgacaagatcacccccgccatcaccaactacgtgaccgacaagctgggcaagaagttcgtggagcccccccccttcgacctgaccaagagctacctggacagcaactgcaccatccccctgatcttcgtgctgagccccggcgccgaccccatggccagcctgctgaagttcgccaacgacaagagcatgagcggcaacaagttccaggccatcagcctgggccagggccagggccccatcgccgccaagatgatcaaggccgccatcgaggagggcacctgggtgtgcctgcagaactgccacctggccgtgagctggatgcccatgctggagaagatctgcgaggacttcaccagcgagacctgcaacagcagcttcagactgtggctgaccagctaccccagcagcaagttccccgtgaccatcctgcagaacggcgtgaagatgaccaacgagccccccaccggcctgagactgaacctgctgcagagctacctgaccgaccccgtgagcgaccccgagttcttcaagggctgcagaggcaaggagctggcctgggagaagctgctgttcggcgtgtgcttcttccacgccctggtgcaggagagaaagaagttcggccccctgggctggaacatcccctacggcttcaacgagagcgacctgagaatcagcatcagacagctgcagctgttcatcaacgagtacgacaccatccccttcgaggccatcagctacctgaccggcgagtgcaactacggcggcagagtgaccgacgactgggacagaagactgctgctgaccatgctggccgacttctacaacctgtacatcgtggagaacccccactacaagttcagccccagcggcaactacttcgccccccccaagggcacctacgaggactacatcgagttcatcaagaagctgcccttcacccagcaccccgagatcttcggcctgcacgagaacgtggacatcagcaaggacctgcagcagaccaagaccctgttcgagagcctgctgctgacccagggcggcagcaagcagaccggcgccagcggcagcaccgaccagatcctgctggagatcaccaaggacatcctgaacaagctgcccagcgacttcgacatcgagatggccctgagaaagtaccccgtgagatacgaggagagcatgaacaccgtgctggtgcaggagatggagagattcaacaacctgatcatcaccatcagaaacaccctgagagacctggagaaggccatcaagggcgtggtggtgatggacagcgccctggaggccctgagcggcagcctgctggtgggcaaggtgcccgagatctgggccaagagaagctaccccagcctgaagcccctgggcagctacatcaccgacttcctggccagactgaacttcctgcaggactggtacaacagcggcaagccctgcgtgttctggctgagcggcttcttcttcacccaggccttcctgaccggcgccatgcagaactacgccagaaagtacaccacccccatcgacctgctgggctacgagttcgaggtgatccccagcgacaccagcgacaccagccccgaggacggcgtgtacatccacggcctgtacctggacggcgccagatgggacagagagagcggcctgctggccgagcagtaccccaagctgctgttcgacctgatgcccatcatctggatcaagcccacccagaagagcagaatcatcaagagcgacgcctacgtgtgccccctgtacaagaccagcgagagaaagggcaccctgagcaccaccggccacagcaccaacttcgtgatcgccatgctgctgaagaccgaccagcccaccagacactggatcaagagaggcgtggccctgctgtgccagctggacgactag

SEQ ID NO: 20616 - DNA, 13374 bp, Artificial Sequence
  Description of Artificial Sequence: Synthetic coding sequence
atgaccatggcccccgacgtgagactggagtacctggaggaggtggccagcatcgtgctgaagttcaagcccgacaagtggagcaagctgatcggcgccgaggagaacgtggccctgttcaccgagttcttcgagaagcccgacgtgcaggtgctggtgctgaccctgaacgccgccggcatgatcatcccctgcctgggcttcccccagagcctgaagagcaagggcgtgtacttcatcaagaccaagagcgagaacatcaacaaggacaactacagagccagactgctgtacggcgacatcagccccacccccgtggaccagctgatcgccgtggtggaggaggtgctgagcagcctgctgaaccagagcgagaacatggccggctggccccaggtggtgagcgaggacatcgtgaagcaggtgcacagactgaagaacgagatgttcgtgatgagcggcaagatcaagggcaagaccctgctgcccatccccgagcacctgggcagcctggacggcaccctggagagcatggagagaatccccagcagcctggacaacctgctgctgcacgccatcgagaccaccatcatcgactggagccaccagatcagagacgtgctgagcaaggacagcgcccaggccctgctggacggcctgcaccccctgccccaggtggagttcgagttctgggacaccagactgctgaacctgaagtgcatccacgagcagctgaacagacccaaggtgaacaagatcgtggagatcctggagaaggccaagagctgctactggcccgccctgcagaacgtgtacaccaacgtgaccgagggcctgaaggaggccaacgacatcgtgctgtacctgaagcccctgagaatcctgctggaggagatggagcaggccgacttcaccatgctgcccaccttcatcgccaaggtgctggacaccatctgcttcatctgggccaccagcgagtactacaacacccccgccagaatcatcgtgatcctgcaggagttctgcaaccagatcatcgagatgaccagaaccttcctgagccccgaggaggtgctgaagggcctgcagggcgagatcgaggaggtgctgagcggcatcagcctggccgtgaacgtgctgaaggagctgtaccagacctacgacttctgctgcgtgaacatgaagctgttcttcaaggacaaggagcccgtgccctgggagttccccagcagcctggccttcagcagaatcaacagcttcttccagagaatccagaccatcgaggagctgtacaagaccgccatcgagttcctgaagctggagaagatcgagctgggcggcgtgagaggcaacctgctgggcagcctggtgaccagaatctacgacgaggtgttcgagctggtgaaggtgttcgccgactgcaagtacgaccccctggaccccggcgacagcaacttcgacagagactacgccgacttcgagatcaagatccaggacctggacagaagactggccaccatcttctgccagggcttcgacgactgcagctgcatcaagagcagcgccaagctgctgtacatgtgcggcggcctgatggagagacccctgatcctggccgaggtggcccccagatacagcgtgatgctggagctgttcgacgccgagctggacaacgccaagatcctgtacgacgcccagatggccgccagcgaggagggcaacatccccctgatccacaagaacatgccccccgtggccggccagctgaagtggagcctggagctgcaggagagactggaggtgagcatgaagcacctgaagcacgtggagcaccccgtgatgagcggcgccgaggccaagctgacctaccagaagtacgacgagatgatggagctgctgagatgccacagagagaagatctaccagcagtgggtggccggcgtggaccaggactgccacttcaacctgggccagcccctgatcctgagagacgccgccagcaacctgatccacgtgaacttcagcaaggccctggtggccgtgctgagagaggtgaagtacctgaacttccagcagcagaaggagatccccgacagcgccgagagcctgttcagcgagaacgagaccttcagaaagttcgtgggcaacctggagctgatcgtgggctggtacaacgagatcaagaccatcgtgaaggccgtggagttcctgctgatcaagagcgagctggaggccatcgacgtgaagctgctgagcgccgagaccaccctgttctggaacggcgagggcgtgttccagtacatccaggaggtgagagagatcctgcacaacctgcagaacagaatgcagaaggccaagcagaacatcgagggcatcagccaggccatgaaggactggagcgccaaccccctgttcgagagaaaggacaacaagaaggaggccctgctggacctggacggcagaatcgccaacctgaacaagagatacgccgccgtgagagacgccggcgtgaagatccaggccatggtggccgagaacgccgagctgttcagagccgacaccctgagcctgccctggaaggactacgtgatctacatcgacgacatggtgctggacgagttcgaccagttcatcagaaagagcctgagcttcctgatggacaacatggagagcatcgcccccctgttcgagatcagaatggagctggacgaggacggcctgaccttcaaccccaccctggaggtgggcagcgacagaggcttcctggccctgatcgagggcctggtgaacgacatctacaacgtggccagactgatccccagactggccaaggacagaatgaactacaagatggacctggaggacaacaccgacctgatcgagatgagagaggaggtgagcagcctggtgatcaacgccatgaaggaggccgaggagtaccaggacagcttcgagagatacagctacctgtggaccgacaacctgcaggagttcatgaagaacttcctgatctacggctgcgccgtgaccgccgaggacctggacacctggaccgacgacaccatccccaagaccccccccaccctggcccagttccaggagcagatcgacagctacgagaagctgtacgaggaggtgagcaagtgcgagaacaccaaggtgttccacggctggctgcagtgcgactgcagacccttcaagcaggccctgctgagcaccatcagaagatggggcttcatgttcaagagacacctgagcaaccacgtgaccaacagcctggccgacctggaggccttcatgaaggtggccagaatgggcctgaccaagcccctgaaggagggcgactacgacggcctggtggaggtgatgggccacctgatgaaggtgaaggagagacaggccgccaccgacaacatgttcgagcccctgaagcagaccatcgagctgctgaagacctacggcgaggagatgcccgaggagatccacctgaagctgcaggagctgcccgagcactgggccaacaccaagaagctggccatccaggtgaagctgaccgtggcccccctgcaggccaacgaggtgagcatcctgagaagaaagtgccagcagttcgagctgaagcagcacgagttcagagagagattcagaagagaggcccccttcagcttcagcgaccccaacccctacaagagcctgaacaagcagcagaagagcatcagcgccatggagggcatcatggaggccctgagcaagagcggcggcctgttcgaggtgcccgtgcccgactacaagcagctgaaggcctgccacagagaggtgagactgctgaaggagctgtgggacatggtggtggtggtgaacaccagcatcgaggactggaagaccaccaagtggaaggacatcaacgtggagcagatggacatcgactgcaagaagttcgccaaggacatgagaagcctggacaaggagatgaagacctgggacgccttcgtgggcctggacaacaccgtgaagaacgtgatcaccagcctgagagccgtgagcgagctgcagaaccccgccatcagagagagacactggcagcagctgatgcaggccacccaggtgaagttcaagatgagcgaggagaccaccctggccgacctgctgcagctgaacctgcacagctacgaggacgaggtgagaaacatcgtggacaaggccgtgaaggagagcggcatggagaaggtgctgaaggccctggacagcacctggagcatgatggagttccagcacgagccccaccccagaaccggcaccatgatgctgaagagcagcgaggtgctggtggagaccctggaggacaaccaggtgcagctgcagaacctgatgatgagcaagtacctggcccacttcctgaaggaggtgaccagctggcagcagaagctgagcaccgccgacagcgtgatcagcatctggttcgaggtgcagagaacctggagccacctggagagcatcttcatcggcagcgaggacatcagaacccagctgcccggcgacagccagagattcgacgacatcaaccaggagttcaaggccctgatggaggacgccgtgaagacccccaacgtggtggaggccaccagcaagcccggcctgtacaacaagctggaggccctgaagaagagcctggccatctgcgagaaggccctggccgagtacctggagaccaagagactggccttccccagattctacttcgtgagcagcgccgacctgctggacatcctgagcaacggcaacgaccccgtggaggtgagcagacacctgagcaagctgttcgacagcctgtgcaagctgaagttcagactggacgccagcgacaagcccctgaaggtgggcctgggcatgtacagcaaggaggacgagtacatggtgttcgaccaggagtgcgacctgagcggccaggtggaggtgtggctgaacagagtgctggacagaatgtgcagcaccctgagacacgagatccccgaggccgtggtgacctacgaggagaagcccagagagcagtggatcctggactaccccgcccaggtggccctgacctgcacccagatctggtggaccaccgaggtgggcctggccttcgccagactggaggagggctacgagaacgccatcagagactacaacaagaagcagatcagccagctgaacgtgctgatcaccctgctgatgggcaacctgaacgccggcgacagaatgaagatcatgaccatctgcaccatcgacgtgcacgccagagacgtggtggccaagatgatcgtggtggagagcagccaggccttcacctggcaggcccagctgagacacagatgggacgaggagaagagacactgcttcgccaacatctgcgacgcccagatccagtacagctacgagtacctgggcaacacccccagactggtgatcacccccctgaccgacagatgctacatcaccctgacccagagcctgcacctgatcatgggcggcgcccccgccggccccgccggcaccggcaagaccgagaccaccaaggacctgggcagagccctgggcaccatggtgtacgtgttcaactgcagcgagcagatggactacaagagctgcggcaacatctacaagggcctggcccagaccggcgcctggggctgcttcgacgagttcaacagaatcagcgtggaggtgctgagcgtgatcgccgtgcaggtgaagtgcgtgcaggacgccatcagagccaagaagaaggccttcaacttcctgggcgagatcatcggcctgatccccaccgtgggcatcttcatcaccatgaaccccggctacgccggcagagccgagctgcccgagaacctgaaggccctgttcagaccctgcgccatggtggtgcccgacttcgagctgatctgcgagatcatgctgatggccgagggcttcctggaggccagactgctggccagaaagttcatcaccctgtacaccctgtgcaaggagctgctgagcaagcaggaccactacgactggggcctgagagccatcaagagcgtgctggtggtggccggcagcctgaagagaggcgaccccagcagagccgaggaccaggtgctgatgagagccctgagagacttcaacatccccaagatcgtgaccgacgacctgcccgtgttcatgggcctgatcggcgacctgttccccgccctggacgtgcccagaaagagagacctgaacttcgagaagatcatcaagcagagcatcgtggagctgaagctgcaggccgaggacagcttcgtgctgaaggtggtgcagctggaggagctgctgcaggtgagacacagcgtgttcatcgtgggcaacgccggcagcggcaagagccaggtgctgaagagcctgaacaagacctaccagaacctgaagagaaagcccgtggccgtggacctggaccccaaggccgtgacctgcgacgagctgttcggcatcatcaaccccgtgaccagagagtggaaggacggcctgttcagcaccatcatgagagacctggccaacatcacccacgacggccccaagtggatcatcctggacggcgacatcgaccccatgtggatcgagagcctgaacaccgtgatggacgacaacaaggtgctgaccctggccagcaacgagagaatccccctgaacagaaccatgagactggtgttcgagatcagccacctgagaaccgccacccccgccaccgtgagcagagccggcatcctgtacatcaaccccgccgacctgggctggaaccccgtggtgagcagctggatcgagagaagaaaggtgcagagcgagaaggccaacctgatgatcctgttcgacaagtacctgcccacctgcctggacaagctgagattcggcttcaagaagatcacccccgtgcccgagatcaccgtgatccagaccatcctgtacctgctggagtgcctgctgaccgagaagaccgtgccccccgacagccccagagagctgtacgagctgtacttcgtgttcacctgcttctgggccttcggcggcgccatgttccaggaccagctggtggactacagagtggagttcagcaagtggtggatcaacgagttcaagaccatcaagttccccagccagggcaccatcttcgactactacatcgaccccgacaccaagaagttcctgccctggaccgacaaggtgcccagcttcgagctggaccccgacgtgcccctgcaggccagcctggtgcacaccaccgagaccatcagaatcagatacttcatggacctgctgatggagaagagctggcccgtgatgctggtgggcaacgccggcaccggcaagagcgtgctgatgggcgacaagctggagagcctgaacaccgacaactacctggtgcaggccgtgcccttcaacttctacaccaccagcgccatgctgcagggcgtgctggagaagcccctggagaagaagagcggcagaaactacggcccccccggcaccaagaagctggtgtacttcatcgacgacatgaacatgcccgaggtggacaagtacggcaccgtggccccccacaccctgatcagacagcacatggaccacagacactggtacgacagacacaagctgaccctgaaggacatccacaactgccagtacgtggcctgcatgaaccccaccagcggcagcttcaccatcgacagcagactgcagagacacttctgcgtgttcgccgtgagcttccccggccaggaggccctgaccaccatctacaacaccatcctgacccagcacctggccttcagaagcgtgagcatggccatccagagaatcagcagccagctggtggccgccgccctggccctgcaccagaagatcaccgccaccttcctgcccaccgccatcaagttccactacgtgttcaacctgagagacctgagcaacatcttccagggcctgctgttcagcaccgccgaggtgctgaagacccccctggacctggtgagactgtggctgcacgagaccgagagagtgtacggcgacaagatggtggacgagaaggaccaggagaccctgcacagagtgaccatggccagcaccaagaagttcttcgacgacctgggcgacgagctgctgttcgccaagcccaacatcttctgccacttcgcccagggcatcggcgaccccaagtacgtgcccgtgaccgacatggcccccctgaacaagctgctggtggacgtgctggacagctacaacgaggtgaacgccgtgatgaacctggtgctgttcgaggacgccgtggcccacatctgcagaatcaacagaatcctggagagccccagaggcaacgccctgctggtgggcgtgggcggcagcggcaagcagagcctgagcagactggccgcctacatcagcggcctggacgtgttccagatcaccctgaagaagggctacggcatccccgacctgaagatcgacctggccgcccagtacatcaaggccgccgtgaagaacgtgcccagcgtgttcctgatgaccgacagccaggtggccgaggagcagttcctggtgctgatcaacgacctgctggccagcggcgagatccccggcctgttcatggaggacgaggtggagaacatcatcagcagcatgagaccccaggtgaagagcctgggcatgaacgacaccagagagacctgctggaagttcttcatcgagaaggtgagaagacagctgaaggtgatcctgtgcttcagccccgtgggcagcgtgctgagagtgagagccagaaagttccccgccgtggtgaactgcaccgccatcgactggttccacgagtggcccgaggacgccctggtgagcgtgagcgccagattcctggaggagaccgagggcatcccctgggaggtgaaggccagcatcagcttcttcatgagctacgtgcacaccaccgtgaacgagatgagcagagtgtacctggccaccgagagaagatacaactacaccacccccaagaccttcctggagcagatcaagctgtaccagaacctgctggccaagaagagaaccgagctggtggccaagatcgagagactggagaacggcctgatgaagctgcagagcaccgccagccaggtggacgacctgaaggccaagctggccatccaggaggccgagctgaagcagaagaacgagagcgccgaccagctgatccaggtggtgggcatcgaggccgagaaggtgagcaaggagaaggccatcgccgaccaggaggaggtgaaggtggaggtgatcaacaagaacgtgaccgagaagcagaaggcctgcgagaccgacctggccaaggccgagcccgccctgctggccgcccaggaggccctggacaccctgaacaagaacaacctgaccgagctgaagagcttcggcagcccccccgacgccgtggtgaacgtgaccgccgccgtgatgatcctgaccgcccccggcggcaagatccccaaggacaagagctggaaggccgccaagatcatgatgggcaaggtggacaccttcctggacagcctgaagaagttcgacaaggagcacatccccgaggcctgcctgaaggccttcaagccctaccagggcaaccccaccttcgaccccgagttcatcagaagcaagagcaccgccgccgccggcctgtgcagctggtgcatcaacatcgtgagattctacgaggtgtactgcgacgtggcccccaagagacaggccctggaggaggccaacgccgagctggccgaggcccaggagaagctgagcagaatcaagaacaagatcgccgagctgaacgccaacctgagcaacctgaccagcgccttcgagaaggccaccgccgagaagatcaagtgccagcaggaggccgacgccaccaacagagtgatcctgctggccaacagactggtgggcggcctggccagcgagaacatcagatgggccgagagcgtggagaacttcagaagccagggcgtgaccctgtgcggcgacgtgctgctgatcagcgccttcgtgagctacgtgggctacttcaccaagaagtacagaaacgagctgatggagaagttctggatcccctacatccacaacctgaaggtgcccatccccatcaccaacggcctggaccccctgagcctgctgaccgacgacgccgacgtggccacctggaacaaccagggcctgcccagcgacagaatgagcaccgagaacgccaccatcctgggcaacaccgagagatggcccctgatcgtggacgcccagctgcagggcatcaagtggatcaagaacaagtacagaagcgagctgaaggccatcagactgggccagaagagctacctggacgtgatcgagcaggccatcagcgagggcgacaccctgctgatcgagaacatcggcgagaccgtggaccccgtgctggaccccctgctgggcagaaacaccatcaagaagggcaagtacatcaagatcggcgacaaggaggtggagtaccaccccaagttcagactgatcctgcacaccaagtacttcaacccccactacaagcccgagatgcaggcccagtgcaccctgatcaacttcctggtgaccagagacggcctggaggaccagctgctggccgccgtggtggccaaggagagacccgacctggagcagctgaaggccaacctgaccaagagccagaacgagttcaagatcgtgctgaaggagctggaggacagcctgctggccagactgagcgccgccagcggcaacttcctgggcgacaccgccctggtggagaacctggagaccaccaagcacaccgccagcgagatcgaggagaaggtggtggaggccaagatcaccgaggtgaagatcaacgaggccagagagaactacagacccgccgccgagagagccagcctgctgtacttcatcctgaacgacctgaacaagatcaaccccgtgtaccagttcagcctgaaggccttcaacgtggtgttcgagaaggccatccagagaaccacccccgccaacgaggtgaagcagagagtgatcaacctgaccgacgagatcacctacagcgtgtacatgtacaccgccagaggcctgttcgagagagacaagctgatcttcctggcccaggtgaccttccaggtgctgagcatgaagaaggagctgaaccccgtggagctggacttcctgctgagattccccttcaaggccggcgtggtgagccccgtggacttcctgcagcaccagggctggggcggcatcaaggccctgagcgagatggacgagttcaagaacctggacagcgacatcgagggcagcgccaagagatggaagaagctggtggagagcgaggcccccgagaaggagatcttccccaaggagtggaagaacaagaccgccctgcagaagctgtgcatggtgagatgcctgagacccgacagaatgacctacgccatcaagaacttcgtggaggagaagatgggcagcaagttcgtggagggcagaagcgtggagttcagcaagagctacgaggagagcagccccagcaccagcatcttcttcatcctgagccccggcgtggaccccctgaaggacgtggaggccctgggcaagaagctgggcttcaccatcgacaacggcaagctgcacaacgtgagcctgggccagggccaggaggtggtggccgagaacgccctggacgtggccgccgagaagggccactgggtgatcctgcagaacatccacctggtggccagatggctgggcaccctggacaagaagctggagcactacagcaccggcagccacgaggactacagagtgttcatcagcgccgagcccgcccccagccccgagacccacatcatcccccagggcatcctggagaacgccatcaagatcaccaacgagccccccaccggcatgcacgccaacctgcacaaggccctggacctgttcacccaggacaccctggagatgtgcaccaaggagatggagttcaagtgcatgctgttcgccctgtgctacttccacgccgtggtggccgagagaagaaagttcggcgcccagggctggaacagaagctaccccttcaacaacggcgacctgaccatcagcatcaacgtgctgtacaactacctggaggccaaccccaaggtgccctgggacgacctgagatacctgttcggcgagatcatgtacggcggccacatcaccgacgactgggacagaagactgtgcagaacctacctggccgagtacatcagaaccgagatgctggagggcgacgtgctgctggcccccggcttccagatcccccccaacctggactacaagggctaccacgagtacatcgacgagaacctgccccccgagagcccctacctgtacggcctgcaccccaacgccgagatcggcttcctgaccgtgaccagcgagaagctgttcagaaccgtgctggagatgcagcccaaggagaccgacagcggcgccggcaccggcgtgagcagagaggagaaggtgaaggccgtgctggacgacatcctggagaagatccccgagaccttcaacatggccgagatcatggccaaggccgccgagaagaccccctacgtggtggtggccttccaggagtgcgagagaatgaacatcctgaccaacgagatgagaagaagcctgaaggagctgaacctgggcctgaagggcgagctgaccatcaccaccgacgtggaggacctgagcaccgccctgttctacgacaccgtgcccgacacctgggtggccagagcctaccccagcatgatgggcctggccgcctggtacgccgacctgctgctgagaatcagagagctggaggcctggaccaccgacttcgccctgcccaccaccgtgtggctggccggcttcttcaacccccagagcttcctgaccgccatcatgcagagcatggccagaaagaacgagtggcccctggacaagatgtgcctgagcgtggaggtgaccaagaagaacagagaggacatgaccgccccccccagagagggcagctacgtgtacggcctgttcatggagggcgccagatgggacacccagaccggcgtgatcgccgaggccagactgaaggagctgacccccgccatgcccgtgatcttcatcaaggccatccccgtggacagaatggagaccaagaacatctacgagtgccccgtgtacaagaccagaatcagaggccccacctacgtgtggaccttcaacctgaagaccaaggagaaggccgccaagtggatcctggccgccgtggccctgctgctgcaggtgtag

SEQ ID NO: 20617 - DNA, 13458 bp, Artificial Sequence
  Description of Artificial Sequence: Synthetic coding sequence
atgaccatggcccccgacgtgagactggagtacctggaggaggtggccagcatcgtgctgaagttcaagcccgacaagtggagcaagctgatcggcgccgaggagaacgtggccctgttcaccgagttcttcgagaagcccgacgtgcaggtgctggtgctgaccctgaacgccgccggcatgatcatcccctgcctgggcttcccccagagcctgaagagcaagggcgtgtacttcatcaagaccaagagcgagaacatcaacaaggacaactacagagccagactgctgtacggcgacatcagccccacccccgtggaccagctgatcgccgtggtggaggaggtgctgagcagcctgctgaaccagagcgagaacatggccggctggccccaggtggtgagcgaggacatcgtgaagcaggtgcacagactgaagaacgagatgttcgtgatgagcggcaagatcaagggcaagaccctgctgcccatccccgagcacctgggcagcctggacggcaccctggagagcatggagagaatccccagcagcctggacaacctgctgctgcacgccatcgagaccaccatcatcgactggagccaccagatcagagacgtgctgagcaaggacagcgcccaggccctgctggacggcctgcaccccctgccccaggtggagttcgagttctgggacaccagactgctgaacctgaagtgcatccacgagcagctgaacagacccaaggtgaacaagatcgtggagatcctggagaaggccaagagctgctactggcccgccctgcagaacgtgtacaccaacgtgaccgagggcctgaaggaggccaacgacatcgtgctgtacctgaagcccctgagaatcctgctggaggagatggagcaggccgacttcaccatgctgcccaccttcatcgccaaggtgctggacaccatctgcttcatctgggccaccagcgagtactacaacacccccgccagaatcatcgtgatcctgcaggagttctgcaaccagatcatcgagatgaccagaaccttcctgagccccgaggaggtgctgaagggcctgcagggcgagatcgaggaggtgctgagcggcatcagcctggccgtgaacgtgctgaaggagctgtaccagacctacgacttctgctgcgtgaacatgaagctgttcttcaaggacaaggagcccgtgccctgggagttccccagcagcctggccttcagcagaatcaacagcttcttccagagaatccagaccatcgaggagctgtacaagaccgccatcgagttcctgaagctggagaagatcgagctgggcggcgtgagaggcaacctgctgggcagcctggtgaccagaatctacgacgaggtgttcgagctggtgaaggtgttcgccgactgcaagtacgaccccctggaccccggcgacagcaacttcgacagagactacgccgacttcgagatcaagatccaggacctggacagaagactggccaccatcttctgccagggcttcgacgactgcagctgcatcaagagcagcgccaagctgctgtacatgtgcggcggcctgatggagagacccctgatcctggccgaggtggcccccagatacagcgtgatgctggagctgttcgacgccgagctggacaacgccaagatcctgtacgacgcccagatggccgccagcgaggagggcaacatccccctgatccacaagaacatgccccccgtggccggccagctgaagtggagcctggagctgcaggagagactggaggtgagcatgaagcacctgaagcacgtggagcaccccgtgatgagcggcgccgaggccaagctgacctaccagaagtacgacgagatgatggagctgctgagatgccacagagagaagatctaccagcagtgggtggccggcgtggaccaggactgccacttcaacctgggccagcccctgatcctgagagacgccgccagcaacctgatccacgtgaacttcagcaaggccctggtggccgtgctgagagaggtgaagtacctgaacttccagcagcagaaggagatccccgacagcgccgagagcctgttcagcgagaacgagaccttcagaaagttcgtgggcaacctggagctgatcgtgggctggtacaacgagatcaagaccatcgtgaaggccgtggagttcctgctgatcaagagcgagctggaggccatcgacgtgaagctgctgagcgccgagaccaccctgttctggaacggcgagggcgtgttccagtacatccaggaggtgagagagatcctgcacaacctgcagaacagaatgcagaaggccaagcagaacatcgagggcatcagccaggccatgaaggactggagcgccaaccccctgttcgagagaaaggacaacaagaaggaggccctgctggacctggacggcagaatcgccaacctgaacaagagatacgccgccgtgagagacgccggcgtgaagatccaggccatggtggccgagaacgccgagctgttcagagccgacaccctgagcctgccctggaaggactacgtgatctacatcgacgacatggtgctggacgagttcgaccagttcatcagaaagagcctgagcttcctgatggacaacatggtgatcgacgagagcatcgcccccctgttcgagatcagaatggagctggacgaggacggcctgaccttcaaccccaccctggaggtgggcagcgacagaggcttcctggccctgatcgagggcctggtgaacgacatctacaacgtggccagactgatccccagactggccaaggacagaatgaactacaagatggacctggaggacaacaccgacctgatcgagatgagagaggaggtgagcagcctggtgatcaacgccatgaaggaggccgaggagtaccaggacagcttcgagagatacagctacctgtggaccgacaacctgcaggagttcatgaagaacttcctgatctacggctgcgccgtgaccgccgaggacctggacacctggaccgacgacaccatccccaagaccccccccaccctggcccagttccaggagcagatcgacagctacgagaagctgtacgaggaggtgagcaagtgcgagaacaccaaggtgttccacggctggctgcagtgcgactgcagacccttcaagcaggccctgctgagcaccatcagaagatggggcttcatgttcaagagacacctgagcaaccacgtgaccaacagcctggccgacctggaggccttcatgaaggtggccagaatgggcctgaccaagcccctgaaggagggcgactacgacggcctggtggaggtgatgggccacctgatgaaggtgaaggagagacaggccgccaccgacaacatgttcgagcccctgaagcagaccatcgagctgctgaagacctacggcgaggagatgcccgaggagatccacctgaagctgcaggagctgcccgagcactgggccaacaccaagaagctggccatccaggtgaagctgaccgtggcccccctgcaggccaacgaggtgagcatcctgagaagaaagtgccagcagttcgagctgaagcagcacgagttcagagagagattcagaagagaggcccccttcagcttcagcgaccccaacccctacaagagcctgaacaaggtgttcctgctgaagggcatcatggaggccctgagcaagagcggcggcctgttcgaggtgcccgtgcccgactacaagcagctgaaggcctgccacagagaggtgagactgctgaaggagctgtgggacatggtggtggtggtgaacaccagcatcgaggactggaagaccaccaagtggaaggacatcaacgtggagcagatggacatcgactgcaagaagttcgccaaggacatgagaagcctggacaaggagatgaagacctgggacgccttcgtgggcctggacaacaccgtgaagaacgtgatcaccagcctgagagccgtgagcgagctgcagaaccccgccatcagagagagacactggcagcagctgatgcaggccacccaggtgaagttcaagatgagcgaggagaccaccctggccgacctgctgcagctgaacctgcacagctacgaggacgaggtgagaaacatcgtggacaaggccgtgaaggagagcggcatggagaaggtgctgaaggccctggacagcacctggagcatgatggagttccagcacgagccccaccccagaaccggcaccatgatgctgaagagcagcgaggtgctggtggagaccctggaggacaaccaggtgcagctgcagaacctgatgatgagcaagtacctggcccacttcctgaaggaggtgaccagctggcagcagaagctgagcaccgccgacagcgtgatcagcatctggttcgaggtgcagagaacctggagccacctggagagcatcttcatcggcagcgaggacatcagaacccagctgcccggcgacagccagagattcgacgacatcaaccaggagttcaaggccctgatggaggacgccgtgaagacccccaacgtggtggaggccaccagcaagcccggcctgtacaacaagctggaggccctgaagaagagcctggccatctgcgagaaggccctggccgagtacctggagaccaagagactggccttccccagattctacttcgtgagcagcgccgacctgctggacatcctgagcaacggcaacgaccccgtggaggtgagcagacacctgagcaagctgttcgacagcctgtgcaagctgaagttcagactggacgccagcgacaagcccctgaaggtgggcctgggcatgtacagcaaggaggacgagtacatggtgttcgaccaggagtgcgacctgagcggccaggtggaggtgtggctgaacagagtgctggacagaatgtgcagcaccctgagacacgagatccccgaggccgtggtgacctacgaggagaagcccagagagcagtggatcctggactaccccgcccagatctggtggaccaccgaggtgggcctggccttcgccagactggaggagggctacgagaacgccatcagagactacaacaagaagcagatcagccagctgaacgtgctgatcaccctgctgatgggcaacctgaacgccggcgacagaatgaagatcatgaccatctgcaccatcgacgtgcacgccagagacgtggtggccaagatgatcgtggagagcagccaggccttcacctggcaggcccagctgagacacagatgggacgaggagaagagacactgcttcgccaacatctgcgacgcccagatccagtacagctacgagtacctgggcaacacccccagactggtgatcacccccctgaccgacagatgctacatcaccctgacccagagcctgcacctgatcatgggcggcgcccccgccggccccgccggcaccggcaagaccgagaccaccaaggacctgggcagagccctgggcaccatggtgtacgtgttcaactgcagcgagcagatggactacaagagctgcggcaacatctacaagggcctggcccagaccggcgcctggggctgcttcgacgagttcaacagaatcagcgtggaggtgctgagcgtgatcgccgtgcaggtgaagtgcgtgcaggacgccatcagagccaagaagaaggccttcaacttcctgggcgagatcatcggcctgatccccaccgtgggcatcttcatcaccatgaaccccggctacgccggcagagccgagctgcccgagaacctgaaggccctgttcagaccctgcgccatggtggtgcccgacttcgagctgatctgcgagatcatgctgatggccgagggcttcctggaggccagactgctggccagaaagttcatcaccctgtacaccctgtgcaaggagctgctgagcaagcaggaccactacgactggggcctgagagccatcaagagcgtgctggtggtggccggcagcctgaagagaggcgaccccagcagagccgaggaccaggtgctgatgagagccctgagagacttcaacatccccaagatcgtgaccgacgacctgcccgtgttcatgggcctgatcggcgacctgttccccgccctggacgtgcccagaaagagagacctgaacttcgagaagatcatcaagcagagcatcgtggagctgaagctgcaggccgaggacagcttcgtgctgaaggtggtgcagctggaggagctgctgcaggtgagacacagcgtgttcatcgtgggcaacgccggcagcggcaagagccaggtgctgaagagcctgaacaagacctaccagaacctgaagagaaagcccgtggccgtggacctggaccccaaggccgtgacctgcgacgagctgttcggcatcatcaaccccgtgaccagagagtggaaggacggcctgttcagcaccatcatgagagacctggccaacatcacccacgacggccccaagtggatcatcctggacggcgacatcgaccccatgtggatcgagagcctgaacaccgtgatggacgacaacaaggtgctgaccctggccagcaacgagagaatccccctgaacagaaccatgagactggtgttcgagatcagccacctgagaaccgccacccccgccaccgtgagcagagccggcatcctgtacatcaaccccgccgacctgggctggaaccccgtggtgagcagctggatcgagagaagaaaggtgcagagcgagaaggccaacctgatgatcctgttcgacaagtacctgcccacctgcctggacaagctgagattcggcttcaagaagatcacccccgtgcccgagatcaccgtgatccagaccatcctgtacctgctggagtgcctgctgaccgagaagaccgtgccccccgacagccccagagagctgtacgagctgtacttcgtgttcacctgcttctgggccttcggcggcgccatgttccaggaccagctggtggactacagagtggagttcagcaagtggtggatcaacgagttcaagaccatcaagttccccagccagggcaccatcttcgactactacatcgaccccgacaccaagaagttcctgccctggaccgacaaggtgcccagcttcgagctggaccccgacgtgcccctgcaggccagcctggtgcacaccaccgagaccatcagaatcagatacttcatggacctgctgatggagaagagctggcccgtgatgctggtgggcaacgccggcaccggcaagagcgtgctgatgggcgacaagctggagagcctgaacaccgacaactacctggtgcaggccgtgcccttcaacttctacaccaccagcgccatgctgcagggcgtgctggagaagcccctggagaagaagagcggcagaaactacggcccccccggcaccaagaagctggtgtacttcatcgacgacatgaacatgcccgaggtggacaagtacggcaccgtggccccccacaccctgatcagacagcacatggaccacagacactggtacgacagacacaagctgaccctgaaggacatccacaactgccagtacgtggcctgcatgaaccccaccagcggcagcttcaccatcgacagcagactgcagagacacttctgcgtgttcgccgtgagcttccccggccaggaggccctgaccaccatctacaacaccatcctgacccagcacctggccttcagaagcgtgagcatggccatccagagaatcagcagccagctggtggccgccgccctggccctgcaccagaagatcaccgccaccttcctgcccaccgccatcaagttccactacgtgttcaacctgagagacctgagcaacatcttccagggcctgctgttcagcaccgccgaggtgctgaagacccccctggacctggtgagactgtggctgcacgagaccgagagagtgtacggcgacaagatggtggacgagaaggaccaggagaccctgcacagagtgaccatggccagcaccaagaagttcttcgacgacctgggcgacgagctgctgttcgccaagcccaacatcttctgccacttcgcccagggcatcggcgaccccaagtacgtgcccgtgaccgacatggcccccctgaacaagctgctggtggacgtgctggacagctacaacgaggtgaacgccgtgatgaacctggtgctgttcgaggacgccgtggcccacatctgcagaatcaacagaatcctggagagccccagaggcaacgccctgctggtgggcgtgggcggcagcggcaagcagagcctgagcagactggccgcctacatcagcggcctggacgtgttccagatcaccctgaagaagggctacggcatccccgacctgaagatcgacctggccgcccagtacatcaaggccgccgtgaagaacgtgcccagcgtgttcctgatgaccgacagccaggtggccgaggagcagttcctggtgctgatcaacgacctgctggccagcggcgagatccccggcctgttcatggaggacgaggtggagaacatcatcagcagcatgagaccccaggtgaagagcctgggcatgaacgacaccagagagacctgctggaagttcttcatcgagaaggtgagaagacagctgaaggtgatcctgtgcttcagccccgtgggcagcgtgctgagagtgagagccagaaagttccccgccgtggtgaactgcaccgccatcgactggttccacgagtggcccgaggacgccctggtgagcgtgagcgccagattcctggaggagaccgagggcatcccctgggaggtgaaggccagcatcagcttcttcatgagctacgtgcacaccaccgtgaacgagatgagcagagtgtacctggccaccgagagaagatacaactacaccacccccaagaccttcctggagcagatcaagctgtaccagaacctgctggccaagaagagaaccgagctggtggccaagatcgagagactggagaacggcctgatgaagctgcagagcaccgccagccaggtggacgacctgaaggccaagctggccatccaggaggccgagctgaagcagaagaacgagagcgccgaccagctgatccaggtggtgggcatcgaggccgagaaggtgagcaaggagaaggccatcgccgaccaggaggaggtgaaggtggaggtgatcaacaagaacgtgaccgagaagcagaaggcctgcgagaccgacctggccaaggccgagcccgccctgctggccgcccaggaggccctggacaccctgaacaagaacaacctgaccgagctgaagagcttcggcagcccccccgacgccgtggtgaacgtgaccgccgccgtgatgatcctgaccgcccccggcggcaagatccccaaggacaagagctggaaggccgccaagatcatgatgggcaaggtggacaccttcctggacagcctgaagaagttcgacaaggagcacatccccgaggcctgcctgaaggccttcaagccctaccagggcaaccccaccttcgaccccgagttcatcagaagcaagagcaccgccgccgccggcctgtgcagctggtgcatcaacatcgtgagattctacgaggtgtactgcgacgtggcccccaagagacaggccctggaggaggccaacgccgagctggccgaggcccaggagaagctgagcagaatcaagaacaagatcgccgagctgaacgccaacctgagcaacctgaccagcgccttcgagaaggccaccgccgagaagatcaagtgccagcaggaggccgacgccaccaacagagtgatcctgctggccaacagactggtgggcggcctggccagcgagaacatcagatgggccgagagcgtggagaacttcagaagccagggcgtgaccctgtgcggcgacgtgctgctgatcagcgccttcgtgagctacgtgggctacttcaccaagaagtacagaaacgagctgatggagaagttctggatcccctacatccacaacctgaaggtgcccatccccatcaccaacggcctggaccccctgagcctgctgaccgacgacgccgacgtggccacctggaacaaccagggcctgcccagcgacagaatgagcaccgagaacgccaccatcctgggcaacaccgagagatggcccctgatcgtggacgcccagctgcagggcatcaagtggatcaagaacaagtacagaagcgagctgaaggccatcagactgggccagaagagctacctggacgtgatcgagcaggccatcagcgagggcgacaccctgctgatcgagaacatcggcgagaccgtggaccccgtgctggaccccctgctgggcagaaacaccatcaagaagggcaagtacatcaagatcggcgacaaggaggtggagtaccaccccaagttcagactgatcctgcacaccaagtacttcaacccccactacaagcccgagatgcaggcccagtgcaccctgatcaacttcctggtgaccagagacggcctggaggaccagctgctggccgccgtggtggccaaggagagacccgacctggagcagctgaaggccaacctgaccaagagccagaacgagttcaagatcgtgctgaaggagctggaggacagcctgctggccagactgagcgccgccagcggcaacttcctgggcgacaccgccctggtggagaacctggagaccaccaagcacaccgccagcgagatcgaggagaaggtggtggaggccaagatcaccgaggtgaagatcaacgaggccagagagaactacagacccgccgccgagagagccagcctgctgtacttcatcctgaacgacctgaacaagatcaaccccgtgtaccagttcagcctgaaggccttcaacgtggtgttcgagaaggccatccagagaaccacccccgccaacgaggtgaagcagagagtgatcaacctgaccgacgagatcacctacagcgtgtacatgtacaccgccagaggcctgttcgagagagacaagctgatcttcctggcccaggtgaccttccaggtgctgagcatgaagaaggagctgaaccccgtggagctggacttcctgctgagattccccttcaaggccggcgtggtgagccccgtggacttcctgcagcaccagggctggggcggcatcaaggccctgagcgagatggacgagttcaagaacctggacagcgacatcgagggcagcgccaagagatggaagaagctggtggagagcgaggcccccgagaaggagatcttccccaaggagtggaagaacaagaccgccctgcagaagctgtgcatggtgagatgcctgagacccgacagaatgacctacgccatcaagaacttcgtggaggagaagatgggcagcaagttcgtggagggcagaagcgtggagttcagcaagagctacgaggagagcagccccagcaccagcatcttcttcatcctgagccccggcgtggaccccctgaaggacgtggaggccctgggcaagaagctgggcttcaccatcgacaacggcaagctgcacaacgtgagcctgggccagggccaggaggtggtggccgagaacgccctggacgtggccgccgagaagggccactgggtgatcctgcaggtgagaggcggccagcactgcagaaacatccacctggtggccagatggctgggcaccctggacaagaagctggagcactacagcaccggcagccacgaggactacagagtgttcatcagcgccgagcccgcccccagccccgagacccacatcatcccccagggcatcctggagaacgccatcaagatcaccaacgagccccccaccggcatgcacgccaacctgcacaaggccctggacctgttcacccaggacaccctggagatgtgcaccaaggagatggagttcaagtgcatgctgttcgccctgtgctacttccacgccgtggtggccgagagaagaaagttcggcgcccagggctggaacagaagctaccccttcaacaacggcgacctgaccatcagcatcaacgtgctgtacaactacctggaggccaaccccaaggtgccctgggacgacctgagatacctgttcggcgagatcatgtacggcggccacatcaccgacgactgggacagaagactgtgcagaacctacctggccgagtacatcagaaccgagatgctggagggcgacgtgctgctggcccccggcttccagatcccccccaacctggactacaagggctaccacgagtacatcgacgagaacctgccccccgagagcccctacctgtacggcctgcaccccaacgccgagatcggcttcctgaccgtgaccagcgagaagctgttcagaaccgtgctggagatgcagcccaaggagaccgacagcggcgccggcaccggcgtgagcagagaggagaaggccggcagcctgaagctgctgcccagcgagagaaagggcgaggacctggagctgagaagaggcggctgccccggcaccggcttccaggtgaaggccgtgctggacgacatcctggagaagatccccgagaccttcaacatggccgagatcatggccaaggccgccgagaagaccccctacgtggtggtggccttccaggagtgcgagagaatgaacatcctgaccaacgagatgagaagaagcctgaaggagctgaacctgggcctgaagggcgagctgaccatcaccaccgacgtggaggacctgagcaccgccctgttctacgacaccgtgcccgacacctgggtggccagagcctaccccagcatgatgggcctggccgcctggtacgccgacctgctgctgagaatcagagagctggaggcctggaccaccgacttcgccctgcccaccaccgtgtggctggccggcttcttcaacccccagagcttcctgaccgccatcatgcagagcatggccagaaagaacgagtggcccctggacaagatgtgcctgagcgtggaggtgaccaagaagaacagagaggacatgaccgccccccccagagagggcagctacgtgtacggcctgttcatggagggcgccagatgggacacccagaccggcgtgatcgccgaggccagactgaaggagctgacccccgccatgcccgtgatcttcatcaaggccatccccgtggacagaatggagaccaagaacatctacgagtgccccgtgtacaagaccagaatcagaggccccacctacgtgtggaccttcaacctgaagaccaaggagaaggccgccaagtggatcctggccgccgtggccctgctgctgcaggtgtag

SEQ ID NO: 20618 - DNA, 1545 bp, Artificial Sequence
  Description of Artificial Sequence: Synthetic coding sequence
atggccgacgccgaggtgatcatcctgcccaagaagcacaagaagaagaaggagagaaagagcctgcccgaggaggacgtggccgagatccagcacgccgaggagttcctgatcaagcccgagagcaaggtggccaagctggacaccagccagtggcccctgctgctgaagaacttcgacaagctgaacgtgagaaccacccactacacccccctggcctgcggcagcaaccccctgaagagagagatcggcgactacatcagaaccggcttcatcaacctggacaagcccagcaaccccagcagccacgaggtggtggcctggatcagaagaatcctgagagtggagaagaccggccacagcggcaccctggaccccaaggtgaccggctgcctgatcgtgtgcatcgagagagccaccagactggtgaagagccagcagagcgccggcaaggagtacgtgggcatcgtgagactgcacaacgccatcgagggcggcacccagctgagcagagccctggagaccctgaccggcgccctgttccagagaccccccctgatcgccgccgtgaagagacagctgagagtgagaaccatctacgagagcaagatgatcgagtacgaccccgagagaagactgggcatcttctgggtgagctgcgaggccggcacctacatcagaaccctgtgcgtgcacctgggcctgctgctgggcgtgggcggccagatgcaggagctgagaagagtgagaagcggcgtgatgagcgagaaggaccacatggtgaccatgcacgacgtgctggacgcccagtggctgtacgacaaccacaaggacgagagctacctgagaagagtggtgtaccccctggagaagctgctgaccagccacaagagactggtgatgaaggacagcgccgtgaacgccatctgctacggcgccaagatcatgctgcccggcgtgctgagatacgaggacggcatcgaggtgaaccaggagatcgtggtgatcaccaccaagggcgaggccatctgcatggccatcgccctgatgaccaccgccgtgatcagcacctgcgaccacggcatcgtggccaagatcaagagagtgatcatggagagagacacctaccccagaaagtggggcctgggccccaaggccagccagaagaagctgatgatcaagcagggcctgctggacaagcacggcaagcccaccgacagcacccccgccacctggaagcaggagtacgtggactacagcgagagcgccaagaaggaggtggtggccgaggtggtgaaggccccccaggtggtggccgaggccgccaagaccgccaagagaaagagagagagcgagagcgagagcgacgagaccccccccgccgccccccagctgatcaagaaggagaagaagaagagcaagaaggacaagaaggccaaggccggcctggagagcggcgccgagcccggcgacggcgacagcgacaccaccaagaagaagaagaagaagaagaaggccaaggaggtggagctggtgagcgagtag

SEQ ID NO: 20619 - DNA, 13125 bp, Artificial Sequence
  Description of Artificial Sequence: Synthetic coding sequence
atgaaggtggacagaaccaagctgaagaagacccccaccgaggcccccgccgactgcagagccctgatcgacaagctgaaggtgtgcaacgacgagcagctgctgctggagctgcagcagatcaagacctggaacatcggcaagtgcgagctgtaccactgggtggacctgctggacagattcgacggcatcctggccgacgccggccagaccgtggagaacatgagctggatgctggtgtgcgacagacccgagagagagcagctgaagatgctgctgctggccgtgctgaacttcaccgccctgctgatcgagtacagcttcagcagacacctgtacagcagcatcgagcacctgaccaccctgctggccagcagcgacatgcaggtggtgctggccgtgctgaacctgctgtacgtgttcagcaagagaagcaactacatcaccagactgggcagcgacaagagaacccccctgctgaccagactgcagcacctggccgagagctggggcggcaaggagaacggcttcggcctggccgagtgctgcagagacctgcacatgatgaagtacccccccagcgccaccaccctgcacttcgagttctacgccgaccccggcgccgaggtgaagatcgagaagagaaccaccagcaacaccctgcactacatccacatcgagcagctggacaagatcagcgagagccccagcgagatcatggagagcctgaccaagatgtacagcatccccaaggacaagcagatgctgctgttcacccacatcagactggcccacggcttcagcaaccacagaaagagactgcaggccgtgcaggccagactgcacgccatcagcatcctggtgtacagcaacgccctgcaggagagcgccaacagcatcctgtacaacggcctgatcgaggagctggtggacgtgctgcagatcaccgacaagcagctgatggagatcaaggccgccagcctgagaaccctgaccagcatcgtgcacctggagagaacccccaagctgagcagcatcatcgactgcaccggcaccgccagctaccacggcttcctgcccgtgctggtgagaaactgcatccaggccatgatcgaccccagcatggacccctacccccaccagttcgccaccgccctgttcagcttcctgtaccacctggccagctacgacgccggcggcgaggccctggtgagctgcggcatgatggaggccctgctgaaggtgatcaagttcctgggcgacgagcaggaccagatcaccttcgtgaccagagccgtgagagtggtggacctgatcaccaacctggacatggccgccttccagagccacagcggcctgagcatcttcatctacagactggagcacgaggtggacctgtgcagaaaggagtgccccttcgtgatcaagcccaagatccagagacccaacaccacccaggagggcgaggagatggagaccgacatggacggcgtgcagtgcatcccccagagagccgccctgctgaagagcatgctgaacttcctgaagaaggccatccaggaccccgccttcagcgacggcatcagacacgtgatggacggcagcctgcccaccagcctgaagcacatcatcagcaacgccgagtactacggccccagcctgttcctgctggccaccgaggtggtgaccgtgttcgtgttccaggagcccagcctgctgagcagcctgcaggacaacggcctgaccgacgtgatgctgcacgccctgctgatcaaggacgtgcccgccaccagagaggtgctgggcagcctgcccaacgtgttcagcgccctgtgcctgaacgccagaggcctgcagagcttcgtgcagtgccagcccttcgagagactgttcaaggtgctgctgagccccgactacctgcccgccatgagaagaagaagaagcagcgaccccctgggcgacaccgccagcaacctgggcagcgccgtggacgagctgatgagacaccagcccaccctgaagaccgacgccaccaccgccatcatcaagctgctggaggagatctgcaacctgggcagagaccccaagtacatctgccagaagcccagcatccagaaggccgacggcaccgccaccgcccccccccccagaagcaaccacgccgccgaggaggccagcagcgaggacgaggaggaggaggaggtgcaggccatgcagagcttcaacagcacccagcagaacgagaccgagcccaaccagcaggtggtgggcaccgaggagagaatccccatccccctgatggactacatcctgaacgtgatgaagttcgtggagagcatcctgagcaacaacaccaccgacgaccactgccaggagttcgtgaaccagaagggcctgctgcccctggtgaccatcctgggcctgcccaacctgcccatcgacttccccaccagcgccgcctgccaggccgtggccggcgtgtgcaagagcatcctgaccctgagccacgagcccaaggtgctgcaggagggcctgctgcagctggacagcatcctgagcagcctggagcccctgcacagacccatcgagagccccggcggcagcgtgctgctgagagagctggcctgcgccggcaacgtggccgacgccaccctgagcgcccaggccacccccctgctgcacgccctgaccgccgcccacgcctacatcatgatgttcgtgcacacctgcagagtgggccagagcgagatcagaagcatcagcgtgaaccagtggggcagccagctgggcctgagcgtgctgagcaagctgagccagctgtactgcagcctggtgtgggagagcaccgtgctgctgagcctgtgcacccccaacagcctgcccagcggctgcgagttcggccaggccgacatgcagaagctggtgcccaaggacgagaaggccggcaccacccagggcggcaagagaagcgacggcgagcaggacggcgccgccggcagcatggacgccagcacccagggcctgctggagggcatcggcctggacggcgacaccctggcccccatggagaccgacgagcccaccgccagcgacagcaagggcaagagcaagatcacccccgccatggccgccagaatcaagcagatcaagcccctgctgagcgccagcagcagactgggcagagccctggccgagctgttcggcctgctggtgaagctgtgcgtgggcagccccgtgagacagagaagaagccaccacgccgccagcaccaccaccgcccccacccccgccgccagaagcaccgccagcgccctgaccaagctgctgaccaagggcctgagctggcagccccccccctacacccccacccccagattcagactgaccttcttcatctgcagcgtgggcttcaccagccccatgctgttcgacgagagaaagtacccctaccacctgatgctgcagaagttcctgtgcagcggcggccacaacgccctgttcgagaccttcaactgggccctgagcatgggcggcaaggtgcccgtgagcgagggcctggagcacagcgacctgcccgacggcaccggcgagttcctggacgcctggctgatgctggtggagaagatggtgaaccccaccaccgtgctggagagcccccacagcctgcccgccaagctgcccggcggcgtgcagaacttcccccagttcagcgccctgagattcctggtggtgacccagaaggccgccttcacctgcatcaagaacctgtggaacagaaagcccctgaaggtgtacggcggcagaatggccgagagcatgctggccatcctgtgccacatcctgagaggcgagcccgtgatcagagagagactgagcaaggagaaggagggcagcagaggcgaggaggacaccggccaggaggagggcggcagcagaagagagccccaggtgaaccagcagcagctgcagcagctgatggacatgggcttcaccagagagcacgccatggaggccctgctgaacaccagcaccatggagcaggccaccgagtacctgctgacccaccccccccccatcatgggcggcgtggtgagagacctgagcatgagcgaggaggaccagatgatgagagccatcgccatgagcctgggccaggacatccccatggaccagagagccgagagccccgaggaggtggcctgcagaaaggaggaggaggagagaaaggccagagagaagcaggaggaggaggaggccaagtgcctggagaagttccaggacgccgaccccctggagcaggacgagctgcacaccttcaccgacaccatgctgcccggctgcttccacctgctggacgagctgcccgacaccgtgtacagagtgtgcgacctgatcatgaccgccatcaagagaaacggcgccgactacagagacatgatcctgaagcaggtggtgaaccaggtgtgggaggccgccgacgtgctgatcaaggccgccctgcccctgaccaccagcgacaccaagaccgtgagcgagtggatcagccagatggccaccctgccccaggccagcaacctggccaccagaatcctgctgctgaccctgctgttcgaggagctgaagctgccctgcgcctgggtggtggagagcagcggcatcctgaacgtgctgatcaagctgctggaggtggtgcagccctgcctgcaggccgccaaggagcagaaggaggtgcagacccccaagtggatcacccccgtgctgctgctgatcgacttctacgagaagaccgccatcagcagcaagagaagagcccagatgaccaagtacctgcagagcaacagcaacaactggagatggttcgacgacagaagcggcagatggtgcagctacagcgccagcaacaacagcaccatcgacagcgcctggaagagcggcgagaccagcgtgagattcaccgccggcagaagaagatacaccgtgcagttcaccaccatggtgcaggtgaacgaggagaccggcaacagaagacccgtgatgctgaccctgctgagagtgcccagactgaacaagaacagcaagaacagcaacggccaggagctggagaagaccctggaggagagcaaggagatggacatcaagagaaaggagaacaagggcaacgacacccccctggccctggagagcaccaacaccgagaaggagaccagcctggaggagaccaagatcggcgagatcctgatccagggcctgaccgaggacatggtgaccgtgctgatcagagcctgcgtgagcatgctgggcgtgcccgtggaccccgacaccctgcacgccaccctgagactgtgcctgagactgaccagagaccacaagtacgccatgatgttcgccgagctgaagagcaccagaatgatcctgaacctgacccagagcagcggcttcaacggcttcacccccctggtgaccctgctgctgagacacatcatcgaggacccctgcaccctgagacacaccatggagaaggtggtgagaagcgccgccaccagcggcgccggcagcaccaccagcggcgtggtgagcggcagcctgggcagcagagagatcaactacatcctgagagtgctgggccccgccgcctgcagaaaccccgacatcttcaccgaggtggccaactgctgcatcagaatcgccctgcccgcccccagaggcagcggcaccgccagcgacgacgagttcgagaacctgagaatcaagggccccaacgccgtgcagctggtgaagaccacccccctgaagcccagccccctgcccgtgatccccgacaccatcaaggaggtgatctacgacatgctgaacgccctggccgcctaccacgcccccgaggaggccgacaagagcgaccccaagcccggcgtgatgacccaggaggtgggccagctgctgcaggacatgggcgacgacgtgtaccagcagtacagaagcctgaccagacagagcagcgacttcgacacccagagcggcttcagcatcaacagccaggtgttcgccgccgacggcgccagcaccgagaccagcgccagcggcaccagccagggcgaggccagcacccccgaggagagcagagacggcaagaaggacaaggagggcgacagagccagcgaggagggcaagcagaagggcaagggcagcaagcccctgatgcccaccagcaccatcctgagactgctggccgagctggtgagaagctacgtgggcatcgccaccctgatcgccaactacagctacaccgtgggccagagcgagctgatcaaggaggactgcagcgtgctggccttcgtgctggaccacctgctgccccacacccagaacgccgaggacaaggacacccccgccctggccagactgttcctggccagcctggccgccgccggcagcggcaccgacgcccaggtggccctggtgaacgaggtgaaggccgccctgggcagagccctggccatggccgagagcaccgagaagcacgccagactgcaggccgtgatgtgcatcatcagcaccatcatggagagctgccccagcaccagcagcttctacagcagcgccaccgccaagacccagcacaacggcatgaacaacatcatcagactgttcctgaagaagggcctggtgaacgacctggccagagtgccccacagcctggacctgagcagccccaacatggccaacaccgtgaacgccgccctgaagcccctggagaccctgagcagaatcgtgaaccagcccagcagcctgttcggcagcaagagcgccagcagcaagaacaagagcgagcaggacgcccagggcgccagccaggacagcagcagcaaccagcaggaccccggcgagcccggcgaggccgaggtgcaggaggaggaccacgacgtgacccagaccgaggtggccgacggcgacatcatggacggcgaggccgagaccgacagcgtggtgatcgccggccagcccgaggtgctgagcagccaggagatgcaggtggagaacgagctggaggacctgatcgacgagctgctggagagagacggcggcagcggcaacagcaccatcatcgtgagcagaagcggcgaggacgagagccaggaggacgtgctgatggacgaggcccccagcaacctgagccaggccagcaccctgcaggccaacagagaggacagcatgaacatcctggaccccgaggacgaggaggagcacacccaggaggaggacagcagcggcagcaacgaggacgaggacgacagccaggacgaggaggaggaggaggaggaggacgaggaggacgaccaggaggacgacgagggcgaggagggcgacgaggacgacgacgacgacggcagcgagatggagctggacgaggactaccccgacatgaacgccagccccctggtgagattcgagagattcgacagagaggacgacctgatcatcgagttcgacaacatgttcagcagcgccaccgacatcccccccagccccggcaacatccccaccacccaccccctgatggtgagacacgccgaccacagcagcctgaccctgggcagcggcagcagcaccaccagactgacccagggcatcggcagaagccagagaaccctgagacagctgaccgccaacaccggccacaccatccacgtgcactaccccggcaacagacagcccaacccccccctgatcctgcagagactgctgggccccagcgccgccgccgacatcctgcagctgagcagcagcctgcccctgcagagcagaggcagagccagactgctggtgggcaacgacgacgtgcacatcatcgccagaagcgacgacgagctgctggacgacttcttccacgaccagagcaccgccaccagccaggccggcaccctgagcagcatccccaccgccctgaccagatggaccgaggagtgcaaggtgctggacgccgagagcatgcacgactgcgtgagcgtggtgaaggtgagcatcgtgaaccacctggagttcctgagagacgaggagctggaggagagaagagagaagagaagaaagcagctggccgaggaggagaccaagatcaccgacaagggcaaggaggacaaggagaacagagaccagagcgcccagtgcaccgccagcaagagcaacgacagcaccgagcagaacctgagcgacggcacccccatgcccgacagctaccccaccacccccagcagcaccgacgccgccaccagcgagagcaaggagaccctgggcaccctgcagagcagccagcagcagcccaccctgcccaccccccccgccctgggcgaggtgccccaggagctgcagagccccgccggcgagggcggcagcagcacccagctgctgatgcccgtggagcccgaggagctgggccccaccagacccagcggcgaggccgagaccacccagatggagctgagccccgcccccaccatcaccagcctgagccccgagagagccgaggacagcgacgccctgaccgccgtgagcagccagctggagggcagccccatggacaccagcagcctggccagctgcaccctggaggaggccgtgggcgacaccagcgccgccggcagcagcgagcagcccagagccggcagcagcacccccggcgacgccccccccgccgtggccgaggtgcagggcagaagcgacggcagcggcgagagcgcccagccccccgaggacagcagcccccccgccagcagcgagagcagcagcaccagagacagcgccgtggccatcagcggcgccgacagcagaggcatcctggaggagcccctgcccagcaccagcagcgaggaggaggaccccctggccggcatcagcctgcccgagggcgtggaccccagcttcctggccgccctgcccgacgacatcagaagagaggtgctgcagaaccagctgggcatcagaccccccaccagaaccgcccccagcaccaacagcagcgcccccgccgtggtgggcaaccccggcgtgaccgaggtgagccccgagttcctggccgccctgccccccgccatccaggaggaggtgctggcccagcagagagccgagcagcagagaagagagctggcccagaacgccagcagcgacacccccatggaccccgtgaccttcatccagaccctgcccagcgacctgagaagaagcgtgctggaggacatggaggacagcgtgctggccgtgatgccccccgacatcgccgccgaggcccaggccctgagaagagagcaggaggccagacagagacagctgatgcacgagagactgttcggccacagcagcaccagcgccctgagcgccatcctgagaagccccgccttcaccagcagactgagcggcaacagaggcgtgcagtacaccagactggccgtgcagagaggcggcaccttccagatgggcggcagcagcagccacaacagacccagcggcagcaacgtggacaccctgctgagactgagaggcagactgctgctggaccacgaggccctgagctgcctgctggtgctgctgttcgtggacgagcccaagctgaacaccagcagactgcacagagtgctgagaaacctgtgctaccacgcccagaccagacactgggtgatcagaagcctgctgagcatcctgcagagaagcagcgagagcgagctgtgcatcgagacccccaagctgaccaccagcgaggagaagggcaagaagagcagcaagagctgcggcagcagcagccacgagaacagacccctggacctgctgcacaagatggagagcaagagcagcaaccagctgagctggctgagcgtgagcatggacgccgccctgggctgcagaaccaacatcttccagatccagagaagcggcggcagaaagcacaccgagaagcacgccagcggcggcagcaccgtgcacatccacccccaggccgcccccgtggtgtgcagacacgtgctggacaccctgatccagctggccaaggtgttccccagccacttcacccagcagagaaccaaggagaccaactgcgagagcgacagagagagaggcaacaaggcctgcagcccctgcagcagccagagcagcagcagcggcatctgcaccgacttctgggacctgctggtgaagctggacaacatgaacgtgagcagaaagggcaagaacagcgtgaagagcgtgcccgtgagcgccggcggcgagggcgagaccagcccctacagcctggaggccagccccctgggccagctgatgaacatgctgagccaccccgtgatcagaagaagcagcctgctgaccgagaagctgctgagactgctgagcctgatcagcatcgccctgcccgagaacaaggtgagcgaggcccaggccaacagcggcagcggcgccagcagcaccaccaccgccaccagcaccaccagcaccaccaccaccaccgccgccagcaccacccccaccccccccaccgcccccacccccgtgaccagcgcccccgccctggtggccgccaccgccatcagcaccatcgtggtggccgccagcaccaccgtgaccacccccaccaccgccaccaccaccgtgagcatcagccccaccaccaagggcagcaagagccccgccaaggtgagcgacggcggcagcagcagcaccgacttcaagatggtgagcagcggcctgaccgagaaccagctgcagctgagcgtggaggtgctgaccagccacagctgcagcgaggagggcctggaggacgccgccaacgtgctgctgcagctgagcagaggcgacagcggcaccagagacaccgtgctgaagctgctgctgaacggcgccagacacctgggctacaccctgtgcaagcagatcggcaccctgctggccgagctgagagagtacaacctggagcagcagagaagagcccagtgcgagaccctgagccccgacggcctgcccgaggagcagccccagaccaccaagctgaagggcaagatgcagagcagattcgacatggccgagaacgtggtgatcgtggccagccagaagagacccctgggcggcagagagctgcagctgcccagcatgagcatgctgaccagcaagaccagcacccagaagttcttcctgagagtgctgcaggtgatcatccagctgagagacgacaccagaagagccaacaagaaggccaagcagaccggcagactgggcagcagcggcctgggcagcgccagcagcatccaggccgccgtgagacagctggaggccgaggccgacgccatcatccagatggtgagagagggccagagagccagaagacagcagcaggccgccaccagcgagagcagccagagcgaggccagcgtgagaagagaggagagccccatggacgtggaccagcccagccccagcgcccaggacacccagagcatcgccagcgacggcaccccccagggcgagaaggagaaggaggagagaccccccgagctgcccctgctgagcgagcagctgagcctggacgagctgtgggacatgctgggcgagtgcctgaaggagctggaggagagccacgaccagcacgccgtgctggtgctgcagcccgccgtggaggccttcttcctggtgcacgccaccgagagagagagcaagccccccgtgagagacaccagagagagccagctggcccacatcaaggacgagcccccccccctgagccccgcccccctgacccccgccacccccagcagcctggaccccttcttcagcagagagcccagcagcatgcacatcagcagcagcctgccccccgacacccagaagttcctgagattcgccgagacccacagaaccgtgctgaaccagatcctgagacagagcaccacccacctggccgacggccccttcgccgtgctggtggactacatcagagtgctggacttcgacgtgaagagaaagtacttcagacaggagctggagagactggacgagggcctgagaaaggaggacatggccgtgcacgtgagaagagaccacgtgttcgaggacagctacagagagctgcacagaaagagccccgaggagatgaagaacagactgtacatcgtgttcgagggcgaggagggccaggacgccggcggcctgctgagagagtggtacatgatcatcagcagagagatgttcaaccccatgtacgccctgttcagaaccagccccggcgacagagtgacctacaccatcaaccccagcagccactgcaaccccaaccacctgagctacttcaagttcgtgggcagaatcgtggccaaggccgtgtacgacaacagactgctggagtgctacttcaccagaagcttctacaagcacatcctgggcaagagcgtgagatacaccgacatggagagcgaggactaccacttctaccagggcctggtgtacctgctggagaacgacgtgagcaccctgggctacgacctgaccttcagcaccgaggtgcaggagttcggcgtgtgcgaggtgagagacctgaagcccaacggcgccaacatcctggtgaccgaggagaacaagaaggagtacgtgcacctggtgtgccagatgagaatgaccggcgccatcagaaagcagctggccgccttcctggagggcttctacgagatcatccccaagagactgatcagcatcttcaccgagcaggagctggagctgctgatcagcggcctgcccaccatcgacatcgacgacctgaagagcaacaccgagtaccacaagtaccagagcaacagcatccagatccagtggttctggagagccctgagaagcttcgaccaggccgacagagccaagttcctgcagttcgtgaccggcaccagcaaggtgcccctgcagggcttcgccgccctggagggcatgaacggcatccagaagttccagatccacagagacgacagaagcaccgacagactgcccagcgcccacacctgcttcaaccagctggacctgcccgcctacgagagcttcgagaagctgagacacatgctgctgctggccatccaggagtgcagcgagggcttcggcctggcctag

SEQ ID NO: 20620 - DNA, 1746 bp, Artificial Sequence
  Description of Artificial Sequence: Synthetic coding sequence
atgaccagcgccgtggtggacagcggcggcaccatcctggagctgagcagcaacggcgtggagaaccaggaggagagcgagaaggtgagcgagtaccccgccgtgatcgtggagcccgtgcccagcgccagactggagcagggctacgccgcccaggtgctggtgtacgacgacgagacctacatgatgcaggacgtggccgaggagcaggaggtggagaccgagaacgtggagaccgtggaggccagcgtgcacagcagcaacgcccactgcaccgacaagaccatcgaggccgccgaggccctgctgcacatggagagccccacctgcctgagagacagcagaagccccgagttcatccacgccgccatgagacccgacgtgatcaccgagaccgtggtggaggtgagcaccgaggagagcgagcccatggacaccagccccatccccaccagccccgacagccacgagcccatgaagaagaagaaggtgggcagaaagcccaagacccagcagagccccatcagcaacggcagccccgagctgggcatcaagaagaagcccagagagggcaagggcaacaccacctacctgtgggagttcctgctggacctgctgcaggacaagaacacctgccccagatacatcaagtggacccagagagagaagggcatcttcaagctggtggacagcaaggccgtgagcaagctgtggggcaagcacaagaacaagcccgacatgaactacgagaccatgggcagagccctgagatactactaccagagaggcatcctggccaaggtggagggccagagactggtgtaccagttcaaggacatgcccaagaacatcgtggtgatcgacgacgacaagagcgagacctgcaacgaggacctggccggcaccaccgacgagaagagcctggagagagtgagcctgagcgccgagagcctgctgaaggccgccagcagcgtgagaagcggcaagaacagcagccccatcaactgcagcagagccgagaagggcgtggccagagtggtgaacatcaccagccccggccacgacgccagcagcagaagccccaccaccaccgccagcgtgagcgccaccgccgcccccagaaccgtgagagtggccatgcaggtgcccgtggtgatgaccagcctgggccagaagatcagcaccgtggccgtgcagagcgtgaacgccggcgcccccctgatcaccagcaccagccccaccaccgccaccagccccaaggtggtgatccagaccatccccaccgtgatgcccgccagcaccgagaacggcgacaagatcaccatgcagcccgccaagatcatcaccatccccgccacccagctggcccagtgccagctgcagaccaagagcaacctgaccggcagcggcagcatcaacatcgtgggcacccccctggccgtgagagccctgacccccgtgagcatcgcccacggcacccccgtgatgagactgagcatgcccacccagcaggccagcggccagaccccccccagagtgatcagcgccgtgatcaagggccccgaggtgaagagcgaggccgtggccaagaagcaggagcacgacgtgaagaccctgcagctggtggaggagaagcccgccgacggcaacaagaccgtgacccacgtggtggtggtgagcgcccccagcgccatcgccctgcccgtgaccatgaagaccgagggcctggtgacctgcgagaagtag

SEQ ID NO: 20621 - DNA, 1602 bp, Artificial Sequence
  Description of Artificial Sequence: Synthetic coding sequence
atggccaccagcctgcacgagggccccaccaaccagctggacctgctgatcagagccgtggaggccagcgtgcacagcagcaacgcccactgcaccgacaagaccatcgaggccgccgaggccctgctgcacatggagagccccacctgcctgagagacagcagaagccccgtggaggtgttcgtgcccccctgcgtgagcacccccgagttcatccacgccgccatgagacccgacgtgatcaccgagaccgtggtggaggtgagcaccgaggagagcgagcccatggacaccagccccatccccaccagccccgacagccacgagcccatgaagaagaagaaggtgggcagaaagcccaagacccagcagagccccatcagcaacggcagccccgagctgggcatcaagaagaagcccagagagggcaagggcaacaccacctacctgtgggagttcctgctggacctgctgcaggacaagaacacctgccccagatacatcaagtggacccagagagagaagggcatcttcaagctggtggacagcaaggccgtgagcaagctgtggggcaagcacaagaacaagcccgacatgaactacgagaccatgggcagagccctgagatactactaccagagaggcatcctggccaaggtggagggccagagactggtgtaccagttcaaggacatgcccaagaacatcgtggtgatcgacgacgacaagagcgagacctgcaacgaggacctggccggcaccaccgacgagaagagcctggagagagtgagcctgagcgccgagagcctgctgaaggccgccagcagcgtgagaagcggcaagaacagcagccccatcaactgcagcagagccgagaagggcgtggccagagtggtgaacatcaccagccccggccacgacgccagcagcagaagccccaccaccaccgccagcgtgagcgccaccgccgcccccagaaccgtgagagtggccatgcaggtgcccgtggtgatgaccagcctgggccagaagatcagcaccgtggccgtgcagagcgtgaacgccggcgcccccctgatcaccagcaccagccccaccaccgccaccagccccaaggtggtgatccagaccatccccaccgtgatgcccgccagcaccgagaacggcgacaagatcaccatgcagcccgccaagatcatcaccatccccgccacccagctggcccagtgccagctgcagaccaagagcaacctgaccggcagcggcagcatcaacatcgtgggcacccccctggccgtgagagccctgacccccgtgagcatcgcccacggcacccccgtgatgagactgagcatgcccacccagcaggccagcggccagaccccccccagagtgatcagcgccgtgatcaagggccccgaggtgaagagcgaggccgtggccaagaagcaggagcacgacgtgaagaccctgcagctggtggaggagaagcccgccgacggcaacaagaccgtgacccacgtggtggtggtgagcgcccccagcgccatcgccctgcccgtgaccatgaagaccgagggcctggtgacctgcgagaagtag

SEQ ID NO: 20622 - DNA, 1515 bp, Artificial Sequence
  Description of Artificial Sequence: Synthetic coding sequence
atggccaccagcctgcacgagggccccaccaaccagctggacctgctgatcagagccgtggaggccagcgtgcacagcagcaacgcccactgcaccgacaagaccatcgaggccgccgaggccctgctgcacatggagagccccacctgcctgagagacagcagaagccccgtggaggtgttcgtgcccccctgcgtgagcacccccgagttcatccacgccgccatgagacccgacgtgatcaccgagaccgtggtggaggtgagcaccgaggagagcgagcccatggacaccagccccatccccaccagccccgacagccacgagcccatgaagaagaagaagggcaacaccacctacctgtgggagttcctgctggacctgctgcaggacaagaacacctgccccagatacatcaagtggacccagagagagaagggcatcttcaagctggtggacagcaaggccgtgagcaagctgtggggcaagcacaagaacaagcccgacatgaactacgagaccatgggcagagccctgagatactactaccagagaggcatcctggccaaggtggagggccagagactggtgtaccagttcaaggacatgcccaagaacatcgtggtgatcgacgacgacaagagcgagacctgcaacgaggacctggccggcaccaccgacgagaagagcctggagagagtgagcctgagcgccgagagcctgctgaaggccgccagcagcgtgagaagcggcaagaacagcagccccatcaactgcagcagagccgagaagggcgtggccagagtggtgaacatcaccagccccggccacgacgccagcagcagaagccccaccaccaccgccagcgtgagcgccaccgccgcccccagaaccgtgagagtggccatgcaggtgcccgtggtgatgaccagcctgggccagaagatcagcaccgtggccgtgcagagcgtgaacgccggcgcccccctgatcaccagcaccagccccaccaccgccaccagccccaaggtggtgatccagaccatccccaccgtgatgcccgccagcaccgagaacggcgacaagatcaccatgcagcccgccaagatcatcaccatccccgccacccagctggcccagtgccagctgcagaccaagagcaacctgaccggcagcggcagcatcaacatcgtgggcacccccctggccgtgagagccctgacccccgtgagcatcgcccacggcacccccgtgatgagactgagcatgcccacccagcaggccagcggccagaccccccccagagtgatcagcgccgtgatcaagggccccgaggtgaagagcgaggccgtggccaagaagcaggagcacgacgtgaagaccctgcagctggtggaggagaagcccgccgacggcaacaagaccgtgacccacgtggtggtggtgagcgcccccagcgccatcgccctgcccgtgaccatgaagaccgagggcctggtgacctgcgagaagtag

SEQ ID NO: 20623 - DNA, 1782 bp, Artificial Sequence
  Description of Artificial Sequence: Synthetic coding sequence
atgaccagcgccgtggtggacagcggcggcaccatcctggagctgagcagcaacggcgtggagaaccaggaggagagcgagaaggtgagcgagtaccccgccgtgatcgtggagcccgtgcccagcgccagactggagcagggctacgccgcccaggtgctggtgtacgacgacgagacctacatgatgcaggacgtggccgaggagcaggaggtggagaccgagaacgtggagaccgtggaggccagcgtgcacagcagcaacgcccactgcaccgacaagaccatcgaggccgccgaggccctgctgcacatggagagccccacctgcctgagagacagcagaagccccgtggaggtgttcgtgcccccctgcgtgagcacccccgagttcatccacgccgccatgagacccgacgtgatcaccgagaccgtggtggaggtgagcaccgaggagagcgagcccatggacaccagccccatccccaccagccccgacagccacgagcccatgaagaagaagaaggtgggcagaaagcccaagacccagcagagccccatcagcaacggcagccccgagctgggcatcaagaagaagcccagagagggcaagggcaacaccacctacctgtgggagttcctgctggacctgctgcaggacaagaacacctgccccagatacatcaagtggacccagagagagaagggcatcttcaagctggtggacagcaaggccgtgagcaagctgtggggcaagcacaagaacaagcccgacatgaactacgagaccatgggcagagccctgagatactactaccagagaggcatcctggccaaggtggagggccagagactggtgtaccagttcaaggacatgcccaagaacatcgtggtgatcgacgacgacaagagcgagacctgcaacgaggacctggccggcaccaccgacgagaagagcctggagagagtgagcctgagcgccgagagcctgctgaaggccgccagcagcgtgagaagcggcaagaacagcagccccatcaactgcagcagagccgagaagggcgtggccagagtggtgaacatcaccagccccggccacgacgccagcagcagaagccccaccaccaccgccagcgtgagcgccaccgccgcccccagaaccgtgagagtggccatgcaggtgcccgtggtgatgaccagcctgggccagaagatcagcaccgtggccgtgcagagcgtgaacgccggcgcccccctgatcaccagcaccagccccaccaccgccaccagccccaaggtggtgatccagaccatccccaccgtgatgcccgccagcaccgagaacggcgacaagatcaccatgcagcccgccaagatcatcaccatccccgccacccagctggcccagtgccagctgcagaccaagagcaacctgaccggcagcggcagcatcaacatcgtgggcacccccctggccgtgagagccctgacccccgtgagcatcgcccacggcacccccgtgatgagactgagcatgcccacccagcaggccagcggccagaccccccccagagtgatcagcgccgtgatcaagggccccgaggtgaagagcgaggccgtggccaagaagcaggagcacgacgtgaagaccctgcagctggtggaggagaagcccgccgacggcaacaagaccgtgacccacgtggtggtggtgagcgcccccagcgccatcgccctgcccgtgaccatgaagaccgagggcctggtgacctgcgagaagtag

SEQ ID NO: 20624 - DNA, 1746 bp, Artificial Sequence; identical to SEQ ID NO: 20620
  Description of Artificial Sequence: Synthetic coding sequence

SEQ ID NO: 20625 - DNA, 1191 bp, Artificial Sequence
  Description of Artificial Sequence: Synthetic coding sequence
atgagcgtgatcgtgttcaagggcaacaccacctacctgtgggagttcctgctggacctgctgcaggacaagaacacctgccccagatacatcaagtggacccagagagagaagggcatcttcaagctggtggacagcaaggccgtgagcaagctgtggggcaagcacaagaacaagcccgacatgaactacgagaccatgggcagagccctgagatactactaccagagaggcatcctggccaaggtggagggccagagactggtgtaccagttcaaggacatgcccaagaacatcgtggtgatcgacgacgacaagagcgagacctgcaacgaggacctggccggcaccaccgacgagaagagcctggagagagtgagcctgagcgccgagagcctgctgaaggccgccagcagcgtgagaagcggcaagaacagcagccccatcaactgcagcagagccgagaagggcgtggccagagtggtgaacatcaccagccccggccacgacgccagcagcagaagccccaccaccaccgccagcgtgagcgccaccgccgcccccagaaccgtgagagtggccatgcaggtgcccgtggtgatgaccagcctgggccagaagatcagcaccgtggccgtgcagagcgtgaacgccggcgcccccctgatcaccagcaccagccccaccaccgccaccagccccaaggtggtgatccagaccatccccaccgtgatgcccgccagcaccgagaacggcgacaagatcaccatgcagcccgccaagatcatcaccatccccgccacccagctggcccagtgccagctgcagaccaagagcaacctgaccggcagcggcagcatcaacatcgtgggcacccccctggccgtgagagccctgacccccgtgagcatcgcccacggcacccccgtgatgagactgagcatgcccacccagcaggccagcggccagaccccccccagagtgatcagcgccgtgatcaagggccccgaggtgaagagcgaggccgtggccaagaagcaggagcacgacgtgaagaccctgcagctggtggaggagaagcccgccgacggcaacaagaccgtgacccacgtggtggtggtgagcgcccccagcgccatcgccctgcccgtgaccatgaagaccgagggcctggtgacctgcgagaagtag

SEQ ID NO: 20626 - DNA, 2385 bp, Artificial Sequence
  Description of Artificial Sequence: Synthetic coding sequence
atggccagccccaccctgagccccgacagcagcagccaggaggccctgagcgcccccacctgcagccccaccagcgacagcgagaacctgagccccgacgagctggagctgctggccaagctggaggagcagaacagactgctggaggccgacagcaagagcatgagaagcatgaacggcagcagaagaaacagcggcagcagcctggtgagcagcagcagcgccagcagcaacctgagccacctggaggaggacacctggatcctgtggggcagaatcgccaacgagtgggaggagtggagaagaagaaaggagaagctgctgaaggagctgatcagaaagggcatcccccaccacttcagagccatcgtgtggcagctgctgtgcagcgccaccgacatgcccgtgaagaaccagtacagcgagctgctgaagatgagcagcccctgcgagaagctgatcagaagagacatcgccagaacctaccccgagcacgagttcttcaagggccaggacagcctgggccaggaggtgctgttcaacgtgatgaaggcctacagcctggtggacagagaggtgggctactgccagggcagcgccttcatcgtgggcctgctgctgatgcagatgcccgaggaggaggccttctgcgtgttcgtgagactgatgcaggagtacagactgagagagctgttcaagcccagcatggccgagctgggcctgtgcatctaccagttcgagtacatgctgcaggagcagctgcccgacctgaacacccacttcagaagccagagcttccacaccagcatgtacgccagcagctggttcctgaccctgttcctgaccaccttccccctgcccgtggccaccagagtgttcgacatcttcatgtacgagggcctggagatcgtgttcagagtgggcctggccctgctgcaggtgaaccaggccgagctgatgcagctggacatggagggcatgagccagtacttccagagagtgatcccccaccagttcgacagctgccccgacaagctggtgctgaaggcctaccaggtgaagtacaaccccaagaagatgaagagactggagaaggagtacgccgccatgaagagcaaggagatggaggagcagatcgagatcaagagactgagaaccgagaacagactgctgaagcagagaatcgagaccctggagaagggccaggtgaccagagcccaggaggccgaggagaactacgtgatcaagagagagctggccgtggtgagacagcagtgcagcagcgccgccgaggacctgcagaaggcccagagcaccatcagacagctgcaggagcagcaggagaaccccagactgaccgaggacttcgtgagccacctggagaccgagctggagcagagcagactgagagagaccgagaccctgggcgccctgagagagatgcaggacaaggtgctggacatggagaagagaaacagcagcctgcccgacgagaacaacgtggcccagctgcaggaggagctgaaggccctgaaggtgagagagggccaggccgtggccagcaccagagagctgaagctgcagctgcaggagctgagcgacacctggcaggcccacctggccagaggcggcagatggaaggagagccccagaaagctggtggtgggcgagctgcaggacgagctgatgagcgtgagactgagagaggcccaggccctggccgagggcagagagctgagacagagagtggtggagctggagacccaggaccacatccacagaaacctgctgaacagagtggaggccgagagagccgccctgcaggagaagctgcagtacctggccgcccagaacaagggcctgcagacccagctgagcgagagcagaagaaagcaggccgaggccgagtgcaagagcaaggaggaggtgatggccgtgagactgagagaggccgacagcatggccgccgtggccgagatgagacagagaatcgccgagctggagatccagagagaggagggcagaatccagggccagctgaaccacagcgacagcagccagtacatcagagagctgaaggaccagatcgaggagctgaaggccgaggtgagactgctgaagggccccccccccttcgaggaccccctggccttcgacggcctgagcctggccagacacctggacgaggacagcctgcccagcagcgacgaggagctgctgggcgtgggcgtgggcgccgccctgcaggacgccctgtaccccctgagccccagagacgccagattcttcagaagactggagagacccgccaaggacagcgagggcagcagcgacagcgacgccgacgagctggccgccccctacagccagggcctggacaactag

SEQ ID NO: 20627 - DNA, 2418 bp, Artificial Sequence
  Description of Artificial Sequence: Synthetic coding sequence
atggccagccccaccctgagccccgacagcagcagccaggaggccctgagcgcccccacctgcagccccaccagcgacagcgagaacctgagccccgacgagctggagctgctggccaagctggaggagcagaacagactgctggaggccgacagcaagagcatgagaagcatgaacggcagcagaagaaacagcggcagcagcctggtgagcagcagcagcgccagcagcaacctgagccacctggaggaggacacctggatcctgtggggcagaatcgccaacgagtgggaggagtggagaagaagaaaggagaagctgctgaaggagctgatcagaaagggcatcccccaccacttcagagccatcgtgtggcagctgctgtgcagcgccaccgacatgcccgtgaagaaccagtacagcgagctgctgaagatgagcagcccctgcgagaagctgatcagaagagacatcgccagaacctaccccgagcacgagttcttcaagggccaggacagcctgggccaggaggtgctgttcaacgtgatgaaggcctacagcctggtggacagagaggtgggctactgccagggcagcgccttcatcgtgggcctgctgctgatgcagatgcccgaggaggaggccttctgcgtgttcgtgagactgatgcaggagtacagactgagagagctgttcaagcccagcatggccgagctgggcctgtgcatctaccagttcgagtacatgctgcaggagcagctgcccgacctgaacacccacttcagaagccagagcttccacaccagcatgtacgccagcagctggttcctgaccctgttcctgaccaccttccccctgcccgtggccaccagagtgttcgacatcttcatgtacgagggcctggagatcgtgttcagagtgggcctggccctgctgcaggtgaaccaggccgagctgatgcagctggacatggagggcatgagccagtacttccagagagtgatcccccaccagttcgacagctgccccgacaagctggtgctgaaggcctaccaggtgaagtacaaccccaagaagatgaagagactggagaaggagtacgccgccatgaagagcaaggagatggaggagcagatcgagatcaagagactgagaaccgagaacagactgctgaagcagagaatcgagaccctggagaaggagagcgccgccctggccgacagactgatccagggccaggtgaccagagcccaggaggccgaggagaactacgtgatcaagagagagctggccgtggtgagacagcagtgcagcagcgccgccgaggacctgcagaaggcccagagcaccatcagacagctgcaggagcagcaggagaaccccagactgaccgaggacttcgtgagccacctggagaccgagctggagcagagcagactgagagagaccgagaccctgggcgccctgagagagatgcaggacaaggtgctggacatggagaagagaaacagcagcctgcccgacgagaacaacgtggcccagctgcaggaggagctgaaggccctgaaggtgagagagggccaggccgtggccagcaccagagagctgaagctgcagctgcaggagctgagcgacacctggcaggcccacctggccagaggcggcagatggaaggagagccccagaaagctggtggtgggcgagctgcaggacgagctgatgagcgtgagactgagagaggcccaggccctggccgagggcagagagctgagacagagagtggtggagctggagacccaggaccacatccacagaaacctgctgaacagagtggaggccgagagagccgccctgcaggagaagctgcagtacctggccgcccagaacaagggcctgcagacccagctgagcgagagcagaagaaagcaggccgaggccgagtgcaagagcaaggaggaggtgatggccgtgagactgagagaggccgacagcatggccgccgtggccgagatgagacagagaatcgccgagctggagatccagagagaggagggcagaatccagggccagctgaaccacagcgacagcagccagtacatcagagagctgaaggaccagatcgaggagctgaaggccgaggtgagactgctgaagggccccccccccttcgaggaccccctggccttcgacggcctgagcctggccagacacctggacgaggacagcctgcccagcagcgacgaggagctgctgggcgtgggcgtgggcgccgccctgcaggacgccctgtaccccctgagccccagagacgccagattcttcagaagactggagagacccgccaaggacagcgagggcagcagcgacagcgacgccgacgagctggccgccccctacagccagggcctggacaactag

SEQ ID NO: 20628 - DNA, 7740 bp, Artificial Sequence
  Description of Artificial Sequence: Synthetic coding sequence
atggccgaggccgtgaagccccagagaagagccaaggccaaggccagcagaaccaagaccaaggagaagaagaagtacgagaccccccagagagaggagagcagcgaggtgagcctgcccaagaccagcagagagcaggagatccccagcctggcctgcgagttcaagggcgaccacctgaaggtggtgaccgacagccagctgcaggacgacgccagcggccagaacgagagcgagatgttcgacgtgcccctgaccagcctgaccatcagcaacgaggagagcctgacctgcaacaccgagccccccaaggagggcggcgaggccagaccctgcgtgggcgacagcgccgtgacccccaaggtgcaccccggcgacaacgtgggcaccaaggtggagacccccaagaacttcaccgaggtggaggagaacatgagcgtgcagggcggcctgagcgagagcgccccccagagcaacttcagctacacccagcccgccatggagaacatccaggtgagagagacccagaacagcaaggaggacaagcagggcctggtgtgcagcagcgaggtgccccagaacgtgggcctgcagagcagctgccccgccaagcacggcttccagacccccagagtgaagaagctgtacccccagctgcccgccgagatcgccggcgaggcccccgccctggtggccgtgaagcccctgctgagaagcgagagactgtaccccgagctgcccagccagctggagctggtgcccttcaccaaggagcagctgaagatcctggagcccggcagctggctggagaacgtggagagctacctggaggagttcgacagcatggcccaccaggacagacacgagttctacgagctgctgctgaactacagcagatgcagaaagcagctgctgctggccgaggccgagctgctgaccctgaccagcgactgccagaacgccaagagcagactgtggcagttcaaggaggagcagatgagcgtgcagggcatctgcgccgaccaggtgaaggtgttcagctaccacagataccagagagtggagatgaacgagaacgccctggtggagctgaagaagctgttcgacgccaagagcgagcacctgcaccagaccctggccctgcacagctacaccagcgtgctgagcagactgcaggtggagagctacatctacgccctgctgagcagcagcgccgtgctgagaagcagcgccatccaccagcagggcagagccagcaagcagaccgagagcatccccagcgacctgtgccagctgaaggagtgcatcagcgtgctgttcatgttcaccagaagagtgaacgaggacacccagttccacgacgacatcctgctgtggctgcagaagctggtgagcgtgctgcagagagtgggctgccccggcgaccacctgttcctgctgaaccacatcctgagatgccccgccggcgtgagcaagtgggccgtgcccttcatccagatcaaggtgctgcacaaccccagcggcgtgttccacttcatgcagagcctggccctgctgatgagccccgtgaagaacagagccgagttcatgtgccacatgaagcccagcgagagaaagcccagcagcagcggccccggcagcggcacctggaccctggtggacgagggcggcgaggaggacgaggaccccgagaccagctggatcctgctgaacgaggacgacctggtgaccatcctggcccagttccccttccacgagctgttccagcacctgctgggcttcaaggccaagggcgactacctgcccgagaccaccagaccccaggagatgatgaagatcttcgccttcgccaacagcctggtggagctgctggccgtgggcctggagaccttcaacagagccagatacagacagttcgtgaagagaatcggctacatgatcagaatgaccctgggctacgtgagcgaccactgggcccagtacgtgagccacaaccagggcagcggcctggcccagcagccctacagcatggagaagctgcaggtggagttcgacgagctgttcctgagagccgtgctgcacgtgctgaaggccaagagactgggcatctggctgttcatgagcgagatgcccttcggcaccctgagcgtgcagatgctgtggaagctgttctacctgatgcaccaggtggagagcgagaacctgcagcagctgagcagcagcctgcagcccgcccagtgcaagcagcagctgcaggaccccgagcacttcaccaacttcgagaagtgcctgagcagcatgaacagcagcgaggagatctgcctgctgaccaccttcgcccagatggcccaggccagaagaaccaacgtggacgaggacttcatcaagatcatcgtgctggagatctacgaggtgagctacgtgaccctgagcaccagagagaccttcagcaaggtgggcagagagctgctgggcaccatcaccgccgtgcaccccgagatcatcagcgtgctgctggacagagtgcaggagaccatcgaccaggtgggcatggtgagcctgtacctgttcaaggagctgcccctgtacctgtggcagcccagcgccagcgagatcgccgtgatcagagactggctgctgaactacaacctgaccgtggtgaagaacaagctggcctgcgtgatcctggagggcctgaactggggcttcgccaagcaggccaccctgcacctggaccaggccgtgcacgccgaggtggccctgatggtgctggaggcctaccagaagtacctggcccagaagccctacgccggcatcctgagcgagagcatgaagcaggtgagctacctggccagcatcgtgagatacggcgagacccccgagaccagcttcaaccagtgggcctggaacctgatcctgagactgaagctgcacaagaacgactacggcatccagcccaactgccccgccgtgcccttcagcgtgaccgtgcccgacatgaccgagagccccaccttccaccccctgctgaaggccgtgaaggccggcatgcccatcggctgctacctggccctgagcatgaccgccgtgggccacagcatcgagaagttctgcgccgagggcatccccctgctgggcatcctggtgcagagcagacacctgagaaccgtggtgcacgtgctggacaagatcctgcccctgttctacccctgccagtactacctgctgaagaacgagcagttcctgagccacctgctgctgttcctgcacctggacagcggcgtgccccagggcgtgacccagcaggtgacccacaaggtggcccagcacctgaccggcgccagccacggcgacaacgtgaagctgctgaacagcatgatccaggcccacatcagcgtgagcacccagcccaacgaggtgggccccgtggccgtgctggagttctgggtgcaggccctgatcagccagcacctgtggtacagagagcagcccatcctgttcctgatggaccacctgtgcaaggccgccttccagctgatgcaggaggactgcatccagaagctgctgtaccagcagcacaagaacgccctgggctaccactgcgacagaagcctgctgagcagcctggtgagctggatcgtggccggcaacatcacccccagcttcgtggagggcctggccacccccacccaggtgtggttcgcctggaccgtgctgaacatggagagcatcttcgaggaggacagccagctgagaagagtgatcgagggcgagctggtgatcaacagcgccttcacccccgaccaggccctgaagaaggcccagacccagctgaagctgcccatcgtgcccagcctgcagagactgctgatctacagatgggcccaccaggccctggtgacccccagcgaccaccccctgctgcccctgatctggcagaagttcttcctgctgtacctgcacagacccggcccccagtacggcctgcccatcgacggctgcatcggcagaagattcttccagagccccgcccacatcaacctgctgaaggagatgaagagaagactgaccgaggtggccgacttccaccacgccgccagcaaggccctgagagtgcccgccgagggcagcgagggcctgcccgagagccacagcggcacccccggctacctgaccagccccgagctgcacaaggagctggtgagactgttcaacgtgtacatcctgtggctggaggacgagaacttccagaagggcgacacctacatccccagcctgcccaagcactacgacatccacagactggccaaggtgatgcagaaccagcaggacctgtggatggagtacctgaacatggagagaatctaccacgagttccaggagaccgtgggcctgtggacccaggccaagctggagagccacagcaccccctgcagcctgagcgtgcagctggacttcaccgaccccctgctggccaaggagagagtgctgagcaacctgagaaagcacgaggccccccagccccccctggccctgcaccccaccaagccccccgtgcccgtgatcagcagcgccgtgctgctgagccagaaggacgccacccagctggtgtgcaccgacctgaacctgctgcagcagcaggccagaaccgccgccctgagagagagccagcaggtggccctggacggcgagctgctggacaccatgcccaagcagtacgtgaacagagaggagcagaccaccctgcacctggagtgcagaggcagcagcggcaagaagtgccagggcgccgccgtggtgaccgtgcagttcgagggcatgcacaagaacgaggccatcagccagcagctgcacgtgctgagaaaggaggtgaagcagctgcaggccgaggccgccaagccccccagcctgaacatcgtggaggccgccgtgcacgccgagaacctgatcaccgccctggtgaacgcctacaagctgcagcccacccccggcatccagaaggtgggcatcagcctgttcttcaccatcgtggactacgtgagcgacgagacccagagacacccccccaccagacagttcttcaccagctgcatcgagatcctgggccaggtgttcatcagcggcatcaagagcgagtgcagaaaggtgctggagaccatcctgaagaacagcagactgtgcagcctgctgagccccttcttcacccccaacgccgcccccgccgagttcatccagctgtacgagcaggtggtgaagttcctgagcgaggacaacagcgacatgatcttcatgctgctgaccaagttcgacctgaagcagtggctgagcgccaccaagccccccctgagcgacagaaccagactgctggagagcatccacctggccctgaccgcctggggcctggagcccgacgaggacatcctgatgcccttcaacctgttctgcaagcactggacctacctgctgctgtaccagttccccgaccagtacagcgacatcctgagactgctgatgcagagcagcgccgagcagctgctgagccccgagtgctggaaggccaccctgagagccctgggctgctgcgcccccagctgccagcagggcgccgccagcaccgagggcgccgtgctgcccagcagcagcgacgccctgctgagcgacaagcaggtgatggagaccatccagtggctgagcgacttcttctacaagctgagactgagcaagatggacttcaagagcttcggcctgttcagcaagtggagcccctacatggccgacgtgaagaccttcctgggctacctggtgaagagactgatcgacctggagatgacctgcctggcccaggaccccaccgccagcagaaagaccgtgctgaagagcctgcacagcgtgatcatccagctgttcaagccctggatcctggtgctggaggacaacgagagcagccagcagagacactacccctggctggagagcgacaccgtggtggccagcagcatcgtgcagctgttcaccgactgcatcgacagcctgcacgagagcttcaaggacaagctgctgcccggcgacgccggcgccctgtggctgcacctgatgcactactgcgaggcctgcaccgcccccaagatgcccgagttcatcctgtacgccttccacagcacctacagaaagctgccctggaaggacctgcaccccgaccagatgctgatggaggccttcttcaaggtggagagaggcagccccaagagctgcttcctgttcctgggcagcgtgctgtgcgaggtgaactgggtgagcgtgctgagcgacgcctggaacagcagcccccaccccgagaccagaagcatgatcgtgtgcctgctgttcatgatgatcctgctggccaaggaggtgcagctggtggaccagaccgacagccccctgctgagcctgctgggccagaccagcagcctgagctggcacctggtggacatcgtgagctaccagagcgtgctgagctacttcagcagccactacccccccagcatcatcctggccaaggagagctacgccgagctgatcatgaagctgctgaaggtgagcgccggcctgagcatccccaccgacagccagaagcacctggacgccgtgcccaagtgccaggccttcacccaccagatggtgcagttcctgagcaccctggagcagaacggcaagatcaccctggccgtgctggagcaggagatgagcaagctgctggacgacatcatcgtgttcaacccccccgacatggacagccagaccagacacatggccctgagcagcctgttcatggaggtgctgatgatgatgaacaacgccaccatccccaccgccgagttcctgagaggcagcatcagaacctggatcggccagaagatgcacggcctggtggtgctgcccctgctgaccgccgcctgccagagcctggccagcgtgagacacatggccgagaccaccgaggcctgcatcaccgcctacttcaaggagagccccctgaaccagaacagcggctggggccccatcctggtgagcctgcaggtgcccgagctgaccatggaggagttcctgcaggagtgcctgaccctgggcagctacctgaccctgtacgtgtacctgctgcagtgcctgaacagcgagcagaccctgagaaacgagatgaaggtgctgctgatcctgagcaagtggctggagcaggtgtaccccagcagcgtggaggaggaggccaagctgttcctgtggtggcaccaggtgctgcagctgagcctgatccagaccgagcagaacgacagcgtgctgaccgagagcgtgatcagaatcctgctgctggtgcagagcagacagaacctggtggccgaggagagactgagcagcggcatcctgggcgccatcggcttcggcagaaagagccccctgagcaacagattcagagtggtggccagaagcatggccgccttcctgagcgtgcaggtgcccatggaggaccagatcagactgagacccggcagcgagctgcacctgacccccaaggcccagcaggccctgaacgccctggagagcatggccagcagcaagcagtacgtggagtaccaggaccagatcctgcaggccacccagttcatcagacaccccggccactgcctgcaggacggcaagagcttcctggccctgctggtgaactgcctgtaccccgaggtgcactacctggaccacatcagatag

SEQ ID NO: 20629 - DNA, 4071 bp, Artificial Sequence
  Description of Artificial Sequence: Synthetic coding sequence
atgatccaggcccacatcagcgtgagcacccagcccaacgaggtgggccccgtggccgtgctggagttctgggtgcaggccctgatcagccagcacctgtggtacagagagcagcccatcctgttcctgatggaccacctgtgcaaggccgccttccagctgatgcaggaggactgcatccagaagctgctgtaccagcagcacaagaacgccctgggctaccactgcgacagaagcctgctgagcagcctggtgagctggatcgtggccggcaacatcacccccagcttcgtggagggcctggccacccccacccaggtgtggttcgcctggaccgtgctgaacatggagagcatcttcgaggaggacagccagctgagaagagtgatcgagggcgagctggtgatcaacagcgccttcacccccgaccaggccctgaagaaggcccagacccagctgaagctgcccatcgtgcccagcctgcagagactgctgatctacagatgggcccaccaggccctggtgacccccagcgaccaccccctgctgcccctgatctggcagaagttcttcctgctgtacctgcacagacccggcccccagtacggcctgcccatcgacggctgcatcggcagaagattcttccagagccccgcccacatcaacctgctgaaggagatgaagagaagactgaccgaggtggccgacttccaccacgccgccagcaaggccctgagagtgcccgccgagggcagcgagggcctgcccgagagccacagcggcacccccggctacctgaccagccccgagctgcacaaggagctggtgagactgttcaacgtgtacatcctgtggctggaggacgagaacttccagaagggcgacacctacatccccagcctgcccaagcactacgacatccacagactggccaaggtgatgcagaaccagcaggacctgtggatggagtacctgaacatggagagaatctaccacgagttccaggagaccgtgggcctgtggacccaggccaagctggagagccacagcaccccctgcagcctgagcgtgcagctggacttcaccgaccccctgctggccaaggagagagtgctgagcaacctgagaaagcacgaggccccccagccccccctggccctgcaccccaccaagccccccgtgcccgtgatcagcagcgccgtgctgctgagccagaaggacgccacccagctggtgtgcaccgacctgaacctgctgcagcagcaggccagaaccgccgccctgagagagagccagcaggtggccctggacggcgagctgctggacaccatgcccaagcagtacgtgaacagagaggagcagaccaccctgcacctggagtgcagaggcagcagcggcaagaagtgccagggcgccgccgtggtgaccgtgcagttcgagggcatgcacaagaacgaggccatcagccagcagctgcacgtgctgagaaaggaggtgaagcagctgcaggccgaggccgccaagccccccagcctgaacatcgtggaggccgccgtgcacgccgagaacctgatcaccgccctggtgaacgcctacaagctgcagcccacccccggcatccagaaggtgggcatcagcctgttcttcaccatcgtggactacgtgagcgacgagacccagagacacccccccaccagacagttcttcaccagctgcatcgagatcctgggccaggtgttcatcagcggcatcaagagcgagtgcagaaaggtgctggagaccatcctgaagaacagcagactgtgcagcctgctgagccccttcttcacccccaacgccgcccccgccgagttcatccagctgtacgagcaggtggtgaagttcctgagcgaggacaacagcgacatgatcttcatgctgctgaccaagttcgacctgaagcagtggctgagcgccaccaagccccccctgagcgacagaaccagactgctggagagcatccacctggccctgaccgcctggggcctggagcccgacgaggacatcctgatgcccttcaacctgttctgcaagcactggacctacctgctgctgtaccagttccccgaccagtacagcgacatcctgagactgctgatgcagagcagcgccgagcagctgctgagccccgagtgctggaaggccaccctgagagccctgggctgctgcgcccccagctgccagcagggcgccgccagcaccgagggcgccgtgctgcccagcagcagcgacgccctgctgagcgacaagcaggtgatggagaccatccagtggctgagcgacttcttctacaagctgagactgagcaagatggacttcaagagcttcggcctgttcagcaagtggagcccctacatggccgacgtgaagaccttcctgggctacctggtgaagagactgatcgacctggagatgacctgcctggcccaggaccccaccgccagcagaaagaccgtgctgaagagcctgcacagcgtgatcatccagctgttcaagccctggatcctggtgctggaggacaacgagagcagccagcagagacactacccctggctggagagcgacaccgtggtggccagcagcatcgtgcagctgttcaccgactgcatcgacagcctgcacgagagcttcaaggacaagctgctgcccggcgacgccggcgccctgtggctgcacctgatgcactactgcgaggcctgcaccgcccccaagatgcccgagttcatcctgtacgccttccacagcacctacagaaagctgccctggaaggacctgcaccccgaccagatgctgatggaggccttcttcaaggtggagagaggcagccccaagagctgcttcctgttcctgggcagcgtgctgtgcgaggtgaactgggtgagcgtgctgagcgacgcctggaacagcagcccccaccccgagaccagaagcatgatcgtgtgcctgctgttcatgatgatcctgctggccaaggaggtgcagctggtggaccagaccgacagccccctgctgagcctgctgggccagaccagcagcctgagctggcacctggtggacatcgtgagctaccagagcgtgctgagctacttcagcagccactacccccccagcatcatcctggccaaggagagctacgccgagctgatcatgaagctgctgaaggtgagcgccggcctgagcatccccaccgacagccagaagcacctggacgccgtgcccaagtgccaggccttcacccaccagatggtgcagttcctgagcaccctggagcagaacggcaagatcaccctggccgtgctggagcaggagatgagcaagctgctggacgacatcatcgtgttcaacccccccgacatggacagccagaccagacacatggccctgagcagcctgttcatggaggtgctgatgatgatgaacaacgccaccatccccaccgccgagttcctgagaggcagcatcagaacctggatcggccagaagatgcacggcctggtggtgctgcccctgctgaccgccgcctgccagagcctggccagcgtgagacacatggccgagaccaccgaggcctgcatcaccgcctacttcaaggagagccccctgaaccagaacagcggctggggccccatcctggtgagcctgcaggtgcccgagctgaccatggaggagttcctgcaggagtgcctgaccctgggcagctacctgaccctgtacgtgtacctgctgcagtgcctgaacagcgagcagaccctgagaaacgagatgaaggtgctgctgatcctgagcaagtggctggagcaggtgtaccccagcagcgtggaggaggaggccaagctgttcctgtggtggcaccaggtgctgcagctgagcctgatccagaccgagcagaacgacagcgtgctgaccgagagcgtgatcagaatcctgctgctggtgcagagcagacagaacctggtggccgaggagagactgagcagcggcatcctgggcgccatcggcttcggcagaaagagccccctgagcaacagatag

SEQ ID NO: 20630 - DNA, 1524 bp, Artificial Sequence
  Description of Artificial Sequence: Synthetic coding sequence
accacccccgtggagagaggcagccccaagagctgcttcctgttcctgggcagcgtgctgtgcgaggtgaactgggtgagcgtgctgagcgacgcctggaacagcagcccccaccccgagaccagaagcatgatcgtgtgcctgctgttcatgatgatcctgctggccaaggaggtgcagctggtggaccagaccgacagccccctgctgagcctgctgggccagaccagcagcctgagctggcacctggtggacatcgtgagctaccagagcgtgctgagctacttcagcagccactacccccccagcatcatcctggccaaggagagctacgccgagctgatcatgaagctgctgaaggtgagcgccggcctgagcatccccaccgacagccagaagcacctggacgccgtgcccaagtgccaggccttcacccaccagatggtgcagttcctgagcaccctggagcagaacggcaagatcaccctggccgtgctggagcaggagatgagcaagctgctggacgacatcatcgtgttcaacccccccgacatggacagccagaccagacacatggccctgagcagcctgttcatggaggtgctgatgatgatgaacaacgccaccatccccaccgccgagttcctgagaggcagcatcagaacctggatcggccagaagatgcacggcctggtggtgctgcccctgctgaccgccgcctgccagagcctggccagcgtgagacacatggccgagaccaccgaggcctgcatcaccgcctacttcaaggagagccccctgaaccagaacagcggctggggccccatcctggtgagcctgcaggtgcccgagctgaccatggaggagttcctgcaggagtgcctgaccctgggcagctacctgaccctgtacgtgtacctgctgcagtgcctgaacagcgagcagaccctgagaaacgagatgaaggtgctgctgatcctgagcaagtggctggagcaggtgtaccccagcagcgtggaggaggaggccaagctgttcctgtggtggcaccaggtgctgcagctgagcctgatccagaccgagcagaacgacagcgtgctgaccgagagcgtgatcagaatcctgctgctggtgcagagcagacagaacctggtggccgaggagagactgagcagcggcatcctgggcgccatcggcttcggcagaaagagccccctgagcaacagattcagagtggtggccagaagcatggccgccttcctgagcgtgcaggtgcccatggaggaccagatcagactgagacccggcagcgagctgcacctgacccccaaggcccagcaggccctgaacgccctggagagcatggccagcagcaagcagtacgtggagtaccaggaccagatcctgcaggccacccagttcatcagacaccccggccactgcctgcaggacggcaagagcttcctggccctgctggtgaactgcctgtaccccgaggtgcactacctggaccacatcagatag

SEQ ID NO: 20631 - DNA, 636 bp, Artificial Sequence
  Description of Artificial Sequence: Synthetic coding sequence
atgaacagaaagaagctgcagaagctgaccgacaccctgaccaagaactgcaagcacttcaacaagttcgaggtgaactgcctgatcaagctgttctacgacctggtgggcggcgtggagagacagggcctggtggtgggcctggacagaaacgccttcagaaacatcctgcacgtgaccttcggcatgaccgacgacatgatcatggacagagtgttcagaggcttcgacaaggacaacgacggctgcgtgaacgtgctggagtggatccacggcctgagcctgttcctgagaggcagcctggaggagaagatgaagtactgcttcgaggtgttcgacctgaacggcgacggcttcatcagcaaggaggagatgttccacatgctgaagaacagcctgctgaagcagcccagcgaggaggaccccgacgagggcatcaaggacctggtggagatcaccctgaagaagatggaccacgaccacgacggcaagctgagcttcgccgactacgagctggccgtgagagaggagaccctgctgctggaggccttcggcccctgcctgcccgaccccaagagccagatggagttcgaggcccaggtgttcaaggaccccaacgagttcaacgacatgtag
